United States Patent 8,067,671 (METHODS FOR GENETIC CONTROL OF PLANT PEST INFESTATION AND COMPOSITIONS THEREOF) - sequence listing, part 50

SEQ ID NO: 123876 - protein, 175 aa, Heterodera glycines
  Homolog annotation: Hit_ID=NP_494774.1; Match level="QueryCoverage =91%, HitCoverage=50%, E-value=6e-54, Identity=61%"; Hit description =transcription complex (34.7 kD) (2E664) [Caenorhabditis elegans] gb|AAL11100.1| Not-like (yeast ccr4/not
  Gene Ontology: Cellular component=CCR4-NOT core complex; Biological process=regulation of transcription, DNA-dependent
  Essential gene: C elegans homolog=B0286.4a; Phenotype=Unclassified
  Coding regions on vcDNA: vcDNA=SeqID_50299; Strand=+; Position=2-526
PAVAAAFELVDPPGCFTRHEGRVTNIPSGMLNDLFAMDGLLTFLRTIESAPSIVGLALGHDLTNLGLNLNSSKRNLFQTFGGPWADFPCRIQDLDAKVPDEYLTNATIRDKLPNIKMNKLHEDVLFYLFYNCPGEVYQVAAATELYSRDWRFHKVERVWLMRAPFSAPPREIGGT

SEQ ID NO: 123877 - protein, 137 aa, Heterodera glycines
  Homolog annotation: Hit_ID=CAF98252.1; Match level="QueryCoverage =99%, HitCoverage=19%, E-value=1e-14, Identity=37%"; Hit description =unnamed protein product [Tetraodon nigroviridis]
  Essential gene: C elegans homolog=B0286.4a; Phenotype=Unclassified
  Coding regions on vcDNA: vcDNA=SeqID_50300; Strand=+; Position=66-476
MLNDDDFPALPNSVLQSNQSQQISAQQRLPSQHTHQNNSLLVNDDATNARLSRMKQQMALENSDKVGIQTHPDGRVTNIPSGMLNDQCVTNETNIRLQINSFPLRFGMAGLLTFLRTIESAPSIVGLALGHDLTNLG

SEQ ID NO: 123878 - protein, 149 aa, Heterodera glycines
  Homolog annotation: Hit_ID=CAE62748.1; Match level="QueryCoverage =84%, HitCoverage=43%, E-value=4e-28, Identity=53%"; Hit description =Hypothetical protein CBG06912 [Caenorhabditis briggsae]
  Essential gene: C elegans homolog=K02D10.5; Phenotype=Ste
  Coding regions on vcDNA: vcDNA=SeqID_50301; Strand=+; Position=33-479
MANPFDDDSDEFIRKIRAGRGIEPTKSFTTPAASQNIEDQIAADEKAIERYLQASLDSTQRSRQQLSSSEGLAESTARELLEQREKLERAEQNLDTIHHTTQHTQRSLNSLKSWFGGLVRNKLSRAPKGLGTANVNANNQQQQQEQTVQ

SEQ ID NO: 123879 - protein, 156 aa, Heterodera glycines
  Homolog annotation: Hit_ID=AAB47548.1; Match level="QueryCoverage =92%, HitCoverage=97%, E-value=3e-57, Identity=67%"; Hit description =similar to nonmuscle myosin essential light chain encoded by GenBank Accession Number U25057 [Toxocara can
  Gene Ontology: Mol. function=structural constituent of muscle; Cellular component=muscle myosin; Biological process=muscle development
  Essential gene: C elegans homolog=T12D8.6; Phenotype=Emb
  Coding regions on vcDNA: vcDNA=SeqID_50302; Strand=+; Position=15-482
MNKTDDQLAECREIFCYFDSKGDEKINVKQVGDVLRALGQSPTESEVRKCCEHWTEPDTRISFEEFVPIFQTVSKSRAQYTKDQFVEGLSHFDREGNGTIAVAELKHLLTNLGERLSEEEVEQLLAGHDVANGFVSIDSFIETVLRFPLTPPDNEK

SEQ ID NO: 123880 - protein, 242 aa, Heterodera glycines
  Homolog annotation: Hit_ID=CAE60137.1; Match level="QueryCoverage =99%, HitCoverage=53%, E-value=1e-72, Identity=51%"; Hit description =Hypothetical protein CBG03683 [Caenorhabditis briggsae]
  Gene Ontology: Mol. function=snoRNA binding; Cellular component=small nuclear ribonucleoprotein complex; Biological process=rRNA processing
  Essential gene: C elegans homolog=ZK430.7; Phenotype=Lva
  Coding regions on vcDNA: vcDNA=SeqID_50303; Strand=+; Position=3-728
SGPINGLSVDASDGLHFVTVGQDAQFKVWPLPIEFDGNAQPTQPVHSLSLDGVPHGCSHVAMSSDFVTCGEGISVWRLHRSSPIRHYAVGPNTVQHINCNPIEEGIMAGCAADRSIFLFDTRQKVPLSRVVLKLRTNSIAWHPLEPFTFVAANEDYNLYTFDMRRLDSARHVHQGHTSAVMDVDFAPSGHEFVSGSFDRSLRIFPVEQWRSREVYHTPRMQYVLSVLWSSDNKFVLSGSDDM

SEQ ID NO: 123881 - protein, 124 aa, Heterodera glycines
  Homolog annotation: Hit_ID=P41955; Match level="QueryCoverage=98%, HitCoverage=79%, E-value=8e-29, Identity=43%"; Hit description =Succinate dehydrogenase cytochrome b560 subunit, mitochondrial precursor emb|CAE56795.1| Hypothetical protein
  Essential gene: C elegans homolog=T07C4.7; Phenotype=Emb
  Coding regions on vcDNA: vcDNA=SeqID_50304; Strand=+; Position=2-373
LSSTAAKTPVQEFGFEYLKRQMNLGRPLSPHLQIYKPQLTWVMSGVHRILACIMSGALLVGVFVFGICSVDFTSFAERLNSWNLWRPAFDMAKGTELASVYRSGYLVIGLSTLISLLIVANSKH

SEQ ID NO: 123882 - protein, 399 aa, Heterodera glycines; identical to SEQ ID NO: 122722
  Homolog annotation: Hit_ID=AAM81355.1; Match level="QueryCoverage =100%, HitCoverage=100%, E-value=1e-124, Identity=57%"; Hit description=heat shock protein 40 [Steinernema feltiae]
  Gene Ontology: Mol. function=Hsp70/Hsc70 protein regulator activity; Cellular component=cytosol; Biological process=protein folding
  Essential gene: C elegans homolog=F39B2.10; Phenotype=Emb,Spd
  Coding regions on vcDNA: vcDNA=SeqID_50305; Strand=+; Position=24-1223

SEQ ID NO: 123883 - protein, 213 aa, Heterodera glycines
  misc_feature (172)..(172): Xaa can be any naturally occurring amino acid
  misc_feature (203)..(203): Xaa can be any naturally occurring amino acid
  Homolog annotation: Hit_ID=NP_491961.1; Match level="QueryCoverage =99%, HitCoverage=99%, E-value=1e-94, Identity=81%"; Hit description =dna directed rna polymerase ii polypeptide e (24.3 kD) (1H427) [Caenorhabditis elegans] gb|AAF39906.1| Hy
  Gene Ontology: Mol. function=DNA-directed RNA polymerase activity; Cellular component=DNA-directed RNA polymerase I complex; Biological process=embryogenesis and morphogenesis
  Essential gene: C elegans homolog=H27M09.2; Phenotype=Emb
  Coding regions on vcDNA: vcDNA=SeqID_50306; Strand=+; Position=26-663
MADDDAETFKLWRVRKTVMQMCHDRGYLVTQDELDQTLDQFKDQFGDRPSERRPGRGELTILVAHNDDPTDQMYVFFPDDPKIGIKTIKQICQQMQEQNITRAIIVVQSGMTPSAKQAIVDMAPKYILEHFLEAELMINITEHELVPEHVVMSSEEKAELLARYKLRDNQLXPRIQVSDPVARYFGLKRGQVVKIIRASETAXGRYITYRLCN

SEQ ID NO: 123884 - protein, 380 aa, Heterodera glycines
  Homolog annotation: Hit_ID=AAP20434.1; Match level="QueryCoverage =100%, HitCoverage=84%, E-value=0.0, Identity=96%"; Hit description =beta-tubulin isotype 1 [Cooperia oncophora]
  Gene Ontology: Mol. function=MHC class I protein binding; Cellular component=tubulin; Biological process=embryogenesis and morphogenesis
  Essential gene: C elegans homolog=K01G5.7; Phenotype=Emb
  Coding regions on vcDNA: vcDNA=SeqID_50307; Strand=+; Position=2-1141
REIFHIQAGQCGNQIGSKFWEVISDEHGIQPDGTYKGESDLQLERINVYYNEAHGGKYVPRAVLVDLEPGTMDSIRAGAYGQLFRPDNFVFGQSGAGNNWAKGHYTEGAELVDNVLDVVRKEAEGCDCLQGFQLTHSLGGGTGSGMGTLLISKIREEYPDRIMSSFSVVPSPKVSDTVVEPYNATLSVHQLVENTDETFCIDNEALYDICFRTLKLQNPTYGDLNHLVSVTMSGVTTCLRFPGQLNADLRKLAVNMVPFPRLHFFMPGFAPLSAKGAAAYQALSVSELTKQMFDAKNMMAACDPRHGRYLTVAAMFRGRMSMREVDDQMMSVQNKNSSYFVEWIPNNVKTAVCDIPPRGLKMSATFVGNSTAIQELFKRI

SEQ ID NO: 123885 - protein, 127 aa, Heterodera glycines; identical to SEQ ID NO: 122389
  Homolog annotation: Hit_ID=CAE64456.1; Match level="QueryCoverage =86%, HitCoverage=88%, E-value=4e-21, Identity=49%"; Hit description =Hypothetical protein CBG09169 [Caenorhabditis briggsae]
  Gene Ontology: Mol. function=protein phosphatase inhibitor activity; Cellular component=soluble fraction
  Essential gene: C elegans homolog=C07H6.2; Phenotype=Gro
  Coding regions on vcDNA: vcDNA=SeqID_50308; Strand=+; Position=48-431

SEQ ID NO: 123886 - protein, 157 aa, Heterodera glycines
  Homolog annotation: Hit_ID=EAA66532.1; Match level="QueryCoverage =96%, HitCoverage=87%, E-value=9e-61, Identity=71%"; Hit description =hypothetical protein AN0433.2 [Aspergillus nidulans FGSC A4] ref|XP _404570.1| hypothetical protein AN0433.
  Gene Ontology: Mol. function=structural constituent of ribosome; Cellular component=cytosolic large ribosomal subunit (sensu Eukarya); Biological process=protein biosynthesis
  Essential gene: C elegans homolog=E04A4.8; Phenotype=Emb,Gro
  Coding regions on vcDNA: vcDNA=SeqID_50309; Strand=+; Position=5-475
MSSASRFNEYQVVGRHQPSETNPQPTLYRMRIFAPNAVVAKSRFWYFLKKFRKVKKATGQIVAVNQVLEKNPTQVKTFGIWLRYDSRSGTHNMYKEYRELTRVNAVQACYQDMAARHRARFRSVQIIRVAEVATKDVRRPYIQQILEKNLKFPLPHR

SEQ ID NO: 123887 - protein, 336 aa, Heterodera glycines
  Homolog annotation: Hit_ID=CAE59832.1; Match level="QueryCoverage =91%, HitCoverage=93%, E-value=2e-89, Identity=53%"; Hit description =Hypothetical protein CBG03304 [Caenorhabditis briggsae]
  Gene Ontology: Mol. function=protein phosphatase type 1 intrinsic regulator activity; Cellular component=cytoplasm; Biological process= cell cycle
  Essential gene: C elegans homolog=T09A5.9; Phenotype=Emb,Pvl,Stp,Unc
  Coding regions on vcDNA: vcDNA=SeqID_50310; Strand=+; Position=65-1072
MQEAKPTASLNLFDLSVMPDSETSIELNQMRVDAVPDLARFTQLQFLGLRQNLLTSLNANLGRLTTLTELELYDNQLTEIAGLDQLVNLVMLDMSYNRITKIQGLSTMTKLRRLFLVHNKIKRIEGLEGLDALELLELGDNRIKVIENLCHLVNLNELFVGHNDIQRIEGIQTLIKLRVLSLPANRLTKLEGLDTLTELEQLHLSDQGIESLDGLGNQSKLIILDAANNRIVNLDGLGHLQKLEDLWLNNNKIVVWSEVDKLAQLRALDTVYLEHNPLYTTDTNQYRRKAMLALPHIRQLDSTVCRQQKNVVEEDTKQNSEDNNNAKPNSQRSAVA

SEQ ID NO: 123888 - protein, 110 aa, Heterodera glycines; identical to SEQ ID NO: 123155
  Homolog annotation: Hit_ID=NP_113897.1; Match level="QueryCoverage =92%, HitCoverage=90%, E-value=9e-25, Identity=47%"; Hit description =ribosomal protein S12 [Rattus norvegicus] gb|AAA42077.1| ribosomal protein S12
  Gene Ontology: Mol. function=structural constituent of ribosome; Cellular component=eukaryotic 48S initiation complex; Biological process=protein biosynthesis
  Essential gene: C elegans homolog=F54E7.2; Phenotype=Emb,Ste
  Coding regions on vcDNA: vcDNA=SeqID_50311; Strand=+; Position=35-367

SEQ ID NO: 123889 - protein, 130 aa, Heterodera glycines; identical to SEQ ID NO: 122114
  Homolog annotation: Hit_ID=CAE67541.1; Match level="QueryCoverage =89%, HitCoverage=95%, E-value=3e-39, Identity=67%"; Hit description =Hypothetical protein CBG13066 [Caenorhabditis briggsae]
  Gene Ontology: Mol. function=structural constituent of ribosome; Cellular component=cytosolic ribosome (sensu Eukarya); Biological process=protein biosynthesis
  Essential gene: C elegans homolog=F10E7.7; Phenotype =Clr,Emb,Gro,Sck,Slu,Stp
  Coding regions on vcDNA: vcDNA=SeqID_50312; Strand=+; Position=1-393

SEQ ID NO: 123890 - protein, 56 aa, Heterodera glycines; identical to SEQ ID NO: 120012
  Homolog annotation: Hit_ID=AAQ63317.1; Match level="QueryCoverage =100%, HitCoverage=100%, E-value=3e-19, Identity=71%"; Hit description=40S ribosomal protein S29 [Hippocampus comes] gb|AAK95214.1| 40S ribosomal protein S29 [Ictalurus puncta
  Essential gene: C elegans homolog=B0412.4; Phenotype=Dpy,Emb,Ste
  Coding regions on vcDNA: vcDNA=SeqID_50313; Strand=+; Position=52-222

SEQ ID NO: 123891 - protein, 173 aa, Heterodera glycines
  misc_feature (83)..(83): Xaa can be any naturally occurring amino acid
  Homolog annotation: Hit_ID=CAE71615.1; Match level="QueryCoverage =99%, HitCoverage=100%, E-value=2e-83, Identity=85%"; Hit description= Hypothetical protein CBG18577 [Caenorhabditis briggsae]
  Gene Ontology: Mol. function=peptidyl-prolyl cis-trans isomerase activity; Cellular component=membrane fraction; Biological process =protein folding
  Essential gene: C elegans homolog=Y75B12B.2; Phenotype=Emb
  Coding regions on vcDNA: vcDNA=SeqID_50314; Strand=+; Position=21-540
MSRPKVFFDITIGGKAAGRIVMELYSDIVPKTAENFRSLCTGEKGMGKSGKPLHYKGSKFHRVIPNFMLQGGDFTRGNGTGGXESIYGEKFVDENFKEKHTQPGILSMANAGPNTNGSQFFVTTVKTEWLDGKHVVFGRVTDGMDVVKAVEAQGSQSGRASKDIMIADCGQLS

SEQ ID NO: 123892 - protein, 42 aa, Heterodera glycines
  misc_feature (34)..(34): Xaa can be any naturally occurring amino acid
  Homolog annotation: Hit_ID=AAQ96652.1; Match level="QueryCoverage =100%, HitCoverage=22%, E-value=4e-11, Identity=76%"; Hit description= ribosomal protein L17 [Branchiostoma belcheri tsingtaunese]
  Essential gene: C elegans homolog=Y48G8AL.8a; Phenotype=Emb,Lva
  Coding regions on vcDNA: vcDNA=SeqID_50315; Strand=+; Position=2-127
GGVGRKAQAQAWGTTQGRWPKKSAEFLLPLLRNXESMAEVEG

SEQ ID NO: 123893 - protein, 233 aa, Heterodera glycines
  Homolog annotation: Hit_ID=NP_499675.1; Match level="QueryCoverage =65%, HitCoverage=40%, E-value=2e-11, Identity=36%"; Hit description =human Mortality factor-Related Gene related (38.3 kD) (mrg-1) [Caenorhabditis elegans] emb|CAA21528.1| Hy
  Essential gene: C elegans homolog=Y37D8A.9; Phenotype=Fgc
  Coding regions on vcDNA: vcDNA=SeqID_50316; Strand=+; Position=18-716
MPSRNLSAKKKQQNSLVRDESTSSPSRTPKSVSKASNSNSSQQKLQKKHNSSELSTISSESVEKDLSSSMSTNPHGHPTDKKWTIGEKVLCRYLNSEHIYYEAKVMFLKDLSGGDVGYGIHYPGWSNRHDEVVPQHEALIRFKNYSDEEATKAKEDVKRAQQMLNAKKRKRSELKNRSQAHDESSRSSTPGSADNASKRKIARRTTIETSAVAKKDMPQVTLTDPLRRILIDD

SEQ ID NO: 123894 - protein, 118 aa, Heterodera glycines
  Homolog annotation: Hit_ID=NP_496281.1; Match level="QueryCoverage =88%, HitCoverage=25%, E-value=9e-22, Identity=48%"; Hit description =mitochondrial ribosomal protein S22 (48.3 kD) (2K875) [Caenorhabditis elegans] emb|CAB60995.1| Hypothetic
  Essential gene: C elegans homolog=C14A4.14; Phenotype=Emb,Lva
  Coding regions on vcDNA: vcDNA=SeqID_50317; Strand=+; Position=99-452
SSRVPISHLNGEQLESLFVDERVQRLLLSLTGHDTDKILRHRRINQTERKHYALMTDGMVKEFMSRLDQRAGKFLRIVPFKEPRSNRTEVLARDAEIDGFDTAKFVFTDISFDATDMD

SEQ ID NO: 123895 - protein, 197 aa, Heterodera glycines; identical to SEQ ID NO: 122435
  Homolog annotation: Hit_ID=XP_550320.1; Match level="QueryCoverage =92%, HitCoverage=28%, E-value=3e-27, Identity=35%"; Hit description =putative Ubiquitin isopeptidase T; Ubiquitin-specific protease-5 [Oryza sativa (japonica cultivar-group)]
  Gene Ontology: Mol. function=ubiquitin-specific protease activity; Biological process=protein modification
  Essential gene: C elegans homolog=T27A3.2; Phenotype=Gro,Pvl,Slu,Stp
  Coding regions on vcDNA: vcDNA=SeqID_50318; Strand=+; Position=1-594

SEQ ID NO: 123896 - protein, 114 aa, Heterodera glycines; identical to SEQ ID NO: 122631
  Homolog annotation: Hit_ID=NP_594438.1; Match level="QueryCoverage =95%, HitCoverage=97%, E-value=5e-33, Identity=59%"; Hit description =60S ribosomal protein L34 [Schizosaccharomyces pombe] emb|CAA16982.1| SPAC23A1.08c [Schizosaccharomyces p
  Gene Ontology: Mol. function=structural constituent of ribosome; Cellular component=cytosolic large ribosomal subunit (sensu Eukarya); Biological process=protein biosynthesis
  Essential gene: C elegans homolog=C42C1.14; Phenotype=Lva
  Coding regions on vcDNA: vcDNA=SeqID_50319; Strand=+; Position=33-377

SEQ ID NO: 123897 - protein, 406 aa, Heterodera glycines; identical to SEQ ID NO: 122265
  Homolog annotation: Hit_ID=AAL40720.1; Match level="QueryCoverage =98%, HitCoverage=97%, E-value=0.0, Identity=79%"; Hit description =calreticulin [Meloidogyne incognita]
  Gene Ontology: Mol. function=calcium ion storage activity; Cellular component=endoplasmic reticulum lumen; Biological process=regulation of transcription, DNA-dependent
  Essential gene: C elegans homolog=Y38A10A.5; Phenotype=Unc
  Coding regions on vcDNA: vcDNA=SeqID_50320; Strand=+; Position=22-1242

SEQ ID NO: 123898 - protein, 189 aa, Heterodera glycines
  Homolog annotation: Hit_ID=NP_493394.1; Match level="QueryCoverage =92%, HitCoverage=97%, E-value=2e-43, Identity=53%"; Hit description =cytochrome c oxidase subunit IV (1O250) [Caenorhabditis elegans] emb|CAB63334.1| Hypothetical protein W09
  Gene Ontology: Biological process=positive regulation of growth rate
  Essential gene: C elegans homolog=W09C5.8; Phenotype=Age,Gro,Ste
  Coding regions on vcDNA: vcDNA=SeqID_50321; Strand=+; Position=124-693
MIYHLLDLVRMGILTASKVCTLPRLSSARSMTWWWGPEKNNGREVVGPTFHGDEFYQDRLDRWYPSIRFRKNDEVITPIRHKELGDWKKLSIEEKKLIYRYSFRQTLAEFEALTPYGYLTVTLFFSMLGLTILYASFVRTYVTKFNDRLPDTFDDEYKESQAERRVVLERGNPYGPAYYYDYEKNRWKD

SEQ ID NO: 123899 - protein, 166 aa, Heterodera glycines
  Homolog annotation: Hit_ID=CAE71348.1; Match level="QueryCoverage =80%, HitCoverage=71%, E-value=3e-20, Identity=36%"; Hit description =Hypothetical protein CBG18251 [Caenorhabditis briggsae]
  Gene Ontology: Cellular component=chromatin; Biological process =embryogenesis and morphogenesis
  Essential gene: C elegans homolog=T12D8.7; Phenotype=Emb
  Coding regions on vcDNA: vcDNA=SeqID_50322; Strand=+; Position=2-499
MATVSSSSNNTCKPSESYSASKIPQCAETIKKMFHELGIKEYEPQLVLQLCDISYSLTKEILVDARSVSEFSGKKQVDRSDVDLAIKTFDEKHSNDRPPKAFVSELAAEKNALPLHPIRQNYGLRLPNDRFCQLQPNYIYIGDDPNNEDQAVHMEERPRQNGSSKF

SEQ ID NO: 123900 - protein, 72 aa, Heterodera glycines; identical to SEQ ID NO: 122636
  Homolog annotation: Hit_ID=AAT92157.1; Match level="QueryCoverage =93%, HitCoverage=90%, E-value=2e-11, Identity=54%"; Hit description =copper transport protein [Ixodes pacificus]
  Essential gene: C elegans homolog=ZK652.11; Phenotype=Unclassified
  Coding regions on vcDNA: vcDNA=SeqID_50323; Strand=+; Position=67-285

SEQ ID NO: 123901 - protein, 240 aa, Heterodera glycines
  Homolog annotation: Hit_ID=NP_500844.1; Match level="QueryCoverage =73%, HitCoverage=46%, E-value=1e-13, Identity=27%"; Hit description =beclin 1 (42.8 kD) (4G426) [Caenorhabditis elegans] gb|AAA83597.2| Beclin (human autophagy) homolog prote
  Gene Ontology: Cellular component=cytoplasmic vesicle; Biological process=anti-apoptosis
  Essential gene: C elegans homolog=T19E7.3; Phenotype=Gro,Unc
  Coding regions on vcDNA: vcDNA=SeqID_50324; Strand=+; Position=6-725
WTPGLQNRHEPLKAVHSPAVHCLVLQCRLELHHSLFGPTEDGTDCASSTKSYALRSDGASCSTTTDAKPDFASTYEHCIDLTSTVGTSQSANLLDLVAESTSPLEVPMCKKCANAVTAELNKQLGHLEKECIQYKKSLDHLLRRRADCPFDMEASRIKLDALKSEERDLLEQLTLLEDEERTLLHELDTKQEERKKIGERDEQLYRQLRDNHSILIEQSDEQRSFKLQINQANEQIRRLS

SEQ ID NO: 123902 - protein, 167 aa, Heterodera glycines
  Homolog annotation: Hit_ID=NP_505968.1; Match level="QueryCoverage =100%, HitCoverage=39%, E-value=5e-42, Identity=55%"; Hit description= syntaxin 5a (45.9 kD) (5M245) [Caenorhabditis elegans] emb|CAA96656.1| Hypothetical protein F55A11.2 [Ca
  Gene Ontology: Mol. function=t-SNARE activity; Cellular component =integral to membrane; Biological process=synaptic vesicle docking
  Essential gene: C elegans homolog=F55A11.2; Phenotype=Emb,Lva,Unc
  Coding regions on vcDNA: vcDNA=SeqID_50325; Strand=+; Position=1-504
ENLKFKRERREKFSQSAAIPSNLPPSTSNGQMGSLLLHDEMASASSGSSTFALDMDKLEQQRVQEQTTLLLDDTEQFHQSRFYSMESIESSISELGTIFRQLATLVSEQGEMITRIDSNVEESSLNVEAAHHELLKYFNNISRNRWLIIKVFGVLMAFFVFFVIFLT

SEQ ID NO: 123903 - protein, 240 aa, Heterodera glycines; identical to SEQ ID NO: 122238
  Homolog annotation: Hit_ID=AAT02163.1; Match level="QueryCoverage =87%, HitCoverage=96%, E-value=1e-41, Identity=45%"; Hit description =hypothetical protein L3ni56 isoform a [Dictyocaulus viviparus]
  Essential gene: C elegans homolog=C55B7.9; Phenotype=Dpy
  Coding regions on vcDNA: vcDNA=SeqID_50326; Strand=+; Position=67-786

SEQ ID NO: 123904 - protein, 173 aa, Heterodera glycines; identical to SEQ ID NO: 119685
  Homolog annotation: Hit_ID=CAE57948.1; Match level="QueryCoverage =90%, HitCoverage=98%, E-value=2e-33, Identity=42%"; Hit description =Hypothetical protein CBG01005 [Caenorhabditis briggsae]
  Essential gene: C elegans homolog=R53.4; Phenotype=Emb,Lva
  Coding regions on vcDNA: vcDNA=SeqID_50327; Strand=+; Position=31-552

SEQ ID NO: 123905 - protein, 126 aa, Heterodera glycines
  Homolog annotation: Hit_ID=XP_394802.1; Match level="QueryCoverage =95%, HitCoverage=26%, E-value=3e-23, Identity=47%"; Hit description =similar to Drosophila cyclin E type I [Apis mellifera]
  Gene Ontology: Mol. function=cyclin-dependent protein kinase, intrinsic regulator activity; Cellular component=nucleus; Biological process=negative regulation of FGF receptor signaling pathway
  Essential gene: C elegans homolog=C37A2.4a; Phenotype=Emb
  Coding regions on vcDNA: vcDNA=SeqID_50328; Strand=+; Position=99-476
MKIGHRTPPRQKRATDPPPQFDSSDLGSPQKVWSLLCEKDEKLRRDPHVFSRQKKINAKMRAMLLDWLMDVCADKQLHRETFHLCIDYIDRFIALSDHQMQPQRLQLFGSTALVIASKVEEIYPPK

SEQ ID NO: 123906 - protein, 271 aa, Heterodera glycines
  Homolog annotation: Hit_ID=EAL22335.1; Match level="QueryCoverage =93%, HitCoverage=47%, E-value=2e-28, Identity=29%"; Hit description =hypothetical protein CNBB5100 [Cryptococcus neoformans var. neoformans B-3501A]
  Gene Ontology: Biological process=embryogenesis and morphogenesis
  Essential gene: C elegans homolog=C16A3.4; Phenotype=Emb
  Coding regions on vcDNA: vcDNA=SeqID_50329; Strand=+; Position=49-861
MTTTETPTAPRLDHTTGWTCLACKLVFSSGQLQRDHYRSEWHLYNMKRQIANLPPVTECDFLEKLQYFLQHQQKNAFDADHRRLSSLSVSAAASSLPLGASAVASSLPPLSSSNLSSSSPSSLVCTVCRNKRFRSRNAFDNHLQSRRHKEEEQLQQQQKTTATIEANECQTEGRENGGMEAKLPKIVAQNIDGEEEAVLPIESDNDDDEEAEQKEDNSFAKKEDGIPPNECLYCELKSDTWEANLAHMSKQHGFLVPDSPFCTDVPGLLTY

SEQ ID NO: 123907 - protein, 185 aa, Heterodera glycines
  misc_feature (26)..(26): Xaa can be any naturally occurring amino acid
  Homolog annotation: Hit_ID=NP_491654.1; Match level="QueryCoverage =88%, HitCoverage=29%, E-value=2e-74, Identity=79%"; Hit description =CBF1 interacting corepressor (65.8 kD) (1G222) [Caenorhabditis elegans] gb|AAB37808.1| Hypothetical prote
  Gene Ontology: Biological process=growth
  Essential gene: C elegans homolog=F55F8.4; Phenotype=Emb
  Coding regions on vcDNA: vcDNA=SeqID_50330; Strand=+; Position=82-637
MGKGFQNFMSKKDFHPSAWWNLKRKXEAEQKNDLEKRRQDELRVQYEKEQEILNNKALLGDEKARLGLSFMYDAPAGINKKKEEGPEPKFEWQRKYNAPREEWAKGNELIQDQPFGIQVRNVRCVKCRAWGHLNTDRECPLYGMSGNAEDHGYANNPSDIIRDLNVEKKTKTVSDVTTNEQIDIK

SEQ ID NO: 123908 - protein, 158 aa, Heterodera glycines
  Homolog annotation: Hit_ID=NP_510561.1; Match level="QueryCoverage =98%, HitCoverage=28%, E-value=2e-54, Identity=63%"; Hit description =suox gene product (61.0 kD) (XQ117) [Caenorhabditis elegans] emb|CAB17069.1| Hypothetical protein H13N06.
  Gene Ontology: Mol. function=sulfite oxidase activity; Cellular component=mitochondrial intermembrane space; Biological process =methionine catabolism
  Essential gene: C elegans homolog=H13N06.4; Phenotype=Gro,Slu,Stp,Unc
  Coding regions on vcDNA: vcDNA=SeqID_50331; Strand=+; Position=1-474
VHFEGADVDASGSRYGASIPFEKAMRPEVIIAYEMNGDVLTRDHGFPIRLVVPGHVGARQVKWLNAIRLSDEESPSTWQQRDYKAFPSSVQIGDPLPFDTTPAIQEYPVQSVICEPNSNTKIAPGAKTITVRGYAWSGGGRGIIRVEVSPDNGTTWKC

SEQ ID NO: 123909 - protein, 126 aa, Heterodera glycines; identical to SEQ ID NO: 122425
  Homolog annotation: Hit_ID=NP_502513.1; Match level="QueryCoverage =84%, HitCoverage=22%, E-value=3e-18, Identity=45%"; Hit description =spinster-like family member (53.5 kD) (4N853) [Caenorhabditis elegans] emb|CAA94337.1| Hypothetical prote
  Gene Ontology: Biological process=reproduction
  Essential gene: C elegans homolog=C39E9.10; Phenotype=Emb,Gro,Lva,Ste
  Coding regions on vcDNA: vcDNA=SeqID_50332; Strand=+; Position=1-381

SEQ ID NO: 123910 - protein, 196 aa, Heterodera glycines; identical to SEQ ID NO: 122092
  Homolog annotation: Hit_ID=CAE57690.1; Match level="QueryCoverage =97%, HitCoverage=34%, E-value=9e-53, Identity=52%"; Hit description =Hypothetical protein CBG00692 [Caenorhabditis briggsae]
  Gene Ontology: Mol. function=Ran guanyl-nucleotide exchange factor activity; Cellular component=nucleus; Biological process=DNA packaging
  Essential gene: C elegans homolog=C26D10.1; Phenotype=Emb,Gro
  Coding regions on vcDNA: vcDNA=SeqID_50333; Strand=+; Position=41-628

SEQ ID NO: 123911 - protein, 153 aa, Heterodera glycines
  Homolog annotation: Hit_ID=CAE65046.1; Match level="QueryCoverage =100%, HitCoverage=39%, E-value=1e-33, Identity=45%"; Hit description= Hypothetical protein CBG09887 [Caenorhabditis briggsae]
  Gene Ontology: Mol. function=general RNA polymerase II transcription factor activity; Cellular component=transcription factor TFIIH complex; Biological process=regulation of transcription, DNA -dependent
  Essential gene: C elegans homolog=T16H12.4; Phenotype=Emb,Gro,Unc
  Coding regions on vcDNA: vcDNA=SeqID_50334; Strand=+; Position=29-487
MDDDDAIGGAEAFKWEQAYTEGLNIRSVLQEDEHGSVEESIRRLVMDEKRQRRMDRLPAKIRLGMMRYVHLAVDCSSAILSADFFPSRLSVALECLRKFVDKFFLLNPLSQMGLIAVRDKRAERISGFTSSVQFLLESLQDISSTNCGGEFSL

SEQ ID NO: 123912 - protein, 189 aa, Heterodera glycines
  Homolog annotation: Hit_ID=CAE75171.1; Match level="QueryCoverage =94%, HitCoverage=94%, E-value=1e-51, Identity=54%"; Hit description =Hypothetical protein CBG23108 [Caenorhabditis briggsae]
  Essential gene: C elegans homolog=C06H2.1; Phenotype=Emb,Lva
  Coding regions on vcDNA: vcDNA=SeqID_50335; Strand=+; Position=13-582
MAQPAKRVAVSSVNWAKLAERLTPQQEEELNRLKAQNSSYHAEVVQHQADLPKVDWATLKKQMPENSTVLDSLQKQWEALCIPYGTIPDNLKKQIDQWVKFNEARVKFHELKTADGLVEMKKIEDKWAKMPPVEQLWRDQLVQYFPHKYQDLRYLNEYYDPWGIGVNDTNWRERFKDFQSRPREGATLH

SEQ ID NO: 123913 - protein, 196 aa, Heterodera glycines
  Homolog annotation: Hit_ID=CAE60601.1; Match level="QueryCoverage =90%, HitCoverage=50%, E-value=6e-47, Identity=51%"; Hit description =Hypothetical protein CBG04238 [Caenorhabditis briggsae]
  Essential gene: C elegans homolog=C18A3.4a; Phenotype=Emb
  Coding regions on vcDNA: vcDNA=SeqID_50336; Strand=+; Position=80-667
MASGFWAFVGRAWEWLKTLILPQSINGTCLNQTFINDTPSAGEFLADLEPFQIVLLSVGSVLTFTVFLLAFLQWWYIFNYVSSEQRRNKLYLLISLFPVCTFCCLVGMFCPRTALLVSSFGLLYFLLCLFVLVSLMRHLSGGRATLALSLTDKGKLIDFRGPPFCCLLYCLPRANPTEVNLTRLEWIVLQAPIIRV

SEQ ID NO: 123914 - protein, 472 aa, Heterodera glycines
  Homolog annotation: Hit_ID=NP_508494.1; Match level="QueryCoverage =72%, HitCoverage=62%, E-value=1e-132, Identity=60%"; Hit description= C2H2 type zinc finger containing protein (XD472) [Caenorhabditis elegans] gb|AAA81404.2| Hypothetical pr
  Gene Ontology: Mol. function=DNA binding; Cellular component=nucleus; Biological process=regulation of transcription, DNA-dependent
  Essential gene: C elegans homolog=F53B3.1; Phenotype=Egl
  Coding regions on vcDNA: vcDNA=SeqID_50337; Strand=+; Position=10-1428
MPIILNQGILSTTCDEQQRETLKLQLEPAAEYNETNFKRTVLNASGTPINGAFTFWSAPSTAAPAATASVSNLSATTTVISSEPDLTPLTPSTSDVTVNGHSSNVKVLKPVPLVIRTQSADEIAGAVAHPTKPSEIRKLIRSKMVRCRICRNRFLDKHIYERHLRDRHPKEHAAYLSQQEDEVRQQRKEEFEANRLDELVSGGFIPPQEDLDASKYEVNIKEIPLPGELTGGVPARFDRFGVLFQPKRVYKKKVSPQCPFCDKRYRNEYSVKKHIAKKHTECAEWAQCLKCFKAVPSKAEMVDHLGEMIYLCFECVPPRNLCNDVRLYNHRTKFHRGQNSGFKCNLCNQKFLTPRKLRKHKKMSHVFTKTYQCHFCEELFINETAVTTHERIHTGIIKFECKICDYKCNRFLNMEDHVKEDHGYLCSICQSKLSEWGDLKNHMLMDHGGYLSSEFNSGYIESPRVWLMFKGD

SEQ ID NO: 123915 - protein, 114 aa, Heterodera glycines
  Homolog annotation: Hit_ID=CAE57569.1; Match level="QueryCoverage =99%, HitCoverage=78%, E-value=2e-24, Identity=52%"; Hit description =Hypothetical protein CBG00547 [Caenorhabditis briggsae]
  Gene Ontology: Mol. function=structural constituent of ribosome; Cellular component=cytosolic ribosome (sensu Eukarya); Biological process=protein biosynthesis
  Essential gene: C elegans homolog=F28C6.7a; Phenotype=Emb,Lva,Ste
  Coding regions on vcDNA: vcDNA=SeqID_50338; Strand=+; Position=2-343
KLNPFVSSSARKSRKRHFNAPSHIRRRIMSAPLSKDLRNKRGVRSTPIRIDDEVTVTRSHYKGNARRIMRVYPENFFIAPLTKILPEKGQGTNGPRLGIFPFNGGFPKFENGKR

SEQ ID NO: 123916 - protein, 139 aa, Heterodera glycines; identical to SEQ ID NO: 122423
  Homolog annotation: Hit_ID=CAE75063.1; Match level="QueryCoverage =75%, HitCoverage=59%, E-value=5e-10, Identity=34%"; Hit description =Hypothetical protein CBG22978 [Caenorhabditis briggsae]
  Essential gene: C elegans homolog=K12H4.5; Phenotype=Emb
  Coding regions on vcDNA: vcDNA=SeqID_50339; Strand=+; Position=3-422

SEQ ID NO: 123917 - protein, 133 aa, Heterodera glycines
  Homolog annotation: Hit_ID=NP_497284.1; Match level="QueryCoverage =100%, HitCoverage=31%, E-value=1e-17, Identity=35%"; Hit description= cytochrome Bc1 Complex From Chicken like family member (45.6 kD) (3B499) [Caenorhabditis elegans] gb|AAC
  Gene Ontology: Cellular component=mitochondrion
  Essential gene: C elegans homolog=T24C4.1; Phenotype=Stp
  Coding regions on vcDNA: vcDNA=SeqID_50340; Strand=+; Position=1-399
GTDSINYLGVRLLWVTGQSGATLQAKLSKDLMLVHMSVPRTMSPVAISVLGEFVQPALKSWDVLSVQEEMAYDLSQQSPYDLTIEGLYRAAFRNGSLSNALLSPHYQIGNITNKRTQQFVNSRWLTKETALIG

SEQ ID NO: 123918 - protein, 153 aa, Heterodera glycines; identical to SEQ ID NO: 122629
  Homolog annotation: Hit_ID=NP_594672.1; Match level="QueryCoverage =98%, HitCoverage=96%, E-value=5e-56, Identity=72%"; Hit description =40s ribosomal protein s11-2 [Schizosaccharomyces pombe] ref|NP _594003.1| 40s ribosomal protein s11. [Schi
  Gene Ontology: Biological process=reproduction
  Essential gene: C elegans homolog=F40F11.1; Phenotype=Ste
  Coding regions on vcDNA: vcDNA=SeqID_50341; Strand=+; Position=32-493

SEQ ID NO: 123919 - protein, 116 aa, Heterodera glycines
  misc_feature (102)..(102): Xaa can be any naturally occurring amino acid
  Homolog annotation: Hit_ID=NP_500608.1; Match level="QueryCoverage =66%, HitCoverage=98%, E-value=9e-23, Identity=67%"; Hit description =mitochondrial ribosomal protein S21 like (4F422) [Caenorhabditis elegans] gb|AAF99924.1| Hypothetical pro
  Essential gene: C elegans homolog=F29B9.10; Phenotype=Lva
  Coding regions on vcDNA: vcDNA=SeqID_50342; Strand=+; Position=31-382
MVRLIQNQFWRGTLTQPWGVKMFKYIWRKHSRFLVKTVMVQENDIDSAFHLLNRLMEREGLLKIIRNTQRYQKPFMQRSQLSIEASKAILEEDRDRKLKFLXRKHRADAYPGQLTM

SEQ ID NO: 123920 - protein, 290 aa, Heterodera glycines
  misc_feature (157)..(157): Xaa can be any naturally occurring amino acid
  Homolog annotation: Hit_ID=CAE60157.1; Match level="QueryCoverage =88%, HitCoverage=47%, E-value=3e-46, Identity=39%"; Hit description =Hypothetical protein CBG03709 [Caenorhabditis briggsae]
  Gene Ontology: Biological process=reproduction
  Essential gene: C elegans homolog=T05F1.1; Phenotype=Ste
  Coding regions on vcDNA: vcDNA=SeqID_50343; Strand=+; Position=1-868
AHLNAAERGRPYLFIVAHYDTYGIIPSLGIGSDSNGSGTAVLLELLAILSQIYSLPSHKARYNLVFVLSAGGKFSYQGSRSFIDDFNERHSDERIALAICLDSLARGDSLFVHASKIPSDETKAFRFIQTLRHFANRPVELISKKISLASDRLAWEXHEIYNIRRIHAVTISHFSNHSNPFRNSLLDIPTSLDFSMLEDNAKLIANALVSFVFDLDSRLCNNAKENNLACSLLNDAVEVDPKRLKAWVSMFGSKSRPIVVSQHQLVANLFEVVKRLAHSAHVSEIVVNDY

SEQ ID NO: 123921 - protein, 194 aa, Heterodera glycines
  misc_feature (157)..(157): Xaa can be any naturally occurring amino acid
  Homolog annotation: Hit_ID=NP_499360.1; Match level="QueryCoverage =91%, HitCoverage=93%, E-value=1e-39, Identity=53%"; Hit description =mitochondrial ribosomal protein L7L12 (18.4 kD) (3L797) [Caenorhabditis elegans] emb|CAB07857.1| Hypothet
  Gene Ontology: Mol. function=structural constituent of ribosome; Cellular component=mitochondrial large ribosomal subunit; Biological process=growth
  Essential gene: C elegans homolog=W09D10.3; Phenotype=Lva
  Coding regions on vcDNA: vcDNA=SeqID_50344; Strand=+; Position=18-603
MIVNGSLKICRTALGPFVRRASASALGLPLEDGPSVSPPSVDRAKDISPRVRSLVDQIAELSLVEVSDLNFALKKRLNIPDTPAMAMSPEMFAAAGMFGAQAGGAAGAQTSQANADDDSASTKTSYAVRLAKFDDAKKIALIKEVRSVIPGMNLVQXKKLIESAPVEIKGDMGKTEADELKALLEKHGAECEVI

SEQ ID NO: 123922 - protein, 94 aa, Heterodera glycines; identical to SEQ ID NO: 123139
  Homolog annotation: Hit_ID=NP_572215.1; Match level="QueryCoverage =81%, HitCoverage=17%, E-value=8e-10, Identity=42%"; Hit description =CG4202-PA [Drosophila melanogaster] gb|AAG22407.2| CG4202-PA [Drosophila melanogaster] gb|AAK77307.1| GH0
  Essential gene: C elegans homolog=T01B7.5; Phenotype=Lva
  Coding regions on vcDNA: vcDNA=SeqID_50345; Strand=+; Position=1-285

SEQ ID NO: 123923 - protein, 196 aa, Heterodera glycines; identical to SEQ ID NO: 122084
  Homolog annotation: Hit_ID=CAE57494.1; Match level="QueryCoverage =82%, HitCoverage=83%, E-value=3e-31, Identity=44%"; Hit description =Hypothetical protein CBG00465 [Caenorhabditis briggsae]
  Gene Ontology: Cellular component=mitochondrial ribosome
  Essential gene: C elegans homolog=F54C4.1; Phenotype=Lva
  Coding regions on vcDNA: vcDNA=SeqID_50346; Strand=+; Position=17-604

SEQ ID NO: 123924 - protein, 150 aa, Heterodera glycines
  Homolog annotation: Hit_ID=NP_500367.1; Match level="QueryCoverage =98%, HitCoverage=27%, E-value=7e-35, Identity=43%"; Hit description =rab geranylgeranyl transferase (67.2 kD) (4E295) [Caenorhabditis elegans] gb|AAC68985.1| Hypothetical pro
  Gene Ontology: Biological process=lipid metabolism
  Essential gene: C elegans homolog=M57.2; Phenotype=Lva,Lvl,Unc
  Coding regions on vcDNA: vcDNA=SeqID_50347; Strand=+; Position=12-461
TPFAKKSEEQREAEEKKRAEKLQQFVDSRNLVFQKRKSGEYDDEVLTVCGELLKNNPDIYTLWNVRREAIEKRATKCEDESDEELAKRISELINGELKLTQSCLLRNPKSYSTWHHRYWSCLRHPTPPLRQELALCEKALGQDCRNFHCW

SEQ ID NO: 123925 - protein, 158 aa, Heterodera glycines; identical to SEQ ID NO: 122602
  Homolog annotation: Hit_ID=AAV34867.1; Match level="QueryCoverage =100%, HitCoverage=100%, E-value=9e-66, Identity=78%"; Hit description=ribosomal protein S11-1 [Bombyx mori]
  Gene Ontology: Biological process=reproduction
  Essential gene: C elegans homolog=F40F11.1; Phenotype=Ste
  Coding regions on vcDNA: vcDNA=SeqID_50348; Strand=+; Position=35-511

SEQ ID NO: 123926 - protein, 72 aa, Heterodera glycines; identical to SEQ ID NO: 122302
  Homolog annotation: Hit_ID=CAE73689.1; Match level="QueryCoverage =97%, HitCoverage=93%, E-value=8e-18, Identity=58%"; Hit description =Hypothetical protein CBG21200 [Caenorhabditis briggsae]
  Essential gene: C elegans homolog=T27E9.2; Phenotype=Gro
  Coding regions on vcDNA: vcDNA=SeqID_50349; Strand=+; Position=33-251

SEQ ID NO: 123927 - protein, 137 aa, Heterodera glycines
  Homolog annotation: Hit_ID=EAK82181.1; Match level="QueryCoverage =98%, HitCoverage=92%, E-value=1e-47, Identity=68%"; Hit description =hypothetical protein UM01318.1 [Ustilago maydis 521] ref|XP _398933.1| hypothetical protein UM01318.1 [Usti
  Gene Ontology: Mol. function=structural constituent of ribosome; Cellular component=cytosolic small ribosomal subunit (sensu Eukarya); Biological process=protein biosynthesis
  Essential gene: C elegans homolog=F54E7.2; Phenotype=Emb,Ste
  Coding regions on vcDNA: vcDNA=SeqID_50350; Strand=+; Position=53-466
MADTVEVAAAEVHVASTMTVEEALQDVLKRSLIHDGLARGIRESVKALDRREAHLCVLAQSCDEKEYVRLIEALCAEHNIRLIKVEDNKKLGEWAGLCKIDRDGNPRKVVGASVVVVKDWGEESEALNIILEYFKSQ

SEQ ID NO: 123928 - protein, 158 aa, Heterodera glycines
  misc_feature (70)..(70): Xaa can be any naturally occurring amino acid
  Homolog annotation: Hit_ID=S50830; Match level="QueryCoverage=97%, HitCoverage=45%, E-value=2e-31, Identity=43%"; Hit description =Machado-Joseph disease MJD1a protein - human gb|AAB33571.1| MJD1 protein [Homo sapiens]
  Gene Ontology: Cellular component=cytoplasm; Biological process =synaptic transmission
  Essential gene: C elegans homolog=F28F8.6; Phenotype=Emb
  Coding regions on vcDNA: vcDNA=SeqID_50351; Strand=+; Position=17-489
MDLVYHEKQVGRMCAQHALNMLLQGDYFTPDSLASIAQELDQRERAMLRDESEFQSQNYDDSGYFSIQVXTEALRRQANLSLEPIISPNAMKVLQNPSLAHAYICHLEDHWFTIRKIGTTWFILNSLFKAPRIVSETFLELYVHQLNTEAPNIFGHDE

SEQ ID NO: 123929 - protein, 192 aa, Heterodera glycines; identical to SEQ ID NO: 122297
  Homolog annotation: Hit_ID=CAE65929.1; Match level="QueryCoverage =44%, HitCoverage=26%, E-value=2e-11, Identity=41%"; Hit description =Hypothetical protein CBG11102 [Caenorhabditis briggsae]
  Gene Ontology: Mol. function=receptor binding; Cellular component =cell junction; Biological process=EGF receptor signaling pathway
  Essential gene: C elegans homolog=Y54G11A.10; Phenotype=Gro
  Coding regions on vcDNA: vcDNA=SeqID_50352; Strand=+; Position=11-589

SEQ ID NO: 123930 - protein, 103 aa, Heterodera glycines
  misc_feature (24)..(24): Xaa can be any naturally occurring amino acid
  misc_feature (77)..(77): Xaa can be any naturally occurring amino acid
  misc_feature (79)..(79): Xaa can be any naturally occurring amino acid
  misc_feature (94)..(94): Xaa can be any naturally occurring amino acid
  Homolog annotation: Hit_ID=CAE60169.1; Match level="QueryCoverage =95%, HitCoverage=31%, E-value=5e-29, Identity=70%"; Hit description =Hypothetical protein CBG03723 [Caenorhabditis briggsae]
  Gene Ontology: Mol. function=adenine transporter activity; Cellular component=integral to plasma membrane; Biological process =embryogenesis and morphogenesis
  Essential gene: C elegans homolog=T27E9.1a; Phenotype=Emb
  Coding regions on vcDNA: vcDNA=SeqID_50353; Strand=+; Position=47-357
KCPKISPKVVSAKKKSGGFNTKKXYLDLASGGTAAAVSKTAVAPIERVKLLLQVQDASIHITADKRYKGIIDVLVRXSXFFGFLSLWRGNLFNXSRSFPTQAL

SEQ ID NO: 123931 - protein, 277 aa, Heterodera glycines
  Homolog annotation: Hit_ID=NP_501910.1; Match level="QueryCoverage =88%, HitCoverage=50%, E-value=1e-25, Identity=33%"; Hit description =KOW (4L123) [Caenorhabditis elegans] emb|CAA94367.1| Hypothetical protein R11A8.2 [Caenorhabditis elegans
  Essential gene: C elegans homolog=R11A8.2; Phenotype=Bmd,Emb,Lva,Stp
  Coding regions on vcDNA: vcDNA=SeqID_50354; Strand=+; Position=2-835
KEQNSGDEEAEEADEHRTKKRGILSLEDGIIVDAEPLAKREKKQLVIPVLQVSSRAQISRIQKLVDEGTATETDLARLSLLIDSLDDEQRKTTTLPLDARHQTVPTVAVADDDDPDYASVPVGEFGLAFLRGCGWKDEKSCIGKSNPQVVPLRVIEPRPKGLGLGAVLPTTAPPTANALKAAENGDEEATTLGKHSYVRCLSGLNKGSYGQVMSMDEENASIFVELAWPPANVGKTVRVSQWAVEVVRRKEYRECVKGGSGGGGTAENGRRLERVRV

SEQ ID NO: 123932 - protein, 223 aa, Heterodera glycines
  Homolog annotation: Hit_ID=CAE72294.1; Match level="QueryCoverage =91%, HitCoverage=57%, E-value=3e-39, Identity=40%"; Hit description =Hypothetical protein CBG19424 [Caenorhabditis briggsae]
  Essential gene: C elegans homolog=T05G5.7; Phenotype=Emb
  Coding regions on vcDNA: vcDNA=SeqID_50355; Strand=+; Position=1-669
VFIVTFFRAPQLLMFEYIDQLDSENKHEEAYCLLAKQSLNTGLNQQEILWRLARSCVQMAYPLDMKNPKKKKLLDEGHKYACSAYELCSDDFNVLKWTAAAVGSRTDFLGTKERIEQGNFFRDVLDKALAINPEEYTLLHMRGRLVLSVASLSWIERKAATVLFGPPPEVSLNEAIRDFTAVLELAPDWLENTLFLAKAYLANSDRESAVHHLKQLIDSYQQN

SEQ ID NO: 123933 - protein, 260 aa, Heterodera glycines
  Homolog annotation: Hit_ID=NP_498415.2; Match level="QueryCoverage =93%, HitCoverage=40%, E-value=4e-84, Identity=65%"; Hit description =electron transfer flavoprotein-ubiquinone oxidoreductase, LEThal LET- 721 (65.3 kD) (let-721) [Caenorhabdi
  Gene Ontology: Mol. function=electron acceptor activity; Cellular component=mitochondrial inner membrane; Biological process=electron transport
  Essential gene: C elegans homolog=C05D11.12; Phenotype=Emb
  Coding regions on vcDNA: vcDNA=SeqID_50356; Strand=+; Position=20-799
MANNFLSVRRFLHCCPPLRNVVNGRWTTTHYTQRPREKDGRWKCVDMACVEDEFDVVIVGGGPAGLSAAIRLKQLAAEKAKELRVCLVEKAPEIGAHTLSGAIIETGGLDRLFPNWRELDSPIKQAVKKDAFAILTKNGRIPVPLVPGVLLNNHGNYIVRLGHLVRWLGERAEEHGVELYSGIAAQEVLFDEAGKTVCGVATGDVGIHKDGSPKESFERGMELKAKCTIFAEGCPGHLTKSVIGKFGLREGRDPMTFGNG

SEQ ID NO: 123934 - protein, 180 aa, Heterodera glycines
  misc_feature (38)..(38): Xaa can be any naturally occurring amino acid
  Homolog annotation: Hit_ID=CAA70477.2; Match level="QueryCoverage =95%, HitCoverage=92%, E-value=2e-58, Identity=70%"; Hit description =SEC-2 protein [Globodera pallida]
  Essential gene: C elegans homolog=F02A9.2; Phenotype=Bmd,Dpy
  Coding regions on vcDNA: vcDNA=SeqID_50357; Strand=+; Position=2-544
LAVSPSPFSVLDGDRVPTVDISQNTAEYRELIPEEVTXFYHELTEDDKNALNEVAERHEEFRTEEQAMEALKEKSEKLYNKAVELRTLVKGKIDQLVPDAKAFVIGMIEKAKGMRPKAGEKPKLEELRTAANELIEKYKALNDEAKESLKSNFPKITSVIQNEKFQTLAKSLLKQEAPAA

SEQ ID NO: 123935 - protein, 154 aa, Heterodera glycines; identical to SEQ ID NO: 122335
  Homolog annotation: Hit_ID=CAE71331.1; Match level="QueryCoverage =98%, HitCoverage=93%, E-value=1e-46, Identity=59%"; Hit description =Hypothetical protein CBG18231 [Caenorhabditis briggsae]
  Gene Ontology: Mol. function=RNA binding; Cellular component=small nuclear ribonucleoprotein complex; Biological process=positive regulation of growth rate
  Essential gene: C elegans homolog=Y48A6B.3; Phenotype=Gro
  Coding regions on vcDNA: vcDNA=SeqID_50358; Strand=+; Position=3-467

SEQ ID NO: 123936 - protein, 184 aa, Heterodera glycines
  Homolog annotation: Hit_ID=CAG09543.1; Match level="QueryCoverage =69%, HitCoverage=85%, E-value=5e-25, Identity=44%"; Hit description =unnamed protein product [Tetraodon nigroviridis]
  Gene Ontology: Mol. function=protein translocase activity; Cellular component=mitochondrial outer membrane translocase complex; Biological process=mitochondrial translocation
  Essential gene: C elegans homolog=F23H12.2; Phenotype=Lva
  Coding regions on vcDNA: vcDNA=SeqID_50359; Strand=+; Position=10-564
MSTFYSLNVSSNWLKYLSLGTALVVGYAVYIDRKRRLDPEYKQKIRQNRKQKQANFFYAKMSGGVDFPDPSDPQANEIFFFSQITLGEEKMQTGHIEEGITHLSNAIVTCSKPDELLRIFQQTIPPECFSLLVQAIPGAKMRRNASSSYRHGREPIDLDCAKIDDIGDNAVDKKMFVLQDDELE

SEQ ID NO: 123937 - protein, 257 aa, Heterodera glycines
  Homolog annotation: Hit_ID=AAA81746.1; Match level="QueryCoverage =93%, HitCoverage=98%, E-value=2e-25, Identity=34%"; Hit description =Lamp/cd68 related protein 1 [Caenorhabditis elegans] ref|NP _509072.1| LAMP/CD68 related (25.8 kD) (lmp-1)
  Essential gene: C elegans homolog=C03B1.12; Phenotype=Clr
  Coding regions on vcDNA: vcDNA=SeqID_50360; Strand=+; Position=41-811
MNRSVFSPPNCSLFRLAFFLVFCLLSANAMKFAVKGDDNKYCILLDSPQITGAIRYEEKNGSFNTTTFSLSNSSASVDKNASSCDASIQRISIQFAPLIEGIATEMSKKWNITLEFTKKDGKNYALSDYSLGVVFFPAQKASQKSHVYEKNGTAEWVAQLESDQSKHPNGFTCSENKLALSDASTINFEFLKLVAFDDNEKDEFRDGQIFENCPLDARTSDLVPIVVGALLAGLVVIVLIAYLIGRARAKRQGYTSV

SEQ ID NO: 123938 - protein, 125 aa, Heterodera glycines
  Homolog annotation: Hit_ID=NP_492119.1; Match level="QueryCoverage =96%, HitCoverage=97%, E-value=2e-38, Identity=60%"; Hit description =NADH dehydrogenase 1 beta subcomplex 7, possibly N-myristoylated (14.4 kD) (1I156) [Caenorhabditis elegan
  Gene Ontology: Mol. function=NADH dehydrogenase (ubiquinone) activity; Cellular component=membrane fraction
  Essential gene: C elegans homolog=D2030.4; Phenotype=Age,Gro,Lva
  Coding regions on vcDNA: vcDNA=SeqID_50361; Strand=+; Position=1-378
MGQKLAVSLDDYFHPETAPRIDRPPTFDPLYGFPKGRKPREMQASWEELEKMKMPISERDYCAHKMVALRKCVWDRAPFASHYCHGRRHDLGLCLYDDHLMRMKEFEREKRLLMRKARKERAKAA

SEQ ID NO: 123939 - protein, 213 aa, Heterodera glycines
  misc_feature (171)..(171): Xaa can be any naturally occurring amino acid
  Homolog annotation: Hit_ID=NP_509586.1; Match level="QueryCoverage =100%, HitCoverage=100%, E-value=3e-52, Identity=43%"; Hit description=golgi snap receptor complex member 2 (XK58) [Caenorhabditis elegans] emb|CAA86311.1| Hypothetical prote
  Gene Ontology: Mol. function=v-SNARE activity; Biological process=ER to Golgi transport
  Essential gene: C elegans homolog=M03E7.5; Phenotype=Emb
  Coding regions on vcDNA: vcDNA=SeqID_50362; Strand=+; Position=16-658
MEQLFQQANMDLHQIHLEMRHLELCKNESEAQPLFQKLHQQIRQSAAQLDGLERLVNKEPSGKRHTSKYRFEQLRHDYNALEMAINSLQNRLTTKWRTAAEREELLTMRFKPNETHLDFEGTELLVNDRLKQSHNAVDDLIAHGNSVLTSLRHQHLGLKDVKRKMHDIGQXLGLSTTTLQMIEKRLEDDWLLFLVLCVLCVVFMYCFYRFWKG

SEQ ID NO: 123940 - protein, 231 aa, Heterodera glycines
  Homolog annotation: Hit_ID=CAE67168.1; Match level="QueryCoverage =92%, HitCoverage=32%, E-value=5e-51, Identity=44%"; Hit description =Hypothetical protein CBG12598 [Caenorhabditis briggsae]
  Gene Ontology: Mol. function=protein binding; Cellular component =anaphase-promoting complex; Biological process=mitosis
  Essential gene: C elegans homolog=F10C5.1; Phenotype=Mei,Ste
  Coding regions on vcDNA: vcDNA=SeqID_50363; Strand=+; Position=16-708
MHEQAQEFLKRAIKLCPTNASIWVLLGHEYLETKNHQLASTAYKKATEIDSVCYRGWYGLGQLYEILKQSETALYYYQKAHKCRPADSRILIALGVIFSKIDRKSDAEKCFKKAFQIGDVEGNALTHLAKLYEEQENQQNAAKAYEAYLTLYTEELVGDLSLIAEACRFLARHNLDLGDLDTSYAYAQRCLNYDLSKEEGQRILRLIMSKRKEEQERKLALPVGTPQQQNI

SEQ ID NO: 123941 - protein, 210 aa, Heterodera glycines
  Homolog annotation: Hit_ID=NP_741269.1; Match level="QueryCoverage =98%, HitCoverage=38%, E-value=1e-62, Identity=58%"; Hit description =coronin (67.1 kD) (cor-1) [Caenorhabditis elegans] emb|CAA83461.1| Hypothetical protein R01H10.3a [Caenor
  Gene Ontology: Mol. function=structural molecule activity; Cellular component=actin cytoskeleton; Biological process=cell organization and biogenesis
  Essential gene: C elegans homolog=Y76A2B.1; Phenotype=Emb
  Coding regions on vcDNA: vcDNA=SeqID_50364; Strand=+; Position=3-632
PPYVHYINTHTTSEPQRGFAFMPKRGMNSLENEINRIYKVTTKGVVDILQFFVPRKSDLWQADLYPDTRSLIPALTAEEFVGGKNAPPNLIPVNPEAAKAGPKVQVAKKANILAQMPPQQEHPPEPPMQRPAPPQQQRAAPVRHDEEMGIVRSQRREPSPPEQQTPAPRQQVQLRSREARDETGGSQTAGQRRAAAELDRIRREQNRSGA

SEQ ID NO: 123942 - protein, 210 aa, Heterodera glycines
  Homolog annotation: Hit_ID=AAK95139.1; Match level="QueryCoverage =100%, HitCoverage=99%, E-value=2e-62, Identity=57%"; Hit description= ribosomal protein L13 [Ictalurus punctatus] sp|Q90YV5|RL13_ICTPU 60S ribosomal protein L13
  Gene Ontology: Mol. function=structural constituent of ribosome; Cellular component=cytosolic ribosome (sensu Eukarya); Biological process=protein biosynthesis
  Essential gene: C elegans homolog=C32E8.2a; Phenotype=Emb,Lva,Ste
  Coding regions on vcDNA: vcDNA=SeqID_50365; Strand=+; Position=38-667
MAPRGNNMLPNAHFHKHWQRRIKTWFNQPARKERRRAARSAKAARLAPRPAGGLLRPVVRCPSVRYNKKCRVGRGFTLEELKRSGMGKYQARSLGIAVDTRRVNRSVESTERNVARLKEYRSRLIIFPKKMNKPKKGDSSPEELKLAAQMPGSVVMPPVVKQRRLKAEPITEAMNKFSAYCHQRRVRADKRLKGKREKKARNGGRRAGQK

SEQ ID NO: 123943 - protein, 339 aa, Heterodera glycines
  misc_feature (73)..(73): Xaa can be any naturally occurring amino acid
  Homolog annotation: Hit_ID=NP_498386.2; Match level="QueryCoverage =88%, HitCoverage=89%, E-value=3e-53, Identity=40%"; Hit description =DeHydrogenase, Short chain, complex, LEThal LET-767 (34.3 kD) (let -767Co) [Caenorhabditis elegans] gb|AAA
  Gene Ontology: Cellular component=integral to membrane; Biological process=fatty acid biosynthesis
  Essential gene: C elegans homolog=C56G2.6; Phenotype=Lva
  Coding regions on vcDNA: vcDNA=SeqID_50366; Strand=+; Position=3-1023
MTYYNDSNSPFLITLLGRICLSLLLAKVCRSLYNILYPYVIAKPRDLHELAGGDANWAVVTGATDGIGKAYAXELALRGFNLVLISRSAHKLEAVATELKQYSATSGQRGEVQLRTVQFDFTNANPADYERHIFGAISDLNIGILVNNVGMGNPNDYPERFDEMSTKLLSDMTIVNTLPVTVLSSFVLRQMVKRRRGAVINISSASAYMKWYQYAVYSSTKSFIVHLSEILRKEFASDCPGIAIQTVCPMVVATKLTQRSSRDGLSSLLAASPTEFARQAIQTVGLVPETSGCLSHQIQVELLFSLLLTFVPNSLFDFFVRLEAHLHKSVLNTASKQHD

SEQ ID NO: 123944 - protein, 89 aa, Heterodera glycines; identical to SEQ ID NO: 122405
  Homolog annotation: Hit_ID=XP_311506.1; Match level="QueryCoverage =94%, HitCoverage=93%, E-value=9e-30, Identity=72%"; Hit description =ENSANGP00000022836 [Anopheles gambiae]
  Essential gene: C elegans homolog=Y49E10.15; Phenotype=Emb
  Coding regions on vcDNA: vcDNA=SeqID_50367; Strand=+; Position=39-308

SEQ ID NO: 123945 - protein, 172 aa, Heterodera glycines
  Homolog annotation: Hit_ID=NP_493272.1; Match level="QueryCoverage =99%, HitCoverage=69%, E-value=1e-71, Identity=74%"; Hit description =translation factor (26.3 kD) (1N561) [Caenorhabditis elegans] emb|CAB16860.1| Hypothetical protein C47B2.
  Gene Ontology: Cellular component=cytoplasm; Biological process =protein biosynthesis
  Essential gene: C elegans homolog=C47B2.5; Phenotype=Lva
  Coding regions on vcDNA: vcDNA=SeqID_50368; Strand=+; Position=23-538
MVALRAQFEASNDVGVFCKLTNAYCLVGIASSENFYSIVEAELADVIPVIHCTVAGCRIVGRVTAGNRHGLLVPNATTDQELQHIRNSLPDSVQIRRVDERLSALGNVIACNDHIAVVHADISKETEAALAEVLKVEVFRLSLGENALVGSYAAMTSNGALVAAKTPPEVQR

SEQ ID NO: 123946 - protein, 51 aa, Heterodera glycines; identical to SEQ ID NO: 122799
  Homolog annotation: Hit_ID=AAV34853.1; Match level="QueryCoverage =100%, HitCoverage=100%, E-value=9e-20, Identity=86%"; Hit description=ribosomal protein L39 [Bombyx mori] gb|AAK92174.1| ribosomal protein L39 [Spodoptera frugiperda] dbj|BAD
  Essential gene: C elegans homolog=C26F1.9; Phenotype=Emb,Lva
  Coding regions on vcDNA: vcDNA=SeqID_50369; Strand=+; Position=19-174

SEQ ID NO: 123947 - protein, 158 aa, Heterodera glycines
  Homolog annotation: Hit_ID=AAL78213.1; Match level="QueryCoverage =100%, HitCoverage=63%, E-value=1e-85, Identity=100%"; Hit description=probable protein kinase Hgg-20 [Heterodera glycines]
  Gene Ontology: Mol. function=casein kinase I activity; Cellular component=nucleus; Biological process=signal transduction
  Essential gene: C elegans homolog=R90.1; Phenotype=Lva,Unc
  Coding regions on vcDNA: vcDNA=SeqID_50370; Strand=+; Position=1-474
GTRVSGRWTILKKLGAGAFGAVYLCKDGKGTVAALKTEPIDTRQPLLVMEATVLDTLGKKLKNADGQHFCRLLDLGRSEQRNATSGDTVFNYVVMTVVGTPLDKLIRNAGDRFSPGTAIGMSIQLLSAIKALHNVGFLHRDIKPANTAIGRAETNEHR

SEQ ID NO: 123948 - protein, 262 aa, Heterodera glycines; identical to SEQ ID NO: 122609
  Homolog annotation: Hit_ID=NP_502793.1; Match level="QueryCoverage =100%, HitCoverage=55%, E-value=1e-140, Identity=95%"; Hit description=sec61 (52.2 kD) (4P588) [Caenorhabditis elegans] emb|CAB16516.1| Hypothetical protein Y57G11C.15 [Caeno
  Gene Ontology: Mol. function=protein transporter activity; Cellular component=endoplasmic reticulum membrane; Biological process =reproduction
  Essential gene: C elegans homolog=Y57G11C.15; Phenotype=Sck,Ste
  Coding regions on vcDNA: vcDNA=SeqID_50371; Strand=+; Position=58-843

SEQ ID NO: 123949 - protein, 157 aa, Heterodera glycines
  Homolog annotation: Hit_ID=CAE74830.1; Match level="QueryCoverage =98%, HitCoverage=19%, E-value=1e-58, Identity=77%"; Hit description =Hypothetical protein CBG22668 [Caenorhabditis briggsae]
  Gene Ontology: Mol. function=ATP-binding cassette (ABC) transporter activity; Cellular component=membrane fraction; Biological process =positive regulation of growth rate
  Essential gene: C elegans homolog=W04C9.1; Phenotype=Gro
  Coding regions on vcDNA: vcDNA=SeqID_50372; Strand=+; Position=1-471
IKLALVGQEPILFARSVAENIAYGLERCTIVDVVEAAKMANAHTFIQQTRDQYETNVGEKGSQMSGGQKQRIAIARALVRRPAILLLDEATSALDTESEHLVQEAIYKNLKGRSVILIAHRLSTVEKADKIVVISRGRLEQIGTHEQLLAQEGMYRS

SEQ ID NO: 123950 - protein, 318 aa, Heterodera glycines
  Homolog annotation: Hit_ID=CAE66814.1; Match level="QueryCoverage =91%, HitCoverage=64%, E-value=5e-95, Identity=56%"; Hit description =Hypothetical protein CBG12179 [Caenorhabditis briggsae]
  Gene Ontology: Mol. function=translation elongation factor activity; Cellular component=mitochondrion; Biological process=translational elongation
  Essential gene: C elegans homolog=C43E11.4; Phenotype=Emb,Sck,Stp
  Coding regions on vcDNA: vcDNA=SeqID_50373; Strand=+; Position=1-954
QRSVFSLSRRFYVSYAQPQQKVQTYKREKPHLNVGTIGHVDHGKTTLSAAITKVLSRQKKARFVSYEDIDKGAEERARGVTINIAHIEYESDNRHYAHTDCPGHIDFIKNMITGTAQMDSAVLVIAADDGVMPQTREHLLLAKQIGLREIIVFVNKTDLVDTDVMELVEIEARELLTAYGFDGENAKIVFGSALRALADDDDKCILELINALDGLEEPVRTENGPFLMPISSKCKITGRGSVLIGTIESGTVKKGDTLELLGQEYAQKTLIADIHVFGKSTAQSSAGEHVGLLCKNLYYDPISRGFWLTKPGTVTPTN

SEQ ID NO: 123951 - protein, 165 aa, Heterodera glycines
  Homolog annotation: Hit_ID=CAE63314.1; Match level="QueryCoverage =84%, HitCoverage=31%, E-value=1e-40, Identity=60%"; Hit description =Hypothetical protein CBG07704 [Caenorhabditis briggsae]
  Gene Ontology: Mol. function=arylformamidase activity; Biological process=nicotinamide adenine dinucleotide biosynthesis
  Essential gene: C elegans homolog=F28H6.3; Phenotype=Unclassified
  Coding regions on vcDNA: vcDNA=SeqID_50374; Strand=+; Position=50-544
MRHSAYFVERKFRLISFHFLRRFLSTSAMPTKPSRHSPSKIVHGAGKSIWVEFTALAVECNAVNLGQGFTDSPMPDFLTRHLADIGKSPERTDFHQYTRGYGHPRLVSVLAKLYSRLLSVSVDAQSEVLITVGAYLSLYYAFMGWLNAGDEAIIFEPAYDSYVSQ

SEQ ID NO: 123952 - protein, 165 aa, Heterodera glycines
  Homolog annotation: Hit_ID=AAL78223.1; Match level="QueryCoverage =100%, HitCoverage=68%, E-value=9e-89, Identity=99%"; Hit description= hypothetical protein Hgg-29 [Heterodera glycines]
  Essential gene: C elegans homolog=ZC373.5; Phenotype=Unc
  Coding regions on vcDNA: vcDNA=SeqID_50375; Strand=+; Position=8-502
MRDLFIEDNSPITPARLAELIRHFYALGWMRDNGGGMAVLCNGAVFGSPTSVQKEKVSENDLFVIDATTGTVLKRPQNAASVPSATCGLLMNTGLNCVIHTHSKYANLVSQLVTGNEFAIQNQEMIQGVENRSSGLRLDNVDRLVVPIVDSELNEQMLSPVLLRT

SEQ ID NO: 123953 - protein, 294 aa, Heterodera glycines
  Homolog annotation: Hit_ID=CAA52188.1; Match level="QueryCoverage =98%, HitCoverage=50%, E-value=4e-51, Identity=37%"; Hit description =lamin [Caenorhabditis elegans] pir||S42257 lamin - Caenorhabditis elegans
  Gene Ontology: Mol. function=protein binding; Cellular component =lamin filament; Biological process=pronuclear envelope synthesis
  Essential gene: C elegans homolog=DY3.2; Phenotype=Emb
  Coding regions on vcDNA: vcDNA=SeqID_50376; Strand=+; Position=33-914
MASKSKRTTRSQREAAIHIDASADETIESSSNGSTINSSSGHLSSRQDEKNHLCNLNDRLAGYIERVRSLETENARLQIQVREVEVVERKEKENLSARYEIKIDELRKQLEFFTREKAKLQIESDKAQSGFEELKARVGKLEKDLRKAEKERTAAQADVQELTARFNNTDTALGNAEREIEQLRNEFNNSENMVDMLRRQLEDEVLLRTELENRLHTAKDDLDFARRSHSNQIEEIRRKRQVEMTSFSDEVEHRYQAKLQEQLQAMRDDFDNRIAQNRAEVDELYRNKLGEAVE

SEQ ID NO: 123954 - protein, 140 aa, Heterodera glycines
  Homolog annotation: Hit_ID=NP_506079.1; Match level="QueryCoverage =62%, HitCoverage=26%, E-value=9e-14, Identity=43%"; Hit description =putative mitochondrial translation elongation factor Ts, with ubiquitin associated domain (34.1 kD) (5M75
  Gene Ontology: Cellular component=mitochondrion
  Essential gene: C elegans homolog=F55C5.5; Phenotype=Lva
  Coding regions on vcDNA: vcDNA=SeqID_50377; Strand=+; Position=1-420
RTADEAIVATVSKVGENIQLARASVISSSPANKLFGQTHPKEEFNGVQLGRFISLVSLGHKSDESVSDFPTAQLGQVICQHIIGMAPESLGEPRKKGAKRATQMEIVDNGEGTEKERSANAENESDTGEEEDLNASQVDQ

SEQ ID NO: 123955 - protein, 266 aa, Heterodera glycines
  Homolog annotation: Hit_ID=NP_741153.1; Match level="QueryCoverage =100%, HitCoverage=48%, E-value=1e-109, Identity=74%"; Hit description=chaperonin Containing TCP-1 (58.9 kD) (cct-6) [Caenorhabditis elegans] gb|AAC46642.1| Chaperonin contai
  Gene Ontology: Mol. function=chaperone activity; Cellular component =cytoplasm; Biological process=protein folding
  Essential gene: C elegans homolog=F01F1.8a; Phenotype=Emb
  Coding regions on vcDNA: vcDNA=SeqID_50378; Strand=+; Position=55-852
MASIACLNPKAELARHAAALEMNISGAKGLQEVMKTNLGPKGTLKMLVSGSGDLKVTKDGNVLLHEMQIQHPTASLIAKACTAQNDVTGDGTTSTVLLIGELLKQAENYVSEGVHPHLVTEGFQLAHDHLLQLLAVSKKALLIDRPLLIEVARTTLRTKLDQKLADHVTECVVDAVLAIRRDENDTEPDLHMIEIQQMEHEMETDTQLIRGLVLDHGGRHPDMPKSVRNVHILTCNVSLEFEKTEVNSGLFYETAAERERLLQAER

SEQ ID NO: 123956 - protein, 160 aa, Heterodera glycines
  Homolog annotation: Hit_ID=CAE57581.1; Match level="QueryCoverage =97%, HitCoverage=35%, E-value=2e-32, Identity=44%"; Hit description =Hypothetical protein CBG00560 [Caenorhabditis briggsae]
  Gene Ontology: Mol. function=ATPase activity; Cellular component =mitochondrial inner membrane; Biological process=aerobic respiration
  Essential gene: C elegans homolog=F54C9.6; Phenotype=Gro
  Coding regions on vcDNA: vcDNA=SeqID_50379; Strand=+; Position=2-481
YVRNMCTHLELSNKDQDYQWGLDFINKQSQLITNQLSVSSTELISESGKASTQFFFMPGQGHHFMSYGGRLVRVERERTEQMLQRADKRRTPLETVRLTTIGVKPEFWRQMLEKAAKDALSEVETGLAVYTPFGPEWHHFGKPLKKQPLDTIVLDNGIRE

SEQ ID NO: 123957 - protein, 140 aa, Heterodera glycines; identical to SEQ ID NO: 122293
  Homolog annotation: Hit_ID=NP_498231.1; Match level="QueryCoverage =100%, HitCoverage=100%, E-value=2e-70, Identity=92%"; Hit description=ribosomal Protein, Large subunit (15.0 kD) (rpl-23) [Caenorhabditis elegans] gb|AAK18857.1| Ribosomal p
  Gene Ontology: Cellular component=cytosolic ribosome (sensu Eukarya); Biological process=protein biosynthesis
  Essential gene: C elegans homolog=B0336.10; Phenotype=Emb,Ste
  Coding regions on vcDNA: vcDNA=SeqID_50380; Strand=+; Position=27-449

SEQ ID NO: 123958 - protein, 267 aa, Heterodera glycines
  Homolog annotation: Hit_ID=AAN78300.1; Match level="QueryCoverage =94%, HitCoverage=38%, E-value=1e-141, Identity=100%"; Hit description=heat shock protein 70 A [Heterodera glycines]
  Gene Ontology: Mol. function=non-chaperonin molecular chaperone ATPase activity; Cellular component=intracellular; Biological process=reproduction
  Essential gene: C elegans homolog=F26D10.3; Phenotype=Lva,Ste
  Coding regions on vcDNA: vcDNA=SeqID_50381; Strand=+; Position=2-802
STFKAFSKCHLKLCTFIDLGTTYSCVGVFQHGKVEIIANDQGNRTTPSYVAFTDTERLIGDAAKNQVAMNPSNTVFDAKRLIGRKFDDPAVQSDMKHWPFKVVQGEGARPKVMVEVKGEDKAFFPEEVSSMVLIKMKETAEAFLGQTVTDAVVTVPAYFNDSQRQATKDAGTIAGLNVLRIINEPTAAAIAYGLDKKGQGERHVLIFDLGGGTFDVSILTIEDGIFEVKSTAGDTHLGGEDFDNRMVNHFVAEFKRKHKKDLSSNPR

SEQ ID NO: 123959 - protein, 180 aa, Heterodera glycines
  misc_feature (144)..(144): Xaa can be any naturally occurring amino acid
  misc_feature (162)..(162): Xaa can be any naturally occurring amino acid
  Homolog annotation: Hit_ID=AAK71499.1; Match level="QueryCoverage =99%, HitCoverage=99%, E-value=2e-69, Identity=74%"; Hit description =translationally controlled tumor protein-like protein [Wuchereria bancrofti] sp|Q962A2|TCTP_WUCBA Translat
  Essential gene: C elegans homolog=F25H2.11; Phenotype=Gro,Stp,Unc
  Coding regions on vcDNA: vcDNA=SeqID_50382; Strand=+; Position=74-615
MIIYKDAFTDDELASDSFPMKLVDDLIYEFKGRHVVRKEGEITMSGANPSAEEIDEGTEEAVERGIDFVLNHRLQEMNCYENQATFKGYVKDFMKKIIEYMEKEQKSADEIAAFKKKIQAWVVSLLAKDRFKNLAFFIGENMAXEGKGEGQVAIVEYRQGEXEEVPTLMLIKEALIVEKC

SEQ ID NO: 123960 - protein, 209 aa, Heterodera glycines; identical to SEQ ID NO: 122397
  Homolog annotation: Hit_ID=NP_496549.1; Match level="QueryCoverage =99%, HitCoverage=99%, E-value=4e-92, Identity=78%"; Hit description =RAB family member (23.4 kD) (rab-7) [Caenorhabditis elegans] emb|CAA91357.1| Hypothetical protein W03C9.3
  Gene Ontology: Mol. function=ATP binding; Cellular component=Golgi apparatus; Biological process=embryogenesis and morphogenesis
  Essential gene: C elegans homolog=W03C9.3; Phenotype=Unclassified
  Coding regions on vcDNA: vcDNA=SeqID_50383; Strand=+; Position=55-684

SEQ ID NO: 123961 - protein, 88 aa, Heterodera glycines
  misc_feature (60)..(60): Xaa can be any naturally occurring amino acid
  Homolog annotation: Hit_ID=NP_492601.1; Match level="QueryCoverage =88%, HitCoverage=65%, E-value=7e-14, Identity=44%"; Hit description =cytochrome C Oxidase, subunit Vb, LiPid Depleted LPD-4 (lpd-4) [Caenorhabditis elegans] emb|CAB03002.1| H
  Gene Ontology: Biological process=negative regulation of FGF receptor signaling pathway
  Essential gene: C elegans homolog=F26E4.9; Phenotype=Lpd
  Coding regions on vcDNA: vcDNA=SeqID_50384; Strand=-; Position=1-263
MTMNRLLSGRSLLPKIMRNFSHSNRLAASEADPEHYGYFPDPTEQTWGLEREMLAARPKXYYRAEHSTKDVPNVVRVHLEDKVVGCLC

SEQ ID NO: 123962 - protein, 262 aa, Heterodera glycines; identical to SEQ ID NO: 122253
  Homolog annotation: Hit_ID=CAF90706.1; Match level="QueryCoverage =100%, HitCoverage=100%, E-value=1e-106, Identity=72%"; Hit description=unnamed protein product [Tetraodon nigroviridis]
  Gene Ontology: Mol. function=structural constituent of ribosome; Cellular component=eukaryotic 48S initiation complex; Biological process=protein biosynthesis
  Essential gene: C elegans homolog=F56F3.5; Phenotype=Emb,Ste
  Coding regions on vcDNA: vcDNA=SeqID_50385; Strand=+; Position=176-964

SEQ ID NO: 123963 - protein, 92 aa, Heterodera glycines; identical to SEQ ID NO: 122591
  Homolog annotation: Hit_ID=EAA04924.2; Match level="QueryCoverage =93%, HitCoverage=95%, E-value=2e-36, Identity=81%"; Hit description =ENSANGP00000018702 [Anopheles gambiae str. PEST]
  Essential gene: C elegans homolog=W01D2.1; Phenotype=Gro
  Coding regions on vcDNA: vcDNA=SeqID_50386; Strand=+; Position=31-309

SEQ ID NO: 123964 - protein, 132 aa, Heterodera glycines
  Homolog annotation: Hit_ID=BAC25377.1; Match level="QueryCoverage =93%, HitCoverage=86%, E-value=1e-44, Identity=70%"; Hit description =unnamed protein product [Mus musculus]
  Gene Ontology: Mol. function=structural constituent of ribosome; Cellular component=eukaryotic 48S initiation complex; Biological process=protein biosynthesis
  Essential gene: C elegans homolog=T08B2.10; Phenotype=Lva
  Coding regions on vcDNA: vcDNA=SeqID_50387; Strand=+; Position=40-438
MVGRVRTKTVKKASRVIIEKYYTKLTNDFHTNKRICEEVAIVPSKKMRNRIAGFITHLMKRIERGPVRGISIKLQEEERERRDNYMPEISYLDAQNHQTISTDQETKDMIEYLGLGLNLEVKGPVPTGAGRR

SEQ ID NO: 123965 - protein, 158 aa, Heterodera glycines
  Homolog annotation: Hit_ID=EAL25231.1; Match level="QueryCoverage =89%, HitCoverage=37%, E-value=2e-30, Identity=45%"; Hit description =GA21281-PA [Drosophila pseudoobscura]
  Gene Ontology: Mol. function=structural molecule activity; Cellular component=nuclear pore; Biological process=NLS-bearing substrate -nucleus import
  Essential gene: C elegans homolog=Y43F4B.4; Phenotype=Him
  Coding regions on vcDNA: vcDNA=SeqID_50388; Strand=+; Position=3-476
MLPFEVQHFSTGTADTAPSFHADTIHHVEFDFYGQRVATVSSDKTVCIWDKDTQNGAWRKSASWKKHGGAVWKVRFAHPEYGQVLATCSFDNTIQIFDKDAADLSEIRPITGADSSNGWACRTVLRQSNASASITDIQFAPHYLGLQLAACTSSGRLI

SEQ ID NO: 123966 - protein, 163 aa, Heterodera glycines; identical to SEQ ID NO: 122256
  Homolog annotation: Hit_ID=XP_393173.1; Match level="QueryCoverage =98%, HitCoverage=14%, E-value=2e-79, Identity=94%"; Hit description =similar to Hypothetical protein CBG09037 [Apis mellifera]
  Essential gene: C elegans homolog=F25B5.4a; Phenotype=Emb
  Coding regions on vcDNA: vcDNA=SeqID_50389; Strand=+; Position=1-492

SEQ ID NO: 123967 - protein, 310 aa, Heterodera glycines
  Homolog annotation: Hit_ID=CAE59414.1; Match level="QueryCoverage =100%, HitCoverage=40%, E-value=1e-111, Identity=62%"; Hit description=Hypothetical protein CBG02783 [Caenorhabditis briggsae]
  Gene Ontology: Mol. function=translation elongation factor activity; Cellular component=mitochondrion; Biological process=translational elongation
  Essential gene: C elegans homolog=F29C12.4; Phenotype=Lva
  Coding regions on vcDNA: vcDNA=SeqID_50390; Strand=+; Position=3-932
LVEELAFFNEVEDGSVLRKEEIPQEYREEAKILRQELLENLANCDDVIAECYLNEVTPSVKEIKEAIRRATIKRSFVPVLVGSALKNKGVQQMIDAIVHYLPNPSEVDNFVNLYDKNDNAERVLMDPLRTANSEKQKPFIGLAFKLEAGNFGQLTYFRIYQGRLVKGDTIYATRDGRKVRIQRLVRMHANTMEDVDVAYAGDICATFGVDCFSGETFCSDEQLRVHCESMHIPDPVISMSIKPIGKRDMENYLRALKRFAKEDPTFKLFYSKEHKETVVSGMGELHLEIYAQRMGNEYNCPVELGRPTVS

SEQ ID NO: 123968 - protein, 340 aa, Heterodera glycines; identical to SEQ ID NO: 122299
  Homolog annotation: Hit_ID=CAE65161.1; Match level="QueryCoverage =93%, HitCoverage=80%, E-value=4e-68, Identity=40%"; Hit description =Hypothetical protein CBG10030 [Caenorhabditis briggsae]
  Gene Ontology: Mol. function=DNA primase activity; Cellular component= alpha DNA polymerase:primase complex; Biological process =embryogenesis and morphogenesis
  Essential gene: C elegans homolog=F58A4.4; Phenotype=Emb
  Coding regions on vcDNA: vcDNA=SeqID_50391; Strand=+; Position=1-1023

SEQ ID NO: 123969 - protein, 160 aa, Heterodera glycines
  Homolog annotation: Hit_ID=NP_502033.2; Match level="QueryCoverage =83%, HitCoverage=10%, E-value=2e-17, Identity=34%"; Hit description =ortholog of Glued p150, DyNactin Complex component DNC-1 (148.4 kD) (dnc-1) [Caenorhabditis elegans] emb|
  Essential gene: C elegans homolog=ZK593.5; Phenotype=Clr,Emb,Rup,Sck
  Coding regions on vcDNA: vcDNA=SeqID_50392; Strand=+; Position=2-481
ELPPSAKDGDPTRNGSPLTINGNPFVPLNERAYGRKKEAVEADGIRWQLAKKDEELLNLQKALKERDSEIGTMKLRVEMAKTQLAETTGKGGISVEMELLRQRCTGLENDLKRQKDEYEQQLDQLRQQLAEEHNRTREFSKKALFANMQNQQQQAAASAL

SEQ ID NO: 123970 - protein, 225 aa, Heterodera glycines; identical to SEQ ID NO: 122719
  Homolog annotation: Hit_ID=NP_495681.3; Match level="QueryCoverage =98%, HitCoverage=52%, E-value=3e-57, Identity=47%"; Hit description =Spliceosome-Associated Protein, and actin related protein (47.5 kD) (sap-49C) [Caenorhabditis elegans] gb
  Gene Ontology: Mol. function=transporter activity; Cellular component= actin filament; Biological process=transport
  Essential gene: C elegans homolog=C08B11.6; Phenotype=Emb
  Coding regions on vcDNA: vcDNA=SeqID_50393; Strand=+; Position=147-821

SEQ ID NO: 123971 - protein, 341 aa, Heterodera glycines
  Homolog annotation: Hit_ID=CAC00543.1; Match level="QueryCoverage =98%, HitCoverage=70%, E-value=2e-96, Identity=55%"; Hit description =necepsin II [Necator americanus]
  Gene Ontology: Mol. function=aspartic-type endopeptidase activity; Cellular component=lysosome; Biological process=induction of non -apoptotic programmed cell death
  Essential gene: C elegans homolog=R12H7.2; Phenotype=Ced
  Coding regions on vcDNA: vcDNA=SeqID_50394; Strand=+; Position=1-1023
MLSKITVVLAFLCLLLALLVGIDAQQSQWEQKQNRAAPRGLASVTLRRMDTVRSRLAAAGSLVQFRKHLRQALRQRLDRLYSDKMARADVAFDTDAAAREGIDEVLRNYMDAQYYGDISIGSPPQNFTVIFDTGSSNLWVPSKKCSFFDLACRYHSKYDHKKSSTYQPDGREVAIEYGTGSMKGFVSKDTVCIMDGMCVEGQEFAEATSEPGDTFVNTKADGILGMAYPGISVQKLSTVFNNLVEQKEVEEPVFAFWLNRDPSYEFGGQMTVGGMDKRRFVEPINYVPVTRQTYWQFKMDSVTGGQNGKSKIACRNGCQAIADTGTSLITGPQKDVEAIHK

SEQ ID NO: 123972 - protein, 35 aa, Heterodera glycines
  Homolog annotation: Hit_ID=AAC79129.1; Match level="QueryCoverage =100%, HitCoverage=10%, E-value=2e-11, Identity=94%"; Hit description= glyceraldehyde-3-phosphate-dehydrogenase [Globodera rostochiensis] sp|O16027|G3P1_GLORO Glyceraldehyde-3-
  Essential gene: C elegans homolog=K10B3.7; Phenotype=Unclassified
  Coding regions on vcDNA: vcDNA=SeqID_50395; Strand=+; Position=148-252
MVKPKVGINGFGRIGRLALRAAIEKDTVQVVAVND

SEQ ID NO: 123973 - protein, 182 aa, Heterodera glycines
  Homolog annotation: Hit_ID=NP_495445.2; Match level="QueryCoverage =100%, HitCoverage=46%, E-value=2e-54, Identity=59%"; Hit description= probable rna phosphate cyclase-like protein (41.6 kD) (2H339) [Caenorhabditis elegans] gb|AAB93426.2| Hy
  Gene Ontology: Mol. function=RNA-3'-phosphate cyclase activity; Cellular component=nucleolus; Biological process=35S primary transcript processing
  Essential gene: C elegans homolog=ZK1127.5; Phenotype=Emb,Lva
  Coding regions on vcDNA: vcDNA=SeqID_50396; Strand=+; Position=3-548
KIRGLAYVCKVTPSIASRMIDGAKKMLHGNISDIYITIDQRKGPQGGLSPGFGIFLTAETTEGVFFHGEAMSRPKGQNEDQTVPEEIGEQAARRLLDEIHMGGCADSSCQSLAATFMTLCDRDVSKFLLGPLTINSVHTLRNLQMFFEQMFKLEEWWKVMKEIVGKGGNAMKNGSEDKCLMT

SEQ ID NO: 123974 - protein, 146 aa, Heterodera glycines
  Homolog annotation: Hit_ID=P22085; Match level="QueryCoverage=71%, HitCoverage=64%, E-value=5e-17, Identity=35%"; Hit description =Onchocystatin precursor (Cysteine proteinase inhibitor OV7) pir||A43428 onchocystatin - nematode (Onchocerca v
  Gene Ontology: Mol. function=cysteine protease inhibitor activity; Cellular component=extracellular space; Biological process =reproduction
  Essential gene: C elegans homolog=R01B10.1a; Phenotype=Ste
  Coding regions on vcDNA: vcDNA=SeqID_50397; Strand=+; Position=23-463
MRFQKAKFAIFRLNSHQIFILLLLLIKLAMTDQQNSIVGGWTEQNVNDEKIKSLASRSVAKINSESNDRFSLFPLEVLSAKSQVVAGIQYQLRIKVGRSNCSKNQSNLADHANCATEDDQTARKTFLVTIWEKPWEQFEQITYKLE

SEQ ID NO: 123975 - protein, 500 aa, Heterodera glycines
  misc_feature (402)..(402): Xaa can be any naturally occurring amino acid
  Homolog annotation: Hit_ID=CAE60648.1; Match level="QueryCoverage =91%, HitCoverage=91%, E-value=1e-124, Identity=51%"; Hit description= Hypothetical protein CBG04294 [Caenorhabditis briggsae]
  Gene Ontology: Mol. function=proteasome endopeptidase activity; Cellular component=proteasome regulatory particle (sensu Eukarya); Biological process=proteolysis and peptidolysis
  Essential gene: C elegans homolog=F10G7.8; Phenotype=Emb
  Coding regions on vcDNA: vcDNA=SeqID_50398; Strand=+; Position=19-1522
MDPFHRNEAKVEVAVEPPTAIDQRVDDIMQTGRFGDGRLVKMEVDYSAQVDSQLIVADNLAKEGKTAEAIESLEKLEKDRRINCDMRSNQRLLCHMVKLAFDANNWQLLCETAKTLCKKRLLIKSSIKKMVQECCEMVPKAPDASSKSTLIDTLRAVTAGKIYLEVERARLTKQVAEKLEAEGKLDEAREMMMELQVETYGTMEVEEKVNYLLHQMRLSIANNHFTRASIISRKISTKFFEREGTQVQLMKLEFYKYMVQIGLSENNYLDVCKHFLAILNTPQIQENNVKKIEILKCVVFYLLLSAHDNEKWELLHRVNAMRELEQIPKHKELLELFIHQELIFWSKTIESEFAPILFAAQPPVEVISDSFLPSTHVFPMTKEDGQKRRERLHDCVGEHNVXMVAKYYSRITFQRMAKLLEFGIEQMEAFVCKMIVDGVIPEVKIHRPSQIIYLSPKKNGAEVLDEWVFNVRKLTDTMNKVSQLIAKEEMVHGLQISQRI

SEQ ID NO: 123976 - protein, 149 aa, Heterodera glycines
  Homolog annotation: Hit_ID=CAE64461.1; Match level="QueryCoverage =92%, HitCoverage=32%, E-value=3e-59, Identity=79%"; Hit description =Hypothetical protein CBG09177 [Caenorhabditis briggsae]
  Gene Ontology: Mol. function=RNA helicase activity; Cellular component=cytoplasm; Biological process=anti-apoptosis
  Essential gene: C elegans homolog=C07H6.5; Phenotype=Emb
  Coding regions on vcDNA: vcDNA=SeqID_50399; Strand=+; Position=32-478
MSAAVSSSRPMEDWKSELAMPDKDLRYKTSDVTATKGVEFEEFGLTRDLLKGIFEKGWEHPSPVQEASIGIALTGQDILARAKNGTGKTGAYCIPCIEKIDPSKEYIQAMIIVPTRELALQTSQICVELSKHLKIKIMVTTGGTDLRDD

SEQ ID NO: 123977 - protein, 312 aa, Heterodera glycines
  Homolog annotation: Hit_ID=CAE73046.1; Match level="QueryCoverage =88%, HitCoverage=61%, E-value=1e-100, Identity=62%"; Hit description= Hypothetical protein CBG20416 [Caenorhabditis briggsae]
  Gene Ontology: Mol. function=[RNA-polymerase]-subunit kinase activity; Cellular component=polytene chromosome puff; Biological process=RNA elongation from Pol II promoter
  Essential gene: C elegans homolog=H25P06.2a; Phenotype=Emb,Gro,Unc
  Coding regions on vcDNA: vcDNA=SeqID_50400; Strand=+; Position=336 -1271
MLEMNGVGNSKDYDTKVKAILEQCRISQKLLNYTEHFNYPYVSEVTYYEQLLKIGQGTFGEVFKARCKRTGKLVALKKILMENEKEGFPITALREIKMLQRLRHQHITELVEVCTSKQKSGKEKFCFYLVFTFCEHDLAGLLSNTQVKIRLVDIKTMMQHILRGLHKIHSSQILHRDMKAANVLITGDGVLKLADFGLARIMYKQPEHCYTNRVVTLWYRPPELLLGTRNYGPAIDIWGAGCIMAELWIRAPILQGNTEQSQLELISKLCGSINPHSWPGCDKLPYYNNLQGSLQQNLPRRVRERINPFLQN

SEQ ID NO: 123978 - protein, 154 aa, Heterodera glycines
  Homolog annotation: Hit_ID=NP_502794.1; Match level="QueryCoverage =100%, HitCoverage=100%, E-value=4e-73, Identity=82%"; Hit description=ribosomal Protein, Small subunit (17.8 kD) (rps-18) [Caenorhabditis elegans] emb|CAB16517.1| Hypothetic
  Gene Ontology: Cellular component=mitochondrion
  Essential gene: C elegans homolog=Y57G11C.16; Phenotype=Ste
  Coding regions on vcDNA: vcDNA=SeqID_50401; Strand=+; Position=11-475
MSLIMPEKFQHIHRVMNTNIDGNRKVPYALTAIKGVGRRYAFLVCRKADIDIHKRAGELSEEDMEKLTTVMLNPQQYKIPSWFLNRQKDIRDGKNQQVLSTNLESKYRDDFERMKKIRLHRGLRHYWGLRVRGQHTKTTGRKGRTVGVSKKKGG

SEQ ID NO: 123979 - protein, 184 aa, Heterodera glycines; identical to SEQ ID NO: 122376
  Homolog annotation: Hit_ID=CAE66979.1; Match level="QueryCoverage =84%, HitCoverage=91%, E-value=8e-31, Identity=44%"; Hit description =Hypothetical protein CBG12375 [Caenorhabditis briggsae]
  Gene Ontology: Biological process=positive regulation of embryonic development
  Essential gene: C elegans homolog=F36A2.7; Phenotype=Emb,Lva
  Coding regions on vcDNA: vcDNA=SeqID_50402; Strand=+; Position=38-592

SEQ ID NO: 123980 - protein, 327 aa, Heterodera glycines; identical to SEQ ID NO: 122740
  Homolog annotation: Hit_ID=CAE70646.1; Match level="QueryCoverage =98%, HitCoverage=93%, E-value=2e-52, Identity=34%"; Hit description =Hypothetical protein CBG17349 [Caenorhabditis briggsae]
  Gene Ontology: Mol. function=zinc ion binding; Cellular component =integral peroxisomal membrane; Biological process=peroxisome organization and biogenesis
  Essential gene: C elegans homolog=F08B12.2; Phenotype=Lva,Unclassified
  Coding regions on vcDNA: vcDNA=SeqID_50403; Strand=+; Position=49-1032

SEQ ID NO: 123981 - protein, 177 aa, Heterodera glycines
  Homolog annotation: Hit_ID=NP_080173.1; Match level="QueryCoverage =96%, HitCoverage=37%, E-value=8e-41, Identity=48%"; Hit description =RIKEN cDNA 1500003O22 [Mus musculus] gb|AAH46799.1| RIKEN cDNA 1500003O22 [Mus musculus] gb|AAH22923.1| R
  Gene Ontology: Biological process=rRNA processing
  Essential gene: C elegans homolog=T07A9.8; Phenotype=Gro
  Coding regions on vcDNA: vcDNA=SeqID_50404; Strand=+; Position=1-531
AESEGAKGDGTEAEGSDRSPLLTSVDVSRFRFLNERLCSQTSASSAKLFEEDPDSFRLYHRGYRHQVSKWPVNPLEKIVLDLGSLPPGSVVADLGCGDAEIAKRLGERLRVHSFDLVASNERVLAADMADLPLEAESVDVCVYCLSLMGTNLAQFFREAHRVLKTHGKIQIGQITKR

SEQ ID NO: 123982 - protein, 123 aa, Heterodera glycines; identical to SEQ ID NO: 122378
  Homolog annotation: Hit_ID=AAK92166.1; Match level="QueryCoverage =98%, HitCoverage=97%, E-value=5e-53, Identity=80%"; Hit description =ribosomal protein L31 [Spodoptera frugiperda] emb|CAC19413.1| ribosomal protein L31 [Heliothis virescens]
  Gene Ontology: Mol. function=structural constituent of ribosome; Cellular component=cytosolic ribosome (sensu Eukarya); Biological process=protein biosynthesis
  Essential gene: C elegans homolog=W09C5.6a; Phenotype=Emb,Ste,Stp
  Coding regions on vcDNA: vcDNA=SeqID_50405; Strand=+; Position=24-395

SEQ ID NO: 123983 - protein, 158 aa, Heterodera glycines
  Homolog annotation: Hit_ID=XP_419990.1; Match level="QueryCoverage =94%, HitCoverage=40%, E-value=1e-55, Identity=66%"; Hit description =PREDICTED: similar to XPA binding protein 1; MBD2 interactor protein; putative ATP(GTP)-binding protein [
  Essential gene: C elegans homolog=C34E10.2; Phenotype=Emb
  Coding regions on vcDNA: vcDNA=SeqID_50406; Strand=+; Position=12-485
MADDKSCDGASSALPPCLIVLGMAGSGKSSFVQRLASHLHSKKVFPYLVNLDPAAATVPFPANIDIRDTVNYKKVMQEYGLGPNGAILTSLNLFCTRFNQVLDLLDRRKGSMPYAIFDTPGQIEVFTWSASGTVITDSLAASFPTVVAYVMDSARSTN

SEQ ID NO: 123984 - protein, 62 aa, Heterodera glycines; identical to SEQ ID NO: 120533
  Homolog annotation: Hit_ID=P30757; Match level="QueryCoverage=100%, HitCoverage=50%, E-value=1e-23, Identity=85%"; Hit description =Histone H2B pir||S16084 histone H2B - sipunculid (Sipunculus nudus)
  Gene Ontology: Mol. function=DNA binding; Cellular component =nucleosome; Biological process=nucleosome assembly
  Essential gene: C elegans homolog=H02I12.6; Phenotype=Gro,Pvl,Ste
  Coding regions on vcDNA: vcDNA=SeqID_50407; Strand=+; Position=58-246

SEQ ID NO: 123985 - protein, 208 aa, Heterodera glycines
  Homolog annotation: Hit_ID=NP_499174.2; Match level="QueryCoverage =99%, HitCoverage=49%, E-value=1e-43, Identity=46%"; Hit description =mannose-6-phosphate isomerase, type I (46.4 kD) (3K896) [Caenorhabditis elegans]
  Gene Ontology: Mol. function=mannose-6-phosphate isomerase activity; Biological process=cell wall mannoprotein biosynthesis
  Essential gene: C elegans homolog=C05C8.7; Phenotype=Emb,Lva
  Coding regions on vcDNA: vcDNA=SeqID_50408; Strand=+; Position=3-626
MKRLECAVQHYAWGKSGKDSFVAHLLPAERVDLDKRYAELWMGTHPNGPSRVIDGGAEASTNLKDFLAQNPQLLGHHEKGELSFLFIILSVDKALSIQSHPTKEQAKVLHAKDPANYPDDNHKPEMAIALTDFELLCGFQTPHGIISNVKAHRELLQLVGEPLLDELAQAEHHEPDWGERALRRMFCQVWTSPAEQIAHVVAQIVDRL

SEQ ID NO: 123986 - protein, 159 aa, Heterodera glycines
  Homolog annotation: Hit_ID=NP_493580.1; Match level="QueryCoverage =98%, HitCoverage=34%, E-value=6e-19, Identity=32%"; Hit description =putative mitochondrial protein, with 3 coiled coil domains, of bilaterial origin (48.2 kD) (1P387) [Caeno
  Essential gene: C elegans homolog=K11B4.1; Phenotype=Emb,Lva
  Coding regions on vcDNA: vcDNA=SeqID_50409; Strand=+; Position=2-478
NYGIFPNEHICCMFLDHFLGSAQLQYAAKIAIYVMLQEMFDFPLLTFLATRALLEWTQGERKLDEQIHPKMAPSLEDETNFNEENVRLFRYPFLKNPFWDGHFDENDSDRMAGKALEWLSYHLKLAKNDETNYDETLIRVIRLLGLSIQRKWTEAKSLA

SEQ ID NO: 123987 - protein, 74 aa, Heterodera glycines; identical to SEQ ID NO: 122797
  Homolog annotation: Hit_ID=AAR85527.1; Match level="QueryCoverage =100%, HitCoverage=100%, E-value=7e-17, Identity=71%"; Hit description=14-3-3b protein [Meloidogyne incognita]
  Gene Ontology: Mol. function=protein domain specific binding; Biological process=protein targeting
  Essential gene: C elegans homolog=M117.2; Phenotype=Emb
  Coding regions on vcDNA: vcDNA=SeqID_50410; Strand=+; Position=36-260

SEQ ID NO: 123988 - protein, 213 aa, Heterodera glycines
  Homolog annotation: Hit_ID=NP_490675.1; Match level="QueryCoverage =82%, HitCoverage=81%, E-value=4e-70, Identity=78%"; Hit description =RAB family member (23.4 kD) (rab-11.1) [Caenorhabditis elegans] gb|AAB54158.1| Rab family protein 11.1 [C
  Gene Ontology: Mol. function=GTPase activity; Cellular component =Golgi apparatus; Biological process=signal transduction
  Essential gene: C elegans homolog=F53G12.1; Phenotype=Emb,Ste
  Coding regions on vcDNA: vcDNA=SeqID_50411; Strand=+; Position=27-665
KCRIEDEYDYLFKVVLIGDSGVGKSNLLSRFTRNEFNLESKSSAGVELFFEFSPSIKVDGKTMKAQIWDTAGQERHQPIVSAFYRRAVGALLVYDISVRLTYENVGRWLKELRDHSDPNIVIMLVGNKSDLGNLRAVPTDEANAYAERNQMAFIETSALDGTNVGAAFTNILTTICRSQSTTAGSTPKIDINDDLIDEDALLEPEDLQRPEQS

SEQ ID NO: 123989 - protein, 329 aa, Heterodera glycines; identical to SEQ ID NO: 122086
  Homolog annotation: Hit_ID=Q8BK63; Match level="QueryCoverage=93%, HitCoverage=91%, E-value=1e-158, Identity=87%"; Hit description =Casein kinase I, alpha isoform (CKI-alpha) (CK1) sp|P48729|KC1A _HUMAN Casein kinase I, alpha isoform (CKI-alp
  Gene Ontology: Mol. function=casein kinase I activity; Cellular component=nucleus; Biological process=signal transduction
  Essential gene: C elegans homolog=C03C10.1; Phenotype=Emb
  Coding regions on vcDNA: vcDNA=SeqID_50412; Strand=+; Position=80-1069

SEQ ID NO: 123990 - protein, 154 aa, Heterodera glycines
  Homolog annotation: Hit_ID=CAE58998.1; Match level="QueryCoverage =85%, HitCoverage=18%, E-value=8e-24, Identity=48%"; Hit description =Hypothetical protein CBG02271 [Caenorhabditis briggsae]
  Essential gene: C elegans homolog=R05F9.1a; Phenotype=Unc
  Coding regions on vcDNA: vcDNA=SeqID_50413; Strand=+; Position=84-545
MMKHTTSSSSSNSGDAKDSSCHRNQRSMSLGGPAHESLLSKQHSSSPPQTVELSRADNGDCVVLVVENTRFIVNPALLVVKPDTMLGRMFSLRARTGGGTNTLSVPSSSSSANDPGADRGSPSDLVRPNERNEYDVAEGLSAACFRVVMDFYHR

SEQ ID NO: 123991 - protein, 216 aa, Heterodera glycines
  misc_feature (179)..(179): Xaa can be any naturally occurring amino acid
  Homolog annotation: Hit_ID=A48463; Match level="QueryCoverage=97%, HitCoverage=98%, E-value=1e-110, Identity=89%"; Hit description=Ras -like GTP-binding protein - nematode (Brugia malayi) sp|P38542|RAN _BRUMA GTP-binding nuclear protein Ran (
  Gene Ontology: Mol. function=RAN small monomeric GTPase activity; Cellular component=nucleus; Biological process=embryogenesis and morphogenesis
  Essential gene: C elegans homolog=K01G5.4; Phenotype=Emb
  Coding regions on vcDNA: vcDNA=SeqID_50414; Strand=+; Position=55-706
MNQEQDNIPTFKLVLVGDGGTGKTTFVKRHLTGEFEKKYIATLGVEVHPLTFHTSRGQIRFNVWDTAGQEKFGGLRDGYYIQGQCAIVMFDVTARVTYKNVPNWHRDLVRVCENIPIVLVGNKVDVKDRKVKAKSITFHRKKNLQYYDISAKSNYNFEKPFLYLARKLIGDPNLEFVGXPALAPPEVQMDPALAAKYEQEVAEAASAELPDDDEDI

SEQ ID NO: 123992 - protein, 111 aa, Heterodera glycines; identical to SEQ ID NO: 122367
  Homolog annotation: Hit_ID=AAN05584.1; Match level="QueryCoverage =95%, HitCoverage=92%, E-value=1e-42, Identity=80%"; Hit description =ribosomal protein L30 [Argopecten irradians]
  Gene Ontology: Cellular component=cytosolic ribosome (sensu Eukarya); Biological process=protein biosynthesis
  Essential gene: C elegans homolog=Y106G6H.3; Phenotype=Emb,Lva
  Coding regions on vcDNA: vcDNA=SeqID_50415; Strand=+; Position=117-452

SEQ ID NO: 123993 - protein, 131 aa, Heterodera glycines
  Homolog annotation: Hit_ID=NP_741323.1; Match level="QueryCoverage =98%, HitCoverage=96%, E-value=5e-32, Identity=48%"; Hit description =CCHC type  zinc finger containing protein (15.6 kD) (4C475) [Caenorhabditis elegans] gb|AAK84542.1| Hypot
  Gene Ontology: Mol. function=RNA helicase activity; Cellular component=cytoplasm; Biological process=cell cycle
  Essential gene: C elegans homolog=K08D12.3a; Phenotype=Unc
  Coding regions on vcDNA: vcDNA=SeqID_50416; Strand=+; Position=74-466
MSANTECYRCHEFGHISRDCPNAGRSGGGGGGGGGSRGGGGETKCYNCGRSGHFARECRDAGDRDRGRGGGGGGGGRGGDDRGSKCYNCGGYGHFARECRDERSASGGGRGGRDDRDDRGNKCYNCGKSGH

SEQ ID NO: 123994 - protein, 105 aa, Heterodera glycines
  Homolog annotation: Hit_ID=XP_319892.1; Match level="QueryCoverage =100%, HitCoverage=86%, E-value=2e-22, Identity=49%"; Hit description= ENSANGP00000010639 [Anopheles gambiae]
  Gene Ontology: Biological process=positive regulation of growth rate
  Essential gene: C elegans homolog=B0334.5; Phenotype=Gro
  Coding regions on vcDNA: vcDNA=SeqID_50417; Strand=+; Position=1-318
LFWRILCSLSVLSLAHCAYSAAQHRSYLRLVGQPFTHLPADLTTQTLLSLLFAIVSASFVVGDFQPIRTDLLISKKSWDVLGNCPSFYVFNHRAKCLMPKFDDID

SEQ ID NO: 123995 - protein, 128 aa, Heterodera glycines
  misc_feature (119)..(119): Xaa can be any naturally occurring amino acid
  Homolog annotation: Hit_ID=CAE59572.1; Match level="QueryCoverage =91%, HitCoverage=24%, E-value=9e-49, Identity=77%"; Hit description =Hypothetical protein CBG02970 [Caenorhabditis briggsae]
  Gene Ontology: Mol. function=NADH dehydrogenase (ubiquinone) activity; Cellular component=mitochondrial inner membrane; Biological process=energy pathways
  Essential gene: C elegans homolog=C09H10.3; Phenotype=Emb,Lva
  Coding regions on vcDNA: vcDNA=SeqID_50418; Strand=+; Position=36-418
MVSMVAGRVHLLPRAASFGKSFLSSDATKKPDKTSFGNLNDSDRIFTNLYGRHDYRLKGALARGDWFKTKDIILKGPKWILGEISTSGLRGRGGAGFPSGMKWGFMGKPFDGRPKYLVXNADEGEPGT

SEQ ID NO: 123996 - protein, 272 aa, Heterodera glycines
  Homolog annotation: Hit_ID=CAE57911.1; Match level="QueryCoverage =97%, HitCoverage=83%, E-value=4e-93, Identity=63%"; Hit description =Hypothetical protein CBG00961 [Caenorhabditis briggsae]
  Gene Ontology: Mol. function=rRNA (adenine-N6N6-)-dimethyltransferase activity; Cellular component=nucleoplasm; Biological process=rRNA modification
  Essential gene: C elegans homolog=E02H1.1; Phenotype=Lva
  Coding regions on vcDNA: vcDNA=SeqID_50419; Strand=+; Position=38-853
MANIMKKKKKNAVATTTAGPQKDGGKFKQKGIKFNTEKGQHILKNPGVVHAIVEKSAVKGTDTVLEVGPGTGNLSMKLLDRAGRLIAYELDPKMVAELQKRVVGTPVQYKLRIIAGDVIKAAEWPPFDVCVSNLPYQISSPFIFRLLLQRPLPRYAVLMLQKEFADRLLAKPGSKVYCRLSVSVQLLATVEHLMRVKRSEFVPPPKVDSAVIRIQPRNPPPAINYKEWDGMLRIAFMRKNKTLSALFKQKQVVDVLRKNYAVVCGTKGKEVP

SEQ ID NO: 123997 - protein, 308 aa, Heterodera glycines
  Homolog annotation: Hit_ID=CAE70786.1; Match level="QueryCoverage =93%, HitCoverage=46%, E-value=9e-22, Identity=30%"; Hit description =Hypothetical protein CBG17542 [Caenorhabditis briggsae]
  Gene Ontology: Biological process=embryogenesis and morphogenesis
  Essential gene: C elegans homolog=C37H5.9a; Phenotype=Emb
  Coding regions on vcDNA: vcDNA=SeqID_50420; Strand=+; Position=6-929
MLPIRLLFLLAVPSSAMGRFDLGGLLVNLPQFTRHACVHLSGIFGRMGQQQPNSAHSYDQPPRHFHRGGPPPHHHPDSGSGGGLGNIGGAVEGILSRVGVNPQLANQFGKIQIPPIPSLAVHNVLDGVPGILRQFLPAQTVGQITAIARQAIESICSSDNCLQQRPEWLHQRATVAQFETLIRKTFSPGQSDSQIGRDVEIRLSRTFQVKKALIRKAGLEGRVEPANNGVFQQDLLLTEQQANVLITEINQNEVGVGAVPPSDNRRFSRRHNFNRRRFTRAGNSLFFEASPTQKWPVGQPILYMFDQS

SEQ ID NO: 123998 - protein, 145 aa, Heterodera glycines
  Homolog annotation: Hit_ID=A48466; Match level="QueryCoverage=100%, HitCoverage=32%, E-value=3e-74, Identity=89%"; Hit description =tubulin alpha chain - nematode (Haemonchus contortus)
  Gene Ontology: Mol. function=GTP binding; Cellular component =microtubule; Biological process=microtubule-based process
  Essential gene: C elegans homolog=C47B2.3; Phenotype=Emb
  Coding regions on vcDNA: vcDNA=SeqID_50421; Strand=+; Position=3-440
DPRHGKYMAVCLLYRGDVVPKDVNAAIASIKTNRSIQFVDWCPTGFKVGINYQPPTVVPGGDVAKVPRAVCMLSNTTAIAEAWSRLDHKFDLMYAKRAFVHWYVGEGMEEGEFSEAREDLAALEKDYEEVAIDTVEGDGAGDDDY

SEQ ID NO: 123999 - protein, 167 aa, Heterodera glycines; identical to SEQ ID NO: 122330
  Homolog annotation: Hit_ID=NP_495912.1; Match level="QueryCoverage =100%, HitCoverage=55%, E-value=6e-43, Identity=54%"; Hit description= haymaker protein (32.4 kD) (2J262) [Caenorhabditis elegans] emb|CAA93850.1| Hypothetical protein C18E9.6
  Essential gene: C elegans homolog=C18E9.6; Phenotype=Gro,Sma
  Coding regions on vcDNA: vcDNA=SeqID_50422; Strand=+; Position=3-506

SEQ ID NO: 124000 - protein, 137 aa, Heterodera glycines
  Homolog annotation: Hit_ID=NP_741950.1; Match level="QueryCoverage =100%, HitCoverage=80%, E-value=8e-48, Identity=64%"; Hit description= neuralized, possibly N-myristoylated (XR998) [Caenorhabditis elegans] gb|AAM54201.1| Hypothetical protei
  Gene Ontology: Mol. function=ubiquitin-protein ligase activity; Cellular component=plasma membrane; Biological process=sensory organ precursor cell fate determination
  Essential gene: C elegans homolog=F10D7.5a; Phenotype=Emb,Sck,Ste
  Coding regions on vcDNA: vcDNA=SeqID_50423; Strand=+; Position=2-412
IINRGTIGRPKPLLKFHSVCGTNIQLLREGRVAPRKESFCKGLAFINRPISINEIVCIRLSEIGTNWSGVMRFGVTNVDPASFRDIELPKFACPDLTSKGGYWAKSLAERYSVEGSILHFFTNANGEMYYGVNGVHK

SEQ ID NO: 124001 - protein, 152 aa, Heterodera glycines
  Homolog annotation: Hit_ID=AAH74666.1; Match level="QueryCoverage =100%, HitCoverage=81%, E-value=1e-46, Identity=57%"; Hit description= MGC69249 protein [Xenopus tropicalis] ref|NP_001004848.1| MGC69249 protein [Xenopus tropicalis]
  Gene Ontology: Mol. function=snoRNA binding; Cellular component=small nuclear ribonucleoprotein complex; Biological process=rRNA processing
  Essential gene: C elegans homolog=C48B6.2; Phenotype=Lva,Lvl
  Coding regions on vcDNA: vcDNA=SeqID_50424; Strand=+; Position=24-479
MVRTLKFHEKKLLKKVDFINWPAELDNSLHENKIMRRYHVEKREHYTLYNKLSREIREMAKRIRELDDKNPNKLVLARMLLGKLFDMGVIPTADTLERCDKVTASSFCRRRLPVVCHKMQMAPTVRKSSQLVEQGHVRVGVEMVTDPAFLVT

SEQ ID NO: 124002 - protein, 196 aa, Heterodera glycines
  Homolog annotation: Hit_ID=NP_496500.1; Match level="QueryCoverage =97%, HitCoverage=47%, E-value=2e-55, Identity=58%"; Hit description =Malate/L-lactate dehydrogenase (42.8 kD) (2M3) [Caenorhabditis elegans] emb|CAA88951.1| Hypothetical prot
  Essential gene: C elegans homolog=F36A2.3; Phenotype=Egl,Unc
  Coding regions on vcDNA: vcDNA=SeqID_50425; Strand=+; Position=78-665
MLSSPPKEFVAPVGEVHAFVVKCMQSVGTSAAHAAQLADLLLDADIVGHYSHGLNRLCIYIEDVASGVKGDGEPKVLKQKGATAWVDGCDLLGAVVGNFCTELAIKLAKEHGIGWVVCKRSNHYGICQHYAKKIANAGLLGLSFTNTSPIIFPTRSSQIGLGTNPISCCANSREKGDGFILDMAASTVALGKGEIA

SEQ ID NO: 124003 - protein, 139 aa, Heterodera glycines
  misc_feature (64)..(64): Xaa can be any naturally occurring amino acid
  Homolog annotation: Hit_ID=CAA82999.1; Match level="QueryCoverage =99%, HitCoverage=96%, E-value=7e-46, Identity=65%"; Hit description =ribosomal protein S19S [Ascaris suum] pir||A54581 ribosomal protein S19.e - pig roundworm sp|P39698|R19S_A
  Gene Ontology: Mol. function=structural constituent of ribosome; Cellular component=eukaryotic 48S initiation complex; Biological process=hemocyte development
  Essential gene: C elegans homolog=T05F1.3; Phenotype=Emb,Lva
  Coding regions on vcDNA: vcDNA=SeqID_50426; Strand=+; Position=18-436
MGKPTSVKDVDQHEIVQSVATFLKKSGKIKLPDWVDLVKLGKNKELAPINPDWYYVRVASVHRXGVGSFRNVYGGKNRRGVALSHFTNASGAVIRKALQSLEEIKWVEKDGGTGGRKLTKQGQKDLDRIASQLRYRTEE

SEQ ID NO: 124004 - protein, 97 aa, Heterodera glycines; identical to SEQ ID NO: 121214
  Homolog annotation: Hit_ID=CAE65731.1; Match level="QueryCoverage =95%, HitCoverage=36%, E-value=2e-13, Identity=39%"; Hit description =Hypothetical protein CBG10814 [Caenorhabditis briggsae]
  Gene Ontology: Biological process=mitotic spindle positioning
  Essential gene: C elegans homolog=Y110A7A.11; Phenotype=Emb,Lva,Unc
  Coding regions on vcDNA: vcDNA=SeqID_50427; Strand=+; Position=26-319

SEQ ID NO: 124005 - protein, 267 aa, Heterodera glycines; identical to SEQ ID NO: 122328
  Homolog annotation: Hit_ID=CAE67771.1; Match level="QueryCoverage =97%, HitCoverage=78%, E-value=2e-79, Identity=54%"; Hit description =Hypothetical protein CBG13346 [Caenorhabditis briggsae]
  Gene Ontology: Mol. function=proteasome endopeptidase activity; Cellular component=proteasome regulatory particle (sensu Eukarya); Biological process=protein deubiquitination
  Essential gene: C elegans homolog=C08B11.7; Phenotype=Emb,Lva
  Coding regions on vcDNA: vcDNA=SeqID_50428; Strand=+; Position=43-843

SEQ ID NO: 124006 - protein, 436 aa, Heterodera glycines
  Homolog annotation: Hit_ID=NP_741529.1; Match level="QueryCoverage =99%, HitCoverage=93%, E-value=1e-148, Identity=57%"; Hit description= adenylosuccinate synthetase, possibly N-myristoylated (50.2 kD) (5F298) [Caenorhabditis elegans] gb|AAM2
  Gene Ontology: Mol. function=protein binding; Biological process =purine nucleotide metabolism
  Essential gene: C elegans homolog=C37H5.6a; Phenotype =Emb,Gro,Pvl,Stp,Unc
  Coding regions on vcDNA: vcDNA=SeqID_50429; Strand=+; Position=7-1314
ISKMNGSLTNGNKVDRGVTILLGAQWGDEGKGKVLDFLIGHHMIDIVARCQGGNNAGHTVLANGREYHFHLLPSGLASEKVLNIVGNGVVVNLDALFEELESNKIEDSADRLFVSDSAHLVLPVHIATDIMRENALGQNSKLGTTKRGIGPAYSSKCFRNGIRLGELLHQPEKFEQNYRSLVAHFKTLFPDIELDTESDVKQLKAHAARLLQMGIVCNTTVFLHKKRLEGKSILVEGANGTLLDIDFGTYPFVTSSNSTVGGCITGLGIPPTAVRRVIGVVKAYQTRVGSGPFPTELLDADGHPSEEGKRLQEVGAEIGVTTRRKRRCGWLDLVLLRYSAMINGFTSLAVTKVDILDQFHEIKIAIGYELNGRQIEYPPATVDDWANLCVHYKTFEGWQSPTTSARQWEQLPDKCRAYLEFIQNQLGVPVEYIGVG

SEQ ID NO: 124007 - protein, 159 aa, Heterodera glycines
  Homolog annotation: Hit_ID=NP_492715.1; Match level="QueryCoverage =99%, HitCoverage=27%, E-value=1e-65, Identity=70%"; Hit description =carboxypeptidase a2 precursor family member (1K935) [Caenorhabditis elegans] emb|CAB00065.2| Hypothetical
  Gene Ontology: Mol. function=lysine carboxypeptidase activity; Cellular component=extracellular space; Biological process =proteolysis and peptidolysis
  Essential gene: C elegans homolog=R11A5.7; Phenotype=Dpy
  Coding regions on vcDNA: vcDNA=SeqID_50430; Strand=+; Position=2-478
TNKRIVWIDGGMHAREWASIHTALWFIDQLISLYGVDPQVTAYMDTLNFYVLPLANPDGFEYSRSDVNPQTRFWRKNRGQQVCKKDRWRRERCCGGVDLNRNFDFHWGETGSSSDMCSDIYQGAYAFSEPESRAIRDKMMSSELYGKVDAFLTLHTYSQ

SEQ ID NO: 124008 - protein, 145 aa, Heterodera glycines
  Homolog annotation: Hit_ID=AAL78213.1; Match level="QueryCoverage =99%, HitCoverage=58%, E-value=2e-41, Identity=59%"; Hit description =probable protein kinase Hgg-20 [Heterodera glycines]
  Essential gene: C elegans homolog=R90.1; Phenotype=Lva,Unc
  Coding regions on vcDNA: vcDNA=SeqID_50431; Strand=+; Position=92-526
MEELVALSPGIRVGRWTITKKLGAGAFGAVYLCVNDQGEQAALKTEPVNTPHPLLVMEAHVMTKLDALRDGDGKHFCRCLDLGRDEQKDQQSGQMKKFNYIVMSLVGRGLDGVVKDAGGRLSLGSAVGVSIQMLAALRGLHTVGY

SEQ ID NO: 124009 - protein, 183 aa, Heterodera glycines
  Homolog annotation: Hit_ID=CAE72716.1; Match level="QueryCoverage =89%, HitCoverage=59%, E-value=1e-49, Identity=55%"; Hit description =Hypothetical protein CBG19953 [Caenorhabditis briggsae]
  Gene Ontology: Mol. function=transferase activity, transferring groups other than amino-acyl groups; Cellular component=integral to membrane; Biological process=fatty acid elongation
  Essential gene: C elegans homolog=F41H10.8; Phenotype=Gro
  Coding regions on vcDNA: vcDNA=SeqID_50432; Strand=+; Position=2-550
GAPRGGGRSTTSGSPGLQEFGTRRLWNLWLAMFSIAGCLVTSYALLREIGTYGLVSSYTNCRDFFEGFTGLWTWWFCMSKFAELGDTYFIVLRKKPLMFLHWYHHVATLNYGLMSYVDNTAFNTWIVWLNFSVHAVMYTYYFLAACRIRLPAWFAQCLTTSQITQFLITLAILAHVGVRLLVG

SEQ ID NO: 124010 - protein, 158 aa, Heterodera glycines
  Homolog annotation: Hit_ID=CAE74082.1; Match level="QueryCoverage =95%, HitCoverage=39%, E-value=2e-61, Identity=79%"; Hit description =Hypothetical protein CBG21737 [Caenorhabditis briggsae]
  Gene Ontology: Mol. function=GDP-mannose 46-dehydratase activity; Biological process=carbohydrate metabolism
  Essential gene: C elegans homolog=F56H6.5; Phenotype =Egl,Lva,Lvl,Prz,Unc
  Coding regions on vcDNA: vcDNA=SeqID_50433; Strand=+; Position=3-476
GLLKRLEEDCIGSAPAAMDKDDAKQFEEYRARKVAMITGISGQDGSYLAEFLLAKGYQVHGVIRRSSSFNTGRIEHLYSNPMTHAVGSSFNLHYGDMTDSSCLIKLISTIRPTELYHLAAQSHVKVSFDLPEYTAEVDAVGTLRLLDAIHACGLTRLV

SEQ ID NO: 124011 - protein, 279 aa, Heterodera glycines
  misc_feature (37)..(37): Xaa can be any naturally occurring amino acid
  misc_feature (161)..(161): Xaa can be any naturally occurring amino acid
  Homolog annotation: Hit_ID=NP_509083.1; Match level="QueryCoverage =98%, HitCoverage=65%, E-value=1e-105, Identity=68%"; Hit description= fumarylacetoacetate hydrolase (46.0 kD) (XH66) [Caenorhabditis elegans] gb|AAK39259.1| Hypothetical prot
  Gene Ontology: Mol. function=fumarylacetoacetase activity; Biological process=tyrosine catabolism
  Essential gene: C elegans homolog=K10C2.4; Phenotype=Emb,Lva,Unc
  Coding regions on vcDNA: vcDNA=SeqID_50434; Strand=+; Position=11-849
MPSVSFVDVPVNSPFTFENLPFGVFSTNENSKKRIGXAIGTQILDLSVETHLFTGTLLSERQNVFSQETLNQFMGLSRQCWLEARLTLQSLLSNANPMLRDDSELRERAFVAQSEAKMHLPALIGDYTDFYSSIYHATNVGTMFRGKDNALMENWKWLPAXYHGRASSIVVSGTAVNRPWGQVKAEDDTQPNFVTSRLMDFELEMAFFVGGPENALGTPIPIEKTEEHIFGMVLMNDWSARDIQKWEYVPLGPFLGKSFATTISPWVVTMEALRPFVVD

SEQ ID NO: 124012 - protein, 331 aa, Heterodera glycines; identical to SEQ ID NO: 122237
  Homolog annotation: Hit_ID=CAE62343.1; Match level="QueryCoverage =98%, HitCoverage=56%, E-value=2e-53, Identity=36%"; Hit description =Hypothetical protein CBG06418 [Caenorhabditis briggsae] pir||S27782 esterase precursor - Caenorhabditis br
  Gene Ontology: Mol. function=neurexin binding; Cellular component =synaptic junction; Biological process=synaptic vesicle targeting
  Essential gene: C elegans homolog=K07C11.4; Phenotype=Gro
  Coding regions on vcDNA: vcDNA=SeqID_50435; Strand=+; Position=1-993

SEQ ID NO: 124013 - protein, 136 aa, Heterodera glycines
  Homolog annotation: Hit_ID=CAE70374.1; Match level="QueryCoverage =93%, HitCoverage=9%, E-value=5e-20, Identity=39%"; Hit description =Hypothetical protein CBG16933 [Caenorhabditis briggsae]
  Gene Ontology: Biological process=locomotory behavior
  Essential gene: C elegans homolog=VF36H2L.1; Phenotype=Unc
  Coding regions on vcDNA: vcDNA=SeqID_50436; Strand=+; Position=12-419
TSQTDKRRQMGVAFVLCCFSVAFTPSLFIFRRFVAPDPLRIILFVLGAFFWLCSLLLSAVVFAVFGQHLLLVAIFFSILFQEVARALFYLLLYKTQSNLARLMAADANRTGTVSSMRLLYSSRHILAIVCGLGMGT

SEQ ID NO: 124014 - protein, 223 aa, Heterodera glycines; identical to SEQ ID NO: 122116
  Homolog annotation: Hit_ID=NP_507024.1; Match level="QueryCoverage =100%, HitCoverage=100%, E-value=1e-68, Identity=58%"; Hit description=adrenal gland protein AD-002 like (26.1 kD) (5Q503) [Caenorhabditis elegans] emb|CAB07655.1| Hypothetic
  Gene Ontology: Biological process=mRNA splicing
  Essential gene: C elegans homolog=T10C6.5; Phenotype=Emb
  Coding regions on vcDNA: vcDNA=SeqID_50437; Strand=+; Position=21-692

SEQ ID NO: 124015 - protein, 214 aa, Heterodera glycines
  misc_feature (176)..(176): Xaa can be any naturally occurring amino acid
  Homolog annotation: Hit_ID=CAE61654.1; Match level="QueryCoverage =100%, HitCoverage=81%, E-value=1e-102, Identity=78%"; Hit description=Hypothetical protein CBG05588 [Caenorhabditis briggsae]
  Gene Ontology: Mol. function=structural constituent of ribosome; Cellular component=cytosolic large ribosomal subunit (sensu Eukarya); Biological process=reproduction
  Essential gene: C elegans homolog=B0250.1; Phenotype=Emb,Lva,Unc
  Coding regions on vcDNA: vcDNA=SeqID_50438; Strand=+; Position=51-690
MGRRIRAQRKGRGGIFKSHSKHRKGPAKLRPVDYSERHGFIRGIVKDIIHDPGRGAPLAIVQFRDPYKYRVKKETMIAAEGLHTGQFIYCGKKAQVQIGNVMPIGELPEGTTVCNLEEKAGDRGRLARTSGNYAIIVAHNPDTKRTRIRLPSGAKKVVPSANRAMIGIVAGGGRTXDKPLLKAGRAYHKYKVKRNCWPKVRGVAMNPVEHPHGG

SEQ ID NO: 124016 - protein, 158 aa, Heterodera glycines
  Homolog annotation: Hit_ID=NP_492348.1; Match level="QueryCoverage =79%, HitCoverage=13%, E-value=2e-19, Identity=42%"; Hit description =insulin-like growth factor binding protein acid labile (1J254) [Caenorhabditis elegans] emb|CAB03182.1| H
  Gene Ontology: Biological process=embryogenesis and morphogenesis
  Essential gene: C elegans homolog=K07A12.2; Phenotype=Emb
  Coding regions on vcDNA: vcDNA=SeqID_50439; Strand=+; Position=1-474
SKLPPELTQQVMRGEMPDLTKLPLDLQQWIKDNFDRLVASLENNPDLSIDEIMKKLPTFEHPLMSTFSPYDINKVDADLVVQQRNEEEANHRFWRIFAASALALAGAVTLGVLSAFFWYLKRSRRLADPPMAPPIGIDGGPELPSVIREQYFRPSASS

SEQ ID NO: 124017 - protein, 136 aa, Heterodera glycines
  Homolog annotation: Hit_ID=NP_492007.1; Match level="QueryCoverage =80%, HitCoverage=86%, E-value=2e-28, Identity=51%"; Hit description =nadh dehydrogenase Fe-S protein 6 (15.7 kD) (1H669) [Caenorhabditis elegans] emb|CAA95810.1| Hypothetical
  Essential gene: C elegans homolog=F22D6.4; Phenotype=Gro
  Coding regions on vcDNA: vcDNA=SeqID_50440; Strand=+; Position=50-460
MRRLSQLFLRCHWTPSEIAASCRHASSAATARPLYMDVQATTPMTWDKTDWRNARFEYTPKQVNPNIAAHLIAELAPVPSEERVVRCDGGHRELGHPRVYINLDKPGTHACGYCGQRFYNVHMTKAEGLDIHHIQV

SEQ ID NO: 124018 - protein, 286 aa, Heterodera glycines
  Homolog annotation: Hit_ID=NP_506254.1; Match level="QueryCoverage =99%, HitCoverage=56%, E-value=2e-65, Identity=42%"; Hit description =putative protein, with a transmembrane domain (5N488) [Caenorhabditis elegans] emb|CAB01420.1| Hypothetic
  Essential gene: C elegans homolog=F15B9.5; Phenotype=Unclassified
  Coding regions on vcDNA: vcDNA=SeqID_50441; Strand=+; Position=3-860
LFLSFVLFFSINFSPSVVAQRTQWDAFNFPNPTAPGDFHRCKMRSTALLCDPDEVLSEQERYRLNYELGLIESATRQENGREFCERKGINAAVAIARQVKGGQEQDVRNMANDLLRRWTLDKQCEEALVIVLSLEDRRFWVARMPRVPVYAQEFTELFKREQGTFKTGRNSEGLQNVIRAIRDRALSKQFPSARPDDDGRSKGTPFVPMPKPTPHPEGKHRQRGGGGVLSWLFILLVIVFVVIPLACCCCCLYFCFFRKKDSGSNNRTPHNAENGGSGAERRGGTG

SEQ ID NO: 124019 - protein, 160 aa, Heterodera glycines
  Homolog annotation: Hit_ID=CAE67141.1; Match level="QueryCoverage =96%, HitCoverage=28%, E-value=4e-70, Identity=79%"; Hit description =Hypothetical protein CBG12564 [Caenorhabditis briggsae]
  Gene Ontology: Mol. function=phenylalanine-tRNA ligase activity; Cellular component=cytoplasm; Biological process=morphogenesis
  Essential gene: C elegans homolog=T08B2.9a; Phenotype=Emb,Lva
  Coding regions on vcDNA: vcDNA=SeqID_50442; Strand=+; Position=1-480
PRAATLQKQELDLTSAMIASGSWRGKQFKQYNFSAMGVPPPSGHLHPLLKVRAEFRDIFFQMGFSEMPTNRFVESSFWNFDALFQPQQHPARDSHDTFFLSRPALSTEFPEDYLESVRKVHSEGGFGSIGYRYDWKLEEAQKNLLRTHTTAVSARQLYLL

SEQ ID NO: 124020 - protein, 146 aa, Heterodera glycines
  Homolog annotation: Hit_ID=CAB62552.1; Match level="QueryCoverage =100%, HitCoverage=64%, E-value=4e-75, Identity=99%"; Hit description= vacuolar ATPase subunit E [Heterodera schachtii] sp|Q9U1G5|VATE_HETSC Vacuolar ATP synthase subunit E (V-
  Gene Ontology: Mol. function=hydrogen-transporting ATPase activity, rotational mechanism; Cellular component=vacuolar membrane (sensu Fungi); Biological process=proton transport
  Essential gene: C elegans homolog=C17H12.14; Phenotype=Emb,Lva
  Coding regions on vcDNA: vcDNA=SeqID_50443; Strand=+; Position=57-494
MGISDNDVQKQLRHMMAFIEQEANEKAEEIDAKAEEEFNIEKGKLVQQQRQKIMEYYEKKEKQVELQRKIQRSNMQNQSRLKCLKARDDHLKNVLEEARANLSKISADRERYPAILKGLLLQGLFQLLESKVVLRCRKKDEEMVAR

SEQ ID NO: 124021 - protein, 145 aa, Heterodera glycines
  Homolog annotation: Hit_ID=CAA91120.1; Match level="QueryCoverage =100%, HitCoverage=33%, E-value=4e-60, Identity=77%"; Hit description= Hypothetical protein C26D10.2a [Caenorhabditis elegans] pir||T19484 hypothetical protein C26D10.2 - Caeno
  Gene Ontology: Mol. function=ATP dependent RNA helicase activity; Cellular component=nucleus; Biological process=RNA localization
  Essential gene: C elegans homolog=C26D10.2a; Phenotype=Emb
  Coding regions on vcDNA: vcDNA=SeqID_50444; Strand=+; Position=57-491
MDEEQLLDYEEEQEETQEQQSKNDAATNGDATKKIKGNYASIHSSGFRDLMLRPELLRAIIDCGFEHPSEVQHECIPQAILGMDIVCQAKSGMGKTAVFVLATLQQLTPTDGTVSVLVMCHTRELAFQISKEYERFSKYMPGVKV

SEQ ID NO: 124022 - protein, 439 aa, Heterodera glycines
  Homolog annotation: Hit_ID=CAE64108.1; Match level="QueryCoverage =99%, HitCoverage=82%, E-value=0.0, Identity=85%"; Hit description =Hypothetical protein CBG08717 [Caenorhabditis briggsae]
  Gene Ontology: Mol. function=hydrogen-transporting ATP synthase activity, rotational mechanism; Cellular component=proton -transporting ATP synthase, catalytic core (sensu Eukarya); Biological process=morphogenesis
  Essential gene: C elegans homolog=H28O16.1a; Phenotype=Emb,Lva
  Coding regions on vcDNA: vcDNA=SeqID_50445; Strand=+; Position=16-1332
MLSKKLFQSILNKSPKTAFSTSARLSASSAEVSRILEEKILGQASQINLEETGRVLSIGDGIARVYGLKNIQAEEMVEFDSGMKGMALNLETDNVGVVVFGNDKVIKEGDVVKRTGSIVDVGVGEALLGRVVDALGNPIDGKGPINVSKRSRVEVKAPGIIPRVGVREPMLTGVKAVDSLVPIGRGQRELIIGDRQTGKTAIAIDTIINQKRFNSSTEEKKKLYCIYVAIGQKRSTVAQIVKRLTDTDAMKYTIIVSATASDAAPLQFLAPYSGAAMGEFFRDNGKHALIIYDDLSKQAVAYRQMSLLLRRPPGREAYPGDVFYLHSRLLERAAKMNETHGGGSMTALPIIETQAGDVSAYIPTNVISITDGQIFLETELFYKGVRPAINVGLSVSRVGSAAQTKSMKQVAGSMKLELAQYREVAAFAQFGSDLDASTH

SEQ ID NO: 124023 - protein, 136 aa, Heterodera glycines
  Homolog annotation: Hit_ID=NP_498690.1; Match level="QueryCoverage =75%, HitCoverage=15%, E-value=2e-12, Identity=38%"; Hit description =DEAD/DEAH box helicase and helicase, C-terminal (3I854) [Caenorhabditis elegans] pir||S44912 hypothetical
  Essential gene: C elegans homolog=ZK686.2; Phenotype=Lva
  Coding regions on vcDNA: vcDNA=SeqID_50446; Strand=+; Position=3-410
EWLGFVEKYANVPSVCTLNVSSLTDNSYNNWLQRILVSATLSMDVHSLHKWNLRCPILFQAEKEIKVNQQTENSAEPAVLLPNSLTHKLIVCKQNFKPLLLFREIDLNFDKWNRIIVFVNKKQTSRRLSSLMETLS

SEQ ID NO: 124024 - protein, 150 aa, Heterodera glycines
  Homolog annotation: Hit_ID=XP_391945.1; Match level="QueryCoverage =95%, HitCoverage=33%, E-value=1e-39, Identity=60%"; Hit description =similar to CG10149-PB [Apis mellifera]
  Gene Ontology: Mol. function=proteasome endopeptidase activity; Cellular component=proteasome regulatory particle (sensu Eukarya); Biological process=embryogenesis and morphogenesis
  Essential gene: C elegans homolog=F57B9.10; Phenotype=Emb
  Coding regions on vcDNA: vcDNA=SeqID_50447; Strand=+; Position=29-478
MTASLQPLRAQPGWTADKCKEQIEVAKSENRTFQRQTLQAHLVHLLNKEHKFNEAIQLAAQLVRELKKVDDKDLLVDVQLEESIGFYHLSNYTKARAELVSARTIANTKYTPPAMQARLDLQSGILHAADDRDFKTAYSYFFEAFQAFDS

SEQ ID NO: 124025 - protein, 213 aa, Heterodera glycines; identical to SEQ ID NO: 122316
  Homolog annotation: Hit_ID=CAE64991.1; Match level="QueryCoverage =98%, HitCoverage=60%, E-value=5e-19, Identity=31%"; Hit description =Hypothetical protein CBG09827 [Caenorhabditis briggsae]
  Gene Ontology: Mol. function=phosphatase regulator activity; Biological process=signal transduction
  Essential gene: C elegans homolog=Y71H2B.3; Phenotype =Reproductive,defect
  Coding regions on vcDNA: vcDNA=SeqID_50448; Strand=+; Position=30-668

SEQ ID NO: 124026 - protein, 161 aa, Heterodera glycines; identical to SEQ ID NO: 122769
  Homolog annotation: Hit_ID=CAB58171.1; Match level="QueryCoverage =100%, HitCoverage=100%, E-value=8e-79, Identity=91%"; Hit description=troponin-like protein [Anisakis simplex]
  Essential gene: C elegans homolog=F54C1.7; Phenotype=Emb,Lvl
  Coding regions on vcDNA: vcDNA=SeqID_50449; Strand=+; Position=89-574

SEQ ID NO: 124027 - protein, 160 aa, Heterodera glycines
  Homolog annotation: Hit_ID=NP_001003882.1; Match level="QueryCoverage= 100%, HitCoverage=31%, E-value=3e-41, Identity=53%"; Hit description =seryl-tRNA synthetase [Danio rerio] gb|AAH81608.1| Seryl-tRNA synthetase [Danio rerio] gb|AAT68157.1|
  Gene Ontology: Mol. function=serine-tRNA ligase activity; Cellular component=cytoplasm; Biological process=tRNA processing
  Essential gene: C elegans homolog=C47E12.1; Phenotype=Emb,Lva,Ste,Unc
  Coding regions on vcDNA: vcDNA=SeqID_50450; Strand=+; Position=1-480
EKGGDPEQIRKSQVGRFADVSLVDKVISADSEWRKERFFLDGLNRAIKVCSTAIGDKMKKKESAGDSDAIPEGQIKSLAELKMDDIKEMKISQIKTVKGMVDEEVRRTKLRMETLEGDRNEHLAKIGNLLHNSVPISDNEDENRVERTFGDCASRKSYSH

SEQ ID NO: 124028 - protein, 296 aa, Heterodera glycines; identical to SEQ ID NO: 122222
  Homolog annotation: Hit_ID=CAE73448.1; Match level="QueryCoverage =96%, HitCoverage=97%, E-value=2e-74, Identity=50%"; Hit description =Hypothetical protein CBG20897 [Caenorhabditis briggsae]
  Gene Ontology: Mol. function=transferase activity, transferring groups other than amino-acyl groups; Cellular component=integral to endoplasmic reticulum membrane; Biological process=fatty acid elongation
  Essential gene: C elegans homolog=D2024.3; Phenotype=Gro
  Coding regions on vcDNA: vcDNA=SeqID_50451; Strand=+; Position=46-936

SEQ ID NO: 124029 - protein, 210 aa, Heterodera glycines
  Homolog annotation: Hit_ID=NP_491237.1; Match level="QueryCoverage =74%, HitCoverage=50%, E-value=6e-48, Identity=54%"; Hit description =protein phosphatase 1A (34.6 kD) (1E406) [Caenorhabditis elegans] gb|AAB42233.1| Yeast glc seven-like pho
  Gene Ontology: Mol. function=protein serine/threonine phosphatase activity; Cellular component=cytoplasm; Biological process=protein amino acid dephosphorylation
  Essential gene: C elegans homolog=W09C3.6; Phenotype=Ste
  Coding regions on vcDNA: vcDNA=SeqID_50452; Strand=+; Position=30-659
MAKEEYCFDAKAAAAAGQSRRPSTTASVLVQGDGQSSRFVDAIIRKVTQPPLQRFTDEITDEELKQLCKAATDFFRMQPTLVRIRPPVVVVGDIHGQFSDLQRIFTTHGPPPEQQYMFLGDYVDRGAHSMETIILLFCYKIKYPSNFMLLRGNHECSNINKAYGFYEEIDRRYPRTGARRLFDLFNQVFAWMPFVGLIGEKILCMDGGIS

SEQ ID NO: 124030 - protein, 219 aa, Heterodera glycines
  misc_feature (164)..(164): Xaa can be any naturally occurring amino acid
  Homolog annotation: Hit_ID=NP_491237.1; Match level="QueryCoverage =94%, HitCoverage=64%, E-value=4e-52, Identity=48%"; Hit description =protein phosphatase 1A (34.6 kD) (1E406) [Caenorhabditis elegans] gb|AAB42233.1| Yeast glc seven-like pho
  Gene Ontology: Mol. function=protein serine/threonine phosphatase activity; Cellular component=cytoplasm; Biological process=protein amino acid dephosphorylation
  Essential gene: C elegans homolog=W09C3.6; Phenotype=Ste
  Coding regions on vcDNA: vcDNA=SeqID_50453; Strand=+; Position=3-657
KVRHSPVQRFTDEITDEELKQLCMAATDIFRMQPTLVRIQPPVVVVGDIHGQFTDLQRIFHTHGNPPEQQYVFLGDYADRGSQSLETIVLLFCYKVKYPANFMLLRGNHECANINRVYGFFDEVNRRYQRPGPRRLYDLFNQTFAWMPYVGLIGDKILCMHGGXLSDPIHSLEQLSQLNPPANTTPRLRTLEKRILLWGETLPNRKYRWQAYPRTTMEK

SEQ ID NO: 124031 - protein, 214 aa, Heterodera glycines
  misc_feature (174)..(174): Xaa can be any naturally occurring amino acid
  Homolog annotation: Hit_ID=NP_500107.1; Match level="QueryCoverage =99%, HitCoverage=56%, E-value=6e-17, Identity=29%"; Hit description =putative nuclear protein, with 4 coiled coil domains (40.0 kD) (4C373) [Caenorhabditis elegans] gb|AAK684
  Essential gene: C elegans homolog=Y41D4B.11; Phenotype=Gro,Pvl,Stp
  Coding regions on vcDNA: vcDNA=SeqID_50454; Strand=+; Position=91-733
MGRHRRYPMKKTAKNTNQAQKIERLSFDTDQTPLQTPKDSRKNKNMNKKPSNSMLEEQPTTWKEQMLKKLTDEVAQQKNKIQKRNKKPKNRLLEETQKLGYHHMPWESAKTLIYRIQQDQNKAINEELLKARFAKAGRDVKEIAEEYKIMDEKNKMKKERRKVLHEKQSKLRAXKKTLTKESERIRKKKWTKTKWKKGREKTEEAEKRKRKEQV

SEQ ID NO: 124032 - protein, 141 aa, Heterodera glycines; identical to SEQ ID NO: 123048
  Homolog annotation: Hit_ID=AAM00924.1; Match level="QueryCoverage =54%, HitCoverage=20%, E-value=1e-13, Identity=45%"; Hit description =bone morphogenetic protein receptor type IB [Sus scrofa]
  Gene Ontology: Mol. function=transforming growth factor-beta receptor activity; Cellular component=extracellular space; Biological process =TGFbeta receptor signaling pathway
  Essential gene: C elegans homolog=C32D5.2; Phenotype=Sma
  Coding regions on vcDNA: vcDNA=SeqID_50455; Strand=+; Position=63-488

SEQ ID NO: 124033 - protein, 178 aa, Heterodera glycines
  Homolog annotation: Hit_ID=CAE68064.1; Match level="QueryCoverage =100%, HitCoverage=40%, E-value=7e-75, Identity=75%"; Hit description= Hypothetical protein CBG13686 [Caenorhabditis briggsae]
  Gene Ontology: Biological process=proteolysis and peptidolysis
  Essential gene: C elegans homolog=Y116A8A.9; Phenotype=Emb
  Coding regions on vcDNA: vcDNA=SeqID_50456; Strand=+; Position=1-534
HYTPNAGDETVLGPSDVVKIDYGTHVNGRIIDCAFTLTFDPKFDTLLNAVREATETGIREAGIDVRLCDIGEAIEEVMTSYELELDGKTFPIKPIRNLNGHSIGPYRIHAGKTVPIVKNGEQVKMEENEFFAIETFGSTGKGHVHDDMETSHYMKNYDLHEEHIPLRLTRSKKLLATI

SEQ ID NO: 124034 - protein, 127 aa, Heterodera glycines
  Homolog annotation: Hit_ID=CAE68064.1; Match level="QueryCoverage =100%, HitCoverage=28%, E-value=5e-58, Identity=80%"; Hit description= Hypothetical protein CBG13686 [Caenorhabditis briggsae]
  Gene Ontology: Biological process=proteolysis and peptidolysis
  Essential gene: C elegans homolog=Y116A8A.9; Phenotype=Emb
  Coding regions on vcDNA: vcDNA=SeqID_50457; Strand=-; Position=60-650
KMEENEFFAIETFGSTGKGHVHDDMETSHYMKNYDLHEEHIPLRLTRSKKLLATINKNFGTLAFCRRWLDRLGETKYLMSLRDLCEKDIVAPYPPLCDQKGCYTAQWEHTILLRPTCKEVVSRGEDY

SEQ ID NO: 124035 - protein, 195 aa, Heterodera glycines
  Homolog annotation: Hit_ID=XP_509279.1; Match level="QueryCoverage =99%, HitCoverage=40%, E-value=2e-81, Identity=73%"; Hit description =PREDICTED: methionyl aminopeptidase 2 [Pan troglodytes] ref|NP _006829.1| methionyl aminopeptidase 2 [Homo
  Gene Ontology: Biological process=proteolysis and peptidolysis
  Essential gene: C elegans homolog=Y116A8A.9; Phenotype=Emb
  Coding regions on vcDNA: vcDNA=SeqID_50458; Strand=+; Position=2-586
DKDDRTAINRMTSEEKKALDSSYEEIYNDFRRAAESHRQTRKYVKSWIKPGMKLIDICERLEAHSRRMINESGLEAGLAFPTGCSINHCAAHYTPNAGDETVLGPSDVVKIDYGTHVNGRIIDCAFTLTFDPKFDTLLNAVREATETGIREAGIDVRLCDIGEAIEEVMTSYELELDGKTFPIKPIRNLNGHSIG

SEQ ID NO: 124036 - protein, 145 aa, Heterodera glycines
  Homolog annotation: Hit_ID=CAE65024.1; Match level="QueryCoverage =93%, HitCoverage=31%, E-value=5e-37, Identity=56%"; Hit description =Hypothetical protein CBG09862 [Caenorhabditis briggsae]
  Gene Ontology: Mol. function=GTP binding; Cellular component=mRNA cleavage and polyadenylation specificity factor complex; Biological process=mRNA cleavage
  Essential gene: C elegans homolog=F59A2.4; Phenotype=Emb
  Coding regions on vcDNA: vcDNA=SeqID_50459; Strand=+; Position=116-550
MDQNNDQRRAVNEYRLNEDNELRLEVGKEEVILELLEGSAEIFGSQISMHKRYSLPPGFRAAVFTYKGALIEVVGRTDSAYIAQQTPMIIYLNTHAALESMRKSAETQLVADRTSSARGPRLLVAGPTDVGKSTLCRILCNYAVR

SEQ ID NO: 124037 - protein, 264 aa, Heterodera glycines
  misc_feature (147)..(147): Xaa can be any naturally occurring amino acid
  Homolog annotation: Hit_ID=CAE65943.1; Match level="QueryCoverage =100%, HitCoverage=43%, E-value=1e-101, Identity=64%"; Hit description=Hypothetical protein CBG11120 [Caenorhabditis briggsae]
  Gene Ontology: Biological process=reproduction
  Essential gene: C elegans homolog=C34C6.4; Phenotype=Ste
  Coding regions on vcDNA: vcDNA=SeqID_50460; Strand=+; Position=2-791
LHQAFLESGRQHWIGVTEDMNGYRQEGLGKMDMTIKDGRRWSASSAYLTNILDRPNLFTTAGVTCTSVLFNNHRAIGIEFIRYHRFMLTEEVDAYSREKIYCEDSVILCAGAINTPQLLMLSGVGPASHLKVHQIPVVQDMPGVGQXNLQDHLELYVQQKCTKPITLYNKSTWRHPHRMVINGLQWFLTKKGLAATSHLESGGFARSSTEIDHPDLQFHFLPSTVHEDGRQSPNCHAFQVHVGPMRTKSAGEITLQSKDPRTSP

SEQ ID NO: 124038 - protein, 158 aa, Heterodera glycines
  Homolog annotation: Hit_ID=XP_419303.1; Match level="QueryCoverage =64%, HitCoverage=5%, E-value=7e-15, Identity=38%"; Hit description =PREDICTED: similar to anaphase promoting complex subunit 1; anaphase- promoting complex 1 (meiotic checkpoi
  Gene Ontology: Mol. function=ATP binding
  Essential gene: C elegans homolog=W10C6.1; Phenotype=Mei,Ste
  Coding regions on vcDNA: vcDNA=SeqID_50461; Strand=+; Position=3-476
NSSLGRAYTPGGGGIEGVVESLNGANHNNGGTSGQSAARHADHSGIGQPCSSHVRELPTLNTHLTSPAAAVALGLIYLRTGDCWIRETLAIADTFYEIDQIRPDMLMIRTFSRCLVDFEDIKCTREWVDAQIPQIIRKYVKRFLEVKSKEDMWWSDFI

SEQ ID NO: 124039 - protein, 205 aa, Heterodera glycines
  Homolog annotation: Hit_ID=NP_495841.1; Match level="QueryCoverage =80%, HitCoverage=24%, E-value=4e-15, Identity=28%"; Hit description =initiation factor eIF-2Be (75.5 kD) (2I953) [Caenorhabditis elegans] emb|CAA91063.1| Hypothetical protein
  Essential gene: C elegans homolog=D2085.3; Phenotype=Gro
  Coding regions on vcDNA: vcDNA=SeqID_50462; Strand=+; Position=14-628
MSSQQQQLDVLIVIDGTNIDKPCVDIFSSSGFVASCLNWVSKLHSPNVIVALPNQPNDVAAELLKKWASKFKQLQAFGVSNCQSLNDVLREVDFRQILRNDFMLIQNLATFCFSYLTRQIEKFRNDRRQNNKNVLTLLYYSKRNYGRKFEEDRSLIGYIEQTQKLTHYENIGKHRTFTVPKSEFLHDTVFRVDLFSCGIALCGIE

SEQ ID NO: 124040 - protein, 234 aa, Heterodera glycines; identical to SEQ ID NO: 122120
  Homolog annotation: Hit_ID=NP_495988.1; Match level="QueryCoverage =100%, HitCoverage=76%, E-value=5e-57, Identity=45%"; Hit description= eukaryotic Initiation Factor (32.9 kD) (eif-3.F) [Caenorhabditis elegans] emb|CAA87773.1| Hypothetical p
  Gene Ontology: Mol. function=translation initiation factor activity; Cellular component=eukaryotic translation initiation factor 3 complex; Biological process=regulation of translational initiation
  Essential gene: C elegans homolog=D2013.7; Phenotype=Emb,Lva
  Coding regions on vcDNA: vcDNA=SeqID_50463; Strand=+; Position=4-705

SEQ ID NO: 124041 - protein, 344 aa, Heterodera glycines
  Homolog annotation: Hit_ID=NP_506137.1; Match level="QueryCoverage =98%, HitCoverage=74%, E-value=2e-73, Identity=44%"; Hit description =hemoglobinase-type cysteine proteinase family C13, legumain (53.2 kD) (5M993) [Caenorhabditis elegans] em
  Gene Ontology: Mol. function=GPI-anchor transamidase activity; Cellular component=extracellular space; Biological process =embryogenesis and morphogenesis
  Essential gene: C elegans homolog=T28H10.3; Phenotype=Emb
  Coding regions on vcDNA: vcDNA=SeqID_50464; Strand=+; Position=1-1032
TTHTQKLFNEPGGKDVYEGVKIDYSGTEVNPENFEAVLLGDEQRSEGKPVLKSTEKDKVFVYFSDHGAVGVIGFPAADLTVKQLTQTLKEMHAKKMYGELTFYLEACESGSMFDHTLAQSLKIYAVTAANGDESSWGCFCDTKFLPGNCLGDLFSVNWMQDSDQENLRTETLRKQFGIVREETNKSHVMHYGDLQIQDEHVSEFMGKEQAHKRNERPPSPHKFPMFPSRDIPMFMMARRQNESKQIQRNLRVAWKKRSFLEQSIKQIVHQLVHDMNNRRQMLTTYPQQIRDLDCHHEVMHTFSNLCFRFSENPYALKYAYVLANLCERPELDAERIRMALIEHC

SEQ ID NO: 124042 - protein, 199 aa, Heterodera glycines
  Homolog annotation: Hit_ID=XP_218419.1; Match level="QueryCoverage =60%, HitCoverage=35%, E-value=3e-13, Identity=34%"; Hit description =similar to Protein fosB [Rattus norvegicus]
  Gene Ontology: Mol. function=subtilase activity; Cellular component =cytoplasm; Biological process=proteolysis and peptidolysis
  Essential gene: C elegans homolog=F29G9.4; Phenotype=Pvl,Stp
  Coding regions on vcDNA: vcDNA=SeqID_50465; Strand=+; Position=1-597
PPQVQLSALVLPPSSQSFNIESPNSDLNSPQISNRQTNKTSALSMPRGTTKTVAQRRGGRRPREAEDHQLTDEDKDRRAKRRERNKQAAARCRRRREEKMQSLQEQVDELRKQNERRENEIRKMREKEQRLLEMLRLRNGGIVQQQLHHHLQAVHVQQQHQSVADHPTVSRPTSLLQPFLVGLNNKRDSVKPRQCHPRP

SEQ ID NO: 124043 - protein, 151 aa, Heterodera glycines
  Homolog annotation: Hit_ID=NP_510300.1; Match level="QueryCoverage =95%, HitCoverage=44%, E-value=1e-39, Identity=54%"; Hit description =nervous system antigen like (35.7 kD) (XO384) [Caenorhabditis elegans] emb|CAB04477.1| Hypothetical prote
  Gene Ontology: Mol. function=sodium/potassium-exchanging ATPase activity; Cellular component=sodium/potassium-exchanging ATPase complex; Biological process=transport
  Essential gene: C elegans homolog=C17E4.9; Phenotype =Bmd,Emb,Gro,Sma,Unc
  Coding regions on vcDNA: vcDNA=SeqID_50466; Strand=+; Position=24-476
MTKTDNGKFTEENNTLMANGRTKPSEKTSLSTFIYNKQDGTFLGRSAKSWAQIIGFYIVFYIFLALFWLGCLWTFLNTIDDFVPRYHGENTIIGANPGVGYQPWLASNPESTLIKFYENDTSSYKDYLNAIDTFLEKYHNTENTRFCDENG

SEQ ID NO: 124044 - protein, 166 aa, Heterodera glycines
  Homolog annotation: Hit_ID=P38981; Match level="QueryCoverage=100%, HitCoverage=52%, E-value=4e-49, Identity=57%"; Hit description=40S ribosomal protein SA (p40) (34/67 kDa laminin binding protein) gb|AAA90978.1| 34/67 kD laminin binding pr
  Gene Ontology: Mol. function=laminin receptor activity; Cellular component=eukaryotic 48S initiation complex; Biological process=cell adhesion
  Essential gene: C elegans homolog=B0393.1; Phenotype=Emb,Ste
  Coding regions on vcDNA: vcDNA=SeqID_50467; Strand=+; Position=13-510
MSSSLDVFKLTDDDAMKFLVCESHIGTKKMDYQMEHYVWKRRSDGIHIINIRKTWEKLLFAARAIAAIENPSDVFVVSTHPNSQRDVLQFAAHIGATPIVGRFTTGSLTNHLLKNCLEPRLLAGSDPEVHQQEGRDASYENTPGIAPTNTDSTLRFVDIAVPANNK

SEQ ID NO: 124045 - protein, 159 aa, Heterodera glycines
  Homolog annotation: Hit_ID=NP_501283.1; Match level="QueryCoverage =98%, HitCoverage=23%, E-value=5e-29, Identity=47%"; Hit description =component of rsec6 8 secretory complex p71 (4I544) [Caenorhabditis elegans] gb|AAA82266.1| Hypothetical p
  Gene Ontology: Cellular component=exocyst; Biological process=post -Golgi transport
  Essential gene: C elegans homolog=C33H5.9; Phenotype =Gro,Rup,Sma,Stp,Unc
  Coding regions on vcDNA: vcDNA=SeqID_50468; Strand=+; Position=3-479
NPEQYLANLHELYLKTHKLLGLLQEKFRTNSLDPQFLPTLTQSVFGPYLVTYAKIEHKFIADKCTFTLRKFYESKGHQKRSILSSGLQELKSRLLTAEDFGGETFLSEIIAINILQEFKNAFARCSSLCKKTESLELNTVLFDMLLKFLYTEHVEYAIE

SEQ ID NO: 124046 - protein, 190 aa, Heterodera glycines; identical to SEQ ID NO: 121702
  Homolog annotation: Hit_ID=NP_495248.1; Match level="QueryCoverage =83%, HitCoverage=98%, E-value=9e-29, Identity=41%"; Hit description =putative protein family member of bilaterial origin (17.5 kD) (2G537) [Caenorhabditis elegans] gb|AAA6835
  Essential gene: C elegans homolog=T24H7.3; Phenotype=Emb
  Coding regions on vcDNA: vcDNA=SeqID_50469; Strand=+; Position=15-587

SEQ ID NO: 124047 - protein, 157 aa, Heterodera glycines
  Homolog annotation: Hit_ID=NP_509206.1; Match level="QueryCoverage =96%, HitCoverage=18%, E-value=2e-19, Identity=35%"; Hit description =protruding VuLva PVL-1, Suppressor of PolyraY SPY-1, Beta -catenin/Armadillo Related, associates to cadher
  Gene Ontology: Mol. function=alpha-catenin binding; Cellular component=adherens junction; Biological process=Wnt receptor signaling pathway
  Essential gene: C elegans homolog=C54D1.6; Phenotype=Egl,Pvl,Rup,Unc
  Coding regions on vcDNA: vcDNA=SeqID_50470; Strand=+; Position=4-474
MLSWLEDKNEKFLNIVTDIMQKVITKNSEQMTFFIGMNGHQKLVGLIANCRQEALLWRVTKLMDKIVQMDAERMVGAGLLEALQRHLDHPSQRLLRQVLSCVRSVSHVPTADRTVQPLLQKLLQLLGTSDIRLKENCVDILANLCANNSQNKSFLVE

SEQ ID NO: 124048 - protein, 342 aa, Heterodera glycines; identical to SEQ ID NO: 122168
  Homolog annotation: Hit_ID=XP_320451.1; Match level="QueryCoverage =72%, HitCoverage=57%, E-value=9e-23, Identity=32%"; Hit description =ENSANGP00000016785 [Anopheles gambiae]
  Gene Ontology: Mol. function=protein binding; Cellular component =dynactin complex; Biological process=microtubule-based movement
  Essential gene: C elegans homolog=C49H3.8; Phenotype=Emb,Gro
  Coding regions on vcDNA: vcDNA=SeqID_50471; Strand=+; Position=65-1090

SEQ ID NO: 124049 - protein, 177 aa, Heterodera glycines; identical to SEQ ID NO: 122762
  Homolog annotation: Hit_ID=NP_506653.1; Match level="QueryCoverage =97%, HitCoverage=94%, E-value=5e-49, Identity=50%"; Hit description =putative endoplasmic reticulum protein, with a transmembrane domain (5P303) [Caenorhabditis elegans] emb|
  Essential gene: C elegans homolog=W06A7.2; Phenotype=Unc
  Coding regions on vcDNA: vcDNA=SeqID_50472; Strand=+; Position=53-586

SEQ ID NO: 124050 - protein, 106 aa, Heterodera glycines; identical to SEQ ID NO: 122303
  Homolog annotation: Hit_ID=CAB58173.1; Match level="QueryCoverage =100%, HitCoverage=33%, E-value=3e-27, Identity=54%"; Hit description= putative nucleosome binding protein [Anisakis simplex]
  Gene Ontology: Mol. function=chaperone activity; Cellular component =chromatin assembly complex; Biological process=nucleosome assembly
  Essential gene: C elegans homolog=D2096.8; Phenotype =Gro,Pvl,Rup,Stp,Unc
  Coding regions on vcDNA: vcDNA=SeqID_50473; Strand=+; Position=1-321

SEQ ID NO: 124051 - protein, 157 aa, Heterodera glycines
  Homolog annotation: Hit_ID=NP_493745.1; Match level="QueryCoverage =85%, HitCoverage=23%, E-value=5e-18, Identity=41%"; Hit description =protein beta-transducin family (52.4 kD) (2A772) [Caenorhabditis elegans] gb|AAC78176.1| Hypothetical pro
  Essential gene: C elegans homolog=W07E6.2; Phenotype=Lva
  Coding regions on vcDNA: vcDNA=SeqID_50474; Strand=+; Position=3-473
IGLLLEQPVKKRKIEVGESDGNEQRSVAVRLFSEDGKEIGQAPVVLLASTTAEQLQVLYHQLLRSEKQQNGECGDDGDFDEGTAPVQFRTVADEKSGGKGTEIVDSLLDSLPSERLFLEKPLELVCLPQAVFRVRPVTRCTASLPGHGEPVLSVQFS

SEQ ID NO: 124052 - protein, 182 aa, Heterodera glycines
  Homolog annotation: Hit_ID=NP_492006.1; Match level="QueryCoverage =100%, HitCoverage=32%, E-value=6e-66, Identity=69%"; Hit description= asparagiNyl tRNA Synthetase (61.2 kD) (nrs-1) [Caenorhabditis elegans] emb|CAA95808.1| Hypothetical prot
  Gene Ontology: Mol. function=ATP binding; Cellular component =cytoplasm; Biological process=protein biosynthesis
  Essential gene: C elegans homolog=F22D6.3a; Phenotype=Emb,Lva
  Coding regions on vcDNA: vcDNA=SeqID_50475; Strand=+; Position=3-638
PPTLVQTQVEGGSTLFSLNFFGESAFLTQSSQLYLETCIASLGDCYCISQSYRAEKSRTRRHLAEYSHVEAEFPFITFEDLMVRIEEMTCDTVNRVMADPEIRELIQQQWQKDSQYEFVAPKRPFLRMTYAEAIEWLQKNEVMNEEGKPFQFGEDIPEGPERFMTDTIGQPILLNRFPHGIK

SEQ ID NO: 124053 - protein, 158 aa, Heterodera glycines
  Homolog annotation: Hit_ID=NP_508588.1; Match level="QueryCoverage =98%, HitCoverage=25%, E-value=2e-45, Identity=57%"; Hit description =chitinase (66.9 kD) (cht-1) [Caenorhabditis elegans] gb|AAA83586.1| Chitinase protein 1 [Caenorhabditis e
  Gene Ontology: Mol. function=extracellular matrix structural constituent; Cellular component=extracellular matrix; Biological process=response to bacteria
  Essential gene: C elegans homolog=C04F6.3; Phenotype=Emb
  Coding regions on vcDNA: vcDNA=SeqID_50476; Strand=+; Position=1-474
KSFIDSAIAFVRKHGFDGIDIVREYPKGGEQKRNFSRFFKELKDAVRKEASSSGRPRLLITAAVAAGTENIDNGYDIPTVGKLLDFVLLMGYDFHGSWEQQTGMNAPLYGRSKDVPEKRLWNVAGAANYWAKKGMPKSKIIIGIPTYGRGWTLSNPQQ

SEQ ID NO: 124054 - protein, 350 aa, Heterodera glycines; identical to SEQ ID NO: 122300
  Homolog annotation: Hit_ID=CAE70179.1; Match level="QueryCoverage =84%, HitCoverage=74%, E-value=1e-47, Identity=35%"; Hit description =Hypothetical protein CBG16652 [Caenorhabditis briggsae]
  Essential gene: C elegans homolog=F09G8.3; Phenotype=Lva
  Coding regions on vcDNA: vcDNA=SeqID_50477; Strand=+; Position=16-1065

SEQ ID NO: 124055 - protein, 94 aa, Heterodera glycines
  Homolog annotation: Hit_ID=NP_497835.1; Match level="QueryCoverage =91%, HitCoverage=33%, E-value=3e-15, Identity=45%"; Hit description =i-94 protein (30.9 kD) (3F268) [Caenorhabditis elegans] emb|CAA86740.1| Hypothetical protein C16C10.2 [Ca
  Gene Ontology: Mol. function=structural constituent of ribosome; Cellular component=small nucleolar ribonucleoprotein complex; Biological process=protein biosynthesis
  Essential gene: C elegans homolog=C16C10.2; Phenotype=Lva,Lvl
  Coding regions on vcDNA: vcDNA=SeqID_50478; Strand=+; Position=153-434
MPGNETIRGHLEKRKDWIRRTRDHQEKSADIKKLKRSARERNPDEFHFHMLRSQIGFDGTHRDLETEEEEKSEAQRLLSDVSDINFVQFKLGME

SEQ ID NO: 124056 - protein, 226 aa, Heterodera glycines
  Homolog annotation: Hit_ID=XP_320933.1; Match level="QueryCoverage =78%, HitCoverage=50%, E-value=1e-18, Identity=31%"; Hit description =ENSANGP00000007768 [Anopheles gambiae]
  Gene Ontology: Mol. function=protein phosphatase activity; Cellular component=cytoplasm; Biological process=meiosis
  Essential gene: C elegans homolog=C24F3.2; Phenotype=Unclassified
  Coding regions on vcDNA: vcDNA=SeqID_50479; Strand=+; Position=27-704
MLSQIEDHLFLSFWIEYAQKYLIDAKIGRVLTVALDHIPQIRHLQNVEYRHIRMADVESEELLASQKLQNALDYVEDSVNRGINIVVHCQCGISRSATVVMAYLMRKYKWNVNDSFSFVKARRSCVQPNPSFLRQLEVFQKLDYRCDLLTLRNSKLFKEFECISENPSEVSRSTCDIYSLNESAKLSVGRRFSCKKCRCDLFYDFNILSHNFVVASGQNESVKLAK

SEQ ID NO: 124057 - protein, 398 aa, Heterodera glycines
  Homolog annotation: Hit_ID=NP_501972.1; Match level="QueryCoverage =100%, HitCoverage=74%, E-value=1e-108, Identity=48%"; Hit description=flavin-containing monooxygenase (60.1 kD) (fmo-12) [Caenorhabditis elegans] emb|CAA94290.1| Hypothetica
  Gene Ontology: Mol. function=monooxygenase activity; Cellular component=integral to membrane; Biological process=gametogenesis
  Essential gene: C elegans homolog=Y39A1A.19; Phenotype=Ste,Stp
  Coding regions on vcDNA: vcDNA=SeqID_50480; Strand=+; Position=2-1195
YSAHFGLLKHIQFQTEVLNVQRVEEFAQNGKWTVTYRKTEDEEQKVMDDTFDGVMLCTGHHCSERWPNPPFPGQSVFRGQVIHSRAFHTAKPFEDQTVVVVGIGNSGGDIAVELSKVAKKVYLSTRTGSWVINSVWEKGHPTDAVLLNRFAFALRAITPRSVQNRLIERKLNLRLDHERYGLRPSHRFLEAHVTVNDELPNRIASGTVVIKPNIQKLAEKDVTFDDGTTVYGVDTVIFATGYNFFFPQLENGRLISVQDNKTLLYKLMFPHDLSPKNTLAIIGLIQPTGSIMPISEMQARLFCAQLVGDISLPQKAQMEADALAQARRISKEFVNRPRHTIQVQYVDYMDELAKLVGCKPKLVGRIFTDPCLAKVLLFNGLVPYQFRLDGPHRWEGAR

SEQ ID NO: 124058 - protein, 212 aa, Heterodera glycines
  misc_feature (45)..(45): Xaa can be any naturally occurring amino acid
  Homolog annotation: Hit_ID=CAE62078.1; Match level="QueryCoverage =100%, HitCoverage=100%, E-value=9e-58, Identity=53%"; Hit description=Hypothetical protein CBG06101 [Caenorhabditis briggsae]
  Essential gene: C elegans homolog=ZK809.3; Phenotype=Emb,Lva
  Coding regions on vcDNA: vcDNA=SeqID_50481; Strand=+; Position=15-651
MGNYYSPPKRVGQNPFTRSGAPPPKLVIRKDKDVPMHRVNDPMSXLQLHMADERVRTAGLSKAEREWREKWVHDQSMHPDEPIHVDAVHRQLNPIRVLYRWPMDKLYKHFLRPTFGNYWATIIRVYVPKFFWFFMTFEFFYYVWKYESKSWQKRIGFSTINRPDRYVLVKDHDEETLKLGLTDYSRSDYFDKEFYQRIKTANIDFGPPKRPW

SEQ ID NO: 124059 - protein, 113 aa, Heterodera glycines; identical to SEQ ID NO: 122215
  Homolog annotation: Hit_ID=NP_491944.2; Match level="QueryCoverage =100%, HitCoverage=100%, E-value=3e-32, Identity=61%"; Hit description=60s acidic ribosomal protein p2 (1H366) [Caenorhabditis elegans] gb|AAB52450.2| Hypothetical protein C3
  Gene Ontology: Mol. function=structural constituent of ribosome; Cellular component=cytosolic large ribosomal subunit (sensu Eukarya); Biological process=protein biosynthesis
  Essential gene: C elegans homolog=C37A2.7; Phenotype=Emb,Gro
  Coding regions on vcDNA: vcDNA=SeqID_50482; Strand=+; Position=27-368

SEQ ID NO: 124060 - protein, 293 aa, Heterodera glycines; identical to SEQ ID NO: 122725
  misc_feature (275)..(275): Xaa can be any naturally occurring amino acid
  Homolog annotation: Hit_ID=NP_509821.1; Match level="QueryCoverage =100%, HitCoverage=67%, E-value=1e-117, Identity=71%"; Hit description=succinyl-coa ligase mitochondrial (47.4 kD) (XL516) [Caenorhabditis elegans] emb|CAA91981.1| Hypothetic
  Gene Ontology: Mol. function=succinate-CoA ligase (ADP-forming) activity; Cellular component=mitochondrion; Biological process =succinyl-CoA pathway
  Essential gene: C elegans homolog=C50F7.4; Phenotype=Sck
  Coding regions on vcDNA: vcDNA=SeqID_50483; Strand=+; Position=2-881

SEQ ID NO: 124061 - protein, 219 aa, Heterodera glycines
  Homolog annotation: Hit_ID=AAO85519.1; Match level="QueryCoverage =97%, HitCoverage=67%, E-value=9e-63, Identity=54%"; Hit description =putative serine/threonine phosphatase [Oesophagostomum dentatum] gb|AAO85518.1| putative serine/threonine
  Gene Ontology: Mol. function=protein serine/threonine phosphatase activity; Cellular component=cytoplasm; Biological process=protein amino acid dephosphorylation
  Essential gene: C elegans homolog=W09C3.6; Phenotype=Ste
  Coding regions on vcDNA: vcDNA=SeqID_50484; Strand=+; Position=2-658
HGQFPDLMRIFNCLGTPPEKKYLFLGDYVDRGAQSVETIMLLLCYKVKYPTSIVLLRGNHETSNINATYGFKKELEERYPAHSQALFDSFNDTFAWMPLTGLIGQKILCMHGGISNKIRSIEQLKQLERPMLLPPTDSLHIDLMWADPMEAQGQRPNPRGAGVLFGEDVVIRTCQLLKISCIIRAHQFIQSGFEPMFNQRLITVFSAPAYTGQTNTGAV

SEQ ID NO: 124062 - protein, 242 aa, Heterodera glycines
  Homolog annotation: Hit_ID=CAE61943.1; Match level="QueryCoverage =98%, HitCoverage=62%, E-value=8e-67, Identity=49%"; Hit description =Hypothetical protein CBG05941 [Caenorhabditis briggsae]
  Gene Ontology: Mol. function=structural constituent of ribosome; Cellular component=mitochondrial large ribosomal subunit; Biological process=protein biosynthesis
  Essential gene: C elegans homolog=F33D4.5; Phenotype=Emb,Lva
  Coding regions on vcDNA: vcDNA=SeqID_50485; Strand=+; Position=7-732
MHNQFLPLATALSSIRQYHSPSVYGKSDELLQLRIELNMTTEKATKFVSDSRQLVVLPHPFQHSEKRTILAFAGTKEAQQEVMLNGADIAIGPEMVKKILKGQFNMDDYDFCIAHTDMAKHILPLRGVIKTRFPTKINGGIGDDLNEILESFLSGINLTVRRDPTNKEWGLSEPLIGRLSMSDEQIEENVAVIVDTLCKMRKAVLGPFINRASLITASAGPQQSFFPVDVSPWEALPTEEEI

SEQ ID NO: 124063 - protein, 158 aa, Heterodera glycines
  Homolog annotation: Hit_ID=NP_498735.1; Match level="QueryCoverage =96%, HitCoverage=35%, E-value=2e-14, Identity=30%"; Hit description =predicted CDS, putative cytoplasmic protein family member (3J53) [Caenorhabditis elegans] gb|AAK84536.1|
  Essential gene: C elegans homolog=F19G12.2; Phenotype=Unclassified
  Coding regions on vcDNA: vcDNA=SeqID_50486; Strand=+; Position=1-474
INMIGATWIKNLKITVQGREIYDSNSLYAYKAYLDAELSYSKNVKESDLQASGYYVDSENQDGTDITQQGFELRRKLFSQSQTAQFITKLDADIFNQDRYMVNGVEIDIQLTPNDNEFMVMAAADDKYRIEITACKLYVKTLEVVDGLALDIQKKLES

SEQ ID NO: 124064 - protein, 159 aa, Heterodera glycines
  Homolog annotation: Hit_ID=AAB94050.1; Match level="QueryCoverage =97%, HitCoverage=40%, E-value=2e-29, Identity=49%"; Hit description =glucose repression mediator protein [Takifugu rubripes]
  Essential gene: C elegans homolog=D2021.1; Phenotype=Gro,Pvl,Sma,Unc
  Coding regions on vcDNA: vcDNA=SeqID_50487; Strand=+; Position=12-488
MGESTWAIRSSKSWSTISRYGQYQAESFRHSLKEETEKLRQANPKLFQQQTPSTSDTPPVDCASPAPSKKRKTAASMAAGSGTPTSRGRVEESSPYKIIKFGTNIDLSDERKFYVQLKELNKLPAFCRLHSASNMLSYLGHTVFGMNTVQLYLKVPGCR

SEQ ID NO: 124065 - protein, 147 aa, Heterodera glycines
  Homolog annotation: Hit_ID=NP_501798.1; Match level="QueryCoverage =98%, HitCoverage=36%, E-value=1e-38, Identity=53%"; Hit description =novel nuclear protein 1 (45.9 kD) (4K746) [Caenorhabditis elegans] emb|CAA93111.1| Hypothetical protein C
  Gene Ontology: Cellular component=nucleus; Biological process=rRNA processing
  Essential gene: C elegans homolog=C47E12.7; Phenotype=Lva
  Coding regions on vcDNA: vcDNA=SeqID_50488; Strand=+; Position=82-522
MMDEDMEEVEIVFAQRLASGEPTARQRAMKHLRTHIRERTKTDAKGFSSVSLARLCKGLHYALWMQDKMTLQEELADEICALCNYFRTDEQLLEFVVVLFTTLSKEWPYIDRWRMDKFLMLVRRLVRTLFRRLSSHRWDPPLCDQFL

SEQ ID NO: 124066 - protein, 209 aa, Heterodera glycines
  misc_feature (181)..(181): Xaa can be any naturally occurring amino acid
  Homolog annotation: Hit_ID=CAE65046.1; Match level="QueryCoverage =99%, HitCoverage=53%, E-value=3e-46, Identity=42%"; Hit description =Hypothetical protein CBG09887 [Caenorhabditis briggsae]
  Gene Ontology: Mol. function=general RNA polymerase II transcription factor activity; Cellular component=nucleotide excision repair factor 3 complex; Biological process=regulation of transcription, DNA-dependent
  Essential gene: C elegans homolog=T16H12.4; Phenotype=Emb,Gro,Unc
  Coding regions on vcDNA: vcDNA=SeqID_50489; Strand=+; Position=31-658
MDDDDAIGGAEAFKWEQAYTEGLNIRSVLQEDEHGSVEESIRRLVMDEKRQRRMDRLPAKIRLGMMRYVHLAVDCSSAILSADFFPSRLSVALECLRKFVDKFFLLNPLSQMGLIAVRDKRAERISGFTSSVQFLLESLQDISSTNCGGEFSLQSVLQCALHSFQGLPAHSSKECILLIAXLSSVDASPLRHTFEQLKMRSVRCSIVSF

SEQ ID NO: 124067 - protein, 78 aa, Heterodera glycines; identical to SEQ ID NO: 123016
  Homolog annotation: Hit_ID=CAE65730.1; Match level="QueryCoverage =78%, HitCoverage=24%, E-value=2e-20, Identity=80%"; Hit description =Hypothetical protein CBG10813 [Caenorhabditis briggsae]
  Gene Ontology: Mol. function=endopeptidase activity; Cellular component=26S proteasome; Biological process=ubiquitin-dependent protein catabolism
  Essential gene: C elegans homolog=Y110A7A.14; Phenotype=Emb
  Coding regions on vcDNA: vcDNA=SeqID_50490; Strand=+; Position=65-301

SEQ ID NO: 124068 - protein, 250 aa, Heterodera glycines
  misc_feature (232)..(232): Xaa can be any naturally occurring amino acid
  Homolog annotation: Hit_ID=CAE72630.1; Match level="QueryCoverage =100%, HitCoverage=51%, E-value=2e-93, Identity=64%"; Hit description= Hypothetical protein CBG19828 [Caenorhabditis briggsae]
  Gene Ontology: Biological process=embryogenesis and morphogenesis
  Essential gene: C elegans homolog=H04M03.4; Phenotype=Unclassified
  Coding regions on vcDNA: vcDNA=SeqID_50491; Strand=+; Position=3-753
QFAVPLFPDAVKKQCLKELKQRYENKEIKSPPENFEEWVLHHFGPQILDVFFNPYSKKVWTVKPSKMSPIWVGTRVAKLPQEKLEELCSMDANVLKNADFGWGPNAQFNFPKYGGTGAVWKNMTEKLPSEWFKYNSKVLRVDHRQKCVHYVQLNANGQPTGPTKSLKYDALINSSPIDAFVADNKICEMPLLEHNKVFVIGVGLKLPMTEFCEKYTWLYFPDPDVPFYRVTXSRYGEVTPDNTKFWSVLC

SEQ ID NO: 124069 - protein, 156 aa, Heterodera glycines
  misc_feature (82)..(82): Xaa can be any naturally occurring amino acid
  misc_feature (135)..(135): Xaa can be any naturally occurring amino acid
  Homolog annotation: Hit_ID=AAP20434.1; Match level="QueryCoverage =97%, HitCoverage=33%, E-value=2e-72, Identity=84%"; Hit description =beta-tubulin isotype 1 [Cooperia oncophora]
  Gene Ontology: Mol. function=MHC class I protein binding; Cellular component=tubulin; Biological process=embryogenesis and morphogenesis
  Essential gene: C elegans homolog=C36E8.5; Phenotype=Emb
  Coding regions on vcDNA: vcDNA=SeqID_50492; Strand=+; Position=28-497
MREIVHIQAGQCGNQIGSKFWEVISDEHGIQPDGTYKGETDLQLERINVYYNEAHGGKYVPRAVLVDLEPGIFFSIRAGPYXQLFRLDNFVFGQSGAGNNWAKGHYTEGAELVDNVLDVVLKEAEGCGRLQGFQXTHPLGSSKRTGRGTLFVRENP

SEQ ID NO: 124070 - protein, 222 aa, Heterodera glycines; identical to SEQ ID NO: 122700
  Homolog annotation: Hit_ID=CAE59999.1; Match level="QueryCoverage =97%, HitCoverage=23%, E-value=8e-28, Identity=35%"; Hit description =Hypothetical protein CBG03493 [Caenorhabditis briggsae]
  Gene Ontology: Mol. function=rRNA primary transcript binding; Cellular component=nucleolus; Biological process=35S primary transcript processing
  Essential gene: C elegans homolog=T23F6.4; Phenotype=Lva
  Coding regions on vcDNA: vcDNA=SeqID_50493; Strand=+; Position=34-777

SEQ ID NO: 124071 - protein, 162 aa, Heterodera glycines
  Homolog annotation: Hit_ID=NP_741143.1; Match level="QueryCoverage =85%, HitCoverage=37%, E-value=2e-38, Identity=55%"; Hit description =3-hydroxyisobutyryl-Coenzyme A hydrolase (42.7 kD) (3G645) [Caenorhabditis elegans] gb|AAA50696.1| Hypoth
  Gene Ontology: Mol. function=3-hydroxyisobutyryl-CoA hydrolase activity; Biological process=embryogenesis and morphogenesis
  Essential gene: C elegans homolog=F09F7.4a; Phenotype=Emb
  Coding regions on vcDNA: vcDNA=SeqID_50494; Strand=+; Position=2-487
FLGLSSRNVFPQSVRPSSLFACHFSSGTNDDVLFERVNQKLVITLNRPKALNALNFPMIRKIYPQLRNSSFDLALVKGTGGLAFCAGGDVLAVSKSYKANDPDRIFQQFFLEEYQLNHLIGSLSRPYVAFIDGITMGGGCGLSLHGAFRVATERTILAMPET

SEQ ID NO: 124072 - protein, 164 aa, Heterodera glycines
  Homolog annotation: Hit_ID=NP_492476.1; Match level="QueryCoverage =99%, HitCoverage=14%, E-value=4e-68, Identity=73%"; Hit description =RNA polymerase (1J858) [Caenorhabditis elegans] emb|CAA99827.1| Hypothetical protein F14B4.3 [Caenorhabdi
  Gene Ontology: Mol. function=protein binding; Cellular component =nucleolus; Biological process=growth
  Essential gene: C elegans homolog=F14B4.3; Phenotype=Lva,Lvl
  Coding regions on vcDNA: vcDNA=SeqID_50495; Strand=+; Position=1-492
HDDRVPAFTELTLIRHSPDSENIQMQFAAFFIYSGLGRLMRPVRNLLFDQIEQIGIFEQVYLSIIIDPEEAEPGVTMHQELHPSSLFSFAGNLIPFPDHNQSPRNVYQCQMGKQTMGVPVHAWQTRTDNKMYKLQTAQKPLLKLEAHDKYEMDEYPLGTNACVA

SEQ ID NO: 124073 - protein, 231 aa, Heterodera glycines
  Homolog annotation: Hit_ID=AAK93843.1; Match level="QueryCoverage =70%, HitCoverage=19%, E-value=4e-32, Identity=46%"; Hit description =Dnaj domain (prokaryotic heat shock protein) protein 8 [Caenorhabditis elegans] ref|NP_495340.1| DNaJ doma
  Essential gene: C elegans homolog=C56C10.13; Phenotype=Egl,Unc
  Coding regions on vcDNA: vcDNA=SeqID_50496; Strand=+; Position=200-892
MDVNQAYKILSNPQRRKAYDTFGFTDEQFEGMRKEFFREQQQHQFQFVRWPQPPRKKQTDISQFLLPFGSVLGTLFFIFVVGYFLNHMNVSEQSKRRRQPQNRAEEANEMGGGDTKTEDNEKELAEDQKAPLTEEERQQKLQARVWRVMGPMIRELRAETQFGLIRLLKPGCRSIIVLVDKDSKDKLLQQFARHLYCLRNNKTFSFGFLMVPKNLSWFRSLLELTLPDEQQ

SEQ ID NO: 124074 - protein, 261 aa, Heterodera glycines
  Homolog annotation: Hit_ID=CAE59981.1; Match level="QueryCoverage =90%, HitCoverage=22%, E-value=6e-71, Identity=60%"; Hit description =Hypothetical protein CBG03473 [Caenorhabditis briggsae]
  Gene Ontology: Mol. function=ATP dependent RNA helicase activity; Cellular component=nucleolus; Biological process=RNA localization
  Essential gene: C elegans homolog=W08D2.7; Phenotype=Emb,Lva,Unc
  Coding regions on vcDNA: vcDNA=SeqID_50497; Strand=+; Position=32-814
MDDLLNDIDEDQQQSESGSSSLPPQSVNTMAWLEQNKQNQARAFSENLLKDLSAVSETGKSAEFNVKDEMEGEAGDEEENQFIQNCQRIRSYQVASEKNCNHEAIVPFDVEYQQLKKTNTPAKLYEFKLDMFQSQALKCLDNQQSVLVSAHTSAGKTVVALYAIAMALRDKQRVIYTSPIKALSNQKYRELVEEFEDVGLVTGDVTLNPNASCVVMTTEILRSMLYRGCEIVREVGWVIFDEIHYMRDKERGVVWEETLIL

SEQ ID NO: 124075 - protein, 426 aa, Heterodera glycines; identical to SEQ ID NO: 122347
  Homolog annotation: Hit_ID=CAE63008.1; Match level="QueryCoverage =76%, HitCoverage=60%, E-value=4e-79, Identity=45%"; Hit description =Hypothetical protein CBG07248 [Caenorhabditis briggsae]
  Gene Ontology: Mol. function=ubiquitin-protein ligase activity; Biological process=protein polyubiquitination
  Essential gene: C elegans homolog=C11H1.3; Phenotype=Dpy,Gro,Pvl,Unc
  Coding regions on vcDNA: vcDNA=SeqID_50498; Strand=+; Position=164 -1441

SEQ ID NO: 124076 - protein, 184 aa, Heterodera glycines
  Homolog annotation: Hit_ID=CAE59164.1; Match level="QueryCoverage =71%, HitCoverage=24%, E-value=2e-12, Identity=31%"; Hit description =Hypothetical protein CBG02470 [Caenorhabditis briggsae] emb|CAE59162.1| Hypothetical protein CBG02468 [Cae
  Essential gene: C elegans homolog=C25H3.6a; Phenotype=Emb,Lva,Unc
  Coding regions on vcDNA: vcDNA=SeqID_50499; Strand=+; Position=256-807
MVAACVATPSVTVTATAATYFNHNQTGFAGTLGGGGGSKKGMEANSNPSKASKGVTMTTAEVDQLRQQLQSVVENGDLTASNVCVEQLESAVLSKDTLEATRIGRFVNDVRKQTAQQWPDFSKRCRALIKQWQKVAEYRPSSSCEGSSNGGTPQLVSPALKRGLTPRAGAVTTPGKRTTPHQPQ

SEQ ID NO: 124077 - protein, 150 aa, Heterodera glycines
  Homolog annotation: Hit_ID=NP_741145.1; Match level="QueryCoverage =98%, HitCoverage=96%, E-value=3e-64, Identity=79%"; Hit description =myosin light chain (17.1 kD) (mlc-3) [Caenorhabditis elegans] gb|AAA50701.1| Myosin light chain protein 3
  Gene Ontology: Mol. function=structural constituent of muscle; Cellular component=muscle myosin; Biological process=muscle development
  Essential gene: C elegans homolog=F09F7.2a; Phenotype=Egl,Unc
  Coding regions on vcDNA: vcDNA=SeqID_50500; Strand=+; Position=54-506
MPSQGELKEIFNLYDEELEGKIDATQIGDVARACGLKPTNAMVWKAAGEEYKRKGEKKLAFEEWLPIFEQLQKEKEVGTYADFVEGLKVFDKDESGKIMAAELRHVLLALGERLSAEEADELLLGAQDGEGMINYDQFIKKVLAGPYPED

SEQ ID NO: 124078 - protein, 215 aa, Heterodera glycines; identical to SEQ ID NO: 122106
  Homolog annotation: Hit_ID=NP_496403.1; Match level="QueryCoverage =96%, HitCoverage=72%, E-value=3e-76, Identity=65%"; Hit description =holocytochrome c synthase, possibly N-myristoylated (31.3 kD) (2L524) [Caenorhabditis elegans] emb|CAA889
  Gene Ontology: Mol. function=holocytochrome c synthase activity; Cellular component=mitochondrial intermembrane space; Biological process=electron transport
  Essential gene: C elegans homolog=T06D8.6; Phenotype=Age,Gro,Lva
  Coding regions on vcDNA: vcDNA=SeqID_50501; Strand=+; Position=1-645

SEQ ID NO: 124079 - protein, 151 aa, Heterodera glycines
  Homolog annotation: Hit_ID=NP_956549.1; Match level="QueryCoverage =96%, HitCoverage=30%, E-value=1e-22, Identity=39%"; Hit description =similar to DNA methyltransferase 1-associated protein 1 [Danio rerio] gb|AAH48054.1| Similar to DNA methy
  Essential gene: C elegans homolog=Y105E8A.17; Phenotype=Emb,Gro,Unc
  Coding regions on vcDNA: vcDNA=SeqID_50502; Strand=+; Position=34-486
MFSTDAQDILGGGGSGSQLAKKSGLPTMKLTNLDKKKKITTNGQPKRPVGMHRELYNLFVHQGKDNNKEKIESLMPTQTKKGFSLAKAQLGKRPVRKWLWCPFENEARKDGLALKHWEREDKHSTPYSFVQFNKQLDVPSFTDEEYEEHLV

SEQ ID NO: 124080 - protein, 125 aa, Heterodera glycines; identical to SEQ ID NO: 123938
  Homolog annotation: Hit_ID=NP_492119.1; Match level="QueryCoverage =96%, HitCoverage=97%, E-value=2e-38, Identity=60%"; Hit description =NADH dehydrogenase 1 beta subcomplex 7, possibly N-myristoylated (14.4 kD) (1I156) [Caenorhabditis elegan
  Gene Ontology: Mol. function=NADH dehydrogenase (ubiquinone) activity; Cellular component=membrane fraction
  Essential gene: C elegans homolog=D2030.4; Phenotype=Age,Gro,Lva
  Coding regions on vcDNA: vcDNA=SeqID_50503; Strand=+; Position=2-511

SEQ ID NO: 124081 - protein, 151 aa, Heterodera glycines
  Homolog annotation: Hit_ID=XP_311177.1; Match level="QueryCoverage =99%, HitCoverage=36%, E-value=2e-77, Identity=93%"; Hit description =ENSANGP00000019055 [Anopheles gambiae]
  Gene Ontology: Biological process=reproduction
  Essential gene: C elegans homolog=T04C12.6; Phenotype=Ste
  Coding regions on vcDNA: vcDNA=SeqID_50504; Strand=+; Position=64-519
KHQSQPEKMCDEEVAALVVDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMAQIMCETFNTPGMYVGIQGLLSL

SEQ ID NO: 124082 - protein, 185 aa, Heterodera glycines
  Homolog annotation: Hit_ID=CAE67039.1; Match level="QueryCoverage =96%, HitCoverage=90%, E-value=3e-71, Identity=73%"; Hit description =Hypothetical protein CBG12445 [Caenorhabditis briggsae]
  Essential gene: C elegans homolog=W10D5.2; Phenotype=Emb,Lva
  Coding regions on vcDNA: vcDNA=SeqID_50505; Strand=+; Position=69-623
MAKSDVPALSTTNQPYPYKEQTPKGIFEKMGLQKTPDGTSIGEFAVMRMDDMMNLIGRGSLWPLTFGLACCAVEMMHFAAPRYDMMRFGVVFRATPRQCDLIIVSGTVTNKMAPALRRIYDQMPHPKWVISMGSCANGGGYYHYSYSVLRGCDRVIPVDIYVQGCPPSAEALLYGVLQLQKKIKR

SEQ ID NO: 124083 - protein, 356 aa, Heterodera glycines
  Homolog annotation: Hit_ID=CAE60849.1; Match level="QueryCoverage =90%, HitCoverage=44%, E-value=1e-106, Identity=60%"; Hit description= Hypothetical protein CBG04558 [Caenorhabditis briggsae]
  Gene Ontology: Biological process=cell growth
  Essential gene: C elegans homolog=C47E8.7; Phenotype=Emb
  Coding regions on vcDNA: vcDNA=SeqID_50506; Strand=+; Position=1-1068
MAHLIQDGFVVNDATWKLGIFITDMNISRELFVRGDMTIGSLMMQLVGQIGETQDWSDHYMWWPDRRKWLKHTRSTLDQIGITAATYLEFTPMHKHAKVQLPDLQIIDARLDFSVPILKVTQKICQELAIRHPEELSLKRDIPPDILRKGASVESEAQIQPYMKPGEESIGPGTLRTAKPIRASTVNLTSGRGSPALSQASAMGPGHLFNASEIGTLPKMGTIPRGMSPGSAAYREVLGRTPEPGYSEGGGLECDQFDENLINSPKITPGRETFRPQNYLEKAALNRGWLDSSRSLMEQGICEGDVVLLRFKFMQFFDMNPLRKCCRCKQEGQRQRKTVHKTRRNRNRCSCPRISI

SEQ ID NO: 124084 - protein, 170 aa, Heterodera glycines
  Homolog annotation: Hit_ID=AAN15196.1; Match level="QueryCoverage =100%, HitCoverage=45%, E-value=1e-93, Identity=100%"; Hit description=actin [Globodera rostochiensis] gb|AAN78299.1| actin 1 [Heterodera glycines] gb|AAG47837.2| actin 1 [Het
  Gene Ontology: Mol. function=structural constituent of cytoskeleton; Cellular component=cytoskeleton; Biological process=actin cytoskeleton organization and biogenesis
  Essential gene: C elegans homolog=T04C12.5; Phenotype=Ste
  Coding regions on vcDNA: vcDNA=SeqID_50507; Strand=+; Position=3-515
REIVRDIKEKLCYVALDFEQEMATAASSSSLEKSYELPDGQVITVGNERFRCPEALFQPSFIGMESAGIHESTYNSIMKCDIDIRKDLYANNVLSGGTTMYPGIADRMQKEMTALAPSTMKIKIIAPPERKYSVWIGGSILASLSTFQQMWISKQEYDESGPSIVHRKCF

SEQ ID NO: 124085 - protein, 160 aa, Heterodera glycines
  Homolog annotation: Hit_ID=AAC47533.1; Match level="QueryCoverage =72%, HitCoverage=55%, E-value=2e-37, Identity=68%"; Hit description =calponin homolog MjCAP-1 [Meloidogyne javanica]
  Gene Ontology: Mol. function=troponin C binding; Biological process =growth
  Essential gene: C elegans homolog=F28H1.2; Phenotype=Emb,Lva
  Coding regions on vcDNA: vcDNA=SeqID_50508; Strand=+; Position=41-523
MGSRSVAGGVGASIMNKQASKYNESEGELLLNWIKQVTGATMTVNGTRENFQAQLKDGTLLCKVALKLEPNSIKGVTDKASSTFQQMSNLELFIEFCRKQGVITHELFRAVDLVEARDLYSVCMTLNSLGRIMQKKGKSHPKHVSASEIVNIPSTDALRL

SEQ ID NO: 124086 - protein, 139 aa, Heterodera glycines
  Homolog annotation: Hit_ID=XP_414775.1; Match level="QueryCoverage =98%, HitCoverage=9%, E-value=2e-22, Identity=39%"; Hit description =PREDICTED: similar to Eukaryotic translation initiation factor 3 subunit 9 (eIF-3 eta) (eIF3 p116) (eIF3 p
  Essential gene: C elegans homolog=Y54E2A.11a; Phenotype=Lva,Ste
  Coding regions on vcDNA: vcDNA=SeqID_50509; Strand=+; Position=2-418
FNIPIISSDRLPKLRNVLAGVFSIQNTYKYNDNYPLDGEGNTKGFCFLEYQTKEAANAVLAICDGHRLDKNHTFSAYPFTAIRSMKEPEKDWKKPERQPYVDLGDPWSWLQNPKCLDQFGLLYESGQGGTLRLDVFWNV

SEQ ID NO: 124087 - protein, 147 aa, Heterodera glycines
  Homolog annotation: Hit_ID=CAE66740.1; Match level="QueryCoverage =79%, HitCoverage=32%, E-value=6e-47, Identity=75%"; Hit description =Hypothetical protein CBG12090 [Caenorhabditis briggsae]
  Gene Ontology: Mol. function=endopeptidase activity; Cellular component=proteasome regulatory particle (sensu Eukarya); Biological process=embryonic cleavage
  Essential gene: C elegans homolog=R12E2.3; Phenotype=Emb
  Coding regions on vcDNA: vcDNA=SeqID_50510; Strand=+; Position=110-550
MAPAPEKEKTEDKKLKDGQKPNVTTDHAHCLSNVQPNLPVNKVVVHPLVLLSVVDHFNRVNKTHKVNRVVGVLLGCMKHDKTLDIANCFAVPYDEDSENSNIFFLDADFLEDMFGMFYKVAARERIVGWYHSGPRLCKNDILINEVI

SEQ ID NO: 124088 - protein, 184 aa, Heterodera glycines
  misc_feature (128)..(128): Xaa can be any naturally occurring amino acid
  Homolog annotation: Hit_ID=CAE75300.1; Match level="QueryCoverage =79%, HitCoverage=24%, E-value=2e-37, Identity=54%"; Hit description =Hypothetical protein CBG23270 [Caenorhabditis briggsae]
  Gene Ontology: Mol. function=solute:solute antiporter activity; Cellular component=mitochondrial inner membrane; Biological process =transport
  Essential gene: C elegans homolog=F55A11.4; Phenotype=Emb
  Coding regions on vcDNA: vcDNA=SeqID_50511; Strand=+; Position=56-607
MVIKSNSVISRSHSDHFQEASGSLSATSGSEDAIKHWGWWRHFVAGATAGCVSRSVTAPLDRLKVFLQVNANHKTPHTLPSAVDYLYREGGFLSFWRGNGINILKIAQESAIKFMFYEQVSSSIFVLXFLDLEKQEFQKLTGHRDLDIFERFMAGASAGVIAQTAIYPLEVLKTRLALRRTGEL

SEQ ID NO: 124089 - protein, 159 aa, Heterodera glycines
  Homolog annotation: Hit_ID=AAO14563.2; Match level="QueryCoverage =99%, HitCoverage=21%, E-value=1e-71, Identity=89%"; Hit description =Hsp90 [Heterodera glycines]
  Gene Ontology: Mol. function=heat shock protein activity; Cellular component=centrosome; Biological process=reproduction
  Essential gene: C elegans homolog=C47E8.5; Phenotype=Emb,Ste
  Coding regions on vcDNA: vcDNA=SeqID_50512; Strand=+; Position=33-509
MSEQSGETFAFQAEIAQLMSLIINTFYSNKEIFLRELISNSSDALDKIRYQALTDPSQMESGKELFIKIVPNKADKTLTIIDTGIGMTKADLVNNLGTIAKSGTKAFMEALQAGADISMIGQFGVGFYSGFLGGERGRVTSKRHDERLWAWEEISVGGP

SEQ ID NO: 124090 - protein, 162 aa, Heterodera glycines
  Homolog annotation: Hit_ID=AAA92672.1; Match level="QueryCoverage =79%, HitCoverage=27%, E-value=4e-29, Identity=53%"; Hit description =HMG CoA synthase
  Gene Ontology: Mol. function=hydroxymethylglutaryl-CoA synthase activity; Cellular component=endoplasmic reticulum; Biological process=ergosterol biosynthesis
  Essential gene: C elegans homolog=F25B4.6; Phenotype=Emb,Lva,Lvl,Unc
  Coding regions on vcDNA: vcDNA=SeqID_50513; Strand=+; Position=2-487
NNHHPTVNGNGFGLTNGTHFADEFSESIKDVGIIGIELYFPKSYVNQEDLEKFDNVTSNKYVLGLGQQEMCFCHDNEDVCSLSLTVAAALMDNYKVNPKDIGFLAVGTETWFDKTKGESRGYGIVCRFRQLDLEGPRRKNPGFGGTQALVIAPQWVGPELPN

SEQ ID NO: 124091 - protein, 365 aa, Heterodera glycines; identical to SEQ ID NO: 122250
  Homolog annotation: Hit_ID=NP_499734.1; Match level="QueryCoverage =92%, HitCoverage=91%, E-value=3e-66, Identity=43%"; Hit description =cleavage and Polyadenylation Factor (cpf-2) [Caenorhabditis elegans] emb|CAB05746.1| Hypothetical protein
  Gene Ontology: Mol. function=RNA binding; Cellular component=nucleus; Biological process=embryogenesis and morphogenesis
  Essential gene: C elegans homolog=F56A8.6; Phenotype=Emb
  Coding regions on vcDNA: vcDNA=SeqID_50514; Strand=+; Position=36-1133

SEQ ID NO: 124092 - protein, 56 aa, Heterodera glycines
  Homolog annotation: Hit_ID=NP_498397.1; Match level="QueryCoverage =73%, HitCoverage=10%, E-value=2e-09, Identity=53%"; Hit description =zinc finger protein -related like (43.1 kD) (3H473) [Caenorhabditis elegans] gb|AAB47598.1| Hypothetical
  Gene Ontology: Biological process=embryogenesis and morphogenesis
  Essential gene: C elegans homolog=C16A3.4; Phenotype=Emb
  Coding regions on vcDNA: vcDNA=SeqID_50515; Strand=+; Position=291-461
MTTTETPTAPRLDHTTGWTCLACKLVFSSGQLQRDHYRSEWHLYNMKRQVGQFLDW

SEQ ID NO: 124093 - protein, 214 aa, Heterodera glycines
  misc_feature (64)..(64): Xaa can be any naturally occurring amino acid
  misc_feature (136)..(136): Xaa can be any naturally occurring amino acid
  misc_feature (184)..(184): Xaa can be any naturally occurring amino acid
  misc_feature (196)..(196): Xaa can be any naturally occurring amino acid
  misc_feature (202)..(202): Xaa can be any naturally occurring amino acid
  Homolog annotation: Hit_ID=XP_311177.1; Match level="QueryCoverage =99%, HitCoverage=51%, E-value=1e-106, Identity=92%"; Hit description= ENSANGP00000019055 [Anopheles gambiae]
  Gene Ontology: Biological process=reproduction
  Essential gene: C elegans homolog=T04C12.6; Phenotype=Ste
  Coding regions on vcDNA: vcDNA=SeqID_50516; Strand=+; Position=30-667
PIKMCDEEVAALVVDNGSGMCKAGFAGDDAPRAVFPSIVGRPRHQGVMVGMGQKDSYVGDEAQXSKRGILTLKYPIEHGIVTNWDDMEKIWHHTFYNELRVAPEEHPVLLTEAPLNPKANREKMTQIMFETFNTPXAMYVAIQAVLSLYASGRTTGLVLDSGDGVTHTVPIYEGYALPHTILRXLDLVRRDLADYXCKILLXRGSSFETTAEAE

SEQ ID NO: 124094 - protein, 85 aa, Heterodera glycines
  Homolog annotation: Hit_ID=NP_496558.1; Match level="QueryCoverage =100%, HitCoverage=9%, E-value=1e-10, Identity=45%"; Hit description =DNA replication licensing factor Mini Chromosome Maintenance (99.3 kD) (mcm-2) [Caenorhabditis elegans] e
  Gene Ontology: Mol. function=DNA binding; Cellular component =chromatin; Biological process=DNA replication
  Essential gene: C elegans homolog=Y17G7B.5a; Phenotype=Emb
  Coding regions on vcDNA: vcDNA=SeqID_50517; Strand=+; Position=2-256
GVYSNGYDGSLNSCHRFPLFHTVIIANHFTRKDPNQSDSLTDEDIKPSPNWQNFRNSSTIFLRGPPTFLGPAKWKQAIVFFFFGG

SEQ ID NO: 124095 - protein, 375 aa, Heterodera glycines
  misc_feature (108)..(108): Xaa can be any naturally occurring amino acid
  Homolog annotation: Hit_ID=NP_502204.2; Match level="QueryCoverage =98%, HitCoverage=84%, E-value=9e-64, Identity=36%"; Hit description =nucleoside transporter of the ENT family (50.0 kD) (ent-1) [Caenorhabditis elegans] gb|AAM46663.1| equili
  Gene Ontology: Mol. function=nucleoside transporter activity; Cellular component=integral to plasma membrane; Biological process =physiological processes
  Essential gene: C elegans homolog=ZK809.4; Phenotype=Sck
  Coding regions on vcDNA: vcDNA=SeqID_50518; Strand=+; Position=1-1124
GRRPPPDRFRLVYLIVLLHGMGMLLPWNTFITIAGDYYLQFKFANVSNEDNYKVYFFNYLTVCAQIPNLLLTFLNLFGVIRGGFYRRIYFTLAVIFGICLVTIAMGLXGFFLFTMLSVVLLNSASGVYQNSIWGLFADFPGEFAGAIIIGNNLCGILMAVLDILIIVLVGANAALAATVYFGLALFTVVLCIFSFHFLQKLNFYNYYVQKAAKARANNGTNILHEEETGEAKANIKVTHPPLKTYIAIFSEVRRQLLDVWLVFFVTLALFPTVLLKVSLISPFNDQKTSESLYKQLTVFLNFNVWAAVGCWLSGFSPRPSPDYLSLPICLRLLFLPLFWVCDYQYDHLTPRRFVFIHNPWVFTVLITLMALSHGY

SEQ ID NO: 124096 - protein, 65 aa, Heterodera glycines
  Homolog annotation: Hit_ID=CAA54829.1; Match level="QueryCoverage =78%, HitCoverage=49%, E-value=7e-20, Identity=98%"; Hit description =histone H4 [Pyrenomonas salina] sp|Q43083|H4_PYRSA Histone H4
  Essential gene: C elegans homolog=ZK131.1; Phenotype=Unclassified
  Coding regions on vcDNA: vcDNA=SeqID_50519; Strand=-; Position=3-197
LVSTFSQVLRDNIQGITKPAIRRLARRGGVKRISGLIYEETRSVLKVFLENVIRDAVNIFFLLGI

SEQ ID NO: 124097 - protein, 221 aa, Heterodera glycines
  Homolog annotation: Hit_ID=CAE71840.1; Match level="QueryCoverage =96%, HitCoverage=99%, E-value=2e-32, Identity=42%"; Hit description =Hypothetical protein CBG18881 [Caenorhabditis briggsae]
  Gene Ontology: Mol. function=calcium ion binding; Cellular component =actin filament; Biological process=signal transduction
  Essential gene: C elegans homolog=F11E6.3; Phenotype=Gro
  Coding regions on vcDNA: vcDNA=SeqID_50520; Strand=+; Position=3-665
LSSKIPFWTKLCPFSKQQPEQQQSSPVAEDTIPPQQQKEGAAMSAEGNDAPPAAEQPPPAEAAPAEAVPVQEAAAPPVEAAAETAPAEAAQPVEEAAPPAEAPVEAAPAEAAPPIEEAAPPAEAPVEAAPAEAAPPIEEAAPPAEAPVEPAPPVEEPKAAEPEAPVSEAVPAAEAPVEEAVAAPIEVAPAEAEPVSAPPAEAVPAEEAPAAEVAQLSLEEQ

SEQ ID NO: 124098 - protein, 212 aa, Heterodera glycines
  Homolog annotation: Hit_ID=NP_490762.1; Match level="QueryCoverage =97%, HitCoverage=98%, E-value=3e-39, Identity=42%"; Hit description =putative N-myristoylated nuclear protein, with a coiled coil domain, of eukaryotic origin (24.1 kD) (1B11
  Gene Ontology: Cellular component=endosome; Biological process =locomotion
  Essential gene: C elegans homolog=Y65B4A.3; Phenotype=Lva,Unc
  Coding regions on vcDNA: vcDNA=SeqID_50521; Strand=+; Position=3-641
ISLAFGQKRTDLRLAPTDHDRTTLSLKMQRDKLRQAYQRYERNIAKDAERARALLRDGRKDRALLLLKRKRFQETMINRIGFFLEQVERTITDMEMAQINREVFDNLRLGTEALKALNETISLDEVERLMEESKEAQEFQEELSTMLGQQMSEEDNDMVEEEFERMLSEQMPAVPTEQPTDTKEGRKTADEERTKEEKEPKRRREGVAQEAT

SEQ ID NO: 124099 - protein, 170 aa, Heterodera glycines
  Homolog annotation: Hit_ID=NP_493746.1; Match level="QueryCoverage =70%, HitCoverage=17%, E-value=2e-34, Identity=58%"; Hit description =yeast splicing factor PRP related, pre-mRNA splicing factor 3a (73.8 kD) (prp-21) [Caenorhabditis elegans
  Gene Ontology: Mol. function=pre-mRNA splicing factor activity; Cellular component=nucleus; Biological process=embryogenesis and morphogenesis
  Essential gene: C elegans homolog=W07E6.4; Phenotype=Emb
  Coding regions on vcDNA: vcDNA=SeqID_50522; Strand=+; Position=33-542
WIPRAACTRHEVAQEPPLQIVIPRLDDDKPLVRRPTPQAQPAAPAVPAELRVSNREEDAQNIEPSMSGKQIVGLIIPPPDIRTIVDKTALFVARNGLEFEMKIKEREASNMRFNFLNPTDPYFAYYRNKVNEFETGVASADTQSKVKLPEAVREHVQRAEFIPRLPPKPF

SEQ ID NO: 124100 - protein, 157 aa, Heterodera glycines
  Homolog annotation: Hit_ID=NP_493746.1; Match level="QueryCoverage =73%, HitCoverage=16%, E-value=2e-34, Identity=60%"; Hit description =yeast splicing factor PRP related, pre-mRNA splicing factor 3a (73.8 kD) (prp-21) [Caenorhabditis elegans
  Gene Ontology: Mol. function=pre-mRNA splicing factor activity; Cellular component=nucleus; Biological process=embryogenesis and morphogenesis
  Essential gene: C elegans homolog=W07E6.4; Phenotype=Emb
  Coding regions on vcDNA: vcDNA=SeqID_50523; Strand=+; Position=7-477
MAQEPPLQIVIPRLDDDKPLVRRPTPQAQPAAPAVPAELRVSNREEDAQNIEPSMSGKQIVGLIIPPPDIRTIVDKTALFVARNGLEFEMKIKEREASNMRFNFLNPTDPYFAYYRNKVNEFETGVASADTQSKVKLPEAVREHVQRAEFIPRLPPK

SEQ ID NO: 124101 - protein, 221 aa, Heterodera glycines
  Homolog annotation: Hit_ID=NP_741145.1; Match level="QueryCoverage =61%, HitCoverage=88%, E-value=3e-57, Identity=79%"; Hit description =myosin light chain (17.1 kD) (mlc-3) [Caenorhabditis elegans] gb|AAA50701.1| Myosin light chain protein 3
  Gene Ontology: Mol. function=structural constituent of muscle; Cellular component=muscle myosin; Biological process=muscle development
  Essential gene: C elegans homolog=F09F7.2a; Phenotype=Egl,Unc
  Coding regions on vcDNA: vcDNA=SeqID_50524; Strand=+; Position=103-768
SVRPRTSFARFFRRYTLISHSPTKHFTNKSSRRITKRKSREMPSQGELKEIFNLYDEELEGKIDATQIGDVARACGLKPTNAMVWKAAGEEYKRKGEKKLAFEEWLPIFEQLQKEKEVGTYADFVEGLKVFDKDESGKIMAAELRHVLLALGERLSAEEADELLLGAQDGEGMINYDRKRLLMKLTVSRVPTNDRSPLVFQSSSKRCWPGPTPRIERRNAN

SEQ ID NO: 124102 - protein, 279 aa, Heterodera glycines
  misc_feature (171)..(171): Xaa can be any naturally occurring amino acid
  Homolog annotation: Hit_ID=NP_498534.1; Match level="QueryCoverage =98%, HitCoverage=65%, E-value=3e-79, Identity=53%"; Hit description =UBiquitin Activating enzme related, ectopic membrane RuFfLes in embryo RFL-1, CYtoKinesis defect CYK-5 (r
  Gene Ontology: Mol. function=NEDD8 activating enzyme activity; Biological process=endomitotic cell cycle
  Essential gene: C elegans homolog=F11H8.1; Phenotype=Emb
  Coding regions on vcDNA: vcDNA=SeqID_50525; Strand=+; Position=2-931
SIEARRWLNATVCSLVEFDDGNNPKSNTIVPLIDGGTEGFKGNSRVIIPFMTPCIQCTIDLYTPQVNFPLCTIAHTPRLPEHCVEYVKVVLWEKEKPFGQDVKLDADDPAHVEWAFRAAQQRANEYEIKDVDLRLTQGVLKRIIPAVASTNAIIAGSCALEALKLASKYLXFNVVALERDPECLVCGQKSVQMYSVREDCTLSGFLDDLKDKYQLQNPSIRAGSTFLYEINTLMPEMETASRKNLCKTLKELHVTEDSELLVADEALTRSIVFRIKYSK

SEQ ID NO: 124103 - protein, 120 aa, Heterodera glycines
  misc_feature (29)..(30): Xaa can be any naturally occurring amino acid
  misc_feature (48)..(48): Xaa can be any naturally occurring amino acid
  Homolog annotation: Hit_ID=XP_313971.1; Match level="QueryCoverage =78%, HitCoverage=25%, E-value=8e-16, Identity=49%"; Hit description =ENSANGP00000009996 [Anopheles gambiae]
  Gene Ontology: Biological process=reproduction
  Essential gene: C elegans homolog=T04C12.6; Phenotype=Ste
  Coding regions on vcDNA: vcDNA=SeqID_50526; Strand=+; Position=6-365
STHSRKALLLIAFAFKTKHQSQPEKMCDXXVAALVVDNGSGMCKAGFXGDDAPPAVFPSLWAPPLFKPSCSHGNKGLYLVTRANQPGFPTLNSPFNPVSPPWDTLEKIWPPSFKKIFFPP

SEQ ID NO: 124104 - protein, 216 aa, Heterodera glycines
  Homolog annotation: Hit_ID=NP_506733.1; Match level="QueryCoverage =97%, HitCoverage=35%, E-value=3e-76, Identity=63%"; Hit description =WD repeat domain 1 family member (64.9 kD) (5P616) [Caenorhabditis elegans] emb|CAB03187.1| Hypothetical
  Gene Ontology: Mol. function=actin binding; Cellular component=actin cytoskeleton; Biological process=hearing
  Essential gene: C elegans homolog=C04F6.4a; Phenotype=Gro,Slu
  Coding regions on vcDNA: vcDNA=SeqID_50527; Strand=+; Position=22-669
MTSSDEEFKKECTFASLPRTVRGMPLVVSSNSDGTKFLYCNGNSVFIRDEENIADCDVYTEHATLTTVAKYSPSEFYIASGDQSGKIRFWDTTQSTHILKSEFALLSGAIRDISWSEDSKRVAIVGEGHERFGHVFLFDTGTSNGNLSGQSRPMNSIDFRPTRPYRLVSGSEDNTVAIFEGPPFKFKSIFHEHSRFVQSVRYNKDGSLFAAGGMDG

SEQ ID NO: 124105 - protein, 136 aa, Heterodera glycines
  misc_feature (64)..(64): Xaa can be any naturally occurring amino acid
  Homolog annotation: Hit_ID=EAA63008.1; Match level="QueryCoverage =82%, HitCoverage=84%, E-value=1e-39, Identity=71%"; Hit description =H2A_EMENI Histone H2A [Aspergillus nidulans FGSC A4] ref|XP _407605.1| H2A_EMENI Histone H2A [Aspergillus n
  Gene Ontology: Mol. function=DNA binding; Cellular component =nucleosome; Biological process=establishment and/or maintenance of chromatin architecture
  Essential gene: C elegans homolog=T23D8.6; Phenotype=Emb
  Coding regions on vcDNA: vcDNA=SeqID_50528; Strand=+; Position=216-624
RRAEKGRRRRAERVVFVKIAASGTYSTRSARAGVAFPVGRIHRLLRHGRHAQRIGAGAPVYMAXVLEYLAAEMLELTGNAATENKKLRINPRHLQLAVRNDEELNKLLSEVTISRGGVLPNIHTELLSKMQQNKQQ

SEQ ID NO: 124106 - protein, 252 aa, Heterodera glycines
  Homolog annotation: Hit_ID=NP_496958.1; Match level="QueryCoverage =100%, HitCoverage=28%, E-value=1e-116, Identity=76%"; Hit description=5'-3' exoribonuclease 2 (101.3 kD) (2O455) [Caenorhabditis elegans] emb|CAB54449.1| Hypothetical protei
  Gene Ontology: Mol. function=5'-3' exoribonuclease activity; Cellular component=chromosome; Biological process=cell growth
  Essential gene: C elegans homolog=Y48B6A.3; Phenotype=Emb,Lva,Lvl
  Coding regions on vcDNA: vcDNA=SeqID_50529; Strand=+; Position=51-806
MGVPAFFRWLSRKYVSIIVDAVEQRRREIDGVKIPIDATQPNENYQEFDNLYLDMNGIIHPCTHPEDRPAPKTEEEMFILIFEYIDRLFSIVRPRKLLYMAVDGVAPRAKMNQQRSRRFRAAQEAAEKRELIENVRKRLESEGIPLPPPRKEEEHFDSNCITPGTPFMARLSVALRYYVHKRITYDPAWQKIQVILSDANVPGEGEHKIMDYVRRQRASPAHDPNTVHCLCGADADLIMLGLATHESNFNII

SEQ ID NO: 124107 - protein, 58 aa, Heterodera glycines
  Essential gene: C elegans homolog=F55C5.5; Phenotype=Lva
  Coding regions on vcDNA: vcDNA=SeqID_50530; Strand=+; Position=2-178
ETQLLHQPFMLNPEQTVNEYLEEHGANIADFLRIEMGQEHTKTNDLVTRSKGFSFLGY

SEQ ID NO: 124108 - protein, 203 aa, Heterodera glycines
  Homolog annotation: Hit_ID=NP_492557.1; Match level="QueryCoverage =51%, HitCoverage=15%, E-value=1e-16, Identity=41%"; Hit description =complex locus; 3' and 5' of different mRNAs overlap; the locus encodes successively a product with simila
  Gene Ontology: Mol. function=transcriptional activator activity; Cellular component=cytoplasm; Biological process=signal transduction
  Essential gene: C elegans homolog=T05F1.6; Phenotype=Unclassified
  Coding regions on vcDNA: vcDNA=SeqID_50531; Strand=+; Position=2-613
LASDETAYLIADTYYRTHKYLSALSLSIPCVSYKWIQQCVAEKQLTDHRPFLLPAGESSLDTKQQFEWRPLKGVLMKGKRVLIWSSSAETDPGIVSFAEIWTPILQNLGATLVGIGPGEPFASKSSANLEEKMEFCSKIEPPVDVLLAETGLPGRGGQAGRGTGRFGRVQRMGHSGHRHWFAARPGRARRREVPLRFCLVLAE

SEQ ID NO: 124109 - protein, 161 aa, Heterodera glycines
  Homolog annotation: Hit_ID=NP_997731.1; Match level="QueryCoverage =100%, HitCoverage=50%, E-value=7e-59, Identity=66%"; Hit description= serine/threonine kinase a [Danio rerio] gb|AAH67695.1| Serine/threonine kinase a [Danio rerio]
  Gene Ontology: Mol. function=protein serine/threonine kinase activity; Cellular component=spindle; Biological process=chromosome condensation
  Essential gene: C elegans homolog=B0207.4; Phenotype=Mei
  Coding regions on vcDNA: vcDNA=SeqID_50532; Strand=+; Position=1-486
LARDRKYRIPVALKILFKSQLVKGNVEHQLVREIEIHAHLRHPNILRMFNYFHDDKKVYLILEYALHGELFKVLQKSRRFSESTSAQYIFQVSDALNYCHSKKVIHRDIKPENILLCADGKIRIADFGWAVHAKNRRQTMCGTLDYLPPEMVLKRQHDEKV

SEQ ID NO: 124110 - protein, 142 aa, Heterodera glycines; identical to SEQ ID NO: 122669
  Homolog annotation: Hit_ID=NP_492352.1; Match level="QueryCoverage =87%, HitCoverage=94%, E-value=8e-26, Identity=50%"; Hit description =ATP Synthase G homolog (14.9 kD) (asg-1) [Caenorhabditis elegans] emb|CAB03179.1| Hypothetical protein K0
  Essential gene: C elegans homolog=K07A12.3; Phenotype=Emb,Gro,Stp
  Coding regions on vcDNA: vcDNA=SeqID_50533; Strand=+; Position=42-470

SEQ ID NO: 124111 - protein, 285 aa, Heterodera glycines
  Homolog annotation: Hit_ID=NP_499068.1; Match level="QueryCoverage =93%, HitCoverage=18%, E-value=8e-56, Identity=41%"; Hit description =yeast transcriptional mediator complex RGR homolog (rgr-1) [Caenorhabditis elegans] pir||A88554 protein C
  Gene Ontology: Mol. function=transcription co-activator activity; Biological process=regulation of transcription from Pol II promoter
  Essential gene: C elegans homolog=C38C10.5a; Phenotype=Emb
  Coding regions on vcDNA: vcDNA=SeqID_50534; Strand=+; Position=1-855
KAGAPRGGGRSTTSGSPGLQVSGTRYVETADRLVEIARNELPNARLPAFQVAQAVDVLTLGSYPRLPQNIKDRFIPPLPLGAAERRLTLRQLNKLIEFHLAQQAAQLSPRIRHITVQNGMACLVVPGEFEMELTRLGDEPTTRWTLLNIRILVESAEVGEGQQMVHPLQINFLHQMVQEKLDTANEPIMAAYIVLHWFCRSLHLDILFCQALQIAKINRSGKGSEGSSQQYIRVDEYNEKECRLAISYWLRREGGTIHGRLSSHYRMLIFGDKNNSHVGLKIRHH

SEQ ID NO: 124112 - protein, 137 aa, Heterodera glycines
  Homolog annotation: Hit_ID=XP_393383.1; Match level="QueryCoverage =89%, HitCoverage=16%, E-value=1e-21, Identity=39%"; Hit description =similar to CG6693-PA [Apis mellifera]
  Gene Ontology: Mol. function=protein binding; Biological process =protein folding
  Essential gene: C elegans homolog=T24H10.3; Phenotype=Unc
  Coding regions on vcDNA: vcDNA=SeqID_50535; Strand=+; Position=3-416
CVDLFGTKDLYQILKLDRSKSNLSSAQIKKAYYRQSILWHPDRFASAQHDETTRELAKQKFQVIGRAYAILGDSEKRKAYDETGSLDDENEFYEGKDWSAVWRGVFKKVTPEEIEAYLAKFRGPYGKNNSSRMKMYK

SEQ ID NO: 124113 - protein, 220 aa, Heterodera glycines
  Homolog annotation: Hit_ID=NP_491165.1; Match level="QueryCoverage =100%, HitCoverage=25%, E-value=1e-109, Identity=88%"; Hit description=human Spastic ParapleGia homolog (spg-7) [Caenorhabditis elegans]
  Gene Ontology: Mol. function=chaperone activity; Cellular component =mitochondrion; Biological process=embryonic cleavage
  Essential gene: C elegans homolog=Y47G6A.10; Phenotype=Gro
  Coding regions on vcDNA: vcDNA=SeqID_50536; Strand=+; Position=1-660
VKTAFADVAGCEEAKIEIMEFVNFLKNPAQYKALGAKIPKGALLTGPPGTGKTLLAKATAGEANVPFITVSGSEFLEMFVGVGPSRVRDMFEMARKKAPCILFIDEIDAVGRKRGGKGAMGGHSEQENTLNQLLVEMDGFSTDESNVVVIAATNRVDILDPALMRPGRFDRQIFIPVPDIKGRASIFRVHLTPIKTTLDKIELSRKLAAHTPGFSGADIA

SEQ ID NO: 124114 - protein, 189 aa, Heterodera glycines
  Homolog annotation: Hit_ID=NP_497663.1; Match level="QueryCoverage =91%, HitCoverage=38%, E-value=5e-88, Identity=89%"; Hit description =MEChanosensory abnormality MEC-12, TuBulin, Alpha, specific of 15 protofilament microtubules found in mec
  Gene Ontology: Mol. function=GTP binding; Cellular component =microtubule; Biological process=spindle assembly
  Essential gene: C elegans homolog=F26E4.8; Phenotype=Emb
  Coding regions on vcDNA: vcDNA=SeqID_50537; Strand=+; Position=54-620
MLDMSFPETMSLFFAMTLREVISIHVGQAGVQIGNACWELYCLEHGIQPDGKMPSDQNNQDDSFITFFSETGNGRHVPRAVMVDLEPTVIDEIRTGTYKHLFHPEQLITGKEDAANNYARGHYTVGKEIIDPVLDRIRRIADNCTGLQGFLIFHSFGGGTGSGFTSLLMERLSVDYGKKSKLEFSIYPA

SEQ ID NO: 124115 - protein, 161 aa, Heterodera glycines
  Homolog annotation: Hit_ID=CAE67460.1; Match level="QueryCoverage =95%, HitCoverage=52%, E-value=4e-19, Identity=35%"; Hit description =Hypothetical protein CBG12961 [Caenorhabditis briggsae]
  Essential gene: C elegans homolog=C06A8.1a; Phenotype=Gro
  Coding regions on vcDNA: vcDNA=SeqID_50538; Strand=+; Position=17-499
MLASVINDRFNRHSQYAPFFSLEFYPPLKEHPKNLADFFEMLDHLKQAQPLFVDITWSRRNDPGNLAKLNSSSAIAIATAAIFGKERTMLHICCNDHTRTESISHVKQTLSHGIANIMALRGDDMPTEQTLLTKNTKHFAIDLVKWTRELEETDGYFGNDR

SEQ ID NO: 124116 - protein, 264 aa, Heterodera glycines
  Homolog annotation: Hit_ID=CAE67177.1; Match level="QueryCoverage =73%, HitCoverage=22%, E-value=2e-76, Identity=72%"; Hit description =Hypothetical protein CBG12609 [Caenorhabditis briggsae]
  Gene Ontology: Cellular component=nucleoplasm; Biological process =chromosome segregation
  Essential gene: C elegans homolog=ZC308.1a; Phenotype=Emb
  Coding regions on vcDNA: vcDNA=SeqID_50539; Strand=+; Position=70-861
MAPPPATVDEYTLSQSRFPSVASLAPPTVLMMSTAGQTPVHRRRHCSAGSNNAQPNNSHEAISRMDVLSERIRDFHYNEDQTHAQLNRKLQLRDQLYYAISPIFPMCGLYIVGSSLNGFGTKRSDLDLCLMITNRDIDQRTDAVVVLSSVMRTLESNQIVAEQNLILAKVPILRIKFIGTFHDITVDLNVNNSVAIRNTHLMCYYSSFDWRVRPLVMVVKEWAKRHGINDSACSSFTSYSLVLMVIHYLQCGAQPPRTCGCAHA

SEQ ID NO: 124117 - protein, 272 aa, Heterodera glycines
  misc_feature (190)..(190): Xaa can be any naturally occurring amino acid
  Homolog annotation: Hit_ID=CAE64409.1; Match level="QueryCoverage =99%, HitCoverage=65%, E-value=1e-123, Identity=83%"; Hit description= Hypothetical protein CBG09101 [Caenorhabditis briggsae]
  Gene Ontology: Mol. function=proteasome ATPase activity; Cellular component=26S proteasome; Biological process=proteolysis and peptidolysis
  Essential gene: C elegans homolog=F23F12.6; Phenotype=Emb
  Coding regions on vcDNA: vcDNA=SeqID_50540; Strand=+; Position=26-839
MENPSDFTLGGALPTSSTDDYLKLKRLENKLANLDVMEEYLKMDMRNLEKELVHAQEEVKRIQSVPLIIGQFLEAVDYDHAIVGSTTGSNYYVRVLSILDRELLKAGCSVSLHKYSNALVDVLPPESDSSIQMLRADEKPDVVYSDIGGLDTQKQEVREAVELPLTNGELYEQIGIEPPRGVLLYGPPGXCGKTMLAKAVAKHTKASFIRVVGSEFVQKYLGEGPRMVRDVFRLAKENSPCIIFIDEIDAIATKRFDAQTGADREVQRILLE

SEQ ID NO: 124118 - protein, 156 aa, Heterodera glycines
  Homolog annotation: Hit_ID=NP_499643.1; Match level="QueryCoverage =83%, HitCoverage=53%, E-value=2e-10, Identity=31%"; Hit description =angio-associated migratory cell protein (23.7 kD) (3N707) [Caenorhabditis elegans] emb|CAC35841.1| Hypoth
  Gene Ontology: Biological process=gametogenesis
  Essential gene: C elegans homolog=Y111B2A.12; Phenotype =Emb,Lva,Sck,Sma,Stp
  Coding regions on vcDNA: vcDNA=SeqID_50541; Strand=+; Position=6-473
MNYDNGISDDDDLEMDENGSDGVEIVDFVEEPHKEDNSAAKIAAHSKDVFCLALSPDGHWLASGSEDETAAVWDLRHGMTSPLLHRTISSHSDSVHLLAWNVSANILASADMAGRIICTKVTGDEATQTASLTIDDCFVEPSRRDDDNGEDEEGQG

SEQ ID NO: 124119 - protein, 418 aa, Heterodera glycines
  Homolog annotation: Hit_ID=CAE70046.1; Match level="QueryCoverage =100%, HitCoverage=100%, E-value=1e-169, Identity=72%"; Hit description=Hypothetical protein CBG16478 [Caenorhabditis briggsae]
  Gene Ontology: Mol. function=helicase activity; Cellular component =eukaryotic translation initiation factor 4 complex; Biological process=regulation of translational initiation
  Essential gene: C elegans homolog=F57B9.6; Phenotype=Lva
  Coding regions on vcDNA: vcDNA=SeqID_50542; Strand=+; Position=44-1300
MTDAKTDQKDNVKSEVGDVPNGGTSFTAQLSDDFTIQSNTNEVVDSFDNMQLKDTLLRGIYSFGFEKPSAIQQRAIVPCCSGRDVIAQAQSGTGKTATFSISVLQRVDENAPDVQALVMAPTRELAQQILLVMRALGEYMGVKFHTCIGGTSVRDDQRKLEGSVQVIVGTPGRVNDMILRGALKTDKIKMFVLDEADEMLSRGFKDQIYEVFKSLPNDVQVVLLSATMPNEVLDVTKKFMRNPIQILIKKEELTLEGIRQFYIFVDKEEWKFETLCDLYDTVNITQAVIFANTRRKVEDLARNMTQKKFTVSLIHGEMEQQDRDVIMREFRSGSSRVLITTDLLARGIDVQQVSVVINYDLPGNRENYIHRIGRSGRFGRKGVAINFVTKQDQQMLKEIETYYSTQIEEMPANIGDMI

SEQ ID NO: 124120 - protein, 219 aa, Heterodera glycines; identical to SEQ ID NO: 122351
  Homolog annotation: Hit_ID=NP_501800.1; Match level="QueryCoverage =100%, HitCoverage=19%, E-value=6e-60, Identity=51%"; Hit description= UBA (human ubiquitin) related, UBiquitin Activating enzme related (124.1 kD) (uba-1) [Caenorhabditis ele
  Gene Ontology: Mol. function=ubiquitin activating enzyme activity; Cellular component=cytoplasm; Biological process=reproduction
  Essential gene: C elegans homolog=C47E12.5; Phenotype=Emb
  Coding regions on vcDNA: vcDNA=SeqID_50543; Strand=+; Position=2-864

SEQ ID NO: 124121 - protein, 157 aa, Heterodera glycines
  Homolog annotation: Hit_ID=CAE58955.1; Match level="QueryCoverage =96%, HitCoverage=57%, E-value=1e-40, Identity=50%"; Hit description =Hypothetical protein CBG02223 [Caenorhabditis briggsae]
  Gene Ontology: Mol. function=NADH dehydrogenase (ubiquinone) activity; Cellular component=membrane fraction; Biological process =growth
  Essential gene: C elegans homolog=F59C6.5; Phenotype=Emb,Lva
  Coding regions on vcDNA: vcDNA=SeqID_50544; Strand=+; Position=10-480
MSAVKGRREQDRKEWAAYWNIRWKEVENSFVGKYSYYTNRFLDWPVTWFRENIVERLHDKHKMPYYHRKISRVPEIDECGVNDRICLFEAEEQFRLDKLVDHYIRDILYQRFTQCVRAEGYDHLYKCAKHVDDYENAELNFFIKYGELGSEQTVVAC

SEQ ID NO: 124122 - protein, 108 aa, Heterodera glycines
  Homolog annotation: Hit_ID=XP_318051.1; Match level="QueryCoverage =99%, HitCoverage=24%, E-value=1e-33, Identity=64%"; Hit description =ENSANGP00000010668 [Anopheles gambiae]
  Gene Ontology: Mol. function=ATP dependent helicase activity; Biological process=ribosome biogenesis
  Essential gene: C elegans homolog=Y55F3BR.1; Phenotype=Gro,Stp,Unc
  Coding regions on vcDNA: vcDNA=SeqID_50545; Strand=+; Position=175-498
MSLPSLCKTDSVHAFDQLRPGSDNPETLSEAVKVLKGEYLVKAIEEHKMDQAIIFCRTKLDCDNMEKFLAPRGYKCVCLHGDRSADERTRNLLSIKEKIVRFLICTDV

SEQ ID NO: 124123 - protein, 140 aa, Heterodera glycines
  misc_feature (83)..(83): Xaa can be any naturally occurring amino acid
  Homolog annotation: Hit_ID=NP_492006.1; Match level="QueryCoverage =98%, HitCoverage=25%, E-value=1e-58, Identity=76%"; Hit description =asparagiNyl tRNA Synthetase (61.2 kD) (nrs-1) [Caenorhabditis elegans] emb|CAA95808.1| Hypothetical prote
  Gene Ontology: Mol. function=ATP binding; Cellular component =cytoplasm; Biological process=protein biosynthesis
  Essential gene: C elegans homolog=F22D6.3a; Phenotype=Emb,Lva
  Coding regions on vcDNA: vcDNA=SeqID_50546; Strand=+; Position=2-421
LRMTYAEAIEWLLTNEVMNEEGKPFQFGEDISEGPERFMTDTIGQPILLNRFPHGIKAFYMSRCADQPELTESVDLLMPGVGXIVGGSMRIWKEDELLGAFQKADIDPKPYYWYVDQRKYGGCPHGGFGLGLERFVCWLA

SEQ ID NO: 124124 - protein, 159 aa, Heterodera glycines
  Homolog annotation: Hit_ID=NP_505626.1; Match level="QueryCoverage =72%, HitCoverage=11%, E-value=2e-18, Identity=39%"; Hit description =general transcription factor IIIC polypeptide 3 102kDa (119.0 kD) (5K688) [Caenorhabditis elegans] emb|CA
  Gene Ontology: Mol. function=RNA polymerase III transcription factor activity; Cellular component=transcription factor TFIIIC complex; Biological process=transcription from Pol III promoter
  Essential gene: C elegans homolog=ZK856.13; Phenotype=Gro
  Coding regions on vcDNA: vcDNA=SeqID_50547; Strand=+; Position=3-479
RIHCFGQESDKRLILDLDDQQAGPSEQKVGRRGPGRKSANPTLDNLLGHANLEHARGRTKEAMTFLFEVVKLAPYHVQTYKELSDLYSELGQKEKSFEFKMLAALLNSKTTAEEWDEIAGTAKSFNRLELAVACLAKAIRCDPENWLYYEKRIQILDAS

SEQ ID NO: 124125 - protein, 144 aa, Heterodera glycines
  Homolog annotation: Hit_ID=NP_694766.1; Match level="QueryCoverage =100%, HitCoverage=14%, E-value=2e-52, Identity=66%"; Hit description= expressed sequence AI429152 [Mus musculus] gb|AAH34516.1| Expressed sequence AI429152 [Mus musculus]
  Gene Ontology: Cellular component=nucleus
  Essential gene: C elegans homolog=F55A12.8; Phenotype=Lva
  Coding regions on vcDNA: vcDNA=SeqID_50548; Strand=+; Position=2-433
ERGVANRWRSLFIIIGDKAKDQAVTLHHILAKATTGGRPSVLWCYKKETEFSSHRKKRIKELKKRKESGLFQSKEDNLFEQFILSTQISYCYYADSHRILGNTFGMAVLQDFEALTPNLLARTVETVEGGGLVVLLIQSVTSLK

SEQ ID NO: 124126 - protein, 139 aa, Heterodera glycines
  Homolog annotation: Hit_ID=XP_522178.1; Match level="QueryCoverage =100%, HitCoverage=12%, E-value=1e-49, Identity=70%"; Hit description= PREDICTED: similar to beta isoform of regulatory subunit A, protein phosphatase 2 isoform b; protein pho
  Gene Ontology: Mol. function=protein phosphatase type 2A activity; Cellular component=shmoo tip; Biological process=cell organization and biogenesis
  Essential gene: C elegans homolog=F48E8.5; Phenotype=Emb
  Coding regions on vcDNA: vcDNA=SeqID_50549; Strand=+; Position=3-419
LLPPLENLANIEETVVRDKAVESLQKIAEKHSAAQLEEYFIPMVLRLSAGDWFTSRTSACGLFSVAYARANPAQKTELRAAFRCLCRDDTPMVRRAAASKLGDFAKVQEEDYLKNEITQMFEDLAKDEQDSVRLLSVEA

SEQ ID NO: 124127 - protein, 235 aa, Heterodera glycines
  Homolog annotation: Hit_ID=CAE65729.1; Match level="QueryCoverage =73%, HitCoverage=78%, E-value=9e-36, Identity=38%"; Hit description =Hypothetical protein CBG10812 [Caenorhabditis briggsae]
  Gene Ontology: Biological process=mitotic spindle positioning and orientation
  Essential gene: C elegans homolog=Y110A7A.13; Phenotype=Pvl,Stp
  Coding regions on vcDNA: vcDNA=SeqID_50550; Strand=+; Position=1-705
VRKCGHYQRTQSGNCVEASGQNWVDKLLKEQTTGLAQSSDCEQQQKQPQQKIDDEKQQELLMWNGLNEPSERFTTEKAMIPLNLQIAESALKVLQTKTPGGEIEQSATAGAHCTNNTCKKVFTGPESDAEECVFHPGNAVFHEGLKYWSCCGRKTTDFTTFLDQLGCTRGKHCWKKKEIVTNAREDWFQRGGQVHITIYCKGALPSETSAKSDGLTLEVTINGSTKRYELFGEIA

SEQ ID NO: 124128 - protein, 204 aa, Heterodera glycines
  Homolog annotation: Hit_ID=CAE62798.1; Match level="QueryCoverage =86%, HitCoverage=31%, E-value=5e-62, Identity=53%"; Hit description =Hypothetical protein CBG06972 [Caenorhabditis briggsae]
  Gene Ontology: Mol. function=RNA binding; Biological process =regulation of protein activity, epigenetic
  Essential gene: C elegans homolog=T01D1.2a; Phenotype=Emb
  Coding regions on vcDNA: vcDNA=SeqID_50551; Strand=+; Position=13-624
MSSESDEQSADVNGLCSQSLRSDEKVCPDPDTIKMFIGQIPKAWDELQLKEYFEEFGPIYQLSVLRDKETASSRGCCFVTYYHRKDAISAQNELHNVRTFPGLSHPIQMKPADVENKNERKLFIGMLPKSMDEESVRALFKEFGQVEDCSILREDGKSKGCAFLTLVSRSCAQQAIRKMHHSQIFEGCSKPLVVKFPDSCREKT

SEQ ID NO: 124129 - protein, 114 aa, Heterodera glycines
  Homolog annotation: Hit_ID=CAE62880.1; Match level="QueryCoverage =79%, HitCoverage=83%, E-value=4e-20, Identity=49%"; Hit description =Hypothetical protein CBG07066 [Caenorhabditis briggsae]
  Gene Ontology: Mol. function=receptor activity; Cellular component =integral to membrane; Biological process=mitochondrial translocation
  Essential gene: C elegans homolog=W10D9.5; Phenotype=Emb,Lva
  Coding regions on vcDNA: vcDNA=SeqID_50552; Strand=+; Position=19-363
MAHIQFGPQQPEVEEDLVNWDEVPDDELEETAFERFEGLKEMFPTPVRSVLSTTVQLTWVVAQNSFSFARSAAWVLSTSALLMVMPYIVDKELQDVEKAQLKQQQQLLLGGRPS

SEQ ID NO: 124130 - protein, 121 aa, Heterodera glycines
  misc_feature (27)..(27): Xaa can be any naturally occurring amino acid
  Homolog annotation: Hit_ID=AAH75177.1; Match level="QueryCoverage =97%, HitCoverage=28%, E-value=4e-34, Identity=54%"; Hit description =LOC398349 protein [Xenopus laevis]
  Gene Ontology: Mol. function=protein serine/threonine kinase activity; Cellular component=centrosome; Biological process =chromosome condensation
  Essential gene: C elegans homolog=B0207.4; Phenotype=Mei
  Coding regions on vcDNA: vcDNA=SeqID_50553; Strand=+; Position=2-367
KNRRQTMCGTLDYLPPEMVLKRQHDEXVDYWSVGVLCYEFLVGRPPFETKTQEETYTRIMKVQYSFPSFMSPDARDLISKLLVKEPSRRLSFEHVLKHHWIIAHCNKNNDADSSTASSECW

SEQ ID NO: 124131 - protein, 197 aa, Heterodera glycines
  Homolog annotation: Hit_ID=NP_010376.1; Match level="QueryCoverage =97%, HitCoverage=31%, E-value=2e-78, Identity=73%"; Hit description =Protein with strong similarity to human RNase L Inhibitor (RLI), required for vegetative growth and early
  Gene Ontology: Mol. function=ATP-binding cassette (ABC) transporter activity
  Essential gene: C elegans homolog=Y39E4B.1; Phenotype=Emb
  Coding regions on vcDNA: vcDNA=SeqID_50554; Strand=+; Position=2-592
QTAQTRIAIVNPDRCKPKNCGQPCKKNCPVVRTGKQCIVVEPTSKIAEISEILCIGCGICVKKCPYGAIQIINLPSNLERETTHRYSANSFKLHRLPTPRLGSVLGLVGTNGIGKSTALNILSNRLKPNLGSFKSPPDWPSILQYFRGSELQNYFTKLLENKFKAITKPQYVDQIPKFLEKQPLKKVGELLEKRAQK

SEQ ID NO: 124132 - protein, 178 aa, Heterodera glycines
  Homolog annotation: Hit_ID=CAE67162.1; Match level="QueryCoverage =97%, HitCoverage=55%, E-value=8e-36, Identity=43%"; Hit description =Hypothetical protein CBG12588 [Caenorhabditis briggsae]
  Gene Ontology: Mol. function=RNA binding; Cellular component=nuclear speck; Biological process=mRNA metabolism
  Essential gene: C elegans homolog=F26B1.2a; Phenotype=Emb
  Coding regions on vcDNA: vcDNA=SeqID_50555; Strand=+; Position=3-539
QDQGRDDVDVRVIVHQSHAGAIIGKQGSKIKELRELMQAHIKVFQECAPQSTDRVVLITTQQSKMPDAIKHLMEFMREVPIKGPTKPYDPSSHDPRIVQCYGGFSGPMPPPPMGGPPMGMHGGGGGYAGFGPRGGPPMPGGMGMPGGFMQEQVTTTQVTIPNELGGTIIGKGGDRINR

SEQ ID NO: 124133 - protein, 154 aa, Heterodera glycines
  Homolog annotation: Hit_ID=NP_056076.1; Match level="QueryCoverage =94%, HitCoverage=9%, E-value=3e-35, Identity=48%"; Hit description =KIAA0056 protein [Homo sapiens]
  Essential gene: C elegans homolog=Y110A7A.1a; Phenotype=Emb
  Coding regions on vcDNA: vcDNA=SeqID_50556; Strand=+; Position=185-646
MRIKKRIFRGELMSREVRASGVLAIGKLCLLDEQLAKKCIPVFVRQLRENPDHFVRNNIVVVICDLCIRYTSEVDRYSTILASCLWDSSILIRRQTLLLLTNLIKEQYLKWEGTVIYRFVTTLLDPEQCIEEYANFCLTDILLPQFRERMFFHH

SEQ ID NO: 124134 - protein, 360 aa, Heterodera glycines
  Homolog annotation: Hit_ID=NP_499741.1; Match level="QueryCoverage =95%, HitCoverage=57%, E-value=1e-123, Identity=61%"; Hit description= phosphomannomutase 45A (66.6 kD) (3O391) [Caenorhabditis elegans] emb|CAA16334.1| Hypothetical protein Y
  Gene Ontology: Biological process=growth
  Essential gene: C elegans homolog=Y43F4B.5a; Phenotype=Emb
  Coding regions on vcDNA: vcDNA=SeqID_50557; Strand=+; Position=2-1081
SFQGECHLLPSQVAPQTSSLRLTYSAFHGVGSKFVRRMFAEFGFPSENISYVKEQDKPDPDFGTVPFPNPEEGHRVLKLCIETANANDSTLLLVNDPDADRLQLAEKEANGEWRVFSGNEMGILLTWWAWTNWRAANPTADSSRVFVLHSAVSSQMVATMAKKEGFKAAHSLTGFKYIGNLAHKLRSEGNTVIAAWEESIGFTPGTTLDKDGVSSAAVFAEMANWLRTQKGVSLREQLFRLFSIYGFHLQRNSYWGVKSTEVTKKLFADLRSDYPETIGQNFDVKFVRDLTTGYDNAQPDDRAILPLSTSSEMVTFTLVDGSAVTLRASGTEPKVKYYIELRTEPGKEEKDLSSVLEQLD

SEQ ID NO: 124135 - protein, 268 aa, Heterodera glycines
  Homolog annotation: Hit_ID=CAE67991.1; Match level="QueryCoverage =70%, HitCoverage=57%, E-value=2e-44, Identity=51%"; Hit description =Hypothetical protein CBG13601 [Caenorhabditis briggsae]
  Gene Ontology: Mol. function=tRNA methyltransferase activity; Cellular component=nucleus; Biological process=gametogenesis
  Essential gene: C elegans homolog=W02A11.1; Phenotype=Gro,Stp
  Coding regions on vcDNA: vcDNA=SeqID_50558; Strand=+; Position=2-805
RTLQKSTQILYTPDIGTILLLLDVKPGARICETGTGSGSLSHAIATAVAPDGHLYSFDIDEKRAKTVHNDLKLHGLSQNATVLCRDVSQHGFAATDCAEKEWRCDGVFLDLPAPWLAIGHAHKVLLQNGPERRPSRLVSFSPCIEQVQRVCAELEQHGFVDIETVEVVPRKLKVVDLPCESLSEYAAKGANAQTFFQKESQHNNTDCEQQRQKGRRGAKRKADNAGEKTKMEEDADTCQNGLNGKVAAASIAQESDGPQTETDAMPFP

SEQ ID NO: 124136 - protein, 178 aa, Heterodera glycines
  Homolog annotation: Hit_ID=CAE64609.1; Match level="QueryCoverage =98%, HitCoverage=69%, E-value=5e-65, Identity=64%"; Hit description =Hypothetical protein CBG09365 [Caenorhabditis briggsae]
  Gene Ontology: Mol. function=RNA binding; Cellular component =polysome; Biological process=proteolysis and peptidolysis
  Essential gene: C elegans homolog=CD4.6; Phenotype=Emb,Lva,Lvl,Unc
  Coding regions on vcDNA: vcDNA=SeqID_50559; Strand=+; Position=35-568
MFRNQYDSDVTVFSPQGRLHQIDYAVEAMRQGSAAVAIRSKDYAVVVALMRAQNELSSYQQKVFKLDDHLGLSMSGLISDGRILARFMQSECAEFRWNYHNPISVELLNRKLGLKLQSNTQYYGRRPFGVGLLIIGYDDKGPHVVKAEPSGDVSEMFAASIGARSQSARTYLEKNLPE

SEQ ID NO: 124137 - protein, 204 aa, Heterodera glycines
  Homolog annotation: Hit_ID=EAA13221.3; Match level="QueryCoverage =100%, HitCoverage=27%, E-value=8e-66, Identity=59%"; Hit description= ENSANGP00000010668 [Anopheles gambiae str. PEST]
  Gene Ontology: Mol. function=RNA helicase activity; Biological process=ribosome biogenesis
  Essential gene: C elegans homolog=Y55F3BR.1; Phenotype=Gro,Stp,Unc
  Coding regions on vcDNA: vcDNA=SeqID_50560; Strand=+; Position=2-613
VHELHSRIPKYSEFGERLQMIVSSATLHNMVVQRLATQDMYFPQWIDLKGQDSDTETVHQVVCMVDPCEDKSWIRLRSKTGQSVHTDSVHARDQLQTGSDNPETLSEAVKVLKGEYLVKAIEEHKMDQAIVFCRTKLDCDNMEKFLAPRGYKCVCLHGDRSADERTRNLLSFKENIVRFLICTDVAARRLDILGVPYVDNVTLP

SEQ ID NO: 124138 - protein, 192 aa, Heterodera glycines
  Homolog annotation: Hit_ID=XP_422103.1; Match level="QueryCoverage =66%, HitCoverage=36%, E-value=5e-22, Identity=44%"; Hit description =PREDICTED: similar to Uridine monophosphate synthetase [Gallus gallus]
  Gene Ontology: Mol. function=orotidine-5'-phosphate decarboxylase activity; Biological process=UMP biosynthesis
  Essential gene: C elegans homolog=T07C4.1; Phenotype=Gro
  Coding regions on vcDNA: vcDNA=SeqID_50561; Strand=+; Position=3-578
TTSGSPGLHYLRRGVSASLDKPMLLKRKEAKTYGKKQLIEGRFEAGQSALIIEDVVTSGASVLETVAALRAVGLRCVHVFCVLDRQQGGEQRLGREADIVLRSLLSMGSLLDFLEQCGTIDAGKKTQIVHQLQNPIFDDSATHLQEQKTEKNEAECVPLVVSSSVVPTTTSVGWAQQFADGTLNRRLAQIMV

SEQ ID NO: 124139 - protein, 151 aa, Heterodera glycines
  Homolog annotation: Hit_ID=AAS50826.1; Match level="QueryCoverage =74%, HitCoverage=20%, E-value=2e-13, Identity=42%"; Hit description =ABR056Cp [Ashbya gossypii ATCC 10895] ref|NP_983002.1| ABR056Cp [Eremothecium gossypii]
  Gene Ontology: Cellular component=chromatin; Biological process=DNA replication
  Essential gene: C elegans homolog=W02D9.1; Phenotype=Emb
  Coding regions on vcDNA: vcDNA=SeqID_50562; Strand=+; Position=6-458
MFFGEEITKIPREVGKEDVCKAISHQIEAIDIDQCNLNMYLKPDTGVISLDQFQAMGSKRLTMLRKLEMLKEKFGNANSQDEYKKAFREDIGALMPLVTNLCVNAGLNEARREDRISHFILRLAFCHIPEQSDWFVRLETELFRMRFQNET

SEQ ID NO: 124140 - protein, 268 aa, Heterodera glycines; identical to SEQ ID NO: 122682
  Homolog annotation: Hit_ID=NP_508734.1; Match level="QueryCoverage =97%, HitCoverage=60%, E-value=1e-100, Identity=69%"; Hit description= choline kinase (49.2 kD) (XE909) [Caenorhabditis elegans] gb|AAK39220.1| Choline kinase a protein 2 [Cae
  Gene Ontology: Mol. function=choline kinase activity; Biological process=lipid metabolism
  Essential gene: C elegans homolog=B0285.8; Phenotype=Unclassified
  Coding regions on vcDNA: vcDNA=SeqID_50563; Strand=+; Position=73-876

SEQ ID NO: 124141 - protein, 155 aa, Heterodera glycines
  Homolog annotation: Hit_ID=CAE71397.1; Match level="QueryCoverage =100%, HitCoverage=14%, E-value=7e-71, Identity=86%"; Hit description= Hypothetical protein CBG18305 [Caenorhabditis briggsae]
  Gene Ontology: Mol. function=calcium-transporting ATPase activity; Cellular component=smooth endoplasmic reticulum; Biological process =calcium ion homeostasis
  Essential gene: C elegans homolog=K11D9.2a; Phenotype=Ste
  Coding regions on vcDNA: vcDNA=SeqID_50564; Strand=+; Position=25-489
MENAHTKSEDELFRFFGTGPDGLTEEQADELRDKYGYNEMPAEEGKKLWELILEQFDDLLVKILLLAAIISFVLALFEEHDDQTSAVTAFVEPFVILLILIANATVGVWQERNAESAIEALKEYEPEMAKVIRAGKHGIQMIRAKELVPGDLVEV

SEQ ID NO: 124142 - protein, 247 aa, Heterodera glycines; identical to SEQ ID NO: 122162
  Homolog annotation: Hit_ID=NP_508269.1; Match level="QueryCoverage =99%, HitCoverage=36%, E-value=8e-16, Identity=25%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
  Coding regions on vcDNA: vcDNA=SeqID_50565; Strand=+; Position=2-742

SEQ ID NO: 124143 - protein, 189 aa, Heterodera glycines
  Homolog annotation: Hit_ID=NP_741810.1; Match level="QueryCoverage =97%, HitCoverage=44%, E-value=3e-70, Identity=67%"; Hit description =aspartate aminotransferase Complex With Alpha-Methyl (45.6 kD) (XG861) [Caenorhabditis elegans] gb|AAA803
  Gene Ontology: Cellular component=extracellular space; Biological process=aspartate catabolism
  Essential gene: C elegans homolog=T01C8.5; Phenotype=Gro
  Coding regions on vcDNA: vcDNA=SeqID_50566; Strand=+; Position=49-615
MDQQEKSSGWFANVEMGPPDVILGVTEAFKRDDNPKKVNLGVGAYRDDQGMPFVLPSVKQAEKELLEANLDKEYAGIAGLPDFTAKAIELALGRDSEVLKAKRNATVQSVSGTGALRTGAEFLSKWFPHNKVVYQPTPTWGNHVPVFKVAGFEIQKYRYYDPKTCGFDENGCLEDILNIPAKSVILFHA

SEQ ID NO: 124144 - protein, 130 aa, Heterodera glycines; identical to SEQ ID NO: 122180
  Homolog annotation: Hit_ID=CAE59628.1; Match level="QueryCoverage =96%, HitCoverage=97%, E-value=5e-57, Identity=89%"; Hit description =Hypothetical protein CBG03041 [Caenorhabditis briggsae]
  Gene Ontology: Mol. function=pre-mRNA splicing factor activity; Cellular component=small nuclear ribonucleoprotein complex; Biological process=neurogenesis
  Essential gene: C elegans homolog=M28.5; Phenotype=Emb,Lva
  Coding regions on vcDNA: vcDNA=SeqID_50567; Strand=+; Position=31-423

SEQ ID NO: 124145 - protein, 199 aa, Heterodera glycines
  Homolog annotation: Hit_ID=CAE68356.1; Match level="QueryCoverage =45%, HitCoverage=22%, E-value=1e-21, Identity=56%"; Hit description =Hypothetical protein CBG14093 [Caenorhabditis briggsae]
  Essential gene: C elegans homolog=F49H12.1; Phenotype=Gro,Pvl,Stp,Unc
  Coding regions on vcDNA: vcDNA=SeqID_50568; Strand=+; Position=36-632
MLFFQNGPVEQCPHQQQQNAAPLSHRPTAFSLPATSPFSTISSVGSLPSEPTTPTERMSTGNVMMMMSPKRMDKGNGGEKGQRQKAPGKERPKDGKERVHKCDQCQKAFRFKSNLFEHKSLHLGSSSRNPFVCPFCSKTCRLKGNLKKHLQVHVTSAEDLECLWKRSFSRSSGRPSKNAPPAPLPKPGDDLGMVPVLVS

SEQ ID NO: 124146 - protein, 250 aa, Heterodera glycines
  misc_feature (141)..(141): Xaa can be any naturally occurring amino acid
  misc_feature (161)..(161): Xaa can be any naturally occurring amino acid
  Homolog annotation: Hit_ID=CAE67745.1; Match level="QueryCoverage =93%, HitCoverage=78%, E-value=6e-70, Identity=55%"; Hit description =Hypothetical protein CBG13320 [Caenorhabditis briggsae] emb|CAE67740.1| Hypothetical protein CBG13315 [Cae
  Gene Ontology: Mol. function=transcription factor activity; Cellular component=CCR4-NOT core complex; Biological process=regulation of transcription, DNA-dependent
  Essential gene: C elegans homolog=Y56A3A.20; Phenotype=Emb
  Coding regions on vcDNA: vcDNA=SeqID_50569; Strand=+; Position=302 -1053
MTVTSTKNNSFPSSFKDITLHDVWASNLEAEFAKLRDLIDDYPFVAMDTEYPGVIATPVGQFRSKEDFNYQQLRLNVDCLKLIQVGFTLMNEKGQLPPARDIFQFNLHFDPSTDSFAHNSLELLKTAGFDFNKHQNGGHQXRTLGELLTTSGLVADRRITXLTFHSCFDYGHLIRAIMLVKLPEDDQDFFRYHRKLIPNRFHFEILLRLTGSRDTMLNGRLQELADQLHVPRIATCHQVGSDSLLTAMTF

SEQ ID NO: 124147 - protein, 135 aa, Heterodera glycines
  Homolog annotation: Hit_ID=NP_496290.2; Match level="QueryCoverage =92%, HitCoverage=57%, E-value=1e-20, Identity=43%"; Hit description =programmed cell death 10 (24.8 kD) (2K896) [Caenorhabditis elegans] emb|CAA90115.2| Hypothetical protein
  Essential gene: C elegans homolog=C14A4.11; Phenotype=Dpy,Emb
  Coding regions on vcDNA: vcDNA=SeqID_50570; Strand=+; Position=23-430
MSNNDIIFRNEEGVNYLAPWTYSCLIKTSIDRLKTALSENREAIHALNHLQEVFRQIDRASPSFLYDFSKLLLIDSGVAGTNVQESYLRMHANAATEELELPQFAHIAEFQYLSMRAVSLCKVLARIPDEMTDRF

SEQ ID NO: 124148 - protein, 152 aa, Heterodera glycines
  Homolog annotation: Hit_ID=NP_497614.1; Match level="QueryCoverage =100%, HitCoverage=46%, E-value=2e-65, Identity=78%"; Hit description= rna helicase (3D862) [Caenorhabditis elegans] gb|AAK29964.1| Hypothetical protein Y71H2AM.18 [Caenorhabd
  Gene Ontology: Mol. function=RNA helicase activity; Cellular component=cytoplasm; Biological process=translational initiation
  Essential gene: C elegans homolog=Y54E10A.9a; Phenotype=Emb
  Coding regions on vcDNA: vcDNA=SeqID_50571; Strand=+; Position=3-458
VFLAVGRVGSTSENIGQKVVWVEEHNKRHFLMDLLDASEPEALTLIFVETKRGCGDLSYMLQQEGYHCVAIHGDLKQMERERHLENFRNGTAPILVATAVAARGLDIPNVKHVINYDLPNDIDEYVHRIGRTGRVGNIGMATSFFNDKNRNI

SEQ ID NO: 124149 - protein, 106 aa, Heterodera glycines; identical to SEQ ID NO: 122167
  Homolog annotation: Hit_ID=CAE69896.1; Match level="QueryCoverage =68%, HitCoverage=91%, E-value=2e-15, Identity=50%"; Hit description =Hypothetical protein CBG16246 [Caenorhabditis briggsae]
  Essential gene: C elegans homolog=R10H10.4; Phenotype=Emb
  Coding regions on vcDNA: vcDNA=SeqID_50572; Strand=+; Position=155-475

SEQ ID NO: 124150 - protein, 297 aa, Heterodera glycines
  misc_feature (122)..(122): Xaa can be any naturally occurring amino acid
  Homolog annotation: Hit_ID=CAE71286.1; Match level="QueryCoverage =99%, HitCoverage=83%, E-value=1e-106, Identity=61%"; Hit description= Hypothetical protein CBG18174 [Caenorhabditis briggsae]
  Gene Ontology: Mol. function=actin binding; Cellular component=Arp2/3 protein complex; Biological process=embryogenesis and morphogenesis
  Essential gene: C elegans homolog=Y79H2A.6; Phenotype=Emb
  Coding regions on vcDNA: vcDNA=SeqID_50573; Strand=+; Position=3-894
QSDSPVPNWLLNIGPISCHAWNKDKTQLAVSPSNNEIHIFARLETVWNPLHVLREHDLLITGLDWAPNTNRIVSCSHDKNAFVWTWEAEKNSWKPEMVVVRINRAATCVKWSPNENKFAVGXRENDWWVAKQIKKLIRSTVTSLNWHPNNILLAVGACDFKTRVFSAYVKEIDEKPTPNPWGTKMPLGELLKEYQSTGWVHDLAFSPSGCKLAWVSHDSSIAVIDKSNSQPQERPIQHKTAFLPFTSVRWVNETHIVTAGHDCSPMLFTFDGTALNFKCKLDVPPENKNGSNVSSAF

SEQ ID NO: 124151 - protein, 125 aa, Heterodera glycines
  Homolog annotation: Hit_ID=NP_501727.1; Match level="QueryCoverage =91%, HitCoverage=37%, E-value=8e-48, Identity=81%"; Hit description =adenine nucleotide family member (4K472) [Caenorhabditis elegans] emb|CAA92472.1| Hypothetical protein K0
  Gene Ontology: Mol. function=adenine transporter activity; Cellular component=integral to plasma membrane; Biological process =embryogenesis and morphogenesis
  Essential gene: C elegans homolog=T27E9.1a; Phenotype=Emb
  Coding regions on vcDNA: vcDNA=SeqID_50574; Strand=+; Position=102-476
MSENKSEGGAEKKKSGGFNTKKFLLDLASGGTAAAVSKTAVAPIERVKLLLQVQDASIHITADKRYKGIIDVLVRVPKEQGFLSLWRGNLANVIRYFPTQALNFAFKDTYKRVFTQGVDKEKQFL

SEQ ID NO: 124152 - protein, 218 aa, Heterodera glycines
  Homolog annotation: Hit_ID=CAE70145.1; Match level="QueryCoverage =100%, HitCoverage=70%, E-value=2e-76, Identity=63%"; Hit description= Hypothetical protein CBG16607 [Caenorhabditis briggsae]
  Gene Ontology: Mol. function=pre-mRNA splicing factor activity; Cellular component=nucleus; Biological process=mRNA splicing
  Essential gene: C elegans homolog=K04G7.10; Phenotype=Emb
  Coding regions on vcDNA: vcDNA=SeqID_50575; Strand=+; Position=4-657
MTQFLPDNLLALFAPRPPIQFKPPPDDLFIHRKHMQMGGMAECVHGFEDPKDTPPKPKIETREEKRARKRKEKEELMAYKIELCIATWTPADNPKATVDPYKTLFIGRINYETSESKLRREFEKYGKITKIIMVHDKNSKPRGYAFIEYAHKSEMSAAYKKADGTKIDGRRVVVDYKRGRTQKKWLPRPLGGGKGGPRPMRESKAKMLARELARKGGG

SEQ ID NO: 124153 - protein, 155 aa, Heterodera glycines
  misc_feature (143)..(143): Xaa can be any naturally occurring amino acid
  Homolog annotation: Hit_ID=NP_477226.2; Match level="QueryCoverage =96%, HitCoverage=35%, E-value=3e-41, Identity=53%"; Hit description =CG5179-PA [Drosophila melanogaster] gb|AAF46868.1| CG5179-PA [Drosophila melanogaster] gb|AAM50669.1| GH2
  Gene Ontology: Mol. function=[RNA-polymerase]-subunit kinase activity; Cellular component=transcription elongation factor complex; Biological process=RNA elongation from Pol II promoter
  Essential gene: C elegans homolog=H25P06.2a; Phenotype=Emb,Gro,Unc
  Coding regions on vcDNA: vcDNA=SeqID_50576; Strand=+; Position=39-543
TFQEQPEHCYTNRVVTLWYRPPELLLGTRNYGPAIDIWGAGCIMAELWIRAPILYVNTEQSQLELISKLCGSINPHSWPGVWCDKLPYYNNLQGSLQQNLPRRVRERINPFLQNNEQALSLIDFMLTLNPEKRPSASAALDHXFFFEAPIPAINI

SEQ ID NO: 124154 - protein, 165 aa, Heterodera glycines
  Homolog annotation: Hit_ID=CAE67047.1; Match level="QueryCoverage =98%, HitCoverage=42%, E-value=7e-24, Identity=34%"; Hit description =Hypothetical protein CBG12454 [Caenorhabditis briggsae]
  Essential gene: C elegans homolog=ZK858.7; Phenotype=Dpy,Gro,Stp
  Coding regions on vcDNA: vcDNA=SeqID_50577; Strand=+; Position=3-497
PSKIHEGVFAIVRKVGGEHIRLCRLISGQRVLIERLSFNPKDAIGHFYGIFEVSNGGDMLCPIEFASKLFFTEFSNGNSAGDRGHGNESTQQLTSNQIMSLKEDGITTNELVSKLVSGNCHFQSRTKFSKEKYMRKKVHKHSDRVVILQPNIRLLADCYYRKDPQ

SEQ ID NO: 124155 - protein, 108 aa, Heterodera glycines
  Homolog annotation: Hit_ID=CAE59286.1; Match level="QueryCoverage =74%, HitCoverage=25%, E-value=9e-22, Identity=65%"; Hit description =Hypothetical protein CBG02619 [Caenorhabditis briggsae]
  Essential gene: C elegans homolog=C29F5.4; Phenotype=Emb
  Coding regions on vcDNA: vcDNA=SeqID_50578; Strand=+; Position=138-461
MAKLESFCAINGSRPLEAKAEFRPINSMDFHSDVGRMLYTIAILLMFSFVIFALMVRSISRSRSSAELETLLDAMRFREELDIQLRQKHRLRKAKRKVTAWLCRGNGA

SEQ ID NO: 124156 - protein, 133 aa, Heterodera glycines
  Homolog annotation: Hit_ID=NP_492601.1; Match level="QueryCoverage =90%, HitCoverage=91%, E-value=8e-37, Identity=56%"; Hit description =cytochrome C Oxidase, subunit Vb, LiPid Depleted LPD-4 (lpd-4) [Caenorhabditis elegans] emb|CAB03002.1| H
  Gene Ontology: Cellular component=extracellular space; Biological process=negative regulation of FGF receptor signaling pathway
  Essential gene: C elegans homolog=F26E4.9; Phenotype=Lpd
  Coding regions on vcDNA: vcDNA=SeqID_50579; Strand=+; Position=26-427
MTMNRLLPGRSLLPKIMRNFSHSNRLAASEADPEHYGYFPDPTEQMWGLEREMLAARLKGEDRYSPKIYYRAEHSTKDVPNVVRVHLEDKVVGCLCEHDGDHVNYWHIRKGDTKRCECGHWFKGVQADTDSFD

SEQ ID NO: 124157 - protein, 135 aa, Heterodera glycines
  misc_feature (110)..(110): Xaa can be any naturally occurring amino acid
  Homolog annotation: Hit_ID=NP_491707.1; Match level="QueryCoverage =37%, HitCoverage=4%, E-value=6e-11, Identity=66%"; Hit description=P- GlycoProtein related (pgp-2) [Caenorhabditis elegans] gb|AAB52482.2| P-glycoprotein related protein 2 [C
  Essential gene: C elegans homolog=C34G6.4; Phenotype=Unclassified
  Coding regions on vcDNA: vcDNA=SeqID_50580; Strand=+; Position=76-479
MEGIFGTQRGGGDILPNNDNNGNHNDRQPLLLEENEKASYGSLVPTEDSFRQDKHWWKRSGKLKASKRQLGIFAYSSSVDYALIAFGTVASVLHGAGFPLLSIVLGGMTXRAENSDFVHGQTPRQNATNSSAISP

SEQ ID NO: 124158 - protein, 216 aa, Heterodera glycines
  Homolog annotation: Hit_ID=CAE73776.1; Match level="QueryCoverage =99%, HitCoverage=29%, E-value=2e-92, Identity=74%"; Hit description =Hypothetical protein CBG21320 [Caenorhabditis briggsae]
  Gene Ontology: Mol. function=glycine-tRNA ligase activity; Cellular component=mitochondrion; Biological process=tRNA modification
  Essential gene: C elegans homolog=T10F2.1a; Phenotype=Emb
  Coding regions on vcDNA: vcDNA=SeqID_50581; Strand=+; Position=3-650
CALKANMIQAWRTHFVLEEGMLEVECTSLTPEYVLKASGHVDRFIDWMVKDKQTGACFRADHLVKNQAETLIRDKKTDEKTKSELMNVLVMLDGMSCDDLHEVIKKFNFKSPLTGGDLSEPVSFNLMFPTEIGPTCDQRAFLRPETAQGIFINFKRLLEFNQGRLPFAAAQVGSGFRNEISPRQGLIRVREFTMCEIEHFVDPTDKRHPKFEKIAH

SEQ ID NO: 124159 - protein, 168 aa, Heterodera glycines
  Homolog annotation: Hit_ID=AAH45216.1; Match level="QueryCoverage =96%, HitCoverage=38%, E-value=4e-21, Identity=33%"; Hit description =RNPC7 protein [Xenopus laevis]
  Essential gene: C elegans homolog=W04D2.6a; Phenotype=Gro
  Coding regions on vcDNA: vcDNA=SeqID_50582; Strand=+; Position=12-515
MAFPPPFPNPLLPRLPNQSVQFPGQKFGFFSPQRQSILPGIPLLRPRFRPNFIPRELRPPNPLARPTGPPTTTTVFIGNISDKCPDRIIQEVLKKCGSVCNWKRLQDSRGKFKAFGFCDFMYPDGAKKALSVLKDFPIGDKRLNVKADEQTEKLLDEFSKNKLIAANE

SEQ ID NO: 124160 - protein, 190 aa, Heterodera glycines
  misc_feature (120)..(120): Xaa can be any naturally occurring amino acid
  misc_feature (153)..(153): Xaa can be any naturally occurring amino acid
  Homolog annotation: Hit_ID=NP_497550.1; Match level="QueryCoverage =99%, HitCoverage=98%, E-value=1e-32, Identity=39%"; Hit description =mitochondrial ribosomal protein L30 like (23.3 kD) (3D496) [Caenorhabditis elegans] gb|AAC68918.1| Hypoth
  Essential gene: C elegans homolog=W04B5.4; Phenotype=Lva
  Coding regions on vcDNA: vcDNA=SeqID_50583; Strand=+; Position=41-615
MSKQIRTCWVWRKNNRWWRYLPRRNDSHNLIDMDELGEQCATFSDPMPADPPKLWVAWLYTDSYGSGRKIRDQVTKLFGKDAKTGEMQVFKNTLSTNKQLWKIKHLLEIRPVTFPNGEPXPEDATHLEIMADGRCVIDRQSLPNVDEFQLIDXASQFSPRYLASRLMSKDVAKQDVYEDTVYNPENISIG

SEQ ID NO: 124161 - protein, 146 aa, Heterodera glycines
  Homolog annotation: Hit_ID=CAE74519.1; Match level="QueryCoverage =100%, HitCoverage=91%, E-value=3e-38, Identity=55%"; Hit description= Hypothetical protein CBG22273 [Caenorhabditis briggsae]
  Gene Ontology: Mol. function=structural constituent of ribosome; Cellular component=cytosolic large ribosomal subunit (sensu Eukarya); Biological process=reproduction
  Essential gene: C elegans homolog=D1007.12; Phenotype=Emb,Lva,Ste
  Coding regions on vcDNA: vcDNA=SeqID_50584; Strand=+; Position=3-443
HPGHGKRVVRADGKIQIYLSKKAQRGAALKRNPRDVPWTVLYRRKHKKGVHAEEGTQRKRVKRTVQIASRPIADLTVEALLAQRNQKPEFRKQQREAAIKAAKESARVQKDETKKKQQKIDKKAAPTKTKAAKQVKAPKQFVGGKR

SEQ ID NO: 124162 - protein, 91 aa, Heterodera glycines; identical to SEQ ID NO: 122150
  Homolog annotation: Hit_ID=XP_393173.1; Match level="QueryCoverage =84%, HitCoverage=14%, E-value=9e-36, Identity=98%"; Hit description =similar to Hypothetical protein CBG09037 [Apis mellifera]
  Essential gene: C elegans homolog=ZK1010.1; Phenotype=Emb
  Coding regions on vcDNA: vcDNA=SeqID_50585; Strand=+; Position=3-278

SEQ ID NO: 124163 - protein, 197 aa, Heterodera glycines
  Homolog annotation: Hit_ID=CAE63623.1; Match level="QueryCoverage =95%, HitCoverage=64%, E-value=9e-64, Identity=61%"; Hit description =Hypothetical protein CBG08117 [Caenorhabditis briggsae]
  Essential gene: C elegans homolog=T04G9.4; Phenotype=Gro,Prz,Unc
  Coding regions on vcDNA: vcDNA=SeqID_50586; Strand=+; Position=107-697
MQAVTEQCFCKRWAFSLKKSMESENFERHFRLAIQSVTAEDYEKMRQYRHREDSLATLAGRLFLRKAVQCLCGVRWADIEISRTERGKPFIVRPENISIGLNVSHQGDYTVFASSCTNQVGVDVMRLDMCRGNKTADEYINSMAKSASAGELRTMRGQPTEQMKMTVFYRYWCLKEAIMKATGHGLVNDLSRFDFII

SEQ ID NO: 124164 - protein, 150 aa, Heterodera glycines
  Homolog annotation: Hit_ID=NP_500569.1; Match level="QueryCoverage =82%, HitCoverage=87%, E-value=1e-55, Identity=88%"; Hit description =histone H2A.F Z (14.7 kD) (4F211) [Caenorhabditis elegans] gb|AAC48074.1| Hypothetical protein R08C7.3 [C
  Gene Ontology: Mol. function=chromatin binding; Cellular component =polytene chromosome; Biological process=establishment and/or maintenance of chromatin architecture
  Essential gene: C elegans homolog=R08C7.3; Phenotype=Gro
  Coding regions on vcDNA: vcDNA=SeqID_50587; Strand=+; Position=27-479
MAGGKRKAGKDSGKAKSKKIISRSARAGLQFPVGRIHRFLKKRTTSTGRVGATAAVYSAAILEYLTAEVLELAGNASKDLKVKRVTPRHLHLAIRGDEELDSMVTATIAGGGVIPHIHRSLMRKPPSQLNHSHQHNHSQQQMTNVGNGDN

SEQ ID NO: 124165 - protein, 205 aa, Heterodera glycines
  Homolog annotation: Hit_ID=CAB02838.1; Match level="QueryCoverage =87%, HitCoverage=96%, E-value=2e-23, Identity=34%"; Hit description =Hypothetical protein C41G7.1a [Caenorhabditis elegans] pir||T19892 hypothetical protein C41G7.1 - Caenorha
  Gene Ontology: Mol. function=protein binding; Cellular component =nucleus; Biological process=spliceosome assembly
  Essential gene: C elegans homolog=C41G7.1a; Phenotype=Lva,Unc
  Coding regions on vcDNA: vcDNA=SeqID_50588; Strand=+; Position=2-619
ASESGSDKIVFQKNVTGRGSQVLDDAEFVKMYDRSTSKTLNTSSANDNAQSNQQKEQVQKWKVGDQCMALYEVDGKCYPAKIEQISPVKNTCTVSYIGYDQKAILKLEDILGESDVEAADDHGDEREAEGTSGTTKIADNDVKKDAFPIPDLCPPPPPSMFGKIAVAGNEKEALTNMLMSWYMSGYHTGFYQGVMHEKTTRQKPK

SEQ ID NO: 124166 - protein, 151 aa, Heterodera glycines
  Homolog annotation: Hit_ID=NP_504559.1; Match level="QueryCoverage =96%, HitCoverage=92%, E-value=8e-71, Identity=88%"; Hit description =AdaPTin or adaptin-related protein (18.6 kD) (apt-2C) [Caenorhabditis elegans] gb|AAB65902.1| Adaptin or
  Gene Ontology: Mol. function=protein transporter activity; Cellular component=AP-1 adaptor complex; Biological process=neurotransmitter secretion
  Essential gene: C elegans homolog=F29G9.3; Phenotype=Emb,Lva,Lvl,Unc
  Coding regions on vcDNA: vcDNA=SeqID_50589; Strand=+; Position=1-456
AVLAPGKLRLQKWYVAYPDKAKKKITRELVTTILSRKPKMCAFLEYKDTKVVYKRYASLYFCCAIEQTDNELLCLEVIHRYVELLDRYFGSVCELDIIFNFEKAYFILDEFLLAGEIQETSKKQVLKAISAQDLLQDEETTQGLFEDNGLG

SEQ ID NO: 124167 - protein, 65 aa, Heterodera glycines
  misc_feature (49)..(49): Xaa can be any naturally occurring amino acid
  Homolog annotation: Hit_ID=XP_317628.1; Match level="QueryCoverage =93%, HitCoverage=21%, E-value=2e-15, Identity=65%"; Hit description =ENSANGP00000019124 [Anopheles gambiae] gb|EAA12157.2| ENSANGP00000019124 [Anopheles gambiae str. PEST]
  Gene Ontology: Mol. function=F-actin capping activity
  Essential gene: C elegans homolog=M106.5; Phenotype =Bmd,Dpy,Emb,Gro,Lvl
  Coding regions on vcDNA: vcDNA=SeqID_50590; Strand=+; Position=342-587
MSGELRLDSSLDLMRRLPPQNCEKHLTDLVALAPDLCESLLTAVDQPLXVAKGLQTTGREYLLCG

SEQ ID NO: 124168 - protein, 336 aa, Heterodera glycines; identical to SEQ ID NO: 122321
  Homolog annotation: Hit_ID=NP_498280.1; Match level="QueryCoverage =71%, HitCoverage=95%, E-value=4e-90, Identity=53%"; Hit description =paxillin (3G980) [Caenorhabditis elegans] gb|AAA62294.1| Hypothetical protein C28H8.6a [Caenorhabditis el
  Gene Ontology: Mol. function=protein binding; Cellular component =focal adhesion; Biological process=integrin-mediated signaling pathway
  Essential gene: C elegans homolog=C28H8.6a; Phenotype=Lva
  Coding regions on vcDNA: vcDNA=SeqID_50591; Strand=+; Position=27-1034

SEQ ID NO: 124169 - protein, 52 aa, Heterodera glycines
  Essential gene: C elegans homolog=F55C5.5; Phenotype=Lva
  Coding regions on vcDNA: vcDNA=SeqID_50592; Strand=+; Position=3-161
GEETQLLHQPFMLNPEQTVNEYLEAHGANIADFLRIEMGQEHTKTNDLSVHC

SEQ ID NO: 124170 - protein, 133 aa, Heterodera glycines; identical to SEQ ID NO: 122713
  Homolog annotation: Hit_ID=CAE59649.1; Match level="QueryCoverage =100%, HitCoverage=100%, E-value=3e-40, Identity=58%"; Hit description=Hypothetical protein CBG03063 [Caenorhabditis briggsae]
  Gene Ontology: Mol. function=DNA-directed RNA polymerase activity; Cellular component=DNA-directed RNA polymerase II, holoenzyme; Biological process=transcription from Pol III promoter
  Essential gene: C elegans homolog=C06A1.5; Phenotype=Emb,Ste
  Coding regions on vcDNA: vcDNA=SeqID_50593; Strand=+; Position=25-426

SEQ ID NO: 124171 - protein, 203 aa, Heterodera glycines
  Homolog annotation: Hit_ID=NP_497777.1; Match level="QueryCoverage =99%, HitCoverage=41%, E-value=2e-29, Identity=40%"; Hit description =UDP-N-acteylglucosamine pyrophosphorylase 1 (53.5 kD) (3E932) [Caenorhabditis elegans] emb|CAA91270.2| Hy
  Gene Ontology: Mol. function=UDP-N-acetylglucosamine pyrophosphorylase activity; Biological process=UDP-N -acetylglucosamine biosynthesis
  Essential gene: C elegans homolog=C36A4.4; Phenotype=Emb
  Coding regions on vcDNA: vcDNA=SeqID_50594; Strand=+; Position=2-610
FDFSYLNKAFKRALEPKLPSTDIRPIPDERCVNTAHLGEAEKERLEQIGLKAIAEGRVAAVVLAGGQASRLGSAQPKGVLRLGTGLGQDDVDSLLFIQAAQIVRLQRMAAEQFPAEAAKSGGRITWLVMTSNTTNAAVHDHLNAVLAETGLSSDQVLIFTQKEIPAFDFDGNALMKSSTELVTAPDGNGGFYDVVRPLLPNWR

SEQ ID NO: 124172 - protein, 125 aa, Heterodera glycines
  Homolog annotation: Hit_ID=NP_498349.1; Match level="QueryCoverage =100%, HitCoverage=50%, E-value=2e-52, Identity=81%"; Hit description= ribosomal Protein, Small subunit (27.3 kD) (rps-3) [Caenorhabditis elegans] gb|AAF99870.1| Ribosomal pro
  Gene Ontology: Mol. function=structural constituent of ribosome; Cellular component=eukaryotic 48S initiation complex; Biological process=protein biosynthesis
  Essential gene: C elegans homolog=C23G10.3; Phenotype=Emb
  Coding regions on vcDNA: vcDNA=SeqID_50595; Strand=+; Position=53-427
MAQQQAITKKRKAVQDGIFKAELNNFLMKELAEDGYSGVEVRRAPSRTEVIIMATRTQSVLGERGKRIRELTALVQKRFGYSAGQIELYAEKVSSRGLCAVAQCESLRYKLVGGLTVRRACYGVL

SEQ ID NO: 124173 - protein, 159 aa, Heterodera glycines
  Homolog annotation: Hit_ID=NP_505624.1; Match level="QueryCoverage =93%, HitCoverage=86%, E-value=3e-27, Identity=37%"; Hit description =putative protein of eukaryotic origin (5K684) [Caenorhabditis elegans] emb|CAA94859.1| Hypothetical prote
  Essential gene: C elegans homolog=ZK856.11; Phenotype=Lva
  Coding regions on vcDNA: vcDNA=SeqID_50596; Strand=+; Position=34-513
MSKTSKKNFVTKQLVKEIVIPADNEFVGKILASRGNNLHEVETDEGENFLVSMPTRFRKKLWVRRGTYVILQSIEEGDKVRAEIVHVLDPENIAFLMEKEVWPERFIVEAAQLTKRGQRTEENDDSDLFPATSESENSAEESSSLVSEDVALNGQTNAF

SEQ ID NO: 124174 - protein, 134 aa, Heterodera glycines; identical to SEQ ID NO: 122599
  Homolog annotation: Hit_ID=NP_034515.1; Match level="QueryCoverage =91%, HitCoverage=96%, E-value=2e-24, Identity=50%"; Hit description =H2-K region expressed gene 2 [Mus musculus] gb|AAH22974.1| H2-K region expressed gene 2 [Mus musculus] gb
  Gene Ontology: Mol. function=tubulin binding; Cellular component =cytoplasm; Biological process=tubulin folding
  Essential gene: C elegans homolog=F21C3.5; Phenotype=Gro
  Coding regions on vcDNA: vcDNA=SeqID_50597; Strand=+; Position=15-419

SEQ ID NO: 124175 - protein, 112 aa, Heterodera glycines
  Homolog annotation: Hit_ID=P53021; Match level="QueryCoverage=99%, HitCoverage=88%, E-value=1e-27, Identity=51%"; Hit description=Major sperm protein 1 gb|AAA29146.1| major sperm protein
  Essential gene: C elegans homolog=ZK546.6; Phenotype=Emb
  Coding regions on vcDNA: vcDNA=SeqID_50598; Strand=+; Position=3-341
TREIHLNSPFNIRTIYNFRLINTGSKRIGFAFKTTKPKRIFLNPPCGTVGVGDTVNVIITVAPFDPNNEDIKNDRVIVEWCNAPGPSDAVFNLDWFTENAVRNVRLNVVYNL

SEQ ID NO: 124176 - protein, 150 aa, Heterodera glycines; identical to SEQ ID NO: 119655
  Homolog annotation: Hit_ID=AAH20086.1; Match level="QueryCoverage =90%, HitCoverage=79%, E-value=2e-38, Identity=53%"; Hit description =RNA binding motif protein 8a [Mus musculus] gb|AAH58376.1| RNA binding motif protein 8a [Mus musculus] gb|
  Gene Ontology: Mol. function=mRNA binding; Cellular component =nucleus; Biological process=microtubule cytoskeleton organization and biogenesis
  Essential gene: C elegans homolog=R07E5.14; Phenotype=Emb
  Coding regions on vcDNA: vcDNA=SeqID_50599; Strand=+; Position=29-481

SEQ ID NO: 124177 - protein, 140 aa, Heterodera glycines
  misc_feature (79)..(79): Xaa can be any naturally occurring amino acid
  misc_feature (88)..(88): Xaa can be any naturally occurring amino acid
  Homolog annotation: Hit_ID=AAT92172.1; Match level="QueryCoverage =100%, HitCoverage=91%, E-value=3e-48, Identity=72%"; Hit description= ribosomal protein S14 [Ixodes pacificus]
  Gene Ontology: Mol. function=structural constituent of ribosome; Cellular component=cytosolic small ribosomal subunit (sensu Eukarya); Biological process=protein biosynthesis
  Essential gene: C elegans homolog=F37C12.9; Phenotype=Emb,Ste
  Coding regions on vcDNA: vcDNA=SeqID_50600; Strand=+; Position=25-443
MASRKGNVKEEQPAVSLGPQVQEGENVFGVAHIFASFNDTFVHVTDLSGRETIVKITGGMRVKDDRDEASSYAVMLAAXQDVAERCKXQVGINALHVKLSETGGTKTKKAGFFFQAEMRAHERSGMKIGRIEDGRPIPLD

SEQ ID NO: 124178 - protein, 170 aa, Heterodera glycines
  misc_feature (14)..(14): Xaa can be any naturally occurring amino acid
  Homolog annotation: Hit_ID=EAA67908.1; Match level="QueryCoverage =98%, HitCoverage=96%, E-value=2e-71, Identity=77%"; Hit description =hypothetical protein FG01081.1 [Gibberella zeae PH-1] ref|XP _381257.1| hypothetical protein FG01081.1 [Gib
  Gene Ontology: Mol. function=structural constituent of ribosome; Cellular component=mitochondrion; Biological process=protein biosynthesis
  Essential gene: C elegans homolog=F07D10.1; Phenotype=Lva
  Coding regions on vcDNA: vcDNA=SeqID_50601; Strand=+; Position=15-525
MAAQNPMRELLLEXLVLNICVGESGDKLTRAAKVLEQLTGQTPVYSKAKYTVRSFGIRRNEKIAVHVTVRGAKAEEILERGLKVKEYELRAANFSQTGHFGFGITEHIDLDIKYDPTIGIYGMDFYCVMGRAGFRVSRRRRAVAKVGAPHRIHQDETIEWFKKNYDGVIL

SEQ ID NO: 124179 - protein, 133 aa, Heterodera glycines
  Homolog annotation: Hit_ID=CAE59719.1; Match level="QueryCoverage =61%, HitCoverage=16%, E-value=1e-11, Identity=43%"; Hit description =Hypothetical protein CBG03152 [Caenorhabditis briggsae]
  Gene Ontology: Biological process=embryogenesis and morphogenesis
  Essential gene: C elegans homolog=K08F8.1a; Phenotype=Emb
  Coding regions on vcDNA: vcDNA=SeqID_50602; Strand=+; Position=1-399
DGRHGVFFRNDLFPYSSGSSPVASFRLAVHHSRAPSTCGKFNESLLGELANSATLQSSLCVCTSIRRTAAVVEEEEEATEGRKLKLKEHPVTDEYKVSHEIVGIGESGKVMACFHKRRGEKCALKVLRDNARS

SEQ ID NO: 124180 - protein, 143 aa, Heterodera glycines
  Homolog annotation: Hit_ID=NP_497623.1; Match level="QueryCoverage =91%, HitCoverage=26%, E-value=4e-54, Identity=77%"; Hit description =translation elongation factor Tu, elongated for truncated tRNAs found in nematode mitochondria (54.6 kD)
  Gene Ontology: Mol. function=translation elongation factor activity; Cellular component=mitochondrion; Biological process=gametogenesis
  Essential gene: C elegans homolog=Y71H2AM.23; Phenotype=Lva
  Coding regions on vcDNA: vcDNA=SeqID_50603; Strand=+; Position=48-476
MPQYNLFANRSLLFTKRFFAVGPPGTKATYKRTKPHMNVGTIGHVDHGKTTLSSAITKLLAAKKQAKFLKYDEIDNAPEERSRGVTINAAHLEYETDNRHYAHVDCPGHADYIKNMITGAAQMEGTILVVAITDGPMPQTREH

SEQ ID NO: 124181 - protein, 158 aa, Heterodera glycines
  Homolog annotation: Hit_ID=CAE71280.1; Match level="QueryCoverage =98%, HitCoverage=19%, E-value=2e-55, Identity=66%"; Hit description =Hypothetical protein CBG18164 [Caenorhabditis briggsae]
  Gene Ontology: Mol. function=kinesin motor activity; Cellular component=kinesin complex; Biological process=mitochondrial transport
  Essential gene: C elegans homolog=R05D3.7; Phenotype=Dpy,Gro,Rup,Unc
  Coding regions on vcDNA: vcDNA=SeqID_50604; Strand=+; Position=7-480
MASECCIQVFCRVRPLNESEKKNSSTNVVKFQSKDTIVVGGKPYAYDHVFEPSSNQEAVYSTAARHIVQDVLTGYNGTIFVYGQTSSGKTHTMEGVIGDSEKQGIIPRIVNDIFTHIYNFVDTEMEFLIKVSYFEIYNERIRDLLDVTKTNLAIHEDK

SEQ ID NO: 124182 - protein, 174 aa, Heterodera glycines
  Homolog annotation: Hit_ID=CAE68128.1; Match level="QueryCoverage =62%, HitCoverage=14%, E-value=1e-19, Identity=48%"; Hit description =Hypothetical protein CBG13773 [Caenorhabditis briggsae]
  Gene Ontology: Mol. function=glutamine-tRNA ligase activity; Cellular component=cytoplasm; Biological process=glutaminyl-tRNA aminoacylation
  Essential gene: C elegans homolog=Y41E3.4; Phenotype=Emb,Lva
  Coding regions on vcDNA: vcDNA=SeqID_50605; Strand=+; Position=20-544
MTQQRNPNGMKKTNKELTELNDCLSKFAYLRGFLPSQDDQRLFESFSSAPPQKEYLNIARWYNHVQTYEDVERSTWPDKSSNIVEEETAPKKDRVGEDSTKVTTQKRFAEMFGHLHFHEVGKNDTTEGYVRTENTERLLREHVKAVGGKVVTRFPPEPNGILHIGHAKAINIVF

SEQ ID NO: 124183 - protein, 159 aa, Heterodera glycines
  Homolog annotation: Hit_ID=AAG12473.1; Match level="QueryCoverage =49%, HitCoverage=20%, E-value=2e-26, Identity=74%"; Hit description =transcription factor DP1 [Brugia malayi]
  Gene Ontology: Mol. function=transcription co-activator activity; Cellular component=transcription factor complex; Biological process =regulation of cell cycle
  Essential gene: C elegans homolog=T23G7.1; Phenotype=Emb,Stp,Unc
  Coding regions on vcDNA: vcDNA=SeqID_50606; Strand=+; Position=19-495
MNQRSEMPAQLRFQPSNAIGTHQRSIITAQQFQQQPFCVKRARYDYDLYEGQSHHNFQRQRFDQTPPSAIHPMRTFQIRHRSTDKTRGLRHFAQKVCEKVKQKVQTNYNEVAEELVNEYFDNIAEVPSDPEKLQYDTRNIRRRVYDALNVLMAMNIIEK

SEQ ID NO: 124184 - protein, 189 aa, Heterodera glycines
  Homolog annotation: Hit_ID=NP_510818.2; Match level="QueryCoverage =75%, HitCoverage=58%, E-value=4e-57, Identity=50%"; Hit description =neuralized, possibly N-myristoylated (XR998) [Caenorhabditis elegans]
  Gene Ontology: Mol. function=ubiquitin-protein ligase activity; Cellular component=plasma membrane; Biological process=sensory organ precursor cell fate determination
  Essential gene: C elegans homolog=F10D7.5a; Phenotype=Emb,Sck,Ste
  Coding regions on vcDNA: vcDNA=SeqID_50607; Strand=+; Position=47-613
MGNSSTTARSDDPQSTLTAGETLSDYDENIINRGRVARRKESFCKGLAFSNRPISINEIVCIRLSEIGTNWSGVMRFGVTNVDPASFRDIELPKFACPDLTSKGGYWAKSLAERYSVEGSILHFFTNANGEMYYGVNGVHKGLFLSGINVLSPLWIIVDIYGNSIAVEFIDPSEVQLQSKRTSSKNRAG

SEQ ID NO: 124185 - protein, 158 aa, Heterodera glycines
  Homolog annotation: Hit_ID=CAE67177.1; Match level="QueryCoverage =96%, HitCoverage=17%, E-value=1e-59, Identity=73%"; Hit description =Hypothetical protein CBG12609 [Caenorhabditis briggsae]
  Gene Ontology: Cellular component=nucleoplasm; Biological process =chromosome segregation
  Essential gene: C elegans homolog=ZC308.1a; Phenotype=Emb
  Coding regions on vcDNA: vcDNA=SeqID_50608; Strand=+; Position=3-476
DIDQRTDAVVVLSSVMRTLESNQIVAEQNLILAKVPILRIKFIGTFHDITVDLNVNNSVAIRNTHLMCYYSSFDWRVRPLVMVVKEWAKRHGINDSACSSFTSYSLVLMVIHYLQCGAQPPVLPNLQQMYPKRFSVRADVRTLNVSLPFEPIPTAMGW

SEQ ID NO: 124186 - protein, 131 aa, Heterodera glycines
  Homolog annotation: Hit_ID=CAE71286.1; Match level="QueryCoverage =85%, HitCoverage=30%, E-value=2e-38, Identity=66%"; Hit description =Hypothetical protein CBG18174 [Caenorhabditis briggsae]
  Gene Ontology: Mol. function=actin binding; Cellular component=Arp2/3 protein complex; Biological process=embryogenesis and morphogenesis
  Essential gene: C elegans homolog=Y79H2A.6; Phenotype=Emb
  Coding regions on vcDNA: vcDNA=SeqID_50609; Strand=+; Position=2-397
VSAQSDSPVPNWLLNIGPISCHAWNKDKTQLAVSPSNNEIHIFARLETVWNPLHVLREHDLLITGLDWAPNTNRIVSCSHDKNAFVWTWEAEKNSWKPEMVVVRINRAATCVKWSPNGRFDHSLLIHWPIL

SEQ ID NO: 124187 - protein, 89 aa, Heterodera glycines
  Homolog annotation: Hit_ID=AAT70232.1; Match level="QueryCoverage =100%, HitCoverage=23%, E-value=4e-45, Identity=98%"; Hit description= unc-87 [Heterodera glycines]
  Essential gene: C elegans homolog=F08B6.4a; Phenotype=Unc
  Coding regions on vcDNA: vcDNA=SeqID_50610; Strand=+; Position=157-423
MPESENDFDEEAPNATMETKVAGGGAAPKRVGRWTLSQLRQTDGIIPSQAGWNNGDSQKLMTNFGTPRNTTTKVKVENLAEIPEDILLK

SEQ ID NO: 124188 - protein, 201 aa, Heterodera glycines
  misc_feature (13)..(13): Xaa can be any naturally occurring amino acid
  misc_feature (55)..(55): Xaa can be any naturally occurring amino acid
  misc_feature (77)..(77): Xaa can be any naturally occurring amino acid
  misc_feature (139)..(139): Xaa can be any naturally occurring amino acid
  misc_feature (160)..(160): Xaa can be any naturally occurring amino acid
  misc_feature (183)..(183): Xaa can be any naturally occurring amino acid
  Homolog annotation: Hit_ID=XP_311177.1; Match level="QueryCoverage =99%, HitCoverage=47%, E-value=1e-73, Identity=77%"; Hit description =ENSANGP00000019055 [Anopheles gambiae]
  Gene Ontology: Biological process=reproduction
  Essential gene: C elegans homolog=T04C12.5; Phenotype=Ste
  Coding regions on vcDNA: vcDNA=SeqID_50611; Strand=+; Position=36-635
KHQSQPEKMCDEXVAALVVDNGSGMCKAGFAGDDAPRAVFPSIVGRPRHQGVMVXMGQKDSYVGDDVQSKRGILTLXYPIEHGIVTNWDDMEKIWHHTFCYELRVAPEEHPVVLTEAPLNPKANREKMTPIMCETFNTXRAMYVAIQGRAVPCTASGRTXTGLVLDSARWVYPHRGPSTRGYXPAPTPCLRLCLGRGGDVT

SEQ ID NO: 124189 - protein, 217 aa, Heterodera glycines
  Homolog annotation: Hit_ID=AAA81160.2; Match level="QueryCoverage =97%, HitCoverage=49%, E-value=4e-82, Identity=68%"; Hit description =Ectopic membrane ruffles in embryo protein 1 [Caenorhabditis elegans]
  Gene Ontology: Mol. function=NEDD8 activating enzyme activity; Biological process=endomitotic cell cycle
  Essential gene: C elegans homolog=F11H8.1; Phenotype=Emb
  Coding regions on vcDNA: vcDNA=SeqID_50612; Strand=+; Position=2-652
IDENRRWSDLRCLTDRASTFANSGFVPGIKNLKEVHKMPVLVVGAGGLGCEILKDLALSGFHDIHIIDMDTIDLSNLNRQFLFRENDIGRSKAEVAAAFIEKRVFGCKVTPHNCKIQDKSLEFYRKFFIIICGLDSIEARRWLNATVCSLVEFDDGNNPKSNTIVPLIDGGTEGFKGNSRVIIPFMTPCIQCTIDLYTPQVNFPVCTIAHTPRLPEH

SEQ ID NO: 124190 - protein, 165 aa, Heterodera glycines
  Homolog annotation: Hit_ID=NP_495841.1; Match level="QueryCoverage =78%, HitCoverage=18%, E-value=7e-12, Identity=30%"; Hit description =initiation factor eIF-2Be (75.5 kD) (2I953) [Caenorhabditis elegans] emb|CAA91063.1| Hypothetical protein
  Essential gene: C elegans homolog=D2085.3; Phenotype=Gro
  Coding regions on vcDNA: vcDNA=SeqID_50613; Strand=+; Position=145-639
SFQISTFNLFNLKVDIFSSSGFVASCLNWVSKLHSPNVIVALPNQPNDVAAELLKKWASKFKQLQAFGVSNCQSLNDVLREVDFRQILRNDFMLIQNLATFCFSYLTRQIEKFRNDRRQNNKNVLTLLYYSKRNYGRKFEEDRSLIGYIEQTQKLTHYENIGKHR

SEQ ID NO: 124191 - protein, 179 aa, Heterodera glycines
  Homolog annotation: Hit_ID=NP_001005597.1; Match level="QueryCoverage= 49%, HitCoverage=35%, E-value=2e-13, Identity=40%"; Hit description =zgc:101858 [Danio rerio] gb|AAH81417.1| Zgc:101858 [Danio rerio]
  Essential gene: C elegans homolog=C01G12.5; Phenotype=Gro
  Coding regions on vcDNA: vcDNA=SeqID_50614; Strand=+; Position=5-541
MITPSSNTTHYRESWYACRYRSGIPGSTSSSSWPLIRLTIGQNGAEEEDGGRGRYHGFRGFRRTSSSATAMTSRRTCSIFGALDNDFDFLFNINLKSIAKLTRLCAPYLEETKGAVVNISSFGTQRSLSDYTYYSTIKNALDNYCRSIAVKFAKRDIRVNNINPGFIIGETLDEDDNRA

SEQ ID NO: 124192 - protein, 132 aa, Heterodera glycines
  misc_feature (75)..(75): Xaa can be any naturally occurring amino acid
  Homolog annotation: Hit_ID=BAD11763.1; Match level="QueryCoverage =71%, HitCoverage=19%, E-value=6e-22, Identity=46%"; Hit description =mitochondria bc1 complex core subunit 1 [Brugia malayi]
  Gene Ontology: Mol. function=peptidase activity; Cellular component =mitochondrion; Biological process=mitochondrial processing
  Essential gene: C elegans homolog=F56D2.1; Phenotype=Emb
  Coding regions on vcDNA: vcDNA=SeqID_50615; Strand=+; Position=23-419
MLKMLLKFPSIHRFCSIRSLTQLPNSYEVLRDRGDTAELSQLKNGFRVASYANGRPTVTVGVWLNAGSRIETNDXNGIASLFEGLLHKGSGKRNSVQLQTELAKLGARLRSFTTREHSAFFVECLKSDTDKV

SEQ ID NO: 124193 - protein, 153 aa, Heterodera glycines
  Homolog annotation: Hit_ID=NP_611046.2; Match level="QueryCoverage =100%, HitCoverage=31%, E-value=3e-18, Identity=36%"; Hit description= CG8190-PA [Drosophila melanogaster] gb|AAF58125.1| CG8190-PA [Drosophila melanogaster]
  Gene Ontology: Mol. function=translation initiation factor activity; Cellular component=cytoplasm; Biological process=translational initiation
  Essential gene: C elegans homolog=C15F1.4; Phenotype=Emb,Lva
  Coding regions on vcDNA: vcDNA=SeqID_50616; Strand=+; Position=1-459
FAGGRGSRMPSLTNQMPKALLPMANMPLYWFSLNLLRLNRVRDCLLIVPLGQKLQIENALKTDGGGRWPTLKGMDIEVVAIDSLEEDVDDWGTADVLKRLLGKLKSDHILLISGDLVSDVRLRDMFKQYMENNAVLSCLLTDSALGGPIPGPK

SEQ ID NO: 124194 - protein, 213 aa, Heterodera glycines
  Homolog annotation: Hit_ID=NP_501551.2; Match level="QueryCoverage =93%, HitCoverage=41%, E-value=3e-32, Identity=39%"; Hit description =putative nuclear protein of eukaryotic origin (53.7 kD) (4J693) [Caenorhabditis elegans] emb|CAA92294.2|
  Gene Ontology: Mol. function=RNA binding; Cellular component=nucleus; Biological process=mRNA processing
  Essential gene: C elegans homolog=D1046.1; Phenotype=Slu,Stp
  Coding regions on vcDNA: vcDNA=SeqID_50617; Strand=+; Position=2-640
LDGTDGDEALNLNDLDEKEVLGDDEEDQHQNQHTTKEEVEDLYDEAMAPSGALSEKRESAEVISSLPSSIQHKSSFAMPMMIKSEPGIAGGSQSGKRYCCYIGNMTWWTTDDQLQKLIQTLGVDDMIDVKFYENRNNGQSKGFALAVFASEPSVKAVMEKLPSKKLHEQSLAVLPYTKQSLAKLEEATKRYDQKSQKDDKVVNIGTVRIGTNG

SEQ ID NO: 124195 - protein, 77 aa, Heterodera glycines; identical to SEQ ID NO: 122121
  Homolog annotation: Hit_ID=CAE60496.1; Match level="QueryCoverage =98%, HitCoverage=98%, E-value=3e-27, Identity=71%"; Hit description =Hypothetical protein CBG04114 [Caenorhabditis briggsae]
  Gene Ontology: Mol. function=U6 snRNA binding; Cellular component =nucleus; Biological process=mRNA splicing
  Essential gene: C elegans homolog=Y71F9B.4; Phenotype=Emb,Gro
  Coding regions on vcDNA: vcDNA=SeqID_50618; Strand=+; Position=38-271

SEQ ID NO: 124196 - protein, 136 aa, Heterodera glycines; identical to SEQ ID NO: 120882
  Homolog annotation: Hit_ID=A30033; Match level="QueryCoverage=93%, HitCoverage=97%, E-value=3e-40, Identity=65%"; Hit description =development-specific protein 217 - sea urchin (Tripneustes gratilla) sp|P13732|RL22_TRIGR 60S ribosomal protei
  Gene Ontology: Mol. function=structural constituent of ribosome; Cellular component=cytosolic ribosome (sensu Eukarya); Biological process=protein biosynthesis
  Essential gene: C elegans homolog=C27A2.2a; Phenotype=Emb,Lva
  Coding regions on vcDNA: vcDNA=SeqID_50619; Strand=+; Position=43-453

SEQ ID NO: 124197 - protein, 82 aa, Heterodera glycines; identical to SEQ ID NO: 122810
  Homolog annotation: Hit_ID=CAE74051.1; Match level="QueryCoverage =100%, HitCoverage=95%, E-value=1e-28, Identity=67%"; Hit description= Hypothetical protein CBG21703 [Caenorhabditis briggsae]
  Essential gene: C elegans homolog=F49C12.13; Phenotype=Emb,Lva,Lvl
  Coding regions on vcDNA: vcDNA=SeqID_50620; Strand=+; Position=20-268

SEQ ID NO: 124198 - protein, 94 aa, Heterodera glycines
  Homolog annotation: Hit_ID=CAE71410.1; Match level="QueryCoverage =97%, HitCoverage=96%, E-value=7e-22, Identity=53%"; Hit description =Hypothetical protein CBG18320 [Caenorhabditis briggsae]
  Essential gene: C elegans homolog=K01G5.8a; Phenotype=Unclassified
  Coding regions on vcDNA: vcDNA=SeqID_50621; Strand=+; Position=87-371
MLLVRTGLKLKRGTLFKKKRNVDPKTIDLTIKKEQEGPRKTKAELAFLKRQEETAFDRLSKRAQISHREKVEKFNKQMEELTEFNDIPKVSWTK

SEQ ID NO: 124199 - protein, 138 aa, Heterodera glycines
  misc_feature (106)..(106): Xaa can be any naturally occurring amino acid
  Homolog annotation: Hit_ID=CAE58656.1; Match level="QueryCoverage =94%, HitCoverage=53%, E-value=2e-32, Identity=50%"; Hit description =Hypothetical protein CBG01825 [Caenorhabditis briggsae]
  Gene Ontology: Mol. function=3'-5' exoribonuclease activity; Cellular component=exosome (RNase complex); Biological process=rRNA processing
  Essential gene: C elegans homolog=B0564.1; Phenotype=Lva
  Coding regions on vcDNA: vcDNA=SeqID_50622; Strand=+; Position=2-415
YRQDARTPSQIRNIVYQMGVYSHADGSAYIEQGETKVLCAVYGPHECRFRSRAKEDEAIVICQYSQATFSVPDRRNRPRGDRRGNSFSHLLERAFESVIFTNLYPXSEIDIFLELLDADSASLVFSITASLPFVTISI

SEQ ID NO: 124200 - protein, 149 aa, Heterodera glycines
  Homolog annotation: Hit_ID=CAE73901.1; Match level="QueryCoverage =98%, HitCoverage=95%, E-value=3e-67, Identity=80%"; Hit description =Hypothetical protein CBG21507 [Caenorhabditis briggsae]
  Gene Ontology: Cellular component=mitochondrion
  Essential gene: C elegans homolog=Y57G11C.16; Phenotype=Ste
  Coding regions on vcDNA: vcDNA=SeqID_50623; Strand=+; Position=3-493
ARKIPHIHRVMNTNIDGNRKVPCALTAIKGVGRRYAFLVCRKADIDIHKRAGELSEEDMEKLTTVMLNPQQYKIPSWFLNRQKDIRDGKNQQVLSTNLESKYRDDFERMKKIRLHRGLRHYWGLRVRGQHTKTTGRKGRTVGVSKKKGG

SEQ ID NO: 124201 - protein, 88 aa, Heterodera glycines
  Homolog annotation: Hit_ID=NP_499930.2; Match level="QueryCoverage =97%, HitCoverage=68%, E-value=5e-16, Identity=47%"; Hit description =mitochondrial ribosomal protein L55 (4B197) [Caenorhabditis elegans] gb|AAD12855.2| Hypothetical protein
  Essential gene: C elegans homolog=Y66H1A.3; Phenotype=Gro,Unclassified
  Coding regions on vcDNA: vcDNA=SeqID_50624; Strand=+; Position=1-267
WRLCLGKIRRKEMVRLYKVKIMRSDGSVIFGRCDEPREIIQLPVDLRTLSDDERRMRIAERKPIAKKVVEDTLDDSFDFHKYVSQWKR

SEQ ID NO: 124202 - protein, 112 aa, Heterodera glycines; identical to SEQ ID NO: 122786
  Homolog annotation: Hit_ID=BAB84192.1; Match level="QueryCoverage =91%, HitCoverage=72%, E-value=1e-31, Identity=62%"; Hit description =cytochrome b small subunit of succinate-ubiquinone reductase [Ascaris suum]
  Gene Ontology: Mol. function=electron transporter activity; Cellular component=mitochondrial membrane; Biological process=tricarboxylic acid cycle
  Essential gene: C elegans homolog=F33A8.5; Phenotype=Emb
  Coding regions on vcDNA: vcDNA=SeqID_50625; Strand=+; Position=73-411

SEQ ID NO: 124203 - protein, 130 aa, Heterodera glycines
  Homolog annotation: Hit_ID=NP_496982.1; Match level="QueryCoverage =74%, HitCoverage=30%, E-value=5e-20, Identity=49%"; Hit description =abnormal cell LINeage LIN-7, lin-7 (lin-7) [Caenorhabditis elegans] emb|CAA22459.2| Hypothetical protein
  Gene Ontology: Mol. function=receptor binding; Cellular component =cell junction; Biological process=EGF receptor signaling pathway
  Essential gene: C elegans homolog=Y54G11A.10; Phenotype=Gro
  Coding regions on vcDNA: vcDNA=SeqID_50626; Strand=+; Position=3-395
RFSLFHFLRRPLPLLVFRRSLFKPPLDSPFCGIYRTNGEICRTDDILVCQRKMNYHPGANVRHQRDRNQHLLKAVCDGTVVITREHCEVNPKNEWMYAQYAYRDFENIYKLTFNVIPRRMSNTFKLISEE

SEQ ID NO: 124204 - protein, 84 aa, Heterodera glycines
  Homolog annotation: Hit_ID=AAQ97988.1; Match level="QueryCoverage =94%, HitCoverage=75%, E-value=4e-23, Identity=60%"; Hit description =ribosomal protein S24 [Danio rerio] ref|NP_957510.1| ribosomal protein S24 [Danio rerio]
  Gene Ontology: Cellular component=eukaryotic 48S initiation complex; Biological process=protein biosynthesis
  Essential gene: C elegans homolog=T07A9.11; Phenotype=Lva
  Coding regions on vcDNA: vcDNA=SeqID_50627; Strand=+; Position=1-252
VEGGVITLHTRKVLNNRPLFRKQMVVDILHPNRASVPKSEVRERLAKLYKTTQDVVVAYGFRCQFGGGGRTGFGCVFNSLCYTK

SEQ ID NO: 124205 - protein, 155 aa, Heterodera glycines; identical to SEQ ID NO: 122806
  Homolog annotation: Hit_ID=CAE70903.1; Match level="QueryCoverage =94%, HitCoverage=61%, E-value=1e-44, Identity=52%"; Hit description =Hypothetical protein CBG17700 [Caenorhabditis briggsae]
  Gene Ontology: Biological process=embryogenesis and morphogenesis
  Essential gene: C elegans homolog=F22A3.6a; Phenotype=Emb
  Coding regions on vcDNA: vcDNA=SeqID_50628; Strand=+; Position=60-527

SEQ ID NO: 124206 - protein, 142 aa, Heterodera glycines; identical to SEQ ID NO: 122788
  Homolog annotation: Hit_ID=NP_491282.1; Match level="QueryCoverage =100%, HitCoverage=100%, E-value=2e-53, Identity=69%"; Hit description=CalPoNin (cpn-3) [Caenorhabditis elegans] gb|AAB52338.1| Calponin protein 3 [Caenorhabditis elegans] pi
  Gene Ontology: Mol. function=troponin C binding; Biological process =growth
  Essential gene: C elegans homolog=F28H1.2; Phenotype=Emb,Lva
  Coding regions on vcDNA: vcDNA=SeqID_50629; Strand=+; Position=11-439

SEQ ID NO: 124207 - protein, 208 aa, Heterodera glycines
  misc_feature (90)..(90): Xaa can be any naturally occurring amino acid
  Homolog annotation: Hit_ID=CAE59826.1; Match level="QueryCoverage =99%, HitCoverage=99%, E-value=5e-79, Identity=72%"; Hit description =Hypothetical protein CBG03298 [Caenorhabditis briggsae]
  Gene Ontology: Mol. function=transporter activity; Cellular component= integral to membrane; Biological process=proton transport
  Essential gene: C elegans homolog=T01H3.1; Phenotype=Emb,Ste
  Coding regions on vcDNA: vcDNA=SeqID_50630; Strand=+; Position=5-630
MASPALHTFNALLATGASLLTLMAFYYMLTGQGDRFDIAWFLTETSPYMWAGIAIAASLSLSVIGVGWGIFTTGSSILGGGVKAPRIRTXNLVSIIFCEAVAIFGIIMAFVFAGKLGKFTRETATQEVIVKNLAAGYAIFGGGLTVGFSDLICGLAVGIVGSGAALADAANPVLFVKILIIEIFASAIGLFGMIIGIVQTNKFNIGTT

SEQ ID NO: 124208 - protein, 130 aa, Heterodera glycines
  Homolog annotation: Hit_ID=NP_496290.2; Match level="QueryCoverage =80%, HitCoverage=47%, E-value=8e-13, Identity=40%"; Hit description =programmed cell death 10 (24.8 kD) (2K896) [Caenorhabditis elegans] emb|CAA90115.2| Hypothetical protein
  Essential gene: C elegans homolog=C14A4.11; Phenotype=Dpy,Emb
  Coding regions on vcDNA: vcDNA=SeqID_50631; Strand=+; Position=1-393
SNNDIIFGNEEGVNYLAPWTYSCLIKTSIDRLKTALSENREAIHALNHLQEVFRQIDRASPSFLYDFSKLLLIESGVAGTNVQESYLRMHANAATEELELPQFAHIAEFQYLVVTLNCLGYLNFEMFAEF

SEQ ID NO: 124209 - protein, 171 aa, Heterodera glycines
  misc_feature (13)..(13): Xaa can be any naturally occurring amino acid
  misc_feature (91)..(91): Xaa can be any naturally occurring amino acid
  Homolog annotation: Hit_ID=CAE65022.1; Match level="QueryCoverage =98%, HitCoverage=98%, E-value=2e-75, Identity=83%"; Hit description =Hypothetical protein CBG09860 [Caenorhabditis briggsae]
  Gene Ontology: Mol. function=structural constituent of muscle; Cellular component=muscle myosin; Biological process=regulation of muscle contraction
  Essential gene: C elegans homolog=C56G7.1; Phenotype=Emb
  Coding regions on vcDNA: vcDNA=SeqID_50632; Strand=+; Position=3-513
AAPKTVARRARPXRATSNVFAMFDQPQIQEFKEAFNMIDQNHDGFIDEHDLKDMFASLGKEVSEKFIENMVNDASGSINFTMFLTLFGEKXLTGTDPEEVIKNAFQCFDEDNSGTIAEDRLRELLTTMGDRYTEEQVDELFRDAPIKNGRFDYVEFTRMLKHWTKDKDEED

SEQ ID NO: 124210 - protein, 131 aa, Heterodera glycines
  Homolog annotation: Hit_ID=NP_499915.1; Match level="QueryCoverage =99%, HitCoverage=39%, E-value=3e-45, Identity=63%"; Hit description =ribosomal Protein, Small subunit (rps-24) [Caenorhabditis elegans] gb|AAK39283.2| Ribosomal protein, smal
  Gene Ontology: Cellular component=eukaryotic 48S initiation complex; Biological process=protein biosynthesis
  Essential gene: C elegans homolog=T07A9.11; Phenotype=Lva
  Coding regions on vcDNA: vcDNA=SeqID_50633; Strand=+; Position=1-396
DGGVITLHTRKVLNNRLLFRKQMVVDILHPNRASVPKSEVRERLAKLYKTTQDVVVAYGFRCQFGGGRSTGFANVYDSLDYAKRFEAKYRLLRQGVGQKAEKGGRKQRKERKNRQKKVRGVKKVKVQAGEK

SEQ ID NO: 124211 - protein, 244 aa, Heterodera glycines
  Homolog annotation: Hit_ID=CAE71150.1; Match level="QueryCoverage =88%, HitCoverage=98%, E-value=4e-73, Identity=57%"; Hit description =Hypothetical protein CBG18006 [Caenorhabditis briggsae]
  Essential gene: C elegans homolog=T04A8.11; Phenotype=Lva
  Coding regions on vcDNA: vcDNA=SeqID_50634; Strand=+; Position=73-807
MTLRLGSKLKFSILLQNVGIRKNPFRNSYNYPITFEHVVFPPNNQFKLPTMPPEPIYDESLGETKHKLTKQFIEARGFEPIHTELIHKQYGLVAMSGGFIKAEDFAWIQQEVNEKLVDKQFAIWRVDAPWLPRVRRPPSTKKGGGKGPIHHYETPVRTGRVILELGGYITEQEARSILMHLYLHMPFPVEFVSQELMDKRKGLEMKVRANNRNKFDWDTLIKYNMQNCKAWLSPYDVYWKCRYE

SEQ ID NO: 124212 - protein, 90 aa, Heterodera glycines
  Homolog annotation: Hit_ID=NP_498870.1; Match level="QueryCoverage =82%, HitCoverage=44%, E-value=2e-10, Identity=40%"; Hit description =putative protein of bilaterial origin (19.1 kD) (3J539) [Caenorhabditis elegans] gb|AAA27965.1| Hypotheti
  Essential gene: C elegans homolog=C30C11.1; Phenotype=Emb
  Coding regions on vcDNA: vcDNA=SeqID_50635; Strand=+; Position=3-275
GVPKYRTSKPRVLFRRFNRPFYQYTMRPLVQCPRCSASHEPWVLCMDCYRVLRDATEPIKRRMVSHNAYIGQRQQPMPRWTDENGINANP

SEQ ID NO: 124213 - protein, 125 aa, Heterodera glycines
  Homolog annotation: Hit_ID=NP_499549.1; Match level="QueryCoverage =76%, HitCoverage=71%, E-value=2e-26, Identity=57%"; Hit description =acyl carrier protein mitochondrial (15.0 kD) (3N4) [Caenorhabditis elegans] emb|CAB60498.1| Hypothetical
  Gene Ontology: Mol. function=NADH dehydrogenase (ubiquinone) activity; Cellular component=mitochondrion; Biological process =gametogenesis
  Essential gene: C elegans homolog=Y56A3A.19; Phenotype=Lva
  Coding regions on vcDNA: vcDNA=SeqID_50636; Strand=+; Position=108-485
MTRQKMQMYSPEMRAVNYQQKRTHMHAILTKKTVEDRVMLNLHLFDKVDNDKLTFDSDFFKDLGIDSLDFVEFIIAIEDEFEFEIPDGDSDRMRTPRDVYNYICDKCDVYDGMYDKCCRQKIVLF

SEQ ID NO: 124214 - protein, 146 aa, Heterodera glycines
  Homolog annotation: Hit_ID=CAE67737.1; Match level="QueryCoverage =100%, HitCoverage=93%, E-value=4e-23, Identity=42%"; Hit description= Hypothetical protein CBG13312 [Caenorhabditis briggsae]
  Gene Ontology: Mol. function=NADH dehydrogenase (ubiquinone) activity; Cellular component=membrane fraction; Biological process =gametogenesis
  Essential gene: C elegans homolog=Y56A3A.19; Phenotype=Lva
  Coding regions on vcDNA: vcDNA=SeqID_50637; Strand=+; Position=7-444
MNKAFVKAALCSKSTNVCLFKRLVRPVVQIGSRPITGAGFGHPMTRQKMQMYSPEMRAVNYQQKRTHMHAILTKKTVEDLFMLNLHLFDKVDNDKLTFDSDFFKDLGIDSLDFVEFIIAIEDEFEFEIPDGDSDRMRTPRDVYNYI

SEQ ID NO: 124215 - protein, 186 aa, Heterodera glycines; identical to SEQ ID NO: 122790
  Homolog annotation: Hit_ID=CAA70477.2; Match level="QueryCoverage =94%, HitCoverage=94%, E-value=3e-62, Identity=71%"; Hit description =SEC-2 protein [Globodera pallida]
  Essential gene: C elegans homolog=F02A9.2; Phenotype=Bmd,Dpy
  Coding regions on vcDNA: vcDNA=SeqID_50638; Strand=+; Position=11-571

SEQ ID NO: 124216 - protein, 188 aa, Heterodera glycines
  Homolog annotation: Hit_ID=NP_492523.1; Match level="QueryCoverage =100%, HitCoverage=95%, E-value=2e-73, Identity=68%"; Hit description= i-35 protein (22.8 kD) (1K80) [Caenorhabditis elegans] emb|CAB03017.2| Hypothetical protein F30A10.9 [Ca
  Gene Ontology: Biological process=gametogenesis
  Essential gene: C elegans homolog=F30A10.9; Phenotype=Lva,Lvl
  Coding regions on vcDNA: vcDNA=SeqID_50639; Strand=+; Position=9-618
MGRHKKTQKFRNKLQKLIKPTDDRIKDEIRVKKPPKEDENALKIKEAPKISAAMFLKYNTQLGPPFHVIIDTNFVNFSIKNRIDIMTGFMDCLYAKVVPYISDCVLGELEKMGRRFKLALKIIKDNRFQRLQCTHKGIYADDCIVQRVTQHKCYIVATCDKDLRQRIRKIPGVPIMYVRDHRYTIERM

SEQ ID NO: 124217 - protein, 44 aa, Heterodera glycines; identical to SEQ ID NO: 123524
  Homolog annotation: Hit_ID=NP_740781.1; Match level="QueryCoverage =81%, HitCoverage=19%, E-value=2e-09, Identity=75%"; Hit description =ribosomal protein L22/L17 (1B631) [Caenorhabditis elegans] gb|AAK29902.1| Ribosomal protein, large subuni
  Essential gene: C elegans homolog=Y48G8AL.8a; Phenotype=Emb,Lva
  Coding regions on vcDNA: vcDNA=SeqID_50640; Strand=+; Position=2-136

SEQ ID NO: 124218 - protein, 150 aa, Heterodera glycines
  Homolog annotation: Hit_ID=NP_498923.1; Match level="QueryCoverage =98%, HitCoverage=75%, E-value=1e-46, Identity=61%"; Hit description =ribosomal protein L11 and Ribosomal protein L11 (3J807) [Caenorhabditis elegans] gb|AAA27905.1| Hypotheti
  Gene Ontology: Mol. function=RNA binding; Cellular component =mitochondrial large ribosomal subunit; Biological process=protein biosynthesis
  Essential gene: C elegans homolog=B0303.15; Phenotype=Lva
  Coding regions on vcDNA: vcDNA=SeqID_50641; Strand=+; Position=2-451
AQIKAQMASAAPPLGPSLGQRGVNVANFCKEFNNLTSTIRFGTNLPMSIHVKPDRTYEIDISTPTTEWLLQQAAGIRRNRQEEGEIVGMISVKHVYEIAKVKSQDKSLIGVPLKEICQLVIERADSIGIKVQNEDLDPEEYRKFLEHRQE

SEQ ID NO: 124219 - protein, 51 aa, Heterodera glycines
  Homolog annotation: Hit_ID=CAE65195.1; Match level="QueryCoverage =100%, HitCoverage=19%, E-value=1e-12, Identity=72%"; Hit description= Hypothetical protein CBG10070 [Caenorhabditis briggsae]
  Essential gene: C elegans homolog=F55H2.2; Phenotype=Emb
  Coding regions on vcDNA: vcDNA=SeqID_50642; Strand=-; Position=2-154
SLRAQTVMKTRLKGAQKGHSLLKKKADALNMRFREILKKITEVSYLQQQML

SEQ ID NO: 124220 - protein, 197 aa, Heterodera glycines; identical to SEQ ID NO: 122644
  Homolog annotation: Hit_ID=NP_498946.1; Match level="QueryCoverage =76%, HitCoverage=82%, E-value=4e-18, Identity=34%"; Hit description =putative protein of eukaryotic origin (3J896) [Caenorhabditis elegans] gb|AAK26132.2| Hypothetical protei
  Essential gene: C elegans homolog=F54F2.7; Phenotype=Gro
  Coding regions on vcDNA: vcDNA=SeqID_50643; Strand=+; Position=93-683

SEQ ID NO: 124221 - protein, 176 aa, Heterodera glycines
  Homolog annotation: Hit_ID=NP_506378.1; Match level="QueryCoverage =97%, HitCoverage=35%, E-value=3e-30, Identity=40%"; Hit description =splicing factor 3a 60kDa like (5O109) [Caenorhabditis elegans] emb|CAB54256.5| Hypothetical protein F53F4
  Gene Ontology: Biological process=protein modification
  Essential gene: C elegans homolog=F53F4.14; Phenotype=Emb
  Coding regions on vcDNA: vcDNA=SeqID_50644; Strand=+; Position=1-528
ISINFFTKSDIESVNFINHLPEKLYFLESDGQVFHNLNDIDDGKLIQLHFRACGGKGGFGSLLRSFRIHKSSNQLMCRNLQGRRLADVREEERLKKYIAKKAEREKEKQKKKDEKIERLKAGGETKHQFEDQKHLRKRDTLLDEVEDAVEAGMDALEVKAASSEHEVSETIADTEP

SEQ ID NO: 124222 - protein, 83 aa, Heterodera glycines
  Homolog annotation: Hit_ID=CAE64681.1; Match level="QueryCoverage =90%, HitCoverage=91%, E-value=1e-26, Identity=60%"; Hit description =Hypothetical protein CBG09459 [Caenorhabditis briggsae]
  Essential gene: C elegans homolog=K02B2.5; Phenotype=Gro
  Coding regions on vcDNA: vcDNA=SeqID_50645; Strand=+; Position=3-254
KTSKKTDPKGGKAAPAKKKEGGGGGKAKKKKWSKGKVRDKLANMVLFDQATYDKLYKEIISVKCVVKHGSQLVYTRATKAEEA

SEQ ID NO: 124223 - protein, 106 aa, Heterodera glycines
  Homolog annotation: Hit_ID=NP_593530.1; Match level="QueryCoverage =77%, HitCoverage=32%, E-value=9e-36, Identity=85%"; Hit description =succinate dehydrogenase [ubiquinone] iron-sulfur protein precursor(ec 1.3.5.1) [Schizosaccharomyces pombe
  Gene Ontology: Mol. function=succinate dehydrogenase (ubiquinone) activity; Cellular component=mitochondrial inner membrane; Biological process=electron transport
  Essential gene: C elegans homolog=F42A8.2; Phenotype=Emb
  Coding regions on vcDNA: vcDNA=SeqID_50646; Strand=+; Position=2-322
TFEIYRYNPEKPEQKPFLQKYDVDLNQCGPMVLDALIKIKNEMDPTLTFRRSCREGICGSCAMNIGGENTLACICNIEKKTKYSTKTGGKRIMILLIRICILCISW

SEQ ID NO: 124224 - protein, 136 aa, Heterodera glycines
  misc_feature (87)..(87): Xaa can be any naturally occurring amino acid
  misc_feature (92)..(92): Xaa can be any naturally occurring amino acid
  Homolog annotation: Hit_ID=CAE71615.1; Match level="QueryCoverage =99%, HitCoverage=78%, E-value=5e-65, Identity=83%"; Hit description =Hypothetical protein CBG18577 [Caenorhabditis briggsae]
  Gene Ontology: Mol. function=FK506 binding; Cellular component =histone deacetylase complex; Biological process=protein folding
  Essential gene: C elegans homolog=Y75B12B.2; Phenotype=Emb
  Coding regions on vcDNA: vcDNA=SeqID_50647; Strand=+; Position=3-413
DITIGGKAAGRIVMELYSDIVPKTAENFRSLCTGEKGMGKSGKPLHYKGSKFHRVIPNFMLQGGDFTRGNGTGGESIYGEKFVDENXKEKHXQPGILSMANAGPNTNGSQFFVTTVKTEWLDGSHIRFGRLTDGVG

SEQ ID NO: 124225 - protein, 73 aa, Heterodera glycines; identical to SEQ ID NO: 119375
  Homolog annotation: Hit_ID=NP_491640.1; Match level="QueryCoverage =100%, HitCoverage=100%, E-value=1e-33, Identity=86%"; Hit description=UBiquitin-Like (8.7 kD) (ubl-5) [Caenorhabditis elegans] gb|AAK21382.1| Ubiquitin-like family protein 5
  Essential gene: C elegans homolog=F46F11.4; Phenotype=Gro,Stp,Unc
  Coding regions on vcDNA: vcDNA=SeqID_50648; Strand=+; Position=33-254

SEQ ID NO: 124226 - protein, 190 aa, Heterodera glycines
  Homolog annotation: Hit_ID=NP_506083.1; Match level="QueryCoverage =95%, HitCoverage=29%, E-value=1e-32, Identity=40%"; Hit description =signal recognition particle 68kDa (70.6 kD) (5M770) [Caenorhabditis elegans] emb|CAB01573.1| Hypothetical
  Essential gene: C elegans homolog=F55C5.8; Phenotype=Emb,Lva,Ste
  Coding regions on vcDNA: vcDNA=SeqID_50649; Strand=+; Position=2-571
TESNGPKVLRILEIVKNAQQKHGLRHENYRRYRGYCSRRIEGIRKSLKFMHSYKCAPKRTAKFIARNVSAELIGDLRFLQIAVFEVERNWAYAMQMKFEMVDLPLSRKKFHMRQKLRRAVKSAHFLHSLINDNPLVHEVTRVETVSYVSFIFGSLELELKNWKRAIETFDRARIGYSELLEQVPNSDLSE

SEQ ID NO: 124227 - protein, 190 aa, Heterodera glycines; identical to SEQ ID NO: 122780
  Homolog annotation: Hit_ID=NP_492354.1; Match level="QueryCoverage =95%, HitCoverage=75%, E-value=6e-33, Identity=43%"; Hit description =proteasome Beta Subunit (26.7 kD) (pbs-7) [Caenorhabditis elegans] emb|CAB03081.1| Hypothetical protein F
  Gene Ontology: Mol. function=endopeptidase activity; Cellular component=proteasome core complex (sensu Eukarya); Biological process=locomotory behavior
  Essential gene: C elegans homolog=F39H11.5; Phenotype=Emb,Lva,Unc
  Coding regions on vcDNA: vcDNA=SeqID_50650; Strand=+; Position=12-581

SEQ ID NO: 124228 - protein, 92 aa, Heterodera glycines
  Homolog annotation: Hit_ID=CAE65135.1; Match level="QueryCoverage =42%, HitCoverage=23%, E-value=8e-10, Identity=76%"; Hit description =Hypothetical protein CBG10001 [Caenorhabditis briggsae]
  Gene Ontology: Cellular component=integral to membrane; Biological process=proton transport
  Essential gene: C elegans homolog=R10E11.8; Phenotype=Ste
  Coding regions on vcDNA: vcDNA=SeqID_50651; Strand=+; Position=4-282
MSGDNSALIAAEQAAYGPFFGSLGVTAAMIFTAAGSAYGTAKSGARSLRNDCLTAAKFLLNNGRKKEGKNGTSAEHCADRRVLMIKMTSHRI

SEQ ID NO: 124229 - protein, 93 aa, Heterodera glycines
  misc_feature (74)..(74): Xaa can be any naturally occurring amino acid
  Homolog annotation: Hit_ID=AAQ55231.1; Match level="QueryCoverage =97%, HitCoverage=71%, E-value=6e-31, Identity=68%"; Hit description =ribosomal protein S19S [Parascaris univalens]
  Gene Ontology: Mol. function=structural constituent of ribosome; Cellular component=eukaryotic 48S initiation complex; Biological process=hemocyte development
  Essential gene: C elegans homolog=T05F1.3; Phenotype=Emb,Lva
  Coding regions on vcDNA: vcDNA=SeqID_50652; Strand=+; Position=2-280
GKPTSVKDVDQHEIVQSVATFLKKSGKIKLPDWVDLVKSGKNKELAPINPDWYYERVASLALRLYIRSPAGVGXFRNLFGGINIRGVSPNHFT

SEQ ID NO: 124230 - protein, 129 aa, Heterodera glycines
  Homolog annotation: Hit_ID=NP_034515.1; Match level="QueryCoverage =93%, HitCoverage=93%, E-value=2e-24, Identity=50%"; Hit description =H2-K region expressed gene 2 [Mus musculus] gb|AAH22974.1| H2-K region expressed gene 2 [Mus musculus] gb
  Gene Ontology: Mol. function=tubulin binding; Cellular component =cytoplasm; Biological process=tubulin folding
  Essential gene: C elegans homolog=F21C3.5; Phenotype=Gro
  Coding regions on vcDNA: vcDNA=SeqID_50653; Strand=+; Position=2-391
ETKSKLEAEFEKLRNLEKDRSKCMTNRRQLESQLTENSMVKEEFDRLKSDAGVFKLIGPVLVKQNLEEAKQNVAKRIDYIRTEIERIESLLGDLEKNIEVQKESVERMRDTFRQTLAVATAPTANSINA

SEQ ID NO: 124231 - protein, 101 aa, Heterodera glycines
  Homolog annotation: Hit_ID=NP_001001593.1; Match level="QueryCoverage= 94%, HitCoverage=61%, E-value=2e-36, Identity=80%"; Hit description =ribosomal protein L23a [Danio rerio] gb|AAS66970.1| ribosomal protein L23a [Danio rerio]
  Gene Ontology: Mol. function=structural constituent of ribosome; Cellular component=cytosolic large ribosomal subunit (sensu Eukarya); Biological process=ribosomal large subunit assembly and maintenance
  Essential gene: C elegans homolog=F55D10.2; Phenotype=Gro
  Coding regions on vcDNA: vcDNA=SeqID_50654; Strand=+; Position=39-344
KNRKGCRKAVPKRNKLDSFSIIKHPLTTESAMKKIEDTNTLVFIVDVKANKHQIKSAVNKPYNIEAQKVNTLVTPDHTKKAYVRLAADYDALDVANKIGII

SEQ ID NO: 124232 - protein, 99 aa, Heterodera glycines
  misc_feature (45)..(45): Xaa can be any naturally occurring amino acid
  Homolog annotation: Hit_ID=NP_491501.1; Match level="QueryCoverage =100%, HitCoverage=99%, E-value=4e-21, Identity=67%"; Hit description= troponin C, Paralysed Arrest at Two-fold PAT-10 (18.5 kD) (pat-10) [Caenorhabditis elegans] gb|AAK21395.
  Essential gene: C elegans homolog=F54C1.7; Phenotype=Emb,Lvl
  Coding regions on vcDNA: vcDNA=SeqID_50655; Strand=+; Position=2-300
AENIEEILAEIDGSQIEEYQRFFDLFDRGKNGYIMATQIGQIMNXNGYISRPTLKGLLHEIAPDLSDKGLEAAVDEIDEDGSGKIEFEEFWELMAGETD

SEQ ID NO: 124233 - protein, 169 aa, Heterodera glycines
  Homolog annotation: Hit_ID=NP_493382.1; Match level="QueryCoverage =97%, HitCoverage=79%, E-value=9e-50, Identity=57%"; Hit description =vacuolar protein (24.2 kD) (1O178) [Caenorhabditis elegans] emb|CAB54493.1| Hypothetical protein Y87G2A.1
  Gene Ontology: Cellular component=endosome; Biological process =protein-vacuolar targeting
  Essential gene: C elegans homolog=Y87G2A.10; Phenotype=Gro
  Coding regions on vcDNA: vcDNA=SeqID_50656; Strand=+; Position=118-624
MASIDLSQEVRLYDNNAERDRIDNMAELYAMVNALECLEKVFSRDYIHAKEYTAECSKLLVQIKVALRLVPGMTIDEFFRSYYIQCPAALERIREDRPITVRDDKGNALKCIADIVELFITFLDQLKLNIRAVDELFPNLNDLYASINTMSTLPDDFDAKLRVKSWHDK

SEQ ID NO: 124234 - protein, 131 aa, Heterodera glycines
  Homolog annotation: Hit_ID=CAE71397.1; Match level="QueryCoverage =74%, HitCoverage=9%, E-value=1e-37, Identity=79%"; Hit description =Hypothetical protein CBG18305 [Caenorhabditis briggsae]
  Gene Ontology: Mol. function=calcium-transporting ATPase activity; Cellular component=nuclear envelope-endoplasmic reticulum network; Biological process=calcium ion homeostasis
  Essential gene: C elegans homolog=K11D9.2a; Phenotype=Ste
  Coding regions on vcDNA: vcDNA=SeqID_50657; Strand=+; Position=1-393
ENAHTKSEDELFRFFGTGPDGLTEEQADELRDKYGYNEMPAEEGKKLWELILEQFDDLLVKILLLAAIISFVLALFEEHDDQTSAVTAFVEPGVILPIDATQPTENYQEFDNLYLDMNGIIHPCTHPEDRP

SEQ ID NO: 124235 - protein, 148 aa, Heterodera glycines
  Homolog annotation: Hit_ID=NP_494764.1; Match level="QueryCoverage =91%, HitCoverage=95%, E-value=2e-21, Identity=37%"; Hit description =prefoldin (16.1 kD) (2E617) [Caenorhabditis elegans] gb|AAF39891.1| Hypothetical protein H20J04.5 [Caenor
  Gene Ontology: Mol. function=chaperone activity; Cellular component =cytosol; Biological process=protein folding
  Essential gene: C elegans homolog=H20J04.5; Phenotype=Emb
  Coding regions on vcDNA: vcDNA=SeqID_50658; Strand=+; Position=46-492
MASSTASSSSATNEQQKIVNGFQKLRELQQATINELNKIQTEQREHTTVLKTVQSLEPNRKCFRQVGDTLFEFTASELIVLLEETIKRFKQRVDELENQVVKVGEDINAYKEKHNIRFLSNKDVIELQKKQALSKISQLDLGPGGKSQ

SEQ ID NO: 124236 - protein, 144 aa, Heterodera glycines
  misc_feature (108)..(108): Xaa can be any naturally occurring amino acid
  misc_feature (125)..(125): Xaa can be any naturally occurring amino acid
  Homolog annotation: Hit_ID=CAE58579.1; Match level="QueryCoverage =99%, HitCoverage=79%, E-value=6e-43, Identity=57%"; Hit description =Hypothetical protein CBG01745 [Caenorhabditis briggsae]
  Gene Ontology: Mol. function=structural constituent of ribosome; Cellular component=cytosolic large ribosomal subunit (sensu Eukarya); Biological process=reproduction
  Essential gene: C elegans homolog=E04A4.8; Phenotype=Emb,Gro
  Coding regions on vcDNA: vcDNA=SeqID_50659; Strand=+; Position=1-432
KASGETLRKYIVVGRKLPTADDPNPTLHEMVIFASNHVVAKSRFWYFTSMLRRVKKTHGEIIACEEVFEKKPGCVKNFGIWLRYDSRTGHHNVDREYRDVGEAGASTXWGRDGGGRHHPQTDGVXIMGREAIRVAHCNRAMVEQ

SEQ ID NO: 124237 - protein, 124 aa, Heterodera glycines; identical to SEQ ID NO: 122776
  Homolog annotation: Hit_ID=AAS94231.1; Match level="QueryCoverage =47%, HitCoverage=13%, E-value=1e-12, Identity=55%"; Hit description =legumain-like protease precursor [Ixodes ricinus]
  Essential gene: C elegans homolog=T28H10.3; Phenotype=Emb
  Coding regions on vcDNA: vcDNA=SeqID_50660; Strand=+; Position=3-377

SEQ ID NO: 124238 - protein, 206 aa, Heterodera glycines
  Homolog annotation: Hit_ID=CAE59483.1; Match level="QueryCoverage =96%, HitCoverage=14%, E-value=1e-27, Identity=37%"; Hit description =Hypothetical protein CBG02868 [Caenorhabditis briggsae]
  Essential gene: C elegans homolog=Y62F5A.1a; Phenotype=Gro,Stp
  Coding regions on vcDNA: vcDNA=SeqID_50661; Strand=+; Position=2-622
EETEGKLLQIREIFHDLLMSLELQEHVQWADMVQKFCSLAGMFASLQQLMRKPGHNNFDDNVKLMKMTQFVPKNVSLELDPNLTHLTEGRLSNFGHNIVPILLRTKLKPEVEEDELNIERDRSKGDIPKQIKTLNSHIDMLCGKLADFTKLHVVDRREAPSYSQEETVKLVKAICLGRGIYPKAPSSAHPGSADAGRSTSSSQKAK

SEQ ID NO: 124239 - protein, 66 aa, Heterodera glycines
  Homolog annotation: Hit_ID=NP_493208.1; Match level="QueryCoverage =98%, HitCoverage=21%, E-value=6e-24, Identity=84%"; Hit description =PDZ-containing protein, abnormal embryonic PARtitioning of cytoplasm PAR-6 (34.2 kD) (par-6) [Caenorhabdi
  Gene Ontology: Mol. function=ATP binding; Biological process=mitotic spindle positioning and orientation
  Essential gene: C elegans homolog=T26E3.3; Phenotype=Emb,Gro
  Coding regions on vcDNA: vcDNA=SeqID_50662; Strand=+; Position=3-203
KGIFISRLVEGGLAESTGLLSVGDEVVEVNGIEVNGKKLDQVADMMVANAHNLIVTIKPANQRNSL

SEQ ID NO: 124240 - protein, 136 aa, Heterodera glycines
  misc_feature (61)..(61): Xaa can be any naturally occurring amino acid
  Homolog annotation: Hit_ID=XP_393173.1; Match level="QueryCoverage =100%, HitCoverage=14%, E-value=6e-56, Identity=83%"; Hit description= similar to Hypothetical protein CBG09037 [Apis mellifera]
  Essential gene: C elegans homolog=F25B5.4a; Phenotype=Emb
  Coding regions on vcDNA: vcDNA=SeqID_50663; Strand=+; Position=106-513
MQIFVKTLTGKTITLEVEASDTIENVKAKIQDKEGIPPDQQRLIFAGTSTFKPLQHHFYTXPLFSGKQLEDGRTLADYNIQKESTLHLVLRLRGGMQIFVKTLTGKTITLEVEASDTIENVKAKIQDKEGIPPDQQ

SEQ ID NO: 124241 - protein, 101 aa, Heterodera glycines
  Homolog annotation: Hit_ID=AAN32889.1; Match level="QueryCoverage =100%, HitCoverage=84%, E-value=2e-49, Identity=96%"; Hit description= ubiquitin extension protein [Heterodera glycines]
  Gene Ontology: Biological process=cell cycle
  Essential gene: C elegans homolog=F25B5.4a; Phenotype=Emb
  Coding regions on vcDNA: vcDNA=SeqID_50664; Strand=+; Position=2-307
APGFDGMQIFVKTLTGKTITLEVESSDTVDNVKTKIQDKEGVPPDQQRLIFAGKQLEDGRTLADYNIQKESTLHLVLRLRGGNGKRNTGKNKKSNKKLDQN

SEQ ID NO: 124242 - protein, 109 aa, Heterodera glycines; identical to SEQ ID NO: 123498
  Homolog annotation: Hit_ID=XP_424236.1; Match level="QueryCoverage =79%, HitCoverage=21%, E-value=8e-18, Identity=47%"; Hit description =PREDICTED: similar to FLJ20699 protein, partial [Gallus gallus]
  Essential gene: C elegans homolog=Y54G11A.7; Phenotype=Emb
  Coding regions on vcDNA: vcDNA=SeqID_50665; Strand=+; Position=125-454

SEQ ID NO: 124243 - protein, 454 aa, Heterodera glycines
  Homolog annotation: Hit_ID=NP_499264.1; Match level="QueryCoverage =95%, HitCoverage=92%, E-value=0.0, Identity=81%"; Hit description =citrate synthase (51.5 kD) (3L304) [Caenorhabditis elegans] emb|CAA83004.1| Hypothetical protein T20G5.2 [C
  Gene Ontology: Mol. function=citrate (SI)-synthase activity; Cellular component=mitochondrial matrix; Biological process=citrate metabolism
  Essential gene: C elegans homolog=T20G5.2; Phenotype=Emb
  Coding regions on vcDNA: vcDNA=SeqID_50666; Strand=+; Position=37-1401
MLSRFSKIIVRGYAKDLNLKEVLANKIPEHNKKVVEFRKAHGSTVVQNITVDMIYGGMRSMKGMVTETSVLDPEEGIRFRGYSIPECQQKLPKAEGGEEPLPEGIWWLLCTGEIPDQKQVNAISKEWASRADLPAHVAQLLENFPPNLHPMSQFVAAIAALQSESKFAEAYSKGVPKSTYWEYAYEDSMNLLAKLPTIAAMIYRNLYRDGSSVGVLDPNKDWSANFCHMLGYTEREFVELMRLYLVIHSDHEGGNVSAHTCHLVGSALSDPYLSFAASMAGLAGPLHGLANQEVLVFLTKMVADIGHEYSEQQLKEWVWNHLKSGQVVPGYGHAVLRKTDPRYTCQREFALKHLPDDPMFKLVSTLYKVTPDILLEQGKAKNPWPNVDAHSGVLLQHYGMHEMSYYTVLFGVSRALGCLSQLIWARGMGLPLERPKSHSTDGLIKLAAAATAAK

SEQ ID NO: 124244 - protein, 74 aa, Heterodera glycines
  Homolog annotation: Hit_ID=CAE60849.1; Match level="QueryCoverage =98%, HitCoverage=10%, E-value=5e-34, Identity=87%"; Hit description =Hypothetical protein CBG04558 [Caenorhabditis briggsae]
  Gene Ontology: Biological process=cell growth
  Essential gene: C elegans homolog=C47E8.7; Phenotype=Emb
  Coding regions on vcDNA: vcDNA=SeqID_50667; Strand=+; Position=3-227
TWRFSGMKKWHVNWEIRHLKIQFDNEDVEFKPLSADCKVVHEFIGGYIFLSMRSKGQNQTLDEEGFHRLTGGWG

SEQ ID NO: 124245 - protein, 180 aa, Heterodera glycines
  Homolog annotation: Hit_ID=CAE71174.1; Match level="QueryCoverage =65%, HitCoverage=38%, E-value=3e-22, Identity=48%"; Hit description =Hypothetical protein CBG18031 [Caenorhabditis briggsae]
  Gene Ontology: Biological process=embryogenesis and morphogenesis
  Essential gene: C elegans homolog=F02E8.1; Phenotype=Lva
  Coding regions on vcDNA: vcDNA=SeqID_50668; Strand=+; Position=4-543
MITPSSNTSHYRESWYAFRYRAGIPGSTSSSWPLIRLTIGEKAKGARPGELENPSIFQKIILLNKEIIIMEENFCCFVFGWINIYLFFHTAFRYKFEKYVYKVTRERFGKMKAYIDNELKEAIEFRKTSKEQADSLKAVHENFPTIFQENLALQLEATYRKNVDYAWQEMKRRLDYLQEV

SEQ ID NO: 124246 - protein, 173 aa, Heterodera glycines
  misc_feature (119)..(119): Xaa can be any naturally occurring amino acid
  Homolog annotation: Hit_ID=CAE57581.1; Match level="QueryCoverage =86%, HitCoverage=31%, E-value=8e-25, Identity=38%"; Hit description =Hypothetical protein CBG00560 [Caenorhabditis briggsae]
  Gene Ontology: Mol. function=ATPase activity; Cellular component =mitochondrial inner membrane; Biological process=aerobic respiration
  Essential gene: C elegans homolog=F54C9.6; Phenotype=Gro
  Coding regions on vcDNA: vcDNA=SeqID_50669; Strand=-; Position=3-521
LANAPKGGLFDAFTSNPLFTGGAGLMCVGVLFNYGRKLSTVGASVLRRKYVSTLELSNEDQCVHSRTITIQWVLDFINKQSRRKTNQLSVSSTVLISESGKASTQFFFMPGQGHHYMSXGGRLVRVERERTEQMLQRADKRRTPLETVRLTTIGANLDSILILNQKFYYCKFE

SEQ ID NO: 124247 - protein, 173 aa, Heterodera glycines
  Homolog annotation: Hit_ID=NP_496497.1; Match level="QueryCoverage =79%, HitCoverage=19%, E-value=5e-63, Identity=76%"; Hit description =threonyl tRNA Synthetase (84.4 kD) (trs-1) [Caenorhabditis elegans] emb|CAA93762.1| Hypothetical protein
  Gene Ontology: Mol. function=threonine-tRNA ligase activity; Cellular component=cytoplasm; Biological process=tRNA modification
  Essential gene: C elegans homolog=C47D12.6a; Phenotype=Emb,Lva
  Coding regions on vcDNA: vcDNA=SeqID_50670; Strand=+; Position=22-540
YVNYRESWTPVLPGRNSRVDIIIIIMAANTTHYRGFQEVISPNIYNAKLWEQSGHWHHYAENMFRFEIEKEQFGLKPMNCPGHCLMFDYKPHAYNELPIRYADFGVLHRNEMSGALSGLTRVRRFQQDDAHIFCRKDQILSEISGCLDFLNFVYVEVFGFSFRLHLSTRPEEG

SEQ ID NO: 124248 - protein, 112 aa, Heterodera glycines; identical to SEQ ID NO: 122753
  misc_feature (31)..(31): Xaa can be any naturally occurring amino acid
  Homolog annotation: Hit_ID=CAE67341.1; Match level="QueryCoverage =99%, HitCoverage=97%, E-value=2e-21, Identity=42%"; Hit description =Hypothetical protein CBG12804 [Caenorhabditis briggsae]
  Gene Ontology: Cellular component=integral to endoplasmic reticulum membrane; Biological process=proteolysis and peptidolysis
  Essential gene: C elegans homolog=C34B2.10; Phenotype=Lva,Lvl,Unc
  Coding regions on vcDNA: vcDNA=SeqID_50671; Strand=+; Position=20-359

SEQ ID NO: 124249 - protein, 67 aa, Heterodera glycines; identical to SEQ ID NO: 122763
  Homolog annotation: Hit_ID=NP_496957.1; Match level="QueryCoverage =74%, HitCoverage=54%, E-value=6e-16, Identity=78%"; Hit description =ribosomal Protein, Large subunit (10.1 kD) (rpl-43) [Caenorhabditis elegans] emb|CAB54440.1| Hypothetical
  Essential gene: C elegans homolog=Y48B6A.2; Phenotype=Lva
  Coding regions on vcDNA: vcDNA=SeqID_50672; Strand=+; Position=38-241

SEQ ID NO: 124250 - protein, 155 aa, Heterodera glycines
  Homolog annotation: Hit_ID=NP_495227.1; Match level="QueryCoverage =80%, HitCoverage=24%, E-value=2e-20, Identity=39%"; Hit description =aRginyl aa-tRNA syntheTase (58.9 kD) (rrt-2) [Caenorhabditis elegans] gb|AAL02449.1| Arginyl aa-trna synt
  Gene Ontology: Biological process=tRNA modification
  Essential gene: C elegans homolog=C29H12.1; Phenotype=Gro
  Coding regions on vcDNA: vcDNA=SeqID_50673; Strand=+; Position=70-534
MIQSGLCRLTPDELWAVCQPEVGLGREKITLRKGDGLNLYMNRDLASIYARHRLYNADKYYYLVDYGQTNHFNQLRLLLRIRGDDDLADRMEHVSFGRIIGLSTRNGKNDSVDFLIDQGAREADAYVHASPTMRAEPAELGTICRRLAESTLLFE

SEQ ID NO: 124251 - protein, 114 aa, Heterodera glycines
  Homolog annotation: Hit_ID=CAE66364.1; Match level="QueryCoverage =94%, HitCoverage=61%, E-value=2e-31, Identity=51%"; Hit description =Hypothetical protein CBG11621 [Caenorhabditis briggsae]
  Essential gene: C elegans homolog=W06A7.2; Phenotype=Unc
  Coding regions on vcDNA: vcDNA=SeqID_50674; Strand=+; Position=69-454
MAQYVPWYYKRSPPIFCGVCVPVYLGVWSVRKFIVVLGFLLFLIGVLLLLGLLLICVAIECSAAAGALLPFALVLIIAGLLLLHCGWAAHLLDVGEGMPYGEYSTTKTVSTSAR

SEQ ID NO: 124252 - protein, 145 aa, Heterodera glycines
  Homolog annotation: Hit_ID=CAE58558.1; Match level="QueryCoverage =100%, HitCoverage=87%, E-value=5e-69, Identity=81%"; Hit description= Hypothetical protein CBG01720 [Caenorhabditis briggsae]
  Gene Ontology: Mol. function=ubiquitin-like conjugating enzyme activity; Cellular component=nucleus; Biological process=growth
  Essential gene: C elegans homolog=F29B9.6; Phenotype =Emb,Gro,Pvl,Stp,Unc
  Coding regions on vcDNA: vcDNA=SeqID_50675; Strand=+; Position=123-557
MAGIAAGRLTEERKAWRKDHPFGFIARQCKKEDGTLDLYNWICAIPGPKSTIWEGGLYKLRMIFKDDFPSTPPKCRFEPPLFHPNVYPSGTVCLSLLDENKDWKPSITVKQLLLGIQELLVSPHPEDPAQAEAYQIYVQNRPEYE

SEQ ID NO: 124253 - protein, 190 aa, Heterodera glycines
  Homolog annotation: Hit_ID=NP_498895.1; Match level="QueryCoverage =96%, HitCoverage=16%, E-value=1e-27, Identity=39%"; Hit description =kurz (3J700) [Caenorhabditis elegans] gb|AAA27928.2| Hypothetical protein C06E1.10 [Caenorhabditis elegan
  Gene Ontology: Biological process=rRNA processing
  Essential gene: C elegans homolog=C06E1.10; Phenotype=Lva
  Coding regions on vcDNA: vcDNA=SeqID_50676; Strand=+; Position=3-572
QEGLYTITQLGQSLAQLPLTPSFAKVVISSIRGGLLPFAVTLVSALSVREPLLFISSTKEDGTEERRKRMSEVIKQRFLWCAVGEARLFGDLTVILNTVGAADYEEENARAIEALGLRPKALKEINKQRHQLTLLLNKSDSVEKLPEKFRMDAPSQEQLRRLRHIMVKCHPDKLAKKVQSLDAPKGAYKT

SEQ ID NO: 124254 - protein, 99 aa, Heterodera glycines
  Homolog annotation: Hit_ID=NP_499676.1; Match level="QueryCoverage =77%, HitCoverage=45%, E-value=1e-17, Identity=54%"; Hit description =signal peptidase subunit (20.6 kD) (3N965) [Caenorhabditis elegans] emb|CAA21529.1| Hypothetical protein
  Gene Ontology: Cellular component=integral to membrane
  Essential gene: C elegans homolog=Y37D8A.10; Phenotype=Emb
  Coding regions on vcDNA: vcDNA=SeqID_50677; Strand=+; Position=246-542
MAPKEKEVGKGWSFAHFFWHLIKKETRNEKERHILANGRLALSFLAVAFAGFALLYDYFFPFPKSKIILAVCSISYFVMIMVLQAYQWYVEKLTFFQAE

SEQ ID NO: 124255 - protein, 139 aa, Heterodera glycines
  Homolog annotation: Hit_ID=NP_997689.1; Match level="QueryCoverage =98%, HitCoverage=39%, E-value=8e-40, Identity=52%"; Hit description =CGI-58-like protein [Rattus norvegicus] gb|AAS57860.1| CGI-58-like protein [Rattus norvegicus]
  Essential gene: C elegans homolog=C37H5.3a; Phenotype=Unclassified
  Coding regions on vcDNA: vcDNA=SeqID_50678; Strand=+; Position=121-537
GGIDQMIMVGHSFGGYLASSYALEHPSRVRHLVLVDPWGFPERPQIEQLHIPIWMRVFGRLLSLFNPLATLRAAGPFGARLVKKLRSDLGIRYAHQDPDAIYEYIYQCNAMEPTGEIAFGTMSKNFGWAKRPMINRFGG

SEQ ID NO: 124256 - protein, 204 aa, Heterodera glycines
  Homolog annotation: Hit_ID=NP_501180.1; Match level="QueryCoverage =98%, HitCoverage=38%, E-value=6e-68, Identity=64%"; Hit description =phosphate (57.5 kD) (4I161) [Caenorhabditis elegans] gb|AAB03157.2| Hypothetical protein C48A7.2 [Caenorh
  Gene Ontology: Mol. function=sodium:phosphate symporter activity; Cellular component=integral to plasma membrane; Biological process =hermaphrodite genital morphogenesis
  Essential gene: C elegans homolog=C48A7.2; Phenotype=Pvl,Stp
  Coding regions on vcDNA: vcDNA=SeqID_50679; Strand=+; Position=81-692
MALLEEGKTEQNGDEPSTKVKMAENGGGGGAEVAQNKFGSSSIRPASSVLSFFRSSKPEDPYASKLFTFLQVLTACFSGFAHGGNDVSNAIAPLVSLYTIYDEGSVHQKGETSVYLLLYGAAGMCVGLWLLGHRVIYTVGENLTRITPPSGFSIEFGAALTVLFASKLGLPISSTQCKVGSVVAVGLVQAHPVVHWTVFRNISL

SEQ ID NO: 124257 - protein, 50 aa, Heterodera glycines
  misc_feature (18)..(18): Xaa can be any naturally occurring amino acid
  Homolog annotation: Hit_ID=CAC34452.1; Match level="QueryCoverage =84%, HitCoverage=70%, E-value=3e-11, Identity=73%"; Hit description =thioredoxin peroxidase, putative [Globodera rostochiensis]
  Gene Ontology: Mol. function=thioredoxin peroxidase activity; Cellular component=cytoplasm; Biological process=response to oxidative stress
  Essential gene: C elegans homolog=F09E5.15; Phenotype=Sck,Sma
  Coding regions on vcDNA: vcDNA=SeqID_50680; Strand=+; Position=145-297
MSAGRANIGKPAPNFSVXAAADFDFKTVSLDDYKGKYVVLFFYPEDLWVF

SEQ ID NO: 124258 - protein, 103 aa, Heterodera glycines; identical to SEQ ID NO: 119330
  Homolog annotation: Hit_ID=NP_509231.1; Match level="QueryCoverage =100%, HitCoverage=100%, E-value=3e-52, Identity=99%"; Hit description=histone (his-38) [Caenorhabditis elegans] ref|NP _507034.1| histone (his-1) [Caenorhabditis elegans] ref
  Essential gene: C elegans homolog=ZK131.1; Phenotype=Unclassified
  Coding regions on vcDNA: vcDNA=SeqID_50681; Strand=+; Position=38-349

SEQ ID NO: 124259 - protein, 160 aa, Heterodera glycines
  Homolog annotation: Hit_ID=CAE67724.1; Match level="QueryCoverage =56%, HitCoverage=30%, E-value=7e-21, Identity=53%"; Hit description =Hypothetical protein CBG13299 [Caenorhabditis briggsae]
  Gene Ontology: Biological process=growth
  Essential gene: C elegans homolog=C18D11.4; Phenotype=Lva
  Coding regions on vcDNA: vcDNA=SeqID_50682; Strand=+; Position=125-604
GGNRQKSKKGSQTMMKKRERKEKEEVVFSQPVVWVKQKKRNFLCKIMGSPGRRWYRILAISNLNPSPFFSRSRSRDLPSSRGGGGGGGYYGSRRFHDGRDNPNPNPCLGVFGMSLHTTERDLKHLFGRYGEVDSVQIVYDRLSGRSRGFGFVYFTHTKDA

SEQ ID NO: 124260 - protein, 143 aa, Heterodera glycines
  Homolog annotation: Hit_ID=NP_495919.1; Match level="QueryCoverage =81%, HitCoverage=68%, E-value=4e-15, Identity=39%"; Hit description =NADH ubiquinone oxidoreductase, AGGG subunit (18.5 kD) (2J287) [Caenorhabditis elegans] emb|CAA90118.1| H
  Essential gene: C elegans homolog=F44G4.2; Phenotype=Emb,Lva
  Coding regions on vcDNA: vcDNA=SeqID_50683; Strand=+; Position=32-460
MPPLRDYLPRPTWVKHGNEFPLRQLLPGHYDDPEWHPKDRGYAGSPRFGDKIPEDIMIYRRSPTEEEVPFLHKAMHKLMSMVFWYWVFYTIYWHHQEQFTGEWYFPYHYEWTDEELGVPPDDAPDPEERQFWGHPGELIGTYR

SEQ ID NO: 124261 - protein, 63 aa, Heterodera glycines; identical to SEQ ID NO: 123487
  Homolog annotation: Hit_ID=NP_491790.1; Match level="QueryCoverage =96%, HitCoverage=8%, E-value=7e-23, Identity=73%"; Hit description =gastrin-binding protein like (81.5 kD) (1G784) [Caenorhabditis elegans] gb|AAK21464.1| Hypothetical protei
  Gene Ontology: Mol. function=enoyl-CoA hydratase activity; Cellular component=mitochondrion; Biological process=growth
  Essential gene: C elegans homolog=T08B2.7a; Phenotype=Unclassified
  Coding regions on vcDNA: vcDNA=SeqID_50684; Strand=+; Position=2-193

SEQ ID NO: 124262 - protein, 103 aa, Heterodera glycines
  Homolog annotation: Hit_ID=NP_509231.1; Match level="QueryCoverage =100%, HitCoverage=100%, E-value=2e-50, Identity=97%"; Hit description=histone (his-38) [Caenorhabditis elegans] ref|NP _507034.1| histone (his-1) [Caenorhabditis elegans] ref
  Essential gene: C elegans homolog=ZK131.1; Phenotype=Unclassified
  Coding regions on vcDNA: vcDNA=SeqID_50685; Strand=+; Position=41-352
MSGRGKGGKGLGKGGAKRHRKVLRDNIQGITKPAIRRLARRGGVKCISGLIYEETRSVLKVFLENVIRDAVTYCGHAKRKTVTAMDVVYALKRQGRTLYGFGG

SEQ ID NO: 124263 - protein, 238 aa, Heterodera glycines; identical to SEQ ID NO: 122691
  Homolog annotation: Hit_ID=CAE71996.1; Match level="QueryCoverage =97%, HitCoverage=50%, E-value=2e-67, Identity=56%"; Hit description =Hypothetical protein CBG19072 [Caenorhabditis briggsae]
  Gene Ontology: Cellular component=integral to membrane
  Essential gene: C elegans homolog=Y57E12AL.1a; Phenotype=Egl,Gro,Pch
  Coding regions on vcDNA: vcDNA=SeqID_50686; Strand=+; Position=1-717

SEQ ID NO: 124264 - protein, 101 aa, Heterodera glycines
  Homolog annotation: Hit_ID=XP_317657.1; Match level="QueryCoverage =57%, HitCoverage=38%, E-value=7e-11, Identity=55%"; Hit description =ENSANGP00000018565 [Anopheles gambiae]
  Essential gene: C elegans homolog=F58F12.1; Phenotype=Emb,Lva
  Coding regions on vcDNA: vcDNA=SeqID_50687; Strand=+; Position=37-342
MTSIRGLLFTLASPLKAFYANVAVKQIDVTGMSSSVGILPTHVPTIAVLKPGVVKVHELDGCSKYCGIVQHYSNLYLVIDFQCFRKRLQVFRFFWYPFNEY

SEQ ID NO: 124265 - protein, 82 aa, Heterodera glycines
  Homolog annotation: Hit_ID=XP_313971.1; Match level="QueryCoverage =71%, HitCoverage=15%, E-value=7e-27, Identity=94%"; Hit description =ENSANGP00000009996 [Anopheles gambiae]
  Gene Ontology: Biological process=reproduction
  Essential gene: C elegans homolog=T04C12.6; Phenotype=Ste
  Coding regions on vcDNA: vcDNA=SeqID_50688; Strand=+; Position=85-333
PIKMCDEEVAALVVDNGSGMCKAGFAGDDAPRAVFPSIVGRPRHQGVMVGMGQKDSYVGLHFCRRHSPKNSFIFCENKGSNC

SEQ ID NO: 124266 - protein, 134 aa, Heterodera glycines
  Homolog annotation: Hit_ID=CAE61909.1; Match level="QueryCoverage =98%, HitCoverage=14%, E-value=2e-20, Identity=36%"; Hit description =Hypothetical protein CBG05905 [Caenorhabditis briggsae]
  Gene Ontology: Mol. function=aminopeptidase activity; Cellular component=cytosol
  Essential gene: C elegans homolog=F49E8.3; Phenotype=Emb
  Coding regions on vcDNA: vcDNA=SeqID_50689; Strand=+; Position=2-403
AEDKFIVDEVKSNEWVKVNSNFSSFFRVQYSPNMLQSLLDGVKNRELGVLDRYQLASDLYALVKSSRVSVSHFLALLTVCQEEEDYFVWSAIDSGIGSIAHSLKHLDDERKLLDRFERFVCKMIESVAAKLGWE

SEQ ID NO: 124267 - protein, 114 aa, Heterodera glycines
  Homolog annotation: Hit_ID=CAE63488.1; Match level="QueryCoverage =89%, HitCoverage=17%, E-value=1e-37, Identity=70%"; Hit description =Hypothetical protein CBG07956 [Caenorhabditis briggsae]
  Gene Ontology: Mol. function=pre-mRNA splicing factor activity; Cellular component=nuclear matrix; Biological process=mRNA splicing
  Essential gene: C elegans homolog=F28D9.1; Phenotype=Sck
  Coding regions on vcDNA: vcDNA=SeqID_50690; Strand=+; Position=22-366
MDAGFYRGTSSEQDIRLTDKERKLLRQMKFENVLETKVDLAKINLDVIKPWITLKLNEILGMEDDVVVEYVFTQLEEKELNPKKMQINLTGFLNARRAREFMVFFHLLDHLLSF

SEQ ID NO: 124268 - protein, 158 aa, Heterodera glycines
  Homolog annotation: Hit_ID=EAK89192.1; Match level="QueryCoverage =93%, HitCoverage=3%, E-value=6e-41, Identity=57%"; Hit description =very large probable mucin, 11700 aa long protein with signal peptide and pronounced Thr repeat (308 aa long
  Gene Ontology: Mol. function=cell adhesion receptor activity; Cellular component=cell wall (sensu Fungi); Biological process =agglutination during conjugation with cellular fusion
  Essential gene: C elegans homolog=ZK945.9; Phenotype=Gro
  Coding regions on vcDNA: vcDNA=SeqID_50691; Strand=+; Position=43-516
MFYQTVCLLLLLSASNDVAVFGQEETTTTSTSSTSTSTTSSTSTSTTPTTTSSTSTSTTPSTTTSSTSTSTSTTPTTTSSTSTSTTPTTTSSTSTSTTPTTTSSTSTSATPTTTSSTSTSTTPTTTSSTSTSTIPTTTSSTSTSTTPTTTTSTSTSTT

SEQ ID NO: 124269 - protein, 167 aa, Heterodera glycines; identical to SEQ ID NO: 122730
  Homolog annotation: Hit_ID=EAK89192.1; Match level="QueryCoverage =93%, HitCoverage=3%, E-value=2e-44, Identity=56%"; Hit description =very large probable mucin, 11700 aa long protein with signal peptide and pronounced Thr repeat (308 aa long
  Gene Ontology: Mol. function=cell adhesion receptor activity; Cellular component=cell wall (sensu Fungi); Biological process =agglutination during conjugation with cellular fusion
  Essential gene: C elegans homolog=ZK945.9; Phenotype=Gro
  Coding regions on vcDNA: vcDNA=SeqID_50692; Strand=+; Position=43-543

SEQ ID NO: 124270 - protein, 131 aa, Heterodera glycines
  Homolog annotation: Hit_ID=CAE63488.1; Match level="QueryCoverage =93%, HitCoverage=21%, E-value=3e-45, Identity=66%"; Hit description =Hypothetical protein CBG07956 [Caenorhabditis briggsae]
  Gene Ontology: Mol. function=pre-mRNA splicing factor activity; Cellular component=nuclear matrix; Biological process=mRNA splicing
  Essential gene: C elegans homolog=F28D9.1; Phenotype=Sck
  Coding regions on vcDNA: vcDNA=SeqID_50693; Strand=+; Position=1-393
FRCLQFIEIDAGFYRGTSSEQDIRFTDKERKLLRQMKFENVLETKVDLAKINLDVIKPWITLKLNEILGMEDDVVVEYVFTQLEEKELNPKKMQINLTGFLNARRAREFMAEMWQMFVEAQDSPEGIPTSL

SEQ ID NO: 124271 - protein, 186 aa, Heterodera glycines
  misc_feature (175)..(175): Xaa can be any naturally occurring amino acid
  Homolog annotation: Hit_ID=BAD17954.1; Match level="QueryCoverage =100%, HitCoverage=39%, E-value=2e-71, Identity=71%"; Hit description= glucose-6-phosphate 1-dehydrogenase [Branchiostoma belcheri]
  Gene Ontology: Mol. function=glucose-6-phosphate 1-dehydrogenase activity; Cellular component=cytoplasm; Biological process=pentose -phosphate shunt
  Essential gene: C elegans homolog=B0035.5; Phenotype =Emb,Gro,Unclassified
  Coding regions on vcDNA: vcDNA=SeqID_50694; Strand=+; Position=1-559
LVVLRFGNRFISRSWSRDDIASVTISFKENFGTQGRGGYFDKSGIIRDVMQNHLMQILTLVAMEKPATLSAEDFRNEKVKVLKVIKPVELDQTVLGQYIGNPLGKDDDSRKGYLDDPTVPRGSTTPTFATAVLFVHNERWEGVPFFLRCGKALNERKAEVRIQYKDVSGDIFPGXSLKRNELVIRV

SEQ ID NO: 124272 - protein, 126 aa, Heterodera glycines
  Homolog annotation: Hit_ID=AAP80699.1; Match level="QueryCoverage =96%, HitCoverage=62%, E-value=7e-51, Identity=79%"; Hit description =40S ribosome protein S5 [Griffithsia japonica]
  Gene Ontology: Mol. function=structural constituent of ribosome; Cellular component=cytosolic small ribosomal subunit (sensu Eukarya); Biological process=protein biosynthesis
  Essential gene: C elegans homolog=T05E11.1; Phenotype=Ste
  Coding regions on vcDNA: vcDNA=SeqID_50695; Strand=+; Position=137-514
MEVENVKLFNRWSYETIEVKDVSLQDYISVTQHPVYLPHTAGRYQVKRFRKSQCPIVERLACSLMMHGRNNGKKLMAVRIVKHAFEIINLLTDLNPIQVLVDAVQNTGPREDSTRIGSQGTVRRQA

SEQ ID NO: 124273 - protein, 134 aa, Heterodera glycines
  Homolog annotation: Hit_ID=NP_491370.1; Match level="QueryCoverage =92%, HitCoverage=63%, E-value=4e-13, Identity=45%"; Hit description =eukaryotic Initiation Factor (41.0 kD) (eif-3.H) [Caenorhabditis elegans] gb|AAC48137.2| Eukaryotic initi
  Gene Ontology: Biological process=positive regulation of growth rate
  Essential gene: C elegans homolog=C41D11.2; Phenotype=Emb,Gro
  Coding regions on vcDNA: vcDNA=SeqID_50696; Strand=+; Position=72-473
MANPSINAKAAVLVDNPRVEFVQLDSLVVMKIVKHGDIEFYAGMSKIAGETCQGILTGLISVEDKRLEVTCDDSWSPEQTKLAGVNFANFFEELPIVVKNSHLMNVLLAELALSTKCQRAASIRLELGTKQSLE

SEQ ID NO: 124274 - protein, 141 aa, Heterodera glycines
  Homolog annotation: Hit_ID=CAE67836.1; Match level="QueryCoverage =65%, HitCoverage=23%, E-value=2e-28, Identity=66%"; Hit description =Hypothetical protein CBG13421 [Caenorhabditis briggsae]
  Gene Ontology: Mol. function=DNA-(apurinic or apyrimidinic site) lyase activity; Cellular component=mitochondrion; Biological process= base-excision repair
  Essential gene: C elegans homolog=T05H10.2; Phenotype=Emb
  Coding regions on vcDNA: vcDNA=SeqID_50697; Strand=+; Position=12-434
MVEPKIPTTSDFNEENPVKSTPESHSLIKNGFFMSEEYGMTTKSVYTSQISQSVIKAGLYSKKNLGVHVSAAGSLENAIWNAIEMGCRSFALFVRNQRRWNAKPMDESVVERWNCAIKKTKFPLHQIVPHGSYLLNAGSPD

SEQ ID NO: 124275 - protein, 144 aa, Heterodera glycines
  misc_feature (39)..(39): Xaa can be any naturally occurring amino acid
  Homolog annotation: Hit_ID=CAE57828.1; Match level="QueryCoverage =99%, HitCoverage=59%, E-value=2e-43, Identity=65%"; Hit description =Hypothetical protein CBG00853 [Caenorhabditis briggsae]
  Gene Ontology: Mol. function=endopeptidase Clp activity; Cellular component=mitochondrion; Biological process=misfolded or incompletely synthesized protein catabolism
  Essential gene: C elegans homolog=ZK970.2; Phenotype =Emb,Gro,Pvl,Slu,Sma,Stp
  Coding regions on vcDNA: vcDNA=SeqID_50698; Strand=+; Position=1-432
SGKTAINMYINCPGGSVTAGLGIYDTMQHISAPVATWCXAFLIWSGGIQKKGIYFTPGIGQASSMGSLLLTVGAKGMRTSLPNARIMVHQPSGGAYGTAADIVIRAEEINRMRKRLNEIYAMHTGQTVETIDQALDRDRFMSAL

SEQ ID NO: 124276 - protein, 127 aa, Heterodera glycines; identical to SEQ ID NO: 122688
  Homolog annotation: Hit_ID=NP_507032.1; Match level="QueryCoverage =100%, HitCoverage=100%, E-value=2e-60, Identity=92%"; Hit description=histone (13.4 kD) (his-3) [Caenorhabditis elegans] ref|NP_505296.1| histone (13.4 kD) (his-19) [Caenorh
  Gene Ontology: Mol. function=DNA binding; Cellular component =nucleosome; Biological process=nucleosome assembly
  Essential gene: C elegans homolog=T23D8.6; Phenotype=Emb
  Coding regions on vcDNA: vcDNA=SeqID_50699; Strand=+; Position=67-450

SEQ ID NO: 124277 - protein, 124 aa, Heterodera glycines
  Homolog annotation: Hit_ID=XP_515482.1; Match level="QueryCoverage =87%, HitCoverage=68%, E-value=3e-26, Identity=56%"; Hit description =PREDICTED: hypothetical protein XP_515482 [Pan troglodytes] ref|NP _002945.1| ubiquitin and ribosomal prot
  Gene Ontology: Biological process=cell cycle
  Essential gene: C elegans homolog=H06I04.4a; Phenotype=Ste
  Coding regions on vcDNA: vcDNA=SeqID_50700; Strand=+; Position=25-399
LKLNQTEKMFVKTFSNKTVVFNVDPTELSVEQLKALIAEEEEIAVPDQRLVFAGCQLVDGTLLRTYGVDADSTIHLDLRLLGGGKKRKKKQYTGPKKQKHVRKKVKLAVLKLYKVVRHYNWEKR

SEQ ID NO: 124278 - protein, 86 aa, Heterodera glycines; identical to SEQ ID NO: 123461
  Essential gene: C elegans homolog=R10H10.4; Phenotype=Emb
  Coding regions on vcDNA: vcDNA=SeqID_50701; Strand=+; Position=51-311

SEQ ID NO: 124279 - protein, 143 aa, Heterodera glycines
  Homolog annotation: Hit_ID=NP_502365.1; Match level="QueryCoverage =100%, HitCoverage=100%, E-value=4e-70, Identity=88%"; Hit description=ribosomal Protein, Small subunit (15.9 kD) (rps-23) [Caenorhabditis elegans] emb|CAA94601.1| Hypothetic
  Gene Ontology: Cellular component=eukaryotic 48S initiation complex; Biological process=protein biosynthesis
  Essential gene: C elegans homolog=F28D1.7; Phenotype=Ste
  Coding regions on vcDNA: vcDNA=SeqID_50702; Strand=+; Position=9-437
MGKPKGIRTARKLKKHRQEQRWNDKRYKKTNLGTRWKADPFGGACIAKGIVLEKIGVEAKQPNSAIRKCVRVQLIKNSKKITAFVPNDGCLNFIEENDEVLVSGFGRSGHAGGDIPGVRFKVVKVANTSLLALFRGKKERPRS

SEQ ID NO: 124280 - protein, 130 aa, Heterodera glycines
  Homolog annotation: Hit_ID=CAE73772.1; Match level="QueryCoverage =79%, HitCoverage=19%, E-value=6e-11, Identity=39%"; Hit description =Hypothetical protein CBG21316 [Caenorhabditis briggsae]
  Gene Ontology: Mol. function=transcriptional repressor activity; Cellular component=transcription factor complex; Biological process =negative regulation of transcription from Pol II promoter
  Essential gene: C elegans homolog=F21H11.3; Phenotype=Gro,Unc
  Coding regions on vcDNA: vcDNA=SeqID_50703; Strand=+; Position=134-523
MEKEEEGEKSMNDLVTASSPTEVRPASPPASSSVSVPPSAAGVPPSLYVRLPQPDDPFYFCALAVGLAAVPPITFGISGPPLHVFVQADGVTDAPKVELEDKQLWEEFHKFGNEMIITTSGRRIFPSMSV

SEQ ID NO: 124281 - protein, 86 aa, Heterodera glycines
  Homolog annotation: Hit_ID=NP_506079.1; Match level="QueryCoverage =58%, HitCoverage=15%, E-value=3e-09, Identity=56%"; Hit description =putative mitochondrial translation elongation factor Ts, with ubiquitin associated domain (34.1 kD) (5M75
  Gene Ontology: Cellular component=mitochondrion
  Essential gene: C elegans homolog=F55C5.5; Phenotype=Lva
  Coding regions on vcDNA: vcDNA=SeqID_50704; Strand=+; Position=82-342
MEIVDNGEGTEKECSANADLNASQVDQSELTRMDGEETQLLHQPFMLNPEQTVNEYLEAHGANIADFLRIEMGQENTKTNDSSVHC

SEQ ID NO: 124282 - protein, 159 aa, Heterodera glycines
  misc_feature (89)..(89): Xaa can be any naturally occurring amino acid
  Homolog annotation: Hit_ID=NP_502795.1; Match level="QueryCoverage =78%, HitCoverage=27%, E-value=2e-19, Identity=43%"; Hit description =skinny hedgehog like (4P590) [Caenorhabditis elegans] emb|CAB16518.1| Hypothetical protein Y57G11C.17 [Ca
  Essential gene: C elegans homolog=Y57G11C.17; Phenotype=Unclassified
  Coding regions on vcDNA: vcDNA=SeqID_50705; Strand=+; Position=2-479
YRDEGPFKLYIPLITFGPFSSVHRQIGPNLAIIFLRHFVPMFAVFAFVLFWHGLSPNYFCWVSLSATALIAERIGHSLPKWHTIWPYLXEATFVRLKAASMLFTVIPGIFGIFFFLGLNGVGAFVFRSLLLDGLSQILSLRIFSSNSAGFVLLHFFLLG

SEQ ID NO: 124283 - protein, 157 aa, Heterodera glycines
  Homolog annotation: Hit_ID=NP_500466.1; Match level="QueryCoverage =100%, HitCoverage=60%, E-value=1e-55, Identity=63%"; Hit description= proliferating Cell Nuclear Antigen homolog (29.0 kD) (pcn-1) [Caenorhabditis elegans] pir||T28761 hypoth
  Gene Ontology: Mol. function=DNA binding; Cellular component =chromatin; Biological process=DNA replication
  Essential gene: C elegans homolog=W03D2.4; Phenotype=Emb,Ste
  Coding regions on vcDNA: vcDNA=SeqID_50706; Strand=+; Position=14-484
MFEAKFTNAALLKKIVEAIKELVSEAPFDCTENSMCLQAMDGSHVALISLKLDIGLFEVFRCDRTIALGLSMGELSKVLKCSKSEDTLMIRFEDSEQDMVTFTFEDTKGRKQDITLKLMDIDNEHLGIPDQKYAAVVEMPSTEFQKVCRDIASFSDS

SEQ ID NO: 124284 - protein, 137 aa, Heterodera glycines
  Essential gene: C elegans homolog=K07B1.6a; Phenotype=Lva
  Coding regions on vcDNA: vcDNA=SeqID_50707; Strand=+; Position=70-480
MSDDNCCGSVGARSPTGSISSSGSADYDVALSPTQLLAMAIKKRRHLLEDKQRDYQRELLHSHLIQNLCKFLGEGRARVRRHRRSSSRRKLVRHRRWDDDTSGNGDERGQQVVPDDSRSPSSSPNPSGIVFESTVQS

SEQ ID NO: 124285 - protein, 96 aa, Heterodera glycines; identical to SEQ ID NO: 123449
  Homolog annotation: Hit_ID=AAB81951.1; Match level="QueryCoverage =45%, HitCoverage=48%, E-value=7e-15, Identity=86%"; Hit description =Dim1p homolog [Homo sapiens]
  Gene Ontology: Mol. function=pre-mRNA splicing factor activity; Cellular component=small nuclear ribonucleoprotein complex; Biological process=cell cycle
  Essential gene: C elegans homolog=C24H11.9; Phenotype=Gro
  Coding regions on vcDNA: vcDNA=SeqID_50708; Strand=+; Position=5-295

SEQ ID NO: 124286 - protein, 253 aa, Heterodera glycines
  Homolog annotation: Hit_ID=CAE67373.1; Match level="QueryCoverage =66%, HitCoverage=77%, E-value=4e-55, Identity=64%"; Hit description =Hypothetical protein CBG12849 [Caenorhabditis briggsae]
  Gene Ontology: Biological process=body morphogenesis (sensu Nematoda)
  Essential gene: C elegans homolog=B0261.4; Phenotype=Age,Gro,Ste,WT
  Coding regions on vcDNA: vcDNA=SeqID_50709; Strand=+; Position=49-807
MVALFFSKFVVVPSSSSLGVSSSSAILSLVSLLSPVALPHRRSFAVVNNVKIVDPMDVRKDNVSTKKKDDGVAAEVRRKKKVYALAEFLDRPENWGKFGALDPSDRPGRSWTVEELRLKSNSDLHKLWYVLLKERNMLLSMDHAYKVRLRNMPNPERIDRVAESMERLEAVVHERNDAFLHLETGDSASPPKRTVTSFMGFTYDEYATEHYLPAEATGEKQYEQPMLDDQAHLMQVLWREKEQLKKEVALMDE

SEQ ID NO: 124287 - protein, 89 aa, Heterodera glycines; identical to SEQ ID NO: 123438
  Homolog annotation: Hit_ID=AAL99922.1; Match level="QueryCoverage =91%, HitCoverage=9%, E-value=1e-18, Identity=54%"; Hit description =CLL-associated antigen KW-2 [Homo sapiens]
  Essential gene: C elegans homolog=T08G11.4; Phenotype=Emb,Lva,Unc
  Coding regions on vcDNA: vcDNA=SeqID_50710; Strand=+; Position=1-270

SEQ ID NO: 124288 - protein, 104 aa, Heterodera glycines; identical to SEQ ID NO: 123435
  Homolog annotation: Hit_ID=EAL19965.1; Match level="QueryCoverage =98%, HitCoverage=57%, E-value=1e-31, Identity=62%"; Hit description =hypothetical protein CNBF2920 [Cryptococcus neoformans var. neoformans B-3501A]
  Gene Ontology: Mol. function=structural constituent of ribosome; Cellular component=cytosolic large ribosomal subunit (sensu Eukarya); Biological process=protein biosynthesis
  Essential gene: C elegans homolog=F10E7.7; Phenotype =Clr,Emb,Gro,Sck,Slu,Stp
  Coding regions on vcDNA: vcDNA=SeqID_50711; Strand=+; Position=3-317

SEQ ID NO: 124289 - protein, 185 aa, Heterodera glycines
  Homolog annotation: Hit_ID=XP_392565.1; Match level="QueryCoverage =84%, HitCoverage=82%, E-value=2e-43, Identity=56%"; Hit description =similar to ribosomal protein L18 [Apis mellifera]
  Gene Ontology: Cellular component=cytosolic ribosome (sensu Eukarya); Biological process=protein biosynthesis
  Essential gene: C elegans homolog=Y45F10D.12; Phenotype=Ste
  Coding regions on vcDNA: vcDNA=SeqID_50712; Strand=+; Position=2-556
GIDINHKYDRKVRRTAPKSEDPYLRVLVKLYRFLAKRVDTSKRFNAVVLKRLFMSKRNRPPLSIARIVRYVKKPGNEKELVVCVGSVTDDKRIYTVPAMTDCAVRFTDGARARIIAGGGEWITSKSGIAGPKGQKTLLVKEQQRRAKRKTFPTAPGRLAILQNVGFREGKNFNVDPAPKTSGYKN

SEQ ID NO: 124290 - protein, 88 aa, Heterodera glycines; identical to SEQ ID NO: 119696
  Homolog annotation: Hit_ID=NP_496838.1; Match level="QueryCoverage =71%, HitCoverage=71%, E-value=8e-10, Identity=48%"; Hit description =ubiquinone-binding protein like (10.6 kD) (2N782) [Caenorhabditis elegans] emb|CAB04384.1| Hypothetical p
  Essential gene: C elegans homolog=F45H10.2; Phenotype=Clr,Gro,Stp
  Coding regions on vcDNA: vcDNA=SeqID_50713; Strand=+; Position=16-282

SEQ ID NO: 124291 - protein, 149 aa, Heterodera glycines; identical to SEQ ID NO: 122641
  Homolog annotation: Hit_ID=Q9HFY6; Match level="QueryCoverage=100%, HitCoverage=100%, E-value=2e-77, Identity=97%"; Hit description =Calmodulin (CaM) gb|AAG31446.1| calmodulin [Blastocladiella emersonii]
  Gene Ontology: Mol. function=calcium ion binding
  Essential gene: C elegans homolog=T21H3.3; Phenotype=Emb,Ste
  Coding regions on vcDNA: vcDNA=SeqID_50714; Strand=+; Position=66-515

SEQ ID NO: 124292 - protein, 240 aa, Heterodera glycines
  misc_feature (83)..(83): Xaa can be any naturally occurring amino acid
  misc_feature (167)..(167): Xaa can be any naturally occurring amino acid
  misc_feature (201)..(201): Xaa can be any naturally occurring amino acid
  Homolog annotation: Hit_ID=NP_594138.1; Match level="QueryCoverage =97%, HitCoverage=98%, E-value=1e-68, Identity=58%"; Hit description =40S ribosomal protein S6 [Schizosaccharomyces pombe] emb|CAC36929.1| SPAPB1E7.12 [Schizosaccharomyces pom
  Gene Ontology: Cellular component=eukaryotic 48S initiation complex; Biological process=protein biosynthesis
  Essential gene: C elegans homolog=Y71A12B.1; Phenotype=Ste
  Coding regions on vcDNA: vcDNA=SeqID_50715; Strand=+; Position=2-725
KLNIADPSSGSRKTFEIDDEKRYHVLIDKRISQEIPGDQVGYEFKGYVFRITGGNDKQGFPMKHGVLVNHRVRLLLSEGHSCXRPRRTGERKRNAIRGCIINHDSAGVSLVDFKKGEDDIGGVTDVTVPKLLGSQRASEIRKTFELTKEDDVLKYEIRREVPEKSGXPESNAPKIQRLVTPLTLQRKRAHHAEKRIRAVAXREAAASYKKLLADRAHELYAKKHAKRVQRRSSTHASSTA

SEQ ID NO: 124293 - protein, 178 aa, Heterodera glycines
  Homolog annotation: Hit_ID=NP_495863.1; Match level="QueryCoverage =95%, HitCoverage=33%, E-value=2e-53, Identity=61%"; Hit description =phenylalanine hydroxylase, Biogenic Amine Synthesis related (52.1 kD) (bas-2) [Caenorhabditis elegans] em
  Gene Ontology: Mol. function=tyrosine 3-monooxygenase activity; Biological process=phenylalanine catabolism
  Essential gene: C elegans homolog=ZK1290.2a; Phenotype=Emb
  Coding regions on vcDNA: vcDNA=SeqID_50716; Strand=+; Position=21-554
TSGSPGCRNSARGFGYSSKPHYTPEPDILYELLGHCPLFADPDFAQFSQEFGLASLGASDEMVEKLATLYWFTVEFGICIQNGAKKAYGAGLLSSFGELEYALSGQPELAAFNPPETCQTKYPITSYQPKYFVAESFADAKNKLAYCICRARVLSIFNPPRSRSTWSTSIPRQFQVNY

SEQ ID NO: 124294 - protein, 237 aa, Heterodera glycines
  Homolog annotation: Hit_ID=BAB69973.1; Match level="QueryCoverage =86%, HitCoverage=40%, E-value=7e-41, Identity=40%"; Hit description =Myt1 [Asterina pectinifera]
  Gene Ontology: Mol. function=protein tyrosine kinase activity; Cellular component=nucleus; Biological process=DNA replication
  Essential gene: C elegans homolog=Y53C12A.1; Phenotype=Unclassified
  Coding regions on vcDNA: vcDNA=SeqID_50717; Strand=+; Position=65-775
MEMQASPGPDCGFTTPSRTSTNSKFIVDVPLSTKREKLLRGTPTRFRLPPVRRLMKSAPNIHHRFYLARDHIEPFAQIVSFKRSEDRPSLSNRYRPELEETYLQQCFVLQGRLGQGDFGEVVSVRSKDDGKLYAVKSSLDIYRNSADRREKLQEAWEERGRLYIQTELCSQSLDDMARERHEIPEPEIWYYLIDSLMALEHMHSHDIIHVDIKPSNIFVTSDGICKLGDFGLVFDLK

SEQ ID NO: 124295 - protein, 98 aa, Heterodera glycines
  Homolog annotation: Hit_ID=CAE62886.1; Match level="QueryCoverage =95%, HitCoverage=33%, E-value=2e-45, Identity=89%"; Hit description =Hypothetical protein CBG07073 [Caenorhabditis briggsae]
  Essential gene: C elegans homolog=W08F4.6; Phenotype=Bmd,Lva,Unc
  Coding regions on vcDNA: vcDNA=SeqID_50718; Strand=+; Position=24-320
LCPPPKAYRRMTCSKIFTIEDLPKSFFGPLQSNEYWLTFSFTDGKDKKLGCARLWVDVCKYHLQDKQQKCLRDPNAFKNFINEISSQAEQIRQRTNSG

SEQ ID NO: 124296 - protein, 143 aa, Heterodera glycines
  Homolog annotation: Hit_ID=CAE69690.1; Match level="QueryCoverage =95%, HitCoverage=31%, E-value=4e-35, Identity=52%"; Hit description =Hypothetical protein CBG15945 [Caenorhabditis briggsae]
  Gene Ontology: Mol. function=acyl-CoA dehydrogenase activity; Cellular component=mitochondrial matrix; Biological process=energy pathways
  Essential gene: C elegans homolog=K05F1.3; Phenotype=Unclassified
  Coding regions on vcDNA: vcDNA=SeqID_50719; Strand=+; Position=97-525
MQPFVHWSKCIFKRPFSNSSKLFSSSFSMGFNFEFTEEQKQLQAAVKKFTQDEIIPKASHYDKTMEFPWEVIKKAHANGFMNVDIPSDCGGLDLELVSNVLISEVIGYGCTGIGTAILGNDLAATPLVIGAKEEVKKKFLSRL

SEQ ID NO: 124297 - protein, 155 aa, Heterodera glycines
  Homolog annotation: Hit_ID=NP_494883.1; Match level="QueryCoverage =100%, HitCoverage=74%, E-value=2e-30, Identity=48%"; Hit description= glutathione S-Transferase (23.0 kD) (gst-7) [Caenorhabditis elegans] gb|AAB37846.1| Glutathione s-transf
  Gene Ontology: Mol. function=glutathione transferase activity; Biological process=glutathione conjugation reaction
  Essential gene: C elegans homolog=R05F9.5a; Phenotype=Unclassified
  Coding regions on vcDNA: vcDNA=SeqID_50720; Strand=+; Position=72-536
MVQYKLYSFDGRGLGESIRLLLHYVGQPFEDIRIKDMEEWEKTYKPKFFYGKVPVLEVDGKPLGQSATILRYLAEKFGLAGKDECEKAKANEIIDFQKDANTDLAPYLYVKMGFRQGDLDKLRGEVFEPGVKHILPLFEKLLKESGSGYMLKSGL

SEQ ID NO: 124298 - protein, 126 aa, Heterodera glycines
  Homolog annotation: Hit_ID=CAE58995.1; Match level="QueryCoverage =94%, HitCoverage=57%, E-value=1e-17, Identity=35%"; Hit description =Hypothetical protein CBG02268 [Caenorhabditis briggsae]
  Gene Ontology: Mol. function=glutathione transferase activity; Biological process=glutathione conjugation reaction
  Essential gene: C elegans homolog=R05F9.5a; Phenotype=Unclassified
  Coding regions on vcDNA: vcDNA=SeqID_50721; Strand=+; Position=1-381
KDECEKAKANEIIDFQKDANTDLAPYLYVKMGFRQGDLDKLRAEVFEPGVKHILPLFEKLLKESGSGYMLKSGLSMVDFQVANFLYTFTKLEPETINAFPELIKYVDRVHALPQLQQYLKQRPQDR

SEQ ID NO: 124299 - protein, 134 aa, Heterodera glycines
  Homolog annotation: Hit_ID=NP_499523.1; Match level="QueryCoverage =96%, HitCoverage=49%, E-value=8e-24, Identity=43%"; Hit description =mitochondrial membrane (3M869) [Caenorhabditis elegans] pir||T19428 hypothetical protein C24H11.6 - Caeno
  Gene Ontology: Mol. function=DNA-directed RNA polymerase II activity; Cellular component=DNA-directed RNA polymerase II, core complex; Biological process=regulation of transcription from Pol II promoter
  Essential gene: C elegans homolog=C24H11.9; Phenotype=Gro
  Coding regions on vcDNA: vcDNA=SeqID_50722; Strand=+; Position=22-426
MCDRLTQTLDLVNDLANHMCNSVGVLQASAGPCEFGTAPEELKNEPNCRLFAQQIARTAKDIEILIDSLPADEQSLSVEEHEKALLELDDERARAAKELEQAVEKAEKLTDQLGELLSRIARLQMESRPMAFST

SEQ ID NO: 124300 - protein, 156 aa, Heterodera glycines
  Homolog annotation: Hit_ID=NP_509130.1; Match level="QueryCoverage =100%, HitCoverage=26%, E-value=4e-48, Identity=55%"; Hit description= tolloid-like precursor family member (XH333) [Caenorhabditis elegans] pir||T16617 hypothetical protein K
  Gene Ontology: Mol. function=metallopeptidase activity; Cellular component=extracellular; Biological process=embryogenesis and morphogenesis
  Essential gene: C elegans homolog=C37H5.9a; Phenotype=Emb
  Coding regions on vcDNA: vcDNA=SeqID_50723; Strand=+; Position=2-469
NHLYYVKINNPQFCGLRYVGRISPANPVYLSFQCGNAVGIAIHETMHALGLQHEQLRVDRDLFININWANINPQNYDTFARSELVKYTSYGVRYDYGSIMHYASNIASKSAGLKTMTAKTNPGANDAQMGQRRGLSATDVEELRRMYCMPGCADAN

SEQ ID NO: 124301 - protein, 106 aa, Heterodera glycines; identical to SEQ ID NO: 123405
  Homolog annotation: Hit_ID=CAE56710.1; Match level="QueryCoverage =68%, HitCoverage=17%, E-value=3e-19, Identity=58%"; Hit description =Hypothetical protein CBG24496 [Caenorhabditis briggsae]
  Gene Ontology: Cellular component=postsynaptic membrane; Biological process=neuromuscular junction development
  Essential gene: C elegans homolog=F30A10.8a; Phenotype=Unclassified
  Coding regions on vcDNA: vcDNA=SeqID_50724; Strand=+; Position=2-322

SEQ ID NO: 124302 - protein, 99 aa, Heterodera glycines
  Homolog annotation: Hit_ID=AAR83295.1; Match level="QueryCoverage =90%, HitCoverage=24%, E-value=1e-11, Identity=47%"; Hit description =actin [Spodoptera exigua]
  Gene Ontology: Biological process=reproduction
  Essential gene: C elegans homolog=T04C12.6; Phenotype=Ste
  Coding regions on vcDNA: vcDNA=SeqID_50725; Strand=+; Position=41-337
MWHGRISRGDDAPPRGCFRSIVGRPGHQGVMVGMGKKNPTWKTRPIQPGILNLNNPIETGSYTMGNKLKKIGPNLLKKKWVPPPRKPGLFKKAPVNPKG

SEQ ID NO: 124303 - protein, 131 aa, Heterodera glycines
  Homolog annotation: Hit_ID=XP_311177.1; Match level="QueryCoverage =98%, HitCoverage=31%, E-value=3e-72, Identity=100%"; Hit description= ENSANGP00000019055 [Anopheles gambiae]
  Gene Ontology: Biological process=reproduction
  Essential gene: C elegans homolog=T04C12.6; Phenotype=Ste
  Coding regions on vcDNA: vcDNA=SeqID_50726; Strand=+; Position=57-523
PIKMCDEEVAALVVDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETF

SEQ ID NO: 124304 - protein, 148 aa, Heterodera glycines
  Homolog annotation: Hit_ID=AAH81136.1; Match level="QueryCoverage =100%, HitCoverage=30%, E-value=3e-69, Identity=76%"; Hit description= AB21 protein [Xenopus laevis] emb|CAA55211.1| yeast RPD3 homologue [Xenopus laevis] sp|Q91695|HD11_XENLA
  Gene Ontology: Mol. function=apoptosis inhibitor activity; Cellular component=cytoplasm; Biological process=chromatin modification
  Essential gene: C elegans homolog=C53A5.3; Phenotype=Emb,Gon
  Coding regions on vcDNA: vcDNA=SeqID_50727; Strand=+; Position=45-488
MTIHSRKVVAYYYDGDVGNYYYGQGHPMKPHRIRMTHNLLLNYGLYRKMEVFRPKAASLEEMTKYHSDDYMCFLKSIKPDNIADFGRQMQRFNVGEDCPVFDGLFEFCQISSGGSIAAATKINKKHVDVAINWMGGLHHAKKSEASGF

SEQ ID NO: 124305 - protein, 112 aa, Heterodera glycines
  misc_feature (37)..(37): Xaa can be any naturally occurring amino acid
  misc_feature (90)..(90): Xaa can be any naturally occurring amino acid
  Homolog annotation: Hit_ID=AAC34678.1; Match level="QueryCoverage =98%, HitCoverage=28%, E-value=2e-26, Identity=59%"; Hit description =actin [Pichia angusta] sp|O74258|ACT_PICAN Actin
  Gene Ontology: Biological process=reproduction
  Essential gene: C elegans homolog=T04C12.6; Phenotype=Ste
  Coding regions on vcDNA: vcDNA=SeqID_50728; Strand=+; Position=2-336
AALVGGHGSGMCKAGFAGDDAPRAGVSVICGRPRHQXVMVGMGQKDSYVEKKGNPSVVFLTLIYRMENGSVTNWDNLKKILDPPLLKQIXVSPPKEHPGVFSQSAPFTPKGP

SEQ ID NO: 124306 - protein, 99 aa, Heterodera glycines
  misc_feature (68)..(68): Xaa can be any naturally occurring amino acid
  Homolog annotation: Hit_ID=AAR83295.1; Match level="QueryCoverage =93%, HitCoverage=25%, E-value=2e-17, Identity=54%"; Hit description =actin [Spodoptera exigua]
  Gene Ontology: Biological process=reproduction
  Essential gene: C elegans homolog=T04C12.6; Phenotype=Ste
  Coding regions on vcDNA: vcDNA=SeqID_50729; Strand=+; Position=2-297
AALVVDNGSGMCKAGFAGDDAPRAVFRPLWAAPSSGVMVAWDKRLERGRQAQSKLVFYAEYPNEHGIXTNWENWKKMGTNLLQKLGVPPQETPGCSKGP

SEQ ID NO: 124307 - protein, 186 aa, Heterodera glycines
  misc_feature (4)..(5): Xaa can be any naturally occurring amino acid
  misc_feature (9)..(10): Xaa can be any naturally occurring amino acid
  misc_feature (12)..(12): Xaa can be any naturally occurring amino acid
  misc_feature (14)..(14): Xaa can be any naturally occurring amino acid
  misc_feature (16)..(16): Xaa can be any naturally occurring amino acid
  misc_feature (19)..(20): Xaa can be any naturally occurring amino acid
  misc_feature (25)..(25): Xaa can be any naturally occurring amino acid
  misc_feature (31)..(31): Xaa can be any naturally occurring amino acid
  misc_feature (35)..(38): Xaa can be any naturally occurring amino acid
  misc_feature (40)..(43): Xaa can be any naturally occurring amino acid
  misc_feature (45)..(47): Xaa can be any naturally occurring amino acid
  misc_feature (50)..(50): Xaa can be any naturally occurring amino acid
  misc_feature (52)..(52): Xaa can be any naturally occurring amino acid
  misc_feature (56)..(56): Xaa can be any naturally occurring amino acid
  misc_feature (58)..(60): Xaa can be any naturally occurring amino acid
  misc_feature (64)..(64): Xaa can be any naturally occurring amino acid
  misc_feature (68)..(69): Xaa can be any naturally occurring amino acid
  misc_feature (72)..(72): Xaa can be any naturally occurring amino acid
  misc_feature (74)..(74): Xaa can be any naturally occurring amino acid
  misc_feature (76)..(76): Xaa can be any naturally occurring amino acid
  misc_feature (80)..(82): Xaa can be any naturally occurring amino acid
  misc_feature (84)..(84): Xaa can be any naturally occurring amino acid
  misc_feature (86)..(86): Xaa can be any naturally occurring amino acid
  misc_feature (88)..(89): Xaa can be any naturally occurring amino acid
  misc_feature (92)..(95): Xaa can be any naturally occurring amino acid
  misc_feature (102)..(103): Xaa can be any naturally occurring amino acid
  misc_feature (107)..(107): Xaa can be any naturally occurring amino acid
  misc_feature (110)..(110): Xaa can be any naturally occurring amino acid
  misc_feature (112)..(112): Xaa can be any naturally occurring amino acid
  misc_feature (114)..(118): Xaa can be any naturally occurring amino acid
  misc_feature (120)..(121): Xaa can be any naturally occurring amino acid
  misc_feature (124)..(124): Xaa can be any naturally occurring amino acid
  misc_feature (127)..(128): Xaa can be any naturally occurring amino acid
  misc_feature (130)..(132): Xaa can be any naturally occurring amino acid
  misc_feature (134)..(134): Xaa can be any naturally occurring amino acid
  misc_feature (139)..(139): Xaa can be any naturally occurring amino acid
  misc_feature (141)..(141): Xaa can be any naturally occurring amino acid
  misc_feature (146)..(146): Xaa can be any naturally occurring amino acid
  misc_feature (150)..(150): Xaa can be any naturally occurring amino acid
  misc_feature (154)..(154): Xaa can be any naturally occurring amino acid
  misc_feature (165)..(166): Xaa can be any naturally occurring amino acid
  misc_feature (169)..(169): Xaa can be any naturally occurring amino acid
  misc_feature (172)..(174): Xaa can be any naturally occurring amino acid
  misc_feature (185)..(185): Xaa can be any naturally occurring amino acid
  Homolog annotation: Hit_ID=AAK95187.1; Match level="QueryCoverage =100%, HitCoverage=91%, E-value=4e-36, Identity=45%"; Hit description= 40S ribosomal protein S5 [Ictalurus punctatus]
  Gene Ontology: Mol. function=structural constituent of ribosome; Cellular component=cytosolic small ribosomal subunit (sensu Eukarya); Biological process=protein biosynthesis
  Essential gene: C elegans homolog=T05E11.1; Phenotype=Ste
  Coding regions on vcDNA: vcDNA=SeqID_50730; Strand=+; Position=1-558
EIKXXGKWXXNXVXVXEIXXVDYVXVKEKGXKYLXXXXGXXXXKXXXKGXCXVVEXLXXXMMMXGLNXXKKXMXVXIVKXXXEXIXLXXGEXXXXVLVNGVXXSGPXEDXKXIXXXXXVXXKEXDVXXLXXXNXGIWLXCXGFREXGFRXIKKXGEWFGDELMNXXKGXKNXXXIKKKEELEGVXK

SEQ ID NO: 124308 - protein, 123 aa, Heterodera glycines
  Homolog annotation: Hit_ID=CAE59719.1; Match level="QueryCoverage =75%, HitCoverage=17%, E-value=5e-21, Identity=53%"; Hit description =Hypothetical protein CBG03152 [Caenorhabditis briggsae]
  Gene Ontology: Mol. function=signal transducer activity; Cellular component=nucleus; Biological process=embryogenesis and morphogenesis
  Essential gene: C elegans homolog=K08F8.1a; Phenotype=Emb
  Coding regions on vcDNA: vcDNA=SeqID_50731; Strand=+; Position=94-462
TQSLVTDQAAVFFCRISLFLLLITHFPPKACFHKRRGEKCALKVLRDNARSRRELALHLSVFGHPHVVSIEDMFENSFDGFKCLLVGVEFMGGREVLTIFEQNGRLGYSEKCVGRIVSQIGSG

SEQ ID NO: 124309 - protein, 154 aa, Heterodera glycines
  Homolog annotation: Hit_ID=CAE57843.1; Match level="QueryCoverage =90%, HitCoverage=46%, E-value=4e-59, Identity=75%"; Hit description =Hypothetical protein CBG00872 [Caenorhabditis briggsae]
  Gene Ontology: Mol. function=succinate dehydrogenase (ubiquinone) activity; Cellular component=respiratory chain complex II (sensu Eukarya); Biological process=electron transport
  Essential gene: C elegans homolog=F42A8.2; Phenotype=Emb
  Coding regions on vcDNA: vcDNA=SeqID_50732; Strand=+; Position=34-495
MLLSKIPPPFCIALRAASTNPPARGPSVKTFEIYRYNPEKPEQKPFLQKYDVDLNQCGPMVLDALIKIKNEMDPTLTFRRSCREGICGSCAMNIGGENTLACICNIEKKTKYSTKIYPLPHMYVVKDLVPDMTLFYEQYASVQPWLQKNKPTKL

SEQ ID NO: 124310 - protein, 150 aa, Heterodera glycines
  Homolog annotation: Hit_ID=CAF97135.1; Match level="QueryCoverage =57%, HitCoverage=98%, E-value=8e-23, Identity=60%"; Hit description =unnamed protein product [Tetraodon nigroviridis]
  Gene Ontology: Biological process=gametogenesis
  Essential gene: C elegans homolog=F53A3.7; Phenotype=Emb,Sck,Stp
  Coding regions on vcDNA: vcDNA=SeqID_50733; Strand=+; Position=18-467
MRFTIQLLQKSQRCYKLLFANYTKQVASVSPLLIHRQNLISFSAFRNFCSSIETKKEEIGRIKSQLAIIFTCKVCSTRQGPKQFSRSAYENGVVLIRCDHCRNHHIIADNLGWFSDLDGKKNIEEILASKGEAIKKGTAVLEMEVPAEEE

SEQ ID NO: 124311 - protein, 156 aa, Heterodera glycines
  Homolog annotation: Hit_ID=XP_344287.1; Match level="QueryCoverage =96%, HitCoverage=55%, E-value=4e-30, Identity=39%"; Hit description =similar to J domain of DnaJ-like-protein 1 - rat [Rattus norvegicus]
  Gene Ontology: Mol. function=protein binding; Biological process =protein folding
  Essential gene: C elegans homolog=T24H10.3; Phenotype=Unc
  Coding regions on vcDNA: vcDNA=SeqID_50734; Strand=+; Position=81-548
MSFGKECVDLFGTKDLYQILKLDRSKSNLSSAQIKKAYYRQSILWHPDRFASAQHDETTRELAKQKFQVIGRAYVILGDSEKRKAYDETGSLDDENEFYEGKDWSAVWRGVFKKVTPEEIEAYLAKFRGSQEEIDEVKEAYQKHKGNMDKIMQSVV

SEQ ID NO: 124312 - protein, 159 aa, Heterodera glycines
  Homolog annotation: Hit_ID=NP_492417.1; Match level="QueryCoverage =84%, HitCoverage=5%, E-value=1e-61, Identity=81%"; Hit description =fatty acid synthase (1J552) [Caenorhabditis elegans] emb|CAB04244.1| Hypothetical protein F32H2.5 [Caenorh
  Gene Ontology: Cellular component=mitochondrion; Biological process =polar body extrusion after meiotic divisions
  Essential gene: C elegans homolog=F32H2.5; Phenotype=Emb
  Coding regions on vcDNA: vcDNA=SeqID_50735; Strand=+; Position=3-479
SWSSPRWRPHTTSGSPGLHVSGTRVRSCLEIGPLGGVFHLAMVLRDCLFENQNQQNFKDAAEAKYFGTISLDEATRKGCEQLRWFVVFSSITSGRGNAGQTNYGWFFSTMERIIEQRRADGFPGIAIQWGAIGDVGVILENMGDNNTVVGGTLPQRMPS

SEQ ID NO: 124313 - protein, 219 aa, Heterodera glycines
  Homolog annotation: Hit_ID=EAA01159.2; Match level="QueryCoverage =75%, HitCoverage=29%, E-value=2e-44, Identity=53%"; Hit description =ENSANGP00000018451 [Anopheles gambiae str. PEST]
  Gene Ontology: Mol. function=ubiquitin conjugating enzyme activity; Cellular component=endoplasmic reticulum; Biological process=protein ubiquitination
  Essential gene: C elegans homolog=K10B2.1; Phenotype=Emb,Lon,Lva,Pvl
  Coding regions on vcDNA: vcDNA=SeqID_50736; Strand=+; Position=26-682
NYRRKILKTKIQGPDLNRTKLLHTFTCTFRFDVASHLKRTVNKGQSIRIKIDRFSEWTEQDQTDFCKHLLQRMCHHQHGQIDQFLGPMLQRDFIALLPTGLAENVLHLLDAKSLCASEFVSRRWSRVIVNGLLWRKHIERQVRNDALWAGLAIRRGWKKYFFCSKDQATRAISQSWRQPKNGEDALEFQHKFYRELYPKITADIRQIEQNWREGRHRLE

SEQ ID NO: 124314 - protein, 82 aa, Heterodera glycines
  Homolog annotation: Hit_ID=XP_485052.1; Match level="QueryCoverage =100%, HitCoverage=60%, E-value=7e-35, Identity=93%"; Hit description= similar to H3 histone, family 3B [Mus musculus]
  Gene Ontology: Mol. function=DNA binding; Cellular component =nucleosome; Biological process=embryogenesis and morphogenesis
  Essential gene: C elegans homolog=F45E1.6; Phenotype=Emb,Gro
  Coding regions on vcDNA: vcDNA=SeqID_50737; Strand=+; Position=2-247
YQKSTLLRIRKLPFQRLVREIAQDFKTDLRFQSAAIGALHEASEAYLDGLFEDTNLCAIHAKRVTIMPKDIQLARPIRGERA

SEQ ID NO: 124315 - protein, 52 aa, Heterodera glycines
  Homolog annotation: Hit_ID=NP_497890.1; Match level="QueryCoverage =96%, HitCoverage=13%, E-value=1e-11, Identity=54%"; Hit description =swi Snf related matrix associated actin dependent regulator of chromatin subfamily b member 1 (42.8 kD) (
  Gene Ontology: Biological process=embryogenesis and morphogenesis
  Essential gene: C elegans homolog=R07E5.3; Phenotype=Emb
  Coding regions on vcDNA: vcDNA=SeqID_50738; Strand=+; Position=2-160
PRPESFHADDGERYYVGADVGQYLKYHRGTLYKRYPQLWKRMASVEGKQEEP

SEQ ID NO: 124316 - protein, 147 aa, Heterodera glycines
  Homolog annotation: Hit_ID=NP_509206.1; Match level="QueryCoverage =84%, HitCoverage=15%, E-value=3e-13, Identity=35%"; Hit description =protruding VuLva PVL-1, Suppressor of PolyraY SPY-1, Beta -catenin/Armadillo Related, associates to cadher
  Gene Ontology: Mol. function=transcription co-activator activity; Cellular component=cell-cell adherens junction; Biological process =Wnt receptor signaling pathway
  Essential gene: C elegans homolog=C54D1.6; Phenotype=Egl,Pvl,Rup,Unc
  Coding regions on vcDNA: vcDNA=SeqID_50739; Strand=+; Position=2-445
KNEKFLNIVTDIMQKVITKNSEQMTFFIGMNGHQKLIGLIANCRQEALLWRVTKLMDKIVQMDAERMVGAGLLEALQRHLDHPSQRLLRQVLSCVRSVSHVPTADRTVQPLLQKLLQLLGQFRTKRTNENHKFERAFCLLKERVTFA

SEQ ID NO: 124317 - protein, 113 aa, Heterodera glycines
  Homolog annotation: Hit_ID=AAN78300.1; Match level="QueryCoverage =100%, HitCoverage=17%, E-value=2e-58, Identity=98%"; Hit description= heat shock protein 70 A [Heterodera glycines]
  Gene Ontology: Mol. function=protein binding; Cellular component =intracellular; Biological process=reproduction
  Essential gene: C elegans homolog=F26D10.3; Phenotype=Lva,Ste
  Coding regions on vcDNA: vcDNA=SeqID_50740; Strand=+; Position=1-397
YSCVGVFQHGKVEIIANDQGNRTTPSYVAFTDTERLIGDAANNFVAMNPSNTVFDAKRLIGRKFDDPAVQSDMKHWPFKVVQGEGARPKVMVEVKGEDKAFFPEEVSSMVLIK

SEQ ID NO: 124318 - protein, 223 aa, Heterodera glycines
  Homolog annotation: Hit_ID=NP_493644.1; Match level="QueryCoverage =98%, HitCoverage=54%, E-value=4e-99, Identity=81%"; Hit description =proteasome Regulatory Particle, ATPase-like, S10b (rpt-4) [Caenorhabditis elegans] gb|AAB70326.2| Proteas
  Gene Ontology: Mol. function=proteasome endopeptidase activity; Cellular component=proteasome regulatory particle (sensu Eukarya); Biological process=proteolysis and peptidolysis
  Essential gene: C elegans homolog=F23F1.8; Phenotype=Emb
  Coding regions on vcDNA: vcDNA=SeqID_50741; Strand=+; Position=4-672
MRSPSPTDNDKARSLNVYRRKLAEYKEIENRLKELRTKERESHKLFDKSENEIKSLQSVGQIVGEVLKQLTEEKFIVKATNGPRYVVGCRRTIDKEKLKQGTRVALDMTTLTIMRQLPREVDPLVYKMSHEDPGNVSYAEIGGLSEQIRELREVVELPLINPELFKRVGITPPKGCLLYGPPGTGKTLLARAVASQLNWNSLKVVSSAMVDKYIGESSRRIRE

SEQ ID NO: 124319 - protein, 143 aa, Heterodera glycines
  Homolog annotation: Hit_ID=NP_492528.1; Match level="QueryCoverage =99%, HitCoverage=24%, E-value=3e-19, Identity=38%"; Hit description =benzodiazepine receptor (1K94) [Caenorhabditis elegans] emb|CAB02840.1| Hypothetical protein C41G7.3 [Cae
  Gene Ontology: Biological process=chromosome segregation
  Essential gene: C elegans homolog=C41G7.3; Phenotype=Him
  Coding regions on vcDNA: vcDNA=SeqID_50742; Strand=+; Position=1-429
LQLVDPPGCRISARGLCLTMPLHWTSVDTRNALLCAAVPSIGAFVGSTMAIKDQELVQFLKNQNFPSFARCCKYNYLLANTAVTIPFGYASYLVYKIGGGFDYTDTTVALGLYGATVLSGCFLVPMLKKQDTKALTANAVVLA

SEQ ID NO: 124320 - protein, 148 aa, Heterodera glycines; identical to SEQ ID NO: 122097
  Homolog annotation: Hit_ID=NP_500627.1; Match level="QueryCoverage =100%, HitCoverage=81%, E-value=2e-42, Identity=59%"; Hit description= inner mitochondrial membrane (4F508) [Caenorhabditis elegans] gb|AAB92039.1| Hypothetical protein E04A4.
  Gene Ontology: Mol. function=protein transporter activity; Cellular component=integral to plasma membrane; Biological process =mitochondrial translocation
  Essential gene: C elegans homolog=E04A4.5; Phenotype=Emb,Lva
  Coding regions on vcDNA: vcDNA=SeqID_50743; Strand=+; Position=14-460

SEQ ID NO: 124321 - protein, 46 aa, Heterodera glycines
  Homolog annotation: Hit_ID=NP_492360.1; Match level="QueryCoverage =100%, HitCoverage=18%, E-value=5e-15, Identity=82%"; Hit description= proteasome Alpha Subunit (28.2 kD) (pas-4) [Caenorhabditis elegans] emb|CAB02269.1| Hypothetical protein
  Gene Ontology: Mol. function=endopeptidase activity; Cellular component=proteasome core complex (sensu Eukarya); Biological process=ubiquitin-dependent protein catabolism
  Essential gene: C elegans homolog=C36B1.4; Phenotype=Emb,Lva,Unc
  Coding regions on vcDNA: vcDNA=SeqID_50744; Strand=+; Position=18-155
MEHYDRAITIFSPDGRLFQVDYAQEAVKKGSTAVAVKGKNCVVIGV

SEQ ID NO: 124322 - protein, 149 aa, Heterodera glycines
  Homolog annotation: Hit_ID=NP_038900.1; Match level="QueryCoverage =97%, HitCoverage=54%, E-value=3e-37, Identity=53%"; Hit description =phosphomannomutase 1 [Mus musculus] sp|O35621|PMM1_MOUSE Phosphomannomutase 1 (PMM 1) gb|AAB62943.1| phos
  Gene Ontology: Mol. function=phosphomannomutase activity; Cellular component=cytosol; Biological process=GDP-mannose biosynthesis
  Essential gene: C elegans homolog=F52B11.2; Phenotype=Unclassified
  Coding regions on vcDNA: vcDNA=SeqID_50745; Strand=+; Position=35-481
MSAERKKSVLFLFDVDGTLTASRQSITPSMLAFMHSVKSRVPVAVVGGSDLAKIFEQLGGTQQRDQCLALFDFVFAENGLTGFKGTEPMPSESISKQLGEAKCQELTNFCLRYMSNIELPLKRGNFVEHRNGMINVSPIGRSCSQSERD

SEQ ID NO: 124323 - protein, 192 aa, Heterodera glycines
  Homolog annotation: Hit_ID=NP_492569.2; Match level="QueryCoverage =91%, HitCoverage=28%, E-value=2e-42, Identity=49%"; Hit description =mRNA Capping Enzyme Like, ELAV-like, phosphatase/guanylyltransferase (70.8 kD) (cel-1) [Caenorhabditis el
  Gene Ontology: Mol. function=protein tyrosine phosphatase activity; Cellular component=nucleus; Biological process=RNA processing
  Essential gene: C elegans homolog=C03D6.3a; Phenotype=Unclassified
  Coding regions on vcDNA: vcDNA=SeqID_50746; Strand=+; Position=1-576
VAQRFLPMKTPLDSSYDHLIESPKYFFHPSSVFRSPLLGATKGAKIGLWVDLTNSDNFYNEEEVLNNGSKFLKMKMVGHKQTPTPEQTTAFIEAIDRFITNNPDDVIVVHCTHGFNRTGFLISAYLYEKCDMSIEMAVREFAECRPNGIYKQYYLDDLRKRYGDEDEDEMTFPGRPLWENGPISDDEFTNNG

SEQ ID NO: 124324 - protein, 146 aa, Heterodera glycines; identical to SEQ ID NO: 122643
  Homolog annotation: Hit_ID=XP_319798.1; Match level="QueryCoverage =98%, HitCoverage=30%, E-value=4e-19, Identity=34%"; Hit description =ENSANGP00000005197 [Anopheles gambiae]
  Essential gene: C elegans homolog=B0280.9; Phenotype=Lva
  Coding regions on vcDNA: vcDNA=SeqID_50747; Strand=+; Position=2-442

SEQ ID NO: 124325 - protein, 155 aa, Heterodera glycines
  Homolog annotation: Hit_ID=CAE67662.1; Match level="QueryCoverage =84%, HitCoverage=12%, E-value=4e-41, Identity=61%"; Hit description =Hypothetical protein CBG13225 [Caenorhabditis briggsae]
  Gene Ontology: Mol. function=DNA dependent ATPase activity; Cellular component=chromatin; Biological process=transcription termination
  Essential gene: C elegans homolog=F54E12.2; Phenotype=Emb
  Coding regions on vcDNA: vcDNA=SeqID_50748; Strand=+; Position=1-468
QKAISFTSITGEVRTEERQSRVDAFNRTNTGPKVMLLSLTAGGVGLNLIGGNHLFMIDLHWNPALELQASDRIHRLGQKKNVFIHKFVCASTIEQRVLQLQEKKNAMATSVLEGAAKKLGNLSKDDVMYLFELEKRPNNQQKAGQSQKPTTSSQM

SEQ ID NO: 124326 - protein, 201 aa, Heterodera glycines
  misc_feature (183)..(183): Xaa can be any naturally occurring amino acid
  Homolog annotation: Hit_ID=NP_498517.1; Match level="QueryCoverage =90%, HitCoverage=41%, E-value=1e-53, Identity=60%"; Hit description =proteasome Regulatory Particle, Non-ATPase-like (49.1 kD) (rpn-6) [Caenorhabditis elegans] gb|AAA21173.2|
  Gene Ontology: Mol. function=proteasome endopeptidase activity; Cellular component=proteasome regulatory particle (sensu Eukarya); Biological process=embryogenesis and morphogenesis
  Essential gene: C elegans homolog=F57B9.10; Phenotype=Emb
  Coding regions on vcDNA: vcDNA=SeqID_50749; Strand=+; Position=72-675
MTASLQQIRAQPGWTADKCKEQIEVAKSENRTFQRQTLQAHLVHLLNKEHKFNEAIQLAAQLVRELKKVDDKDLLVDVQLEESIGFYHLSNYTKARAELVSARTIANTKYTPPAMQARLDLQSGILHAADDRDFKTAYSYFFEAFQAFDSVNESALAQQALKYMLLSKVMLDQSDEVHSIMTXKTAQKYAKTETEAMHAIA

SEQ ID NO: 124327 - protein, 187 aa, Heterodera glycines
  Homolog annotation: Hit_ID=NP_499089.1; Match level="QueryCoverage =96%, HitCoverage=35%, E-value=3e-46, Identity=49%"; Hit description =aspartyl(D) tRNA Synthetase (59.9 kD) (drs-1) [Caenorhabditis elegans] emb|CAA79536.1| Hypothetical prote
  Gene Ontology: Mol. function=ATP binding; Cellular component =cytoplasm; Biological process=aspartyl-tRNA aminoacylation
  Essential gene: C elegans homolog=B0464.1; Phenotype=Emb,Ste
  Coding regions on vcDNA: vcDNA=SeqID_50750; Strand=+; Position=2-562
STLHKETETDISVGNYGSYGLVQSSEKREDVVFVEIEKINADFDGKEIWLRGRLHDSRGKGKNCFAKIRQRIHSVQAVLFVGADISKQFVKFVQNIPKESIVDVYGLVARTPQPVTACTQSDVEIKVHKFFIVSQAEPRLPLQLEDAVRPDNDQEELAVVKLDTRLDNRVLDLRTPTSQAIFRFAGG

SEQ ID NO: 124328 - protein, 135 aa, Heterodera glycines
  Homolog annotation: Hit_ID=NP_498349.1; Match level="QueryCoverage =100%, HitCoverage=54%, E-value=1e-50, Identity=75%"; Hit description= ribosomal Protein, Small subunit (27.3 kD) (rps-3) [Caenorhabditis elegans] gb|AAF99870.1| Ribosomal pro
  Gene Ontology: Mol. function=structural constituent of ribosome; Cellular component=cytosolic small ribosomal subunit (sensu Eukarya); Biological process=protein biosynthesis
  Essential gene: C elegans homolog=C23G10.3; Phenotype=Emb
  Coding regions on vcDNA: vcDNA=SeqID_50751; Strand=+; Position=51-458
MAQQQAITKKRKAVQDGIFKAELNNFLMKELAEDGYSGVEVRRAPSRTEVIIMATRTQSVLGERGNFIRELTALVQKRFGYSAGQIELYAEKVSSRGLCAVDQCESLRYKLVGGLAVRRACDGVRASIVDRNARG

SEQ ID NO: 124329 - protein, 79 aa, Heterodera glycines; identical to SEQ ID NO: 123316
  Homolog annotation: Hit_ID=EAK96442.1; Match level="QueryCoverage =93%, HitCoverage=40%, E-value=2e-18, Identity=64%"; Hit description =ubiquitin-ribosomal protein fusion S27a [Candida albicans SC5314] gb|EAK96371.1| ubiquitin-ribosomal prote
  Essential gene: C elegans homolog=F25B5.4a; Phenotype=Emb
  Coding regions on vcDNA: vcDNA=SeqID_50752; Strand=+; Position=129-368

SEQ ID NO: 124330 - protein, 147 aa, Heterodera glycines
  Homolog annotation: Hit_ID=AAL05950.1; Match level="QueryCoverage =77%, HitCoverage=83%, E-value=3e-32, Identity=56%"; Hit description =frataxin [Caenorhabditis elegans] ref|NP_495183.1| FRataxin Homolog (15.7 kD) (frh-1) [Caenorhabditis eleg
  Gene Ontology: Mol. function=iron-sulfur electron transfer carrier; Cellular component=extracellular space; Biological process=synaptic transmission
  Essential gene: C elegans homolog=F59G1.7; Phenotype=Emb,Gro
  Coding regions on vcDNA: vcDNA=SeqID_50753; Strand=+; Position=3-446
FVNSLSSNTKTIHFLKKYLLLAHNYCTFSREWSEMEYERRAEDTLVALTEYLDTLPDRVDCESAFDVSYSMGVLTAHISPRIGTYVINKQTPNKQIWLSSPVSGPKRYDLSDKGRWVYKHDGVTLHELLEKEFRHIFKNDQISLHQS

SEQ ID NO: 124331 - protein, 93 aa, Heterodera glycines
  Homolog annotation: Hit_ID=NP_733306.1; Match level="QueryCoverage =75%, HitCoverage=12%, E-value=5e-09, Identity=44%"; Hit description =CG15509-PB, isoform B [Drosophila melanogaster] gb|AAN14187.1| CG15509-PB, isoform B [Drosophila melanoga
  Gene Ontology: Mol. function=RNA polymerase II transcription factor activity; Cellular component=cytoplasm; Biological process=JNK cascade
  Essential gene: C elegans homolog=F29G9.4; Phenotype=Pvl,Stp
  Coding regions on vcDNA: vcDNA=SeqID_50754; Strand=+; Position=250-528
MPRGTTKTAAQRRGGRRPREAEDHQLTDEDKDRRAKRRERNKQAAARCRRRREEKMQSLQEVSANNERKAKGRKSATFCHWFFEQVDELRKQN

SEQ ID NO: 124332 - protein, 132 aa, Heterodera glycines
  Homolog annotation: Hit_ID=NP_503427.2; Match level="QueryCoverage =100%, HitCoverage=86%, E-value=2e-53, Identity=75%"; Hit description= UNCoordinated locomotion UNC-60 (unc-60) [Caenorhabditis elegans] gb|AAL02463.1| Uncoordinated protein 6
  Gene Ontology: Mol. function=actin binding; Cellular component=actin filament; Biological process=cell organization and biogenesis
  Essential gene: C elegans homolog=C38C3.5c; Phenotype=Unc
  Coding regions on vcDNA: vcDNA=SeqID_50755; Strand=+; Position=86-481
MASGVKVDGECKQAYDELHNKHQFSFLIFRISDDDTTIIVEKKGEKNAPYSDFVEEMKKVVGDGKQCRYAAVDVHVEIQRQGTEGSSNLSKVVFVQYCPDEAPVRRRMLYASSVRALKATLGLESLLQIQAA

SEQ ID NO: 124333 - protein, 139 aa, Heterodera glycines
  Homolog annotation: Hit_ID=CAE60267.1; Match level="QueryCoverage =88%, HitCoverage=25%, E-value=2e-43, Identity=65%"; Hit description =Hypothetical protein CBG03844 [Caenorhabditis briggsae]
  Gene Ontology: Mol. function=ligand-dependent nuclear receptor activity; Cellular component=nucleus; Biological process =transcription from Pol II promoter
  Essential gene: C elegans homolog=K10C3.6a; Phenotype=Unclassified
  Coding regions on vcDNA: vcDNA=SeqID_50756; Strand=+; Position=70-486
MDIVDDPLSEPCHVCGDKSTGTHYGTVSCNGCKGFFRRTILRSQKFTCRFNKQCVIDKNYRCACRFCRFQKCLSAGMKKEAIQFERDAIGSPLPLKRRRVADDGRADHSPSPTGGRTATDGIGTAVGRPVMAQGDGKGQ

SEQ ID NO: 124334 - protein, 131 aa, Heterodera glycines
  Homolog annotation: Hit_ID=XP_418374.1; Match level="QueryCoverage =96%, HitCoverage=20%, E-value=3e-40, Identity=59%"; Hit description =PREDICTED: similar to DKFZP564O0463 protein; HSPC064 protein [Gallus gallus]
  Gene Ontology: Mol. function=snoRNA binding; Cellular component=small nuclear ribonucleoprotein complex; Biological process=35S primary transcript processing
  Essential gene: C elegans homolog=ZK430.7; Phenotype=Lva
  Coding regions on vcDNA: vcDNA=SeqID_50757; Strand=+; Position=231-623
FVREVYHTPRMQYVLSVLWSSDNKFVLSGSDDMNIRLWKANAAEKLGPLCPREKAAIEYSQKLRDTFQGHPEVRRIVKHRHVPKAIYSATREHRIIRESQRRKDKNRRKNTKSAATEPFTSERAKAIVSEG

SEQ ID NO: 124335 - protein, 164 aa, Heterodera glycines
  Homolog annotation: Hit_ID=AAR09171.1; Match level="QueryCoverage =100%, HitCoverage=44%, E-value=4e-78, Identity=90%"; Hit description= aldolase [Heterodera glycines]
  Gene Ontology: Mol. function=fructose-bisphosphate aldolase activity; Biological process=fructose metabolism
  Essential gene: C elegans homolog=F01F1.12a; Phenotype=Gro,Unc
  Coding regions on vcDNA: vcDNA=SeqID_50758; Strand=+; Position=44-535
MAEVGNSYRPPLSEEKQNELRAIAQKILQPGKGILAADESTGSIGKRFDTIGLENTENNRRRYRQLLFTTPSFGQNLSGVILFDETFRQSTDNGVRFVDVIKKAGAVAGIKVDTGVVPLAGTLDEGTTHGLDKLSDRCAEYEKGGWGSAPRRCGVGAARPEPRH

SEQ ID NO: 124336 - protein, 89 aa, Heterodera glycines
  Homolog annotation: Hit_ID=NP_500188.1; Match level="QueryCoverage =100%, HitCoverage=55%, E-value=1e-35, Identity=85%"; Hit description= vacuolar proton ATPase VHA-3, Vacuolar proton ATPase (16.4 kD) (vha -3) [Caenorhabditis elegans] ref|NP_4
  Gene Ontology: Mol. function=hydrogen ion transporter activity; Cellular component=hydrogen-transporting ATPase V0 domain; Biological process=proton transport
  Essential gene: C elegans homolog=Y38F2AL.4; Phenotype=Emb,Gro,Unc
  Coding regions on vcDNA: vcDNA=SeqID_50759; Strand=+; Position=60-326
MTYDLETAERAAYAPFFGYIGAASAQIFTVFGAAYGTAKSAVGICSMGVMRPELIMKSVIPVIMAGIIGIYGLVAARALPGRATCRVGG

SEQ ID NO: 124337 - protein, 140 aa, Heterodera glycines
  Homolog annotation: Hit_ID=CAE57200.1; Match level="QueryCoverage =93%, HitCoverage=32%, E-value=5e-39, Identity=58%"; Hit description =Hypothetical protein CBG00050 [Caenorhabditis briggsae]
  Gene Ontology: Mol. function=branched-chain amino acid aminotransferase activity; Cellular component=mitochondrial matrix; Biological process=branched chain family amino acid biosynthesis
  Essential gene: C elegans homolog=K02A4.1; Phenotype=Emb,Lvl
  Coding regions on vcDNA: vcDNA=SeqID_50760; Strand=+; Position=54-473
MSSMSAAGGAIAASVEQQPAVEPDRSTFYHKDLSIVRATAGQMQPKPLGTVDQIKFGHHFSDHMMEVDWSDTAGWNQPEISPLHSVQLHPGAKVLHYAIELFEGMKAYRGIDDRIRLFRPEMNIARMKRTAARAALPDFD

SEQ ID NO: 124338 - protein, 136 aa, Heterodera glycines
  Homolog annotation: Hit_ID=CAE57680.1; Match level="QueryCoverage =100%, HitCoverage=25%, E-value=2e-44, Identity=69%"; Hit description= Hypothetical protein CBG00674 [Caenorhabditis briggsae]
  Gene Ontology: Mol. function=chaperone activity; Cellular component =cytoskeleton; Biological process=cell organization and biogenesis
  Essential gene: C elegans homolog=K01C8.10; Phenotype=Emb,Lva,Ste
  Coding regions on vcDNA: vcDNA=SeqID_50761; Strand=+; Position=3-410
MSPSLSVANSNVSRPLGQPKVAGFKDKDKPESVRTSNIVAAKAVADAVRTSLGPRGMDKMIQSGNGEVTITNDGATILNQMSVVHPTAKMLVELSKAQDIEGGDGTTTVEGVGGASINPADKLLGEGGRPNTNSDA

SEQ ID NO: 124339 - protein, 145 aa, Heterodera glycines
  Homolog annotation: Hit_ID=AAC79129.1; Match level="QueryCoverage =100%, HitCoverage=44%, E-value=1e-70, Identity=88%"; Hit description= glyceraldehyde-3-phosphate-dehydrogenase [Globodera rostochiensis] sp|O16027|G3P1_GLORO Glyceraldehyde-3-
  Gene Ontology: Mol. function=glyceraldehyde 3-phosphate dehydrogenase (phosphorylating) activity; Cellular component=cytoplasm; Biological process=glycolysis
  Essential gene: C elegans homolog=K10B3.7; Phenotype=Unclassified
  Coding regions on vcDNA: vcDNA=SeqID_50762; Strand=+; Position=2-436
DTVQVVAVNDPFIELDYMVYMFNYDSTHGRFKGKISTNAGNLVVEKEGKSAHTIKVFNLKDPAEIKWGEAGAEYVIESTGVFTTIEKASAHLKGGAKKVVISAPSADAPMYLMGVNEDKHDPANDDAISNASGTTNCLAPVAKLL

SEQ ID NO: 124340 - protein, 131 aa, Heterodera glycines
  Homolog annotation: Hit_ID=CAE64681.1; Match level="QueryCoverage =73%, HitCoverage=78%, E-value=1e-30, Identity=70%"; Hit description =Hypothetical protein CBG09459 [Caenorhabditis briggsae]
  Essential gene: C elegans homolog=K02B2.5; Phenotype=Gro
  Coding regions on vcDNA: vcDNA=SeqID_50763; Strand=+; Position=3-398
MPPKTSKKTDPKGGKAAPAKKKEGGGGGKAKKKKWSKGKVRDKLANMVLFDQATYDNLYQEIISRQLITPHVCLERVKVPPFLGKGGLKNLPQRGVSIWWEKPGSHLLYPGAPQREDLKKGEKGRFCFLFF

SEQ ID NO: 124341 - protein, 144 aa, Heterodera glycines
  Homolog annotation: Hit_ID=AAS55946.1; Match level="QueryCoverage =100%, HitCoverage=88%, E-value=1e-50, Identity=65%"; Hit description= ribosomal protein L21 [Ornithodoros moubata]
  Gene Ontology: Mol. function=structural constituent of ribosome; Cellular component=cytosolic large ribosomal subunit (sensu Eukarya); Biological process=protein biosynthesis
  Essential gene: C elegans homolog=C14B9.7; Phenotype=Emb
  Coding regions on vcDNA: vcDNA=SeqID_50764; Strand=+; Position=24-455
MVNPKGYRRGTRYMFARPVRKHGVEPLSTFYRVYKRGDIVTVKGNGAFQKGMPFKAYHGKTGRVFNVTKHALGVVVNKRVRHRIIPKRINVRVEHVKPSGSRLEFLQRCKANDLQKKQHKEGNAPFVALKRKPKEPRVAHLVKV

SEQ ID NO: 124342 - protein, 176 aa, Heterodera glycines
  misc_feature (126)..(126): Xaa can be any naturally occurring amino acid
  Homolog annotation: Hit_ID=NP_499964.1; Match level="QueryCoverage =100%, HitCoverage=86%, E-value=5e-69, Identity=68%"; Hit description= ribosomal Protein, Large subunit (24.1 kD) (rpl-15) [Caenorhabditis elegans] gb|AAC24397.1| Ribosomal pr
  Gene Ontology: Mol. function=structural constituent of ribosome; Cellular component=cytosolic large ribosomal subunit (sensu Eukarya); Biological process=protein biosynthesis
  Essential gene: C elegans homolog=K11H12.2; Phenotype=Gro,Stp
  Coding regions on vcDNA: vcDNA=SeqID_50765; Strand=+; Position=2-529
GAYKYMQELWRKKQSEVMRYLLRIRCWQYHQMEAIHRCTRPTRPEKARRLGYKAKQGFLIYRVRIRRGGQKRQVTKGQAYGKPKTRGVNQLKNTRSLQAVAEARAGRRLGELRVFNTNWEGQDSTXRILEVIIRDPSDKTIRRNPDTPWITKPCEENFEEGGLSSAGRRGRGLGKG

SEQ ID NO: 124343 - protein, 161 aa, Heterodera glycines
  Homolog annotation: Hit_ID=NP_497550.1; Match level="QueryCoverage =73%, HitCoverage=60%, E-value=7e-13, Identity=38%"; Hit description =mitochondrial ribosomal protein L30 like (23.3 kD) (3D496) [Caenorhabditis elegans] gb|AAC68918.1| Hypoth
  Essential gene: C elegans homolog=W04B5.4; Phenotype=Lva
  Coding regions on vcDNA: vcDNA=SeqID_50766; Strand=+; Position=27-509
SFCTTYHTEVSAFSSQRPPIRPYFGVACDITPDCLRCRAQNIRDHLTKLFGKNAKPGEMQVFKNTLSTNKQLWKIIYLLEIRPVTFPNGEPGQEDATHLEIMADGRCVISRQSLPNVDDFQLIDYSKQVSPRYLASPLMAKDVTKQDVDEDTGYHPENITL

SEQ ID NO: 124344 - protein, 134 aa, Heterodera glycines
  Homolog annotation: Hit_ID=NP_492528.1; Match level="QueryCoverage =97%, HitCoverage=23%, E-value=1e-14, Identity=35%"; Hit description =benzodiazepine receptor (1K94) [Caenorhabditis elegans] emb|CAB02840.1| Hypothetical protein C41G7.3 [Cae
  Gene Ontology: Biological process=chromosome segregation
  Essential gene: C elegans homolog=C41G7.3; Phenotype=Him
  Coding regions on vcDNA: vcDNA=SeqID_50767; Strand=+; Position=48-449
MPLHWTSVDTRNALLCAAVPSIGAFVGSTMAIKDQKLLKFLKNQNFPSFARCCKYNYLLANTSVTILFGYASYLVYKIGGGVSCTDSKIALGLYGATLLSGCFLVPTLKKHDTKALTANAVVLAGLSVATSVAF

SEQ ID NO: 124345 - protein, 155 aa, Heterodera glycines
  misc_feature (64)..(64): Xaa can be any naturally occurring amino acid
  Homolog annotation: Hit_ID=NP_491672.1; Match level="QueryCoverage =100%, HitCoverage=36%, E-value=2e-51, Identity=66%"; Hit description= proteasome Regulatory Particle, ATPase-like, S6a (48.1 kD) (rpt-5) [Caenorhabditis elegans] gb|AAC19196.
  Gene Ontology: Mol. function=transcription co-repressor activity; Cellular component=26S proteasome; Biological process=embryonic cleavage
  Essential gene: C elegans homolog=F56H1.4; Phenotype=Emb
  Coding regions on vcDNA: vcDNA=SeqID_50768; Strand=+; Position=2-466
RILLRAIRLIEDLMTPRQDMTTRPDARIYICNALPYLVSTAIELLDLAEQQDEEGANVDLDAHXTKCAVIRTSTRATYFLPVVGLVDPEEMKPSDLVGVNKDSYLILEKLPPEYDSRVKAMEVDERPKETYSYIGGCDSQIIQLVEAIVLPMDKK

SEQ ID NO: 124346 - protein, 74 aa, Heterodera glycines
  Homolog annotation: Hit_ID=AAO06295.1; Match level="QueryCoverage =90%, HitCoverage=20%, E-value=5e-24, Identity=76%"; Hit description =elongation factor 1-alpha [Escovopsis weberi]
  Gene Ontology: Biological process=protein biosynthesis
  Essential gene: C elegans homolog=R03G5.1a; Phenotype=Emb,Lva,Unc
  Coding regions on vcDNA: vcDNA=SeqID_50769; Strand=+; Position=2-223
LPPQRPTDKPLRLPLQDVYKIGGIGTVPVGRVETGVLKAGMVVTCAPQGISTDVGSVAMRHQGVPQGLGRQSGG

SEQ ID NO: 124347 - protein, 74 aa, Heterodera glycines
  Homolog annotation: Hit_ID=NP_477300.1; Match level="QueryCoverage =97%, HitCoverage=13%, E-value=2e-09, Identity=47%"; Hit description =CG10484-PA [Drosophila melanogaster] gb|AAF53749.1| CG10484-PA [Drosophila melanogaster] pir||JH0665 cate
  Gene Ontology: Mol. function=proteasome endopeptidase activity; Cellular component=proteasome regulatory particle (sensu Eukarya); Biological process=proteolysis and peptidolysis
  Essential gene: C elegans homolog=C30C11.2; Phenotype=Emb
  Coding regions on vcDNA: vcDNA=SeqID_50770; Strand=+; Position=2-223
ESASNSDWARWFYYLGRIEALKGTDAETYKAAEKHFEVALRKAPQNGAGGFLHDLNKWVVLRRGVFFQIPERGI

SEQ ID NO: 124348 - protein, 86 aa, Heterodera glycines; identical to SEQ ID NO: 123261
  Homolog annotation: Hit_ID=NP_510144.1; Match level="QueryCoverage =98%, HitCoverage=20%, E-value=2e-20, Identity=52%"; Hit description =branched-chain amino acid aminotransferase, cytosolic, ECA39 (47.3 kD) (eca-39) [Caenorhabditis elegans]
  Essential gene: C elegans homolog=K02A4.1; Phenotype=Emb,Lvl
  Coding regions on vcDNA: vcDNA=SeqID_50771; Strand=+; Position=1-261

SEQ ID NO: 124349 - protein, 118 aa, Heterodera glycines; identical to SEQ ID NO: 122573
  Homolog annotation: Hit_ID=NP_499164.1; Match level="QueryCoverage =71%, HitCoverage=28%, E-value=1e-19, Identity=50%"; Hit description =xylosylprotein beta 1 4-galactosyltransferase 7, SQuashed Vulva SQV -3 (33.8 kD) (sqv-3) [Caenorhabditis e
  Gene Ontology: Mol. function=xylosylprotein 4-beta -galactosyltransferase activity; Cellular component=Golgi apparatus
  Essential gene: C elegans homolog=R10E11.4; Phenotype=Emb
  Coding regions on vcDNA: vcDNA=SeqID_50772; Strand=-; Position=80-436

SEQ ID NO: 124350 - protein, 191 aa, Heterodera glycines
  Homolog annotation: Hit_ID=NP_501727.1; Match level="QueryCoverage =97%, HitCoverage=58%, E-value=2e-52, Identity=61%"; Hit description =adenine nucleotide family member (4K472) [Caenorhabditis elegans] emb|CAA92472.1| Hypothetical protein K0
  Gene Ontology: Mol. function=adenine transporter activity; Cellular component=integral to plasma membrane; Biological process =embryogenesis and morphogenesis
  Essential gene: C elegans homolog=T27E9.1a; Phenotype=Emb
  Coding regions on vcDNA: vcDNA=SeqID_50773; Strand=+; Position=2-574
SNKSGGFYTKKFLLDLPSGGTAAAVSKTAVAPIERVKLLLQVQDASIHITADKRYKGIIHVLVRVPKEQGFLSLWRGNLANVIRYFPTHALNFALKDTYNRVFTLGVHKEKQFVKFFTMNLASGGAASALRCVLGTSMDFAQTPLGNGCCKGPMPAQSKGWAGLPHEQLSDGTGPIGFYGGLIPLPPGIDI

SEQ ID NO: 124351 - protein, 162 aa, Heterodera glycines
  Homolog annotation: Hit_ID=XP_421457.1; Match level="QueryCoverage =100%, HitCoverage=25%, E-value=2e-23, Identity=33%"; Hit description= PREDICTED: similar to DNA polymerase epsilon subunit B [Gallus gallus]
  Gene Ontology: Mol. function=epsilon DNA polymerase activity; Cellular component=replication fork; Biological process=DNA replication
  Essential gene: C elegans homolog=F08B4.5; Phenotype=Emb,Pvl,Rup,Unc
  Coding regions on vcDNA: vcDNA=SeqID_50774; Strand=+; Position=2-487
VHLDNERVLKALYHLLQGFSASPPNIFVFCGPFLGIQRAHSYMEQAANAFRHFANILSEFSHAYHATEFIFVPSADDAPPLQIFPRPTLLQLIQKCFKEAKNMHFATNPCKLVFKDRHIVIFRDDVVEKVCRSAVFMPKNAMASRIPKLFCDTIWAQRHFSP

SEQ ID NO: 124352 - protein, 86 aa, Heterodera glycines
  Homolog annotation: Hit_ID=CAE56819.1; Match level="QueryCoverage =96%, HitCoverage=24%, E-value=3e-13, Identity=46%"; Hit description =Hypothetical protein CBG24633 [Caenorhabditis briggsae]
  Gene Ontology: Cellular component=mitochondrion
  Essential gene: C elegans homolog=VZK822L.1; Phenotype =Gro,Ste,Unc,Unclassified
  Coding regions on vcDNA: vcDNA=SeqID_50775; Strand=+; Position=2-259
QIVPEVIRQQFLAADLEESVRLREEAKKGPFQNSNCWRNVLLFVLLHFGALVGLCHLFLLANWATIGWCIFPMVPPGGVWGIMGGG

SEQ ID NO: 124353 - protein, 59 aa, Heterodera glycines
  Coding regions on vcDNA: vcDNA=SeqID_50776; Strand=-; Position=1 -137,628-670
MYHIYRQLLLHEHPATHLRLSCYCTNNRDCAHLTLLPLVLLMTKGRSFFNHSVNTFLIC

SEQ ID NO: 124354 - protein, 69 aa, Heterodera glycines
  Coding regions on vcDNA: vcDNA=SeqID_50777; Strand=-; Position=1 -100,948-1057
MHSVPMLWQNLYLFVGTTAVSYRLEFGVMPSLERAPIILRKLDVIVAPAFCHKPCFRCHGMRLFRKTVW

SEQ ID NO: 124355 - protein, 497 aa, Heterodera glycines
  Coding regions on vcDNA: vcDNA=SeqID_50778; Strand=-; Position=1 -139,185-193,753-944,990-1067,1311-1464,1912-2082,3140-3280,3674 -4094,4643-4831
MDNEKQHQFLLLCFLEKHENDEDKFSAFEKLKEKFGSATTHRKQYFHRGSVLVDYSSEESFCHDDYPAFDPYGKGILDGNVSDESICFDDYAAFDEPIYSSREHDNDLGIVRAPEFSQPLFEKMPSLLEKFTNVMDLSESSTNKQPRDQRTQQFVAKKICVFCAQQLKVNDERGVLDCGHYFHAQKPYYDWVADGGFKRCPKSTCRKAAYKKCVKCRTGLGNGTTLHVRCDCKESAATLLCTSDQHRIQSCCVSAPLSPKLIEAERKYCERNGQHFKPVFANLLTDVIGNDPLFSSLSLVFYNACSEKHCANLRTVYAETIHILCSDPASAGVNLELCESKEKFLEKIEFGLCVKAPETLFDHATKMVQSNYSNKFCALILAIAFKRPIIWIEPSAKPGSIVRMSREDAKRLLPQWDDQSRPKTVSYYLPNGKIMESTLHHPKNKKPQRAIEELFWTFQMNIQKTTYTVQNPILIWHNGYGLACPIVLSRRTPPKII

SEQ ID NO: 124356 - protein, 48 aa, Heterodera glycines
  Coding regions on vcDNA: vcDNA=SeqID_50779; Strand=+; Position=1 -39,108-215
MNTFPTSFEDPSKVFNKLFIGLSKHFFIKKHFKVFRLQNLFKKEIMHN

SEQ ID NO: 124357 - protein, 29 aa, Heterodera glycines
  Coding regions on vcDNA: vcDNA=SeqID_50780; Strand=+; Position=1 -11,991-1067
MDKKAENALSSTNIICLLDEEFGLCKTGG

SEQ ID NO: 124358 - protein, 65 aa, Heterodera glycines
  Coding regions on vcDNA: vcDNA=SeqID_50781; Strand=+; Position=1 -123,581-655
MSALFRGQNGLTFTNAKANEVQRSAGENSNSFSYIYFFLFLKKARAIFLKFIPGCVLSFSAITGP

SEQ ID NO: 124359 - protein, 63 aa, Heterodera glycines
  Coding regions on vcDNA: vcDNA=SeqID_50782; Strand=+; Position=1 -3,777-965
MVVNPHFPVVNAYLPVVFYKLNLCAGNAHFPVGNGHFPVVLYKCNLSAGNAHFPVGNAHFPVV

SEQ ID NO: 124360 - protein, 108 aa, Heterodera glycines
  Coding regions on vcDNA: vcDNA=SeqID_50783; Strand=-; Position=1-327
MEDELSLEVPAAVADADLSLEVPEEWSDDDLVFAPDALADADLSLEVPEEWSDDDLVFAPDPLADADLSLEVPEEWSDDDLVFAVPDALADADCFEAEVVFFEVLTEP

SEQ ID NO: 124361 - protein, 308 aa, Heterodera glycines
  Coding regions on vcDNA: vcDNA=SeqID_50784; Strand=+; Position=1 -11,70-255,415-778,833-1122,1183-1258
MDRRWICGDVWMDILPSFDHAQLGLKMALLSDRFDVLVDKHFDGKSELTIWRRIRIRKDKGPKAKLYIDHSVLTFIRSNKPIWDRMGTKFEFFAKSIRQLGFTSGDAFDNLRRLISPTILTGLDQLNSIDSNELFPDGIADDGPNATAGQALVKWLHTPSKNGQPKRLYRNNYFGPQNLEWVNNFKETFISATTSVSYNIQLYFHVNTIPTEPFELVNKRTNEKLTLKQEIDEFDVNVYNWLLQRCPIGETARVPAIKWGDSLNPSANLNSIRFDLWSFDKSIEPLSPPTEEEKEEEEADKSNGNVVC

SEQ ID NO: 124362 - protein, 96 aa, Heterodera glycines
  Coding regions on vcDNA: vcDNA=SeqID_50785; Strand=+; Position=1 -11,54-333
MNRRWICADVWMDILPSFDHAQLGLKMALLSDRFDVLVDKHFDGKSELTIWRAIEIRKDKGPKAKLSVWTDDKFVDFPMPDHSLPNKIRFKDLQIQ

SEQ ID NO: 124363 - protein, 335 aa, Heterodera glycines
  Coding regions on vcDNA: vcDNA=SeqID_50786; Strand=+; Position=1 -230,3058-3480,3543-3821,3882-3957
MPIESFELVNKRTKEKLTLKQEIEALSNGIIYNWLLKRCPIGETATVPAIKWKDSVNPSANLNNVTFDLWSFDKSIGYIDHSVLTFIRVNKQIWDRSGTNLELSISNEQPIWDVFAHEIWPIFAANIRQLGFTSGDAFDNLRRLISPTILTGLDQLNSIDSNELFPDGIADDGPNATAGQALVKWLHTPSKNGQPKRLYRNNYFGPQNLEWVNNFKEVATTSVSYNIQLYFHVNTIPTEPFELVNKRTNEKLTLKQEIDEFDVNVYNWLLQRCPIGETARVPAIKWGDSLNPSANLNSIRFDLWSFDKSIEPLSPPTEEEKEEEEADKSNGNVVC

SEQ ID NO: 124364 - protein, 339 aa, Heterodera glycines
  Coding regions on vcDNA: vcDNA=SeqID_50787; Strand=+; Position=1 -11,70-360,395-757,823-1101,1162-1237
MDRRWICGDVWMDILPSFDHAQLGLKMALLSDRFDVLVDKHFDGKSELTIWRRIKISETVCGDRWQICGISIAGPFAAKQNPFSFPSDSVNQKLYRNQLICYIDHSVLTFIRSNKPIWDRMGTKFEFFAKSIRHLGFHDADALNNLRSRISPTILTDLDQLISIDSGALLRDGIADDGQMQLLAKLWSNGFTLRAKMANRSDCIAIIILVHRISNGSTTSKSATTSVSYNIQLYFHVNTIPTEPFELVNKRTNEKLTLKQEIDEFDVNVYNWLLQRCPIGETARVPAIKWGDSLNPSANLNSIRFDLWSFDKSIEPLSPPTEEEKEEEEADKSNGNVVC

SEQ ID NO: 124365 - protein, 107 aa, Heterodera glycines
  Coding regions on vcDNA: vcDNA=SeqID_50788; Strand=-; Position=1-324
MEDELSLEVPAAVADADLSLEVPEEWSDDDLVFAPDALADADLSLEVPEEWSDDDLVFAPDALADADLSLEVPEEWSDDDLVFAPDPLADADCFEAEVVFFEVLTEP

SEQ ID NO: 124366 - protein, 260 aa, Heterodera glycines
  Coding regions on vcDNA: vcDNA=SeqID_50789; Strand=-; Position=1 -195,244-332,378-453,505-924
MDFADIAEEDDGSEEFEISSIMLYDHCACMLCGRIRFFYLIDYATPHVVTKWGGSYLKDENVLTHAGFCLGRLLTFVNAFAMDGNRLNAQKARQVVFAKNGRGNEDFSLFGIIDGQRVDVNRLFATPVATPDPTPVPSPVVEVEVETTVVVSMDEEDTNEQQQHQQQQLTHCAPATQHQQPPPMLSAAVQQAISTLQMRMPPLPVFPPFAMPLVLPPLQFAFQPHLQHQQQQQQQQQFAPPALQIVPLDDAPAPLPLCDV

SEQ ID NO: 124367 - protein, 1405 aa, Heterodera glycines
  Coding regions on vcDNA: vcDNA=SeqID_50790; Strand=+; Position=1-4218
  Homolog annotation: Hit_ID=NP_507780.1; Match level="QueryCoverage =93%, HitCoverage=86%, E-value=3e-88, Identity=24%"; Hit description =predicted CDS, DNA polymerase type B, organellar and viral family member (5T899) [Caenorhabditis elegans]
MSLEDHNYCGELGRNEETPTKRRKRNDDDREQKFQKNCIRTLSADKQYNQKFKVQSVKSTFVIENLPANPESMLRALFAHCMSTALDESQQNGITPDQLGATISSDLLNPSIWIPIRRISDNTADSIMNRFLEVAQSKSREGSLWGSPFTVTITTLDVAQLPHRQQVRGSGKRTANSVQHIIKESALLRINNNDDAYCLFYALETSRKYHIKEMSRQTFSKYINRQNGRRLEDVFGLMSSANIRTDLREYDAVVYVPIVVDYWNRKYATANQRFKVFIFGATGSYRPKFQYGPDNYNVEIPLYHHNGHFDGIRSGVGKAVFGRDYYCFSCECPYDNANDHSLQCKAKCINCGRIGVGRPCRADDNNDNYYRECTACGKDFMSQDCFSHHLSSNVCRQFKKCKQCGVVWNVKQNRRKGRSGHVCGEKFCYTCKCYHKPERGCFIQQLKARRPTKYRLIAFDCETTQNTRIEGDRRLHSVNFISCYVVCTKCINENLWRNSLQAPCGICGRQRTVTFSHRAYERTQTDAQFITPCPMAAFAQWLLSEFDPRYPTMLFAHFGGRFDNIMLFRQFFLNGFCPQMIRRGNKLYEMKIARGEKNPEIIVRDSWNLMPVPLGALPGAFGLNVQDKEFFPHLANVEANYGLILQSLPPKADYLYGGMTPDRQRRFDQWYAEHHHQQFDLCEQLAAYCTNDTRILIEALVAFRTEFLTISDPLERHGCLDDDNDDEDEEEEVDDDNAFEVIGGGIDITWEPMTIASASMRHFRLNHLKRDQLAIVPECGYDTTNTQSLVALKFMDWYAKKNGVSIQTAHSPGGEKKIGQYTVDGYIAATDTVIEVNGCHWHAHDHPRHRFQPQTVMANGKTAQRIREDDARRMAFITSQVQQVLVFWECEINAEKRNNDEMKRAFAQYKDSGPIRLKDCYHGGRVGPQRLHYEVPEGWRMKYYDVRSLYPHTNAVTAYPVGHPTRVNIIGEAEQAVDWRRADQVPVRGILKVFVVPPHHVDVPVLPVKFDQRLLFPLCRTCALQHPHGAVNEDYECTHREDDERGWVSTVTSIELEEALRNGYRCTAYYRSVEWDDTRWSDRVFRGYVAEFMAMKTHASGFPDEIGTTEEDQQQFIEECEDKFGIRIEREKMVHNKAKRTIAKLCNNSLWGRFSLRNGLSKTIVTDSPAELRALLDNPAVEVSSVDQLTDECVLVTYAAGNEWVEEHECSNIVLSLWTTSVARLHLLRLMQTVARAPNSVLIYTDTDSVCFAHREADGCPLETGPHLGDLSDEWPDHELVEFVSGGCKQYALRMRHRQSGEEKTVLKVRGITLSADACQLLHFDTFKRSVLRYAMCHSNEDDEEGDDDDDDICSILIEYPNFLRPNIKDGTVISVKLSKRYRPIVTKGVVGMNAIVHDFGFIKA

SEQ ID NO: 124368 - protein, 141 aa, Heterodera glycines
  Coding regions on vcDNA: vcDNA=SeqID_50791; Strand=+; Position=1 -291,675-809
MQWIKFNCTLCPIGLHCFYPRKYAKPVLCAHPSVRNITDFLSTGQLDEAATTTTTTTALPTTAEVSAAAAECAPPPAHLTAWIAVCTALVALLVIAEAAGQRRADGTDEEPVYDEVPLDTVEQRRDEENGEEDEEDDDSDF

SEQ ID NO: 124369 - protein, 191 aa, Heterodera glycines
  Coding regions on vcDNA: vcDNA=SeqID_50792; Strand=+; Position=1-576
MVTKEGITLWCTRIEKAQFVPFDVVYELPGHCFFRVKNKARVFSVPYSELSSSDRCAQPLPPPPPPPMTTAKHQRTPDDEEEKNLRRKAKVALDLVEAGLAADAMMQDGTRWKKAKTAINVLANLLLAESLTDVSPTFEQQQQQQLSSKEEEKREECTNNSSAAATTESAPDGDVMDDFVNSIQAATSNMQ

SEQ ID NO: 124370 - protein, 131 aa, Heterodera glycines
  Coding regions on vcDNA: vcDNA=SeqID_50793; Strand=+; Position=1-396
MPDHELVEFVSGGCKQYALRMRHRQSGEEKTVLKVRGITLSADACQLLHFDTFKRSVLRYAMCHSNEDDEEGDDDDDDICSILIEYPNFLRPNIKDGTVISVKLSKRYRPIVTKGVVGMNAIVHDFGFIKA

SEQ ID NO: 124371 - protein, 146 aa, Heterodera glycines
  Coding regions on vcDNA: vcDNA=SeqID_50794; Strand=+; Position=1-441
  Homolog annotation: Hit_ID=AAO53180.1; Match level="QueryCoverage =97%, HitCoverage=9%, E-value=8e-11, Identity=30%"; Hit description =hypothetical protein [Dictyostelium discoideum]
MPEESNNNSTNYNNNNISNINNNNENAQLWKLVRKKYILTFNLCYGCSQKLFESTKNNNNNISNNNNYAFETDQFGGVKVQFRMCKGCVWLNMKLSDLNSAPKSGNNHMKTTRNFPNTNNATYSTDNNFGSFFNNTNPQNNANEWI

SEQ ID NO: 124372 - protein, 215 aa, Heterodera glycines
  Coding regions on vcDNA: vcDNA=SeqID_50795; Strand=+; Position=1 -295,449-737,897-960
MPLQQHYEHQPWELDPPMPEQHLEIGPQLPDAWELVPYQPPPQWAQVVHVEQQQQQQQHHQQQQQQQQGAWDEGWEEQLSPNALAQIQDEADGLRQDLTFWLDEGTAGIPDQQQQQHPMQGWETPRTHFERPVPQRTPSPSGDSPAALIRELNFSDQCLLCMGEHGLDCEVTVRGNNCGCVTICDTCCENGWWARSRGTMCALSVSAARRAESTT

SEQ ID NO: 124373 - protein, 88 aa, Heterodera glycines
  Coding regions on vcDNA: vcDNA=SeqID_50796; Strand=-; Position=1 -117,195-344
MSAARRNRQPARAPTPLILPAMLAGVSLRPTGVNLTVDRAAGQRRADGAIEEGEEPVYDEVPLDSDIVVEMRDEENGEEDEEDDDSDF

SEQ ID NO: 124374 - protein, 47 aa, Heterodera glycines
  Coding regions on vcDNA: vcDNA=SeqID_50797; Strand=-; Position=1 -49,587-681
MCPDQPLHPWRVPFSAGWHNCHYTSQVPSQLATPKVGLSSPPQKFGV

SEQ ID NO: 124375 - protein, 620 aa, Heterodera glycines
  Coding regions on vcDNA: vcDNA=SeqID_50798; Strand=+; Position=1 -121,172-289,334-576,620-705,802-901,949-1203,1250-1376,1435 -1583,1645-1753,1976-2062,2177-2372
  Homolog annotation: Hit_ID=NP_497130.1; Match level="QueryCoverage =98%, HitCoverage=81%, E-value=1e-87, Identity=34%"; Hit description =small optic lobes (3A652) [Caenorhabditis elegans] gb|AAC71148.1| Hypothetical protein W05G11.4 [Caenorha
NWERRDLAIVWLRPNQFTRDGQQPPWSVFNNPQPTDIEQGRLLGNCWLLSALAVISLLGNCWLLSALAVISQRPDILEKLFITKEYNHRGVYEVRLCIDGIWRRIIVDDFFPCHRSYEVRLCIDGIWRRIIVDDFFPCHRSTKRQIFAVGRRSQLWVSLIEKALAKYNGNYAILKSGLISEGINKFSGFGGYYMPFFRIFKSDSDFDSDSDFDIVWAKLLSARQLFFLMSCSCGAGERIIEERIIEEAEYRQVGLSPEHAYSLLDVRHSDGHRVILLRNPWGVNFVWRGVILLRNPWGVNFVWRGEFSSEWLGWTHQLRRELAMGEAAGPGTFWMPLQQFAFYFDSVEIAQLRVGWTATRYLMDIGWDQQNSMIRPIIDERTELCATLMIRPIIDERTELCATLFQQNARTTVDQVDIMLLLHKQEDGTTGELICRSPRRITGELICRSPRRITPSVRIEDTFLPPGEYLLCAHSFSKLKTNDSGTIVIHSSREIFTMKLRTTTLDDLRQSMCSLLLKEGVLQNVCFFSEFITHVLHDDAGLAYMVDNHSRDNYLKVHSDCQNSTNVLSTSSSLLAFDSIPPLHRQVLPSLSLSSQYLVLPGTPNYCLWTMISVGYLPNW

SEQ ID NO: 124376 - protein, 127 aa, Heterodera glycines
  Coding regions on vcDNA: vcDNA=SeqID_50799; Strand=+; Position=1 -142,592-729,826-929
  Homolog annotation: Hit_ID=XP_316793.1; Match level="QueryCoverage =63%, HitCoverage=11%, E-value=2e-12, Identity=46%"; Hit description =ENSANGP00000010260 [Anopheles gambiae]
MISVGSLAQLERRDLAIIWLRPNQFTRDGQQPPWSVFNNPQPTDIEQGFSTLTVQPTLFIDLEFLSDSDFDIVWAKLLSARQLFFLMTCSCGAGERIIEEAEYRQVGLSPEHAYSLLDVRQTSDGHR

SEQ ID NO: 124377 - protein, 72 aa, Heterodera glycines
  Coding regions on vcDNA: vcDNA=SeqID_50800; Strand=+; Position=1-263
LYFPFHSLSYCLSPRPLTSPINMSPFPSLRAFSHSFHHFIILFYYYLFPAVLLLIYLFNKLFIYLLDNICFG

SEQ ID NO: 124378 - protein, 610 aa, Heterodera glycines
  Coding regions on vcDNA: vcDNA=SeqID_50801; Strand=-; Position=1-1833
  Homolog annotation: Hit_ID=XP_319741.1; Match level="QueryCoverage =64%, HitCoverage=87%, E-value=6e-46, Identity=30%"; Hit description =ENSANGP00000006515 [Anopheles gambiae]
AVLKASAEQNNSSAALATSIDARLSTFEYDPELGHTFDVWLKRYGQIIAQDGHALSDQSKVQLLIGKLGEAEYKRYCDSIAPKTQNDFNWDETTAKLKKLFGETRSLFLRRFDCFQIRQEAQQDVPSLIAQINSSCENADLSLSKEELKCMILIIALRDEFTDLRQKCLQRLEDSRTSGRSTSLQELGEECRKYQILKESALSLGSNPCSTSAIRAKPQQIRDKQKSKSRPQQSQKGHFQPNNSTAIEKEVDLPDQPCYSCGGKNHWQKDCWFKNSTCEKCGRIGHIAKRCKNGTETRRVRAVATNSGNDMHIHTVLLQPTCKAIEGSSNKWWRIVTEINGMENPMNVDTAAQITVITTDSWQKLGKPKLGKTTIAVKNCNEKAFAIKGKFNCQVSYNGRTAKLIAYVSDEIHQDLLGMPWIEELEIIPKELMFPNSSQITNSVPMKHQKMPAVNFKNFGKFQQKHQNMERQFNDKYGAKPITFQNGEPVFIWNLKGNKANWLPATIIERVGNSPTYRVDVQTLRRAVHRHANQIRRRFPMEMETSQIGQANGNILAGNQPNRTPIKEIEKAKSPIGQNQNAPRRSTRAKRAPQQLNMDPSKRKYDVFRP

SEQ ID NO: 124379 - protein, 91 aa, Heterodera glycines
  Coding regions on vcDNA: vcDNA=SeqID_50802; Strand=+; Position=1 -74,133-233,364-464
  Homolog annotation: Hit_ID=AAN15416.1; Match level="QueryCoverage =93%, HitCoverage=91%, E-value=1e-33, Identity=78%"; Hit description =unknown protein [Arabidopsis thaliana] gb|AAM13088.1| unknown protein [Arabidopsis thaliana] gb|AAG51633.1
MASATGGKVTFKITLTSDPKLPFKVLSVPENAPFTAVLKFAAEEFRVDPSTSAIITDEGVGVNPAQKASDIFMKYGSELRLIPRDRVGQGE

SEQ ID NO: 124380 - protein, 464 aa, Heterodera glycines
  misc_feature (36)..(36): Xaa can be any naturally occurring amino acid
  Coding regions on vcDNA: vcDNA=SeqID_50803; Strand=-; Position=1 -105,421-594,638-894,946-1049,1128-1197,1243-1325,1366-1461,1537 -1702,1754-1831,1879-1899
  Homolog annotation: Hit_ID=AAK26375.1; Match level="QueryCoverage =98%, HitCoverage=87%, E-value=0.0, Identity=80%"; Hit description =class V aminotransferase [Heterodera glycines]
MLSRMLSSAVAVPRMCESNKKLLRKGATFVGLLRGXMSSSAFTATVAPPHRLMRSLHINEKKLFGPGPSIMPALVQEGLVHPLLGHMHPELFEIMDDVKSGIKYIMDDVKSGIKYIFQTENALSFAVSGTGHAGMECAILNLLEPGQTILVVQNGVWGLRAANLAERLGIKVHRLVVPEGEVINDDFAEAVDNYRPQAVDNYRPQVAFVCHGESSTGVVHPLERFGDICNAYDVLFLVDDVLFLVDTVASICGAPFHADALKVDCVYAATQVDCVYAATQKVLNCPPGLAPISFSEKALEKITKRKTEKITKRKTRVPSFYFDALELGNYWGCFDEPRRYHHTAPISLVYYHHTAPISLVYALREGLSAVAQEGIGHMVNRHKINAKLLYDAFDQLGLELFVQKENNRLPCLTTVRVPEGVDWKNNRLPCLTTVRVPEGVDWKAVQDKLMAQGLKFRAQGLKFR

SEQ ID NO: 124381 - protein, 30 aa, Heterodera glycines
  Coding regions on vcDNA: vcDNA=SeqID_50804; Strand=-; Position=1-91
DYFSKHLVDWGIIGDCGINRDWAIIREYTV

SEQ ID NO: 124382 - protein, 58 aa, Heterodera glycines
  Coding regions on vcDNA: vcDNA=SeqID_50805; Strand=-; Position=1-176
MVHKALNSLDQPEQKQFIERCLELDPARRANVTELLDRLGPPEPDPDDTLAQHPQHED

SEQ ID NO: 124383 - protein, 229 aa, Heterodera glycines
  Coding regions on vcDNA: vcDNA=SeqID_50806; Strand=+; Position=1 -123,182-391,444-548,1139-1390
MEFWGKKNQENGIMRPALIVSSFPNDFGMEIANVVYVAPDEILYPVPRSLYTLDPLQHAYMSKSQCNKMTTVQSEDSVVTVQVDSKASKVTCMMKGGTGLFGLDKRGSDWMMDVDVAVSDEQPRQVFVCSPFLPGTLMKTLINLNDSKQGPCVKKFIENIGNQQGKQPGSIVTCVVSESNGSDKQQKQKDSVMACHLTDDSLRPVSEILSAGSFKQIMKVVNGDSGQNA

SEQ ID NO: 124384 - protein, 198 aa, Heterodera glycines
  Coding regions on vcDNA: vcDNA=SeqID_50807; Strand=-; Position=1-597
MKLFPILFLIVIFNIKFDQIGAEKKKLQQKSFDEIFGEKWEEKEEKKLNELKKREIIGKFYKIKEKIKEKGRKYSTKEWNKIEEKIAKKLGTNRKYIYEWIKEFGLQKQIHKNYKSTTDEEKIVIVQKFIKMTNEYKQKRKYSHKEWKQNYAEICKEIGVSRRTIYKWKKQFGIRGKITDEEKMGKMKKQFGEEMFEN

SEQ ID NO: 124385 - protein, 147 aa, Heterodera glycines
  Coding regions on vcDNA: vcDNA=SeqID_50808; Strand=-; Position=1 -142,378-679
MRSVSFCANNHQQQQQQMLPHFDITGPEMLQFVHSSNRCPDERLNGQDERHLAEKCRNKNIRNGTNIGNDEHFGDADAGMSADAVERRGWCRFAASFGLLARLRHAPTNFHREIRHLDLAQSREVHKVTVIYVAKDQPVNGGEIKGL

SEQ ID NO: 124386 - protein, 165 aa, Heterodera glycines
  Coding regions on vcDNA: vcDNA=SeqID_50809; Strand=-; Position=1 -42,698-1047,1398-1503
MNGSIRWPTPNRMTVKHLRIANELKWHLCAVFARHSISLHWSNLADKFVATGDDFFEGFVIRLSGQWPLPGFPVTQWNSLPPSTTATATTAPHDHQQQQQQQANVGDGVGGDQLQQQQMVTFMETEGAVLNLDKDSNSLWSRTHVGRHCYRMQPICMEEETESPV

SEQ ID NO: 124387 - protein, 37 aa, Heterodera glycines
  Coding regions on vcDNA: vcDNA=SeqID_50810; Strand=-; Position=1 -55,194-252
MAIIKNWCPDEKNVKILAAMNFGLKNTLITNLSSDYA

SEQ ID NO: 124388 - protein, 153 aa, Heterodera glycines
  Coding regions on vcDNA: vcDNA=SeqID_50811; Strand=-; Position=1 -126,204-348,449-637
  Homolog annotation: Hit_ID=NP_501395.1; Match level="QueryCoverage =94%, HitCoverage=26%, E-value=4e-11, Identity=32%"; Hit description =tubulin-specific chaperone e (56.7 kD) (4J61) [Caenorhabditis elegans] gb|AAC04426.1| Hypothetical protei
WESLDGLARLPDLAKLILRGAPLPGARGVDSREMIIAKLPQITDLDRCDVSPVARRSAELLFLSRFGADPIPAEHRATIARLATIYSISNDGDPSSAVSVPRPAQPFSTIHSKKVRLEHAGRSMERSLSLALPIHKVVGLGARLFGFAPDTLT

SEQ ID NO: 124389 - protein, 44 aa, Heterodera glycines
  Coding regions on vcDNA: vcDNA=SeqID_50812; Strand=+; Position=1-158
YIKCCLSSLNELIASFDCLFSLDNAFCSKFACLSQVIFLLNDSL

SEQ ID NO: 124390 - protein, 596 aa, Heterodera glycines
  Coding regions on vcDNA: vcDNA=SeqID_50813; Strand=-; Position=1 -1183,1630-2234
  Homolog annotation: Hit_ID=NP_502797.1; Match level="QueryCoverage =32%, HitCoverage=54%, E-value=4e-30, Identity=35%"; Hit description =HASI (4P602) [Caenorhabditis elegans] emb|CAB16520.1| Hypothetical protein Y57G11C.19 [Caenorhabditis ele
MANKFVLVPQEIYRGLTSATDTGDINLDAVRHDLTRARAERTNPSAKNVSYNQQLRRYLQMRREVADKPARVELVKGLSVLMRRGGADDEAEVVDTPPRPPRPPPPPPPPGQHPPRRPPSPPGPGPSPPGSPPPRPQRPPRPPRAAAPPSRRDGRVEEWRKKRNDIQQRQPVVRDLLAEAAAAPLPESDEEDDYMLESGFALPAPSQYYGDLPVLPDNADAIEEMDTAQHRIATRRKLHDGDDDLHRKKYRAYYPPPPSRPPPSRPQPKIETPRPPPRPSLKKEPQPLLDPRPSTSQQVDRKPKREPKFDLDPRPSTSRQAGYNPPAEPKHEQKPSKKPPPRATPYHIPKREPKIEETVPRHQQPPPAAPQVSSVPPPRRGTKRRHPPENGDESAEKMEMINTTLDKLYNDPSSPAAFAGVSALWKEARKKLKQLRKKDVQHYLEGHRTYTLMRPRRVRFPRAKTVAAGFMTDVQVDLADFQALSRHNRGHRYLLVAVDVLSKRLFVVPLKNKKAEEMLDAFKELVKQMPMVPHRIFSDKGTEFKNKLLKEFFEEREIEKHEPVHSSVKASVAERAIRNVKQRLYRYFAERETLNW

SEQ ID NO: 124391 - protein, 114 aa, Heterodera glycines
  Coding regions on vcDNA: vcDNA=SeqID_50814; Strand=-; Position=1 -51,300-426,614-780
MSCTFCCFFGACTFFSSEPDLITSLILTIGTVFLTITTLTPPILYCICVIYMVFGIVKKAFFSSTANYPPPASNNAIDHLLRERTRLYLICLLGTLPPFILFLLPIVQQMLAIQ

SEQ ID NO: 124392 - protein, 89 aa, Heterodera glycines
  Coding regions on vcDNA: vcDNA=SeqID_50815; Strand=-; Position=1 -154,496-611
MKKCLWIVLFIYRDESFALTTFDFASNCPYKRSIFWLTIAFPFAVSSLPFHSFLLQLTSAENTRRRLLFLCVPLFCVVFVRCRAETTPS

SEQ ID NO: 124393 - protein, 83 aa, Heterodera glycines
  Coding regions on vcDNA: vcDNA=SeqID_50816; Strand=-; Position=1 -60,203-394
MPKFNERLSRDWSITKAEVPLICFFPIRPLSMALTQSSNSPESVTSRRLCPFSNLSQSQMTTKRRRAMKRYSLNFTHSASTPR

SEQ ID NO: 124394 - protein, 268 aa, Heterodera glycines
  Coding regions on vcDNA: vcDNA=SeqID_50817; Strand=-; Position=1 -635,958-1128
MVDKHERRIHELLITDFVRWWTLNNTDGGGGGGGGHNGGGENSTATHSLRSNFVGFLPEQKTDFFIAADHVYLIWRRRVYKFRVGHYFNDPSSQLQFLTNSSDIRFNFLIFERDDDAKLEDSTDRRNSRAAAEASAGLTPSSQMMNSIERLLLALMYLFDVAVICIAVCVIRLLRRTTSNSGPDNTSQARSNDVVHTTEMMALTSGEYGLIHSPGEYYPNPLAEFVCVHIANEDHADQPVLVNGTLDLIEGVELYSTCYPRTETGTID

SEQ ID NO: 124395 - protein, 872 aa, Heterodera glycines
  Coding regions on vcDNA: vcDNA=SeqID_50818; Strand=-; Position=1 -208,255-591,637-883,935-1146,1199-1421,1471-1797,1847-2323,2371 -2649,2698-3003
  Homolog annotation: Hit_ID=NP_920291.1; Match level="QueryCoverage =97%, HitCoverage=51%, E-value=3e-68, Identity=26%"; Hit description =putative helicase [Oryza sativa (japonica cultivar-group)] gb|AAP52578.1| putative helicase [Oryza sativa
MAHIRGPHANWRDGHWLWDWRTLAQLYTITFNNRMEAQKVQYMKQLQGRRRLVLPGSIINWLSALRDNKGYKGDIGRVYMTDEHFRGSRQYYQREYANCMTICREVGKPDLLITLTMDPECDELEEMLPTDPDGHRQQWYDRPDVICRLFVDKFKELRHDLTVKEVMGPVRGWFYSLEHQKRGLPHVHFALILDWDRIRSGGTINTPEDYIEQYISAEIPDNPSGRSSEVLLKRELYKTLRMKHIHTCSARRCLVDGKCLKRFPKPFSYDNVYNEHAYPRYRRRPPAPDARAAARHPEQYGRDFQYTDKSGKTIRVDNRYVVPFNPFLTSKYKAHINTEFVAGEGCTKYLCKYVMKGADMAFIQVQGGPDVRQKVDYDEFHQIRLARYITSMEAILSLWGTKLVGRSHEVDELDVHGPSGHRIAVEQGFDDEEENLNAICEAAQAEEERRLRGEERVTQLTAYFAFNEANPPIGLSYANCYKKLRYDRAKKQWKLYVDAPVPKFCRLKTVSPSNRELLAIRLLLLVVLDPKGWESLRTVNGNVFPTFVEAAQERGLLTDEDLWMKTIDDAFRMKKSIRQRIRWLAVFFATANLASPCTILDKVLANADKWLVNTSVARASAEEQKQYVLNAMEWFLLANGITPDSEPREDGTYESACEHIGLPRPQGLVLTKDIFMKLAFFRDDALNEHLHVDFLPDGQRRGEMRQDYLQKYISGPKPNEEQQQLIDAVQTALEHVQQVIDGQCPDFSPDIQRLFMVTGEGGAGKTFTYNKIIARAKSAGINFLPMASTGIAAELLYEGQTVHKRLCRLKQVDSSTSPNVDNESNFANMLRNIHGILIDEISMQHRDVLEFVDRLLRSVATQQFKDLPFAGK

SEQ ID NO: 124396 - protein, 726 aa, Heterodera glycines
  Coding regions on vcDNA: vcDNA=SeqID_50819; Strand=-; Position=1 -276,547-697,739-906,951-1106,1288-1693,1739-2176,2230-2514,2566 -2725,2776-2918
QAVPLEKQHQTPQELQAAGDPTGESEPLRTPTRNEEQHAFLLDFFKRSPEQKQEAFKALKQRFGKSAVSPQAYGRWWKNFGLGQIILNQCGNTPSSKQSRSTRRIQKSNKCVFCTIPLNDADGYAMLNCGHSCHFDQPFAEWYTDVPNKKCKFRWCKKTTFLKCGDCRQKIGMGIYETGCYCTDASAPVYHADELEARLKASGGKCPDCGTQHPGFCILCQRLFKLQANGLRQSKVFLPCCDSYTHFECCQICGVENAAPLRAVPKPRGIIGARPLKNAKAASPTESIPSTVDTTTAAASDVSANESQALTDSHLMPPPSLAPRRSTRISRQASIASNRPSPVAPKPIAPVTHCCGTIRSAHFGYGCGSKKANHLPSYYNSLRDQAQHNCPHCNALLLPSEAIGPTAYSKCCAKGRVNLADRYKALRARPAELDNILQNPAGQYKGWRDSLFRNVLRYNNNLAFGNIKITRSEERIDHHRIVKCNNMINYMLWDFNPPDGGKPHLHGQLFTIPPADARTRLGEISREHSLDEELMEALYSVILANHKLAVVYETAAETYRQLPEEDRVQFRMLLVDTNQRGTERKLNANDAPAPDNLHVDDRANLKHIHPGRLEAETEAGSRLLAQIFLDCGANIMPPSVYDVVLTGRERTKIVYMKWWNRNIDPANFPLIFSFEQFGYEYGTKLALREHERFDSTYKQIRDKNNNVLLDAAEDLGEEEEFLGSEL

SEQ ID NO: 124397 - protein, 284 aa, Heterodera glycines
  Coding regions on vcDNA: vcDNA=SeqID_50820; Strand=-; Position=1 -230,289-388,436-528,580-759,815-1066
MSEHIDTCALARLRHLIKEMKKFAAGAKDNLAHSRGVGIAVQVPKPWPVAEEDGWTGVTIPGCEEKSPVAEPAIAELRKPKKQKLPKVVTDKRQPWLCNNDGRPIPGLAPVAKQLPVAPLRKLPTDMPRPKNVYHTIVKGKAVASSKLLELSKIDKPRVPIGYAPIARAEKPALQNRPVLNAVPKPVLREPSEEMFVVVGKAIPKSAMEKARKMPDVVKKVPPTVRHRRTVWNSSSVSFVVPCFYVLQQYIKATTSAVASSAPALKSSSMSYAQAVIIILSFCK

SEQ ID NO: 124398 - protein, 104 aa, Heterodera glycines
  Coding regions on vcDNA: vcDNA=SeqID_50821; Strand=-; Position=1 -45,1403-1543,1654-1676,1729-1831
  Homolog annotation: Hit_ID=CAE64885.1; Match level="QueryCoverage =75%, HitCoverage=10%, E-value=8e-24, Identity=65%"; Hit description =Hypothetical protein CBG09697 [Caenorhabditis briggsae]
MRIAHLFLASNDFRALPIRCPPQILFFIFELLVSLMQFNLLIAMMTRTYEMIYATEKEWKRQWAQVILMIELSIHPKKRLMALLGYSRPIGTNKRKRAFVVSRK

SEQ ID NO: 124399 - protein, 48 aa, Heterodera glycines
  Coding regions on vcDNA: vcDNA=SeqID_50822; Strand=+; Position=1 -33,811-924
MAVVDTNINNSGPSVAFFAPSNLLTNLVTTAIYLAIGIAVKAKTGDDI

SEQ ID NO: 124400 - protein, 115 aa, Heterodera glycines
  Coding regions on vcDNA: vcDNA=SeqID_50823; Strand=-; Position=1 -101,257-352,412-443,1033-1151
  Homolog annotation: Hit_ID=CAC34833.1; Match level="QueryCoverage =94%, HitCoverage=14%, E-value=4e-19, Identity=40%"; Hit description =Prx1 protein [Ciona intestinalis]
SSNSSVGGTSASADDRRKTSRRNRTAFSELQLEELEKCFQSSHYPDVNTRDQLARRINLPEAKIQVWFKNRRAKHRKFLRNQPADDGEEEASATANNNNINNNNGQQEAESTTVI

SEQ ID NO: 124401 - protein, 409 aa, Heterodera glycines
  misc_feature (44)..(44): Xaa can be any naturally occurring amino acid
  misc_feature (230)..(230): Xaa can be any naturally occurring amino acid
  Coding regions on vcDNA: vcDNA=SeqID_50824; Strand=-; Position=1-1230
  Homolog annotation: Hit_ID=NP_493834.1; Match level="QueryCoverage =100%, HitCoverage=29%, E-value=2e-72, Identity=38%"; Hit description= putative endoplasmic reticulum protein of ancient origin (2B142) [Caenorhabditis elegans] gb|AAF60594.1|
TGKSFVQSAIFHFLTWLKKVTNMAFSALAATLLKNGRTVHNRVXITIRFKYKFSSSIENNSKEAKEVRETDIFIFDEAPMAPKFVIEIIDKKLREIHKNNIIFGGKIMILSGDFRQCLPIKNKATKTEILDLTLQKSELWVNFKIFHLRKNMRTENESQNFANQILEIGNGKGNDENGICLPKICDVEDNDLVDEIFGEIIKTNDYSKLCSHCILAPYNREINIYNDQIXKKFPGEEYVFRSIDDAESKGAPILPEVLNKLQTNSLPDHELKLKINSVTKLIRNINVNMGLCNGTRVQILDIEKNVLRVMILTGDRIGEIDFIPRITLIEDKKLPYVLKRHQYPLKLAFCMTINSAQGQTFEKIGIDLTRDVFAHGQLYVALSRTRSWERIKIKYSSENKEKTVKNIVW

SEQ ID NO: 124402 - protein, 63 aa, Heterodera glycines
  Coding regions on vcDNA: vcDNA=SeqID_50825; Strand=+; Position=1 -147,961-1005
MALTRKWPRENGPHAKTATRKRPRPWNGSKRVSSVWPVPSSKVMKTCFRAHKEHLDLSNDSKD

SEQ ID NO: 124403 - protein, 16 aa, Heterodera glycines
  Coding regions on vcDNA: vcDNA=SeqID_50826; Strand=+; Position=1 -4,284-330
MSKYPWLKHNVAVNVY

SEQ ID NO: 124404 - protein, 109 aa, Heterodera glycines
  Coding regions on vcDNA: vcDNA=SeqID_50827; Strand=+; Position=1-331
IGFVVASYGETPATAGAASAAQDSQLTCETVVKGPTQLTCEPMVKGPTSSAHNDIANSEARPKATTTSSDFERMKGELLELFSNELQNLKRELAQTIRDEVAKLSADRR

SEQ ID NO: 124405 - protein, 261 aa, Heterodera glycines
  Coding regions on vcDNA: vcDNA=SeqID_50828; Strand=-; Position=1 -166,215-610,1137-1276,1473-1556
MKLDVKIYQHFIKIREVNKKSKVHPNFDENLQSSGLTSINGQCKKDFSGLSNRKKSGSSSSSIVAIDNENSAQKNGCETSLRETDNGKRSFNSILVNNGSIPATNSSLSPPEGTVTKNKRICAGNHCSNTPKTVTSNFLGHRKQMGNCVIGNASVNTGDAGPIYERGLKRHISDDNVNEFGAPNKMRALHTPDNSKNKCSTELTTKDNLQCDFIQQPNNGETPIFQNFFPSVNRGCFEALSTNPASISTNSESLTRTFFEN

SEQ ID NO: 124406 - protein, 170 aa, Heterodera glycines
  misc_feature (5)..(5): Xaa can be any naturally occurring amino acid
  misc_feature (18)..(18): Xaa can be any naturally occurring amino acid
  Coding regions on vcDNA: vcDNA=SeqID_50829; Strand=+; Position=1 -116,657-723,764-918,969-1101
  Homolog annotation: Hit_ID=NP_001002869.1; Match level="QueryCoverage= 86%, HitCoverage=17%, E-value=2e-34, Identity=54%"; Hit description =DEAD (Asp-Glu-Ala-Asp) box polypeptide 27 [Danio rerio] gb|AAT68047.1| DEAD box polypeptide 27 [Danio
SNIFXSAILDYKLLGSMXEIVEKRRKVISDHFSADFAAASANCAHLSFTDLNLSRPLLKSISEAGFQNPTPSISEAGFQNPTPIQTACIPVALAGRDICASSATGTGKTAAFMLPILERLLFRSRRSRRTSVTRVLVLVPTRELAIQVFQVSRQLAKYTQVEICLAAGRI

SEQ ID NO: 124407 - protein, 353 aa, Heterodera glycines
  misc_feature (352)..(352): Xaa can be any naturally occurring amino acid
  Coding regions on vcDNA: vcDNA=SeqID_50830; Strand=-; Position=1 -248,295-461,510-722,776-910,958-1060
  Homolog annotation: Hit_ID=CAE74435.1; Match level="QueryCoverage =89%, HitCoverage=67%, E-value=1e-85, Identity=53%"; Hit description =Hypothetical protein CBG22168 [Caenorhabditis briggsae]
YLATVTTERERTGSLMILTIPQAFSMFFGPILGSKIAIYTTLRFSQIVNGCVMATLLIPVILIFLPTTHSVPRLATARLRPQDYWPMTTKNGALREGLILRGLLIVQDYWPMTTKNGALREGLILRGLLIVAYVCYELIARNFVLRSYMHATSDNAEVMVTMGVSLVLTQFIILPVSLVLTQFIILPFLQRHVSPKTLLQLACFAQLCAYAGITLTNSLYQYLLITAIHTGAYAIAYAESSTQITSAVQAVQPSDLGKATGLASMVQWTAHFLVPLYTSHLVNYWHYTYAFYTSALIMLITIGYISVYAKQTNARLRTSALIMLITIGYISVYAKQTNARLRTLLPSLITTXT

SEQ ID NO: 124408 - protein, 46 aa, Heterodera glycines
  Coding regions on vcDNA: vcDNA=SeqID_50831; Strand=+; Position=1-143
  Homolog annotation: Hit_ID=CAE74433.1; Match level="QueryCoverage =97%, HitCoverage=5%, E-value=6e-13, Identity=80%"; Hit description =Hypothetical protein CBG22166 [Caenorhabditis briggsae]
GLDLKAQEAALRLGLDIVIATPGRLIDHLHNSPNFSLANIEANLSC

SEQ ID NO: 124409 - protein, 248 aa, Heterodera glycines
  Coding regions on vcDNA: vcDNA=SeqID_50832; Strand=+; Position=1 -181,230-393,442-616,825-891,1238-1397
  Homolog annotation: Hit_ID=CAE74433.1; Match level="QueryCoverage =69%, HitCoverage=22%, E-value=9e-26, Identity=39%"; Hit description =Hypothetical protein CBG22166 [Caenorhabditis briggsae]
MNMPATLQHYIHRVGRTARAGKAGRSVSLIGEHDRKLMKEITKVNQISNSFQLMQRKIEPDVIEAYCKRIQEMEPSMKKLMEEEQMEKQLIMAENSIKKAEKQIKSLGGDGTQPKLYSRKWIGGAEKGQNATEKLRIRSKGKRREAKKRLTEALPKRPTAEFASKQHQKSGKKKSAFFTTEIASVSQRAIKRVRNGISSPAITAIVATWGLNGIAEMTRLTIILPPPNFLNNCLPNTVICYNKQMQFI

SEQ ID NO: 124410 - protein, 82 aa, Heterodera glycines
  Coding regions on vcDNA: vcDNA=SeqID_50833; Strand=-; Position=1 -100,149-336
QLLRKFGGGRMIVRRVISAIPFKPHVATIAVIAGIFAWMHGFKVLKRTVKEAFSKDTFVYHQEMEDFIQKISIEQQTKSKNC

SEQ ID NO: 124411 - protein, 177 aa, Heterodera glycines
  misc_feature (27)..(27): Xaa can be any naturally occurring amino acid
  Coding regions on vcDNA: vcDNA=SeqID_50834; Strand=-; Position=1 -67,190-369,432-595,660-758
  Homolog annotation: Hit_ID=CAE63854.1; Match level="QueryCoverage =98%, HitCoverage=98%, E-value=2e-49, Identity=54%"; Hit description =Hypothetical protein CBG08414 [Caenorhabditis briggsae]
GPFMRGTMPLRRTFYYLGQVGLKINKXIKVFAIAFHNFPNVAQEGAKEFVFWHWAQLQFKNPHVQFVKLVDVCVTPFAQAFLGDDGREVVFDLECRTREQISEALIGTLGMTETVRKRMKMDSYKRENPAEFGCDCERQCICEMQCICEMQGQHPCTAILYAPKHLRGSWRWNHSTY

SEQ ID NO: 124412 - protein, 132 aa, Heterodera glycines
  Coding regions on vcDNA: vcDNA=SeqID_50835; Strand=-; Position=1 -85,144-291,659-823
MGNSCLISESVRPINSSSNGFVTFFRQSSDSQLFVKRKLENKKQSPTEAFPKQKTQMSIALPEQKRSYNFLSSKDRELIFLCWRNDIATSRRDLFHKTMLKCIQSSPKMNEVIACGYYCYRDLTKWPKLNRI

SEQ ID NO: 124413 - protein, 75 aa, Heterodera glycines
  Coding regions on vcDNA: vcDNA=SeqID_50836; Strand=-; Position=1 -101,389-515
MAKEMDQDDRMIDQLSDGHCYRHRRLRLRIPLFRYIFVIFVIYIFIVLISVTTYKSTPRNVGKNRKLLSVPFPKA

SEQ ID NO: 124414 - protein, 17 aa, Heterodera glycines
  Coding regions on vcDNA: vcDNA=SeqID_50837; Strand=-; Position=1-51
MSFCAEFAPFLWHFFCR

SEQ ID NO: 124415 - protein, 104 aa, Heterodera glycines
  Coding regions on vcDNA: vcDNA=SeqID_50838; Strand=+; Position=1-359
SRLAQRRSWPKWAKRGHGRTGEEGVAGPRPTSDLPIRGKTDHPSRRSFHPYDRSPFSPSPIVSPFVLFLIAPSPKCVSRLARMAAPSNSIKCIVCFRFTQCTSK

SEQ ID NO: 124416 - protein, 100 aa, Heterodera glycines
  Coding regions on vcDNA: vcDNA=SeqID_50839; Strand=+; Position=1 -142,388-548
MPQAIAKGMDRKDQNFYKDRQSRRNIMDIWAHTKNIEKDSFAMGKFEGNWQRIVFGPVRIRWVISEYGSHSPIVQTTVVVLIRCTVVAHLWPLSAPSTPM

SEQ ID NO: 124417 - protein, 110 aa, Heterodera glycines
  Coding regions on vcDNA: vcDNA=SeqID_50840; Strand=+; Position=1 -58,270-382,433-594
  Homolog annotation: Hit_ID=NP_506599.1; Match level="QueryCoverage =85%, HitCoverage=20%, E-value=3e-40, Identity=75%"; Hit description =histone deacetylase, abnormal GONad development GON-10 (52.1 kD) (hda-1) [Caenorhabditis elegans] emb|CAB
MPNSGVQNHYRKRVAYYYDSNVGNYYYGQGHVMKPHRIRMTHHLLLNYGVYRHLDVYRPFPASLEDMTRFHSEEYMDFLRSATPETLKQFNKQMLKCAFIFRFGLCTFSL

SEQ ID NO: 124418 - protein, 145 aa, Heterodera glycines
  Coding regions on vcDNA: vcDNA=SeqID_50841; Strand=+; Position=1 -187,315-565
MSNLGPEFLKNKTGHKKCRKSWDRHFDFQTNSQFLVDIPCCSGEFPSDSDPVDGKSNLEQLPWLKGIGIDLYFLKKLDPNMKISEYRAQSYGKYKPGPNLISTLCQVDTLYRLSTTVGRSIGMKPQNLIKVSIIIIIPDISPKLM

SEQ ID NO: 124419 - protein, 54 aa, Heterodera glycines
  Coding regions on vcDNA: vcDNA=SeqID_50842; Strand=-; Position=1-163
MALLCAAEPDCMVPIGQTKACIYTATAPNLTCHRQDQSLMEILRYNMEYRQEIE

SEQ ID NO: 124420 - protein, 246 aa, Heterodera glycines
  misc_feature (17)..(17): Xaa can be any naturally occurring amino acid
  Coding regions on vcDNA: vcDNA=SeqID_50843; Strand=-; Position=1 -158,207-276,350-443,504-644,692-855
  Homolog annotation: Hit_ID=CAE59338.1; Match level="QueryCoverage =60%, HitCoverage=52%, E-value=4e-27, Identity=44%"; Hit description =Hypothetical protein CBG02683 [Caenorhabditis briggsae]
VVLGDMGGTWHCNLPFXGHLGVGKTSILLRHDGQGFTSQMSSTLGASYICSRSANNGREANNGREFELQIWDTAGQERFRSMVPLYMRNSSAAMLVFDITNRQSFRDLASWIKVERIDETERIDETGNVLLFIVANKCDLKEMRMVSEEEGRQFAEKQNAHYCETSVKLRLDVPNFQRSVAKALKRLCPQLVKLRLDVPNFQRSVAKALKRLCPQLRNAFYKSLSLRLRSSVHCPFPGTAATAEKC

SEQ ID NO: 124421 - protein, 59 aa, Heterodera glycines
  Coding regions on vcDNA: vcDNA=SeqID_50844; Strand=+; Position=1 -144,417-452
MRKPLLSGEPNAMTLLEEITETEETERGDTDEQQQNNSSQFIRTDNEQEKKNIISFIKK

SEQ ID NO: 124422 - protein, 56 aa, Heterodera glycines
  Coding regions on vcDNA: vcDNA=SeqID_50845; Strand=-; Position=1-177
MKWAPGKLDTRKLDTRKLDTRKLDTNGKMDTRKLDTVVNKNENKQNKLLNKNFGLA

SEQ ID NO: 124423 - protein, 132 aa, Heterodera glycines
  Coding regions on vcDNA: vcDNA=SeqID_50846; Strand=-; Position=1 -102,379-490,532-716
MLSFIFDLATVILGAVLPMFRTWKVLKSRKSRQLEYEPNREVLMASAQYYASKATQHALAYAWNTITSCSPRSKAITTQANGQRNAEFRSVVRIVELEEQEEDFVDIIEQDEQFEDLEADSDNEMTSNSPIH

SEQ ID NO: 124424 - protein, 71 aa, Heterodera glycines
  Coding regions on vcDNA: vcDNA=SeqID_50847; Strand=+; Position=1-213
MVRTRLQKTNKSKKTGGEAKSKRKGEKKMEEEENQEKESKEEKREEDKEMTSQETKDITILKTVSSTDLEE

SEQ ID NO: 124425 - protein, 359 aa, Heterodera glycines
  Coding regions on vcDNA: vcDNA=SeqID_50848; Strand=+; Position=1 -336,525-711,761-969,1020-1367
AGNEHNCQKTAEQPNDALENDIDKKVTDFQTMVETTEEDNRSGTATFESFGNSAEPTPMETTIYHSAKESSEIGTDNGLLSKMAESPPKVPPLTPPSILRKVNSPGGNGVKKLLEHLDQSTSEGAASPSADNESPAKRPMKAFGQIWPIASAGRPSTTTPTRWSKSARRLLPIHERGSPYDAPESVQKAQSSDNKSDQSENNSNDKQQHVDEQLEKLPRMDEQQKDDEIVLVGSANVCVVLPEEEANENRHQQKRDFEQPNETISNDSDKTATDLGTVSKESEENAVQSEAMFHKKLTTDNKSETFERIKNKLDEQQEKLRRQMEALVEESTKRMLAIVAEELAIAEGLANAMPTNDGQ

SEQ ID NO: 124426 - protein, 25 aa, Heterodera glycines
  Coding regions on vcDNA: vcDNA=SeqID_50849; Strand=-; Position=1-79
MSTCHEVTVARQCGMRVFGFSLITN

SEQ ID NO: 124427 - protein, 87 aa, Heterodera glycines
  Coding regions on vcDNA: vcDNA=SeqID_50850; Strand=+; Position=1 -166,424-521
MDDFHISAGTKNCNYSIEQQSFSFEAVEKYHSKDFAIPIIALIDENFSEIDVKLTDANNRSLMEFHIGTNRSLNVTFPDVKNGKILI

SEQ ID NO: 124428 - protein, 65 aa, Heterodera glycines
  Coding regions on vcDNA: vcDNA=SeqID_50851; Strand=+; Position=1 -132,179-244
MILWVALRKNSYEIMLNDTALDNRQFWPNDWWEGSGRENVTHIVIFSKIPFLSFLGIKFFFYSNS

SEQ ID NO: 124429 - protein, 94 aa, Heterodera glycines
  Coding regions on vcDNA: vcDNA=SeqID_50852; Strand=+; Position=1 -160,294-418
MSEIGIPCHPWCAPIWTTLGEQLHLAYHQQFDRGTGHQIGFNSLVKISENCQRMCQCFEWTSGGQMAFHATAKQCAKGVQMLVEGGLLAFCVID

SEQ ID NO: 124430 - protein, 333 aa, Heterodera glycines
  Coding regions on vcDNA: vcDNA=SeqID_50853; Strand=+; Position=1 -365,403-949,1435-1524
VLVIKQQICAHLHYQKIETAAGVGFVCLDVKAALEFRLNSAKDNLISFDDELLIKLSGDHGQGFTKLTISFGQALRNNSASNHFIAAVFPAKDTRENLEQYGALLWPQIDQMNALINRPIKWFLGGDVSFVWALIGHCGSAVTSFPSPICNCHRDRLLTEGQQCQTRTIMQTTQQSEQFSKAVENGEKATAAVRSSTMGIVKAPLMKTIEFDRIIPAPFHVLQGLGNALVRELEQQTDATIAVQQFLRQIGARREQFRKKDMTGNTIRKVLKRASEMEHLFESTWPKTICQALMHLGQIQNFTKRLEEQKEDDNFSEHSDGENDEDSVIDVIG

SEQ ID NO: 124431 - protein, 134 aa, Heterodera glycines
  Coding regions on vcDNA: vcDNA=SeqID_50854; Strand=+; Position=1 -100,317-484,869-946,1389-1447
MEVNRILLRLPIPRTKNCEPEEDYCGEGKCMFSPADGEGANIFMHVQYCTNETLCEKGVEQDIISKEDNTVTGRLTCDKRTCCEWNLCNGTRAAVGCHLRSLCWAFVAMIIAFWAELEPKTVGDSTNSQLYHFV

SEQ ID NO: 124432 - protein, 81 aa, Heterodera glycines
  Coding regions on vcDNA: vcDNA=SeqID_50855; Strand=+; Position=1 -3,322-431,554-686
MLHSGQQFRPSIRNTAMRLPQYSPASAHRNQLLHGQPLVGGRNRSCATFSNSALEHALTDNICPRSYKQRTGGNSSSFYGL

SEQ ID NO: 124433 - protein, 233 aa, Heterodera glycines
  Coding regions on vcDNA: vcDNA=SeqID_50856; Strand=+; Position=1 -131,974-1135,1187-1211,1263-1294,1504-1690,1762-1850
  Homolog annotation: Hit_ID=CAE72206.1; Match level="QueryCoverage =93%, HitCoverage=72%, E-value=3e-47, Identity=48%"; Hit description =Hypothetical protein CBG19316 [Caenorhabditis briggsae]
SSIYRPPYSSFYPSPPPLLPIHPLPPSLSSVSSLPLPFPFFTLVLIPTATILGNGLVIVSVLRFKALHSAINFLILGLAIADLGVALFVMPYAVYVYVQGGRWLLGVQGGRWLLGPLMCNLYLSSPLMCNLYLSSDVACSTASIILLALISFDRYQAISHPIQYSRQAQNIARVVRLFVGVWVYSLLVASPIVLGPSALSGAFELSGAFEPFQGRFYNPGSPCCPPSAPFLLP

SEQ ID NO: 124434 - protein, 18 aa, Heterodera glycines
  Coding regions on vcDNA: vcDNA=SeqID_50857; Strand=+; Position=1 -19,85-122
MSKLNESNNGPMEMKFSE

SEQ ID NO: 124435 - protein, 33 aa, Heterodera glycines
  Coding regions on vcDNA: vcDNA=SeqID_50858; Strand=+; Position=1-99
QKCDGISADETAKNAEHCAQCELLQKAEKFGRL

SEQ ID NO: 124436 - protein, 93 aa, Heterodera glycines
  Coding regions on vcDNA: vcDNA=SeqID_50859; Strand=-; Position=1-282
MAKSDRQSKKSQKVIGNEDMIDKLVGRSQLMAAEPKSDRPVISPSLIKFLICCLSCCCFANLRQVDKAKIWPKKKSVRFVWPNGCNYKVLLRN

SEQ ID NO: 124437 - protein, 179 aa, Heterodera glycines
  Coding regions on vcDNA: vcDNA=SeqID_50860; Strand=+; Position=1 -62,174-367,498-654,726-845
  Homolog annotation: Hit_ID=CAE72004.1; Match level="QueryCoverage =100%, HitCoverage=100%, E-value=4e-37, Identity=47%"; Hit description=Hypothetical protein CBG19083 [Caenorhabditis briggsae]
MGSDFLQVFSYFLANVSDFAQAYRLHCHSCMSPYLEDQFQFISHLYRRPLVFSEKCDHGQFDWRYIATKNCSDACVTLRMNDRVGGRRRFGFMRGCLSDIIHHNRTAVRWRTRQDSKVGRNNMLGYPTKGFVHLFGQHIHIELCACIRSNCNSATKKFGIKNAILGVISTIISFMFLIR

SEQ ID NO: 124438 - protein, 195 aa, Heterodera glycines
  Coding regions on vcDNA: vcDNA=SeqID_50861; Strand=+; Position=1 -271,891-1206
  Homolog annotation: Hit_ID=NP_608540.1; Match level="QueryCoverage =49%, HitCoverage=11%, E-value=6e-09, Identity=29%"; Hit description =CG2839-PA [Drosophila melanogaster] gb|AAF51469.2| CG2839-PA [Drosophila melanogaster]
MKRKQRGGGRRCERKRTKEERIKEKKRRQRQKAKTDEGRKSKGKEEKEKTKRVKEKKERKRRDEGRKKSRGQEAKTPNQDKDGSNFVKRRMGDGAAEARVEQGGPEDVHFGRGALHDDHQLVVFVEEGHVGQFLRQNRQKALQAFTSAKSQLPRIRAFQSEANRIRISNSLTSPTLRAVSRRIRCPTSAPPKWGR

SEQ ID NO: 124439 - protein, 243 aa, Heterodera glycines
  Coding regions on vcDNA: vcDNA=SeqID_50862; Strand=-; Position=1 -181,237-549,622-654,705-839
  Homolog annotation: Hit_ID=NP_506513.1; Match level="QueryCoverage =87%, HitCoverage=36%, E-value=7e-36, Identity=43%"; Hit description =TRNA Methylase (58.3 kD) (trm-1) [Caenorhabditis elegans] emb|CAB00881.1| Hypothetical protein ZC376.5 [C
VRFSTAHFQSELVRLPGTVRRVDGGRMVAKCAHCGGTANTGGPIWVAPTWDTEFVGKLLKGPNAGQLRLKGPNAGQLRLGTRERLEGLLTVLSEELPDVPLFYEHDQLMVVMKCPSPKMNVFRSALLNAGFRCSISHCNPRAVKTDAPTSFLWDVCREWVKEHAESADANDHPPRSRILAKETKCEINFSTHPDSIPKCEINFSTHPDSIPKSKFIGMLRFQDNKGKNWGPKMKAKGLIKHTH

SEQ ID NO: 124440 - protein, 172 aa, Heterodera glycines
  Coding regions on vcDNA: vcDNA=SeqID_50863; Strand=-; Position=1 -191,248-380,426-618
  Homolog annotation: Hit_ID=NP_506513.1; Match level="QueryCoverage =87%, HitCoverage=26%, E-value=4e-24, Identity=44%"; Hit description =TRNA Methylase (58.3 kD) (trm-1) [Caenorhabditis elegans] emb|CAB00881.1| Hypothetical protein ZC376.5 [C
MDGAESVILQCATEKGNGVGPSVAADCEANKLAEVTEGLARITATAEGGETFYNRVQEFNRDLTVVVLRAFAAEIPNEKEPKTEEEGPKAKQRKMDEGKAPEANAAQSQPRAFSVLDALSASGLRAIRFALEVPNVTRVVANDFSEKAFEAIRRNVQLNGVPDKSRRSFPTQ

SEQ ID NO: 124441 - protein, 38 aa, Heterodera glycines
  Coding regions on vcDNA: vcDNA=SeqID_50864; Strand=+; Position=1-127
NKRGDPFVLQNFFKIKNHDNFLSGVLKVANHESDMYFD

SEQ ID NO: 124442 - protein, 132 aa, Heterodera glycines
  Coding regions on vcDNA: vcDNA=SeqID_50865; Strand=+; Position=1 -134,836-1100
  Homolog annotation: Hit_ID=CAE62672.1; Match level="QueryCoverage =61%, HitCoverage=17%, E-value=6e-14, Identity=48%"; Hit description =Hypothetical protein CBG06813 [Caenorhabditis briggsae]
MSLSDQISLNLYFIYRPEIVCGCSDGRQCIALVPMRCRRGLTGQRKLFMSDHGVNPTHPNPTHPNPTHPYPTHPYPTHPYPTHPYPTHPYPTHPYTQLIHTQLIHSTIRVVTVAFNATTKTVQPKNATTETA

SEQ ID NO: 124443 - protein, 65 aa, Heterodera glycines
  Coding regions on vcDNA: vcDNA=SeqID_50866; Strand=-; Position=1 -123,521-593
MALHILSMFGNSSHFVRVVHHFNIPFVSHGYSQIFEHLSEKNCSPAKHNPIDKNEAFAFVDHRFM

SEQ ID NO: 124444 - protein, 37 aa, Heterodera glycines
  Coding regions on vcDNA: vcDNA=SeqID_50867; Strand=-; Position=1 -100,242-255
MGYELHHYFCFYTFIFNPLYIGRCSAGPCKPSNVIYL

SEQ ID NO: 124445 - protein, 49 aa, Heterodera glycines
  Coding regions on vcDNA: vcDNA=SeqID_50868; Strand=+; Position=1-150
CHFPLVPPVQLNESDRIRDGKDGQCAQFQRRIGQLEQIGAPQRTFNTIT

SEQ ID NO: 124446 - protein, 476 aa, Heterodera glycines
  misc_feature (470)..(470): Xaa can be any naturally occurring amino acid
  Coding regions on vcDNA: vcDNA=SeqID_50869; Strand=+; Position=1 -159,214-356,480-607,682-810,1122-1231,1416-1562,1615-1920,1983-2181
  Homolog annotation: Hit_ID=XP_392277.1; Match level="QueryCoverage =99%, HitCoverage=78%, E-value=4e-62, Identity=34%"; Hit description =similar to ENSANGP00000018469 [Apis mellifera]
LTSKELVTAYIDRLKEVNPLINAIAHENYKAALKLAKEVDTELAKMDSKKRKSLAFSKPLAFSKPFYGVPFTSKDNLKTKGFVTIAGNRYLKEGGKVATEDALIVKRMKDAGAILVAISTLPNLAMSYACDDTAYEGVTNNPHDTRRIPGGSSSGEGALGSSSGEGALIGAGASLCGIGNDMGGSVRIPANMNGVFGLRPTTDVVPAEGIVPTAFSTNQRNMLTNGPLCRYASDLPLILKVMAGKKVNSFQLDVEFAKDFKLYYLEDLNVLITHELKAEQRFAVRRVKSYFESKYNSTVQKVEVKSYFESKYNSTVQKVEFTLLSRFLELFYADPWKAGVPVCKSLKFGTNKLIVINLHIYFWQTFDELKTTYHVANDTFFALQFEALKRFAVPKSENEHLQVLLKKEKLRKQVLQVLLKKEKLRKQVAQLLGKNGLLLTPVWPTDVPFHHMEPFVAFDLKYTMVGHLLXVPSSIR

SEQ ID NO: 124447 - protein, 316 aa, Heterodera glycines
  Coding regions on vcDNA: vcDNA=SeqID_50870; Strand=-; Position=1-951
MKIQILLFILILKIYAGGIKEEKSFDEIFGQRWDEKSEENGEKETDQHGIIGQKNDQNETKNDENIAQRLFAEQFDQNFDDNSEVHDEQSVLLSTNCDELEQAPVKFGQICDHFIIFENKKKIEIVEKFDKIKEKVKQMGKKYSKKEWNKIERKIAKKLGENQKKIYKWKREFGMMKNKNYSVEEKRIMLKQFDQIYGKLKMKLNGKLEGKRTKCQKIIATHLGISLKSIYKWKKQLKNGKPLKNQQIDDEKREIVEKYFKTKNEFMQNGKHSRKEWEEFRAKIKQIFGVNYLTTEKWAKKLNFNQNISKGEMFFI

SEQ ID NO: 124448 - protein, 136 aa, Heterodera glycines
  Coding regions on vcDNA: vcDNA=SeqID_50871; Strand=+; Position=1 -186,347-571
MNKLSENAAFSKHLGVQPICLPSVVTDFGFGDTIEKFSKSFSVVNNQSLSADPDLFKPKEGMQMGTKLKYNNIMEELQIYLSTIARLLNSLLALEKREGIFWGGIWGLSSGMDLRGIISEFNITLRLKSNANCSFL

SEQ ID NO: 124449 - protein, 75 aa, Heterodera glycines
  Coding regions on vcDNA: vcDNA=SeqID_50872; Strand=+; Position=1-228
MALKRMFLAQKALRQEAATEAAEGTENGNNTTKSRVKGRRKLRQQQQQQQYHHQNVNAFQWIGSDGWADRLDVVR

SEQ ID NO: 124450 - protein, 101 aa, Heterodera glycines
  Coding regions on vcDNA: vcDNA=SeqID_50873; Strand=+; Position=1-306
MAKLAKLYSLLTDKELSSLSHTLQLARPSTITAASATDATSTSDYCTESSPPPPPQQSPTVASGAGVAAAAFVQPPQHRPTKRAFLEDNHNDYNTGGQKGT

SEQ ID NO: 124451 - protein, 36 aa, Heterodera glycines
  Coding regions on vcDNA: vcDNA=SeqID_50874; Strand=+; Position=1-183
WGIINHLIISSSYHPRPPSYICCLVKTKVCCINKWI

SEQ ID NO: 124452 - protein, 63 aa, Heterodera glycines
  Coding regions on vcDNA: vcDNA=SeqID_50875; Strand=-; Position=1 -34,85-242
MASRRHIIKMSAHCRVKYGLFDQLNLMFPFDGVVGFWLGKTQGQQEPISNMGMIFEAPKGRRI

SEQ ID NO: 124453 - protein, 27 aa, Heterodera glycines
  Coding regions on vcDNA: vcDNA=SeqID_50876; Strand=-; Position=1-89
MSQNVPPLKISEKTENYIIICLHTICF

SEQ ID NO: 124454 - protein, 564 aa, Heterodera glycines
  Coding regions on vcDNA: vcDNA=SeqID_50877; Strand=-; Position=1-1693
  Homolog annotation: Hit_ID=XP_318550.1; Match level="QueryCoverage =88%, HitCoverage=50%, E-value=1e-109, Identity=41%"; Hit description= ENSANGP00000020240 [Anopheles gambiae]
QIEKEALALVFAVQKFHRMLFGRKFTLFTDHKPLLAIFGSKKGIPVYSASRLQRWALIMANYDFDIKYTNTASFGQADVLSRLIANYPKPEEDVLIANICVETDCYINTILQSQTDHLPVTAQEIAESTTKDETLQKIVNFVISGWPTKCREPEIAPFHPKRNEILEIGGCLLYKSRVIIPSQLRGRILKALHFAHPGIVQMKALARQYVYWPGMDSEIEKVVRQCDECQSAQKCPIKAPLAPWTVTDKAFQRVHIDFAGPCQDGFVYFILMDAFSKWPEVYQMSSITAKYTVFTIRSIIHRLGIPKEIVSDNGTQFKSAEFAAFCQEFGIKHTFSPPFHPQSNGQVERFVDTFKRAMKKCSKDDKNWTEKVLLAYRTTPNNAIDGYSPDQLFFGRKLRTKLALVLPKGHRNDSENIDKIQRDKRRKDYSNKMAKQFDERHGAKEKVFFPAEPVLLLNYRNQKTYWLHGTIVERVRNSPTYRVHVPVLGRIVHRHSNQLRRNCVFEENSKHNPGPDQQPIPPVNGQAQNLAHQIADPVDQRTDQQAANDPPTMALRRSQRKPKP

SEQ ID NO: 124455 - protein, 644 aa, Heterodera glycines
  Coding regions on vcDNA: vcDNA=SeqID_50878; Strand=-; Position=1 -297,1817-3399,3473-3524
  Homolog annotation: Hit_ID=XP_319741.1; Match level="QueryCoverage =62%, HitCoverage=91%, E-value=4e-38, Identity=28%"; Hit description =ENSANGP00000006515 [Anopheles gambiae]
MSRVLTRQFPVAQADKPAVDLEQLRQQLRQQHALNQEIVAEKNGLRDMVVEATKVARELSSTLGGQEGQDAMMAKVERAKRLADETMELGTERVAELEQGATRCGYLDFNNLAMDADQLKQILDAVLAKSEKRIQQMMNAQQNVGPSESLSHANLASSIDGRISKFHYDSESGNTFEQWFKRFGILIEEDGKDLPESAKVRLLLGKLADGEYAKYRDSISPTQPDTVNWKDSIDKLKGLFSETRSLFVRRYECFQIRQQPNQDVSTLIAHINASCENANLSLTKEQLKCMILVIALSDDHHDMRQKCLKMLEEAEKSGTRISLGQIEEELKAMQLIKDSALALLSPPISTNAIQLRPQQWREPKSKKGNYNSGKTTANQHTTGGKANQRKPIYPCGACGNSDHWRSDCRFFSAICHKCQKQGHIAKMCPQRSASTSNSRRQNRAVHTVKVTSHCLNVGLNRGHWWKLQVKINDNDCEMNGDTGAQATIITIQTWIKLGRPKLELSDIEMHNCNEEPFPTEGMFQCVVSCFDKPPKRLTAYVSSAVNYNLFGLPWIMAFDLIPREVMFPKVQQKEMCEPISIHATLAPMPKANIKDEASLIEALKTDLSDPETGCQANFLQGTANSTRHWAAPILAVKKKNGKTR

SEQ ID NO: 124456 - protein, 188 aa, Heterodera glycines
  Coding regions on vcDNA: vcDNA=SeqID_50879; Strand=-; Position=1 -39,202-466,545-670,970-1106
MTHSEMNLEDVLQLLEKASSQSSKLEKSLIETPKISGLFAEILDLFLVELTNLFTSMCFDLNKSRTLNSDDQATLCSIVRCVPYLITVIWKLLSSSNLCKILNCPPGVPKLFKRRWNLLSAFTNLSLLWSLNSNLFKTTLTEAIYWSPEGARNSRPIARISRYYARPIQAAVARIANCLSLFRCISSF

SEQ ID NO: 124457 - protein, 31 aa, Heterodera glycines
  misc_feature (31)..(31): Xaa can be any naturally occurring amino acid
  Coding regions on vcDNA: vcDNA=SeqID_50880; Strand=+; Position=1-102
LTQISNLPSDAKKKPQLTFRSKLNKKQIEFX

SEQ ID NO: 124458 - protein, 83 aa, Heterodera glycines
  Coding regions on vcDNA: vcDNA=SeqID_50881; Strand=+; Position=1 -14,510-603,762-905
MPKCTCLLQSIITGKNYHRKEVEEFMNIIRYDVLQLLTFGSICANITFEGEKARMEWYLGRLSKNAQMILDNVEPYVSGELVR

SEQ ID NO: 124459 - protein, 69 aa, Heterodera glycines
  Coding regions on vcDNA: vcDNA=SeqID_50882; Strand=+; Position=1 -42,126-293
MKLFIFPFYIHSFILKSFPKIETAMAKQVIDDMSFTQPVTDNATIFQIATNVFEILDEYGNKKSACIFK

SEQ ID NO: 124460 - protein, 166 aa, Heterodera glycines
  Coding regions on vcDNA: vcDNA=SeqID_50883; Strand=+; Position=1 -27,351-641,997-1179
MNTFTLAKTLSEQQEKPPYDDSIDQLERQLRLGKRLLSQFNRKKTPKLADEHGEEHKEGEEDEQQLNSSEENNDDELDNDQPQTSTANAKKKRGTKRRHMPSRVAKEIKKLFRQANRAMIEDDDEEEDEENGQSDRKSIKSESDGEKKATGRQIKRFLKCFGLFEK

SEQ ID NO: 124461 - protein, 115 aa, Heterodera glycines
  Coding regions on vcDNA: vcDNA=SeqID_50884; Strand=+; Position=1 -97,152-402
MPSSSDLSRQPISSTPFRFRLNFDDPSAYSDNENRPSPANQTSVSLPDNGCNVSPYARYTGSGDSPTSSRSGNGRKRRPRRGDELFMDRRHLRKSREVEEDELDEVENDYTMGDD

SEQ ID NO: 124462 - protein, 194 aa, Heterodera glycines
  misc_feature (172)..(172): Xaa can be any naturally occurring amino acid
  Coding regions on vcDNA: vcDNA=SeqID_50885; Strand=-; Position=1 -139,193-322,390-624
  Homolog annotation: Hit_ID=NP_741088.1; Match level="QueryCoverage =86%, HitCoverage=45%, E-value=7e-48, Identity=61%"; Hit description =actin related protein 2 3 complex 34kDa (34.5 kD) (3B481) [Caenorhabditis elegans] gb|AAL32261.1| Hypothe
NAISIINVSNFPCRFIEAKSDRVTVIFSTLFKDPDDVVIGKVFLQEFREGRRASQTAPQVLYSEFREGRRASQTAPQVLYSVGEPPLELRNNPEARVGDNVGYITFVLFPRHTNKKARDLFPRHTNKKARDNTISLIHTFRDYLHYHIKCSKVAFFLRMKFKTINFQQFLWXSAVCPPIFRKKIKILTKSCKTL

SEQ ID NO: 124463 - protein, 41 aa, Heterodera glycines
  Coding regions on vcDNA: vcDNA=SeqID_50886; Strand=+; Position=1 -25,533-633
MVYKKSKYVKMFLSLFISSIFRRLGSNFEEIKKIKLINVND

SEQ ID NO: 124464 - protein, 59 aa, Heterodera glycines
  Coding regions on vcDNA: vcDNA=SeqID_50887; Strand=+; Position=1-179
MQQNQQHQQGNTMEDGNDNTVVVVMGQQGGTTVDWDSREEQQQHLDMETARTSRTEDII

SEQ ID NO: 124465 - protein, 233 aa, Heterodera glycines
  Coding regions on vcDNA: vcDNA=SeqID_50888; Strand=-; Position=1 -195,406-617,1485-1779
MAGTLDNKLYSWGMHKWAAEGQQPKENDGGADQSAKAAEDGAGGTSDCSYLSSTATSLTNSDGNTATPVEQPKQQKERKKRKKSKSTKTTVRHLFREPLQYEMSQTREGQLVRLKNRDDLMDKPKPFMMQPHLVLRLIPIPFVTHRLCTESKKKTNGQKVPFFVLSLPKNAQRLREEIAALRSQLAEHKNTVRGHQSQMSQLQVEEEARNNLERMPKPKKRQKCRVPGNTSPN

SEQ ID NO: 124466 - protein, 146 aa, Heterodera glycines
  misc_feature (9)..(9): Xaa can be any naturally occurring amino acid
  Coding regions on vcDNA: vcDNA=SeqID_50889; Strand=-; Position=1 -31,1771-1798,1892-1992,2471-2732
  Homolog annotation: Hit_ID=CAE60376.1; Match level="QueryCoverage =93%, HitCoverage=22%, E-value=5e-39, Identity=59%"; Hit description =Hypothetical protein CBG03977 [Caenorhabditis briggsae]
VGLTHPSLXNYERIRTVGKGSFGIASFGIAVLYRRKDDDSFVILKEINLHELTPTERNMSLNEVALLSRLDHPHIIHYFDSFEEDGTLMIEMEYADGGTLAQLLAHRDDAQPLPEGEVVDIFEQMTSAVSYLHDNNILHRQSQSIN

SEQ ID NO: 124467 - protein, 153 aa, Heterodera glycines
  Coding regions on vcDNA: vcDNA=SeqID_50890; Strand=+; Position=1 -268,640-833
MAQQQIDERVVVQVGNTVQQHVALVGRRGGNGSGGQPQQRGGGGGGRRCQRGAGRHIRGGGGTTADVADAVVCRRPSLFVTVAAQQRRLAFVNKFAHIVPHLAIIILVRLVTGDDANPKPAEVGTDRRSKLKAIHQKIVHIQHVLFNVLWLIL

SEQ ID NO: 124468 - protein, 77 aa, Heterodera glycines
  Coding regions on vcDNA: vcDNA=SeqID_50891; Strand=-; Position=1 -204,468-496
FVLVGTDVISENVAAFVNKFAHIVPHLAIIILVRLVTGDDANPKPAEVGTDRRSKLKAIHQKIVHIQHVLFNVLWLI

SEQ ID NO: 124469 - protein, 66 aa, Heterodera glycines
  Coding regions on vcDNA: vcDNA=SeqID_50892; Strand=-; Position=1-201
MGGRRAEKGRKEGGGRGGEKGEGIGGGRERRRRKSRSNRNGRRNRRRKRGIGEEKEEEQEDEEEEE

SEQ ID NO: 124470 - protein, 148 aa, Heterodera glycines
  Coding regions on vcDNA: vcDNA=SeqID_50893; Strand=-; Position=1-447
MKVGSTITKGAHEVNQLVVSPARQKAGQGAKFVYEKATKVLKPKATAESAEAKGESANSSRSENGDEKQSCPDKANAAERQGEQSVDEQPKERHSSAGDDESASEEKPLNGESSGANVAGTANARRKCPVPAIAKKFVSMTVQVSKKN

SEQ ID NO: 124471 - protein, 178 aa, Heterodera glycines
  Coding regions on vcDNA: vcDNA=SeqID_50894; Strand=+; Position=1-537
MRFYYSTLLSLAFVLSLCLRCPTVWSVHSKNKNDSMSNHQSDHDSMAQHSETEGGGKLKMPEFIKKLMRSKQTKKDKKAAQNDARGEQSESESVQNGQNDNSAEIANMLNEMPRWTTSAGTSRNIAENNSPLHGSSPNYYNTVRGSRHQRTKSSNPNQQPGAVVKEGGYLTRALTMVI

SEQ ID NO: 124472 - protein, 76 aa, Heterodera glycines
  Coding regions on vcDNA: vcDNA=SeqID_50895; Strand=-; Position=1-229
MGETAKDEEGMRKSEETERKSKPMEENKQGTAEATTTWASTERPGSTAAEGTQRMNGTKKGIPEAEEEDQHQQQQI

SEQ ID NO: 124473 - protein, 47 aa, Heterodera glycines
  Coding regions on vcDNA: vcDNA=SeqID_50896; Strand=-; Position=1 -126,257-274
MQKEEMHVIRNGRNGTKHDEVHSVDEAHDHVSGAGGGAHHDEMSINI

SEQ ID NO: 124474 - protein, 30 aa, Heterodera glycines
  Coding regions on vcDNA: vcDNA=SeqID_50897; Strand=-; Position=1-89
CCTSSNHFCTSSNHFCTSFITFVPLLITVV

SEQ ID NO: 124475 - protein, 44 aa, Heterodera glycines
  Coding regions on vcDNA: vcDNA=SeqID_50898; Strand=+; Position=1 -45,976-1065
MSVGEMTSWRNVIIMMSCLRTNKLYKIHRKVDIPYKYLIISELL

SEQ ID NO: 124476 - protein, 608 aa, Heterodera glycines
  misc_feature (153)..(153): Xaa can be any naturally occurring amino acid
  Coding regions on vcDNA: vcDNA=SeqID_50899; Strand=+; Position=1 -415,501-1922
  Homolog annotation: Hit_ID=NP_493834.1; Match level="QueryCoverage =99%, HitCoverage=44%, E-value=1e-103, Identity=35%"; Hit description= putative endoplasmic reticulum protein of ancient origin (2B142) [Caenorhabditis elegans] gb|AAF60594.1|
YHQIPEKFCFRKDFGQTRKTYFNTIGRMVKSPAEPERYHLRLLLLNVKGACSYDDLKTVIDINGIAKVCETFSAACLEKGFIRNDEEWKRALEEAESFEMQWKLREFFALILVHCNPAKPEELWNMFKDSLSEDFCRPTMEQINVDDDVETVXPSRKIGFGTKNYSLMYDKQRNVCDAILHRIWNPVNEPPFYFLSGPGGTGKTHVNKTIVHMLRGQKKKVCTMAFTGIAATLLPAGRTLHNRFGLTLDMSNSSISPRSKAWHEVKDTDLFICDEAPMINKRAMRTLDELREIMNNGIAFGGKVMLWTGDFRQTLPIQKHATRAEMVNSTIKSEYWRLAKRYKLAKNMRALETEQEFARDLLEIGSGKLNNENDEIILPENCISNGDLAEEIFASIASENWNEMAKSAILAPKNIDVSEMNNRVLEMLPGEEVVYTSIDLAQDENRQRADEYLDEYLNALNPSGFPRHKLKLKKNAIVLLMRNLTIEMGLCNGSRMKVEQMQPNLIVCKLLTGDKAGQTVYIPRITLCCSEDYPFDLHRHQFPLVLAFAMTINKAQGRTLEQVGIDLRKDVFSHGQLYVALSRARAWNKLRIRLDDSNLERKVMNVVY

SEQ ID NO: 124477 - protein, 371 aa, Heterodera glycines
  Coding regions on vcDNA: vcDNA=SeqID_50900; Strand=+; Position=1-1125
  Homolog annotation: Hit_ID=NP_920591.1; Match level="QueryCoverage =98%, HitCoverage=24%, E-value=9e-80, Identity=43%"; Hit description =putative retroelement [Oryza sativa (japonica cultivar-group)] gb|AAP52878.1| putative retroelement [Oryz
IDLVPGSLPFHFRPYRYPPETQKEIERQIKIMLDQNIIRESESEFASPIVMVPKADKKSWRFAIDYRSLNKMTKKRVFHLPNIQELLDLMGSKKYYTSMDMQSGFMQIPMSTEDIDKTAFISHLGIYEFITMPFGLTAAPDTFQRVMNSLRRRLTAAMLIYLDDIIIGSETEEMHLIDIENFLKLLKEVGLKLKMDKCHWGMAEIRYLGFLLSERGIRMDPRQVQTVQNFKPPKSLTELKSLLGALTYFRRFIKNFAHIARPLQTLIEGKIEENWGKEQDESLNLLKNLLTSAPVLQSPRFGKPFTIECDASKKAIGAVLFQEKGPVAYASRALNRHETNYPSIEREALALVYAVKEFSPYIIGSGVTKII

SEQ ID NO: 124478 - protein, 256 aa, Heterodera glycines
  Coding regions on vcDNA: vcDNA=SeqID_50901; Strand=+; Position=1-770
  Homolog annotation: Hit_ID=DAA04499.1; Match level="QueryCoverage =64%, HitCoverage=11%, E-value=3e-23, Identity=36%"; Hit description =TPA: pol polyprotein [Schistosoma mansoni]
MGKILENEKEENSVKILSTKNEGEENQLEIKGANISIEEVVKEQRKVKELAQIYYILNSGKIPPELKWKRVPTDYCLINGAIYYKKGKENSEQPKLIIPYQLREKFFHNIHDEGHFGFEKTWPEIKNRFYWEEMKKDVRLLTETCELCQKRKIYPGQAKSAPSVPIVPAEAPFQRVHCDLMGPLKKTRLGNLYIILTIDSFSKWVTAKAIPNQKADTVSEAFIETVIHQHSVPEIVITDQGRQFTSQIFAELSKIY

SEQ ID NO: 124479 - protein, 354 aa, Heterodera glycines
  Coding regions on vcDNA: vcDNA=SeqID_50902; Strand=-; Position=1-1062
  Homolog annotation: Hit_ID=EAL49477.1; Match level="QueryCoverage =92%, HitCoverage=44%, E-value=8e-30, Identity=35%"; Hit description =hypothetical protein 42.t00003 [Entamoeba histolytica HM-1:IMSS]
MIAEVERLLTRKRSSPVHESFGNIDDDDEEEGEILDVSFVEEEEDNTGEAPLNPLSYLAKQSAAQQETLRHEKWAQEERKRREEEQRKQRENERRRREEEERRRKTEEEDRRKTAEKAAKEKKAKEEKEASEKKAREEKLAREKKEEQRIAKEKKGEKETKDKKAEEERVAKERKAEDERVAKERKAEEERVAKAEAERAAKAEAERAENETKKKQEEEKQLEELKRQQQAIRKQKELELLKEFRPWRGGYMRLVHGKDPTPDVHYLHETDDYHFVNAVHKYRVRHSELPWEAPEFNPSAHIQQNIGEFRELFEQEVYDENYAVKTREEKEELIELVKGFRFYFTEQIGRFELK

SEQ ID NO: 124480 - protein, 85 aa, Heterodera glycines
  Coding regions on vcDNA: vcDNA=SeqID_50903; Strand=-; Position=1 -163,209-303
MDDDDVITIGDNNNTQTLLDLQPGPSKRGRKPRLDKIHEEIASAMKKAKAMEAEVDESPKKQPTNVFEYPTIFWKLARPKVLANI

SEQ ID NO: 124481 - protein, 808 aa, Heterodera glycines
  Coding regions on vcDNA: vcDNA=SeqID_50904; Strand=+; Position=1 -600,659-947,1105-1784,1952-2033,2076-2651,2699-2896
  Homolog annotation: Hit_ID=AAA93301.1; Match level="QueryCoverage =39%, HitCoverage=86%, E-value=1e-45, Identity=34%"; Hit description =HASI
MDYPRINESELAFPISSGIIVSGPSSSGKTQLVLRLLRHANVMFDPPPKAIGMCKGGFCAVGCCYLVWAYGEYSTQIPDLERQGVVPHPGAPSDEMLKKLPKPCLIVYDDLMGDIEAKKLADLYTKKSHHNNFSVIFLTQNLFDKSMRVPRSNAQYIFLMRAPNDMLSIRNLASQMFPREQGFLMDAYRQACALPYGYLLMTKRESFLPPKMVKREQKIGERVVHNYDYLKKLGKTTSEKKRRHLLNSAGCEELLTLVEICLNVLNGSFCLSRKQKQRLAPFAKDIRQLARVRSERARETKNDDDDDIAERTNLGFVKRQVTAAVQKRKGNVSERNAMYNQQLRRYLKMRKEHKERPVRVQLSNGAQLLNKTVETGVQVRPGPDEPKDKSVMVTDEDEEEEIEVPKFLTPTSQTQGSSRTPRTNKKAAKQQKLIEKKDHLLAIIMSDPQRFGATDRGKIINPKTGREFIDSDLAWSIERLVDPRPENAPSPRGTKELKRKLAQNPLASSLLNRLFVGSGFVGQRNTTYTLFKPKREKFRRLRTVPTGFMTDVQADLADFQALSRKNSGYRYLLLAVDVLSRRMFGAPVKSKRPVDMKRAFEELFEQMPRVPDTLYTDRGLEFVAKPLKEFYAEKGIQKFETSSKKKAAVAERAIRTLKTRLYKYFSSNNTSVWVDVLPKFLSAINNSVCRATGLRPNEISDANAREVWKRVYGEGLAQLDKSSKIRAGETVRIPEPKHIFEKGYIPNYSDHVYTVDEARSTNPQHYLLKDYYGTKLKRKFYLPELTKVQVDENTMYRIEKKYKERVRD

SEQ ID NO: 124482 - protein, 521 aa, Heterodera glycines
  Coding regions on vcDNA: vcDNA=SeqID_50905; Strand=+; Position=1 -637,706-1632
  Homolog annotation: Hit_ID=AAA93301.1; Match level="QueryCoverage =57%, HitCoverage=81%, E-value=4e-47, Identity=38%"; Hit description =HASI
MQHTKRYLLVPEEIYQSLAAPPPSDGTPIGLVRTRIKQIKNDDAINEAERAVKYEQEVKRLNKLTKDEDERPVGVKLENLSDVVDAMPKPVNVTRPIVVSTRRHLKVGRARKENVEQLEDTDDDDDYQNPRSSSANKRQPTQTEILKLIYKNAQSLGVSEEGQVLRAGGRPFITSSVDDIVSHLLNKDKRGQNKEPTAFKEFVERARQNPLLTIIMDLKKLRLLEFLYKDLSSPVAFTSVEPLLREARKSQPKINRNDVQNYLTSQRTYTLHRQAKRRYRRLPTLAPGLHTEWQADLAIFDRLGKQNRGFKYLLVCIDTLSRQVFVEPVKTKTSANMIIAFDRIFKRSKYIPWKVLTDQGKEFTARAVQQFFRTKDVEHFCMLISPQFHAGMAERANRSIKERLYRYFTERNTYKWIDVVQDIVCAINHSTNSSIGMRPVDVNFKNAEALRQKLHDAAENVVRRKPKYRVGDRVRIEKYKHVFQKGYLPRFTNEPFTVAEVHSERSPVVYRLRDDNNEIIS

SEQ ID NO: 124483 - protein, 113 aa, Heterodera glycines
  Coding regions on vcDNA: vcDNA=SeqID_50906; Strand=-; Position=1 -51,477-585,909-1030,1341-1400
MSPMNLFSHIAIFIAKNLNCVLSGPIYPVCIHCGDANDFRAGKAFVSGWGQEEVKTEKSKFRVIAAELCWPAMAHTLFKLECFRLAYAIGGQKGVIQAFIHFWMARGLKKLLD

SEQ ID NO: 124484 - protein, 60 aa, Heterodera glycines
  Coding regions on vcDNA: vcDNA=SeqID_50907; Strand=-; Position=1 -96,252-338
MAQSTSPASVPPPTEYRRENSNLNLAPKIVTKTRTRTNKQKMASRMYKEEMYYGNFFFKR

SEQ ID NO: 124485 - protein, 89 aa, Heterodera glycines
  Coding regions on vcDNA: vcDNA=SeqID_50908; Strand=+; Position=1 -91,1447-1623
MDFAGGKRATKGTADRNTKFCGDWSADGGKDGPEHTAHGHDGIGQQCRGRGHRRQSQRTIGTCGRQIGPVHGAHRNIKAPGTAQQPRAK

SEQ ID NO: 124486 - protein, 154 aa, Heterodera glycines
  Coding regions on vcDNA: vcDNA=SeqID_50909; Strand=-; Position=1 -162,215-442,929-1003
  Homolog annotation: Hit_ID=AAL77223.1; Match level="QueryCoverage =73%, HitCoverage=5%, E-value=9e-09, Identity=34%"; Hit description =Bck1-like MAP kinase kinase kinase [Podospora anserina]
MPMASACGMPPPYAMQTQQQQSAATISAKANHHATEAEEPPKKRKRISKKQQQKEEKEREQQQKQLRVQQEAALVQIQQRQQQQMFFQQRQMAMQQQGMVPLTSPALIGAPQQNYQQHVAQVNILQSLYFMTQYHTAPVPDGGCCTKPCPSPAH

SEQ ID NO: 124487 - protein, 35 aa, Heterodera glycines
  Coding regions on vcDNA: vcDNA=SeqID_50910; Strand=-; Position=1 -29,817-895
MVRFVRNRVRYKRTSNSFHFLQGNIPSYDSENAYK

SEQ ID NO: 124488 - protein, 124 aa, Heterodera glycines
  Coding regions on vcDNA: vcDNA=SeqID_50911; Strand=+; Position=1 -144,201-275,471-626
MASSSNLSPSEELRLLRDRSKELEQMKKDGQSEGNCANSVAEQQKEMKELRKKFAKMEMREAKHLSKIDELEKITHEAESEQQKLIADRNVLQAKMAKMEKKRKEEKEKYSKRIASEWLLWFFH

SEQ ID NO: 124489 - protein, 22 aa, Heterodera glycines
  Coding regions on vcDNA: vcDNA=SeqID_50912; Strand=+; Position=1 -64,276-280
MMGRCSAVWTAENVPNFMEMYG

SEQ ID NO: 124490 - protein, 27 aa, Heterodera glycines
  Coding regions on vcDNA: vcDNA=SeqID_50913; Strand=-; Position=1 -47,207-243
MRRVFAINGLVKREMTFKVGLSLQHGF

SEQ ID NO: 124491 - protein, 79 aa, Heterodera glycines
  Coding regions on vcDNA: vcDNA=SeqID_50914; Strand=-; Position=1-239
MVFESLKIFNPCKSSMQKNFRPREILGLEKWRHYELCAWTAAEAVDRFVEKVIIVNSWSSASNVTSTNSMPAPICSTKA

SEQ ID NO: 124492 - protein, 289 aa, Heterodera glycines
  Coding regions on vcDNA: vcDNA=SeqID_50915; Strand=+; Position=1 -332,511-798,826-984
  Homolog annotation: Hit_ID=CAE63611.1; Match level="QueryCoverage =97%, HitCoverage=22%, E-value=6e-40, Identity=33%"; Hit description =Hypothetical protein CBG08103 [Caenorhabditis briggsae]
ALVPPQTPQITAQPTEAVREGEFVTVRCESQDGNPLPRFQWLFDNRTRVPDAWFHERHEGGGGSGTKPRAISTLQWHLTRSDNGAYLTCQTWNKALREGEVINAETNRLNVLYAPRVKVVPTPELNIEEGELAELKCTADANPPATNFAWTHLPSGETHADREWRVHVRRAHAGEFRCTAVNSLDSASDRIRLNVLYGPTVRIRTVVSPAEGDRLVVDCEADANPKADAITVRIRTVVSPAEGDRLVVDCEADANPKADAIAWSGPGGFQRTGSRLVIEAVNRVGLFLI

SEQ ID NO: 124493 - protein, 24 aa, Heterodera glycines
  Coding regions on vcDNA: vcDNA=SeqID_50916; Strand=-; Position=1-72
MDRMERTQLSSEGQLKKGKATTNQ

SEQ ID NO: 124494 - protein, 27 aa, Heterodera glycines
  Coding regions on vcDNA: vcDNA=SeqID_50917; Strand=+; Position=1-92
FTPHFPFRHSTDILLFNNCPFLNTEFP

SEQ ID NO: 124495 - protein, 476 aa, Heterodera glycines
  Coding regions on vcDNA: vcDNA=SeqID_50918; Strand=-; Position=1 -444,497-685,1237-1384,1442-1953,2008-2145
  Homolog annotation: Hit_ID=NP_504245.2; Match level="QueryCoverage =97%, HitCoverage=56%, E-value=9e-49, Identity=38%"; Hit description =ribosome biogenesis protein bms1 homolog (5F86) [Caenorhabditis elegans] gb|AAF60833.3| Hypothetical prot
VRESIKDSWVTGKWASDGEGEDDESDGERKNDEGQSQRNKKEEKWKAKEEENGDELSDWSGDEFEPNELREAGEAMTKREEGESSEDDEDEEEAEDGTKAEKGQNAEKGDGVAKGAKKERLRKLFDAEFDQTNEQYNALVEEMDKQSKLNKSVFDDLDEEQRQKLEGFRPGLYIRVEVEDVPAAFVDCFNPTFPYIVGGLLPVEQNDGYVQGMFNSALEVTPFQGVAIRTISGIRGLIKKALREPEGAFRATFEDKIKPNDVIFLRSWVDVPVPKFCVSMTDKLLPSGENWLGMKTTGRLRHELGIKPEQKADSGYHRHMKNVKHFIYSVNQMLILKEATEKFFVSAPLVIPKKLQKDLPYKLKPKVGRLCLEDAEEGRDSELVRNHTAELLMEPEENRVNAMMELLRTVKEEKRQRDKAQTKERWEKHQKELSEIEARRKRKMMATKKTVCRNMSRREAKRKRGDNTTEMETIGA

SEQ ID NO: 124496 - protein, 29 aa, Heterodera glycines
  Coding regions on vcDNA: vcDNA=SeqID_50919; Strand=+; Position=1-97
PTGNLPLTFLSVTPQIFCYLIIIIVHFKH

SEQ ID NO: 124497 - protein, 96 aa, Heterodera glycines
  Coding regions on vcDNA: vcDNA=SeqID_50920; Strand=-; Position=1-661
  Homolog annotation: Hit_ID=NP_493603.1; Match level="QueryCoverage =98%, HitCoverage=9%, E-value=9e-23, Identity=52%"; Hit description =PaTched Related (111.8 kD) (ptr-23) [Caenorhabditis elegans] emb|CAB04167.1| Hypothetical protein ZK270.1
LMDWRSVVDRYADLNASVFHDESIFLDLIDNMPTDAWQSGLATLLCMCFICAVFMGHDWRTVLMAGTTIGSIIVGTLGTLSWIGATMDPIMMVRLT

SEQ ID NO: 124498 - protein, 201 aa, Heterodera glycines
  Coding regions on vcDNA: vcDNA=SeqID_50921; Strand=+; Position=1 -23,266-364,398-456,986-1138,1340-1475,1806-1878
  Homolog annotation: Hit_ID=NP_493603.1; Match level="QueryCoverage =99%, HitCoverage=18%, E-value=3e-48, Identity=46%"; Hit description =PaTched Related (111.8 kD) (ptr-23) [Caenorhabditis elegans] emb|CAB04167.1| Hypothetical protein ZK270.1
HSLTLNEDQLEQFLDWPENRYWKSLIHLATVAEDRQNQSVNSFYFTTGYHGQRLRKWAESVNSFYFTTGYHGQRLRKWAERTHLLMDWRSVVDRYADLNASVFHDESIFLDLIDNMPTDAWQSGLATLLCMCFICAVFMGHDWRTVLMAGTTIGSIIVGTLGTLSWIGATMDPIMMAALIISIGFSVDIPAHFSYHFHSAA

SEQ ID NO: 124499 - protein, 327 aa, Heterodera glycines
  Coding regions on vcDNA: vcDNA=SeqID_50922; Strand=+; Position=1-983
MCNNATGPSATAALGADGRKRRIPSRERLSRARTGAIASLMVNTNCSIMQNAMTVELVHNTNNKRSTRAKKNAVDGGGQKGEEKADDDGNKMPKNDDDDEWKQRKIVLLNGSATSTLAEQRDGTKRIAAVDQQQPKRSMIMLGENLNKMAQKFARRRSSLDEQDTRKHSDSGGELFNRSGLVTTTLLLATSKSLCGEEQLRHEEYNGDTTMCNNNSFYHGIRQGAVPKNENVAKRSASTTGGGERTGSLPMSTSFSSSEDSDLTAEHSQYSVRMPCKLPVKKWQKEKQQRGGRGRRRHSMHGIPSKGSNSAEQQKMAPAATTAEEGK

SEQ ID NO: 124500 - protein, 272 aa, Heterodera glycines
  Coding regions on vcDNA: vcDNA=SeqID_50923; Strand=+; Position=1 -275,393-589,812-845,2154-2466
  Homolog annotation: Hit_ID=AAO51818.1; Match level="QueryCoverage =75%, HitCoverage=4%, E-value=5e-09, Identity=25%"; Hit description =similar to Kaposi's sarcoma-associated herpesvirus (KSHV) (Human herpesvirus 8). ORF73 homolog [Dictyosteli
SAPNPVVPTSFGPSVASNFGQMAPPLSAPPIISVPSQSQQQQQQHMVMMMQQHYAGGAGGVAAPSSAGPYSSMSSSSSSSMSQQQHQQQYGSLMRVSRNDVVAQIMMSNNQLFYHQQQQQQQQPQYHQLQRPQPNGDPSYKETLDCWEQIKSGVDTFMSTSDADAVEMDERVHHQLHHPFGVHAGGDGTMLMRVAGANVGSQQQQQMPMPMFNHHHQQQQQQLYSYGNVQLPHHNHPQHVGTTNYPPPPPNNIAVGDDQHHHHLPHHNRFHR

SEQ ID NO: 124501 - protein, 22 aa, Heterodera glycines
  Coding regions on vcDNA: vcDNA=SeqID_50924; Strand=+; Position=1-67
MSTSSTLFLVVVVLASLLISAN

SEQ ID NO: 124502 - protein, 263 aa, Heterodera glycines
  Coding regions on vcDNA: vcDNA=SeqID_50925; Strand=+; Position=1 -433,488-774,832-904
YIDHSVIEFLRSNKHIWDRRGTNLEVFVDAIDMGVQPIWDVFIRQIWPIFATNIRHLSFTSGDALDNLRSRTSPTFLTDLDQLNSIDSGYLCPDGIADDGPNATAGQALTKWLHTPTKNGQPKQLRFRAYVGPPNFEWVNNFKETFRRATTSVSYKIQLYFWVEPMPIEPFELMNEVTKEKLTLKQEIDEFDLNVYNWLLQRCPIGETATAPVKWENRENPSANLNNVRFDLWSFDKSIGPLAPPAEEKEGEEEADQSNKNVV

SEQ ID NO: 124503 - protein, 249 aa, Heterodera glycines
  Coding regions on vcDNA: vcDNA=SeqID_50926; Strand=-; Position=1 -415,475-749,808-868
YIDHSVLAFIRSNKQIWDRMGTKFELKVYSYETDQIWDVLAREIWPIFAPNIRHFGFHCGDHLDNLLRLVSPTLLTDCDQLNSIDSGYLSSSAIAVDGPNTISAWQALAKWLHTPSKDGQPKRLRCDDFSKSINYFKEAFLHATTSVSYKIRFNLFLVPMPIEPFELVNERTNEKLTLTKDGTGLFSDWLLERCPIIGETAADQWENDGNSDANLNNIQFFFWHGSNCFGPLSPPSEEADEEADQSNGN

SEQ ID NO: 124504 - protein, 213 aa, Heterodera glycines
  Coding regions on vcDNA: vcDNA=SeqID_50927; Strand=-; Position=1 -73,368-460,579-773,938-1012,1098-1247,1306-1359
  Homolog annotation: Hit_ID=AAH68967.1; Match level="QueryCoverage =90%, HitCoverage=9%, E-value=2e-45, Identity=47%"; Hit description =MGC83258 protein [Xenopus laevis]
PPFTARCVAYAQPETAEEFDELQLYFTYPGDLTLELVKGGKNVQVTKANCKQFMELVFNWRLVEGVRAEMEALRRGFQLIIGSESLQIFTPDEISELFCGTDDADDKVWSKSVLQHCIRPDHGYTYDSQQIKWLIDMLHGFPKEKRRRFLQFCTGSPRLPVGGFKGLSPPLTVVKKTASFVGNENELPSAMTCYNYLKIPPYESYNTFLDRFE

SEQ ID NO: 124505 - protein, 34 aa, Heterodera glycines
  Coding regions on vcDNA: vcDNA=SeqID_50928; Strand=-; Position=1-201
SHFPLVAHISIKQKISLNLLSLHHILKIVPSQFL

SEQ ID NO: 124506 - protein, 46 aa, Heterodera glycines
  Coding regions on vcDNA: vcDNA=SeqID_50929; Strand=+; Position=1 -102,675-713
MAASSDSSNGHSVVRRPTFGLNARGKGPLVGAESQNIKKQIISREI

SEQ ID NO: 124507 - protein, 34 aa, Heterodera glycines
  Coding regions on vcDNA: vcDNA=SeqID_50930; Strand=-; Position=1-105
LWRCAVDERTAPDNQAAMPPSTSPVLPNKVADRD

SEQ ID NO: 124508 - protein, 82 aa, Heterodera glycines
  Coding regions on vcDNA: vcDNA=SeqID_50931; Strand=+; Position=1 -186,1288-1350
MILLGAALLLLAMFGCCGVTATAPAQKRTKRRLGGGQSGDNNGWEDPVAVVYTSSPLLWLYTARKSFCKANRTCEELLNDTG

SEQ ID NO: 124509 - protein, 174 aa, Heterodera glycines
  Coding regions on vcDNA: vcDNA=SeqID_50932; Strand=+; Position=1-525
  Homolog annotation: Hit_ID=NP_763435.1; Match level="QueryCoverage =86%, HitCoverage=22%, E-value=2e-12, Identity=26%"; Hit description =TPR repeat containing protein [Vibrio vulnificus CMCP6] gb|AAO08425.1| TPR repeat containing protein [Vib
AKAKHSTGSSGGGPSVPAPNNRKKTQNQQQQKGNNELGGEGRENGGKREEKGGEKGAAAEAEEKEKKVAVEHHQKQQQQKQEVQAVQQQQQKQEVQAVQQQQQKQILVGMEMKMDNSKNGETREEVEKEGNSIGEGGETEEKERKRKNSKQGGGERGENEAEKKREEQQQIDTF

SEQ ID NO: 124510 - protein, 176 aa, Heterodera glycines
  Coding regions on vcDNA: vcDNA=SeqID_50933; Strand=-; Position=1 -219,266-343,428-506,555-640,1009-1077
  Homolog annotation: Hit_ID=NP_741554.1; Match level="QueryCoverage =86%, HitCoverage=31%, E-value=4e-40, Identity=52%"; Hit description =ALDH3C1, ALdehyde deHydrogenase (55.6 kD) (alh-4) [Caenorhabditis elegans] gb|AAM45357.1| Aldehyde dehydr
LVESQREFFRTGKTAELAHRRQQLKKLRKTILDNSEFLCEAVQKDLKRDAKLNYPLEISSVIIEIEYVLDNLERWTAPLNVEKTFTTLLDSPQIVREPKGVVLLIGPWNYPLNTLLMPLVDVLAAGNTAILKPSEVASNTAAAVDEIISKAFDRGNSNFENNIFTTSHLMALNNPS

SEQ ID NO: 124511 - protein, 30 aa, Heterodera glycines
  Coding regions on vcDNA: vcDNA=SeqID_50934; Strand=-; Position=1-89
RICSNYSPVSINPAVSNYPPVYEVFLKNNP

SEQ ID NO: 124512 - protein, 59 aa, Heterodera glycines
  Coding regions on vcDNA: vcDNA=SeqID_50935; Strand=+; Position=1 -148,201-232
MFLIALFMLTFSLTFDLVVSFAESEQLVYYNYNPNDYYSTSGSSLSELKDILDSGDNIK

SEQ ID NO: 124513 - protein, 269 aa, Heterodera glycines
  misc_feature (4)..(4): Xaa can be any naturally occurring amino acid
  Coding regions on vcDNA: vcDNA=SeqID_50936; Strand=+; Position=1 -201,335-400,464-532,585-683,766-917,1020-1203
  Homolog annotation: Hit_ID=NP_956046.1; Match level="QueryCoverage =81%, HitCoverage=90%, E-value=8e-44, Identity=42%"; Hit description =RAB28, member RAS oncogene family [Danio rerio] gb|AAH45389.1| RAB28, member RAS oncogene family [Danio r
LSSXTASQPLIVPSLFAMSNLAMSSDDEGGRGEQMSLKVVLLGDNGTGKTAICCRFAQHAYPQKYIQTSGVDFYSRRIAMPRNVSVLLQWDVGGHNLTSPAMLNTYIFGAQAVLFVYDVTNSQSFDHLTDWAVLFVYDVTNSQSFDHLTDWVGAAKKGGAQMEKPFCLALVGNKTDSEHQRAVKMDRHNKFADQNALSAFYVSAKTGDSIDLMFKKTTAEVLGIPLTKADQEWNVNVVQGSINKRKQQQKAEEPRKEKYGRRRGVDTVG

SEQ ID NO: 124514 - protein, 20 aa, Heterodera glycines
  Coding regions on vcDNA: vcDNA=SeqID_50937; Strand=+; Position=1-62
MVADWHGWQQQLAVEHWHRR

SEQ ID NO: 124515 - protein, 201 aa, Heterodera glycines
  Coding regions on vcDNA: vcDNA=SeqID_50938; Strand=-; Position=1 -337,2092-2360
  Homolog annotation: Hit_ID=NP_508537.1; Match level="QueryCoverage =19%, HitCoverage=1%, E-value=4e-09, Identity=75%"; Hit description =spectrin (spc-1) [Caenorhabditis elegans] gb|AAB53876.1| Spectrin protein 1 [Caenorhabditis elegans] pir||
VGWAVAATKRCVSGCSCSSSYLSFTTVHAWTFCNSIWVAFGEWLTWLGSSSERNTRGTCATLEAGRLRNGTWVAPVQHWGNGRLRNVVHAWHHREKDAAGCAVAATGTEMMEYYQRFLSDYRDLMQWVDGMVQLVSSDKLANDVTGAEVVAYRTRNKKPKTLIRLFHRCCAMVADWHGWQQQLAVEHWHRRAKQIRIYEFI

SEQ ID NO: 124516 - protein, 154 aa, Heterodera glycines
  Coding regions on vcDNA: vcDNA=SeqID_50939; Strand=-; Position=1 -191,921-1194
MFKFFTIFSWATIGICPKQSSELGERICNRTGTYAYESDGTFWLSGSLKIRNAEYIYGADDVVGLALFGFADKHKPLLSLLNRSGTYAYASTGNFLINGYWEKGTCKFARGDVVGCGVNLASRRIIFTNKGQRLGWYFGKYHKALLMTPGLGVG

SEQ ID NO: 124517 - protein, 62 aa, Heterodera glycines
  Coding regions on vcDNA: vcDNA=SeqID_50940; Strand=+; Position=1 -66,222-344
MGAISTHQVSFGNPTDTWGPFFAYVIDANNSAAVHWIPNVLTVQQLWSYMDQTERVSQTGFS

SEQ ID NO: 124518 - protein, 309 aa, Heterodera glycines
  Coding regions on vcDNA: vcDNA=SeqID_50941; Strand=+; Position=1 -88,141-650,719-1050
MHGFGLFLSLLAAINLSRGQIGPKDESKKGLFLMANEFLETGKMLLDEFPGNKQAENKSDDGLNSQKANGKALEEKSDNFQQKAFEFLCGIEMKAKNDEKGNDKTKKDDNLLAFKELEEKRLNFCQNWKNGKSIWKGWKEAGISIVTSVNNLKLNQQIYGESLRTLAKMEIFNSKNKEEFGNFTKFGIDLLMKVTEILKDARISSLALADQSDHDQRKGNNTSRRRKRAFHGIFRREFSLEKCFLYLLLTCMSAGLGTDMVVRLAQHKVRVVSFGNSAPPPPFSTEGHHTTPLEGFEIFVAIFCFLTTF

SEQ ID NO: 124519 - protein, 131 aa, Heterodera glycines
  Coding regions on vcDNA: vcDNA=SeqID_50942; Strand=-; Position=1 -79,141-274,326-508
MFKLPCILLPFFALFLSDFIVGQPMKNAAETADQGKQKEEHLVCPHCNGHIKPGELKMQLKGKQSPAEQQKEKPKVARERHPWHVMDDVQIGEEHLPMNKGDDDADLRMEKKLTRETIGEQPKFWTESSDY

SEQ ID NO: 124520 - protein, 81 aa, Heterodera glycines
  Coding regions on vcDNA: vcDNA=SeqID_50943; Strand=-; Position=1 -60,186-371
MPQKLLIKENRKKNIWCVRIEKPKVARERHPWHVMDDVQIGEEEHLPMNKGDDDADLRMEKKLTRETIGEQPKFWTESSDY

SEQ ID NO: 124521 - protein, 96 aa, Heterodera glycines
  Coding regions on vcDNA: vcDNA=SeqID_50944; Strand=+; Position=1 -58,160-389
MSISTSSTNGDFTPSIGGGEVNDDSISLDEDWQFDRKNETVADRQQLLMVGNERSFNEAFTYIFRQNYLFLLEFHESYAKNKVEIEFKITKLVLEK

SEQ ID NO: 124522 - protein, 677 aa, Heterodera glycines
  Coding regions on vcDNA: vcDNA=SeqID_50945; Strand=+; Position=1 -284,327-680,718-1131,1180-1471,1517-1796,1940-2128,2170-2261,2306 -2431
  Homolog annotation: Hit_ID=NP_001004509.1; Match level="QueryCoverage= 97%, HitCoverage=46%, E-value=7e-74, Identity=29%"; Hit description =si:busm1-180o5.3 [Danio rerio] emb|CAD60788.1| novel protein similar to DNA polymerases [Danio rerio]
VKSRKNLNPNVIFRDSWNLIPGPLASMVPMFGLDVDDKPFFPHLVNRPENYGCHIFPTKADYLADGMNPVKRKEFDKWFEENRNKSFFLDEALASYCKNDVDILMSGLIAFRAEFMEMTKRSAGTDGKVDRAAHKTPHDGIDSVRHCITIASACMRHFRTNHLKPAHLALVPEKGYDSCGDNQSDLALNFMQWYSEEHGVRIQNAFSAEGEKSDRVGNFRLDGWIESEKKGLEIHGCVWHACPKCYPDDKDVMPCGKTAGRIRERNKQRMDFILERVLNVEIFWQCEIEQMLARDRKMKDKFSEFTGDGGPINIRACFMGGRTGALKLHHEIAADETISYYDVTSLYPFINYVTHYPVGHPTLHVPCEDVDWRRSEDNPYHLAILKVFVIPPRRIDVPVLPVKVDDRLCFPLCMKCCKKFPNGGVRETYNCTHIDRQRGWISTCTSLELNVALDEGYRVTELLRVLEYSKSDNQLFRPYMSEFIAEKMHASGFDDQIRGNFEAEEKFIAECREEFGIKIDRAKMVPNKGKRALAKLAVNNLFTGLDMLTPERILISYHQKNDWVKEHPCSNVVVSLFTTSAARLHLLKAMQKVVRTPGCILLYTDTDSLIYVHPKGANPLKTGPHLGQFTDEFPKHDILEFVSGGAKQYGLKLRKKGSEEEEFEYVLKLRGITLNYD

SEQ ID NO: 124523 - protein, 301 aa, Heterodera glycines
  Coding regions on vcDNA: vcDNA=SeqID_50946; Strand=+; Position=1 -163,208-495,537-628,673-1035
  Homolog annotation: Hit_ID=NP_001004509.1; Match level="QueryCoverage= 77%, HitCoverage=15%, E-value=7e-19, Identity=29%"; Hit description =si:busm1-180o5.3 [Danio rerio] emb|CAD60788.1| novel protein similar to DNA polymerases [Danio rerio]
MHASGFDDQIRGNFEAEEKFIAECREEFGIKIDRAKMVPNKGKRALAKLAVNNLWGRFSLRNFGLTQTLITDDPSELGNYLDNKKIEVTGLDMLTPERILISYHQKNDWVKEHPCSNVVVSLFNTSAARLHLLKAMQKVVRTPGCILLYTDTDSLIYVHPKVANPLKTGPHLGQFTDEFPKHDILEFVSGGAKQYGLKLRKKGSEEEEFEYVLKLRGITLNYAVTENHGLRFETFKKRVLEFARTGKTQPIKVIYPNFLRPTVIKGNVTSAPLQKIYKPYVGKGIVCSRDFRVLDFGYSSR

SEQ ID NO: 124524 - protein, 171 aa, Heterodera glycines
  Coding regions on vcDNA: vcDNA=SeqID_50947; Strand=-; Position=1-516
MVLFTEKIAKILNCRVSELRDRLNHPSDCKIVEQALNGLPIQTTYKDRNGYTKTFSFGGITPQGASTMMAYGRLGRPFNVCVAAHFYVRHRIKLRHPFLHCAVERFQEGQEDRFYPLELCQMEDVPNELDWLGRMFTEIRSEKVNGMNEESTQISNEGRHECSQNDTYTFW

SEQ ID NO: 124525 - protein, 117 aa, Heterodera glycines
  Coding regions on vcDNA: vcDNA=SeqID_50948; Strand=+; Position=1 -58,109-254,301-450
MSTSSNKNYLPKNQCPNCDDDEVDTDPSPEEVEKWTPEQVIEWDQRCYGKMPAEEELWQEFLDKGEANVLREFFGGKGALEVEKSLREYAKKKERRDAILIEKRNEYKKMMGKKDEN

SEQ ID NO: 124526 - protein, 245 aa, Heterodera glycines
  Coding regions on vcDNA: vcDNA=SeqID_50949; Strand=+; Position=1 -133,969-1025,1074-1621
  Homolog annotation: Hit_ID=BAC57901.1; Match level="QueryCoverage =53%, HitCoverage=18%, E-value=1e-08, Identity=30%"; Hit description =gag-like protein [Anopheles gambiae]
MAENHNEQKMNEQQNEIIPAKNPRSIQSWKLFRPKYMLTFRFCDVRNVAGPSTASDGDDERENGPVLSAVIEGHMNRSRMRLIRDEMVHRAVQQQLEHQRHLLLQQAQQQQQREERERQQHFDQQMEEAELLHEQLQAAEQENDENIEPQPPQQQPQPLIRHQQLQFERNVRLQLRESQRFERGVASSMLVPPAQLYWETECIICTSNRAHLYSRNCGHIYPVLDMCGERGDPQGRDLYALSCAN

SEQ ID NO: 124527 - protein, 45 aa, Heterodera glycines
  Coding regions on vcDNA: vcDNA=SeqID_50950; Strand=-; Position=1-138
KVMRTRPIWQVKQRLLTSQKVRCRDETNQHCLPRGTRHGPPKEWI

SEQ ID NO: 124528 - protein, 95 aa, Heterodera glycines
  Coding regions on vcDNA: vcDNA=SeqID_50951; Strand=+; Position=1-678
LFEYPKRTLEKIDFFVFGAVPPNRCAQIYGETESFRNSFPIACTLILRWIFAPHNCLSTPNGHLKKSIFLFSGQSPRTDAPRFMGRPNPSGIASL

SEQ ID NO: 124529 - protein, 145 aa, Heterodera glycines
  Coding regions on vcDNA: vcDNA=SeqID_50952; Strand=+; Position=1-438
LISLYERAKADERNVPTLRANTARNNGQQQQQKKVPAANGGKKNNNGVAPVVKQQIVVIRQAEQRGETVAKREDGGVTRRRKRGNTATTEVGEQEQPPDNSTDDEKSVEREEQQVMEKKQRKAAAAAESVESIETEEKKQKTGKD

SEQ ID NO: 124530 - protein, 46 aa, Heterodera glycines
  Coding regions on vcDNA: vcDNA=SeqID_50953; Strand=+; Position=1 -50,528-618
MWIDSSMVELTTEWAYDCLSFSCQGIELKLKFKTIPYVRMEGIVKV

SEQ ID NO: 124531 - protein, 37 aa, Heterodera glycines
  Coding regions on vcDNA: vcDNA=SeqID_50954; Strand=+; Position=1-113
IKVNVEASNQVENALFMLNISKLVRRKKKAIASKCGL

SEQ ID NO: 124532 - protein, 30 aa, Heterodera glycines
  Coding regions on vcDNA: vcDNA=SeqID_50955; Strand=-; Position=1 -78,693-707
MALNVTYLFNLSLYCSNSMHEVQAVQKIYI

SEQ ID NO: 124533 - protein, 76 aa, Heterodera glycines
  Coding regions on vcDNA: vcDNA=SeqID_50956; Strand=+; Position=1 -118,465-577
MLINNQLSDHQTTTFGPAYGSEGVKVNGTDTTTNKSNSNEWTYYLYAFLILAIGAMGIYGLYRLCRRSTFTYKKVK

SEQ ID NO: 124534 - protein, 63 aa, Heterodera glycines
  Coding regions on vcDNA: vcDNA=SeqID_50957; Strand=+; Position=1-190
MARRAENGVCHLSQKKRSGKRGGRGACGGGARHARAGDGRATRGSEGARAGDEHGREGDAPGE

SEQ ID NO: 124535 - protein, 392 aa, Heterodera glycines
  misc_feature (382)..(382): Xaa can be any naturally occurring amino acid
  Coding regions on vcDNA: vcDNA=SeqID_50958; Strand=+; Position=1 -91,142-334,387-442,490-602,654-691,916-1031,1093-1191,1240-1366,1480- 1598
  Homolog annotation: Hit_ID=XP_322018.1; Match level="QueryCoverage =97%, HitCoverage=66%, E-value=1e-110, Identity=54%"; Hit description= ENSANGP00000012089 [Anopheles gambiae]
TNKSRIFYYHHPDLGNFHYGPQHPMKPARLAATHSLVLNYELATHSLVLNYELHKHLTCVHPPRATQHDLARFHAPEYVQFLKRISPNADQYEGLFNRFNIGEDCPVFDGIPVFDGIFDFCSLYTGGTLEGAIRLNHGQAEGAIRLNHGQAEIAINWSGGLHHAKKAEASGFCYVNDIVIGIIELLKCHPRVIGIIELLKCHPRVLYIDIDIHHGDGVQEAFNLTDRVMTVSFHRYGSYFFPGTGDMYDVGMGTGDMYDVGMGHGRYFSVNVPLREGMDDESYHSVFKPVIQAVVDNFNPSVIVLQCHSVFKPVIQAVVDNFNPSVIVLQCGADSLGSDRLGCFNLSFDGHGEECVRFVKSLGLPLLILGGGGYTLRNVARXITQKTKEEQN

SEQ ID NO: 124536 - protein, 1769 aa, Heterodera glycines
  Coding regions on vcDNA: vcDNA=SeqID_50959; Strand=+; Position=1 -5295,5623-5637
  Homolog annotation: Hit_ID=NP_502915.1; Match level="QueryCoverage =50%, HitCoverage=97%, E-value=1e-113, Identity=31%"; Hit description= predicted CDS, integrase, catalytic domain containing protein family member (4Q923) [Caenorhabditis eleg
MFEKFKILQIDEELCLSGKEKQFKELCTELKENAYVDNFVMMCDDEKEIKFKHYWSKEIFKLASMNLREFVSNHEQSNKEIQKMEGSEIPKMTKMLGIKWNVDTDELELQIKIPLMSRDTTKRQILTMIAKNFDPMGWISPVILKYKLFFQKLWRSNKDWDDKLNDEEIREWNNISNIDEVSIPRSPFTSQNLKCASLHLFSDASELAYATAAYLHANNKTDLLFAKTRLTPLKGLTIPKLELLGLLIAARAVKFIIKESKLKFETICIWCDSKCVLSWLKCKKNLPIFVKNRVEEIKRIVSEFHITFYYVKSADKPADLASRGTTMNEMKYNELWWKGPKWLKLGKENWPAHSFYTPEQNDSLYDVNIMEIENTQTNLVKMDYQGFIEWKKYNSWDKVTRICQILLKFVFFTLKDSPEFKTKFKIQKFQNELSLKFMAQKMLIRIIQKEMEPNNEEERQLGIYRDNDEILKCGGRLKNAQIKATNPIFLPRTHFGTHLIIMDHHQRNLHAGTMTTLAEIRKTYWIPKGRRIVDQIRKQCFYCKRYNAKPYQQPKMPQLPKSRVQITEPFQNVGLDYMGPLQIKSFTEKCWIILFTCFTTRGIHLELVTSLSIQHFLNAFRRFISRKGTPKIIWSDNASQLKLASKVLPEVLKLKEILKDDSIKNYFEKENIKWIFSIELAPWQNGAIERLNQNVKSAMKKAIGRKLIEFDSFQTLICEIEALVNSRPITFIYDEINSYQILRPIDFILPHKNLCIPPILEENETNDPTYLPKPTYYDQTIELWKKTTKILDDYWKIWTEEYLPSLRERYKTENKNPKNCVKSFPEINEVVIIHDETPRAMWKTGIIKNVITGKDGIIRGANVELPNKNVINRPLKLLYPLEINKNDCEENETITNLIKTTEHKQIGANRKRKQSVLSSPKLSKVFLNTLTFLLLFMQLLPCLSHLYECPKTNEIWRTKYTTFCVENGFTIRQNKLTMEFCYRKIFCHKQHVIKNHPPYCGPQCKCPDWTNSCSFASYHRIKREITDQENIQKIISFFKPNICSFNKTEKCSLMDKNIFSSIMLYDNSIHSVKSFNLLHTQANSRIDYRCLGEGNLTIGTQKFCQEHECTDTHGTKFCFYEPHEKTYLVKSDREIIPIKAWGSIERIFYLANDTLMDELKRKKREFDPFENEQISAECTKGGIKINPTHATTELEILVDKYFILKRSPQSEEFISLPTKITMNEYKPVIKFMKGTSVSEYKNLTCPPSPICELIICRFCMEYIRNPQCIGQMHWALILIMIMLTLYVITLSLKIIKILYRFTIFIFLSVYNCCRKRKLKKIKIIKRKQFIYLIMISLLLNSPTIFSCDEVTNMVAGTNDCAIDQNGKIECIYDQTTQISITPEHKTCLKLDNEKTHTTMETIELSVESLTIICAERSEYFMRDYQLLSSSQKRCSGAGKCTGQICQTLTMKGKNPEIGDHANNQPGYSYCVPSCGGWHCKCFLATDGCLFYRTYTEPIDRNIYEVVKCPTWTILATIKISLDPKTIHTVELKPGVLTHVKDSNLSLTLTSTSIPPTPLFGSKFIINRSNAKAVIVDNENLLKNSLRCETKEKATKFSCTFPPEACQCHGGDSVVHCECEKNPLTEMFTRKENILPLETHGSQVFFDTLLRAKIKLTTSLQVQVTLKGHKVKAIYDKNNCTVKTKSLEGCYSCTNGAEFKFTCTTNFGTALANVKCHSQNFQIPCDTKGNQQQIQLSFNQPSVKEKCEVICPDGKSEITMEATLNYLNIN

SEQ ID NO: 124537 - protein, 132 aa, Heterodera glycines
  Coding regions on vcDNA: vcDNA=SeqID_50960; Strand=-; Position=1 -268,633-763
MGTKMGTAQMGGRHKLGRHGNGQNVGTAQNGGTAQKWVKMWGRHRMGDGTKWVKMWGRHKLGNGTIGAAGIGEGWASGTDTSATRHGIGVCATLAFSNFLTFYYFFNIIHNLSHFNICLKSVISFNVQIIHN

SEQ ID NO: 124538 - protein, 16 aa, Heterodera glycines
  Coding regions on vcDNA: vcDNA=SeqID_50961; Strand=+; Position=1 -43,317-324
MPLNYTSIKKQLIEEN

SEQ ID NO: 124539 - protein, 133 aa, Heterodera glycines
  Coding regions on vcDNA: vcDNA=SeqID_50962; Strand=-; Position=1 -132,614-883
MSDCIWEIYTIFDKINSESEKVEVMWSEVDRSKDFDQVTKLEEKENENSSKHSMATCYKYRKQMRKFRIEIDDLFENIVSLAINYLNPPEESIKDKNDNNRNEIFFTPYRRNRIIHGQQLSEIFIVPIGGTES

SEQ ID NO: 124540 - protein, 192 aa, Heterodera glycines
  Coding regions on vcDNA: vcDNA=SeqID_50963; Strand=+; Position=1 -162,322-646,778-867
  Homolog annotation: Hit_ID=NP_500520.1; Match level="QueryCoverage =99%, HitCoverage=55%, E-value=2e-48, Identity=48%"; Hit description =abnormal RAy Morphology RAM-4, COLlagen structural gene (29.3 kD) (ram-4) [Caenorhabditis elegans] gb|AAA
MNCDAQVKAYKFVAYSALTFSLAAVLSVFIMMPLMYNFVSHVRRQLSQDMVLCQGSSSDLWREVEVLKNAPFIAHNGSTSSSFNTARTARQAYGGGAEVGAGPAHGAGAPAAGAGRAAAPGFCKPCCVPGPPGPQGRPGRHGKPGKPGAPGVPGAAGTGPAICEATPPPCPRCPQGPPGPPGELGPPGEVGA

SEQ ID NO: 124541 - protein, 161 aa, Heterodera glycines
  Coding regions on vcDNA: vcDNA=SeqID_50964; Strand=-; Position=1 -141,195-257,338-553,616-678
FHGQLLRLPLSANKTREELVPESIRRLCLKIILEREENKLPSDEDINDFVECLEASKDVTLQETEGKTSVLRTVGKSLTNILSPVTFFTAHFPDWHLHSEDFRIQIETIVEYLSLKIVFIRYRIKMAQYDPNSTGCLSREQLCDYYLHEVMPRVDVLKDLE

SEQ ID NO: 124542 - protein, 75 aa, Heterodera glycines
  Coding regions on vcDNA: vcDNA=SeqID_50965; Strand=+; Position=1-225
PGLKCPAQAKNFFYFREKIEIFPKKIPVDRARKTMFWKWSPFLWEKSLKNPKIQKPENRFLGLARKIFKIFEILK

SEQ ID NO: 124543 - protein, 185 aa, Heterodera glycines
  Coding regions on vcDNA: vcDNA=SeqID_50966; Strand=+; Position=1 -285,337-609
  Homolog annotation: Hit_ID=AAC95573.1; Match level="QueryCoverage =100%, HitCoverage=49%, E-value=3e-48, Identity=45%"; Hit description= orf 48 [Ateline herpesvirus 3] pir||T42963 hypothetical protein 48 - ateline herpesvirus 3 (strain 73) re
EEEEEDESGQAQDDEEQGDTGEETEAEESGEETENDEEGESREEKQEENSGDDKEEEEEAESRQEEEEEESGEKKEEKEEEESGEEKEEEEEEEKEEESGEEKEEEEEGESGEETEEEESGEEKEKEEEGESGEEKEEEESGEEKEEEEEEESGEEKEEEEEEESGEEKEEEEGGEEKEKEEEGE

SEQ ID NO: 124544 - protein, 173 aa, Heterodera glycines
  Coding regions on vcDNA: vcDNA=SeqID_50967; Strand=-; Position=1 -276,419-618,828-875
SDDLEKALRQIGRDDIVLHRMYGLDITGATAADIDDAWRTSASRGGTPIVSAASLRRDHSSKGSLAAATGGLAFAAAPTAAVALSQALSATPPSSTAGISPTPSSVAAEQQQQPMQQEEGNVETVVTRTERFVHHAQNGEAPIVDERVTEHFYRDGEEFLKSKHYDKIDSLKD

SEQ ID NO: 124545 - protein, 149 aa, Heterodera glycines
  Coding regions on vcDNA: vcDNA=SeqID_50968; Strand=-; Position=1 -108,467-808
MANISIKTLLLQRPGNGGGGANQWEIDATCTALYGGYPGKDLCVLAKKLAYLSVLNRAVSIPARPDGCWPLGQDRNKAVRRCIAEMRRRYDAETVKMADFILDERAKRHFMDEFAFERQAEEMKRAIEIEEDEWEGDEADKMTKWVSER

SEQ ID NO: 124546 - protein, 157 aa, Heterodera glycines
  Coding regions on vcDNA: vcDNA=SeqID_50969; Strand=-; Position=1 -133,193-260,496-567,661-841
  Homolog annotation: Hit_ID=YP_046862.1; Match level="QueryCoverage =89%, HitCoverage=27%, E-value=8e-38, Identity=51%"; Hit description =putative permease [Acinetobacter sp. ADP1] emb|CAG69040.1| putative permease [Acinetobacter sp. ADP1]
MKFSSKNSDNSAGRDFDQKLSNADLLPVEKQTWNAYNITALWMSVIHSVAGYIHSVAGYLTAGTLFSLRLASWQVFVVLILSVLITLFLCNLSSKPSQVHKIPFPVLCRAIFGIHGAHIPSLVRMLICVAYFGIQTFLGSKAFNVALLKLWPNVAYN

SEQ ID NO: 124547 - protein, 29 aa, Heterodera glycines
  Coding regions on vcDNA: vcDNA=SeqID_50970; Strand=-; Position=1 -69,142-162
MRDLKNLNFRLFIRIRVQDTLPAAVFVGR

SEQ ID NO: 124548 - protein, 116 aa, Heterodera glycines
  Coding regions on vcDNA: vcDNA=SeqID_50971; Strand=-; Position=1 -190,239-399
MKRRAATLTDATAEQHPEPKPQEETLKNVEPKDESVTKKRKVEDRELWKLAKGKFLLTTYLCPDDWNRLFNNQQKVKRVEGDRVCFSFDLCEECALANCRATDLLAPMKKRPKNDF

SEQ ID NO: 124549 - protein, 128 aa, Heterodera glycines
  Coding regions on vcDNA: vcDNA=SeqID_50972; Strand=+; Position=1 -108,189-267,318-421,466-561
MPNRNNINGQQHHHLSSASTNDNSQHFTAVHHCFDFAFKMAIVARRLLKNRAIQKQLERRQKNMKTLRRQQAAAAGQSSIVVRSVSTGLPRNQPIHQRQQVCTVPSHEVIYDVPCTGEDQQEGSEDSF

SEQ ID NO: 124550 - protein, 68 aa, Heterodera glycines
  Coding regions on vcDNA: vcDNA=SeqID_50973; Strand=+; Position=1 -54,116-268
MPDERVLHLECFESGDYDIMELYGPDRAKEMLVDLRDYAEAHGMPCQHVKMLLYKLDKGLIKWKGTKP

SEQ ID NO: 124551 - protein, 368 aa, Heterodera glycines
  Coding regions on vcDNA: vcDNA=SeqID_50974; Strand=-; Position=1-1107
MAPEEIPLAEETKLAKGVRTDRQLLQRSIDRVNGMLRECFDHIQLLGDPFLKQAEEDLLAALPTFDDEQADPNVEEWPVITLLSKAQLILDGLQVYIEARFDTTDAISSRSSSRVSDHGADDENRIHRQRQSTDPPTQAQPVNAHQPSNSARADQTLFNQRTPAFPLNLTFPRASNRPTHRSEPHHGHFRQSTNDDDALRVSRIEIPRFSGSAEEWVTFWAAFDFAVHSRQYPAFQKHLLLLQYLEKGSPPRRMIEGYPPSDANYSTVVSILRDRYGDVGNRRDQLNAQLLHLKPARNNLKELRQLQQEIERICTQLCSLEPEGELSPIANSSLVTNLIKSKLPPPVLLELIRMERESYTSWTAQKLA

SEQ ID NO: 124552 - protein, 26 aa, Heterodera glycines
  Coding regions on vcDNA: vcDNA=SeqID_50975; Strand=+; Position=1-79
MEGKEEIRDSLKRAATQIGDGEGERK

SEQ ID NO: 124553 - protein, 436 aa, Heterodera glycines
  Coding regions on vcDNA: vcDNA=SeqID_50976; Strand=-; Position=1 -174,436-1572
MDEQEIHNQLLNVNEQLRELNAEDERRLLDESNRNRGANRDENLLNPGLIQQNQIAGNVGGIPIQQNANNQQQFGINGMLPPPFFWPQFPMQNLQQPMQFYGAQNLGPQLPAQNFSTFFNNQMPVMFPPQNVQYPNTAINPARQMVNQQAVNQREEGQNRQQQIFPQQTSLSGLEYAMILDRLPDIRGNEGGDSIRNFFKKYSQYTADWPNKKRIESLEAKLSGRAERAYNAALANEPFVYENVKRNILQQLEDTDCREMSAFNDLMNGVTRKHGENLDDLADRISSLVRRAYPGLTRNLADEYSIKHLIRSLNNPDLALNLELHRRNVMSFDEFVALASRAEATQMAAKRQSSEHRPNQERKYMHPNNREVETSSKNQLRPYQVVCYTCNEPGHVSRNCNKTMSRQNRTNSHRLFLSRINSKPQILLPLGQTEFS

SEQ ID NO: 124554 - protein, 169 aa, Heterodera glycines
  Coding regions on vcDNA: vcDNA=SeqID_50977; Strand=-; Position=1 -71,152-324,617-759,1099-1221
MLKGAKHADHTKHVDDDEEEEEEEVLGRTHAKVFSAHLHFMNRIDFYESKAGTGETSKTSGFLGFELRASKKNCASASSANYFVLSNDTKNILGLFDHEQSYCMKTRYYQLIRLIKYLWTHKSRLDLEPLFSFEGVGRINLCSNILRLLFSWSAKFLLMTLKIICDCFT

SEQ ID NO: 124555 - protein, 18 aa, Heterodera glycines
  Coding regions on vcDNA: vcDNA=SeqID_50978; Strand=-; Position=1-54
MATSGFGDYHPDTDSWME

SEQ ID NO: 124556 - protein, 46 aa, Heterodera glycines
  Coding regions on vcDNA: vcDNA=SeqID_50979; Strand=-; Position=1 -108,218-250
MLFSAFANLGRTLTEYCCVLWPKLLKWLRKILKKEENILFSNKYPK

SEQ ID NO: 124557 - protein, 72 aa, Heterodera glycines
  Coding regions on vcDNA: vcDNA=SeqID_50980; Strand=-; Position=1 -60,110-268
MDQKAESFVHMKEIEDTTIWFLINLLAHIALIASVICWLLTGSLVFRLIDSEIGAKSFPRSVIWCFQLLTTM

SEQ ID NO: 124558 - protein, 179 aa, Heterodera glycines
  misc_feature (14)..(14): Xaa can be any naturally occurring amino acid
  Coding regions on vcDNA: vcDNA=SeqID_50981; Strand=-; Position=1 -144,605-751,806-824,1187-1224,1313-1487
  Homolog annotation: Hit_ID=CAE69355.1; Match level="QueryCoverage =91%, HitCoverage=89%, E-value=2e-49, Identity=56%"; Hit description =Hypothetical protein CBG15444 [Caenorhabditis briggsae]
FSKIVPTNLFNANXVFFALESLGTLAIVGNCCLVVVLMRNRYLQRASFVLMLSLALADILHGIVTTTFFYPPILLRRVVIPAIGVRIFNVIDWTAWSITLTHSITLTHMSAICLDRLLAITLYGQYSQLITVRRAKLFTIFCWATFSTLNTVYILARFCCLISPLAESHFYTFGYGEFE

SEQ ID NO: 124559 - protein, 220 aa, Heterodera glycines
  Coding regions on vcDNA: vcDNA=SeqID_50982; Strand=-; Position=1 -156,295-585,990-1205
  Homolog annotation: Hit_ID=YP_050229.1; Match level="QueryCoverage =90%, HitCoverage=53%, E-value=4e-27, Identity=35%"; Hit description =ABC transporter, substrate binding protein [Erwinia carotovora subsp. atroseptica SCRI1043] emb|CAG75036.
MTLGISINKNLVSNSTNPPTYGDLLQSAEFANGTVGTADPNHDDAVLFIYKQIVDKYSWQWLEQFAQRNQLITCGGVQLQQALENGTLKAIIGGFGSYPNNAGAATEYVIPADNDPFTAYAIYGAILKDAKHPEAAKLFMSWQLDIDGPNAVQTWPVRTDVTPKDNRRQIWEYPNTSHQKFLEFMSNVEERQRFGRQVALFLDDTKCNFASFVPGVRPLQ

SEQ ID NO: 124560 - protein, 933 aa, Heterodera glycines
  Coding regions on vcDNA: vcDNA=SeqID_50983; Strand=+; Position=1 -70,121-350,394-1450,1493-1860,2094-2295,2339-2892,2936-3256
  Homolog annotation: Hit_ID=NP_001004509.1; Match level="QueryCoverage= 86%, HitCoverage=59%, E-value=4e-85, Identity=28%"; Hit description =si:busm1-180o5.3 [Danio rerio] emb|CAD60788.1| novel protein similar to DNA polymerases [Danio rerio]
MSRFCPLAQIKESGRLNTPKGKFSLFYALEIARSYQLIGKSITENKFRYLMKTEKKQREMAMELMENAGIRNFGTQHLEAVQKYWDREFPDMFRIVAFEMKTGLRPIFKGEGVRKNEVGVIREGDHWDGIKSASWFFGVRYFCVSCEVTYDRPERHRMECKERCKKCCRMGFGFPCADDSPEINCDECHRDFYNIQCFEEHKKLACKEYKKCENCGETHNTRNKHTCGEKFCKLCKVCHPGRQCFIKKIQVRPQKTYRIVAYDLETTVDGGEHRPNLVSAARTCNICAGEERECEICEGPSKITWSVADGFEPMSEFIVWIMGFQRFETIAFAHYAGRFDSHFVLSELTKKEIATELMMADLKIYQIKAGRVYFRDFWMLSQNKLADLPKTLGLKTAAKLYFPHKYNKNENFGKRLPNLPSLGDYCPDNMKEEEAVKLEAWHNENFQTEFELGEQLKTYCENDVEILMESILKFRQLFLGITGDLDVMKDSVTIAGVVMKIFRAKFLKDRHIPIMPEGGYEKAENQSKIAVKYFEWLAQKKGVKVRHACNGGEVEFGGLKVDCVIGAEKKIIEFQECDVREELKKNKEMKKFFESVPDKGPINPRDAYAGGRTMPFCLYAKATEEVEISMFDIISLYPFVNYGTPYPVGVPKIVVSRDFNVNWTTPDDVPYDGLLKVKVVPPKNLLYPLLPVHIDEMLLFPNCWSCARRAKNEFVMTKDVKKCNHRPPQRAFLGTFTSIELRKALELGYRIVGFYRAYHFEQFDSQLFKGYVRMFLKIKVEASGWPAEVKSEDEKRAFIEMYKAKYDINLAYDKIGLNPGLRMIAKLGLNSLWGKFSMRNTLSNTEIVGSMERWMELGRDNTIEFGRPVKISEEISRVVYRKKEEFIREHKVSNIVLSLWTTSAARLKLYEYMEQVYKKEGCKLLYCDTGEKE

SEQ ID NO: 124561 - protein, 148 aa, Heterodera glycines
  Coding regions on vcDNA: vcDNA=SeqID_50984; Strand=+; Position=1-447
MYSFQKYFEEALEKEDFFWQKNRAEVEALLIEASNYKIIIHRDYESRYSDYIATYHRTPLFCFCMIERNLRFFYDTGTGTPIGRVTTVLHVTVEASYTGEGFISPMFSFWFYWEGRSQTTNESFTSRLYLYTVSMLRAMGKAWAENYF

SEQ ID NO: 124562 - protein, 61 aa, Heterodera glycines
  Coding regions on vcDNA: vcDNA=SeqID_50985; Strand=+; Position=1 -102,509-592
MQTIAEIKNFEIVDGGRIFVVRARIENVMEAEYRFGSCWSERKVVAFQKKKKSNLPVPEEL

SEQ ID NO: 124563 - protein, 133 aa, Heterodera glycines
  Coding regions on vcDNA: vcDNA=SeqID_50986; Strand=+; Position=1-402
  Homolog annotation: Hit_ID=XP_146481.3; Match level="QueryCoverage =98%, HitCoverage=14%, E-value=8e-18, Identity=38%"; Hit description =PREDICTED: similar to carboxylesterase 2; carboxylesterase ML3; acylcarnitine hydrolase M1 [Mus musculus]
REGKDENSIGEGGETEEKERKRKNSKQEGGEKEEEKDENSIGEGGETEEKERKRKNSKQEGGEKEEEKDENSIGEGEETEEKERKRKNSKQEGGEKEEEKDENSIGEGGETEEKERKRKNSKQEGGGERGGKG

SEQ ID NO: 124564 - protein, 19 aa, Heterodera glycines
  Coding regions on vcDNA: vcDNA=SeqID_50987; Strand=-; Position=1-58
GLLGSWVRVPPGELPFMFY

SEQ ID NO: 124565 - protein, 47 aa, Heterodera glycines
  Coding regions on vcDNA: vcDNA=SeqID_50988; Strand=-; Position=1-180
AQLLTMQSKKHINNVREQMIYTELNSSLKMRAAQIPTQKPRALFTKD

SEQ ID NO: 124566 - protein, 169 aa, Heterodera glycines
  Coding regions on vcDNA: vcDNA=SeqID_50989; Strand=+; Position=1 -127,172-260,509-541,587-844
  Homolog annotation: Hit_ID=XP_314111.1; Match level="QueryCoverage =57%, HitCoverage=17%, E-value=2e-30, Identity=60%"; Hit description =ENSANGP00000010393 [Anopheles gambiae]
MGDGQILTVISAPPDASKLNFNSLRSSESTSSDEVLVNELTKDLLPALRRTRTRTISSSKGEEDIVTTESGQVTVLAMDSFYKVLNEEQHQLAAKQEYNFDHPDAFDFELLRESLVRLREGKSVEVPVYDFSTHRRAKNPKLMYGADIIIFEGILSFHKSEISDLMDLK

SEQ ID NO: 124567 - protein, 82 aa, Heterodera glycines
  Coding regions on vcDNA: vcDNA=SeqID_50990; Strand=+; Position=1 -56,436-496,538-671
AVPTFSKTAKEAQNKRRGVIKSWSKKSPKNRMAKDIFEAIFVEAEELKATFGIEKGSNGKRLRMEPNFVAHTNMYCKRMESD

SEQ ID NO: 124568 - protein, 107 aa, Heterodera glycines
  Coding regions on vcDNA: vcDNA=SeqID_50991; Strand=+; Position=1 -166,257-414
  Homolog annotation: Hit_ID=EAL26119.1; Match level="QueryCoverage =90%, HitCoverage=25%, E-value=4e-09, Identity=39%"; Hit description =GA20943-PA [Drosophila pseudoobscura]
MSLYKEDVYETEDPPNAEPIETVEKFESEEVEKVHMSMGAAKKRFDHCLLDSEGADFSDSVGVRRLKRGFKASEVFESETIGSEEEETLEQKFNRLNREIRNLAARS

SEQ ID NO: 124569 - protein, 43 aa, Heterodera glycines
  Coding regions on vcDNA: vcDNA=SeqID_50992; Strand=+; Position=1-132
SQNESPSVKKEDVVALDELLKTIASNCKKEGRQPISHGRSEES

SEQ ID NO: 124570 - protein, 153 aa, Heterodera glycines
  Coding regions on vcDNA: vcDNA=SeqID_50993; Strand=-; Position=1 -61,319-718
MEHLYHTRMELPIAHIYGFTGELLTGMDVDGSELNSEYLVTRWPIVRALVGQLKAEFNTLVVEMALWDMEQGIKQFVVANAQTDQAKILKQMMLWDWMMEYKQFIVEMDENDQTKIVDEMKEKFNKFVDYDDPKKGGGTIQEKILEYFHTKLQ

SEQ ID NO: 124571 - protein, 25 aa, Heterodera glycines
  Coding regions on vcDNA: vcDNA=SeqID_50994; Strand=-; Position=1 -51,92-118
MGTAHTFGHLLIVWPKKRPNNSNSF

SEQ ID NO: 124572 - protein, 268 aa, Heterodera glycines
  Coding regions on vcDNA: vcDNA=SeqID_50995; Strand=-; Position=1 -499,861-1005,1319-1482
  Homolog annotation: Hit_ID=CAE62158.1; Match level="QueryCoverage =95%, HitCoverage=68%, E-value=2e-76, Identity=39%"; Hit description =Hypothetical protein CBG06205 [Caenorhabditis briggsae]
TKIDNSHENNTKLRTLGAERMDSGTYKLIATNEHGQDEAEVLVVVLDVPSPPNGPLEARDVTKDSATVKWYMPDDDGGSPITHYAVERQEGDGGRWVPCGETPDTQLRVNRLVEGKEYKFRVKAVNRQGESKPLAMDRGVVAKNPWEAPGKPQDVKVVDWDKDHMDLEWKPPISNGGAPIDGYVIEKKTKTGLWTPCAHVTGNQCKGTASGLVPVPCQSDKQGGRGRTVRPDRAQNGEATSTGAQAEPELADGHPCPGWATDHMHAEF

SEQ ID NO: 124573 - protein, 311 aa, Heterodera glycines
  misc_feature (307)..(307): Xaa can be any naturally occurring amino acid
  Coding regions on vcDNA: vcDNA=SeqID_50996; Strand=-; Position=1 -106,488-548,605-772,820-969,1361-1722,1812-1849
  Homolog annotation: Hit_ID=CAE62158.1; Match level="QueryCoverage =99%, HitCoverage=68%, E-value=3e-98, Identity=39%"; Hit description =Hypothetical protein CBG06205 [Caenorhabditis briggsae]
VVKRALRTDTGTHFITARNDSGTDTAQVLVTVLDRPGEPRGPLNISDVNKNGCTLDWKPDWKPPEDDGGAPVSHYVVEKQDLATGRWVPAGESTEPRIALDDLQPGHEYKFRVKAVNRYGESDPLEAVNRYGESDPLEAPKSMVAKDPFEKADRPGTPDIVDWDKNWADLKWTPPTDDGGAPLEKYVVEKRLGNGEWEYATEVPASKTDARVDGLVEGKQYQFRVKGVNKAGESAPSNPSRTLLAKARRLAPKIDRSAMPEIRIKKGGTIEFNVPVDGEPDPKCQWLINGTQLGTSDRVVFYKNNFXTFFK

SEQ ID NO: 124574 - protein, 44 aa, Heterodera glycines
  Coding regions on vcDNA: vcDNA=SeqID_50997; Strand=+; Position=1 -41,163-256
MNVGHIEWTFRCASIFMWQKLTNYVDLNTLFCFTIFVCGTNHLI

SEQ ID NO: 124575 - protein, 300 aa, Heterodera glycines
  Coding regions on vcDNA: vcDNA=SeqID_50998; Strand=-; Position=1 -266,717-959,1287-1560,2768-2827,2967-3025
  Homolog annotation: Hit_ID=CAE62158.1; Match level="QueryCoverage =100%, HitCoverage=68%, E-value=3e-99, Identity=34%"; Hit description= Hypothetical protein CBG06205 [Caenorhabditis briggsae]
PPRIHREDLSDLVVRPGEDVKFNVHIDGEPPPTVTWTYEDGQALPSCANVQDQDYLSKFAMVKPTRAQSGKYTVTATNPNGSDSVTVTIAVKSRPTAPKGPLEVSDVFENQMTLDWKPPEDDGGEPIQYYEVERQDERDGIWVPVGTCSDPHMVVDGLAKGANYKFRVKAVNAEGKSDPLETDKSTLAKNPYERPDKPNAPELVDWDADHVDLKWDPPANDGGAPVEQFVIEKRSKYGRWEPALTTDGNTTAGTVDGLTKVIRATNENGEAEKRVQVDIIDKPGAPEGPLNVSDVHADRC

SEQ ID NO: 124576 - protein, 159 aa, Heterodera glycines
  Coding regions on vcDNA: vcDNA=SeqID_50999; Strand=-; Position=1 -28,214-525,905-1045
  Homolog annotation: Hit_ID=CAA33463.1; Match level="QueryCoverage =98%, HitCoverage=72%, E-value=4e-52, Identity=39%"; Hit description =twitchin [Caenorhabditis elegans]
FNKKPKSSAILISELTLKVGQSVDFKVPVTGEPPPEKVWTFNDAPIADDKLRIANEDYKTNFSIRNATRAHAGTYTLTATNESGTDTHGVLVNVLGRPSAPEGPLEVKDVLEDRMTLDWKAPADDGGMPVDHYEVEKLDMASGRWVPCGRCTEPGITVT

SEQ ID NO: 124577 - protein, 54 aa, Heterodera glycines
  Coding regions on vcDNA: vcDNA=SeqID_51000; Strand=+; Position=1 -55,165-274
MSISTNSTNIGKFSFDDYEMNYDELSILKEGAVVNTNCESFTDQQQLKAEKHRN

SEQ ID NO: 124578 - protein, 344 aa, Heterodera glycines
  Coding regions on vcDNA: vcDNA=SeqID_51001; Strand=-; Position=1-1036
TSPADLSSQSSGMAKVANRKRNERRIRAVQDLARHLNHRMNRHRHRQRDGKRDPSEERHIRMTAERYADQLSRLGDDHIHRLQHQFPQLPNPRRRRSEVGGNLKGGKSQPKLASMVVRPPQGELLPSKDVGGAAPGASNSHGRNENEEEGREMAEKERGSRPRVLPPPGDSFGELLEKEAKARAEVAELEARAKKAKMEREEEEQKLKSAKEARLRDLGTQADDLRQMLGDASWPWSRGKDGKNGEAVAPRAGKAVAMPAVPMEDDGVSLADSEMEVVPAGGSVARSDEMTKTGGRSAPAKEFSISSIFAFIFSISFFIFPFSASIFASSAFVSCCFNFSWSPF

SEQ ID NO: 124579 - protein, 57 aa, Heterodera glycines
  Coding regions on vcDNA: vcDNA=SeqID_51002; Strand=+; Position=1 -99,741-815
MMIFLINDQWNTNEKNLIIFPFFFFYTKFGLKHHIVINFSVVKLLLHKTVVYLLITL

SEQ ID NO: 124580 - protein, 51 aa, Heterodera glycines
  Coding regions on vcDNA: vcDNA=SeqID_51003; Strand=+; Position=1 -94,158-219
MLIISPAFPEQNISTLINPTDARKIKNEFKNAFETIRALKEDEYVGEIFGQ

SEQ ID NO: 124581 - protein, 114 aa, Heterodera glycines
  Coding regions on vcDNA: vcDNA=SeqID_51004; Strand=+; Position=1 -57,258-545
MREIVHIQAGQCGNQIGSKVANTCPVLFLSILSLALWIQSELERTDNSFGRTISFLDRVARETIGQKAITRRVLSWWTMCWMLCGKKRKAVTVCRAFNSLIHSEEAPAQEWALY

SEQ ID NO: 124582 - protein, 107 aa, Heterodera glycines
  Coding regions on vcDNA: vcDNA=SeqID_51005; Strand=-; Position=1 -213,257-311
  Homolog annotation: Hit_ID=NP_502658.1; Match level="QueryCoverage =71%, HitCoverage=50%, E-value=3e-29, Identity=77%"; Hit description =IscU (16.5 kD) (4O549) [Caenorhabditis elegans] emb|CAA16379.1| Hypothetical protein Y45F10D.4 [Caenorhab
NSFSLTRLFPTLVFHRHGNIQLLQIAAYHEKVIDHYENPRNVGSLDKNDPSVGTGIVGAPACGDVMKLQIMVDGNGQIIDAKFKTFGCGVDGNGQIIDAKFKTFGCG

SEQ ID NO: 124583 - protein, 94 aa, Heterodera glycines
  Coding regions on vcDNA: vcDNA=SeqID_51006; Strand=+; Position=1 -12,403-487,873-1060
MNQQVHAFRAAKDALLVRVENSAGANLRVLFQGISAEFNIPNDIGIVEWLEENDPTNYGIVEFRAQMHALHLELIGNGNNELLGAATACMFLGN

SEQ ID NO: 124584 - protein, 25 aa, Heterodera glycines
  Coding regions on vcDNA: vcDNA=SeqID_51007; Strand=-; Position=1-116
LKYSVYVAQKISYSELIAFSKPLNS

SEQ ID NO: 124585 - protein, 49 aa, Heterodera glycines
  Coding regions on vcDNA: vcDNA=SeqID_51008; Strand=-; Position=1 -69,149-229
MIENGIRGPLNFYIPTDGTHVKYDGNMLGLKYCKIPENIIYCKGNFGSL

SEQ ID NO: 124586 - protein, 72 aa, Heterodera glycines
  Coding regions on vcDNA: vcDNA=SeqID_51009; Strand=+; Position=1 -76,323-465
MTTAAFLPLLKKAASAGEFARVVNIGWVKTEMGGANAMMSVSDSVAKIMARICALTKSDSGKLLYGEKELLP

SEQ ID NO: 124587 - protein, 157 aa, Heterodera glycines
  Coding regions on vcDNA: vcDNA=SeqID_51010; Strand=+; Position=1 -74,299-396,441-646,697-792
MLALSIGQMSPDNLSVDNPSVMDNVNKCFDKIFWCEQSLQMYCSLHTCNIMTMNGGVMLFDSIEKIREHIEIAIAPAAGAHETEKYMNNLDLASVSKLFGINIIVCEKVSKEIFRWQVYSPNLEISLSISQKKSSHSIFLYYHDAHFELIKQPQKIK

SEQ ID NO: 124588 - protein, 418 aa, Heterodera glycines
  Coding regions on vcDNA: vcDNA=SeqID_51011; Strand=-; Position=1 -32,79-120,169-246,299-437,483-584,639-731,778-833,890-920,965 -1077,1140-1245,2732-2783
  Homolog annotation: Hit_ID=NP_492429.2; Match level="QueryCoverage =87%, HitCoverage=44%, E-value=1e-77, Identity=46%"; Hit description =acetylcholine receptor (63.2 kD) (acr-19) [Caenorhabditis elegans] emb|CAB07843.2| Hypothetical protein C
INSIWKPDVLLYNSVDQRFDTLWLYNSVDQRFDTLWPVNAIVMFNGSVTWIPPDIIRSSCPVNAIVMFNGSVTWIPPDIIRSSCRIDVTSFPFDDQTCIMKFGSWTYVTSFPFDDQTCIMKFGSWTYSGFSTDLFNSSVSLDPYTPNGEWHLLSVSSVRNYLVYDCCPEPYVVSSVRNYLVYDCCPEPYVDVTFHISVRRRTLYYGVNLVLPVNLVLPSLLISSLALLGFSLPPDSGEKLNLCVTIFMSLCVFMLMVAETMVTIFMSLCVFMLMVAETMPQTPQTSDTLPLIEVFFTCVMFEVGASVICTVFFTCVMFEVGASVICTVIVLNFHHRKADSYFPMPKWLRILLLDFFPILLFMRRPPLRILLLDFFPILLFMRRPPRVKLPNCDDGENDQNKKRQREKVIREHRERERK

SEQ ID NO: 124589 - protein, 82 aa, Heterodera glycines
  Coding regions on vcDNA: vcDNA=SeqID_51012; Strand=+; Position=1-249
MAIPAMIASVPSTKLLGCSKICMAKEKQMIKLCCSNKHPKDWLLRLCPALGGNDCTIGQQNHVESDQRSPRGHHSRTFFDEI

SEQ ID NO: 124590 - protein, 89 aa, Heterodera glycines
  Coding regions on vcDNA: vcDNA=SeqID_51013; Strand=-; Position=1-270
MGRQRQKAEESAEERPIAVQGIGTCPKLAIPSDALIAQNGRRAAPNQLRPYWVADQLESIYHLFQSPSTHPRPGPKAKGGEIRAEIVEE

SEQ ID NO: 124591 - protein, 57 aa, Heterodera glycines
  Coding regions on vcDNA: vcDNA=SeqID_51014; Strand=+; Position=1 -25,76-224
MGIYLFVISGFSKEERTNCKPQKKIKYKEKLFGDYQTNFRDEQRKRAKERATDWDLE

SEQ ID NO: 124592 - protein, 155 aa, Heterodera glycines
  Coding regions on vcDNA: vcDNA=SeqID_51015; Strand=-; Position=1 -212,579-836
SKSEKVPPPADFDSDLRSALAKRRSKVQQKGENEAGTSGQQNNETMPSSTCNTTSENNDNSRNNGNGVTMLHFLAHFAGAQRLRRHRTTEPKPSKPPPFPTFTGAPVSACSAPRLRSQSANGGGGERSAVARLSARTVGAARGIATTGTKKPTNC

SEQ ID NO: 124593 - protein, 136 aa, Heterodera glycines
  Coding regions on vcDNA: vcDNA=SeqID_51016; Strand=-; Position=1 -127,204-489
ITEPGAVRRVLHYGLGELELDRLVGAFDQCGQMMRFQCKGGGPTFDALWGGKSAVRLVRDAQRAARAAVGRRTALLARLHVRNERLVHGAQVKRTDQNLKFGMPSRLKTNPSAEKALNTFPGAAIVTAATTRWTLA

SEQ ID NO: 124594 - protein, 181 aa, Heterodera glycines
  Coding regions on vcDNA: vcDNA=SeqID_51017; Strand=+; Position=1 -96,135-252,468-628,667-837
MPKQNEIVLKYSFLDLTWFLDIEAVFYAISKTKKCLVVKTIFHISLHNFVSSARIETGIRPLERAARALQEVKKLFEFLQFCFHNFRKLFGIIMPKQNEIVLKYSFLDLTWFLDIEAVFYAISKTKKCLVVKTIFHISLHNFVSSARIETGIRPLERAARALQEGMERKNSYFWDFFRNQN

SEQ ID NO: 124595 - protein, 256 aa, Heterodera glycines
  Coding regions on vcDNA: vcDNA=SeqID_51018; Strand=-; Position=1 -242,510-638,691-726,1114-1297,1721-1773,1831-1888
  Homolog annotation: Hit_ID=CAE60539.1; Match level="QueryCoverage =93%, HitCoverage=24%, E-value=3e-60, Identity=47%"; Hit description =Hypothetical protein CBG04166 [Caenorhabditis briggsae]
LNWPEYNLYRGMVKSHKNGSKTVLDSFMIIVTYHGVELREWHERAVMMQRWRKVADNYVKDFNVSVLHDDGLFLDLLENMPTDIWQSALGTLVCMSIICAAFMNFNPFVVAVTSIVIACILTGTLGIMALIGMTITLGIMALIGMTIDPVVMAAVIISMGFSVDIPAHVSYHFHIAKSEDGQRQRTIEERIRMSFASVGFPAVQASTCTNICILCLLVVPVYPAQVFVRILCTCITLCVFVRILCTCITLCTIHSL

SEQ ID NO: 124596 - protein, 54 aa, Heterodera glycines
  Coding regions on vcDNA: vcDNA=SeqID_51019; Strand=+; Position=1 -147,413-430
MDHIFEQIQEETVIMEHGHIEILHIIVGHLAPPLHHHRPFMPLPQLHAMSLAMS

SEQ ID NO: 124597 - protein, 156 aa, Heterodera glycines
  Coding regions on vcDNA: vcDNA=SeqID_51020; Strand=-; Position=1 -209,541-802
MITRCNNKNCFFISDYKSLNIMVTNFDVTIGEERARKAGQERASKAWEWLFNVLPTFDRSIADLLWTHINANYNINSISVLLENFEKAEFISLTSDDFYSNLSVLREYGGGTGMCGVSSVQVYEKLGKFFSAGVVTYYYAGSFLHQCESFVILFFV

SEQ ID NO: 124598 - protein, 117 aa, Heterodera glycines
  Coding regions on vcDNA: vcDNA=SeqID_51021; Strand=-; Position=1 -51,299-433,774-941
MKYVKTILAVFSSQLSLLTFGSICANITFEGEKARMEWYLGRLSKNAQMILDNVEPYVSGELLKSFPKIENAVAKEVIDEMTFTQPVTDNATIFQIATNVFEILDEYGHRKSACIFR

SEQ ID NO: 124599 - protein, 193 aa, Heterodera glycines
  Coding regions on vcDNA: vcDNA=SeqID_51022; Strand=+; Position=1 -183,461-859
  Homolog annotation: Hit_ID=NP_510658.1; Match level="QueryCoverage =89%, HitCoverage=45%, E-value=8e-17, Identity=32%"; Hit description =TBP-Associated transcription Factor family member (taf-3) [Caenorhabditis elegans] emb|CAA94113.1| Hypoth
MPKIAGVHRHHHHKHQMNGAHKQNKGPNGAKKEKYKSMAARELGQNVRKDQQKGHNKQKAKKNSNRKKKEKKKKLKEKAKELAEKALLKALDKVKLGKSEEKEKLKRALKKEMGREEEKENKEMEREEKKQTDKERKKETENEKKEKAEREQVNEEIDARESRSEVSSAREKSRLFGDFGHGFINGLFETQLI

SEQ ID NO: 124600 - protein, 59 aa, Heterodera glycines
  Coding regions on vcDNA: vcDNA=SeqID_51023; Strand=-; Position=1 -79,150-250
MTEILAKVWNKICSVSSIVYLKNGKILNYNEKTATKEQLINSTYKKSIFKTPYEITTRD

SEQ ID NO: 124601 - protein, 103 aa, Heterodera glycines
  Coding regions on vcDNA: vcDNA=SeqID_51024; Strand=+; Position=1 -169,559-701
MVNYALHKMVPVLVGDQSVLVSFELLAEQLADLGPGQINDELNKMGISMNQGRVSIVPNVMHLNDETSVAIDAQLQKAFFSTVDNCTQNLENSQHQQKTFSAK

SEQ ID NO: 124602 - protein, 244 aa, Heterodera glycines
  Coding regions on vcDNA: vcDNA=SeqID_51025; Strand=+; Position=1 -92,388-463,517-1083
MVVIGQIDALNDVFAFVTDVNGKEFRVPRELIFDSSVSEEAMEENETEQKANGNVKLHVEVKRSGRKNKNGAEIYCSDNFPLVIDSSGLLNRFLEDEPIIRHAPDRKFGVWCAPRKYSIDGIQWKIVRIDPESKPKKSVPNGVSKMNGRSKECVSNGGQTDECISSSPSTVPSLPSTTVRNSPKLEEEEEKVDENELFEGLICSQNETHFLVFSPGRRWLGRLDKAKCGKDSASILGMWIQFKM

SEQ ID NO: 124603 - protein, 212 aa, Heterodera glycines
  Coding regions on vcDNA: vcDNA=SeqID_51026; Strand=-; Position=1 -38,108-386,429-489,532-715
  Homolog annotation: Hit_ID=NP_496465.1; Match level="QueryCoverage =98%, HitCoverage=37%, E-value=1e-45, Identity=44%"; Hit description =d-lactate dehydrogenase (53.4 kD) (2L830) [Caenorhabditis elegans] emb|CAA91337.3| Hypothetical protein F
GAYSFNLLIETSGTDSEHDLAKMDRFLDRCIGDALAADGVLAKNMSEAEHMWKIRENCSLGLRQDGYVFKHDISLPLEHFYEVTEQIRERCETNVRRICTFGHLGDGNAHLNVTVDGNAHLNVTVPTFDEDVYQRLYPFIYETVASTGGSILYPFIYETVASTGGSISAEHGIGLLKREYHHKLIDQKRRMFSSGIKRLFDPRLILSPYKMI

SEQ ID NO: 124604 - protein, 109 aa, Heterodera glycines
  Coding regions on vcDNA: vcDNA=SeqID_51027; Strand=-; Position=1 -176,220-251,725-845
  Homolog annotation: Hit_ID=CAG81820.1; Match level="QueryCoverage =76%, HitCoverage=15%, E-value=1e-15, Identity=48%"; Hit description =unnamed protein product [Yarrowia lipolytica CLIB99] ref|XP _501517.1| hypothetical protein [Yarrowia lipol
MALLKCAIIRGLLHTFNGRHLFSTVIERRGEFAELTEDDLRNFRGIVGDRCVKTEEIDEYNTDFMRWYTGRSQCVLLPQSVQQVSAVLKHCFHRRLAVVPQAGNTGLVG

SEQ ID NO: 124605 - protein, 35 aa, Heterodera glycines
  Coding regions on vcDNA: vcDNA=SeqID_51028; Strand=-; Position=1 -10,361-458
MKLSTNDSVPYLSMALSWGERRHFVMTENLSLGYT

SEQ ID NO: 124606 - protein, 70 aa, Heterodera glycines
  Coding regions on vcDNA: vcDNA=SeqID_51029; Strand=+; Position=1-211
MLIAFVRNDQKMQISEYSKQKYEAYLGTIYFMSKNWQCDKIADEFKNMNGQNAKNLAKYLDYFVRDICLE

SEQ ID NO: 124607 - protein, 92 aa, Heterodera glycines
  Coding regions on vcDNA: vcDNA=SeqID_51030; Strand=+; Position=1 -47,501-732
MMSDRKRGTNQTTKILILPLTNRSVLPFPAPPLKCLSTSESENKMENDEPTEAAKLAEEFATKNLTTKERMDAILKMISGRSGEEGAEEEEE

SEQ ID NO: 124608 - protein, 91 aa, Heterodera glycines
  Coding regions on vcDNA: vcDNA=SeqID_51031; Strand=+; Position=1-274
  Homolog annotation: Hit_ID=ZP_00195010.1; Match level="QueryCoverage =96%, HitCoverage=20%, E-value=5e-17, Identity=52%"; Hit description =COG2008: Threonine aldolase [Mesorhizobium sp. BNC1]
MINLSSDNWTGCHSAISDALSRHSTGADAAYGDSELDKKVERRFCEIFETELAVFLVGTGVAKLALFMAKFPLFAPGTAANALSMAYVNRA

SEQ ID NO: 124609 - protein, 67 aa, Heterodera glycines
  Coding regions on vcDNA: vcDNA=SeqID_51032; Strand=-; Position=1 -91,913-1025
MYTCAYVFTNSDFDFYTSAELLNMRAPPFYAKGSKRRAAAAVGGAVRHARVAASAARRGLSMGRLIE

SEQ ID NO: 124610 - protein, 239 aa, Heterodera glycines
  Coding regions on vcDNA: vcDNA=SeqID_51033; Strand=-; Position=1 -101,163-396,451-833
MPADQCKDVLYLTVVPDVNVIASKCKVYMEELSNMYERRCRLGIHVPIGIREAPRDGIFRVGREESNSLSSGSTPAATVAIPTFPHSVHAMFMQFEPEFGDDMQPSLQRLRIFVECCYAKLCRFFLHNDHLFERRAFHESAYRQQQQPPQGTSLATVPDTVAMPPPAVPSGGSALGTIGGCSSAGPQSGPASATSTMLHHHHTGGPGSSSSSGSVLHSSPMAQHQHQTSPATGNNGPNS

SEQ ID NO: 124611 - protein, 50 aa, Heterodera glycines
  Coding regions on vcDNA: vcDNA=SeqID_51034; Strand=-; Position=1 -105,497-544
MHCLFSIVYTILTIFMVAHTLSKGTVGGQPMKTERGLRLFSIFSAYFGGF

SEQ ID NO: 124612 - protein, 339 aa, Heterodera glycines
  Coding regions on vcDNA: vcDNA=SeqID_51035; Strand=+; Position=1 -172,216-393,444-595,635-817,880-1026
  Homolog annotation: Hit_ID=CAE73274.1; Match level="QueryCoverage =100%, HitCoverage=50%, E-value=7e-66, Identity=42%"; Hit description= Hypothetical protein CBG20692 [Caenorhabditis briggsae]
GFSFDCSLLDLFHFGSLPHPQYLLNIRIPANRTLCLLSNNKGPNCAFPGPLHELRLIEIHQNGGFTLVWLWLEIHQNGGFTLVWLWLKSALSPVLLSVLFWFFRRVRALPRQPVLLEKTIFVLGCSLLLLDVPIEWLSLRMDFPALLLFGPIEWLSLRMDFPALLLFGDLRQGFFYAVLFSFWLIFAGEHLIDDRSRNDLRNYWRNLSLVVLSCARNYWRNLSLVVLSCAVLLGFDLSERGRQLSNPFHSVWSSEGSPRLALVSIVLGIGSAIIYTLFLLYKVCMGWLTILFLLYKVCMGWLTIRQKREAELRRHNPRRRLRVEAVLFRFRFLMLLTLL

SEQ ID NO: 124613 - protein, 364 aa, Heterodera glycines
  misc_feature (290)..(290): Xaa can be any naturally occurring amino acid
  Coding regions on vcDNA: vcDNA=SeqID_51036; Strand=+; Position=1 -159,202-364,408-571,701-1197
  Homolog annotation: Hit_ID=CAE68921.1; Match level="QueryCoverage =94%, HitCoverage=93%, E-value=3e-44, Identity=32%"; Hit description =Hypothetical protein CBG14900 [Caenorhabditis briggsae]
LKSPLLVLCFVVPSSFSDPCPFFGDYQCPEGFHCAFDKCQDEQGIEPPGDCAKIRCGKESECRQGIRCGKESECRQGKCVLYVGRPCGRNVLVAEGLARAVVSDCGPQGKCIGGRCAIDRCADTVCEEMSELCRDGMCMQLSSIDRCADTVCEEMSELCRDGMCMQLSSMFCFSPFDCGPPSLFECHQNKCQRRRDTIVPVCSSGQSCFNGFCVPTSNSNCANSGECAEMNICREGRCVADICKANGGRCLPENACSPVSVPEGECRPFQGIPCSLSAAAEDFPRHTFAXAEFVQKMVSGSDMATNTMPAKECFRKVCQIGERCDGGICIRVEGNGCRDAIRECGEHFDCVAGYCKDRISAYKE

SEQ ID NO: 124614 - protein, 59 aa, Heterodera glycines
  Coding regions on vcDNA: vcDNA=SeqID_51037; Strand=+; Position=1 -14,121-286
MPLDRASVAVLAAAAAAAGAEAATTVTTAATGIVENENVSSTPSPAVVSCSQNARANGD

SEQ ID NO: 124615 - protein, 145 aa, Heterodera glycines
  Coding regions on vcDNA: vcDNA=SeqID_51038; Strand=-; Position=1 -149,623-910
MPRKSLNISPRKRKKNGDQQEQHQESNNDKEKYQKWLEENAKLYKTVYARSRVDWSAWLQCISLILLIIILICLIIAALIAICSCILAAADNGGRRGGGDIFIFNNSSSSSGDCCCCFGTSSSSSSREYSYGRPELTYFDSCSVV

SEQ ID NO: 124616 - protein, 216 aa, Heterodera glycines
  Coding regions on vcDNA: vcDNA=SeqID_51039; Strand=-; Position=1 -37,119-213,260-778
MIILYYFFISYTVLLCMGLSTKELKDLNTQIDIIKHEITETIGRENEGKETMDDKVIKKLEDIANAKIVIETLSNFAINMTAQDYANLMFFEKKFTIPEIQEEHNARKEMNKLQILKKELDDKIEEAKKFWKKNGKGRKNQSQTEIIEMKVKLELMDLMKESNLLMTRQYENLAKECAKFGETEKNEWGKKLVEMFLKSLKEKMDKLREKLTKMIG

SEQ ID NO: 124617 - protein, 571 aa, Heterodera glycines
  Coding regions on vcDNA: vcDNA=SeqID_51040; Strand=-; Position=1-1716
  Homolog annotation: Hit_ID=NP_473347.2; Match level="QueryCoverage =44%, HitCoverage=24%, E-value=7e-09, Identity=23%"; Hit description =hypothetical protein [Plasmodium falciparum 3D7] emb|CAB39053.2| hypothetical protein [Plasmodium falcipa
MDSGHNNQRHYNFRRRVPVNYMEQESGSSQWSQNLGNLRNSGQQLNENTHAIVQPNNAQGNFSNHPLENQPFPAPAQNQSNPQNSNHGQQQLAVPLNPVINFFGGNEQNIGNPRAASTPISPHISFQEGGNYFVNFPREMQNRDLVQNRYNHNRQNPAQNFYNPRVFVNSQLNRNNERPNRNEFPVRDSNHRMHSQFANHQNEQYSARDARMYQHLSRQEANSNFVPPLNLQFSENENRHNHGQFPNPRNFQQNPEMVYAQINPPVYQNQAFPAQTIPIPDIIMELHKVTLSNQYANTMREIPILNGTEGSDKINDFFLTVEMCVGEWRHEKKLEMLKTKLKGKALRALNMALSKFGNTAPFETIKTEIMSTLRETDYKEASAFQELTQTGKRKEGESVMKFGERIQRLVNCAHIGLSEAQRDEISKKFFVLNINDTNMAKFLECQSKPSQTYDELLMVANRLSLVEEKTEERSVQIRNSQNPFHLPNANQISYQNEQSRYFGQRNFQNSYQPQPKYFGRTGPPSHSYGNNFGGRNFPVNQNFNRYPSNQQNRNFGNERAQSNKPRQNEKH

SEQ ID NO: 124618 - protein, 175 aa, Heterodera glycines
  Coding regions on vcDNA: vcDNA=SeqID_51041; Strand=-; Position=1 -502,689-714
MTTIDKEIQFINNEIVARWKKERKIIMEADRLVSYCNNISFYAKIYMIIAFSAPGIHQLYEKILEIAQNIRLLYLQILNEYKNISKILRDNENCLKYKNIKKCQENENSSKHSMATCYKYRKQLRKFRTEIDDLFENIVSLAKINPPEESIKDKNDNNRNEIFFTPYHSNMLMQC

SEQ ID NO: 124619 - protein, 135 aa, Heterodera glycines
  Coding regions on vcDNA: vcDNA=SeqID_51042; Strand=-; Position=1-408
MSINGSCVKRFPTNLKWISLKEKKVNRAEVMSLAEQIIAPEVNDNELFDEITALNEILESISDEKFGEMNAEQKWMKVFEAELPNLVLLVNKILSIPVSNACVERVFSLCSAQLTDVRNLLKVETVKSGPNQIEL

SEQ ID NO: 124620 - protein, 90 aa, Heterodera glycines
  Coding regions on vcDNA: vcDNA=SeqID_51043; Strand=-; Position=1 -26,375-621
  Homolog annotation: Hit_ID=CAH80563.1; Match level="QueryCoverage =91%, HitCoverage=81%, E-value=1e-18, Identity=56%"; Hit description =hypothetical protein PC107372.00.0 [Plasmodium chabaudi]
MKASCLTGAGAHDEMEEGKEEEKKEEGADEEKKEEGEEEEKKGEGEEEEKKEEGEEEEKKEEGEEEEKKEEGEEEEKKGEGEEEEKKKSG

SEQ ID NO: 124621 - protein, 145 aa, Heterodera glycines
  Coding regions on vcDNA: vcDNA=SeqID_51044; Strand=-; Position=1 -247,289-479
  Homolog annotation: Hit_ID=XP_522969.1; Match level="QueryCoverage =84%, HitCoverage=66%, E-value=2e-12, Identity=35%"; Hit description =PREDICTED: similar to putative protein family member (XC187) [Pan troglodytes]
MKRCKCDLKRYKSDKRYKVIKRGTTVIRRGTTVIRRGTTVNRRGTTAIRRVIRRGTTVIRRGTKVIRRGTKVIRRGTTVIRRGTTVIRRGTTVIRRGTTVIRRVTTVIKRGTTVIKRGTTVIRRGTTVIRRGTTVNRRGTKVNLL

SEQ ID NO: 124622 - protein, 148 aa, Heterodera glycines
  Coding regions on vcDNA: vcDNA=SeqID_51045; Strand=-; Position=1 -24,476-611,1080-1213,1526-1678
  Homolog annotation: Hit_ID=NP_741442.1; Match level="QueryCoverage =86%, HitCoverage=7%, E-value=7e-52, Identity=79%"; Hit description =voltage-gated Calcium Channel Alpha subunit, putative L-type calcium channel alpha 1 subunit, EGg Laying d
MNYKIVFQLVRTNLKIYTDGNIDEANEQLRAAIRRIWKRTPIKMLDEVVPPAGRDDEVTVGKFYATFLIQDYFRRFKKRKELEAKGMAAPNTHAMALQAGLRTLHEIGPELKRAISGNLDPDFVHEAEEPQHRVKMHLVYIYLLIYFY

SEQ ID NO: 124623 - protein, 73 aa, Heterodera glycines
  Coding regions on vcDNA: vcDNA=SeqID_51046; Strand=-; Position=1 -41,291-355,422-537
  Homolog annotation: Hit_ID=NP_501655.1; Match level="QueryCoverage =100%, HitCoverage=20%, E-value=6e-14, Identity=50%"; Hit description= COLlagen structural gene (36.5 kD) (col-121) [Caenorhabditis elegans] emb|CAA93499.1| Hypothetical prote
MPCVICPAGPPGQRGSQGERGRIGEAGPSGEYGSEGKEGIMGPNGARGYVGAMGIKGVPGRPGLQGDQVVAGK

SEQ ID NO: 124624 - protein, 43 aa, Heterodera glycines
  Coding regions on vcDNA: vcDNA=SeqID_51047; Strand=-; Position=1 -96,709-744
MGILCSTCALLVLLFLVPIIVHKANILRAELEVLRGLTVRPER

SEQ ID NO: 124625 - protein, 196 aa, Heterodera glycines
  Coding regions on vcDNA: vcDNA=SeqID_51048; Strand=-; Position=1 -177,239-281,341-439,501-577,1097-1186,1244-1348
  Homolog annotation: Hit_ID=NP_741756.1; Match level="QueryCoverage =41%, HitCoverage=24%, E-value=2e-12, Identity=46%"; Hit description =endophilin B2 (40.8 kD) (XE420) [Caenorhabditis elegans] gb|AAB52640.1| Endophilin-related protein protei
MEIFTRFLHFNNSLFTTIICSSPSLVKRLHLLFINPSSVATRAHFKMDALKRLASRARQKSAEIILSAEKTEIGAELEQLLTKTDKTEEHMKKLVHAIEVYLQPNPAVRALDPRKDKSGRQNTLDGLGEAMKVEAELRKAQDEFDTQLETISTALEALQTAVDRQAEQLVQFVAAQIEYHSSSLKLLKDLKRDLGA

SEQ ID NO: 124626 - protein, 363 aa, Heterodera glycines
  Coding regions on vcDNA: vcDNA=SeqID_51049; Strand=+; Position=1 -411,677-1357
  Homolog annotation: Hit_ID=AAK69445.1; Match level="QueryCoverage =70%, HitCoverage=84%, E-value=8e-17, Identity=28%"; Hit description =proline-rich protein-1 [Gossypium hirsutum]
MPISPTTPPYSPPKKPDDATLSPLEQKPVDKSPLTKKSKAKSPFKKKLGTKPSKKKAGAKTPFKKKKLGTKPSLKKKAGAKTPLKKEPEDKSPLKKEPEDKSPLKKKLEDKWPPKKPDFSSPSKKPVPLPRAAPGAKPVALPLRPPSPAAHGQAVHQPVQHGLHQPVHPYAPPHQQQPIHPRYSPPQPLPFQMPAMPTIATGGGPLIQVNVQRKEKPTPQPVAPLRAGVKPIPLRKPVKADDEEEQNAEDDMYSPKQQQPLDHGTPKNALDEDDMYNVPDALKSDHGRGDVQQNHGTTTPNNALDEDDMYNVPDALKSDHGGGDAKQMGAPKNDVDEDDLYNVPNTTKDSTDDDDLYRVPKSY

SEQ ID NO: 124627 - protein, 91 aa, Heterodera glycines
  Coding regions on vcDNA: vcDNA=SeqID_51050; Strand=+; Position=1 -77,133-199,448-579
MMACYYLAAKVDEFNVSIDNFVDNLRNGTRQYNTETILTLEPDVMLKLNSLLSDAMFLYSPSQIALAAVKFGMDKALGGAFSLSMDWFRNK

SEQ ID NO: 124628 - protein, 367 aa, Heterodera glycines
  Coding regions on vcDNA: vcDNA=SeqID_51051; Strand=-; Position=1-1101
  Homolog annotation: Hit_ID=XP_320889.1; Match level="QueryCoverage =85%, HitCoverage=37%, E-value=2e-30, Identity=30%"; Hit description =ENSANGP00000012033 [Anopheles gambiae] ref|XP_313651.1| ENSANGP00000013044 [Anopheles gambiae] ref|XP_314
MLEDAEKTGTDITLQKVEEELKAIQIVKESALSLLTQPVSTSAIQLRPQQWRETIKGKHKAKPAPKWPHHEPAPKSSHHAPSPKQKSDDKANRGHPSHPCASCGSNDHWRSDCKFANAFCNKCNRQGHIAIVCRQRSSNTAHKSQNRSFHTVVVKSHCMVIGTTQGRWWKIPVTINGINLKMNGDSGAQATVISFKTWIKLGQPKLSPTDIETRNCNDTAFSTEGKFHCTVSCFDRPSKTLIAYVSSDLKHDLFGLPWIEEFELIPREILFPKSIKGKPNASINANVVKATNPAIGITDESSLTAVLQKDFEEVFKNGLGHCAIKAHLILKPDARPIFCKARPVPHGAIEAVDTELDRLLQIGAIKP

SEQ ID NO: 124629 - protein, 58 aa, Heterodera glycines
  Coding regions on vcDNA: vcDNA=SeqID_51052; Strand=-; Position=1 -24,347-499
MVTKMAKIHNVAELRRVHVDLGEHRVGQFSGQTGKYEYNAEKQTMEFENLEVEKDDGF

SEQ ID NO: 124630 - protein, 133 aa, Heterodera glycines
  misc_feature (120)..(120): Xaa can be any naturally occurring amino acid
  Coding regions on vcDNA: vcDNA=SeqID_51053; Strand=-; Position=1 -115,189-281,353-420,909-1028
  Homolog annotation: Hit_ID=CAE67483.1; Match level="QueryCoverage =87%, HitCoverage=43%, E-value=5e-29, Identity=48%"; Hit description =Hypothetical protein CBG12987 [Caenorhabditis briggsae]
INAFPIFTNVAIFALCAVPFTLGQLQNAVKGKKCAKDQVVNKLTVYEDGAIEAECGPLPCGSTASTCAEDLDLSTCKAPSEVFSGMKWAQNGQSLLLRCCSMRASNKLYIGTDLVTLVKXKINSIFAFLKIYF

SEQ ID NO: 124631 - protein, 56 aa, Heterodera glycines
  Coding regions on vcDNA: vcDNA=SeqID_51054; Strand=+; Position=1-173
FSAVFWRESDQKWRKKLGEWTNGNRNEKHWPIRKEAQGEVEFWEESAWLKQLKIIS

SEQ ID NO: 124632 - protein, 59 aa, Heterodera glycines
  Coding regions on vcDNA: vcDNA=SeqID_51055; Strand=+; Position=1 -34,321-466
MEASHWHSAASISRNNLLDADTKPNEFRMLISDPIHCMGPSSIDLKFRQEKKLNKQFNN

SEQ ID NO: 124633 - protein, 180 aa, Heterodera glycines
  Coding regions on vcDNA: vcDNA=SeqID_51056; Strand=-; Position=1 -370,524-696
MIDLLLKDHNLLINEIVDRVVVTQRKSPSLSSSSETSCHPLHFQHQRVGTPPLSVPSSPMVSNEESSKKQPSHLTNSRITGAASVPVSPLVVVQTQSANNSNIGNSPPANVWQKRAEAIREKKAVHVATGTQVKSLNAEELAILSREEHQRKAPGYARPQSSASMTKQMLSNMEKTVFNA

SEQ ID NO: 124634 - protein, 342 aa, Heterodera glycines
  Coding regions on vcDNA: vcDNA=SeqID_51057; Strand=-; Position=1 -140,590-946,993-1220,1588-1701,1805-1993
  Homolog annotation: Hit_ID=AAR82779.1; Match level="QueryCoverage =97%, HitCoverage=75%, E-value=4e-97, Identity=40%"; Hit description =LD31436p [Drosophila melanogaster]
TALTLACVGGHAGLVDLLIKRGAHIEHRDKKGFTPLILAATGGHAEVAELLLKSGANKEHRNLSDYTPLSLAASGGYVDIIQLLLCNGAEINSRTNSKLGISPLMLAAMNGHEEATRLLLENGSDINAQIETNKNTALTLACFQGRTEVTRLLIQYGANVEHRAKTGLTPLMEAANGGYVDVGTVLIQANADVNTTPVPTSRDTALTIAADKGQAAFVGLLLRYNAQINARNKKGCTAIWLELIEKCGQSVQFISEAKEKQAEQANKAAQSLLALLAHEEAIEESKKRSKERQKEKKRAKKQAKKENEQQSETTEPETVDEEKEELNAEKKSNVAPEGKAIP

SEQ ID NO: 124635 - protein, 344 aa, Heterodera glycines
  Coding regions on vcDNA: vcDNA=SeqID_51058; Strand=-; Position=1 -90,141-308,359-846,895-988,1080-1175,1247-1342
  Homolog annotation: Hit_ID=AAG48253.1; Match level="QueryCoverage =100%, HitCoverage=41%, E-value=6e-76, Identity=37%"; Hit description= serologically defined breast cancer antigen NY-BR-16 [Homo sapiens]
MLLQAGTDINALSSTHNTALIYACASGYIECVKELLATGRCDLDIRNESGHCALMEAASIGNVEIMKLLVKHGAKVTNVVESVEYKESALTLAAFKGHFDAAKYLLSLMPDTKDALEEEEVYTALIEASMDGHVEVAKLLLSAGAKVNLANESFENPLTLAAGGGHTEMVTNCKTYNPIEFYIKVKLLLSAGAELEEPNDEGYTPLMEASREGHFDVVEMLLDQGANVNAKNEDGLETPLTLAASGGFKDVVELLVSRGGDLTVGERTPLYEACQEGHEKVVQKDLNESLLCTAGIDSDSICKLLIENGAQIDCFSKDNRTPLMEAARQNCTKVVELLIKNGAD

SEQ ID NO: 124636 - protein, 50 aa, Heterodera glycines
  Coding regions on vcDNA: vcDNA=SeqID_51059; Strand=+; Position=1 -128,724-748
MCGTQRINVSTSLEEHSNYVRVPATTCLAKWKYNGTFHGSVNKKIYKGEI

SEQ ID NO: 124637 - protein, 125 aa, Heterodera glycines
  Coding regions on vcDNA: vcDNA=SeqID_51060; Strand=-; Position=1-818
LFEYPKRTLEKIDFFVFGAVPPNRCAQIYGETESFGNSFPIACTLILRWIFAPHNCLSTPNGHLKKSIFFVFGAVPPNRCAQIYGETESFGNSFPIACTLILRWIFAPHNCLSTPNGHLKKSIFL

SEQ ID NO: 124638 - protein, 44 aa, Heterodera glycines
  Coding regions on vcDNA: vcDNA=SeqID_51061; Strand=-; Position=1 -76,296-354
MGKVTKENATVTVLLLNQAIETYDTVPKSVNDFMDEQGAVMGFV

SEQ ID NO: 124639 - protein, 267 aa, Heterodera glycines
  Coding regions on vcDNA: vcDNA=SeqID_51062; Strand=-; Position=1 -60,108-233,293-406,462-653,699-854,1331-1485
MNDQTTRQYIIDRTELILKTMVTQIFHIRSQHLEQLDGVKEGDQKEQELSEFMRSICNFLSTLTNEMTIMQRISTDTLRSFIDSLLSLVSDQRLKILNKQVFRSLNIIVIRLCEFTNPNVCFVALMKLVMKYQASDPGGQLSSLVRKCLTKFTDAIVEPTRIEKVDILTVLHPIHEYYSRFYVADGQTNQISDTVKDTSKLLCIFLQRLVINQKYAAVEDLYNFMDIHPDQNLKFEQLMARCEYASIVRRAFVEIRQTRLNREPLKP

SEQ ID NO: 124640 - protein, 188 aa, Heterodera glycines
  Coding regions on vcDNA: vcDNA=SeqID_51063; Strand=+; Position=1 -105,275-574,825-861,913-1035
  Homolog annotation: Hit_ID=XP_396043.1; Match level="QueryCoverage =21%, HitCoverage=7%, E-value=5e-10, Identity=75%"; Hit description =similar to ENSANGP00000005994 [Apis mellifera]
EEAGPQGHDSFWSKIRILRRTLCDFDKAGDESGGLNIKGVGGAVEPFDARGSQKGAKGNRMPPMRSLFHFKLKPGSTACVADFLAEAMPSKFFYISKRSLLGSTDETSATPKTASALRGVHSGRAIFNSDGINAGWSTSPCKSPLACEKNFIHRDLAARNILISHPSVVKIADFGLARLIRENEYEAR

SEQ ID NO: 124641 - protein, 36 aa, Heterodera glycines
  Coding regions on vcDNA: vcDNA=SeqID_51064; Strand=+; Position=1-110
ATGPGPGPGREFPVIRGPGPGSRSRVLKSSGPGPGP

SEQ ID NO: 124642 - protein, 21 aa, Heterodera glycines
  Coding regions on vcDNA: vcDNA=SeqID_51065; Strand=-; Position=1-64
GPGSRSRVLKSSGPGPGPGRA

SEQ ID NO: 124643 - protein, 164 aa, Heterodera glycines
  Coding regions on vcDNA: vcDNA=SeqID_51066; Strand=+; Position=1 -135,399-456,512-564,710-757,882-1039
  Homolog annotation: Hit_ID=CAE64462.1; Match level="QueryCoverage =94%, HitCoverage=6%, E-value=7e-41, Identity=53%"; Hit description =Hypothetical protein CBG09178 [Caenorhabditis briggsae]
CEHALQAECLQPFFTDIRRSESRLSMGLSPDQYCLNVRDIDECALGLHNCSTYATCTNLPDGYTCQCPAGWEDGNPELPYTCQCPAGWEDGNPELPGRICASKLCAQCSEHGSCIHPANSTNVVCQCFDGYAGTFCEIAPSALPLVLAIILALLFLLLALWSVC

SEQ ID NO: 124644 - protein, 272 aa, Heterodera glycines
  misc_feature (258)..(258): Xaa can be any naturally occurring amino acid
  Coding regions on vcDNA: vcDNA=SeqID_51067; Strand=-; Position=1 -238,302-409,453-569,662-747,796-834,879-917,2824-2914
  Homolog annotation: Hit_ID=NP_491612.1; Match level="QueryCoverage =68%, HitCoverage=25%, E-value=2e-39, Identity=49%"; Hit description =feline leukemia virus subgroup C receptor like (63.8 kD) (1G73) [Caenorhabditis elegans] gb|AAB53976.2| H
VDVPPHAPAPRELANSATLSSRSRSSTRPFASDDIAASIDVHGSARFGTAAAAGLKRVGVTFVMLSASNAMQWIEYSIIIIAHIISAYYGVSYSAVDWTSMVYMLTYMVLMFPGSWFLEKFGLRKSIWFLEKFGLRKSILIGAFGNSFGAWLKMLSTAPGTTKMSFLLLLIQIVVLPQCILGIPPRLAAVWFGPEQVSTACAAGVFGNQVSTACAAGVFGNQLGIAIGFVLLGIAIGFVLPPWLVPCSAATRCVGYRXKKVLQALRLQRVFT

SEQ ID NO: 124645 - protein, 19 aa, Heterodera glycines
  Coding regions on vcDNA: vcDNA=SeqID_51068; Strand=+; Position=1-61
PQIPFPINLAANPQIGQNM

SEQ ID NO: 124646 - protein, 46 aa, Heterodera glycines
  Coding regions on vcDNA: vcDNA=SeqID_51069; Strand=+; Position=1 -76,504-565
MEHHANTSIDDALLVDDNEKQKRLFMLGLFILFCWVGVIILCAYPQ

SEQ ID NO: 124647 - protein, 357 aa, Heterodera glycines
  Coding regions on vcDNA: vcDNA=SeqID_51070; Strand=+; Position=1 -47,108-383,437-854,906-1192,1255-1300
  Homolog annotation: Hit_ID=AAL78214.1; Match level="QueryCoverage =39%, HitCoverage=75%, E-value=6e-12, Identity=26%"; Hit description =putative esophageal gland cell protein Hgg-20 [Heterodera glycines]
MSDNRKEAEEKMAKAIFISGDCWLCVFDLLPPSQLGLGIALISHRFDFYVDEHFKTRKWTLKHIQIGSKIGKNGTNEMEIVNSDWKSMPIPQNPLPKKIVGFERIDILFIDRNAIAFFHHFRPIFPINLAIRSIMNNKRNMELILRNIWPILGKNIYGMELSAFIFHRLRKFVPSFLNDCPSPRFVSFNHGGLFTKFPADDSAMASDGQALAKWLLTPHSTNLPKVLKCMVDRDDPNLASKIEAFKAAFANSSSPTNFIISVWFPRPFADSVVPFDLTNELTREQLAFKRTNISLHFLLIRCPIAREASKWTKWEEEAIGWRIDDQWNFIKIHVDADNDIGDGLLNAMIGPSDQQQK

SEQ ID NO: 124648 - protein, 183 aa, Heterodera glycines
  Coding regions on vcDNA: vcDNA=SeqID_51071; Strand=-; Position=1 -261,546-728,838-945
MALVRFEEAKSNRGKILLSRLGFEYAYESDSRIEQGWEYWKCPKRPPYCPGRACVQMAWHVDANGSRYKMGRMSADHNHAAVFGQLNVGDVGLDALPIENIVIPNALQNRVIFNQILNGHRMIVFCSAHALEILRQYNTECAIDGTFESHAFMGYCQIRRGQHMYVSLRQSETALATIGRRKG

SEQ ID NO: 124649 - protein, 51 aa, Heterodera glycines
  Coding regions on vcDNA: vcDNA=SeqID_51072; Strand=-; Position=1 -34,89-210
MEKEKEQMEKDANANQSKELLERIIELEKRQKQQKEENERKGRNLGDNIGI

SEQ ID NO: 124650 - protein, 40 aa, Heterodera glycines
  Coding regions on vcDNA: vcDNA=SeqID_51073; Strand=-; Position=1 -76,126-172
MLSYAQQLRTTEYIKGSKRLFGCTDAGFVAMCGWTFSREA

SEQ ID NO: 124651 - protein, 296 aa, Heterodera glycines
  Coding regions on vcDNA: vcDNA=SeqID_51074; Strand=+; Position=1 -13,476-665,717-1143,1701-1960
MARKIGFVVTCGWTFFHLLTVLNLAFRIEKGEGPKAKLSVLIDDKCVAFPFPDHPLPNKIRFKDLQIYYIDHSVLAFLRSNKQIWDRSGTKLEVFVPLYMTDVKLIWDVFTREIWPIFAKSIRHFCIRNANHLDNLRRLISPTLLTDLVQLYSITSYGLCPDGISDDGPNATAGQALSKWLHTPSKNGKANELYCCAYFCEITWINTFKETFLRATTSVAYNVRLELLMASEMNTVEQFELVNEMTQEKLTLTKDEEIWLLKRCPIVGETAAVQWEKDENLDHVCGLYFNLHGNCI

SEQ ID NO: 124652 - protein, 122 aa, Heterodera glycines
  Coding regions on vcDNA: vcDNA=SeqID_51075; Strand=-; Position=1 -166,223-425
  Homolog annotation: Hit_ID=AAC04494.1; Match level="QueryCoverage =91%, HitCoverage=66%, E-value=2e-26, Identity=55%"; Hit description =unknown protein [Arabidopsis thaliana] pir||T00799 hypothetical protein At2g32690 [imported] - Arabidopsis
MGGGGMMGGGGGDMGGSMSMGGGGGDMSGMGGGMMSGGGGMMGGGDMTGGGGMGYGNSSSGWCAFEGGGMGGGGGIAMGGGGGGMGMGGGGGMPMEGGGMDGGMGGFGGGGGAAKPILTQIN

SEQ ID NO: 124653 - protein, 179 aa, Heterodera glycines
  misc_feature (2)..(2): Xaa can be any naturally occurring amino acid
  misc_feature (15)..(15): Xaa can be any naturally occurring amino acid
  misc_feature (163)..(163): Xaa can be any naturally occurring amino acid
  Coding regions on vcDNA: vcDNA=SeqID_51076; Strand=+; Position=1 -50,97-267,321-575
  Homolog annotation: Hit_ID=CAD22154.1; Match level="QueryCoverage =100%, HitCoverage=52%, E-value=5e-52, Identity=55%"; Hit description= pherophorin-dz1 protein [Volvox carteri f. nagariensis]
PXLPPDAPPPIFEPXPPPPPPNPPMPPSIPPPSIPPPPPNPPMPPSIPPPSIGIPPPPPIPMPPPPPPMAIPPPPPIPPPSNAHQPDDELPPYPPYPIPPPPVMSPPPIIPPPPLIIPPPIPLISPPPPPILIDPPISPPPPPIIPPPPIAESQSNAKLKLCXLPPSGIPPPLSIPPPP

SEQ ID NO: 124654 - protein, 312 aa, Heterodera glycines
  Coding regions on vcDNA: vcDNA=SeqID_51077; Strand=-; Position=1 -201,247-387,462-635,680-872,1408-1544,1607-1699
  Homolog annotation: Hit_ID=CAE57522.1; Match level="QueryCoverage =77%, HitCoverage=12%, E-value=3e-99, Identity=72%"; Hit description =Hypothetical protein CBG00497 [Caenorhabditis briggsae]
MTVSSHLESSDDRTEAQRTGEEKPDLNNVDYAGLRSDNSEVRRKQLDNIAVAALEFQPKGNTLETTEVKTEVPFLIRGDLREYQLVGLDWLVTLYEKNLNGILADEMGLGKTIQTIALLAHLACDRAVWGPHLIIVPTSVILNWEMELKKWCPALKVLTYFGTAKERAEKRKGWSKSNAFHVCITSYKLATQDIRAFKKKAWQYLILDEAQNIKNFKSQRWQTLLRIQSRRRLLLTDTSPVHSEATEVGSGKAIADQDGEDHSLSIVKKTALFIQRISVKANDNGQPQVRQHAFRAWHYHPAAQVLQPPEPF

SEQ ID NO: 124655 - protein, 157 aa, Heterodera glycines
  Coding regions on vcDNA: vcDNA=SeqID_51078; Strand=+; Position=1 -124,235-582
MADKTTINLILQRLEAIERKVNNNNNAVPAQLNEQLQSIVDQSTKEKPIERAKEDADMVSDVLDALDVEVCPQMVYRMGRRNDDKRRGPRLVKVVLPASTFQRFALAQWGRRRNVLRAKNEEWDRLLVRPSLTKEEQKAEHEARVKKREEYEQKPGW

SEQ ID NO: 124656 - protein, 23 aa, Heterodera glycines
  Coding regions on vcDNA: vcDNA=SeqID_51079; Strand=-; Position=1 -10,349-410
MCYMQSEKKKFQLIEERTELIAK

SEQ ID NO: 124657 - protein, 344 aa, Heterodera glycines
  Coding regions on vcDNA: vcDNA=SeqID_51080; Strand=+; Position=1 -47,104-379,436-853,914-1207
  Homolog annotation: Hit_ID=AAL78214.1; Match level="QueryCoverage =42%, HitCoverage=77%, E-value=2e-13, Identity=30%"; Hit description =putative esophageal gland cell protein Hgg-20 [Heterodera glycines]
MSDNPKEAEKEMEKAIFISADCWLGVFDLLPPSQLGLGIAMISHRFDYFVDEHFKTRKWKLRPIVIRSKIGENGAKEMEIVNSDGKELPIPQNPLPNKVIGFRCIRTFFIDQNVLTFLGHFHRFFANCATELDITTENVRILEFIVHNIWPMFKDTIYLLILNIVAFRQMHQLAPSMLNDCPSLRTFNLSDGISLGFPPDDSANASDGQTVAKWLFTPRHDNLKKKFICVMDSTMEQWLATVEQIKAAFSNASSPVYFGISVYFTPSSSLFSSVVPFKLTNELTGEKLELAKEAEEEEDLISFRLNRCPIVPEDKKQQKMVKELDLLLWNRIEIYIEDDGVGDG

SEQ ID NO: 124658 - protein, 290 aa, Heterodera glycines
  Coding regions on vcDNA: vcDNA=SeqID_51081; Strand=+; Position=1 -343,784-1313
MYVNIRRFPTDQFADQVDIYRDDPREDVHELWRKFTESIDWIHRLNCGRKLLQFIQLLHRLLPKYTEMNRLKAEDQREQLEEEMFWAAEEEETVPTPAEGAARGDDEGNSAKNRVLRAFATLELETIYKKIKEKMLAQFEGWWKRVPEQKEPLYEFFKQLEDISTRYVMAIVDAFFDGISIESFRQEYSLGVKGGAVSGMIRIGFDTLALIQTSKFVYFNEHWEKCQLNLSVLIRDRTTGVGGSRVLIPTESRTIPTILKERSGRIPNLIPLDSEKIQRYPNPVRSLVLI

SEQ ID NO: 124659 - protein, 59 aa, Heterodera glycines
  Coding regions on vcDNA: vcDNA=SeqID_51082; Strand=-; Position=1 -93,139-225
MPDAEQMRQQLEHHFVSNWLMDTGRLDELKLREEERREQAAEDRTNEESDQDADIDVVD

SEQ ID NO: 124660 - protein, 51 aa, Heterodera glycines
  Coding regions on vcDNA: vcDNA=SeqID_51083; Strand=+; Position=1-156
TFPFIYSLKSSKYINSMHWESNLGPTPLVTFSQTTSPHIQIFFGTAAQFPD

SEQ ID NO: 124661 - protein, 77 aa, Heterodera glycines
  Coding regions on vcDNA: vcDNA=SeqID_51084; Strand=+; Position=1 -167,515-581
  Homolog annotation: Hit_ID=CAG89905.1; Match level="QueryCoverage =79%, HitCoverage=8%, E-value=5e-09, Identity=49%"; Hit description =unnamed protein product [Debaryomyces hansenii CBS767] ref|XP _461483.1| unnamed protein product [Debaryomyc
MATHCVKGCALANGRLIIAPTVVITTGTFLNAELVWGAQRKPGGRMGEATSSGLAGTFRRVGFRTGVFEAILYKHFV

SEQ ID NO: 124662 - protein, 189 aa, Heterodera glycines
  Coding regions on vcDNA: vcDNA=SeqID_51085; Strand=+; Position=1 -63,118-289,590-651,866-939,995-1108
  Homolog annotation: Hit_ID=NP_496169.1; Match level="QueryCoverage =88%, HitCoverage=22%, E-value=1e-34, Identity=48%"; Hit description =glucose inhibited division protein A (71.6 kD) (2K322) [Caenorhabditis elegans] emb|CAA91322.1| Hypotheti
CETRKLELGRIEKFTWLPKKNQLLSYVGYTDERQLLSYVGYTDERLVKIVCENVDESRALNEGIKGPRYCPSLEAKCLRFGHLKHRIFLEPEGFDSELIYPQGCALGFTMDVQQKIMRSIDGLERVEVVQPGYSVRYDFVHPQQLWPSLETYSVRYDFVHPQQLWPSLETRKVVGLFLAGQINGTTGEK

SEQ ID NO: 124663 - protein, 34 aa, Heterodera glycines
  Coding regions on vcDNA: vcDNA=SeqID_51086; Strand=+; Position=1 -7,177-274
MTIVSPLWVGALPHVTAMLGWTLAIHFISKYTQN

SEQ ID NO: 124664 - protein, 16 aa, Heterodera glycines
  Coding regions on vcDNA: vcDNA=SeqID_51087; Strand=+; Position=1 -3,277-324
MKCLYPYLAIFYPVYL

SEQ ID NO: 124665 - protein, 208 aa, Heterodera glycines
  misc_feature (199)..(199): Xaa can be any naturally occurring amino acid
  Coding regions on vcDNA: vcDNA=SeqID_51088; Strand=+; Position=1 -37,90-192,429-526,567-691,754-968
  Homolog annotation: Hit_ID=CAE71594.1; Match level="QueryCoverage =95%, HitCoverage=42%, E-value=3e-67, Identity=69%"; Hit description =Hypothetical protein CBG18552 [Caenorhabditis briggsae]
RRMEKLGEGSYATVWKSETVWKSENRLDGSIVALKEIRLQEQEGLPFTAIREVSLLRALRHANIVRLHQIIIHHHSLVLVFEFMNTDLAKHNTDLAKHMEQFPHGLDSFRTKLFLFQLLRGLAFCHEQKILHRDLKPDLKPQNLLVNTNGELKLADFGLARAKSVPSRTFSHDVVTLWYRPSDVLLGSTVYSTPLDMWXICWAFLTHF

SEQ ID NO: 124666 - protein, 80 aa, Heterodera glycines
  Coding regions on vcDNA: vcDNA=SeqID_51089; Strand=+; Position=1 -139,192-295
MTKKVALALIDFWFQLDPRKRISAAGAMLHKYFNEMPKTLHALSPTESIFAAFDGIIQQQKLSIASETTNDSDERRTCYV

SEQ ID NO: 124667 - protein, 108 aa, Heterodera glycines
  Coding regions on vcDNA: vcDNA=SeqID_51090; Strand=+; Position=1 -156,227-301,353-416
  Homolog annotation: Hit_ID=CAE56125.1; Match level="QueryCoverage =95%, HitCoverage=9%, E-value=1e-30, Identity=67%"; Hit description =Hypothetical protein CBG23734 [Caenorhabditis briggsae]
AYPGAEGLCSPEIEISEGGTMLDGKGKFNDLKAMLDSNRENIKMDAMRRIINMVARGRMVARGRDVSELFAAVVKNVAVKNLELKKLLKKLVYVYLVRYAEEQQDLAL

SEQ ID NO: 124668 - protein, 135 aa, Heterodera glycines
  Coding regions on vcDNA: vcDNA=SeqID_51091; Strand=-; Position=1 -82,134-475,524-686
  Homolog annotation: Hit_ID=CAE70802.1; Match level="QueryCoverage =91%, HitCoverage=95%, E-value=7e-19, Identity=38%"; Hit description =Hypothetical protein CBG17563 [Caenorhabditis briggsae]
MGNIVYSDKLSCYESADYCARSCSASSQCVYVDNCGDSANAHYACLPFDTRLLTWILVVSFLVIVLCCSALVVFYALRVIRRSFRNPVQTDGDIVFYNARNVHNFPHPAAMKQPTVEDDGRQEYYYNNSRRNDYY

SEQ ID NO: 124669 - protein, 202 aa, Heterodera glycines
  Coding regions on vcDNA: vcDNA=SeqID_51092; Strand=-; Position=1 -60,110-368,420-474,521-757
  Homolog annotation: Hit_ID=EAL42084.1; Match level="QueryCoverage =96%, HitCoverage=93%, E-value=6e-12, Identity=26%"; Hit description =ENSANGP00000025790 [Anopheles gambiae str. PEST]
IASGNTTQNSTETTIEVEEEIPTAPTVTEASTTATSKTTEQSLDDQTSNGTSSPSTVNEKQPKTIGNDTTTAEKANTERTEATTETETTPIHNSSLNVPIDEQQKNNTTIANEHGSLNVAEETTATTRIPTSPTTFAANTTESGTTDGLIMEGQQNETIIVPPANKEREKGEKAQTIKLPVAKSEKQIEISEQSSPNFPRQM

SEQ ID NO: 124670 - protein, 151 aa, Heterodera glycines
  Coding regions on vcDNA: vcDNA=SeqID_51093; Strand=-; Position=1 -222,276-506
MCKFLNITLIAVILLKTVKSAYLSTKCGFHWADYSIKWAFEPQTQSIVFVLKTMPPRNLSSEGILTTGIAFEAEEHTEFIGVAISKQKDGEMKVIRAKAKGTEGLFELNSDNTANRVREITMKKRQNGEIIVEFARQLKGENERRLLTGCR

SEQ ID NO: 124671 - protein, 290 aa, Heterodera glycines
  Coding regions on vcDNA: vcDNA=SeqID_51094; Strand=+; Position=1 -96,141-372,429-543,585-619,681-728,798-876,1603-1665
  Homolog annotation: Hit_ID=NP_495890.1; Match level="QueryCoverage =100%, HitCoverage=15%, E-value=9e-45, Identity=39%"; Hit description= RNA helicase (rha-1) [Caenorhabditis elegans] emb|CAA90409.1| Hypothetical protein T07D4.3 [Caenorhabdit
RILARLPLEPKMGKMIVLGAALGVGDLMLTSASATSFNTPFVPRESATSFNTPFVPRERMHTKLSHMHRSFSGNRPSDHIGLLNVNQQFAQEYEMDLTQAENFCRRYSLSFPLLSMSNEAKRQLYDVMVHISGFPEKTQLYDVMVHISGFPEKTFQVFPIDVHGDDSNLDIFLSLMIAAYYPNVCYIKLMIAAYYPNVCYIKDKRRVFTLEQTTDKRRVFTLEQTTAILSNMSSCVPFNRNETNMSSCVPFNRNETFDFPSPLFVFAEKLRTSCISCKQASMVSPLQLLL

SEQ ID NO: 124672 - protein, 171 aa, Heterodera glycines
  Coding regions on vcDNA: vcDNA=SeqID_51095; Strand=+; Position=1 -132,406-610,811-990
ALEELHRMRVPPLLYAQRLLCKDGKLLIRKNEIKSGILTPVDKPALEELHRMRVPPLLYAQRLLCKDGKLLIRKNEIKSGILTPVDKPLDIWGQTYIGLPYPINYFWDANCFSPRRAAPDASAAVAVRSTVAVQRRKIAYQKKRNKIRNTHARRQTVGYMGTNLYWTTIPN

SEQ ID NO: 124673 - protein, 21 aa, Heterodera glycines
  Coding regions on vcDNA: vcDNA=SeqID_51096; Strand=+; Position=1-64
MFEEPFESCTGCECPRCCTLN

SEQ ID NO: 124674 - protein, 74 aa, Heterodera glycines
  Coding regions on vcDNA: vcDNA=SeqID_51097; Strand=+; Position=1 -145,299-378
MGNERCTNFGRRTTVKLGLEKSTSANGWINDTKMVVLNALRLDKPHTTENCDLYLGTNRAPDFSTAKDFSTEIL

SEQ ID NO: 124675 - protein, 143 aa, Heterodera glycines
  misc_feature (91)..(91): Xaa can be any naturally occurring amino acid
  Coding regions on vcDNA: vcDNA=SeqID_51098; Strand=-; Position=1 -22,2716-3130
  Homolog annotation: Hit_ID=NP_510671.1; Match level="QueryCoverage =95%, HitCoverage=14%, E-value=2e-30, Identity=51%"; Hit description =predicted CDS, endonuclease/exonuclease/phosphatase family and RNA -directed DNA polymerase (XR69) [Caenor
SDEMIGSQFVILFNRSTTSQLNSCGRLEAIINGKNVDCIYIDFQKAFDSVPHNLLLYKLEKIGIKGKLLMWIKGFLSNRTFRVKIGDSLSXVKVTSGVPQGSVLGPLLFLIYINDLPDALPSGVKIKLYANDVKLYICYKAKS

SEQ ID NO: 124676 - protein, 92 aa, Heterodera glycines
  Coding regions on vcDNA: vcDNA=SeqID_51099; Strand=+; Position=1 -217,527-588
MGYMKTSYPYLSLLIRNCSTVIDFFFLLYCRRHTVPRTKLFWSVATWFVFEFLLNMAGNTLWYACRYSVLNKGLSTLKNLLKIARFLVLAMD

SEQ ID NO: 124677 - protein, 101 aa, Heterodera glycines
  Coding regions on vcDNA: vcDNA=SeqID_51100; Strand=+; Position=1 -72,327-395,854-1018
MIPRLLDLDAKEKSYNGKTSWRPNKFTFFHLKEKACKHQKKSLSDGLCRQMPPPLRLLPFRSPEAKENEEKDKDKQIQVTKAIIKSKFRHNQIQIRQSFIS

SEQ ID NO: 124678 - protein, 79 aa, Heterodera glycines
  Coding regions on vcDNA: vcDNA=SeqID_51101; Strand=-; Position=1-321
FCLEEHSSSHLPHQHYFFNYFFHFITQRSRLIRSSPNFAGKLLRTLQMLINFLRIFCLEEHSSSHLPHQHYFFLIIFCI

SEQ ID NO: 124679 - protein, 92 aa, Heterodera glycines
  Coding regions on vcDNA: vcDNA=SeqID_51102; Strand=+; Position=1-705
LFEYPKRTLEKIDFFVFGAVPPNRCAQIYGETESFRNSFPIACTLILRWIFAPHNCLSTPNGHLKKSIYFCFRGSPPEPMRPDLWGDRILRE

SEQ ID NO: 124680 - protein, 102 aa, Heterodera glycines
  Coding regions on vcDNA: vcDNA=SeqID_51103; Strand=-; Position=1 -66,151-240,876-948,1242-1321
  Homolog annotation: Hit_ID=AAD29052.1; Match level="QueryCoverage =59%, HitCoverage=14%, E-value=4e-14, Identity=57%"; Hit description =transcription enhancer factor-5 [Homo sapiens]
MYKKVLFNKLSKFQCPPKCAVSIYSPIDEEEEAKCSGVWHFRLEKSPMCEYMVRFISELKKLQEPSLMNSVLENFTVLQIVTDKQSNDTLMVIAFMVGIREE

SEQ ID NO: 124681 - protein, 459 aa, Heterodera glycines
  Coding regions on vcDNA: vcDNA=SeqID_51104; Strand=-; Position=1 -286,377-508,919-1879
  Homolog annotation: Hit_ID=CAE67239.1; Match level="QueryCoverage =29%, HitCoverage=40%, E-value=2e-19, Identity=35%"; Hit description =Hypothetical protein CBG12679 [Caenorhabditis briggsae]
KIDPKITTDDVHKFLEKQKTYTIHKPIRKRFPRLKTIPSGFHTDWQCDLCIFDQLKKHNDGYKYLLVCIDVLSRMIFSAPAKSKKSEDMIEAFDREKFIIKNVMYSPDLHAGVVERANRTIKERLYRYFTKKDTLRWVDYDSPRFWNWAQIWSVALSSIIYPYSFTLLGINGQEFIKVWENDSSVPTQVYLPDMNFKTAGGLGNKINEAFSHHYKIKKQRGRREAKAEDTKDSKIDVAKSAAERAGRDVERHFNQINNISNSIQTQLNTLRETNPHILEEPDIKIWFDKMVEMGTEIQTSRNELKSFQEEVDKAKNITLEHVEKNDLKKAKKSADVAKGIARQAKTKYTSTLEGYNDKSEKGFSGIVNRLNEALGEHIKRKDIENRQVSEAEKGPQKRERLANEDVQFQYDSIDQKFIVYLSAAVSHIDLSKHLAYVLGFKNTRLFHAEEATYMPDLTG

SEQ ID NO: 124682 - protein, 52 aa, Heterodera glycines
  Coding regions on vcDNA: vcDNA=SeqID_51105; Strand=+; Position=1 -52,199-305
MCVANGNTDQITKGEINEEGHFNNESKCCGITVSYCKSKTVPIQYSNYGTKK

SEQ ID NO: 124683 - protein, 31 aa, Heterodera glycines
  Coding regions on vcDNA: vcDNA=SeqID_51106; Strand=-; Position=1-95
MTSDEIGWIPSTRRFNFGLQVQLSWIFRLSG

SEQ ID NO: 124684 - protein, 70 aa, Heterodera glycines
  Coding regions on vcDNA: vcDNA=SeqID_51107; Strand=-; Position=1 -107,320-425
MIDQILIILVFIGTICDNKPSYCLIIKRRILSEKNSFLLVCILNHFFISLMNLFNVKILMVKKLNVNLCD

SEQ ID NO: 124685 - protein, 52 aa, Heterodera glycines
  Coding regions on vcDNA: vcDNA=SeqID_51108; Strand=+; Position=1 -140,423-441
MSSNVTDTDSFPFCLLAKLPVGLGVCEVGNGEDSSGRENASLAVGLLTNKSN

SEQ ID NO: 124686 - protein, 72 aa, Heterodera glycines
  Coding regions on vcDNA: vcDNA=SeqID_51109; Strand=-; Position=1 -9,545-754
MAFLQIYCIRGDWCDYDCGKFHRRKLNISDNNFVRAHVDKLEKAALPNNENGGWSNVHCGQGKEEPWPKLKN

SEQ ID NO: 124687 - protein, 203 aa, Heterodera glycines
  Coding regions on vcDNA: vcDNA=SeqID_51110; Strand=+; Position=1 -98,1011-1100,1242-1400,1505-1619,1689-1837
MALMPFLCIIIHSCQQQLSHFECDAKRRWHKLCPMHNSFLSFCVLLSLFHYNFAGASQCPTKPILLTGTIKVPKNVVDFNSSAQCLPSCNQTGQEGNKTFGLTFRLPIDVGQCDEGLLICYPGTLERVSGGGGGGWQNMAAAIKKQYKISDYKNNTNIPNEKCRQNWEKDGKKDGPIWHGVYVYTERNNEVRHIMLELSFSSE

SEQ ID NO: 124688 - protein, 184 aa, Heterodera glycines
  Coding regions on vcDNA: vcDNA=SeqID_51111; Strand=+; Position=1 -100,165-367,729-980
MTRHLKNSRYNFGPNRRQISIPFFGNQSELVGYGGDAFKEFDDASLGTSFIQNIQEGAFLKDFVGLWTLGHDMMAPPSAAGTQQSVVLYFYRSCSCSMEAWFTRPTDTEMPANREAISVGTADCAKTVDTMIPFDYNEKSEFAFTINGITDENAVNISVQLLQEARAGHSLVLEFQNSYFMKNI

SEQ ID NO: 124689 - protein, 149 aa, Heterodera glycines
  Coding regions on vcDNA: vcDNA=SeqID_51112; Strand=-; Position=1 -243,719-747,977-1154
MTQILKLSEIPMIFPKISFFSTDNISHAAGEQQHDQIESKVQFEEQKQSENYAMACFFFTRLYRKLAGLLETPFYGKTRSNFIRPQKYTTKQIEDTSGYQMIPSMLNLDASGKSYGVDQKLIIFMVINYSTKYNFLCANRRTTIPKPIR

SEQ ID NO: 124690 - protein, 67 aa, Heterodera glycines
  Coding regions on vcDNA: vcDNA=SeqID_51113; Strand=-; Position=1-204
PSASDFGLAASSSSTSTGEEDDAQLFGRRVVKFLRSLNNGRRRRRACIGIEQVMIEFETEEEEEQKR

SEQ ID NO: 124691 - protein, 88 aa, Heterodera glycines
  Coding regions on vcDNA: vcDNA=SeqID_51114; Strand=+; Position=1 -96,135-305
MPKQNEIVLKYSFLDLTWFLDIEAVFYAISKTKKCLVVKTIFHISLHNFVSSARIETGIRPLERAARALQEGMERKNSYFWDFFRNQN

SEQ ID NO: 124692 - protein, 33 aa, Heterodera glycines
  Coding regions on vcDNA: vcDNA=SeqID_51115; Strand=+; Position=1 -22,1078-1157
MIKNYRGGIRDNQNAMAEKMSGIDAKLEQIENG

SEQ ID NO: 124693 - protein, 91 aa, Heterodera glycines
  Coding regions on vcDNA: vcDNA=SeqID_51116; Strand=+; Position=1 -48,109-202,282-415
MATLNVAHLITLIGVGSIASSVVADEQQNQNKTQNGGGGLKHLLGSDVFTELRAKQNAMAEKMSGIETKLEKQIQNGNNFILINSFSTFVD

SEQ ID NO: 124694 - protein, 115 aa, Heterodera glycines
  Coding regions on vcDNA: vcDNA=SeqID_51117; Strand=-; Position=1 -145,261-463
MKLMTDLINDGRMKLKENSSEILIKQEKENEENIEGEKIEKKAKRKKNGKQHYDALKEEFRENYQIFKNVHNMKDIEISKLFGINRETVRRWKQAFFSGMIQNPDKKSHGLMIFL

SEQ ID NO: 124695 - protein, 60 aa, Heterodera glycines
  Coding regions on vcDNA: vcDNA=SeqID_51118; Strand=-; Position=1 -46,101-237
MAVLIDSMMDNLKNKENADLVAPLFPITFVILGGELLVERENLEIDYIFNFLSGSVTDDI

SEQ ID NO: 124696 - protein, 204 aa, Heterodera glycines
  Coding regions on vcDNA: vcDNA=SeqID_51119; Strand=-; Position=1 -73,130-299,442-681,762-893
SSAELALNDEKSWANYRRRLATFDVASRIAKPKEISPVVCARHGWKNVGEEFLQCDDCGKVLYIKLPGDEVSNRVLNHCIRHIQRKLVEAHTVICPWRISPGLNTSATYDITARYHQLVDSGQPELPLADNVLDEALADKFGVQSRFFLALAIFGWLPISKQATNHVEMNKPQPNFHCPLCGRHLCASVFSSDNPLDPREQHQH

SEQ ID NO: 124697 - protein, 89 aa, Heterodera glycines
  Coding regions on vcDNA: vcDNA=SeqID_51120; Strand=-; Position=1-270
MDAGFVISDPENIRKGVLPDSLLIIIFSKNLWGPIIQEPRIVVLKVKGNVIIRAPNSALVVHFMRPMDFSRVPRDREFLPKPGPGLAGT

SEQ ID NO: 124698 - protein, 530 aa, Heterodera glycines
  Coding regions on vcDNA: vcDNA=SeqID_51121; Strand=+; Position=1-1593
  Homolog annotation: Hit_ID=AAA59875.1; Match level="QueryCoverage =60%, HitCoverage=68%, E-value=4e-24, Identity=29%"; Hit description =mucin
MVTIGTLDVQWIDIHFTDRRATDEDRQRVIRVPVPKASHSRVEQLRDFLAVTLRNRSGAKLLPTPSEVEANRNRTKLLDSPPPLKREKRDVSSTPMFDASGKRLQDSPPLYNINEDERLEESPPPFEETKISAAPPPPVTSPVKPTTTVKTPAAPAAAPSATAKPATQSTVTKQAPQSPKPTAKPTTATPVKSTTAPPPTVKTTTAPPPTVKATTAPPPTVKTTTEVKSPSVKPTISAPPAQLKSHAKTTAPAKAPPPASVSAELAPRAPLADSPPRFDEEENKTDKLTAAKPSTKTTITAPPAQLKSSATPHQQKQQVPVKPSAPISVPAKPSGSPPRFEETRQKQQQPPPPPTSAALTLADLPENTLSVQIDPLSYVPNSVSIQYLENMERFKLVFNEAIVSHVSFSPQLGYVLGFENPQHVVSNELSKYPVDLRGGISSFAVYSKGLTENMIIGNSLSSLLRVVSISGAIPWEYNEKIYDSPIFARVLPREINEIEIELRTMDKGRLVPFAYGTTMVVLIFKKVINF

SEQ ID NO: 124699 - protein, 279 aa, Heterodera glycines
  Coding regions on vcDNA: vcDNA=SeqID_51122; Strand=-; Position=1 -736,1119-1222
IILLGRYNSKDIIKEAQDKVTKVIILLGRYNSKDIIKEDQDKVTKVIILLGRYNSKDIIKEDQDKVTKVIILLGRCNSKDIIKEDQDKVTKVIILLGRYNSKDIIKEDQDKVTKVIILLGRYNSKDIIKEIQDKVTNVIILLGRYNLKDIIKETQDKVTKLIILLGRYNSKDIIKEDQDKVTKVIILLGRYNSKDIIKETQDKVTKVIILLGRYNSKDIIKETQDKVTKVIILLGRYNSTNDVILLQIFKKLLITFVKVNQIKHSWKHSIAYGFSISSL

SEQ ID NO: 124700 - protein, 85 aa, Heterodera glycines
  Coding regions on vcDNA: vcDNA=SeqID_51123; Strand=+; Position=1 -36,88-309
MSQLQFVWRGSKRIIAVGTQKGLPPNRRTKTADESLRHALPFISKLGLMWGPIQRPITSGTPTLSTVIQSDKLLFSPSNFSCAFM

SEQ ID NO: 124701 - protein, 146 aa, Heterodera glycines
  Coding regions on vcDNA: vcDNA=SeqID_51124; Strand=+; Position=1 -104,155-239,643-795,1239-1337
MSLFLNWATFTIFTIALAVPMFQSFSGVQSYANDENASSLTGESMKKHFTKEYNALDQCTKTEPYRSRSPSLFAGDHFRIRISVEQSQFNIDIHGARVAFFVPKMPTSTGNVLGIDGDLKAEERGTFVTIENEAKSLERLLTSLIF

SEQ ID NO: 124702 - protein, 376 aa, Heterodera glycines
  Coding regions on vcDNA: vcDNA=SeqID_51125; Strand=+; Position=1 -496,654-992,1042-1337
MQFFIRFSLVFVCFYGKFVPNIGQLICKNEEKQNLILVKLYNDELATNDDTGELWEFICELEQQNLAMEKAFETQKQNGKMWRKSSETFDGEAEFFRHKFEIIRRKDNELAELFTKLRSTFYSTVLKGIKRLTPRHFIKNNKMNGKKWTIRQWHYEIVSVTLQMCDGSMAECLRNQLTQFVLMLTQRFKISKEEIMPKKEEPTIALKLIKEFAELWREIKVKQKSKSDYKGTENGKNNGQNEREKCWDSDEKQRKMLRLVFTAVNGDGNIMALNGATKVNGGGRRSQKRRRKKRDLVLLILLIALLISLFFTVYSYCLHSSNDDSLEQQNADMEMLLVVRQANEIFVKFRYGDDETDKKGNPKSDHIYIVVDGKGE

SEQ ID NO: 124703 - protein, 66 aa, Heterodera glycines
  Coding regions on vcDNA: vcDNA=SeqID_51126; Strand=+; Position=1-201
MFQFDPPLIVPPETVESVDAIFEAMLTGHWPPDSHTYALHSCIDFAYQFVCRLNNGMCGTFDYFYS

SEQ ID NO: 124704 - protein, 68 aa, Heterodera glycines
  Coding regions on vcDNA: vcDNA=SeqID_51127; Strand=+; Position=1 -137,339-408
MKSFFNFPFVFCILLLIGCVDKCVGGVAALPPKYLGIKNHDKCLTEIWKKANIRRLAHESEDRSERSK

SEQ ID NO: 124705 - protein, 66 aa, Heterodera glycines
  Coding regions on vcDNA: vcDNA=SeqID_51128; Strand=+; Position=1 -49,176-277,535-584
MEIVFFFISLATILLIGKTARLPSNKKGNDANKSDFASTSNSADQTQNKHKSGQCRITSTSCATLH

SEQ ID NO: 124706 - protein, 376 aa, Heterodera glycines
  Coding regions on vcDNA: vcDNA=SeqID_51129; Strand=+; Position=1 -63,424-1488
MQEAEQKADGPAQFPAAAPKPQNKTKSYYELNDFECLHQGARQMSSPLVHPKPSGRKQKCLSGKDDESSISAIDRKLWQGKTTIKISDLEKAQNDMGKLEDGVNRAFRYMNRSLNQKVNWVKDVVSNTNANFETLKVQYETLTERVEMLEQDSDGTNSGGTVSISNLNRASRVPFVTPMGNAQPNQVVPNPVPIHQLSSEDEDDGPTLFGLNMLSNGPTVGSGLEMFCEESVFAFDDWAERFKDYLSVSGKAYTEQEKVTRLKLALRDTPRALFKELLPAQMDTLDSALSELRQKLDSPQRREIAKRTLSLCKQREDETVAQFLRRLTPLVDATNSTLTGEIRKEKICEEFLDRLKPNISFLIRLVGLSRAKDLDL

SEQ ID NO: 124707 - protein, 43 aa, Heterodera glycines
  Coding regions on vcDNA: vcDNA=SeqID_51130; Strand=+; Position=1-130
MPSARTFVRNRAFYPCRKSRPECALFLLAAAQTFAATCHQMAR

SEQ ID NO: 124708 - protein, 352 aa, Heterodera glycines
  Coding regions on vcDNA: vcDNA=SeqID_51131; Strand=-; Position=1 -48,114-263,409-584,637-938,1042-1239,1310-1494
MRGAVALPTQQPLTLTVSNSVDNGGIGQHPNGGGGIVQHPNGAVGIVQHPNGAVSGASVPMWSLNSALPPSVREAVALVHARQLQKMVNKHIQPEFASVVPAIGENGFSNLWWIYLEWQPDMVMNRVVGLVVLAGPFTTQTDISGYDVRIIFDHNDLEHEMAMHGWQECVPRMSNICAGQIVEFTRLKVRAQGHNAKGSFPFTLLYNAESRHRIVGQSSSAVATSVFNPPSTNTPIIVEANDSNNAISIPSGGSGPISQQGGNGVFGGGGSSVMAAPRQSDQQQRAGVRANAGSEQHRLVMQSDDDDDGEEQQDEQSRGSGGDGRAANFALPSAGTDAPRTETGASSTVSRK

SEQ ID NO: 124709 - protein, 33 aa, Heterodera glycines
  Coding regions on vcDNA: vcDNA=SeqID_51132; Strand=-; Position=1 -70,183-214
MHSFLRSRFSMLSDIHCFLCSTIEGEAPTDYRF

SEQ ID NO: 124710 - protein, 187 aa, Heterodera glycines
  Coding regions on vcDNA: vcDNA=SeqID_51133; Strand=-; Position=1-562
MLFLLFIFVFLIINNSTDKTLSVNLCKKCRPTFAEIFGEEWQNEIIIGGDENENETDQNTNFHQNDQNELTDQTDQLDVQQKIEIIHKFHAIREGIKKKGKYSAKIWNKIEQKIAKKLGINRPKIYEWKKEFGIYYYKKKKREFIDQIDEIKRMPKNGRQKQFAKELGISKETLRKWKKEFGIEMSK

SEQ ID NO: 124711 - protein, 91 aa, Heterodera glycines
  Coding regions on vcDNA: vcDNA=SeqID_51134; Strand=-; Position=1 -103,168-340
MGELSFLNEENKETWKKFVKLSSKELMEFEQSIKATIVLFLQHTKTIKNRRQKRMDNNHPPNTPLANDARIPIGNAKGIQSANDARIPMGL

SEQ ID NO: 124712 - protein, 64 aa, Heterodera glycines
  Coding regions on vcDNA: vcDNA=SeqID_51135; Strand=+; Position=1 -6,265-453
MGDNRKDLDLSNDSSKIWLFLSKIIAKRNFHMRFRTNFRADNESNQKNINATNLKEVSMIVICI

SEQ ID NO: 124713 - protein, 42 aa, Heterodera glycines
  Coding regions on vcDNA: vcDNA=SeqID_51136; Strand=+; Position=1-133
FENFFKRGDPFVLQNFFKIKNHDNLLSGFLKVANHESGMYFD

SEQ ID NO: 124714 - protein, 78 aa, Heterodera glycines
  Coding regions on vcDNA: vcDNA=SeqID_51137; Strand=-; Position=1 -64,710-770,1212-1293,1713-1744
RPSFVEILANFVDFPGFTIGSILDGYNRHKIPGGRVKVMVECFINSKTADIHRSPFPNIFLLIYANGSVFHLTMSLVP

SEQ ID NO: 124715 - protein, 174 aa, Heterodera glycines
  Coding regions on vcDNA: vcDNA=SeqID_51138; Strand=+; Position=1 -66,398-665,724-757,1221-1375
MLKDKIVDKDSQYLVKMQLNSEERWTKAMKCVLLNMKRVIGILTTLPPTLMVNPTTAAAAATAGSRTANTTAIIGTAIPTHSPSTSSSSRSSCTGTAPVVHSSQTVPAAKDAPSSSTGQRKQNSFCSATQRHPPSTGGRRPLLLPPVQWPMATAATKRKYLRRPFTLKTAVVDP

SEQ ID NO: 124716 - protein, 95 aa, Heterodera glycines
  Coding regions on vcDNA: vcDNA=SeqID_51139; Strand=+; Position=1-286
MSNKLNLPLAFCTLFVHILLDVPSSSDGMIANTVRNPAFSKFVTQITHKSTQTAQLAQRVVAQKATGGTIRRNVANTQTKNVGKMPKTATQETTN

SEQ ID NO: 124717 - protein, 45 aa, Heterodera glycines
  Coding regions on vcDNA: vcDNA=SeqID_51140; Strand=+; Position=1-137
MEEFKEGLINAALDILPDFAFAVPVSLFVANPPAAILWAGWLAVG

SEQ ID NO: 124718 - protein, 367 aa, Heterodera glycines
  Coding regions on vcDNA: vcDNA=SeqID_51141; Strand=+; Position=1-1103
  Homolog annotation: Hit_ID=EAL42084.1; Match level="QueryCoverage =100%, HitCoverage=99%, E-value=4e-30, Identity=26%"; Hit description= ENSANGP00000025790 [Anopheles gambiae str. PEST]
LTAKVEDQEDDVNATTASNSTEETAVTAKVEEQKDDANATKATALTAKVEEQEDDVNATTASNSTEETAVTAKMEEQKDDANATTASSSTEETAVTAKVEEQEDDANATTASSSTEETAVTAKVEEQEDDANATTASSSTEETAVTAKVEEQKDDANATTASSSTEETAVTAKVEEQEDDVNATTASSSTEETAVTAKVEEQEDDANATTASSSTEETAVTAKVEEQKDDANATKATALTAKVEEQEDDVNATTASNSTEETAVTAKMEEQEDDVNATTASSSTEETAVTAKVEEQEDDANATTASSSTEETAVTVKVEQQEDDVNATTASSSTEETAVTAKVELQEDDANATTASSSTEETARTVK

SEQ ID NO: 124719 - protein, 334 aa, Heterodera glycines
  Coding regions on vcDNA: vcDNA=SeqID_51142; Strand=+; Position=1-1002
  Homolog annotation: Hit_ID=EAL42084.1; Match level="QueryCoverage =98%, HitCoverage=99%, E-value=6e-25, Identity=26%"; Hit description =ENSANGP00000025790 [Anopheles gambiae str. PEST]
QKKQQVTAKVELQEDDANATTASSSTEETAVTVKVEQQEDDANATAASSSTEETAVTVKVELQEDDANATTASSSTEETAVTAKIEHQEDDANATAASSSTEETAVTVKVELQEDDANATTASSSTEETAVTAKVEQHEDDANATRASNSTEETAVTAKVELQEDDANATTASSSTEETAVTAKMEEQEDDVNATTASSSTEETAVTAKVEEQEDDANATTASSSTEETAVTVKLEQQEDDANATTASSSTEETAVTAKMEEQEDDANATTASSSTEETAVTVKVEQQEDDVNATTASSSTEETAVTAKIEHQEDDANATAASSSTEETAVTVK

SEQ ID NO: 124720 - protein, 33 aa, Heterodera glycines
  Coding regions on vcDNA: vcDNA=SeqID_51143; Strand=+; Position=1 -89,187-199
MEIRRIMRSIFGLETYDSTKRFIDQSILGCVIY

SEQ ID NO: 124721 - protein, 25 aa, Heterodera glycines
  Coding regions on vcDNA: vcDNA=SeqID_51144; Strand=+; Position=1-75
MELLEPRKGPGLSEFSRHYDPECFN

SEQ ID NO: 124722 - protein, 173 aa, Heterodera glycines
  Coding regions on vcDNA: vcDNA=SeqID_51145; Strand=+; Position=1 -74,198-411,758-888,1050-1157
  Homolog annotation: Hit_ID=EAA73157.1; Match level="QueryCoverage =97%, HitCoverage=30%, E-value=3e-31, Identity=41%"; Hit description =hypothetical protein FG03593.1 [Gibberella zeae PH-1] ref|XP _383769.1| hypothetical protein FG03593.1 [Gib
KCPVKGFNGECFERNGGNDTEYENWCYQYASTSMNYDMKPSLILVASSTADVIAAVRFARSKRVNVAVRSGGHQFSGASSASGKNIQLDVSQAFRDFAVLPNCSNSSVAVRVGISFTLLEFFLMMAEKGLFVPGGLCSNVHIGGHIQTGGYGVAIRAFGLEADHVLAFDHYGR

SEQ ID NO: 124723 - protein, 123 aa, Heterodera glycines
  Coding regions on vcDNA: vcDNA=SeqID_51146; Strand=+; Position=1 -148,180-403
MRLWVASLCFYVSIFIFCEILRGFAYRFELHIQIGGEHHQLITSLIYEVAFVKLRIGKAQFLTASNTSDQLLSFSRSICLIERFVLIGPQRKNLPYFTIAAGISRDSLPGPTFYQFTFFLTAL

SEQ ID NO: 124724 - protein, 226 aa, Heterodera glycines
  Coding regions on vcDNA: vcDNA=SeqID_51147; Strand=-; Position=1 -38,98-173,233-296,424-554,618-719,1473-1619,2032-2154
  Homolog annotation: Hit_ID=CAE65781.1; Match level="QueryCoverage =90%, HitCoverage=83%, E-value=7e-80, Identity=63%"; Hit description =Hypothetical protein CBG10876 [Caenorhabditis briggsae]
MSAKIYKTDGFSGFYNGLSASIMRQLTYTTTRFAVYETVKKQSSGDLNFGQKMLLAGVAGACGGVAGSPADLVNVRMQNDIKLPPAERRNYKNAIDGLFRMAREEGVSKWFNGCTMATGRAVLMTIGQLSFYDQIKQVLKTRMMNAPPGQFKGLWDCCVYTAKLGPTGFFKGFFPAWVRLAPHTILLFVFFEQLRMRCGYLPEKKVMQKEADDPKNITTENFSKEK

SEQ ID NO: 124725 - protein, 84 aa, Heterodera glycines
  Coding regions on vcDNA: vcDNA=SeqID_51148; Strand=-; Position=1 -76,130-241,303-368
  Homolog annotation: Hit_ID=NP_509133.1; Match level="QueryCoverage =89%, HitCoverage=25%, E-value=1e-26, Identity=72%"; Hit description =oxoglutarate/malate carrier protein (32.0 kD) (XH342) [Caenorhabditis elegans] gb|AAC46570.1| Hypothetica
MDFLKADERRVSRWYFGGIAGSMAACFTHPLDLLKVHLQTQQQGKLSLPGMSAKIYKTDGFSGFYNGLSASIMRQLTYTTTRFA

SEQ ID NO: 124726 - protein, 93 aa, Heterodera glycines
  Coding regions on vcDNA: vcDNA=SeqID_51149; Strand=-; Position=1 -168,223-333
MVDVRKKLELEVKIDPAIFVVCSGGAFDPTKTTLIPELGQLKLNTLDEPSTKAYEHITDQRLRSLVAKAYDNFQLCLSNLRLVFSTRRRPNSD

SEQ ID NO: 124727 - protein, 42 aa, Heterodera glycines
  Coding regions on vcDNA: vcDNA=SeqID_51150; Strand=+; Position=1-127
MNSLVEILCDFNDSEPHELSEILRHRKKEKVKLLRRHTLITP

SEQ ID NO: 124728 - protein, 195 aa, Heterodera glycines
  Coding regions on vcDNA: vcDNA=SeqID_51151; Strand=-; Position=1 -264,1800-1940,2587-2769
  Homolog annotation: Hit_ID=NP_492444.1; Match level="QueryCoverage =81%, HitCoverage=20%, E-value=3e-11, Identity=31%"; Hit description =MIZ type zinc finger containing protein family member, GEX (Gut on EXterior) Interacting protein GEI-17 (
MRFAFAVSRPGVLIIVTLLALCCAISEGGKPRSKSTHKPDVSSSSNNIPSPQFKWNNNAPVLAPWRSAANQRVSDLRTVELPFYQHIKQINSKPEKKQCSFPVDITRYVHPRDSENNEHRLEIEWDSDKRAWAFTINLVKRLDSNNLLSRILDNPNARRPLESTRQEIVKLNNPVEDGEQMEMDALKLSLVDPVS

SEQ ID NO: 124729 - protein, 87 aa, Heterodera glycines
  Coding regions on vcDNA: vcDNA=SeqID_51152; Strand=+; Position=1-264
QRVAKELEEFAGICETIAETKEKGKRKSAKAEKEEEERAEEKEEEETRGTKKRKKRGETTDEGEGQQKGRNGKGQTRRNKTQRGPDG

SEQ ID NO: 124730 - protein, 371 aa, Heterodera glycines
  Coding regions on vcDNA: vcDNA=SeqID_51153; Strand=-; Position=1 -101,148-238,296-348,391-546,607-804,952-1131,1229-1354
  Homolog annotation: Hit_ID=NP_499688.2; Match level="QueryCoverage =99%, HitCoverage=65%, E-value=3e-92, Identity=47%"; Hit description =putative protein, with a coiled coil-4 domain, of eukaryotic origin (51.9 kD) (3O25) [Caenorhabditis eleg
FREELLWCFYWLGLGVLSSIGLGTGLHTFLLYLGPHIARVGPHIARVTLAAFECNSLDFPEPPYPDESVSPDAMGHSSLVTLWTIIAKDAMGHSSLVTLWTIIAKVRLESLMWGAGTALGELPPFFMARAAVRLESLMWGAGTALGELPPFFMARAARLSGHEPDSEEYREFIAIVERDATNQNLMERIKLWMERAVNLMERIKLWMERAVTRMGFPGILLFASIPNPFFDLAGITCGHFLIPFWTFFGATLIGKALVKMHMQMLFVVLTFSEHHVEHLVSLLNKIPRIGTVLQAPLKEFLQAQKISLHRRPGDPIPEQASSLSFCRNSNSFCRNSNVFFQILWFVYSLINSLAQQYQRRMWEKERIDKKL

SEQ ID NO: 124731 - protein, 74 aa, Heterodera glycines
  Coding regions on vcDNA: vcDNA=SeqID_51154; Strand=+; Position=1 -52,602-774
MFKFLFSRPELLKKIAGGERKVYSDAEKLEYVKRDEEMKRRNPMISDRKIAEKLSIPIANLIRWTKKLGTKLNR

SEQ ID NO: 124732 - protein, 48 aa, Heterodera glycines
  Coding regions on vcDNA: vcDNA=SeqID_51155; Strand=+; Position=1 -134,1458-1470
MGAKEMDRNPDPAWEIALEKLIKKLFLIESVRVRISTLGPPKSVRLKM

SEQ ID NO: 124733 - protein, 256 aa, Heterodera glycines
  Coding regions on vcDNA: vcDNA=SeqID_51156; Strand=-; Position=1 -61,105-811
  Homolog annotation: Hit_ID=CAF96846.1; Match level="QueryCoverage =95%, HitCoverage=20%, E-value=8e-30, Identity=27%"; Hit description =unnamed protein product [Tetraodon nigroviridis]
MKLTIFAILFVALFIAIAEADGNVRAKRHEERLKRQDNRADEENRQVDSADREKRQDNRADREKRQDNRADREKRQDNRADREKRQDNRADREKRQDNRADEENRQVDSADREKRQDNRADREKRQDNRADREKRQDNRADREKRQDNRADREKRQDNRADREKRQDNRADREKRQDNRADREKRQDNRADREKRQDNRADRKKRQDNRADREKRQDNRADEENRQVDSADREKRQDNRADREKRQDNRADEENRQ

SEQ ID NO: 124734 - protein, 152 aa, Heterodera glycines
  Coding regions on vcDNA: vcDNA=SeqID_51157; Strand=+; Position=1-457
  Homolog annotation: Hit_ID=CAF96846.1; Match level="QueryCoverage =100%, HitCoverage=19%, E-value=8e-21, Identity=30%"; Hit description= unnamed protein product [Tetraodon nigroviridis]
NRADREKRQDNRADREKRQDNRADREKRQDNRADREKRQDNRADEENRQVDSADREKRQDNRADREKRQDNRADREKRQDNRADREKRQDNRADREKRQDNRADREKRQDNRADREKRQDNRADREKRQDNRADREKRQDNRADRKKRQDNR

SEQ ID NO: 124735 - protein, 161 aa, Heterodera glycines
  Coding regions on vcDNA: vcDNA=SeqID_51158; Strand=+; Position=1 -16,142-327,377-658
  Homolog annotation: Hit_ID=NP_473064.2; Match level="QueryCoverage =95%, HitCoverage=17%, E-value=7e-14, Identity=31%"; Hit description =hypothetical protein PFB0680w [Plasmodium falciparum 3D7] gb|AAC71925.2| hypothetical protein PFB0680w [P
MGEVFGKKRFSELEKRKIVRHFMEMKANNWTKMDNKTRSEKEKEVTMTFEVSRTTIAKWKCQLRKRGDDQWSEEEANEHTSDEGTENLDGEEDGQQPMAHEDNANENDSENANYSENDNENANSSENDSENANGRKNDSENANYSENDSENDTKIGVKESL

SEQ ID NO: 124736 - protein, 220 aa, Heterodera glycines
  Coding regions on vcDNA: vcDNA=SeqID_51159; Strand=+; Position=1 -32,87-359,410-764
MTDQQQPKKKMPIELCQEVVQMCDHKGPTAFVKIAKINFQFWKLVNDHLRNKKWLLDYLEIDEKQMNGRTEMVIYDGTGKILPIPQNPLPNKISGFQTIWITYLDANVIAFLHLFQHLFTSCEITLTIEMTNGQFLFSLAQNIWPLIKNNVKRFSMPTNFEHFRHHFPSILSSDQWPSLQFVYCEDVLPDFPADDSANASDGQVLTNWLFSAHSCDLPPK

SEQ ID NO: 124737 - protein, 77 aa, Heterodera glycines
  Coding regions on vcDNA: vcDNA=SeqID_51160; Strand=+; Position=1 -69,403-567
MCDGRGGRIGHLLAHFVHSRTDSARSAEFIGPCAPPIPTSSAAAATPTVGLSHGVKRLNRQTERRTAPSIIPKSLSV

SEQ ID NO: 124738 - protein, 46 aa, Heterodera glycines
  Coding regions on vcDNA: vcDNA=SeqID_51161; Strand=-; Position=1 -62,620-698
MPTVTIKFGRIVHKIEGQTQFKFQPFPSLGALQYCLGRHRPQSEQV

SEQ ID NO: 124739 - protein, 27 aa, Heterodera glycines
  Coding regions on vcDNA: vcDNA=SeqID_51162; Strand=+; Position=1 -67,556-572
MSLFNPNEPFEMRIETVQEEGEDCRFS

SEQ ID NO: 124740 - protein, 29 aa, Heterodera glycines
  Coding regions on vcDNA: vcDNA=SeqID_51163; Strand=-; Position=1 -13,408-484
MHLENGNFVLRSAPISNDALRLLHSLKIC

SEQ ID NO: 124741 - protein, 44 aa, Heterodera glycines
  Coding regions on vcDNA: vcDNA=SeqID_51164; Strand=-; Position=1-234
SRGNSVGHRRFRCPIFGHIVFNSNLTFAILTWFLIGYSFLNIIV

SEQ ID NO: 124742 - protein, 126 aa, Heterodera glycines
  Coding regions on vcDNA: vcDNA=SeqID_51165; Strand=+; Position=1 -148,957-1189
MSFFILTVRGGAVRGGRGAFIFIGALAVAAVLQGANADQQAADSIQINVDISATISIRIELGLQALRPIVPLPDPRIWPLKRPEISSPRGRGLTPILSKFIKWAVFCGPLAHKLESRVNYSITNLV

SEQ ID NO: 124743 - protein, 38 aa, Heterodera glycines
  Coding regions on vcDNA: vcDNA=SeqID_51166; Strand=+; Position=1 -14,495-594
MAKVSILICYLGSLDPSGANWAYGMSPEIQFQVPNHQE

SEQ ID NO: 124744 - protein, 107 aa, Heterodera glycines
  Coding regions on vcDNA: vcDNA=SeqID_51167; Strand=+; Position=1 -164,1321-1480
MAFVPFRPLIVHPSSALRSLCLLLDNPLRSGTVNSWSNDAVCAATSSSVPNVTAPAATDRLRFTFRTIPFIAKMDNKMTLKTISRDMVEQNYEQMVAISKHIIQMIR

SEQ ID NO: 124745 - protein, 120 aa, Heterodera glycines
  Coding regions on vcDNA: vcDNA=SeqID_51168; Strand=+; Position=1 -86,512-788
MAHLELKHSTPGFRVKQPWLHTHLEFENRRVEQMTGFYTENAQLRARAGPNWCAGTCRTRPPPTPSSSQHGPETIAQFTQSKQHSPGSGYQTPKGWPQDRAHAATPSISAHSACKCPIRH

SEQ ID NO: 124746 - protein, 73 aa, Heterodera glycines
  Coding regions on vcDNA: vcDNA=SeqID_51169; Strand=-; Position=1-236
NALLVRCFVGSCTCTCSYVTCSARLWGFGVLARTCGSNSRFTDRNSSAPMLCMLWRSAWITGIPALIFRPELR

SEQ ID NO: 124747 - protein, 63 aa, Heterodera glycines
  Coding regions on vcDNA: vcDNA=SeqID_51170; Strand=-; Position=1 -148,628-671
MIVFQILCFKVLFVYLIYRLYFFAFLNKQFVPNFEELKRAVGQLHGSDRQNSGVNDLSTMYVI

SEQ ID NO: 124748 - protein, 159 aa, Heterodera glycines
  misc_feature (8)..(8): Xaa can be any naturally occurring amino acid
  Coding regions on vcDNA: vcDNA=SeqID_51171; Strand=+; Position=1 -167,228-367,410-491
  Homolog annotation: Hit_ID=CAE60841.1; Match level="QueryCoverage =80%, HitCoverage=26%, E-value=6e-39, Identity=62%"; Hit description =Hypothetical protein CBG04550 [Caenorhabditis briggsae]
KSFSNKRXISAQVKPPQNGNVHSSQNKAIPEINGFVGFDSLPYQLVRKCQESGFQFNLLFQFNLLCVGETGMGKTTLLESLFNMKMEFEQCNRELKTVELREKTFDVQEGAVKVKLRVVETAGFGDQLDKEDVQEGAVKVKLRVVETAGFGDQLDKEKS

SEQ ID NO: 124749 - protein, 144 aa, Heterodera glycines
  Coding regions on vcDNA: vcDNA=SeqID_51172; Strand=+; Position=1 -132,266-422,627-772
MVGFHINALERLMNDMIQAPSARALRLITTECENGPHTPRKILRWINLIADQNCKLPTVNEAKTYARALEVTTQIKKLAQRQNRITNSSFYAMWQSALLKKQINFESLKTPHEISQRMVSFFIENRFDSYHADVHRNASADYFE

SEQ ID NO: 124750 - protein, 218 aa, Heterodera glycines
  Coding regions on vcDNA: vcDNA=SeqID_51173; Strand=+; Position=1 -304,351-419,527-633,678-728,801-926
MFSVPMPSCLLPSPSSTSLTPVQTPVLSPIVNDSRFSYHVPMPFSPFSPPPTPTFFQTAVPVTDDTLLRLANFVRSTNSDTQQQQQLVRQQQMAGIESKDDDARRISAANIGTMARVAMLELVRAQVRSPIVDFLCMVLSDFNQFGHFCSFIDSREFKILNTKAFTELLNLRSKQKPKSYLQVARALKGYEGRLVDGHVMLRKVKDKRNQFKFFPDLP

SEQ ID NO: 124751 - protein, 33 aa, Heterodera glycines
  Coding regions on vcDNA: vcDNA=SeqID_51174; Strand=+; Position=1 -68,183-216
MDIANHKWGREETAAWHREMMDRKLWWGNLSLL

SEQ ID NO: 124752 - protein, 84 aa, Heterodera glycines
  Coding regions on vcDNA: vcDNA=SeqID_51175; Strand=-; Position=1-255
NEIRLNRRLNKTAPSQLLEFIIAFTNFSYGIKLNGKFLLSSNISDGEEEFFPQKWWEKLRFDQMTSFEVRKSVDKGLKVLRYRK

SEQ ID NO: 124753 - protein, 268 aa, Heterodera glycines
  Coding regions on vcDNA: vcDNA=SeqID_51176; Strand=+; Position=1-804
MPSKQQNLRKKMQDVYRRQAERSVSRDNSPVSDGSADGNGEASAYLRGTSTPSLSALQISTPASSIGSKKRGRPLRAGAKPILATQERVSLIDTPRTAVTQSDQGSPCKKRGKVAECGQPMFANEAIALTPVSTLSRGGRPVKQLGGHAGKGRGKTNESMSKCSEIDQSVENALSPAPSHIVPEKINFSTVQINFATSRNFACKIWKWAAIGLYERDGETPIAPSSGPRYIETCWNDMTQFLNDGFAATYLAYLATISQRKVVVVDPM

SEQ ID NO: 124754 - protein, 25 aa, Heterodera glycines
  Coding regions on vcDNA: vcDNA=SeqID_51177; Strand=+; Position=1-78
TSLLKSLINQHDPKPSTSSSDGQVT

SEQ ID NO: 124755 - protein, 21 aa, Heterodera glycines
  Coding regions on vcDNA: vcDNA=SeqID_51178; Strand=-; Position=1 -54,579-590
MRTRPIWQVKQRLLTSQKKGF

SEQ ID NO: 124756 - protein, 297 aa, Heterodera glycines
  Coding regions on vcDNA: vcDNA=SeqID_51179; Strand=-; Position=1 -234,555-1213
SPKKKRDIEKKQRNSTQSGEEEEMTTPKTSRVPMKASAITERARKANKNGNNDKFSSTISNGSTSSAASRGVSSSSTQTTQSSSSASSLLNIAPDILRQQLPAKPIGTDAPTTFPLLTTLSSLPAAEAATASSSAFNLHGGVRPEWFDRLFASTTHGAAATVAQRGAGGTTVTELSSSTQQHYQQKQQQPKHRKRWPETADEEEEFGTTFVWEQLYATKMFQFEQDKAEEGVDEYGGVAQHLREEAIRIGDKGNHLLKTLSNGSDEATAADANSCVGDDESNAAPEWADQGIADFAT

SEQ ID NO: 124757 - protein, 36 aa, Heterodera glycines
  Coding regions on vcDNA: vcDNA=SeqID_51180; Strand=-; Position=1-112
DSKQAAIPNNPMSPPLLIIPKLLPSETVPHLVLFPV

SEQ ID NO: 124758 - protein, 16 aa, Heterodera glycines
  Coding regions on vcDNA: vcDNA=SeqID_51181; Strand=-; Position=1-49
EAIPEGFGLPINLGAS

SEQ ID NO: 124759 - protein, 291 aa, Heterodera glycines
  Coding regions on vcDNA: vcDNA=SeqID_51182; Strand=-; Position=1 -240,543-799,968-1254,1325-1414
MKKMYNKAKENATKMEQNEMEQKIFLTGNGQLFGMDMAQTSSSLSSSSKSASKNADANKNYGEKKDELILHLLIYEVESVIEDEAFLMFVKGQSNFMYVLEYAFDTVTRHNLRQTVDETNKRFYTQKYVKHLGILHLMRRDWHCAENGAKFKPESSSDKNAQEIERNDSALVQYEQNVECKKFRSYLDMVYEFLFRVHNGVASAVKPIFEMSGTILTLIDVISALGKISNLNFGFELENFVDVQKLKLLNWNELLKYRKTAAKPKFQTEELFIQVSSKKPDNQKLSDEVYE

SEQ ID NO: 124760 - protein, 99 aa, Heterodera glycines
  Coding regions on vcDNA: vcDNA=SeqID_51183; Strand=+; Position=1 -56,105-209,328-466
MAASALYIPVFKRCSNLSKKLNGDGEAKAEASSQNSTQIYAYIFALVQSASTLGSFFGSTIGGYGADAFGFPWICAFVAFAHFLFIILEQIRRILSKYL

SEQ ID NO: 124761 - protein, 41 aa, Heterodera glycines
  Coding regions on vcDNA: vcDNA=SeqID_51184; Strand=+; Position=1 -29,175-271
MVYQMYLASNFNNCKSNTSQDFLVIISFCFRIATFGIQFVT

SEQ ID NO: 124762 - protein, 360 aa, Heterodera glycines
  misc_feature (7)..(7): Xaa can be any naturally occurring amino acid
  Coding regions on vcDNA: vcDNA=SeqID_51185; Strand=-; Position=1 -191,246-396,440-612,669-756,823-977,1212-1431
  Homolog annotation: Hit_ID=XP_424729.1; Match level="QueryCoverage =91%, HitCoverage=34%, E-value=1e-53, Identity=37%"; Hit description =PREDICTED: similar to RIKEN cDNA 2610528A15 [Gallus gallus]
SVTGKEXFTKTVFLFHRNFRWITSGEYIQMKRRAGRRGKDKGLVILMVDQQMSAETAMQIIKGTSDPGTSDPLNSQFRLTYNMVLNLLRVPDINPQFMLGNSFYQWQNYSRLPDLLQKLNTKRQLFLSAHVDHLSELLNTKRQLFLSAHVDHLSELEGLFRLEKQIEQQRNAIKALVLKPAKVIRFFQPGRMLKLKCFLKCFDKDFGWGVLLRYTKKPNPLNPLSPESAVKPPPPGENGVAVKPPPPGENGVVVVLPFAFDCIQAVSTIRLKIPQELKSKEAFQAVAKTILETKKRFDQLIPELDPIEHMNRSDPQLKKSLEELKRCEERFTEHPLKGLDIWEASIMGQKLEDEYKQAKK

SEQ ID NO: 124763 - protein, 206 aa, Heterodera glycines
  Coding regions on vcDNA: vcDNA=SeqID_51186; Strand=-; Position=1 -52,253-429,500-688,1104-1283,1756-1778
MSSTEEKVRLAQAKATKTKKLSDHEKKRITKQFFNLKEHLENEKMPTKMLEKKIANTFGIHERTVYDWKKKFGINAKTKIKRYSKEQKFEIVQQFDQMKSQMKGKSIAKTAYEMDQQIAKELGVSRSVICQWKKDFGMTNSNHCHDDSEKIKIVKKYFKMIKLNPHLSKNSFAEQFNISHRTLNNWISKFAMKNVNNNKTVVAEIA

SEQ ID NO: 124764 - protein, 517 aa, Heterodera glycines
  Coding regions on vcDNA: vcDNA=SeqID_51187; Strand=+; Position=1 -34,1518-2992,3900-3953
  Homolog annotation: Hit_ID=S08405; Match level="QueryCoverage=97%, HitCoverage=45%, E-value=3e-96, Identity=38%"; Hit description =hypothetical protein 2 - silkworm transposon mag
QRRTEVKLSKSMKLTHEGRTIESNIHVISGKHKNLCGRDLIMGLKIDLNRAFGIPTIRAVENKKELEACLAHEVEKVLDQWQAEKIIEPVATSEWATPLVIMPKANGKLRLCFDYKVTVNPWLDVHQYPLPRPEELFSILNGGEKFTKIDLKDAYLQLMLDEKAKNCLTICTHKNFARLPFGVASAPAIFQQVMEEVLQGIDGVAVYLDDILITAATDQQHVKRIDQVLKRLSEKGLRVKREKCEFLKSEIEYLGHIVDKNGLHASPGKIEAILKMPEPKNLELQSFLGMVNYYGKFVPSLATLSEPLNELRRNDAKWTWTKSQQKAFDRIKNFHKDEKRKVGVIAYASRTLNSSERNYSQIEKEARAIIFGVDKFKQYLYGRKFVLQTDHEPLKEIFGPKGELPIVAAKRLHRWSLTLMNFDFEVVYCSTKNLAADGLSRLPCPEETTIDCVGLEVQQVQAENISCLPVTVSARKEVKKDEILRKVKEFIEKGWPQKVEINPLKFFNYLFSQQKYK

SEQ ID NO: 124765 - protein, 571 aa, Heterodera glycines
  Coding regions on vcDNA: vcDNA=SeqID_51188; Strand=+; Position=1 -1383,1414-1695,2948-2973
  Homolog annotation: Hit_ID=S08405; Match level="QueryCoverage=99%, HitCoverage=47%, E-value=1e-96, Identity=37%"; Hit description =hypothetical protein 2 - silkworm transposon mag
CECFSQFDQVPEFARTTIENARYLGSEILHKYEKREDVVLAYASRTLKSSECNNSQIETQEKAMIFGVDKFKQYLYCRKLVHHTDHEPLKKIFGPKGELPIVAAKRLHRWSLTLMNFDFEVVYCSTKNLAADGLSRLPCPEETTIDCVGLEVQQVQAENISCLPVTVSPIAKEVKKDEILRKVKEFIEKGWPQKVEEGLKSFHVIRNEFALMEGCIMFGNRTIIPSKFRTKMLEILHATHPGMVRMKALARQKMWWPGIDNEIEIIRKRCKICQEEAPDERKVPLHPWESPERLWQRIHIDFCGILGINVLISMYAKSKWPEVVRMRTTTALATNEALRIVFTAHGLPEQIVSDNGPQFSSKAFGDYCQSRGIVHTLIAPYNPKSNGAAERFVQTFKQGMNKLQKEGMKQEIALSQFLLKYRVTPHAATELAPSEILFGRRLRTLLDFVKPTAKESYAERMKRNFDRGANKESYAERMKRNFDRGANSRKNFEVNQRVYARNYPDGSKWIPGQITRKIGTAMFLVRTARGMWRHFDQLKENLTDQNSDNSSSESEDNSDSEDELLAQNFSK

SEQ ID NO: 124766 - protein, 101 aa, Heterodera glycines
  Coding regions on vcDNA: vcDNA=SeqID_51189; Strand=+; Position=1-306
MSVRKCPSANVRPQMSVRKCPSANVRPQMSVRKCPSANVRPQMSVRKCPSANVRPQMSVRKCPSANVRPQMSVRKCPSANVRPQMSVRKCPTAPISIFIYA

SEQ ID NO: 124767 - protein, 96 aa, Heterodera glycines
  Coding regions on vcDNA: vcDNA=SeqID_51190; Strand=+; Position=1 -202,396-484
MPIDQFELMNEQTNEQLTLLSNDESANCNHWVMKRCQIGQSATAQWEDRNLNDLMNNVNVEPYHDIPNATLMGINMPMSVPLAQEAVKFVVKLVHL

SEQ ID NO: 124768 - protein, 62 aa, Heterodera glycines
  Coding regions on vcDNA: vcDNA=SeqID_51191; Strand=+; Position=1 -31,608-765
MFRRLSPGEYAHFLMQEKRESTTAKITTELTNLKTKMEDEEWLPIEEMEEENDKVGEEVIKD

SEQ ID NO: 124769 - protein, 57 aa, Heterodera glycines
  Coding regions on vcDNA: vcDNA=SeqID_51192; Strand=-; Position=1 -3,258-319,764-872
MALLFSPPGIEKMCFNPVLDIFEPCADKKGNKIENECFSNRAAVIRPQETINFDKTE

SEQ ID NO: 124770 - protein, 75 aa, Heterodera glycines
  Coding regions on vcDNA: vcDNA=SeqID_51193; Strand=+; Position=1 -97,225-355
MNNSTFASKNDKLKNNHSNNASSNPKISTKQAMTSNYTKASQIFLKKSKSSDCQAHDDAPSSNDESMNNIEQIES

SEQ ID NO: 124771 - protein, 68 aa, Heterodera glycines
  Coding regions on vcDNA: vcDNA=SeqID_51194; Strand=-; Position=1-205
MPLIIYFSVLFYCVFLIFKIDPQGLNWLQLYNLLAAIPMFLPLALNPIVPICTINYYRLNFISYVKRF

SEQ ID NO: 124772 - protein, 153 aa, Heterodera glycines
  Coding regions on vcDNA: vcDNA=SeqID_51195; Strand=-; Position=1 -146,213-408,452-571
MVVHGLVTIKGVENRIWNLLALTFWMFLVYVSMFGYVSQFIFRYFVIVRDKNISSLKYFLLLFLMLLFPFAYCVNVFICFFPPSDHAILDDKYVAAILGINLDDQIILAGYTFNDVRVTIGYCYIIIVCTFAYLIMFVLAFRIKQFLEKKSKS

SEQ ID NO: 124773 - protein, 27 aa, Heterodera glycines
  Coding regions on vcDNA: vcDNA=SeqID_51196; Strand=-; Position=1 -15,217-285
MAITIILVQTCVTDILMLTMTLLFNPV

SEQ ID NO: 124774 - protein, 121 aa, Heterodera glycines
  Coding regions on vcDNA: vcDNA=SeqID_51197; Strand=-; Position=1-366
MNKATAGCQICGPYRTVVFCQRRFVYTQVNKQVVTENPLKAFVDWLVFQLPKKYDTYAYSHFGGRFDMVLVFRELFRIGFNPNILRKGNKLYEMKVHQKKTSNPNIIFRDSYNLMPCSLKV

SEQ ID NO: 124775 - protein, 246 aa, Heterodera glycines
  Coding regions on vcDNA: vcDNA=SeqID_51198; Strand=+; Position=1 -162,340-563,686-849,948-1140
  Homolog annotation: Hit_ID=CAE70196.1; Match level="QueryCoverage =93%, HitCoverage=10%, E-value=1e-112, Identity=77%"; Hit description= Hypothetical protein CBG16670 [Caenorhabditis briggsae]
PVLDCQGVQQQLSQQEERILTDKSKKWKQLQSKRYAEKRKFGFVDSQKEEMPPEHVRKIIRDHGDMTSRKYRHDKRVYLGALKYMPHAVIKLLENMPMPWEQIRDVKVLYHITGAITFVNEVPRVIEPRMRFPPFDDEEPPLDYADNILDVEPLEPIQMELNDEEENLVKEWFYDYKPLAKTRFVNGESYKQWSFSIPIMSTLYRLANQLLTDLLDENYFYLFDLKSFFTAKALNVAIPGGPTFDH

SEQ ID NO: 124776 - protein, 168 aa, Heterodera glycines
  Coding regions on vcDNA: vcDNA=SeqID_51199; Strand=+; Position=1 -84,266-579,708-814
  Homolog annotation: Hit_ID=NP_610735.1; Match level="QueryCoverage =98%, HitCoverage=6%, E-value=1e-75, Identity=78%"; Hit description =CG8877-PA [Drosophila melanogaster] gb|AAF58573.1| CG8877-PA [Drosophila melanogaster]
TSKLEDYDLPAFYFDPLINPIAQRNTERQMPEPLPGDDEEFEIPSDLVPMFNEFPLYTENTANGMALLWAPRPFNLRSGRTRRIIDVPLVKCWYREHCPAGMPVKVRVSYQKLLKVFVLNALKHRPPKPQKKRYLFRSFKATKFFQNTTLDWVEAGLQVLRQGYNMLN

SEQ ID NO: 124777 - protein, 60 aa, Heterodera glycines
  Coding regions on vcDNA: vcDNA=SeqID_51200; Strand=-; Position=1 -57,328-453
MVEQLQSFAGENEADVHFLLISAHKLILSSSSEVFDAMFRFDAQNAKNGKSKKTKNELSK

SEQ ID NO: 124778 - protein, 42 aa, Heterodera glycines
  Coding regions on vcDNA: vcDNA=SeqID_51201; Strand=-; Position=1 -40,349-437
MAKDLHGNLISDQSAVLCNSAEDGCWGRTKTPSFFPPYRYVN

SEQ ID NO: 124779 - protein, 54 aa, Heterodera glycines
  Coding regions on vcDNA: vcDNA=SeqID_51202; Strand=-; Position=1 -48,537-653
MCPPMIMIDHNDVKRIHTAKMGTKCEEERRECVRQMAHTQFVAKKKQKLNGEKH

SEQ ID NO: 124780 - protein, 79 aa, Heterodera glycines
  Coding regions on vcDNA: vcDNA=SeqID_51203; Strand=-; Position=1 -36,495-698
MSLSSKVHLGVGNRRAKAKRQEEATHEKVFFAQANAALVLAASVARATEAGGVATTMGDPATMANGTVVTKCQTMTTTW

SEQ ID NO: 124781 - protein, 175 aa, Heterodera glycines
  Coding regions on vcDNA: vcDNA=SeqID_51204; Strand=-; Position=1 -87,292-732
MFNVQSLLAENGTKCKSGTKSENGGELEKKHEAISIDNLALKTTTASTTPLLDHHKHHNHSLLLLQKPGTTTSTNCPAPLPAAPFDLPSTTTCCPATAVFPMFVPSGGANNIFPPVAGGGIVPPGSRNADFLPPQMNHHHHAAVAAAAFMPGSPMAAAAMLWLHQQINQQQHQQG

SEQ ID NO: 124782 - protein, 43 aa, Heterodera glycines
  Coding regions on vcDNA: vcDNA=SeqID_51205; Strand=-; Position=1 -64,99-166
MIKFVKIWVEKYLWEGSPLKKYFWIFNKFIQLLFFRRLMNFRN

SEQ ID NO: 124783 - protein, 86 aa, Heterodera glycines
  Coding regions on vcDNA: vcDNA=SeqID_51206; Strand=+; Position=1 -153,241-348
MPPGAVQLFTNGTKRNDDEMCHQNAIFYGRQFRKIYCLSAILGDEKVSIFFEFFCNIFPQKQCSKMFNGNEKNTLNFARSPFIRIF

SEQ ID NO: 124784 - protein, 84 aa, Heterodera glycines
  Coding regions on vcDNA: vcDNA=SeqID_51207; Strand=+; Position=1-255
MARVEDEAEVGRRTNTRCACPMWDGLDAKPIRWSDRLSEKGVEDGSKTRPSFAETEKALDETDSKDANVQALPFPRFKPIYPTR

SEQ ID NO: 124785 - protein, 79 aa, Heterodera glycines
  Coding regions on vcDNA: vcDNA=SeqID_51208; Strand=+; Position=1 -65,1413-1587
MAANRAHAVLFPFHYAQKATKKIWIILYKTYVRPLLEYAPEVWNPSLLKNIKKLKNVKNISPKEFFLNAAFHPFHTNKD

SEQ ID NO: 124786 - protein, 165 aa, Heterodera glycines
  Coding regions on vcDNA: vcDNA=SeqID_51209; Strand=-; Position=1 -36,82-265,318-595
MAHLGKIQIFTKAQPLSPADLDGLETASSVQVISRPTINGANTSFKKDKGPFAASTFVPFARQHRFLGLLDEQGDEALHSVLRRLEQLWKTMPDDEQMRQQLEHHFVSNWLLDTGRFDELKLWVERRALKNVVQLIKREEEQREQAEEDKMNEESDQDADIDIVD

SEQ ID NO: 124787 - protein, 51 aa, Heterodera glycines
  Coding regions on vcDNA: vcDNA=SeqID_51210; Strand=+; Position=1-159
YWSEAGPGILGKTGTRTCRDLRSRDRDLDFSSGPGTGTNREILKIQKNFKN

SEQ ID NO: 124788 - protein, 154 aa, Heterodera glycines
  Coding regions on vcDNA: vcDNA=SeqID_51211; Strand=-; Position=1 -85,605-981
RLYKDEIDPDNPPQQQIVQRIDAKAGKKGNKNRTDVNYHCDVHYHGTYKFTYLTNFFARWQTGAKIDRIDLFMGKAYLNYFLWHDANNETWESDEDDVLKLFRFQLPKMAKKLNTRSQFAMTVLPGLHEFCCPTDLANDDDLENCIGHEVANTK

SEQ ID NO: 124789 - protein, 17 aa, Heterodera glycines
  Coding regions on vcDNA: vcDNA=SeqID_51212; Strand=-; Position=1 -12,556-597
MLYKNKPFFLFYLLAQF

SEQ ID NO: 124790 - protein, 208 aa, Heterodera glycines
  Coding regions on vcDNA: vcDNA=SeqID_51213; Strand=+; Position=1 -55,1187-1389,1479-1580,1623-1797,1963-2054
MSALSYRTEIDRLSLAVNDSTAPSVGQPITMATRSASAAAYPVATPQLIVGTAGAGGGGKMPNAAVTAKQIQQQRHWQRQQQEQMQNLTFLEIFPSLENVVFKQLFLLALVLEGESNFSRHHHPPGNMLSTTLHQQQQQFSAGSDGGPFIRPSHQQQHTPWCRMLSLQLASSTAAPTRVILIDYQKRKSIPLPKYSKKYIIPRENGKN

SEQ ID NO: 124791 - protein, 989 aa, Heterodera glycines
  Coding regions on vcDNA: vcDNA=SeqID_51214; Strand=+; Position=1 -325,508-2306,2438-3280
  Homolog annotation: Hit_ID=NP_507780.1; Match level="QueryCoverage =78%, HitCoverage=55%, E-value=2e-32, Identity=23%"; Hit description =predicted CDS, DNA polymerase type B, organellar and viral family member (5T899) [Caenorhabditis elegans]
MYVKKVSLMDGLALDIERKLEIKPARYAGRKTMMKSMFISQDRFEFTANLFMDQITRRITMGLVSNADYSGTITRSPFNFQLFNVREIAIIANGRSYPQAPYDLDYPHDHNYCGELGGNETPTKRRRRNDDDDGEGEPKFQKNCIRTLSADKQYNQKFKMQSVKSTFVIENLPANPESMLRTLFAHCMSTALDESQQNGITPDQLGATISSDLLNPSIWIPIRRISDNTADSIMNRFLEVAQSKSREGSLWGSPFTVTITTLDVAQLPQRQQVRGSGKRTVDSVQHVVKESALLRINNIDDAYCLFYALEASRKYHIKEMSRRNFCYYINHPNERRLEDVFGLMSSVNIRTDLREYDAVVYVPIVVDYWNRKYATTNQRFKVFIFGVTGSYRPKFQYGPDNYNIEMPLYHHNGQFDGIRCGVGKAVFGRDYYCFSCECPYDNANGHTLQCKAKCINCGRIGVGRPCRADDNNDSYYRECTACGKDFMSQDCFSHHLSSNVCQQFKKCKQCGVVWNVRQNRRKGRSGHVCGEKFCYTCKCYHKPERGCFIQQLKARRPKKYRLIAFDCETTQNTRIEGDRRLHSVNFISCYVVCTNCINENLWRNSLQAPCCICGRQRTVTFSHRAYERTQTDAQFITPCPMAAFAQWLLSEFDPRYPTMLFAHFGGRFDNIMLFRQFFLNGFCPQMIRRGNKLYEMKIARGEKNPEIISLPPKADYLYGGMTPDRQRRFYQCYAEHRHQQFDLCEQLAAYCINDTHILIEALVAFRTEFLTIIDPLERHGCLDDDNDDEEEEEVEEEDKDNAFEVIGDGIDITWEPMTIASASMRHFRLNHLKREQLAIVPECGYDTTNTQSLVALKFMDWYAKKNGVSIQTAHSPDGEKKIGQYTVDGYIAATDTVIEVNGCHWHAHDHPRHRFQPQTVMANGKTAQRIREDDARRLAFITSQVQQVLVFWECEINAEKRYNDEMKRSFAQYKDSGPIHLKDCYHGGR

SEQ ID NO: 124792 - protein, 157 aa, Heterodera glycines
  Coding regions on vcDNA: vcDNA=SeqID_51215; Strand=-; Position=1 -158,212-527
MDENFHHRQLIPSKYLPTHPFSRRFLHTPHPFSCRLSANQNRAALFPMELWNMVEGDLYRTNNSVEAWHRNLNALFRSPSPRLSIFLRKVRQEESHWRQQVKDFANNPANGIRGKGMKRKQNYVDQDMNLNELYVTRNNRHPLQYLRAISNRMAEPL

SEQ ID NO: 124793 - protein, 56 aa, Heterodera glycines
  Coding regions on vcDNA: vcDNA=SeqID_51216; Strand=+; Position=127 -261,317-352
MSDMSAYMGSGPAEPAPSSGAAEASPSSGVASAYMGASPAYEPPAQEKSPDQSAYM

SEQ ID NO: 124794 - protein, 190 aa, Heterodera glycines
  Coding regions on vcDNA: vcDNA=SeqID_51217; Strand=-; Position=1-592
  Homolog annotation: Hit_ID=CAE71161.1; Match level="QueryCoverage =96%, HitCoverage=47%, E-value=3e-43, Identity=45%"; Hit description =Hypothetical protein CBG18017 [Caenorhabditis briggsae]
ASHRFLFIFSLFQLEMLNKKIIKTKYIINGVENKIIQINESEVYRTKYHRGRMLNRPYEWVFGMIQKSNKVRFFPVPDRSADTLLPIIAENIEVGSTIVSDGWAAYGGINNMQQQYNHEWINHQIYFVDPANPQIHTQGIEATWRALKQSLKHLHGTTPELLPTYLFQYAFRRYHENKKIFQHILEEMRH

SEQ ID NO: 124795 - protein, 71 aa, Heterodera glycines
  Coding regions on vcDNA: vcDNA=SeqID_51218; Strand=-; Position=1 -60,462-617
MPFRQGMMLECRGVHSIPLPQRNESDEAELDAQLKRAALAHAEHLERVIRTQKQIHDMETQQIVQVVVVKE

SEQ ID NO: 124796 - protein, 44 aa, Heterodera glycines
  Coding regions on vcDNA: vcDNA=SeqID_51219; Strand=-; Position=1 -7,104-231
MFKNKDFLRSGGGAGTPGKYYVVDFVVLQYFPIVTKESNLNLRL

SEQ ID NO: 124797 - protein, 108 aa, Heterodera glycines
  Coding regions on vcDNA: vcDNA=SeqID_51220; Strand=-; Position=1 -135,211-399
MSQNRDENSQPPVLDGPYPLAQERNEFVEDEAPVLLEMLDRLSQGGICQAMGVFSFVLADCLATFHTFAILFDCETPVPFDEQHKRYVFEHRDKPRLIYVSEDGSAIQ

SEQ ID NO: 124798 - protein, 27 aa, Heterodera glycines
  Coding regions on vcDNA: vcDNA=SeqID_51221; Strand=-; Position=1 -50,660-693
MGGVHGQLSASHLSAANELTNTFKFNY

SEQ ID NO: 124799 - protein, 171 aa, Heterodera glycines
  Coding regions on vcDNA: vcDNA=SeqID_51222; Strand=-; Position=1-514
MRALWRLARAFPGTLIRCICFYAAQALEIERLVAQQEIPDILVTTADATQGHESSLAVVVTTCSVFDSGADSQPFWADAARVDVAISRASHGMIIIGDLLLLNRTETWRRYLDQATTETTVVGPEYFDFEQFNNPDNYYDKDGQLISANGGAVRSELFYSKYGKNVWYNNS

SEQ ID NO: 124800 - protein, 108 aa, Heterodera glycines
  Coding regions on vcDNA: vcDNA=SeqID_51223; Strand=-; Position=1-327
PIWSVFAHEIWPIFAPNIHHLSFSDGQHLDNLRRYTSLAILTDLNQLNSIDSDNLLPAVIADDGPNVTGGQALAKWLQMPRSDGQPKQLICCVDTSEAIECVDSFKEA

SEQ ID NO: 124801 - protein, 132 aa, Heterodera glycines
  Coding regions on vcDNA: vcDNA=SeqID_51224; Strand=-; Position=1-399
MASNGKATEASSEEVRCSSGAAAASTASFVPSSDSPHNQPGSHAIDWKTYAALLSSPSGADLMAAMFSSAAALGPTKAHGEEEEEESERGEGQENVGEEEMTRKGRTTKRAVKDEETEEAEGEEREGKRMEL

SEQ ID NO: 124802 - protein, 127 aa, Heterodera glycines
  Coding regions on vcDNA: vcDNA=SeqID_51225; Strand=-; Position=1 -73,185-245,298-442,802-906
LAEDFAKLCISNYPIKPIANELTSGENGGESGAKPYNKEELETIGRFLTDILAFQQADESPHTPPAHLNLPTMAVLKKQIGDGVSAGFNRFSLVTHGFGGYAFAGVINVLIEMVKECEQRLSSTTEG

SEQ ID NO: 124803 - protein, 122 aa, Heterodera glycines
  Coding regions on vcDNA: vcDNA=SeqID_51226; Strand=-; Position=1 -124,177-305,625-740
STILHLLSLFQINEMQKEQNKELTEENKRLKAIIEELKAGKQKALITDQSQSSSTASAKSPSKPFKDHLRKTGSNSVDLRKSIEKSGIEIQTGQRQHSEDTCFTFLLEAEAVKASYGECLSN

SEQ ID NO: 124804 - protein, 345 aa, Heterodera glycines
  Coding regions on vcDNA: vcDNA=SeqID_51227; Strand=+; Position=1 -444,848-1246,1562-1754
  Homolog annotation: Hit_ID=NP_498064.2; Match level="QueryCoverage =93%, HitCoverage=22%, E-value=4e-31, Identity=33%"; Hit description =la related protein (3G102) [Caenorhabditis elegans] gb|AAK93859.2| Hypothetical protein R144.7 [Caenorhab
AGPRMMRVPYLSGGGGGIGGQRRSTGGGTDYWHKKGGGGSQSGGGREDDRDRRPGPGGSSYYHQQRNNDRWKRNQHPNAPPPLSVAQRRARGPLPDWDEVTGTLSVHQSIHYVSEHLMSGARSRGRQLRLHGNNGEPIFVRMRVIGLCQYYALSAVPPFDPSLGVIASAAAHPSAAPIVPSVAVTAAHAANVVSASVVPPASLLSPTGLISFPLSAPTALSPGAVVVATTDQFPPTSAAAQFTPVVLTAQFPSNALFATRPTTTAPFIDEQKLKDLVRSQIEYYFSADNLQKDFFLRRKMDIDGFLPLGLVASFPRVRSLTLDQNFIVSSLCDSDKVELNEDHQK

SEQ ID NO: 124805 - protein, 165 aa, Heterodera glycines
  Coding regions on vcDNA: vcDNA=SeqID_51228; Strand=-; Position=1 -123,174-266,324-464,633-772
TTYSVIISAEQSFKDQTQETITNGALIAFYVALAISFFEIIAFSVMSTLNLKLFTSKLETQNNVHNLSERYQLAENIRTGRQLGPTFLLHFLNNCVVIIPSVLGFYQIITHPKLLEMIWAFSMKIPLVQRIGDTEGQKIGRIDGKRMQEKKMNEMDNYFEMLTKQ

SEQ ID NO: 124806 - protein, 57 aa, Heterodera glycines
  Coding regions on vcDNA: vcDNA=SeqID_51229; Strand=-; Position=1 -28,450-595
MEGIAGKGEESDEQKAIKELHEFIKTKFEALQRHRQQESNAIKHNFIGTDYQNVLKI

SEQ ID NO: 124807 - protein, 104 aa, Heterodera glycines
  Coding regions on vcDNA: vcDNA=SeqID_51230; Strand=+; Position=1 -174,349-489
MWDCGLGSRKIPQFPKCGIADWDPAKSHNFQNVGLRIEIPQNPARDPVPHRAIPIWYHINIFYFDRNSRKCLPTLICLPDICGQTFADGHLRTDIHEQFREKIK

SEQ ID NO: 124808 - protein, 249 aa, Heterodera glycines
  Coding regions on vcDNA: vcDNA=SeqID_51231; Strand=-; Position=1 -110,154-190,367-559,605-762,824-912,975-1136
MPVLQSDRAKWRYPGSMRVLPGYRPQAGGVLDFGSLGGMGRCLPTAGGPSLNHTVQRHSDPKGRWTDMVTTSDQGSCISHTQRKFGKHFGIKSLTLLPTYRYIYMGTPVNVPMVRPNLRMVFTDFMLNNCDRAAAVQRRWDELADVAQRVHSGVQNVIYTEKPKKEPPVAGYDFVPATKAQEMYKRHGLAQALLCMGTNVNVYNVHNFSGRKIPLLYQCDEATGIAALHLTHRPVLHGPLVPTGEPPLS

SEQ ID NO: 124809 - protein, 265 aa, Heterodera glycines
  Coding regions on vcDNA: vcDNA=SeqID_51232; Strand=+; Position=1 -46,1015-1214,1362-1508,1567-1971
MFFGSLMRKSKRSTHVWNWKKGAAAYAAHWRDEFIGSDNPDVRAAAKAAAEGNFVRLGTNEYVRLDVRDLTQLNIDDALGNNEDVADVDLVKPLTAPTLKNVNADTRHEIMGTIVKRSLRAKAIIGLLQRKVVLTRHALDRTKAKFRKRKRELKREVNTAIGTIRAAEDDLFQQVQQLKEIAPKAKLKKLGLADIGPELSSESEGDEEEEDAAHNTEQQQQDDANDVPDDLTMDERADAARRREVLDFETPVYARELRVFFLECS

SEQ ID NO: 124810 - protein, 100 aa, Heterodera glycines
  Coding regions on vcDNA: vcDNA=SeqID_51233; Strand=-; Position=1 -152,423-573
MINLIIVQFVSIFISVPSLFLYALECWFIFEGRNQKFEGSFYKIFLLSAIIIFSSTSPTYWSQSVPWQLRHFLTLWHQCLVGWHVSFSPRLFTMCLWKIA

SEQ ID NO: 124811 - protein, 194 aa, Heterodera glycines
  Coding regions on vcDNA: vcDNA=SeqID_51234; Strand=+; Position=1 -106,245-592,661-791
MTRKCCVTDVPPTNEPLGLSDSGSPSASDSSYSSPNSEESASGTKKKPTRKSAAAGRSTKQTKSGPKSRHSPAGRGGGRPQTPRMKKQPLKKKPPSRTPGRRVKKPSTKKSPAPRRANTSTKKRGRPAKKAEQAKPSDSGTAADSGRDDSGHSEECLGDEEETNSQERCCWTFHETEGIARRTCGQQKGAGRTL

SEQ ID NO: 124812 - protein, 24 aa, Heterodera glycines
  Coding regions on vcDNA: vcDNA=SeqID_51235; Strand=+; Position=1-76
ITGVSIIAVLFLVFLMPSQNLVRF

SEQ ID NO: 124813 - protein, 95 aa, Heterodera glycines
  Coding regions on vcDNA: vcDNA=SeqID_51236; Strand=-; Position=1-700
LFEYPKRTLEKIDFFVFGAVPPNRCAQIYGEAESFGNSFPIACTLILLWIFAPHNCLSTPNGHLKKSIFLFSGQSPRTDAPRFMGRPNPSGIASL

SEQ ID NO: 124814 - protein, 45 aa, Heterodera glycines
  Coding regions on vcDNA: vcDNA=SeqID_51237; Strand=+; Position=1-419
LNLKKCQRLLFLKFFEILTFSLIIYYFAKLIHKYFLERALKRTKC

SEQ ID NO: 124815 - protein, 165 aa, Heterodera glycines
  Coding regions on vcDNA: vcDNA=SeqID_51238; Strand=+; Position=1 -160,229-566
  Homolog annotation: Hit_ID=XP_324453.1; Match level="QueryCoverage =98%, HitCoverage=77%, E-value=4e-14, Identity=35%"; Hit description =predicted protein [Neurospora crassa] emb|CAD70422.1| conserved hypothetical protein [Neurospora crassa]
MPAGPEGAEASAKPTGQSAAPGGTSAAGGTSAVGQQPAEASKKSLAPAGTASAVPSAYAAPGTGTAMSTTSQKSAAGGAMSQKSAAPAGGASALSTASQKSAAGGAMSQKSAAPAGGASALSTASQKSAAGGAMSQKSAAPAGGASALSTASQKSAAGGAASQKA

SEQ ID NO: 124816 - protein, 214 aa, Heterodera glycines
  Coding regions on vcDNA: vcDNA=SeqID_51239; Strand=-; Position=1 -97,139-275,772-1020,1339-1494,1702-1707
MNSSIYIPNDVLFDVFKLCDRFSINERFEFVNAHWSAFVAANEANHFPKFKMGKLWICPLFCSLQYSLRAHEETTNGEPHAEHFKIRTSTEPWAFKRVVELMKQKITLEIDKNYLIEMRQNGHQFEKLYEIDNSVIEFILTGRQFCSKIVVEAHQFALLFELIEKYKSASIFLHHAIPIVRLFVPSFAWHCRQFVEGTLCQVEETVYVSWARTA

SEQ ID NO: 124817 - protein, 25 aa, Heterodera glycines
  Coding regions on vcDNA: vcDNA=SeqID_51240; Strand=+; Position=1-88
FFRKMIKINTITYLSVCFQRKNNKT

SEQ ID NO: 124818 - protein, 204 aa, Heterodera glycines
  Coding regions on vcDNA: vcDNA=SeqID_51241; Strand=-; Position=1 -255,343-445,496-642,689-796
LGLLIAKMCKKSFNKLLNSQKCSLALFIRHFFRFPTKFCQKISDQFMQNAITAEALSSLASPVHCFSTPMALTFIDHLRNEKQQNIVFVDAFTWLRWHFQCDRPYELSFTSSINSSDGIIDQFSRICFVRPFPFALLNFRFAILSPFTAFNLFGISTIGNEFTNVFLVNAICVESSPKFAPSFHVKLIDQHINSFPFECPLEPE

SEQ ID NO: 124819 - protein, 16 aa, Heterodera glycines
  Coding regions on vcDNA: vcDNA=SeqID_51242; Strand=+; Position=1-48
MENVQQLNNFLGARYQ

SEQ ID NO: 124820 - protein, 242 aa, Heterodera glycines
  Coding regions on vcDNA: vcDNA=SeqID_51243; Strand=-; Position=1 -10,60-775
MFPSLPIPSTIAFIHPIMSAKIIRVPKIACDLSLAKNGVSKNRNYAQKASQTILALPIPSTIAFIHPIMNAKIIRVPKIACDLSLAKNGVSKNRNYAQKAPQTILALPIPSTIAFIHPIMNAKIIRVPKIACDLSLAKNGVSKNRNYAQKAPQTILALPIPSTIAFIHPIMSAKIIRVPKIACDLSLAKNGVSKNRNYAQKAPQTILALPIPSTIAFIHPIMNAKIIRVPKIACDLSLAKNG

SEQ ID NO: 124821 - protein, 82 aa, Heterodera glycines
  Coding regions on vcDNA: vcDNA=SeqID_51244; Strand=+; Position=1 -75,219-392
MKKDNKRETFGGHESNRERNPHGRVPWHAMPTVMDISCGTVFISSLMVCARRRRTSSRLRSAIAVKLMVNEELSRGELQLCT

SEQ ID NO: 124822 - protein, 771 aa, Heterodera glycines
  Coding regions on vcDNA: vcDNA=SeqID_51245; Strand=+; Position=1 -2256,2382-2441
  Homolog annotation: Hit_ID=NP_508324.1; Match level="QueryCoverage =62%, HitCoverage=19%, E-value=7e-49, Identity=25%"; Hit description =predicted CDS, peptidase family A16 and RNA-directed DNA polymerase and Integrase, catalytic domain and Z
MQRKLFNSIVLHDNSIHMVKTLNLLFSQIDSINNFRCFGEGNLTIGTPIYCREHDCFKNNSFKQIYGTKFCFYDPYEKIYLVKSDEELIQIKAWGTIEKVFYLPNNLNQSFIENRRNKREENSSINEEATIECLKGGIIIKAINDIQELQISIENYTIIKKNPQKEEIIYLPPKLTSFEYKPVIKFISNPDKSNEKQITCQSSPVCELINCRFCMEYLKSPQCVDQIHWALMLVIIMIILYVISLSLQIIRILTRFIHWILQFIFNCFKRKPKVNRIRISRPKLKRPLIYLITSSLILFKMIFACDEVTNLVAGTNDCAVTQEGKIECSYDQTTQLSITPEHLTCLKLDNTKTNTTMETLQITIETLTIICTEKSDYFTRGYELSSTSQKRCSGAGKCTGQTCQSVKMSDRNPEVNDHANNQPGYSYCVPSCGGWHCQCFLATDGCLFYRTYAESVGDEIFEVVNCPSWTIQARIKLSINPELTYSVNLKPGILTHIGDESNSSISVTLTSTSIPPTPLFGSTFIIVREELKAAIVANENLLKNILRCKNKEEAQSFSCTFPPEACQCHGGDSVVHCECEKSPLTEIFARQENLLPIKTQGSYVYFDSQIKAKIQQTTSLQMQVTLKGHKVKAIYDKNICNIVTISLEGCYSCTSGANWTLSCKTNFGTALANVECPSQKVQVNCDKEGKEQQIQLAYNKQNITENCEVICPDGKSEITLKANLEYISQQDTKIIPANNTNENPIIGTSLDQNYVCLPSSFAWECRDSAKS

SEQ ID NO: 124823 - protein, 99 aa, Heterodera glycines
  Coding regions on vcDNA: vcDNA=SeqID_51246; Strand=+; Position=1 -76,360-427,495-650
NTMDVLRTVREEGIRQPITVMYQRAPAPEDLPENWPDKAQIESIKMAWEAYNKSDAIVVILINEISETIFDANFFETELDRLSNGRIKVERITLNDCVH

SEQ ID NO: 124824 - protein, 67 aa, Heterodera glycines
  Coding regions on vcDNA: vcDNA=SeqID_51247; Strand=+; Position=1 -93,206-316
  Homolog annotation: Hit_ID=EAL32779.1; Match level="QueryCoverage =98%, HitCoverage=10%, E-value=2e-10, Identity=51%"; Hit description =GA19893-PA [Drosophila pseudoobscura]
MVHPNTRPKINEMVSELAVYGVLIGNMTTGAVSHNVQQGHLLKTKLATANEGGISTGSAVHDSPILF

SEQ ID NO: 124825 - protein, 30 aa, Heterodera glycines
  Coding regions on vcDNA: vcDNA=SeqID_51248; Strand=-; Position=1 -27,143-208
MPKALINQLHNGEMEEKQTPKRKATWEKGN

SEQ ID NO: 124826 - protein, 185 aa, Heterodera glycines
  Coding regions on vcDNA: vcDNA=SeqID_51249; Strand=+; Position=1 -94,227-340,561-717,789-903,1093-1166
  Homolog annotation: Hit_ID=NP_508381.1; Match level="QueryCoverage =94%, HitCoverage=70%, E-value=6e-37, Identity=44%"; Hit description =thioredoxin-like protein p19 (30.2 kD) (XC693) [Caenorhabditis elegans] gb|AAF39830.1| Hypothetical prote
MRRRPFLSLFILFLSLRFTPILAHTDNENAEGFGTDIEWVPWDQAVSVALDLNRPIFLLIHKTWCGACDALKKSFATSPKRKELLELSKQFVMVNTEDEEEPEEEEYAPDGRYIPRLFILSENNGTRDKKRANASSTNQFFFYLAPLQLILILIKIILNLGTEEGESVEGKEKREKEEEGKKKKK

SEQ ID NO: 124827 - protein, 169 aa, Heterodera glycines
  Coding regions on vcDNA: vcDNA=SeqID_51250; Strand=-; Position=1 -11,80-578
MNRRWICNDVWMDIFPSFDRPQLGLKLALLSPRFDALVDKHFNGKSELTIWRPIEISKDIGTKPKLYVQIGDKFVEFPLPDRPLPSKIRFDSIQIEYLKSRAMTIKAFISFSVTLITPSSLFFVQIIKFSTKEASIYICGFLHIPRMANQFGTFLFVKFGPFLRQTLVI

SEQ ID NO: 124828 - protein, 1162 aa, Heterodera glycines
  Coding regions on vcDNA: vcDNA=SeqID_51251; Strand=-; Position=1-3489
  Homolog annotation: Hit_ID=NP_508324.1; Match level="QueryCoverage =93%, HitCoverage=46%, E-value=1e-104, Identity=29%"; Hit description= predicted CDS, peptidase family A16 and RNA-directed DNA polymerase and Integrase, catalytic domain and
MEWPAFWQSFESAVDRAALEPVDKLNYLHGCLRGKAARAVTAYRGGDNYAHAVAALRRLFGDPRKIAEALQSELINLRPVDDSVGSLQHFLETLERVCRQLLNLNMPDDSPFMYQIIRSKLPSTVLSELIKMERAAGIPWGTPQLRAGLAEVLGVREEVERCLREANADRQTRFRHEARPNRPQRPERHENARVFSVAQSVRNSDDKRVPSCLFCPGRHWASECNKVTDAETRKRCLLQQNRCLNCLRKGHQLRECRSKQVCRVCKERHHSAICPSAKGTSSARSKQQKPSPRNKQSFGNERNSRPLVSSAVANEADSITEPKTVNTIMAIVSPSVPHLVMLMALRAPVFSESAPNKRRDALFFFDPGAQVTMVKTPLIRQLSLPKLQDDQLEVNPFHTRQPIKMKAPQHVLCVQREDGGYETLVAHRTDWIVPSVRRATFLQGMLVPVDEEPDILVGMADFWKFFNGVQRVSPQLFKVKTSIGSTVCGRDEIPSRPTADHPLSVMPVTVHVPANEDEMPNTAVSGIQRNESISDLDSLRQFWDLQNIGIRDDPLENDDETAQQIFDQTTTRLANGRYSVGWPWKNFPPDLPSNFAMAHRRLSSILNRLQHFPELLAKYEATIQEQLRLGLIEPAVRTRGLEHFLPHHCVVTHKFRQVLDASAHPKGQNSLNKCMFRGPVIMPELAGILMRFRLAGIALWGDLEKAFNSLSLLERDREFCKVLWVNDVRKPPLPDNVVIYRWSRVPFGVIASPFLLAATIQKHLKQDGSPLAIEMAENAYVDNLLMQCTSPSEALNKYMSSKTLFRACQMNIREFICNSDEVMCRIPKEDQLVKEVPKVLGLHWELRPDKLYIDFPPMDTESRCVTRRTVLQQLASVFDPLGLVCPALHDAKMFFQSLWETKLDWDDPLSTDKVQEWNTIATTWNQQKVRVPRRVIPLEVASHQLHAFVDASKDAYGACIFIRAQHEITITAHLIFAKSRVKPKGSNLTIPRMELMGMLIGIRMLQFAEKQLGLAVRHKFIWCDSKPVLGWVSSSEQQPRFVENRLKEIRAVDQVCFRYISTEQNPADVASRGCTVLELTSHPLWWNGPSWLIHPEDRWPITIEVKPANDDVQTIAEIAAIVPIVQKVEAWICADRFSDCTCLRNVVVLLLRALRRWLSMSR

SEQ ID NO: 124829 - protein, 210 aa, Heterodera glycines
  Coding regions on vcDNA: vcDNA=SeqID_51252; Strand=+; Position=1-631
  Homolog annotation: Hit_ID=NP_508324.1; Match level="QueryCoverage =100%, HitCoverage=8%, E-value=1e-36, Identity=43%"; Hit description =predicted CDS, peptidase family A16 and RNA-directed DNA polymerase and Integrase, catalytic domain and Z
NGRYSVGWPWKNFPPDLPSNFAMAHRRLSSILNRLQHFPELLAKYEATIQEQLRLGLIEPAVRTRGLEHFLPHHCVVTHKFRQVLDASAHPKGQNSLNKCMFRGPVIMPELAGILMRFRLAGIALWGDLEKAFNSLSLLERDREFCKVLWVNDVRKPPLPDNVVIYRWSRVPFGVIASPFLLAATIQKHLKQDGSPLAIEMAENAYVDNL

SEQ ID NO: 124830 - protein, 182 aa, Heterodera glycines
  Coding regions on vcDNA: vcDNA=SeqID_51253; Strand=-; Position=1-549
MSSARCRMALGPALFRLRQHVTTAENLLDEPVINAETTENLEQERGHITRILSRMEVELDAWGAIMNGLQGPAREAEEALFTAFIRDDRHLTEWLEDAREMLAHIAAELADEPNQPIAAGRQQPAVAVNPPVPAVPFVNNAAFLGGANVQQPAAVANHANQPRLVPNNKSCQTCRLLLRLRL

SEQ ID NO: 124831 - protein, 25 aa, Heterodera glycines
  Coding regions on vcDNA: vcDNA=SeqID_51254; Strand=-; Position=1 -52,205-230
MEKACKIWRDYIDFSALEHFLKKYL

SEQ ID NO: 124832 - protein, 92 aa, Heterodera glycines
  Coding regions on vcDNA: vcDNA=SeqID_51255; Strand=+; Position=1 -223,405-460
MAVLVIILYFVCSGQCSYSSGEKYADIDGDIEAGTAHGPHWPSEIRVKFRYGSKDRDLEENRKTDHVYIVVGKYEYDHTTGGARARNKCDLK

SEQ ID NO: 124833 - protein, 50 aa, Heterodera glycines
  Coding regions on vcDNA: vcDNA=SeqID_51256; Strand=+; Position=1 -95,426-483
MANGKWSNGSLDSFRLCLDFAYQFVCLLRNGDKVMTCFVEKIAKMADFTK

SEQ ID NO: 124834 - protein, 22 aa, Heterodera glycines
  Coding regions on vcDNA: vcDNA=SeqID_51257; Strand=+; Position=1 -45,115-138
MADHGGGGRTRGVWQSHFKILL

SEQ ID NO: 124835 - protein, 33 aa, Heterodera glycines
  Coding regions on vcDNA: vcDNA=SeqID_51258; Strand=-; Position=1-99
ARGFGGEPSAPKTKCVHPEGTRIGGSRFFTTCD

SEQ ID NO: 124836 - protein, 282 aa, Heterodera glycines
  Coding regions on vcDNA: vcDNA=SeqID_51259; Strand=-; Position=1 -75,480-689,866-977,1048-1496
MNLFLTPAIFLFLFYFVFISNVKSLQTVQQLEDEAMVAFAKGRTFFDEFCATQWLTIDRYNDNLAQKYETFLGVLYFIKTNWQCEKVVDKLVKEETNSDDDVNDVKECGIYRKHVIILYEYLFREYARQSVKAADPDLAEQIPIVEQPIVKFAYHERGWGVLYRNAGTLIDLMQSLCQIWRFFFDQSYRRTFKSRSVCWLAYHRIQKPSFVNQESLVKKYGVELDKLNRTEFLYNTKNLKISANSNFDNSYLRHRKIFDENMAKFLEKVETNHKQSLTESKG

SEQ ID NO: 124837 - protein, 49 aa, Heterodera glycines
  Coding regions on vcDNA: vcDNA=SeqID_51260; Strand=+; Position=1 -133,400-416
MDIRRHFMCQKLFCLPLLMIITSFCTRSSNAELSQNNKKLSWIIGYNLT

SEQ ID NO: 124838 - protein, 211 aa, Heterodera glycines
  Coding regions on vcDNA: vcDNA=SeqID_51261; Strand=-; Position=1 -80,330-464,684-784,1039-1178,1235-1300,1391-1504
  Homolog annotation: Hit_ID=CAE72985.1; Match level="QueryCoverage =80%, HitCoverage=43%, E-value=5e-27, Identity=37%"; Hit description =Hypothetical protein CBG20329 [Caenorhabditis briggsae]
MILGHKPPLMNMLDQLDQPVFTIWSDWRRPAELGGSGGFMTIGGPDNDHCSGPWHNVPLISRWNSWTFRVDGFQIGKYRSYRDYTAAVDTGTALIGGPVHLMEMIIAATNADYCEEDNLYTVPCDQRPKLASIVLKVNGKDIVVPAEEYIIDLNLPDGKCALGLFGQYGVGFTTDWDWSIKLFGPFTLAFLRKSVLIVPLLTHLFPGLADP

SEQ ID NO: 124839 - protein, 93 aa, Heterodera glycines
  Coding regions on vcDNA: vcDNA=SeqID_51262; Strand=-; Position=1 -164,623-740
MASNSPYIISDLAQQLQVALDTCYPFFWVIDCRCTDQNCHYAKDWEYEKHCFNASKSTSLHGSGDKLTIPCHNCMDDIEAAGDGHRVEKSLIK

SEQ ID NO: 124840 - protein, 65 aa, Heterodera glycines
  Coding regions on vcDNA: vcDNA=SeqID_51263; Strand=+; Position=1 -76,888-1009
MSSAPQHHASSHEQHQPHANGSIFQMEIVESKATTISTSSASSNVDVELQANEQQMGKEIAEHKF

SEQ ID NO: 124841 - protein, 68 aa, Heterodera glycines
  Coding regions on vcDNA: vcDNA=SeqID_51264; Strand=-; Position=1-205
MCPPATNRTTDTDHIKVAAATVDDSRATVGEGLADGDDDDDASQLRHASTPLLTRYYFDAVTAQCYPF

SEQ ID NO: 124842 - protein, 68 aa, Heterodera glycines
  Coding regions on vcDNA: vcDNA=SeqID_51265; Strand=-; Position=1-204
MSHQKLRRNAKKKGLQTDSLENQENEDPMPANQENVIANDAFDEEEDLLNMKIPAPPESFMHRDGNRM

SEQ ID NO: 124843 - protein, 68 aa, Heterodera glycines
  Coding regions on vcDNA: vcDNA=SeqID_51266; Strand=+; Position=1 -67,121-259
  Homolog annotation: Hit_ID=NP_956763.1; Match level="QueryCoverage =95%, HitCoverage=18%, E-value=5e-09, Identity=38%"; Hit description =hypothetical protein MGC63632 [Danio rerio] gb|AAH55174.1| Hypothetical protein MGC63632 [Danio rerio]
RFVTWLRYNVWLLLYPLGLFLEALVLLISVPFFYSSVVYSLQLPNALNFSYNFGVVLALFSFICFPFS

SEQ ID NO: 124844 - protein, 113 aa, Heterodera glycines
  Coding regions on vcDNA: vcDNA=SeqID_51267; Strand=-; Position=1-339
MPEILKTVNNDKNGKQKTKQLSSSNYEKQLQQEFAILEKKQILEEKPLREELKDQAERVGAALLYTLIHMKMRLLFEREKVKKEISISKKSAKATSQMWGLFKRVEEAVVKPV

SEQ ID NO: 124845 - protein, 681 aa, Heterodera glycines
  Coding regions on vcDNA: vcDNA=SeqID_51268; Strand=+; Position=1-2048
  Homolog annotation: Hit_ID=NP_502799.1; Match level="QueryCoverage =99%, HitCoverage=90%, E-value=2e-25, Identity=22%"; Hit description =putative nuclear protein, with 2 coiled coil-4 domains (4P607) [Caenorhabditis elegans] emb|CAB16521.1| H
NQWIKVHLKNGDKIKIDIPAGSYQNEQELENAINESIKNGIKQPATRVKRQLEDGVDLFFHYNPDDYWEKIEEERQRYKELLKLIVTKSRERDDETDTHRKRKIEDEEITPLQNQSLTKKSRIEALEEAARQRDDGKEEKEERTGQEFLKMYPVNYREKLNEVRLELIRDLFNIQDHMKKYQGVTDGRRIQELNEAALRMRTAMKHRRKNLNAFNKAVLKKDLRTTAEEYERTSYEQNKDYVEPFFDSYPTDYWEHIHKKYGGLQDDYKKIRKLREQQQFLTDEQKKQSIQDEIDQLRRLIDYRRKRFAALEYEAKKRDSLQQQPMALALTHGEVLKERLGKIERTTTSHGEETKTHGKSLVELIEQVQKERGENKVETEGKTRGEILGDKLKAKIDEQDSGADGATDGEALKNKPETTIIGEKGMTRGEILGEKLKSKDEEKKEERITHGEALKNRIEQIPEEEKTEGKTRGEMLKEKIGASKPIEEEKTEGKTRGEILKEKIGASKPIEEEIEGVKTRGESLKDLIVSKQIETILFKYLKERRKFSIDFNDQRIDFIELSAQLGYILGFEDPTKILIGAIAKYYCDLKGGIDSLCVYINGITENVIVGDQLASLLRIVVVEGKFGDVIEKIYNTPMYIKVAVKEINEIEIEIRTREGRLIPFQWGTTLLVLAFKKSIVF

SEQ ID NO: 124846 - protein, 177 aa, Heterodera glycines
  Coding regions on vcDNA: vcDNA=SeqID_51269; Strand=-; Position=1-532
MPMFLQVQMRKVKLIFKNIQILYYSHCFLEIEKFSTNLSKLTLSNTHTSQLDDQAMEVNPNIGSVDPRNVQMPMQMSMEVSNEHVNSANGQKLNSTDQNYVDQAHPMSEGTTDTNLISHKSDQIGPETSNSQQKRAKQRKQSTNNIQRTEFITEIKGSFSFKPKASEEPIVKYIEKQ

SEQ ID NO: 124847 - protein, 44 aa, Heterodera glycines
  Coding regions on vcDNA: vcDNA=SeqID_51270; Strand=-; Position=1-133
MKNRNLIFLFLTSRILIENCCLAGKHADEAAKTDMRRRRNEQIQ

SEQ ID NO: 124848 - protein, 267 aa, Heterodera glycines
  Coding regions on vcDNA: vcDNA=SeqID_51271; Strand=-; Position=1 -163,860-1197,1362-1664
MLYNQIFWTALSLSVILMAQKANGGNKKRKLILTAEASSEEPPHIAYSDSEDGIIKLSLSQASVFLIKMDKFFSKCELISDDHSTRNCLKELKIVDLRSIFLQNATQNDQQSVPDQQKPSSSKHLESDMDKKMTPRVVDSDQLMKLFIVKSMQTLDNPSNSLEQLRMKFTKFLKFFDLFPNVFATRAIKELTTEQNLLILHELMLLSIDYAKQIYEKLYDKNNEMKLKLYGEQYPLLYFEFYKNLEEKFNTISLEISKILLNHFGRK

SEQ ID NO: 124849 - protein, 133 aa, Heterodera glycines
  Coding regions on vcDNA: vcDNA=SeqID_51272; Strand=-; Position=1 -57,414-642,855-968
MQNYKSAWAVWKKAGKKILVTRSHSHAPSSTRIEVLIAKSDIRRAAVNAISATPGAIVANALEGISDAAKHQLPKIANLKKTATRQRKGIGDGAADNPLSSRETLRKSLVQNYRNGSHRRTTVTVPMPQTSHY

SEQ ID NO: 124850 - protein, 16 aa, Heterodera glycines
  Coding regions on vcDNA: vcDNA=SeqID_51273; Strand=+; Position=1-49
PVSINPAVSNYPPVYE

SEQ ID NO: 124851 - protein, 71 aa, Heterodera glycines
  Coding regions on vcDNA: vcDNA=SeqID_51274; Strand=-; Position=1 -25,678-868
MGARRCGSEMMNSDHHESRFHNDPISALPVDVDAGPDNHHPVTVHLEQVGAVQQLNALDLIRERKSGMIKI

SEQ ID NO: 124852 - protein, 102 aa, Heterodera glycines
  Coding regions on vcDNA: vcDNA=SeqID_51275; Strand=+; Position=1-309
MPDFTNEIETLKKPQNSPPKEKKKVGKAKKQNAKGCSNSISKLFKTKFKNMLKSPKKTNGSSSSKTSETQNMANQQKQEELQPLTSYLLDQKLNGQVKMGAN

SEQ ID NO: 124853 - protein, 104 aa, Heterodera glycines
  Coding regions on vcDNA: vcDNA=SeqID_51276; Strand=-; Position=1-651
  Homolog annotation: Hit_ID=NP_872102.1; Match level="QueryCoverage =95%, HitCoverage=15%, E-value=2e-09, Identity=36%"; Hit description =putative membrane protein, family 8 (4N121) [Caenorhabditis elegans] emb|CAD56618.1| Hypothetical protein
ARGNEANNNIFLNSLQFKRYLCLTQVLVLRDISIQVRKRFPNMESLVDSELIQVSRTTNIDQNGIIRFECKLIKLPELDLMENVKSEFPKYWMPINWSVNHYLC

SEQ ID NO: 124854 - protein, 359 aa, Heterodera glycines
  Coding regions on vcDNA: vcDNA=SeqID_51277; Strand=+; Position=1 -164,216-312,485-601,651-695,750-930,984-1130,1190-1326,1659 -1715,1768-1902
  Homolog annotation: Hit_ID=NP_498717.1; Match level="QueryCoverage =58%, HitCoverage=33%, E-value=2e-39, Identity=40%"; Hit description =putative membrane protein, family 8 (73.8 kD) (3I993) [Caenorhabditis elegans] gb|AAA28228.1| Hypothetica
MESLVDSELIQVSRTTNIDQNGIIRFECKLIKLPELDLMENVKSEFPKYWMPINWIFSLCYELRQKGNIESDLQMNIILQECKLYREVVFLAVRIYFLLCLIARQYRVHENAEEQNQVDRVIPLMTMLQLIFVMGWLKVAEALLNPLGEDDDDFECLKLLLLFIICKMTDTPLGNYIIDRNIGIFLTMVDECYDQKPPQWAESTNLKNTKKPLYAENCALYTQNPLVGSATLCHLPGESDRVRMVQRRPSDMGRRHSSNFPSQRPYLISPKRLRFRHSLPIRPAELVLFVHKCEQQPIIISSGLYENDIVKSAENQGISSPCPSSAEVPRHLDTVKEDEEVETANDIATEENGTKGRGD

SEQ ID NO: 124855 - protein, 47 aa, Heterodera glycines
  Coding regions on vcDNA: vcDNA=SeqID_51278; Strand=-; Position=1-142
AGLSRCSPHCATGTARAPPGRPCRRGPWSRHPIGARPPPARLRPLLA

SEQ ID NO: 124856 - protein, 136 aa, Heterodera glycines
  Coding regions on vcDNA: vcDNA=SeqID_51279; Strand=+; Position=1 -136,325-599
MNLSTASFVPLAPAPTAGVPPGRLYPTIAPPGTVAVQSTPDSHFHTLRESLENPPLPPIDQQPFANQSQQQQPLPFPTIAPPPYYDHFAGPANGVGSIGVRYLVHGPSQTHEVHSVHAVPSGNAGAARGGGRQAKS

SEQ ID NO: 124857 - protein, 230 aa, Heterodera glycines
  Coding regions on vcDNA: vcDNA=SeqID_51280; Strand=-; Position=1 -128,180-350,477-867
  Homolog annotation: Hit_ID=NP_504430.1; Match level="QueryCoverage =93%, HitCoverage=36%, E-value=2e-10, Identity=23%"; Hit description =solute carrier family 2 member (5F868) [Caenorhabditis elegans] pir||T31930 hypothetical protein C35A11.4
MITFTYALFQLNSIELFVASRFILGLFVTIGIGISSVFLIECSPVQCRGGIGMITGLIKKAFTNRITFLIIRSLGIMIQFGCIVGALLAMPELLGDQSHCFLLFHDQHDKAADAAKFYWGQNKSANAILDGFRTEQTKRSNAMGMLEVLREKQSIGTARGLWIGIFLSICMAFCGISGGHLLANFLIVFIAKFVLQLVIDAYIVEVLQQTMGFSALSSSFVYIGIQIFGL

SEQ ID NO: 124858 - protein, 145 aa, Heterodera glycines
  Coding regions on vcDNA: vcDNA=SeqID_51281; Strand=+; Position=1 -39,630-1028
MCRREEQSDGKTKILAFDLSTNRFGKVRALPDPKYGVPIGRKCHALVQKGNLAYLIGGCRDAETQQNVRGKGDERGEREGYSAKSKPSADSRRLEVRHEHRPMGPNAQQLGEGGVFPFGCPYLRQYCRDFYLKIPNGQLCCYLLG

SEQ ID NO: 124859 - protein, 159 aa, Heterodera glycines
  Coding regions on vcDNA: vcDNA=SeqID_51282; Strand=+; Position=1 -28,96-192,253-359,479-603,890-1018
  Homolog annotation: Hit_ID=NP_502554.2; Match level="QueryCoverage =63%, HitCoverage=18%, E-value=1e-11, Identity=37%"; Hit description =kelch repeat containing protein (4O56) [Caenorhabditis elegans] emb|CAC44304.2| Hypothetical protein Y67H
SRRPEFCECCPIPRSGHRVFADSDFIYVFGGYNPFHSPDSTYTDFWRFNRLTHLWQKCGLSSSDPTTQLPNSLASFALASSSRPSECFIFGGTGIPFGLAASNELHRIRIDLLGNVNVRTEPKQSYEQRQNTANIRQRGRSGGEAADDAAEQRLMPPRM

SEQ ID NO: 124860 - protein, 276 aa, Heterodera glycines
  Coding regions on vcDNA: vcDNA=SeqID_51283; Strand=-; Position=1-828
  Homolog annotation: Hit_ID=NP_504187.1; Match level="QueryCoverage =88%, HitCoverage=19%, E-value=4e-45, Identity=40%"; Hit description =predicted CDS, integrase, catalytic domain containing protein family member (5E782) [Caenorhabditis elega
MAYRRLTTMLQRLQKTPEVLKQYTTVITDQLNAAIIEETTIGAGKHEHFIPHQAVITPKKLRVVYDASAHTRGAPSLNDCLLRGPVWLPDLAGMLIRFRACRVPVIADVEKAFLMVGIEEDDRDVCKFLWVRDPFRPVTTDNLVTYRFRRLAFGLTPSPFCLAAVVRHHLRKYDSNFAEELIRDTYVDNVLIPADTAEEAAIKGQEAKRMFADARMNLREFLSNDETLNSSFSDAEFLGKTTAKVLGLEWNAETDKIRMKYPGSEPGTPIGTTRRT

SEQ ID NO: 124861 - protein, 199 aa, Heterodera glycines
  Coding regions on vcDNA: vcDNA=SeqID_51284; Strand=-; Position=1-600
MVRDSQQTRAQPNGTRKEEQYGTNARFTERTVARGNENGHKGGNGPRFAQNGLPPSFGRGNCSFCLESGHRPSECRAYPTPQARRKRLIEQKRCLRCLGSDHTFEQCQRTVRCDACRKDDHHWLMCWKNQPGNQSRPSGEPERKENNHAMLISGMDQPTHVTTSRDEPNSRDISEMNAGEQRAFTAFGSRVPAQQMIEE

SEQ ID NO: 124862 - protein, 340 aa, Heterodera glycines
  Coding regions on vcDNA: vcDNA=SeqID_51285; Strand=+; Position=1-1023
  Homolog annotation: Hit_ID=NP_502799.1; Match level="QueryCoverage =85%, HitCoverage=45%, E-value=5e-11, Identity=23%"; Hit description =putative nuclear protein, with 2 coiled coil-4 domains (4P607) [Caenorhabditis elegans] emb|CAB16521.1| H
MDDFYIVLPSNTPGQENTTSKFTVRLPETLELGTNWSVALSSIIYPYSFTALGINGQEFIKVWENDNNVPIQVYLPDMNFKTAGGLGNKINEAFTHHYKIKKQRGKREAKAEDTKDSKIDVAKRAAERAGRDVERHFNQINNISNSIQTQLNTLRETNPHILEEPDIKIWFDKMVEMGTEIQTSRNELKSFQEEVDKAKNITLEHVEKNDLKKAKKSADVAKGIARQAKTKYTSTLEGYNDKSEKGFSGIVNRLNEALGEHIKRKDIENRQVSEAEKGPQKRERLANEDVQFQYDSIDQKFIVYLSPAVSHIDLSKHLRYVLAFTNTRLFHAEEANICQI

SEQ ID NO: 124863 - protein, 240 aa, Heterodera glycines
  Coding regions on vcDNA: vcDNA=SeqID_51286; Strand=-; Position=1 -173,239-398,448-579,682-939
  Homolog annotation: Hit_ID=NP_498118.1; Match level="QueryCoverage =74%, HitCoverage=45%, E-value=9e-52, Identity=58%"; Hit description =ATP/GTP binding protein, Gro-1 OPeron gene GOP-2 (39.7 kD) (gop-2) [Caenorhabditis elegans] gb|AAA19064.1
MPYAIFDTPGQIEVFTWSASGTVITDSLAASFPTVRFFEFFNTNAKGFLQVVAYVMDSARSTNPTTFMSNMLYACSILYRTKLPFFVVLNKSDVVDPAFAVEWMRDFEQFQTALDQSSSSFMNDLTRSLSLVLDSFYENLNWVSVSAKTGQGFDKVLELIEKCRLEYWEVYKPMCERVAQERAAETANDGTTDAMPTEKLANLEIRENDVPSDEKGQTEEAQITETNGEEHSTEESEAQK

SEQ ID NO: 124864 - protein, 33 aa, Heterodera glycines
  Coding regions on vcDNA: vcDNA=SeqID_51287; Strand=-; Position=1-99
MADDKSCDGASSALPPCLIVLGMAGSGKSSFVQ

SEQ ID NO: 124865 - protein, 151 aa, Heterodera glycines
  Coding regions on vcDNA: vcDNA=SeqID_51288; Strand=-; Position=1 -51,182-586
  Homolog annotation: Hit_ID=CAE73674.1; Match level="QueryCoverage =86%, HitCoverage=12%, E-value=1e-10, Identity=35%"; Hit description =Hypothetical protein CBG21183 [Caenorhabditis briggsae]
DVQVSSFDSRTLRVVVEDVKMRSQPSAKPSFDAKLIFDDHIRLMAAKQRLSRGKKSSRAFKLSLIAELFGIRLPPQQQQQNDGIAFRHSLPCQSNSASSSSTEEKRPRGIAPGSVQKLQMQTKENDQRSDSSAAPPDPETARLLPGQIHHL

SEQ ID NO: 124866 - protein, 72 aa, Heterodera glycines
  Coding regions on vcDNA: vcDNA=SeqID_51289; Strand=-; Position=1-220
ENNSSIDQAAHMNEHRNRPSPPKHGPMGTKSAREWRQHQPMHVNVLPQMKEVTAKKEEKEEKKTAHLISPFL

SEQ ID NO: 124867 - protein, 248 aa, Heterodera glycines
  misc_feature (220)..(220): Xaa can be any naturally occurring amino acid
  misc_feature (227)..(227): Xaa can be any naturally occurring amino acid
  misc_feature (243)..(243): Xaa can be any naturally occurring amino acid
  Coding regions on vcDNA: vcDNA=SeqID_51290; Strand=+; Position=1 -143,200-419,465-638,695-771
  Homolog annotation: Hit_ID=NP_871948.1; Match level="QueryCoverage =94%, HitCoverage=60%, E-value=8e-57, Identity=53%"; Hit description =Rap1GAP (2B519) [Caenorhabditis elegans] gb|AAN84803.1| Hypothetical protein F53A10.2b [Caenorhabditis el
RFHVSTLLPFTIGDAQQLQRKRHIGNDIVAIVFQEQNTPFCPDMIASNFLHAYLVVHPIEPFLHAYLVVHPIEPGTDRTRYRVSMTARDDVPFFGPTLPRSSIIWKCQLRDFLLTKLINAENAAYKAEKFAKLAERTRASLLDGLYSNLKERAQFYGMAERTRASLLDGLYSNLKERAQFYGMAFLDSVDSAETAATGETTTNGKTTGKTITSTAKRSFXCSSRSFXCSSYSMIKRAKHIFDXLYNIS

SEQ ID NO: 124868 - protein, 81 aa, Heterodera glycines
  Coding regions on vcDNA: vcDNA=SeqID_51291; Strand=-; Position=1-246
CHAMPPPDSTVVLVTGADCCSSTITSTRQGASAAAASSTTNTTMACDVTAASSLNLLLIAANDGQPPSGRKPSSSSSSTST

SEQ ID NO: 124869 - protein, 31 aa, Heterodera glycines
  Coding regions on vcDNA: vcDNA=SeqID_51292; Strand=-; Position=1 -85,532-542
MLPLLIVEFYVLLVISFVMPMEGDSCDVAFW

SEQ ID NO: 124870 - protein, 34 aa, Heterodera glycines
  Coding regions on vcDNA: vcDNA=SeqID_51293; Strand=+; Position=1 -102,669-671
MAIKYGPKIAKYGHKFFQIEGTISQNFFKFAKRK

SEQ ID NO: 124871 - protein, 581 aa, Heterodera glycines
  Coding regions on vcDNA: vcDNA=SeqID_51294; Strand=+; Position=1 -576,664-1833
  Homolog annotation: Hit_ID=NP_507780.1; Match level="QueryCoverage =45%, HitCoverage=19%, E-value=1e-13, Identity=24%"; Hit description =predicted CDS, DNA polymerase type B, organellar and viral family member (5T899) [Caenorhabditis elegans]
MSKRFTDFSIDSILGKKPRQGFLINQILGIAHVLGSVQHGQGSSNKPVNEYVKKLEGSLEHNEKFHYTKMKSRFSIEDVPANPEALLSAIFQYCIEESIADSRKRGIEPTHLGCLISSPLLSGGDIPIPIRQINENTVNTILNRFTQVAQSKKQQNITLWGEPFTVVVTTVNRLGLPTKRQVKGGARRQLARILNPDRHNFCLFYALQATMVAKTKQWPRWKFHRYLNNQHGQQGQLQHDAVQLMNQIGAPLNLNAYDADTYVPRVINHWNNNHQHNRFAVFIFGTTGHYKPIYKYVNNSYNTPLLLYFNDNHFDGVQKQSGLFGKPYCLECEQPYGRASKHSKSCKARCILCARCGPAFPCEATGGFFRNCTLCNKNFNNNDCFQHHLQSGFCKRSKKCRDCGVVWDVTDNNRNGRKGHVCGERYCKLCKNFHNPERGCFIKPLEPRELDPYRIVAFDLETMQHQPISRREPEKRQHQPNFISAKVICPGCIDNGRWRNGTAGCKVCGPHRTVAFCQRRFVNTAVDKQVVTDNPLETFVGWIINDLPKKYDSYAFSHFGGRFDMVLVFLKCVHRWVSTLK

SEQ ID NO: 124872 - protein, 39 aa, Heterodera glycines
  Coding regions on vcDNA: vcDNA=SeqID_51295; Strand=-; Position=1-118
TGNSLALFTAPPKLSSGDCLEVTPNEAADELMKGISGRM

SEQ ID NO: 124873 - protein, 124 aa, Heterodera glycines
  Coding regions on vcDNA: vcDNA=SeqID_51296; Strand=+; Position=1-375
  Homolog annotation: Hit_ID=CAE70735.1; Match level="QueryCoverage =71%, HitCoverage=29%, E-value=1e-11, Identity=38%"; Hit description =Hypothetical protein CBG17479 [Caenorhabditis briggsae]
MGNGKGNFRPTCGKVAETFIEIAIHQHSTPETVVTDQGRQFISQIFGNLTKIYGFEHIMSTAYHQQSNGMAEGSMRILANIISTTINAQGDNWDEILSHAIFTYNKYISAYGNKIFTLFYHLFA

SEQ ID NO: 124874 - protein, 265 aa, Heterodera glycines
  Coding regions on vcDNA: vcDNA=SeqID_51297; Strand=-; Position=1 -135,188-219,275-407,455-480,542-624,682-749,812-901,1114-1194
  Homolog annotation: Hit_ID=CAE57657.1; Match level="QueryCoverage =95%, HitCoverage=93%, E-value=8e-42, Identity=37%"; Hit description =Hypothetical protein CBG00647 [Caenorhabditis briggsae]
MRFWYLLNISDHHTQFLSCFRVSNRTLCFLFGLAQFLVVLASLFQHVYSWTKFGHVHVYSWTKFGHVFKCFKCKSNISADATTEQRLLAYDLVIFDFGLMHRILKMSKCVANYLDGGYLRFSWLDGGYLRFSWCVEHSLALLVLLIVCVEHSLALLVLLIVLILSLKRIWLYWPALFMQSTYLFMQSTYVLGMAILTMATTPKMLEALLEALSRSVDNALGIAFCIYIGGVLLNWMFTLVLWHHYWAEEANLAQNIRENESADGE

SEQ ID NO: 124875 - protein, 30 aa, Heterodera glycines
  Coding regions on vcDNA: vcDNA=SeqID_51298; Strand=+; Position=1 -31,199-260
MFEAKKGELLNGWTHFPFEFVYYVKTQKVI

SEQ ID NO: 124876 - protein, 30 aa, Heterodera glycines; identical to SEQ ID NO: 124875
  Coding regions on vcDNA: vcDNA=SeqID_51299; Strand=+; Position=1 -31,201-262

SEQ ID NO: 124877 - protein, 137 aa, Heterodera glycines
  Coding regions on vcDNA: vcDNA=SeqID_51300; Strand=-; Position=1 -119,308-533,1167-1235
MPEHLIPFDPGHIIPCPFFTRTVRNIVEQTKPDVVFMVFRWYNEVLNVPFNENGTTKNDEILKAFRHELRHFQKFVSNRIFVSAPTLQFKHDVAKELAKRLWQHAPLGDLQLSLRVGFEIENSNKVRSFFSQGSRAA

SEQ ID NO: 124878 - protein, 86 aa, Heterodera glycines
  Coding regions on vcDNA: vcDNA=SeqID_51301; Strand=-; Position=1 -132,347-464,585-595
DRYKILPGEERTERWTKQLKQLLVQEGNKTPQNLLKFVIDRKVKGTGNGTVLLVGNSHADVVARELGEEMNAYYHDFQVFTMPGII

SEQ ID NO: 124879 - protein, 144 aa, Heterodera glycines
  Coding regions on vcDNA: vcDNA=SeqID_51302; Strand=-; Position=1 -105,274-600
MLDSDFQKARFDMYWALAFVANIQPVFENNDYFAEQKPMQNWCQKELGVEAIIEICYYSIAYSTQFRSSPKGVLLPSLPPLLVPWRGNAILPARPVGHAFAAVTSAAYTARLLRHFFCSTVLLASVIGTQLLTTVMPALSFGLM

SEQ ID NO: 124880 - protein, 161 aa, Heterodera glycines
  Coding regions on vcDNA: vcDNA=SeqID_51303; Strand=-; Position=1 -90,229-621
MAISVQMHLEMIKCCSVVQTKVKARHQQKKPLLLDFLSAPDFSVPTQAMLFALQQCAVMLWWRWQRCFDDHCVLSGRRCRGLLKLSQANVCRRWFAAVVVVVAVVLPLLLLLILANYTIRVQEKAVLRLLLLALSIIFATYRRRGGGGGGRDGLRKEHRLR

SEQ ID NO: 124881 - protein, 142 aa, Heterodera glycines
  Coding regions on vcDNA: vcDNA=SeqID_51304; Strand=+; Position=1 -190,240-478
MRFLFNLHFTAPFVVSLAKRSSNNPNLCPTSNSMSDIYGFINNISDRISRRVRRKRPTESGVSGVSGAPPETRKDDKAKGGGCSKKCACIIVCSILTLIVLVIGGLVLAAVLTPETFKNAPLLSLIAGKKNGGVDGEEKETE

SEQ ID NO: 124882 - protein, 45 aa, Heterodera glycines
  Coding regions on vcDNA: vcDNA=SeqID_51305; Strand=-; Position=1 -113,808-832
MHIYVCVLYFGLLNQSLLGFGLFCTKLMLDRYWNMLLRKKYKEHK

SEQ ID NO: 124883 - protein, 182 aa, Heterodera glycines
  Coding regions on vcDNA: vcDNA=SeqID_51306; Strand=-; Position=1 -237,368-574,807-911
  Homolog annotation: Hit_ID=CAD38524.1; Match level="QueryCoverage =98%, HitCoverage=96%, E-value=2e-60, Identity=63%"; Hit description =putative glutathione peroxidase [Globodera rostochiensis]
MSTTTDVQHKSIYDFKANDIDGHEISFDKYRGKVLLVVNVASNCGTTEFNYSQLKQLYDKYKGKGFAVAAFPCNQFGGQEPGNANEIKDFVHKKYNFEPDLFEKIDVNGSNEHPLYGFLKKEQHGTLIDAIKWNFTKARGRHTTTKRVFLVDRNGNVVQRYSPNTEPRDIEADIEKLVAAAA

SEQ ID NO: 124884 - protein, 28 aa, Heterodera glycines
  Coding regions on vcDNA: vcDNA=SeqID_51307; Strand=-; Position=1-165
NWHSICFVLKSLQRFSMVSEEAIGETIN

SEQ ID NO: 124885 - protein, 138 aa, Heterodera glycines
  Coding regions on vcDNA: vcDNA=SeqID_51308; Strand=+; Position=1-414
MPEGPVSEPQMVRHMPEGPVSEPQMVRHMPEGPVSEQQMVRHMPRRASQRTANGATYAQKGQSANREWCDTCPEGPVSEPLWRDTCSEGPVSEPQMVRHMPEGPVSEPQMVRHMPEGPVSEPQMVRHIPEGPVSEQQM

SEQ ID NO: 124886 - protein, 32 aa, Heterodera glycines
  Coding regions on vcDNA: vcDNA=SeqID_51309; Strand=-; Position=1 -21,343-408,806-817
MGKLSYTSEIALFRCPLAIRGYAVFNIIKNSD

SEQ ID NO: 124887 - protein, 39 aa, Heterodera glycines
  Coding regions on vcDNA: vcDNA=SeqID_51310; Strand=-; Position=1-117
MRLMGCVLGQGGHNGQDDEEREQERVNREINKELKKDKK

SEQ ID NO: 124888 - protein, 30 aa, Heterodera glycines
  Coding regions on vcDNA: vcDNA=SeqID_51311; Strand=+; Position=1 -53,527-566
MICRKAQLTPIPTVSPTPPSLEGLIILYEV

SEQ ID NO: 124889 - protein, 127 aa, Heterodera glycines
  Coding regions on vcDNA: vcDNA=SeqID_51312; Strand=-; Position=1 -230,349-503
  Homolog annotation: Hit_ID=CAC21848.1; Match level="QueryCoverage =82%, HitCoverage=50%, E-value=4e-13, Identity=42%"; Hit description =hypothetical protein [Globodera rostochiensis]
YWGIIFGFAVKQQNKLDRSILCERGTYAYESDSNIWINGKRNGTNYKYSYVVGDTVGIGVHLITRQLFFIKNGLRLDTSDLLVDPSFADGSLYPFVSLFYSGEKIEANFGPNNRKILSFPWVFKTKR

SEQ ID NO: 124890 - protein, 100 aa, Heterodera glycines
  Coding regions on vcDNA: vcDNA=SeqID_51313; Strand=+; Position=1 -104,244-442
ASTTTTTTTTEEQPRVEKFANTPPLICILDSACNYATKYPTAKLSKRFKISEDCSELAKRIEMKSTDADWQMSFEFMNGFKYAAFIFDFPMLGGGKGGGQ

SEQ ID NO: 124891 - protein, 30 aa, Heterodera glycines
  Coding regions on vcDNA: vcDNA=SeqID_51314; Strand=-; Position=1-92
TLPALGQIWPTPSGVTLPSDERRTSSRQHH

SEQ ID NO: 124892 - protein, 191 aa, Heterodera glycines
  misc_feature (6)..(6): Xaa can be any naturally occurring amino acid
  misc_feature (148)..(148): Xaa can be any naturally occurring amino acid
  Coding regions on vcDNA: vcDNA=SeqID_51315; Strand=-; Position=1 -82,1317-1465,1558-1775,1914-2036
  Homolog annotation: Hit_ID=NP_503009.1; Match level="QueryCoverage =83%, HitCoverage=37%, E-value=2e-28, Identity=44%"; Hit description =putative nuclear protein of eukaryotic origin (4R878) [Caenorhabditis elegans] pir||T31486 hypothetical p
LLFLHXVRNCSKLLFEYRMDLVKRIVNLKMNSHHKILFLGDSSVGKTSLVNSLCGIGSPPQSTLGCTVQVGVVVCAFHQFQHQFQAGTPNEATELLEFWDVGGSNSHRKASAVFMDGADGVVLVHDLNNVRSEQNLALWVDLLYAQMXGDNAKSGSGERFIALDMDRVYTIPILIVGVKFLFSPNVNVTSF

SEQ ID NO: 124893 - protein, 261 aa, Heterodera glycines
  Coding regions on vcDNA: vcDNA=SeqID_51316; Strand=-; Position=1 -84,380-738,787-991,1045-1179
  Homolog annotation: Hit_ID=CAE56538.1; Match level="QueryCoverage =86%, HitCoverage=39%, E-value=3e-50, Identity=44%"; Hit description =Hypothetical protein CBG24265 [Caenorhabditis briggsae]
MSNKLLPDEMYCSRYKEIKNAFGKRIASAWTEKTDPSKFVYEDCGIVAYLLELWQSYGIGPSKQFADLGCGNGLLVFLLSCHGFRGLGLDVRERNIWEQFRMQGADLRETKFDPSSRDSVAEHLKGVDFLIGNHSDELTPWIPVIAARLRCNFFLLPCCTYDFFGKYSKKMPSEKALAAGAPKGIAEQHFAYIEHICHQLGFKVEIDQLKIPSRKRKCLVGVVPADGLGSSERIEAAINGLLSLAKIGTKDIFTPRPSKEQ

SEQ ID NO: 124894 - protein, 108 aa, Heterodera glycines
  Coding regions on vcDNA: vcDNA=SeqID_51317; Strand=+; Position=1 -144,189-371
  Homolog annotation: Hit_ID=XP_308493.1; Match level="QueryCoverage =67%, HitCoverage=7%, E-value=5e-10, Identity=43%"; Hit description =ENSANGP00000022800 [Anopheles gambiae]
MPKRSIGSEDSEDELRESPSGPNGESPCAKRRKCVEFEPVRICSIGSVKEIENRVLLAQHYKLCERFRLKEKIRLELEKRIEGFERRQIQDDAVMCIINRYWNRVCFS

SEQ ID NO: 124895 - protein, 33 aa, Heterodera glycines
  Coding regions on vcDNA: vcDNA=SeqID_51318; Strand=-; Position=1 -62,479-518
MAKMPVVMAFISKQSMSMTAILFSLNKNYYTFF

SEQ ID NO: 124896 - protein, 68 aa, Heterodera glycines
  Coding regions on vcDNA: vcDNA=SeqID_51319; Strand=-; Position=1 -130,452-528
  Homolog annotation: Hit_ID=AAH79755.1; Match level="QueryCoverage =61%, HitCoverage=10%, E-value=7e-14, Identity=71%"; Hit description =Unknown (protein for IMAGE:6951677) [Xenopus laevis]
MGNGFGGGMGNGFGGGMGNGFGGGMGNGFGGGMGGGSGGGYGYDVKHIFGVPPKFPGHRPINSKITDQ

SEQ ID NO: 124897 - protein, 87 aa, Heterodera glycines
  Coding regions on vcDNA: vcDNA=SeqID_51320; Strand=+; Position=1 -129,635-769
MYGGYAVLSGGRVSDSFSDLTGGITEEWDLKSLDVAKRRDMELILVKRPPNSGVKNYSENCVFGCATGPVNSDLTRAGLVEVIFNLQ

SEQ ID NO: 124898 - protein, 39 aa, Heterodera glycines
  Coding regions on vcDNA: vcDNA=SeqID_51321; Strand=-; Position=1-117
MDQNEKVRQKMKEKTGRRIDSFCIFYLIKFICLFSFLHH

SEQ ID NO: 124899 - protein, 89 aa, Heterodera glycines
  Coding regions on vcDNA: vcDNA=SeqID_51322; Strand=-; Position=1 -124,277-419
MASAANAYVNSWKKSRKGQKQGDKVGTSSSGAQKSPEMGEIENPLECKIVKPILLIEERELQMSSAMEAIKSVYRDFFLWGKGKYLKNT

SEQ ID NO: 124900 - protein, 283 aa, Heterodera glycines
  Coding regions on vcDNA: vcDNA=SeqID_51323; Strand=+; Position=1 -385,743-820,872-1260
  Homolog annotation: Hit_ID=NP_493834.1; Match level="QueryCoverage =50%, HitCoverage=11%, E-value=2e-11, Identity=29%"; Hit description =putative endoplasmic reticulum protein of ancient origin (2B142) [Caenorhabditis elegans] gb|AAF60594.1|
MVRKKQIFPSEGNKAKDQQIDAESIELGSQLPLKSGLKGSKLPDKSGENDNWVQSSQKKRIEQYKQFIDMIDKPSTSQQCKMKEIDRNVNYLETNRFENRKRKSDTFINLDEIDLDESSKISICDRSQEENNLHRHFIENIRKYNNSFACASLACQVYHKFNSTAQPIDQNSLPTNGQLYFLDSSEAQNVRLNSFELNEHLIGKIETSLRKNYPFAKAYEMMKNVINEQKTFSDKSILNETQEVKMFLSFKNGFDPNRYNIQQSNEVAAIMVCNGMMKSRLQI

SEQ ID NO: 124901 - protein, 45 aa, Heterodera glycines
  Coding regions on vcDNA: vcDNA=SeqID_51324; Strand=-; Position=1-137
  Homolog annotation: Hit_ID=ZP_00274011.1; Match level="QueryCoverage =97%, HitCoverage=11%, E-value=4e-09, Identity=63%"; Hit description =COG1960: Acyl-CoA dehydrogenases [Ralstonia metallidurans CH34]
SFAVTEPEAGSDVSNVSTSAERSEDGTFYVLNGAKKWITNCGVAQ

SEQ ID NO: 124902 - protein, 27 aa, Heterodera glycines
  Coding regions on vcDNA: vcDNA=SeqID_51325; Strand=+; Position=1 -69,351-365
MSLQIGIPVLGNGAWMWERYNFKNIVE

SEQ ID NO: 124903 - protein, 131 aa, Heterodera glycines
  Coding regions on vcDNA: vcDNA=SeqID_51326; Strand=+; Position=1 -76,126-259,585-668,725-826
MPKKQQKDAIVDNNKLPTEQQQQNDVLLERNSNEIDQHKLDGIDDNKNNNGKQFGAKKAFDQFEIEQPKSTKFLAPYQNRVVFHWSLYSIVITAMFYQVQNYIQNLWDFHRKADEREWNGFVESINTLLSE

SEQ ID NO: 124904 - protein, 75 aa, Heterodera glycines
  Coding regions on vcDNA: vcDNA=SeqID_51327; Strand=+; Position=1 -93,386-452,492-559
  Homolog annotation: Hit_ID=NP_509429.1; Match level="QueryCoverage =100%, HitCoverage=16%, E-value=6e-26, Identity=57%"; Hit description= transmembrane 9 superfamily member 2 (75.3 kD) (XJ38) [Caenorhabditis elegans] gb|AAB71307.1| Temporaril
MFGFLFVVFLILIVTCSEATILLAYFHLCAEVVSTILYFSYTSIFVFLFFLMTGTMGFFATYWFIYKIYSSVKVD

SEQ ID NO: 124905 - protein, 50 aa, Heterodera glycines
  Coding regions on vcDNA: vcDNA=SeqID_51328; Strand=-; Position=1-151
IKKFTVNSAGNTMTNLLVSDHNNPPGKCPPHSATTATRTELSYVVLFRSL

SEQ ID NO: 124906 - protein, 96 aa, Heterodera glycines
  Coding regions on vcDNA: vcDNA=SeqID_51329; Strand=+; Position=1-291
MKREGNGREMVVGGEQTAEQHNGKDQAKDGTLGRVGGMETKRTANGQETVGTDGDDQPVQIEGKCRIKSDLKRMTDQMATAEHQLAKATKWTRSDR

SEQ ID NO: 124907 - protein, 135 aa, Heterodera glycines
  Coding regions on vcDNA: vcDNA=SeqID_51330; Strand=-; Position=1 -179,232-460
  Homolog annotation: Hit_ID=CAE56370.1; Match level="QueryCoverage =80%, HitCoverage=10%, E-value=5e-46, Identity=78%"; Hit description =Hypothetical protein CBG24045 [Caenorhabditis briggsae]
VETVSKQLAAHVYNFLGKDMLTSGSTGQQMAAYVYFGPIYYQKLKHMVMDKMHARAKGPRAVLTRQPTEGRARDGGLRLGEMERDCLIAYGASMLLMERLMISSDQFSVSTVIPFANDSIFASSFVRWMFVPSAV

SEQ ID NO: 124908 - protein, 530 aa, Heterodera glycines
  misc_feature (8)..(8): Xaa can be any naturally occurring amino acid
  Coding regions on vcDNA: vcDNA=SeqID_51331; Strand=-; Position=1 -135,181-323,381-448,573-629,828-934,1079-1163,1208-1287,1330 -1425,1468-1602,1645-1782,2340-2406,2465-2590
  Homolog annotation: Hit_ID=NP_505028.2; Match level="QueryCoverage =97%, HitCoverage=96%, E-value=1e-79, Identity=34%"; Hit description =focal adhesion kinase (5I348) [Caenorhabditis elegans] gb|AAB65324.2| Hypothetical protein F40A3.5 [Caeno
LTIKQLIXPTVCIDTFCSENLTPWTTVMALFLLYLITLLWMCKHGKNICHPTPDSIYPYIGRLKQLKRHGKNICHPTPDSIYPYIGRLKQLKRDLFFIIRVTLIYFLISKRWTIYLSNIELTDIKLGQGAVGLSNIELTDIKLGQGAVGFVFKGYVVPKSQTRFKQKVFAAVKMSYPMPQKSIGLLEEAARMARLNHANIVRIIAVSKLSFSAFRPMFAMEWLHGGSLAEFFREEIRKEDERERPRVFVRDIVHVLTQVEIRKEDERERPRVFVRDIVHVLTQVGNALKFLHESRDLQGNEFAHGDVAARGNALKFLHESRDLQGNEFAHGDVAARNILLTERNLSRCVAKLGDFGLPIDFCVAKLGDFGLPIDFGPRLPIWLPPEIVCSTDRTNAKHRPESDVWMFGVLCWECATLGAMFGVLCWECATLGAEPHYQQTFDEICDSFRLTHRGLPLQKECPPDYAAFVLDCFSEQHRRPRFSGPTNGGVVLYTLIFCFHFVFHLAHFKVVHNVSNCTCAQHRCNVPLPV

SEQ ID NO: 124909 - protein, 117 aa, Heterodera glycines
  Coding regions on vcDNA: vcDNA=SeqID_51332; Strand=-; Position=1 -190,1508-1672
SFSHGVVLPPFSPWRRRPPLCSAQHSAEHFHQQPSPAVAAFIPLIIIISIVPSAFADLDERKTKAVIQLNALQSNAQTLVLARTQQETRPEWRLEETKEFMDILGISVPFYYLIWFQ

SEQ ID NO: 124910 - protein, 100 aa, Heterodera glycines
  misc_feature (1)..(1): Xaa can be any naturally occurring amino acid
  Coding regions on vcDNA: vcDNA=SeqID_51333; Strand=-; Position=1 -27,419-565,907-1032
  Homolog annotation: Hit_ID=NP_508537.1; Match level="QueryCoverage =99%, HitCoverage=4%, E-value=4e-36, Identity=70%"; Hit description =spectrin (spc-1) [Caenorhabditis elegans] gb|AAB53876.1| Spectrin protein 1 [Caenorhabditis elegans] pir||
XLGLIKCNRDGYVTLQEFMAFMINKETENVRSSDEIEMAFRALSKEYRPYVFAEELFANLTQEQAQYCKQRMKPYVDAASGRTIENALDFEQFVHSMFMN

SEQ ID NO: 124911 - protein, 110 aa, Heterodera glycines
  Coding regions on vcDNA: vcDNA=SeqID_51334; Strand=+; Position=1 -169,671-847
  Homolog annotation: Hit_ID=AAH75201.1; Match level="QueryCoverage =94%, HitCoverage=27%, E-value=2e-34, Identity=66%"; Hit description =Actr1a-prov protein [Xenopus laevis]
CGQCNFCEFIPSFLYFVTQKCDVDLRKTLYQNIVLSGGSTMFAGFGDRLLAEMKRLCPKDVKVRILAPQERIFSTWIGGSILASLDTFRKIWVTKQQYENNGKIIMAETF

SEQ ID NO: 124912 - protein, 42 aa, Heterodera glycines
  Coding regions on vcDNA: vcDNA=SeqID_51335; Strand=-; Position=1 -88,373-413
MALQHNANGRRKLNNGIFLIKIDSLIIMNSFALTFEKHVNII

SEQ ID NO: 124913 - protein, 75 aa, Heterodera glycines
  Coding regions on vcDNA: vcDNA=SeqID_51336; Strand=+; Position=1 -15,807-946,1293-1365
MRKFIEIRLSRAQLSPLVGANLVRRLEKCGTAGEAMTELLNSVVKMYHIIEMYKKRRKELDERFNEVKRMADAIK

SEQ ID NO: 124914 - protein, 119 aa, Heterodera glycines
  Coding regions on vcDNA: vcDNA=SeqID_51337; Strand=+; Position=1 -48,392-602,960-1060
MYKIRSKNLLSPFINKLNTYSNYWDIAACHPNLLISNSASINANAPLNKAQQLLKSNIFTAGAAILATLPGYVRKSVVVKHNGKNSGFCSVFSKISIPNGSFFYYEVTILHKHYEYVNS

SEQ ID NO: 124915 - protein, 30 aa, Heterodera glycines
  Coding regions on vcDNA: vcDNA=SeqID_51338; Strand=-; Position=1-92
MRKMTMLMQPMNAATCSGASPEWVVASTLA

SEQ ID NO: 124916 - protein, 19 aa, Heterodera glycines
  Coding regions on vcDNA: vcDNA=SeqID_51339; Strand=+; Position=1-59
MANKLMRIAFAFTPNSMDE

SEQ ID NO: 124917 - protein, 77 aa, Heterodera glycines
  Coding regions on vcDNA: vcDNA=SeqID_51340; Strand=+; Position=1-231
FKKVMPRRESKTPVIRTFFALIFLCINKKFWKICRLIAFFECFRIIPRMFNLVEKEKSYGRKIRSTTFRLTTVLPTP

SEQ ID NO: 124918 - protein, 29 aa, Heterodera glycines
  Coding regions on vcDNA: vcDNA=SeqID_51341; Strand=-; Position=1 -15,297-371
MGNWSKDYRISLPIVSKMRENFVAKFLSK

SEQ ID NO: 124919 - protein, 236 aa, Heterodera glycines
  misc_feature (5)..(5): Xaa can be any naturally occurring amino acid
  Coding regions on vcDNA: vcDNA=SeqID_51342; Strand=+; Position=1 -52,1594-1784,2147-2262,3062-3194,3608-3829
  Homolog annotation: Hit_ID=AAC83413.1; Match level="QueryCoverage =99%, HitCoverage=46%, E-value=2e-84, Identity=66%"; Hit description =ankyrin homolog LE1 [Onchocerca volvulus]
MTSVXAPLRGLNFLLQSSDDHQAAAAEHARDFNESITQGLRDSAVVHLIHTGEQGVGGKSSSSMAFDTTDADLEAVIKRAQNAPVTTALADSSLENGNDDNVALSRHVIQPRSFLFLNFLVSFLVDARGGAMRGCRHSGVRVIIPPRKAAAPIRITCRYLKKEKLTHPPPLSEGEALASRILEMGPHGAKFLGPVILEVPHFASLRGREREIVILRSDDGQHWKEHQLEATEDAVQ

SEQ ID NO: 124920 - protein, 200 aa, Heterodera glycines
  Coding regions on vcDNA: vcDNA=SeqID_51343; Strand=+; Position=1 -310,353-498,549-695
MDPRNGFYDKNEDKVTLAIDVIVGQAEMDRPISADQSKSKGTLFMDIEKVSQFAREIIWSERKSETVTCLGGLPWKISVQIFTIMGSAVKCLSLFLCCTAPKEDENWRAECSAKFRIVSQMSGVGEFRKEFEHTVFNSETNCWGFPDFITFAELMDPGRGLYDREEDKVTLAIDVTVMKERKGTKRKLAVGNAHPIINLT

SEQ ID NO: 124921 - protein, 24 aa, Heterodera glycines
  Coding regions on vcDNA: vcDNA=SeqID_51344; Strand=-; Position=1 -61,897-910
MPRKENEVESKVRERNAMEGAIFF

SEQ ID NO: 124922 - protein, 82 aa, Heterodera glycines
  Coding regions on vcDNA: vcDNA=SeqID_51345; Strand=-; Position=1 -12,834-1070
MAGNLLQSQVNSARGILMDLLTANRRDLSPDVAACLKAVTALLNPAASPAAQQTYAAGGCANVGAANAAVSGRKEKPMFKSK

SEQ ID NO: 124923 - protein, 62 aa, Heterodera glycines
  Coding regions on vcDNA: vcDNA=SeqID_51346; Strand=+; Position=1-232
LIAIFNIAICSFILSTVCQCVDSVQLSLTELGVPSVVESPYSGEVHVASVGPISAICHLLFS

SEQ ID NO: 124924 - protein, 239 aa, Heterodera glycines
  Coding regions on vcDNA: vcDNA=SeqID_51347; Strand=-; Position=1 -220,574-601,711-835,1368-1559,2233-2386
  Homolog annotation: Hit_ID=NP_505051.2; Match level="QueryCoverage =51%, HitCoverage=51%, E-value=9e-28, Identity=38%"; Hit description =scribbled, LEThal LET-413 (75.3 kD) (let-413) [Caenorhabditis elegans] gb|AAC17752.2| Lethal protein 413,
PPEIGALRSLVELYVDENSLERLPDAMLRCTKLEQLDASSNKLFLLPDELGELGALVDITVSHNCLRELPNSIGRLKRLMILKADDNTIDTLTPAIGGCTSLTEVYLQQNLIGELPSSVGNLKACPANTEHGPVPTAPCARSVGRMCLADRVVHAGQSVARVAHGNWQIGTSTGDGRVQQPTPAFALHAKCAARVASVVAVREPVPSTAPPSAGHRPAERRQSAHLLSVAPTGRIRWLK

SEQ ID NO: 124925 - protein, 88 aa, Heterodera glycines; identical to SEQ ID NO: 124691
  Coding regions on vcDNA: vcDNA=SeqID_51348; Strand=+; Position=1 -96,135-305

SEQ ID NO: 124926 - protein, 47 aa, Heterodera glycines
  Coding regions on vcDNA: vcDNA=SeqID_51349; Strand=-; Position=1 -120,513-536
MNQQLPNKHKRDELKQQKKQKKVTFQEPTKKEENAGDKTEKFPRSTL

SEQ ID NO: 124927 - protein, 1092 aa, Heterodera glycines
  misc_feature (229)..(229): Xaa can be any naturally occurring amino acid
  misc_feature (255)..(255): Xaa can be any naturally occurring amino acid
  misc_feature (410)..(410): Xaa can be any naturally occurring amino acid
  Coding regions on vcDNA: vcDNA=SeqID_51350; Strand=+; Position=1 -78,722-895,970-1182,1415-1921,1984-2064,2120-2175,2397-2490,2596 -2725,3110-3397,3515-3641,3720-3945,4040-4182,4606-4730,4979 -5087,5184-5451,5543-5629,...
  Coding regions on vcDNA: Position=...5657-5760,6155-6434,6579-6685
  Homolog annotation: Hit_ID=NP_492839.3; Match level="QueryCoverage =99%, HitCoverage=43%, E-value=1e-140, Identity=34%"; Hit description= ankyrin and protein kinase and Leucine-rich repeat and Protamine P1 (1L480) [Caenorhabditis elegans] gb|
INLNNEKGLNQQQNQSEKLDSNALLSAIAFDNAELLAELLAARPLLANCHDADGRMPLHHAAAGGHAKCAEILLGSGGDLKFLNDTVKTPLGLDTVKTPLGLASAMGHCTVVHLLAENGADLFYVDSDGHSALQLAQMGGHDQVATLLIGIIERIYAEAERKNQLCAACVDGEVGPVLDISDLGPKSIRKQILNGRSGEQKSALFLAAENGRAEICAHCSPYSTIPHFXAQRRHGMDINVNLLLYLEKAINFASXNSFFMFTKNFSFRLALGLLFEKFPVIKSFPLLASSCRLPLRMWQLLQILHKFPFLMDAVNEEKNLPLHWACRCCGNARVVQALLSAEYPAEIEIFRVSADGYLFVCDLNAVDREDGYLFVCDLNAVDREGRSAFFLAVMEGHSEVVQLLAKVVKXNKYNKQRKHFKLPIYGTRHRREMLRIEEKQNLMEHPILFDGRVNGKTPLMVLDVNYSANERRCRRSGGGALAEAANSGHLEVLQALFHQGAFDYGNRTLRGRLANDSGHSKMVGLFLQQLVHHDNENCVNSARSPRQKKEHGQLPLSDHLPSTKGCQLNWQSTGIRELRSEWMVDAALKLNPQIPRKKSLALNAISRIDLSSNQLCSVPHILFTHLSSLRSLDLSKNCIPRFEIPPDGANWQMPSLDRLCLDENQLEELPKQLLSTPRLCFLSATFNRLRRLPPSVWTAPRLLELHLANNLISELSAAARNSEGSGDKRSNGRGDGHPQVGERRESVSTKFIPTKATFTKLFRVNIWQEKIHLSNIDEDGPTVANEEATGDELAAQKLAFVQFGRMPTCLACCCPRLAKLDLSSNSLSSLGPVGCLPSALRHLDVSKNQLVRLFGGENPAAEAKAALLRGSVRIWNCRCENGRRWRSRSKSVARSQRSLSVVRKSGGGVGRAEQLCCVHKSHCRFEALCCVHKSHCRFEALKTLNLAQNSLEFVDILLPMGGVLFPSLTNFDLSLNRIRQLPTTISLLGSLAMLNLANNVELDSLVPELGLLERLWTIGLSGCQLRAEEPTLQAMVQAGSYKTGEVLAQLRQRLENSMPYPMLKLMLLGASSVGKSTLLQQIRLEGTLSKKP

SEQ ID NO: 124928 - protein, 255 aa, Heterodera glycines
  Coding regions on vcDNA: vcDNA=SeqID_51351; Strand=+; Position=1 -72,117-353,994-1227,1284-1508
  Homolog annotation: Hit_ID=EAL27215.1; Match level="QueryCoverage =89%, HitCoverage=8%, E-value=1e-29, Identity=34%"; Hit description =GA18916-PA [Drosophila pseudoobscura]
MGGVCGKRRKNWDKEMDCKMGYKDREYQSVQRCFFTRRCLFLLLWKVTDGDIALADLHDFLLAIQAQAPNSYVLIVGTHSDFVREQPHRFPSDYLSQMDKQIQQRFILGADPEKNGVPRVLGSLYISCCSREDVRSLCALIYTCATEIRQFSRGGGPARQRLLAQKVPASFVLLEHIVAAMSDEFRAVGKEPIMHFNEFWSLATDRLAQLEEQKEQQQDKKTSTTKPASGTLHFRGAQDFRQACLFLHENGPTYP

SEQ ID NO: 124929 - protein, 274 aa, Heterodera glycines
  Coding regions on vcDNA: vcDNA=SeqID_51352; Strand=+; Position=1 -75,512-652,954-1249,1322-1634
MHQNSVIESVELYTALKRAVRHNLAHRRLSRAVATSIDNLNSTKLTENNGTGENEEKNADLIKILAVDQCKEECLRRLYVMHYIPPGFWARLTTRLLDDERVGNVLTKMLLISRASPLPQQQHMMSMTETDQQQKQPLAALWSTEAIVAAFGRALNAGRMVNLAQRPSIRRDASAADEMENVPEEETSFIVVNSAEEMTEEFAFNSNNKGNPSSSSSSGGTVVVKCCERGVEATDERCRGTGGGIGKVGEELGNVLEWMLWRSGVEVGEAFWAG

SEQ ID NO: 124930 - protein, 109 aa, Heterodera glycines
  Coding regions on vcDNA: vcDNA=SeqID_51353; Strand=-; Position=1-330
MKQLLLENATAAGRLAKWRRTANDPLNGAKGTKSTDRRHLRRECANHQSWIMPIQQSSTQLPQFRVQLAPLRCLCQPIIAPLPPPRRPFRSSIFLYQCRKYSSPSLPTQ

SEQ ID NO: 124931 - protein, 97 aa, Heterodera glycines
  Coding regions on vcDNA: vcDNA=SeqID_51354; Strand=+; Position=1 -150,218-359
FITALEVMDLSTFGTDKERWRNEKGDEGEEEEQLLVGTSNGVVLIVRGIEMSPISAFRPFCSVQRIICCPPPFGQSSSSCRILQKELLHSSTKKAPL

SEQ ID NO: 124932 - protein, 107 aa, Heterodera glycines
  Coding regions on vcDNA: vcDNA=SeqID_51355; Strand=+; Position=1 -207,1245-1361
MISPHSPPNTERHSSKKRSLLIEKSRSIMLKATGGAVAGTAAGNGECQGQRPKMSASIPAEEGKQQQQQFFVAGVCANQPKEEAEEPWYITMMRGSKARKCQRMKSG

SEQ ID NO: 124933 - protein, 66 aa, Heterodera glycines
  Coding regions on vcDNA: vcDNA=SeqID_51356; Strand=-; Position=1 -140,1104-1164
MVNIYSNGLYFSPELFFIYLFIDKEKLPSEGRRPLTLMTDHNKIVSDSIGSCEVVKLPKIGRPYSN

SEQ ID NO: 124934 - protein, 124 aa, Heterodera glycines
  Coding regions on vcDNA: vcDNA=SeqID_51357; Strand=+; Position=1 -137,483-585,709-842
MSLQIGIPVLGNGAWTMATLFKPFWIKNLKLEKFGFSNFCSNSDPGTVVKRTRTRQQTVTMESSSQVATEVDAVFSQVLNIPHMDNPIEELKRQMQKLFIQKESEWAFKLNEVKNCKNSLKKFT

SEQ ID NO: 124935 - protein, 65 aa, Heterodera glycines
  Coding regions on vcDNA: vcDNA=SeqID_51358; Strand=-; Position=1 -175,295-317
MSVQPKLVVINYPLGNSFGVFLTEPKPMEWSLITPWTHFDCIMPTEVSIISHLELRSSSVSQKGD

SEQ ID NO: 124936 - protein, 43 aa, Heterodera glycines
  Coding regions on vcDNA: vcDNA=SeqID_51359; Strand=+; Position=1-275
IFSSFLLYFFFYFIIFCNYFSFFEFISFFFFFFFPFFSKYFAK

SEQ ID NO: 124937 - protein, 84 aa, Heterodera glycines
  Coding regions on vcDNA: vcDNA=SeqID_51360; Strand=+; Position=1 -117,233-370
MKLFPLLCLIIFLIIVKIESEKKKLQQKSFGEYLEKNGNEEKLEEKRETIGKYYKIKEKIQQKGRKYSKKEWHQNYAEICKCRT

SEQ ID NO: 124938 - protein, 113 aa, Heterodera glycines
  Coding regions on vcDNA: vcDNA=SeqID_51361; Strand=-; Position=1 -359,468-640
  Homolog annotation: Hit_ID=S52407; Match level="QueryCoverage=82%, HitCoverage=39%, E-value=8e-11, Identity=35%"; Hit description=TATA box-binding protein - Entamoeba histolytica
KGYIKGVKGPFDWYIVSKMQKPIIVNIIALANLGTGIKLNSLTITECEFKYNPRKFNAAVIKCISPIKATALLWESGKMICLGTKSLIDCENAIKKFIEIIKGSGCPGLLTPD

SEQ ID NO: 124939 - protein, 907 aa, Heterodera glycines
  Coding regions on vcDNA: vcDNA=SeqID_51362; Strand=+; Position=1 -452,619-829,871-1431,1478-1739,1779-2097,2140-2695,2738-3049,3288 -3338
  Homolog annotation: Hit_ID=NP_507780.1; Match level="QueryCoverage =70%, HitCoverage=47%, E-value=4e-68, Identity=28%"; Hit description =predicted CDS, DNA polymerase type B, organellar and viral family member (5T899) [Caenorhabditis elegans]
MENYKLMDYQTTTCQKFGFTKNITEFRINPDVERPDEAMKDAIDNMIKVALKTTEEKMKRKVRMFGVAITGAGLAFPVWVPYRAYPQNNADVIMEEINKLGQSGDGDENKKMLLLSEPITMKITCVTMPSGEGPRNVHKFDFGFKEHQRIGIVNTDNKFCLFYALASSMNYLIMDRFEFNRFMKNIVRQRDAAIELLRNCGIDGNEISYGVEQLPNVQKYWDEIYPGKYRVVAFEKSADPRKSIRVLWKAPMGREKVVPIFLENGHWDGLKNYVCFFNRGRKFCVECECFYDQDVYHTMDCRARCYYCNRVGGMPCEKESGVKIECPKCRRYFYNWECYNYHQGHQTCKLWRRCVICDKTYRFNPKKEHECGETYCQLCSVSHDPKRGCYIMPIEEKEEKYVYRIVVWDSETSQDSIYKGDQKEHVINYISVRVTCTECCDDKNRMNCKICGEKRIKDWSEAEGHEPTKDFVEWILTAFTNYDTYIFAHNAGRFDGHFVFNYLCRTGKNPIPLINGLKIYEFKVRNSKKHSMLIWRDSCLLMPVKLESLKATFNLGCEDKPFFPYYYNKKENYGVCLEHLPPMEDYSPGSMNKEKFAKFEKWYNENKGTPFYLDEELRNYCRNDTEILLLSIIEFRRILINDITKGFDPLPRSCTNAGVAMNIFKAMFLLTEQLSIVPEKGYERCDRASVMAIKYLEWRSKRDEIEIRHAGNGREVKVGNYKLDGFIANNGARDKCIEVMGCYIHGCMSCYDPAAELIGGRTAQELNDETQERLAELRKTLDVEEVWGCQIEKELKKDEEMRDFFDDRGNEKGPIDPRMAYAGGRTGPMKLYAKSDEKKKISVYDIVSLYPSVNYVTAYPIGLPQIIIRKSDEIDVNWTRPEDLKYKGLYKAKALECGYTVDRFYRA

SEQ ID NO: 124940 - protein, 160 aa, Heterodera glycines
  Coding regions on vcDNA: vcDNA=SeqID_51363; Strand=+; Position=1 -267,444-656
MFRRSVTNSLLPSSGNDHRRHSHQTITVVENSRHRRQQKEDDDRRMDASEQLAKEKTCRWSDILGGWSGNGGKGRDGRRESDGGDSAEELIAALKSLQSTGKMTEKAAEAQTKGAKALAKWASKSKNEAMADIVGRVSELMEMHAERQRTFAKDYGHYLK

SEQ ID NO: 124941 - protein, 113 aa, Heterodera glycines
  Coding regions on vcDNA: vcDNA=SeqID_51364; Strand=+; Position=1 -165,277-453
MVAGHSLATNSGCAAVSALPLHHAVPPPFSSPLVVQQFNQHRHQMALALAGINANAHNSNAFDAATAAVPFHQQSNQKHEQSCSTEVPAVQQQIMSTESKQRQPNSIGNVVIK

SEQ ID NO: 124942 - protein, 65 aa, Heterodera glycines
  Coding regions on vcDNA: vcDNA=SeqID_51365; Strand=-; Position=1 -67,117-139,235-301,350-388
TTSFLHQTLNVAFGCNEQIYSPHYILPTPDTTSFLHQTLNVAFGCNEQIYSPHYIIPTPDDERGI

SEQ ID NO: 124943 - protein, 170 aa, Heterodera glycines
  Coding regions on vcDNA: vcDNA=SeqID_51366; Strand=-; Position=1 -33,116-350,588-660,878-931,1170-1301
  Homolog annotation: Hit_ID=CAA58765.1; Match level="QueryCoverage =100%, HitCoverage=33%, E-value=3e-46, Identity=52%"; Hit description= beta-1 subunit of nicotinic acetylcholine receptor [Caenorhabditis elegans] pir||S68587 nicotinic acetylc
MPRWVRFVFLKLMPHLLCMKRPSPAINRLAWHATDGADSDGLTTLPGVGQFTVPPSAHHPNCPAAGKRDNKMEQKSDNKAFVPIFSMKVRAVHSIEYITEHMRREEKHKTRDDWKYVAMVIDRFLLYVFFGVTFGGTIGVLLSAPTVFESVDQQAVLQRLIQAYNSGGRL

SEQ ID NO: 124944 - protein, 100 aa, Heterodera glycines
  Coding regions on vcDNA: vcDNA=SeqID_51367; Strand=-; Position=1 -192,244-354
  Homolog annotation: Hit_ID=NP_491691.1; Match level="QueryCoverage =77%, HitCoverage=11%, E-value=3e-11, Identity=45%"; Hit description =oxysterol-binding protein-like protein 9 (76.7 kD) (1G409) [Caenorhabditis elegans] gb|AAC24270.1| Oxyste
MSSINPNDFLSPSILAAADFKMQAPDWGNYDTNGTDYDYIYNNSDERDNWNSEQAGVFRHLVTQLGTTQTLQNLALPTFVLERRSLLEMYADFFGEYIAF

SEQ ID NO: 124945 - protein, 181 aa, Heterodera glycines; identical to SEQ ID NO: 124594
  Coding regions on vcDNA: vcDNA=SeqID_51368; Strand=+; Position=1 -96,135-252,468-628,667-837

SEQ ID NO: 124946 - protein, 312 aa, Heterodera glycines
  Coding regions on vcDNA: vcDNA=SeqID_51369; Strand=-; Position=1 -730,780-828,882-1042
  Homolog annotation: Hit_ID=NP_001004509.1; Match level="QueryCoverage= 100%, HitCoverage=21%, E-value=3e-50, Identity=35%"; Hit description =si:busm1-180o5.3 [Danio rerio] emb|CAD60788.1| novel protein similar to DNA polymerases [Danio rerio]
LGCYWHGCERCFDPGDKLVDAKSCRELNEETNLRLMQLREGDVDGQGLQVEAVWECEINAQLACNAEMRAFFSDLGMDRGPIEPRGAYFGGRTGPLKLFAEPKEDEKISVFDIISLYPFVNYTCEYPVGIPTIIRPMADEMCVNWTRPEQLPYRGILRVRVVPPRGLRVPVLPVKIDERLLFCCCHHCATMFRKKSTRRPHKCPHTDAQRSFTGSYTHIELERALEHGYKIDRLWRAWHYDEWSDQIFKDYVRLLIKLKIESSGFPEGVSSADQKQRYADEYRRIYEVNIELENVKKNPGLRFIAKLMLNSL

SEQ ID NO: 124947 - protein, 20 aa, Heterodera glycines
  Coding regions on vcDNA: vcDNA=SeqID_51370; Strand=+; Position=1-63
LIQMLKTFLLLFSHDHTING

SEQ ID NO: 124948 - protein, 60 aa, Heterodera glycines
  Coding regions on vcDNA: vcDNA=SeqID_51371; Strand=+; Position=1 -16,442-608
MDSFQDAKQVIKPVAGPAEATDISTKQQRMPRMQVAATPPTEKPKTRKRKYELDFFLSFS

SEQ ID NO: 124949 - protein, 104 aa, Heterodera glycines
  Coding regions on vcDNA: vcDNA=SeqID_51372; Strand=+; Position=1 -210,252-356
MPTHPRGKEAAELWLKHFRRELEEGRERRRQMFMVAMRKQLDIIRRYQQGKLPKEELDALLEEARQRDAQRPDKEQYEEKIKQHMAKAYFEDVKNVHLLTLFQL

SEQ ID NO: 124950 - protein, 134 aa, Heterodera glycines
  Coding regions on vcDNA: vcDNA=SeqID_51373; Strand=+; Position=1 -93,147-368,431-520
MFANAVMYNSTGHYVNNYAKEMVAYALKCIEVVQFPTGQFHAPPPSRQSNGSSSEGGAIGGGGAAKFTIAWATTLIKPKGVDQKKAKGRNDEELTSSSSQDKEREADQRDEEETRRLFQRRRMYNKKYTFTSTI

SEQ ID NO: 124951 - protein, 57 aa, Heterodera glycines
  Coding regions on vcDNA: vcDNA=SeqID_51374; Strand=+; Position=1 -114,159-218
MPATAALWVWEADRDYERWEGSRVLRERRVPKFVLPRTIFDWSDFDYAQQMRKAPTG

SEQ ID NO: 124952 - protein, 107 aa, Heterodera glycines
  Coding regions on vcDNA: vcDNA=SeqID_51375; Strand=+; Position=1 -39,82-366
MQVFANYAINLIEMENKCSLNRVLIEMVKIENLWSEKSSSDNYFIQALAKSGLEAFRRKMCEVFWQKNPTIVQCAAFLDPAVNGLLSQICHSNSNWGTQTMVMSRDF

SEQ ID NO: 124953 - protein, 97 aa, Heterodera glycines
  Coding regions on vcDNA: vcDNA=SeqID_51376; Strand=+; Position=1 -204,1103-1192
MESDSNPQQQSVPVQQLPSDASPQPQQNGGGDSADKIGPDQMRLLSAQIAAYKMLARNEPVPRALLREDSKSHRPAHPGVAMFAHGHAAPFAHPCRN

SEQ ID NO: 124954 - protein, 88 aa, Heterodera glycines
  Coding regions on vcDNA: vcDNA=SeqID_51377; Strand=-; Position=1 -3,270-345,391-578
MLNETEKAAKKINKCNEKEGKGKLKKEQKGSDLEEKLEENRRTKRKGRTETKAKETKGERETDRETAYWNEYWDEEQRRWICETQQKP

SEQ ID NO: 124955 - protein, 214 aa, Heterodera glycines
  Coding regions on vcDNA: vcDNA=SeqID_51378; Strand=-; Position=1 -137,186-459,505-624,678-706,757-841
MDKENKKRKGTKRSKNPEKTSKQREENQNKENDDEFIHPPRRRSARLIAISKPALSSDLSASAEDFVHGKGTKTAKSEVFGTDALFGVSSASFTSPFNSYLTSSVEPIKLSSDEATVSSNRSLTKRLNATNIQNAQSLGEGTSKATLPLSSDDDGEEDEWGAMELLHTDKTEKKVIEVELDEKHSGKFVQTADKSVERERRKRSGGKGKMGARN

SEQ ID NO: 124956 - protein, 111 aa, Heterodera glycines
  Coding regions on vcDNA: vcDNA=SeqID_51379; Strand=+; Position=1 -201,232-366
  Homolog annotation: Hit_ID=NP_507845.1; Match level="QueryCoverage =94%, HitCoverage=14%, E-value=2e-17, Identity=42%"; Hit description =transposase family member (5U321) [Caenorhabditis elegans] emb|CAB81975.1| Hypothetical protein Y116F11B.
MAHGEKATTSGGNLKAPPMEVYLEWIANAWDSLPKQMIADSFLTCGISKEEKGRHDDKIHVFKVLKNPDGAIPNGLAILKQRRQEEDVLKLVEEIDLSEDESDEEIDAEVS

SEQ ID NO: 124957 - protein, 52 aa, Heterodera glycines
  Coding regions on vcDNA: vcDNA=SeqID_51380; Strand=-; Position=1-159
IKKRTTMIRRGATVIRRGATVIRRVTTVIRRGTTMIRRGTAVIRRGTPVIRR

SEQ ID NO: 124958 - protein, 35 aa, Heterodera glycines
  Coding regions on vcDNA: vcDNA=SeqID_51381; Strand=+; Position=1-212
LETGASARLRPRSGLNSPTNLETGAKRPSEASKLP

SEQ ID NO: 124959 - protein, 154 aa, Heterodera glycines
  Coding regions on vcDNA: vcDNA=SeqID_51382; Strand=+; Position=1 -247,567-779,846-850
MKTGIILTLLIIKNSFHQTFFSKLDQIKSFNEIFGHGWSDGEEQIGENQTELAGTSQSRRNDLERNDLQSRIDQSQINGHRYDNSFSNHFENVKQKYSDLEKLEIVKKFFELKAKRVAAKDKAKLNEQINKEIANELGTGVTTIYNWKREFNID

SEQ ID NO: 124960 - protein, 148 aa, Heterodera glycines
  Coding regions on vcDNA: vcDNA=SeqID_51383; Strand=+; Position=1 -166,288-455,618-730
MENFDETEKQKEIVKLFKKYKKQNKEKTNLEIAKELGIHQNKLLEFRKRFDPTYKKKLLANSEKIALVRKYYKLKRKFPELSQNKIAKILKISKNALIKWKQQFGNQFEEQVQKMSHPKMLMRQFGHGTMKHKKEVENEQNLLLKLDE

SEQ ID NO: 124961 - protein, 153 aa, Heterodera glycines
  Coding regions on vcDNA: vcDNA=SeqID_51384; Strand=-; Position=1 -188,246-328,386-454,521-550
  Homolog annotation: Hit_ID=NP_509099.1; Match level="QueryCoverage =71%, HitCoverage=19%, E-value=7e-36, Identity=70%"; Hit description =sterile alpha motif /Pointed domain and Ets-domain containing protein (52.8 kD) (XH139) [Caenorhabditis e
VHQQQSATAAFAVLHQTQQMQPQRTVCGHGNGGTIHLWHFIRELLDQPRDYGGCVRWVDRKEGTFKTFKIESSHHLARFWGLRKNRAAMNYDKLSRSLRQYYKKGIIQKPLSRSLRQYYKKGIIQKPEKKQRLVYKFLPPYNQVYKFLPPYNQ

SEQ ID NO: 124962 - protein, 94 aa, Heterodera glycines
  Coding regions on vcDNA: vcDNA=SeqID_51385; Strand=+; Position=1 -42,360-602
MPQVDDSDCCIEMRQCRLFGTQKRPSSVRNLKVAAEVGTVSSSSILLRWDTADRADIYYVYWRGRNAAEWSNRSARNTTLMRINVDAAMVDEVH

SEQ ID NO: 124963 - protein, 58 aa, Heterodera glycines
  Coding regions on vcDNA: vcDNA=SeqID_51386; Strand=-; Position=1 -143,346-379
MRSTENGKFCAICRHKCAENEEKPRKENAMCCTIKTICILQHQKKPAPKALKMDSILV

SEQ ID NO: 124964 - protein, 483 aa, Heterodera glycines
  Coding regions on vcDNA: vcDNA=SeqID_51387; Strand=-; Position=1 -40,303-555,1079-1484,1819-2108,2161-2288,2863-3017,3104-3283
  Homolog annotation: Hit_ID=AAL05844.1; Match level="QueryCoverage =12%, HitCoverage=11%, E-value=9e-09, Identity=54%"; Hit description =latency associated antigen [Ovine herpesvirus 2]
MDTYVVALTILIQEFNEEAQESADGPQLKNAAASPKIIAAATKAILVPIGTFFVHQTQSKRAMASECGDGECQQCDNIGKLENKISMITSKGQKNIIRAEEEEEEEEKRKSEEEEEEQQQQDEEEEEEESDGTKKGGQWEKHYGKGAMGGGPCGANCGKQCPRRCCCCCVNLSRIILELLSPNNVPVMKCQKQFSLSVKGCAKECERSEKGADKSILGPINRQQSAQKKVPLRLFKPFFARNANFGVFNSPPKLIGFNDKVAEKQRSSVDESLENLKERLGKISNKLDFWKTNLLRKPLQAIDESIPTAADQQQKETSRADQLKMLKEGDNQQGIGSDYGNGKIDKNTFGQWRRKCSKGWRWAEQHGDSTNCDIDLTTSSTSTPTAAVNGTLFTLTTRQLQTASAAELPTPPPYVPANEPSNMPIVNVRSVIVQEMAPTENATGNNGTAKSTTLMSLTQMDQNGNVKANGGAFIGDSFKLRFY

SEQ ID NO: 124965 - protein, 86 aa, Heterodera glycines
  Coding regions on vcDNA: vcDNA=SeqID_51388; Strand=+; Position=1 -124,492-628
MFKCDCNDAEKKDEKFNKISGKEENDEESVQSDQNVALGVDVISLESFFMLIYKFMCFRKFLGNALRLPAPGQSDSGHSDKWTILQ

SEQ ID NO: 124966 - protein, 114 aa, Heterodera glycines
  Coding regions on vcDNA: vcDNA=SeqID_51389; Strand=-; Position=1 -24,149-318,368-518
MAKMRQMNFFVCITATNFVDEHNNRFSYVQEWFNVSSAQNDILFFANFNQNPWVNDLSTVVIPAWLLLWASSKLREIISKQLKIGNEKSRNTIHVHQIMTVSARTQQIKGICRR

SEQ ID NO: 124967 - protein, 87 aa, Heterodera glycines
  Coding regions on vcDNA: vcDNA=SeqID_51390; Strand=-; Position=1 -9,632-886
MDPSFFYPCYITSTLSPLMGSSASAPFFSAMAMLANSNLCPFLFALAIGIPSAVLYCSLLLVIVANFKHFSSPFFILIIIRAILVGK

SEQ ID NO: 124968 - protein, 60 aa, Heterodera glycines
  Coding regions on vcDNA: vcDNA=SeqID_51391; Strand=-; Position=1-211
LAGNTLIGFFLPQMIILFFSPFVLHKFCVFRWNSKGTHWRREIIPKSERELPTRDNGSIV

SEQ ID NO: 124969 - protein, 51 aa, Heterodera glycines
  Coding regions on vcDNA: vcDNA=SeqID_51392; Strand=-; Position=1 -134,365-406
  Homolog annotation: Hit_ID=NP_504477.1; Match level="QueryCoverage =94%, HitCoverage=18%, E-value=3e-14, Identity=58%"; Hit description =predicted CDS, cyclin G1 interacting protein like (5G74) [Caenorhabditis elegans] pir||T32530 hypothetica
VASSPSKVPSRKFCAVCGLFAGYTCVRCSARFCSIPCKDMHLDTRCLKWTV

SEQ ID NO: 124970 - protein, 117 aa, Heterodera glycines
  Coding regions on vcDNA: vcDNA=SeqID_51393; Strand=-; Position=1 -43,194-504
  Homolog annotation: Hit_ID=NP_504477.1; Match level="QueryCoverage =68%, HitCoverage=25%, E-value=6e-10, Identity=42%"; Hit description =predicted CDS, cyclin G1 interacting protein like (5G74) [Caenorhabditis elegans] pir||T32530 hypothetica
MRINPQICEPCFIVGRIISQQPTKCFDEAAKRRRIQQQLESLEKVRLLAENDAFPVFQDNFQEDPHANITWHKAAPKFDDEMVFGDKEKKRRKRKIASPSKVSGAEQASEWKSGEEK

SEQ ID NO: 124971 - protein, 56 aa, Heterodera glycines
  Coding regions on vcDNA: vcDNA=SeqID_51394; Strand=-; Position=1 -98,932-1004
MNVIPTYKQACASAAKDIVVLRPFDQWVNENDPMIDYCRKNGATVDMPSEAELFLH

SEQ ID NO: 124972 - protein, 22 aa, Heterodera glycines
  Coding regions on vcDNA: vcDNA=SeqID_51395; Strand=+; Position=1-66
MNVMKTGEEQDITNFKLGKTQK

SEQ ID NO: 124973 - protein, 19 aa, Heterodera glycines
  Coding regions on vcDNA: vcDNA=SeqID_51396; Strand=-; Position=1-60
KNSNFNLYQVKIIQNYLVF

SEQ ID NO: 124974 - protein, 88 aa, Heterodera glycines
  Coding regions on vcDNA: vcDNA=SeqID_51397; Strand=-; Position=1 -231,765-800
MIPYQTLFSGTKFQSEIIHIKLLFKKPIQILNIYRPPNCNVHNTKKLLKFISDQSDSENIIYCGDFNIPNILWDGNKGNEKTIAQIKK

SEQ ID NO: 124975 - protein, 29 aa, Heterodera glycines
  Coding regions on vcDNA: vcDNA=SeqID_51398; Strand=+; Position=1 -78,238-249
MNVNKEEERLEKKVTKWAIMLTSEDKRKF

SEQ ID NO: 124976 - protein, 189 aa, Heterodera glycines
  Coding regions on vcDNA: vcDNA=SeqID_51399; Strand=+; Position=1 -178,353-744
MTQKAKAATHHQQKKKKERMEAAGEINSIASLFSGEPADVKVNFYGAIKCGIFRDGTANSENIFFSIKKINNFFNHERVAADRTAISGVLDELGIESPITVYRMGSPDQAKTGQNRPRLMKVIFGCSKHQRQTFGSMEQTARSNQSKTGDEQHQNSPFTQPRGTQGPTCAAGRVQQKKKGRWRRVGGLR

SEQ ID NO: 124977 - protein, 43 aa, Heterodera glycines
  Coding regions on vcDNA: vcDNA=SeqID_51400; Strand=-; Position=1-129
MRECWISVPVIQNIFDEGGRENNFNRERNGKGVVHVSSSLILL

SEQ ID NO: 124978 - protein, 103 aa, Heterodera glycines
  Coding regions on vcDNA: vcDNA=SeqID_51401; Strand=-; Position=1 -23,643-731,891-1090
MSKIKSLGSKSRKIEKIRDHGQPCCVPFVTAFCLAFHGTQVTQQHTANEKQMAQIIEILDDEEEMGEEEEKAKNEENENEEKSEDKRRKKSKKKDDCYVYYNF

SEQ ID NO: 124979 - protein, 24 aa, Heterodera glycines
  Coding regions on vcDNA: vcDNA=SeqID_51402; Strand=+; Position=1-100
LTHRPLRRKNQLNCTWSPKLNRRV

SEQ ID NO: 124980 - protein, 234 aa, Heterodera glycines
  Coding regions on vcDNA: vcDNA=SeqID_51403; Strand=+; Position=1-705
MYTYQTSEIERKLRHYGVRALTVDAYQAQECDVIIIVTTRSKYSEMGSGRTDNMHFFEDDQRATVALSRARHAVFIIGDLVSISAGQVWKRFIEMAITRTSVVRAEYVLALLGRTLVRSSTCLFDSAKRESVEDEGFLESWALKHGLRLDRTNAFGQQQSQQPRAPSFQFQNRHFPALQTTGPSDQAGPSGSGGQQRGAPTLAPQYGRGQGRRGPDNQWMHYGGNPKRQKGGRR

SEQ ID NO: 124981 - protein, 54 aa, Heterodera glycines
  Coding regions on vcDNA: vcDNA=SeqID_51404; Strand=+; Position=1-164
MPKPQEALLTDQIIILKMTEDGTIALPEMTDDGIIKPLKMTDAGMLGQFATTVG

SEQ ID NO: 124982 - protein, 203 aa, Heterodera glycines
  Coding regions on vcDNA: vcDNA=SeqID_51405; Strand=+; Position=1 -434,504-682
  Homolog annotation: Hit_ID=NP_780438.1; Match level="QueryCoverage =77%, HitCoverage=5%, E-value=5e-10, Identity=29%"; Hit description =serine/arginine repetitive matrix 2 [Mus musculus] dbj|BAC41104.1| unnamed protein product [Mus musculus]
WRNVRFWLSWRNECFWLSWRNDKLAKCHGAPCRSPKKSGPKNRHSPAGRGGGRSQTPRKKKQPLKKVPGPSSRTPGRRVKKPSTKKSPARRATETKKKPTRKTAGGRANKQTKSRGRKTTKKTDQEEERADSEAEAAGSPRNSGHSEESASGTKNKPTRKSAAAGRSTKQKASRGGRAGNKKAQEERSESPTESGSDREEDEE

SEQ ID NO: 124983 - protein, 573 aa, Heterodera glycines
  Coding regions on vcDNA: vcDNA=SeqID_51406; Strand=-; Position=1-1719
  Homolog annotation: Hit_ID=CAA82797.1; Match level="QueryCoverage =80%, HitCoverage=70%, E-value=3e-35, Identity=25%"; Hit description =gag protein [Ascaris lumbricoides]
MNKEEWNNEWKVQKIFREKHDYLKTIKEIDEILDTLKDVNLEVKRRLKLLKAKSSSDSDPEDESNDYEHENEDEVEEQEEEKEYESDNEDESPELSLNDQIHHDRIPFVNYRSRIKLPPQTLTHFNGKFSQWPSFWDDFKSSVDNDPNLENIQKLKYLRGLLHDEPYRIVSPYPLTNKNYTIVIKLLKSRYGNPQLIRENLHSELRNLKRPTESTIELRRFILLIDRIILQMKSQGEDINHPQIKQSIETKLPYNIRLKLREKFKIYSTKEIMEFMNDHTQAREDIERMEESNRQIRNFPSNRPPQNGVQRQFYPNFPHNQMKPNPRNQQNTSSSPFPYTSALTTKSNPVRLAQFKSNPTQTRTQNKIFCRFCERENHASKECNFNCKYKHNTLLCTRKQTQYKAKEQKTKVNMAQNYENHEETQTFMTMDYDKNFYNYEEEELLMTTEVNVINPDKPKIKKEIILFDNGSQKSYITEECVQTLQLSTIEEKLLAISTFNQNKPKIIKSRLVKVGIKTLKGEIEYITLQTVEKITDVTKMVNKETVDVLGIKIPIANACPQILIGIDYYWHFM

SEQ ID NO: 124984 - protein, 71 aa, Heterodera glycines
  Coding regions on vcDNA: vcDNA=SeqID_51407; Strand=-; Position=1-217
KFEVDTINILLLKLCPTWSICLDENRHDSSLSDRSRPPTFPRPATLRASPISSPSRPLHPAEFDANFLSPR

SEQ ID NO: 124985 - protein, 118 aa, Heterodera glycines
  Coding regions on vcDNA: vcDNA=SeqID_51408; Strand=+; Position=1-357
MGLVTLILPDDEQLRNGEFDVLTWQSGADRTGSTVRRMGTAGQTGRAAGTAGQMGTAEWTGTTGRTSTAGRTAGQMGTAGKARSRVVAPILVVATKNLRRTLRGEGDGKGMKWARRAE

SEQ ID NO: 124986 - protein, 31 aa, Heterodera glycines
  Coding regions on vcDNA: vcDNA=SeqID_51409; Strand=+; Position=1-94
MAKEREGTRAGADREGTRTDREQRRPGAVKG

SEQ ID NO: 124987 - protein, 34 aa, Heterodera glycines
  Coding regions on vcDNA: vcDNA=SeqID_51410; Strand=-; Position=1-102
VGIKHHSPACLLFVPISILPKFLPGRICLCLVPT

SEQ ID NO: 124988 - protein, 73 aa, Heterodera glycines
  Coding regions on vcDNA: vcDNA=SeqID_51411; Strand=-; Position=1-324
IERRRGGTFPIKLRFFPFLMKLHHAYKIYHFHFISRDVSRDTPHSKVVGGFSCCKSACMLLFYFLCLIPGCLC

SEQ ID NO: 124989 - protein, 72 aa, Heterodera glycines
  Coding regions on vcDNA: vcDNA=SeqID_51412; Strand=+; Position=1 -11,73-271,1143-1151
MNRRWICSDVWMDILPSFDRPQLGLKMALLSYRFDALVDTHFDGKRTELTLWRPIAICKEKNIGLEARLCLH

SEQ ID NO: 124990 - protein, 37 aa, Heterodera glycines
  Coding regions on vcDNA: vcDNA=SeqID_51413; Strand=-; Position=1-110
LSALHHDDKEEFDAVNGNFVSANLRRIPVISKVIMFP

SEQ ID NO: 124991 - protein, 17 aa, Heterodera glycines
  Coding regions on vcDNA: vcDNA=SeqID_51414; Strand=-; Position=1-51
LGSPIIWKSIFFSWTVG

SEQ ID NO: 124992 - protein, 41 aa, Heterodera glycines
  Coding regions on vcDNA: vcDNA=SeqID_51415; Strand=-; Position=1 -45,112-192
MQCDTGEANTQVLKIMRELKFAVHKSAMYRLKTWDFTGYGH

SEQ ID NO: 124993 - protein, 43 aa, Heterodera glycines
  Coding regions on vcDNA: vcDNA=SeqID_51416; Strand=+; Position=1-133
ESDECGEFEEEYNGSSDAVFCSDEAQNAETQIKQQNPIEKIHN

SEQ ID NO: 124994 - protein, 171 aa, Heterodera glycines
  Coding regions on vcDNA: vcDNA=SeqID_51417; Strand=+; Position=1 -142,549-922
ANFCQQQQQHFPNPRDSSTPKSNSNGSSPSSITSNKPFSSSNCLGNKIYSTQSSSNTVVANGSGANRSTATTAAFVAEDSCCNQMRGELVARNSVAERAEKASSVYENVATGERREAAKPAAPREANYDANDGANDHNYEQQQQHGPPQNDQGGERREGPKGEIWYEFGCV

SEQ ID NO: 124995 - protein, 232 aa, Heterodera glycines
  Coding regions on vcDNA: vcDNA=SeqID_51418; Strand=-; Position=1-699
MKGCLLTSSLFVFLIIILISINYVGSEKKKLEKKSFDEIFGEKWEEKKNEEQKKREIIGKFYKIKEKIKQKGRKYSKREWEKIERKIAKKLGTNRRYIYEWIKELGLNQKNFYKSKTDEEKLEIILKFIEMKNEFKEKGRTYSKKEWNKNYEEICKKIGVGLFIIKKWKNQFGISRKITMEKEKTEKMKMYWQIKGEKPKMSDKEIGKMMKITSRTIAYWKKQFGKEYVMRN

SEQ ID NO: 124996 - protein, 128 aa, Heterodera glycines
  Coding regions on vcDNA: vcDNA=SeqID_51419; Strand=+; Position=1 -26,223-408,591-765
  Homolog annotation: Hit_ID=CAE61755.1; Match level="QueryCoverage =90%, HitCoverage=18%, E-value=2e-19, Identity=41%"; Hit description =Hypothetical protein CBG05711 [Caenorhabditis briggsae]
MALAQRHNRDRPSSSSRNKYANYSETDEDDEEDEDGGRYDEDEEYDSDLADFIDDSMVDDMQREDFEETLKIINPRYNKEKWLARERMIDDRRMDARFRDVEAEERHSSRLGLVEDLREAKRGSKALG

SEQ ID NO: 124997 - protein, 62 aa, Heterodera glycines
  Coding regions on vcDNA: vcDNA=SeqID_51420; Strand=+; Position=1-186
MAIKYGPKIAKYGHKMAKISKYGNKWQKCQNMDINFSKLSAKFLQIYWLKLHMRYISKFFDS

SEQ ID NO: 124998 - protein, 51 aa, Heterodera glycines
  Coding regions on vcDNA: vcDNA=SeqID_51421; Strand=-; Position=1-155
LQIYWLKLHMRYISKFFDSVRRFDKDGFRFAISRSTFGNWSRIFSAITCNH

SEQ ID NO: 124999 - protein, 61 aa, Heterodera glycines
  Coding regions on vcDNA: vcDNA=SeqID_51422; Strand=+; Position=1 -85,209-309
MQPLHDDESSDPKATPRQHLTTSMAKMRYSARTAGGSEAGNGVNEFTAYARKRTNELMYNE

SEQ ID NO: 125000 - protein, 233 aa, Heterodera glycines
  Coding regions on vcDNA: vcDNA=SeqID_51423; Strand=+; Position=1 -65,400-894,1310-1451
MPLFSRQIIWFSLLKMLCHPKRYFRSLFMVVFLLGVHLFALCAAIHNIRTALPVLAGWNLGAWVLNSATIFSGNLEFSPRFLTFLSPRIGEDLSIYKIVRGPKISKYSKNFSGWGESPENCQKNTPRGDPFVKLCEMQYLCNTVLFIGHTVTAYKLFLRQRLEPFLVRPCFSAVPTLHPSIIHCIQILWPWVTSFLCRKDLCPFSADKMASCHQRYTAPTRARLSHPPVVSRF

SEQ ID NO: 125001 - protein, 165 aa, Heterodera glycines
  Coding regions on vcDNA: vcDNA=SeqID_51424; Strand=+; Position=1 -126,548-658,982-1053,1399-1467,1843-1959
  Homolog annotation: Hit_ID=NP_503966.1; Match level="QueryCoverage =98%, HitCoverage=33%, E-value=1e-24, Identity=33%"; Hit description =CNT-like nucleoside transporter (63.5 kD) (5D941) [Caenorhabditis elegans]
TESAILIEPSIITMTASEIHCMMTAGFACIAGALFSAYIALGNCPIHLLSATLMNSAISLGISKLVYPEVEHSQHKEAEKMKFAERDNEETILECITASSIRTKILGFCFFPLAWAMGVSDAQNTEVMLDETMKVAELMGIKTALNEFIAYQRLAQMVTNGTLNG

SEQ ID NO: 125002 - protein, 77 aa, Heterodera glycines
  Coding regions on vcDNA: vcDNA=SeqID_51425; Strand=-; Position=1-233
MLVDSLRPATLSSSKKRSAHSMDDTDQFIGHSPPHKKQLMDEENDQILTQNTPNDSLDRRRPIAFATKAIHAGNRPE

SEQ ID NO: 125003 - protein, 92 aa, Heterodera glycines
  Coding regions on vcDNA: vcDNA=SeqID_51426; Strand=-; Position=1 -185,314-419
  Homolog annotation: Hit_ID=AAO33473.1; Match level="QueryCoverage =96%, HitCoverage=96%, E-value=1e-33, Identity=69%"; Hit description =gland-specific protein g4e02 [Heterodera glycines]
VMLLRPTVPFVSLSLFLLLFLFIAFPSTDGFGVERGGWPWDWIGKQACKTAANCKCKDGKSWAKCVKSEGYAASNCCDKNYVWACCGKKPKQ

SEQ ID NO: 125004 - protein, 206 aa, Heterodera glycines
  Coding regions on vcDNA: vcDNA=SeqID_51427; Strand=+; Position=1 -72,656-1203
  Homolog annotation: Hit_ID=CAB46679.1; Match level="QueryCoverage =74%, HitCoverage=17%, E-value=7e-09, Identity=27%"; Hit description =proteophosphoglycan [Leishmania major]
GRQTDKDRTQPRVGGRRPAFGDPQINSDRILPTEVYGSLAPSGGASAAAAVGGANGPTVPRPIAPGGSCLAAVTSSVSVVATTTACPSSTGAPPTCAAPSFPFLPSSSNGVTTSASATVIPRCLATTSVHNSIQIAQLNAMAAATTLANTAAASAASNNAAQQQQQRHQSTGGSADGTTNSAATASALNALNQLGLTSATEEQVEL

SEQ ID NO: 125005 - protein, 35 aa, Heterodera glycines
  Coding regions on vcDNA: vcDNA=SeqID_51428; Strand=-; Position=1-108
KAPTWHLEAWNSIPLDPIINLINSMPRRIEAVIKS

SEQ ID NO: 125006 - protein, 67 aa, Heterodera glycines
  Coding regions on vcDNA: vcDNA=SeqID_51429; Strand=+; Position=1 -22,379-544,596-611
MTIRRYSVCSIAQCVIIILPNFFQRPEEQKFILIIHFIINNLALLICKTIAVNYHQKNALEKRWFII

SEQ ID NO: 125007 - protein, 169 aa, Heterodera glycines
  Coding regions on vcDNA: vcDNA=SeqID_51430; Strand=-; Position=1 -41,112-259,316-636
MPTSAATDDHKFKHSASEKKATAQQQLEMKAVKKEEKEEEEEKVQKTAKERGKCQAANSPLMTEKKPIMAVKGISVLSGGTTPPAQKGGPSQSGGGRPLSADSDSESAKSSSMVGESRRNHHTVVGVVSPMQHQQETTLEGTVRANCTEEGGETAENDQPIGEKRHKGN

SEQ ID NO: 125008 - protein, 140 aa, Heterodera glycines
  misc_feature (1)..(1): Xaa can be any naturally occurring amino acid
  Coding regions on vcDNA: vcDNA=SeqID_51431; Strand=-; Position=1 -112,170-219,385-524,671-791
  Homolog annotation: Hit_ID=AAH87561.1; Match level="QueryCoverage =92%, HitCoverage=70%, E-value=8e-34, Identity=50%"; Hit description =Unknown (protein for MGC:97698) [Xenopus tropicalis]
XSECRPHALAYIRMGKYCIIGEGSIIRPPYKYFSKGFFTYFPVHFGDYVFIERGCVVVAAYVGSFVHIGQNSIVGQNCVVKDCCFIQPDSVLMPDTVVPPFSIVGGNPARVLAEWPPTCQSLMVDACAGFFDNFQPETTM

SEQ ID NO: 125009 - protein, 350 aa, Heterodera glycines
  Coding regions on vcDNA: vcDNA=SeqID_51432; Strand=-; Position=1 -219,272-381,430-528,1519-1588,1643-1780,1828-2023,2047-2267
LPFLMLPTIKWLNGPSDDCPSSKLFLLDSDSFSLFRVNDKPPGGSAAHLAGPSAFSVDPLVSSCSPLLQRQEQELVRTFSLDHTRDNRLAIGFTSGRISVVSANTQPGVKYLRGEDIREAQKGINCLDWNFNDSSRLCAAYESQLDPSQRKGLDIDGHSYGVHFYSLPGMSSLTSFDWHPTISDRLALLPVQEKPMAFAHSIASTKRIAIIKLRDDVNSVIGPSGDFCISAGPQLNFENGEKLLAKPNCTSDIDTETLFKRRVLAGYGYGNSLNALAIIICSKKALLEYSKKAIERDQFASDDLRFCWDWLWMQFQSADANEVQKNYGTMCEALFGCPQLIYFHFKVRWH

SEQ ID NO: 125010 - protein, 145 aa, Heterodera glycines
  Coding regions on vcDNA: vcDNA=SeqID_51433; Strand=+; Position=1 -193,244-358,484-644
  Homolog annotation: Hit_ID=NP_704833.1; Match level="QueryCoverage =62%, HitCoverage=41%, E-value=1e-10, Identity=35%"; Hit description =hypothetical protein [Plasmodium falciparum 3D7] emb|CAD51976.1| hypothetical protein, conserved [Plasmod
MFPNTNSLSNSPHSDSFNRNSTSKRWEETIAWVTHGKRLSRRILNPSKDFSDGALVAEIIAQHLPRYVLSLNSFPQVHSLALKKYNWETLERTVLRHLGIHISTEHIESLANAEEGTIQNFLPILRSQIDDAISKRHFRPSSTSS

SEQ ID NO: 125011 - protein, 284 aa, Heterodera glycines
  Coding regions on vcDNA: vcDNA=SeqID_51434; Strand=-; Position=1 -318,398-557,628-782,827-1046
  Homolog annotation: Hit_ID=NP_508998.1; Match level="QueryCoverage =97%, HitCoverage=35%, E-value=7e-33, Identity=33%"; Hit description =putative protein of bilaterial origin (XG587) [Caenorhabditis elegans] pir||T16700 hypothetical protein R
ESLGCSVASSANLQLRSRLLDAALAMHNALGVKGASLCLRFPKFSPPPRSLTAFCVQTLAVSTTCRSFLNPARLCWSPSDSSPKAKATRCKAWPCDGCAWRSFSAVFLSRELLPLLNFYECSLVPLEPGLYVAYLRLHSSLNSIHVLVPDNLISSLPFANVRSNSHVTREEWALLKSLAEADDENGVPLVMEKALPEQRSFYEQLSKASSRLVNHLELDSDQILGTRLFRHRLVQLNKYVSLILVMPRAEEVCQVNACAKGADNGSAVATFRGCVSVPVPVFQM

SEQ ID NO: 125012 - protein, 95 aa, Heterodera glycines; identical to SEQ ID NO: 124528
  Coding regions on vcDNA: vcDNA=SeqID_51435; Strand=-; Position=1-828

SEQ ID NO: 125013 - protein, 142 aa, Heterodera glycines
  Coding regions on vcDNA: vcDNA=SeqID_51436; Strand=-; Position=1-428
METSLFSSSSCSAAVEDDQQQQQPPAADQQPTLAPDFATTADQQQQHPPLTMAQALIGGFQPAVSSAADAADHHHINELTLPPHQLALSSSPATITSSSLIMAPDFGADQSAEQQRQVGATAATMANGNCSAAIGSEMAAQN

SEQ ID NO: 125014 - protein, 99 aa, Heterodera glycines
  Coding regions on vcDNA: vcDNA=SeqID_51437; Strand=+; Position=1 -132,192-259,537-636
MRDARCAAAVFFCARSSPALHANYRLQQFVSWKAKATESWLAIAEVASDSEIFDALFKITFYAEVKRWPNGLEVYKFRHEMATMGWSLQIKQLDVDEWR

SEQ ID NO: 125015 - protein, 42 aa, Heterodera glycines
  Coding regions on vcDNA: vcDNA=SeqID_51438; Strand=+; Position=1-211
MRIERARFDEVLVSQKKIQTFFIKNLKMRIHARFSGNKLNMA

SEQ ID NO: 125016 - protein, 118 aa, Heterodera glycines
  misc_feature (60)..(60): Xaa can be any naturally occurring amino acid
  misc_feature (69)..(69): Xaa can be any naturally occurring amino acid
  Coding regions on vcDNA: vcDNA=SeqID_51439; Strand=+; Position=1-356
  Homolog annotation: Hit_ID=XP_483167.1; Match level="QueryCoverage =100%, HitCoverage=48%, E-value=2e-35, Identity=65%"; Hit description= putative caffeoyl-CoA O-methyltransferase 1 [Oryza sativa (japonica cultivar-group)] ref|XP_507591.1| PR
DREYYEIGRPFFEKAGVAHKVDFREGPAVDHVDKLLVDEANVWAFDFAIGDAVKPKYVKXHEQMLRLVXVGGTIVYDDTLVVSTVVMAPDTPMSDLDRRFSGVIRDLIVRLSAEERIE

SEQ ID NO: 125017 - protein, 80 aa, Heterodera glycines
  Coding regions on vcDNA: vcDNA=SeqID_51440; Strand=+; Position=1 -115,326-453
MSIYGLNHVSIHGLNHVTIYGLNHVSIHGHDLRVNLRSFIIHVSIYGLKHVSIQLIIHMSIYGLNHVSIHGHDLLVNSRA

SEQ ID NO: 125018 - protein, 103 aa, Heterodera glycines
  Coding regions on vcDNA: vcDNA=SeqID_51441; Strand=-; Position=1 -25,193-331,900-1046
MPNECSGEWLMEVAVEIEVKETTENEGTDEANGTANSKPKMAQEKPKRQQGEEEEIALLEASLLERNERLKEMLKENVFMRAQFKKVQNEFGMQTLNEVFNRR

SEQ ID NO: 125019 - protein, 467 aa, Heterodera glycines
  misc_feature (89)..(89): Xaa can be any naturally occurring amino acid
  Coding regions on vcDNA: vcDNA=SeqID_51442; Strand=+; Position=1 -54,116-178,229-385,505-880,1354-1456,1510-1552,1597-1714,1992 -2065,2115-2263,2316-2385
  Homolog annotation: Hit_ID=NP_508706.2; Match level="QueryCoverage =100%, HitCoverage=100%, E-value=3e-75, Identity=38%"; Hit description=protein adaptor (44.2 kD) (XE768) [Caenorhabditis elegans] gb|AAL11482.2| Temporarily assigned gene nam
MSDEFVVAKFDYEAQEERELSVTELSVTKNERLKLLDDTNPWWKAMNARGQIAMNARGQIGFVPSNYMQKESIGERRKRTKSLEEMKSXGEKDKENLRSANHLSKAPFRRRRSVRLRPPKGSFFPNLNSLGQIGPFAICPFKDDELALRRGVRLRVLDKSADGWWKGEEEGAGARRGWFPSNYVREQPATTNCRNSAKTERQKSTATAEAPQTQHSPDRVLEVSAGNFQIVLCLYSFEAQNPQELSFVKHERLDILEHPVDDPEWWMARNQYGQTGVDDPEWWMARNQYGQTGLVPTNYIEVVDLVPTNYIEVVDQNPNRGAFDSPGVSAAPPSVPPLPFRPWYYGHITREQSDTLLKTRGVEGDFLVRDSESKPGDFSISLKDSVRDSESKPGDFSISLKDSAKNKHFWVQSASAQFIIGNRRFESMEKLILNYMSSPIFSDGNYMSSPIFSDGIVNLFLRKPLPK

SEQ ID NO: 125020 - protein, 83 aa, Heterodera glycines
  Coding regions on vcDNA: vcDNA=SeqID_51443; Strand=-; Position=1 -123,1322-1450
MLLALDTYMPKFSRRNLHHFAQMIVIFCFIVLTVLVLLKYEGVDLDAVILDEESAEGEEAKKSWTRENQKGQNSEGEMFLRKA

SEQ ID NO: 125021 - protein, 101 aa, Heterodera glycines
  Coding regions on vcDNA: vcDNA=SeqID_51444; Strand=+; Position=1 -129,281-343,400-513
MEEGTVKIWDTVEDTVEDTVEDTVEDTVAVAIISVRLAKRRTELVMASNSFAWIPKRTVTTAFVANLPKTPAFTAVRWALSPMALAAAASNFGAPTHEKHA

SEQ ID NO: 125022 - protein, 126 aa, Heterodera glycines
  Coding regions on vcDNA: vcDNA=SeqID_51445; Strand=-; Position=1-379
  Homolog annotation: Hit_ID=NP_704526.1; Match level="QueryCoverage =92%, HitCoverage=4%, E-value=1e-10, Identity=37%"; Hit description =hypothetical protein [Plasmodium falciparum 3D7] emb|CAD51345.1| hypothetical protein [Plasmodium falcipar
IFLKRSAREQQQQQHKSVWRLRYGRNIALREHTERIRYRHRNERIWYGNNALRNERLRYGNNERLRYGNNERLRYGNNERLWYGNNALRNERLRYGNNERLWYGNNALRNERLRYGNNERLWYGNN

SEQ ID NO: 125023 - protein, 96 aa, Heterodera glycines
  Coding regions on vcDNA: vcDNA=SeqID_51446; Strand=+; Position=1-290
  Homolog annotation: Hit_ID=XP_527575.1; Match level="QueryCoverage =95%, HitCoverage=65%, E-value=3e-13, Identity=49%"; Hit description =PREDICTED: similar to ENSANGP00000017902 [Pan troglodytes]
MNGYGMGTMPYGMNGYGMGTMNGYGMGTMNGYGMGTMNGYGTGTMPYGMNGYGMGTMNGYGTGTMPYGMNGYGMETMNGYGTGTMPYGMNGYGMGG

SEQ ID NO: 125024 - protein, 81 aa, Heterodera glycines
  Coding regions on vcDNA: vcDNA=SeqID_51447; Strand=+; Position=1 -146,580-680
  Homolog annotation: Hit_ID=NP_502746.1; Match level="QueryCoverage =45%, HitCoverage=5%, E-value=4e-13, Identity=81%"; Hit description =putative protein family member, with at least 3 transmembrane domains (82.6 kD) (4P163) [Caenorhabditis el
IHLFSFCYGNTKWGRRTVPTNSAPLAVHVSAVVGNCNHCGTVGTVDTQDGRTEHHHGLWLDCKRDFSYDYGRPREYYETLH

SEQ ID NO: 125025 - protein, 183 aa, Heterodera glycines
  Coding regions on vcDNA: vcDNA=SeqID_51448; Strand=-; Position=1 -83,133-323,374-651
  Homolog annotation: Hit_ID=CAI11732.1; Match level="QueryCoverage =91%, HitCoverage=23%, E-value=1e-20, Identity=36%"; Hit description =polyA polymerase alpha [Danio rerio]
MATQICVLFPNAPLSFLLFQFFAIYSKWDWANEPIKLAQLAPATLNKNVRNWRPFLGRSSMTVITPTFPQQNATFNVNKFTLRKIVEELENANEILAENPQNWSKVFEEIKIEEKYRHFAVIVCSAVDYKRYSTNCAFQKSKIRQKLFEWANLEKNSSQLDNYHLMPQFEQKTKCKMLPKCAH

SEQ ID NO: 125026 - protein, 98 aa, Heterodera glycines
  Coding regions on vcDNA: vcDNA=SeqID_51449; Strand=+; Position=1 -3,171-464
MAEDALLSEFVKGLATNFDKFLRLFLFEKFQKNYWQKYAAHFGVVYLMKKYWQCDENILNGSDEECQFYGKYLHILYEYLFRLNLEGLFFHYFRKNCH

SEQ ID NO: 125027 - protein, 62 aa, Heterodera glycines
  Coding regions on vcDNA: vcDNA=SeqID_51450; Strand=+; Position=1 -110,309-387
MAQLMPMIPQKWRRPVPWTSKIWHQENRQANRDAISLNSLIASLQRSLNPKDRECDYKNESC

SEQ ID NO: 125028 - protein, 132 aa, Heterodera glycines
  Coding regions on vcDNA: vcDNA=SeqID_51451; Strand=-; Position=1 -150,284-530
MPINELILQLAIDTANEWQTNESAERIIQENFDKNLKEMLKKRKSRQLRTIDDCLFTEFVIGKTTSIDKFFKNDEEDSESKVAHIGILYLMKMNWQCDKIDGKFDEYEQRECQKYRRYFDILYEYLSRIYVE

SEQ ID NO: 125029 - protein, 165 aa, Heterodera glycines
  Coding regions on vcDNA: vcDNA=SeqID_51452; Strand=-; Position=1 -174,238-561
MTTEEVYNTNHILNEPKQHILNGDCGVSTSTAVKSQQINEMTSKDYYFDSYAHFGIHEQTPGNVERRSSDSDLSERNLPQPSPLQEQSGDGRRFRDGYSFDVCCSRRGKESFCGTLLINGRHINDEFWPCSGWNTRKMATQSKKIIKDNQMDGVIEVIHSKIGGH

SEQ ID NO: 125030 - protein, 44 aa, Heterodera glycines
  Coding regions on vcDNA: vcDNA=SeqID_51453; Strand=+; Position=1 -94,288-328
MKPALLLIFIFLVFYFQIYSANSTECGGIPTDLLAKMVNPRTNV

SEQ ID NO: 125031 - protein, 19 aa, Heterodera glycines
  Coding regions on vcDNA: vcDNA=SeqID_51454; Strand=-; Position=1-3,94- 150
MNFKLIGEKRMVRSRFNEK

SEQ ID NO: 125032 - protein, 15 aa, Heterodera glycines
  Coding regions on vcDNA: vcDNA=SeqID_51455; Strand=+; Position=1 -3,995-1039
MNLGPYKLAFNVLIK

SEQ ID NO: 125033 - protein, 103 aa, Heterodera glycines
  Coding regions on vcDNA: vcDNA=SeqID_51456; Strand=+; Position=1-312
LKCQHIHCYKKWPGHKFDTFMHVTVAEQQKQQHSPKLCAASEHGTNKSHCFCPPLTDLDSLHKMLRVKGARRVTVQPWLAVNGETENNTNNSNNRVSGTIAAV

SEQ ID NO: 125034 - protein, 377 aa, Heterodera glycines
  Coding regions on vcDNA: vcDNA=SeqID_51457; Strand=-; Position=1-1131
  Homolog annotation: Hit_ID=XP_320889.1; Match level="QueryCoverage =82%, HitCoverage=38%, E-value=2e-99, Identity=55%"; Hit description =ENSANGP00000012033 [Anopheles gambiae] ref|XP_313651.1| ENSANGP00000013044 [Anopheles gambiae] ref|XP_314
MIDNFLLVKPPNKSINNVSLLKAVLQKDFPEVFEEGLGHCSKAKAHLILRSDAKPIFCRARPIPHGAMEAVNAELDRLLQIGAIKPIDFSHWAAPILAVKKKNGKTRVCIDFSTGLNNALELNRHPLPRPDDIYASLNGAKFFSNLDLRDAYLQMEMDDKSKQLCAINTHRGLFQCQRLPFGVKSAPAIFQHLMDQICAGIPGVFAYLDDGLIATKTLDQHITALYTLFGRIKEYGLRIQLDKCKFLQPELLFLGHIVSANGIRPDPSRSDAIRKMPAPIDKSTLRSFLGALNYYGRFVKCMRELRAPLDKLLQKDVVWNWTSEQQNAFEKAKETMTSDLLLTHYDPARPIVVSADASKDGIGATLSHTFPDKKEKV

SEQ ID NO: 125035 - protein, 685 aa, Heterodera glycines
  Coding regions on vcDNA: vcDNA=SeqID_51458; Strand=-; Position=1 -623,2756-3227,3584-3791,3838-4398,4448-4641
  Homolog annotation: Hit_ID=NP_507780.1; Match level="QueryCoverage =31%, HitCoverage=16%, E-value=8e-10, Identity=24%"; Hit description =predicted CDS, DNA polymerase type B, organellar and viral family member (5T899) [Caenorhabditis elegans]
DDDSVYVEKPTIQCQKIWQKKFQVIAFLRSNQQIFDKRGTYLYLWIPSPHNTDGQPIWDVFVSEIWPIFSTNIHHLDFYNGDHLDHLLRRTSPTIFTDLNQLVSINSVDLLPDAIDDFDVPNATAGQALSKWLHSPRKDGQPKRLHCFDHNEQGNTNWVNNFKEVWSGREQDIVQMITMGKAQVMNIFQKNWPDFANKNIPNPLAIRGTILLKKWKIINCWITNRQLAKKFGFTKNITEFRVNPDGGRPDEAMREAIDDMIKVAFKTTEEKMKRKVRMFGVAITGAGLAFPVWVPYRAYPQNNADVIMEEINKLGQSGDGDENKKMLLLSEPITIKITCVTMPSGEGPRNVHKFDFGFKEHQRIGIVNTDKFCLFYALTSSMNYLIMDRFAFNRFMKNIVRQRDAAIELLRNCGIDINEYSYGVEHLPNVQNYWDEIYPGKYRVVAFEKSADPRKSIRVLWKGPMGRENVVPIFLENNHWDGLKKYVCFFNRGRKFCVECECFYDQDVYHTFECRARCYYCNRVGGMPCEKESGVKIECPKCHRYFYNWGCYNYHQGHQTCKLWRRCVICDKTYLFNPKKDHECGETYCQLCSVSHDPKRGCYIMPIEENEEKDVYRIVVWDSETSQDTIYKGDQKEHVINYISVRVTCTECCDDKHRTNCKICGEERTKDWSEAEGHDPTKDFV

SEQ ID NO: 125036 - protein, 109 aa, Heterodera glycines
  Coding regions on vcDNA: vcDNA=SeqID_51459; Strand=-; Position=1-497
INRFFYFINIFSESALKRTKFYLQVNFSTLMLYYQKGRWRKNFLKIFPYILVISFCFWWGAWNSGIMRTRPIWQVKQRLLTSQKVRCRDETNQHCLPRGTRHGPPKEWI

SEQ ID NO: 125037 - protein, 74 aa, Heterodera glycines
  Coding regions on vcDNA: vcDNA=SeqID_51460; Strand=+; Position=1 -63,1155-1316
MLLKLPIFLYSSRQFFRAVAFAFDMAKGTELASVYRSGYLVIGLSTLISLLIVANSKHLTKEQFQQKYKKEANK

SEQ ID NO: 125038 - protein, 148 aa, Heterodera glycines
  Coding regions on vcDNA: vcDNA=SeqID_51461; Strand=+; Position=1 -195,631-747,1176-1310
MVAEGLPADDGDYNNSFMDTSEDSRDGVGGGGGGHAAMVPMDAAADLLMMSNGGGQHATNGNMLLFERYRNLLEFGHHISQFALKTDAEEGPCQGSAPLRQRMNEAFSLLCYPDPTQSAHANLFDQIQRDLVAKALNAAILGIFFLPS

SEQ ID NO: 125039 - protein, 91 aa, Heterodera glycines
  Coding regions on vcDNA: vcDNA=SeqID_51462; Strand=-; Position=1 -52,166-389
MSSFTTSSSADEFSPLQPIFPNLSTSEEMSVLIARIAELNRAKTTEPSVASSEVFGQDGYGREFCIIEWIQYENYTIKEMVLKFLKSKKLF

SEQ ID NO: 125040 - protein, 59 aa, Heterodera glycines
  Coding regions on vcDNA: vcDNA=SeqID_51463; Strand=+; Position=1-178
HKAEGVCSSQSAPLVSISFTHSSGQNRNCIEIAEHNLTSKQTIGTGKMKRNASIRLNAN

SEQ ID NO: 125041 - protein, 75 aa, Heterodera glycines
  Coding regions on vcDNA: vcDNA=SeqID_51464; Strand=-; Position=1 -75,390-455,622-708
  Homolog annotation: Hit_ID=NP_741410.1; Match level="QueryCoverage =65%, HitCoverage=10%, E-value=2e-11, Identity=52%"; Hit description =lin-12 And Glp-1 transcriptional regulator, suppressor of hairless homolog., Lin-12 And Glp-1 phenotype L
MPDRTGLVFSKMTGFRILSHNPVNPDYSAAKALHISDTDKRKYFHLNIISKPSKKKQSMKSSDCKYLCVGNKSKA

SEQ ID NO: 125042 - protein, 122 aa, Heterodera glycines
  Coding regions on vcDNA: vcDNA=SeqID_51465; Strand=-; Position=1 -54,226-540
MTNSSGLRTSAMLRPKITQNFQNAVADQQQHQAAAPSAFKVENAVGHDNQEQQQKAAEHLESKFVASGTKSKLMNTDARKNVHEQQQQQAVGQQAVQQRTDELRQHLEQPSTSAIEGSSWTM

SEQ ID NO: 125043 - protein, 39 aa, Heterodera glycines
  Coding regions on vcDNA: vcDNA=SeqID_51466; Strand=-; Position=1 -89,496-526
MASEEQFCSEFDAEVARGDGKRPLRRIVISLKPNSKFKK

SEQ ID NO: 125044 - protein, 157 aa, Heterodera glycines
  Coding regions on vcDNA: vcDNA=SeqID_51467; Strand=-; Position=1 -78,1207-1323,1377-1488,1716-1882
MTKRGQTEQDDVVVVTKTNDDRIGRSDSGMSSRDLHSVDSDSYVKGMHEEGLSERVRNICVQSEKPPHSMPQMPTPTANRRPTTFSLPRIFTQKKKDVIPLAVPHLPSAADTVPAPVTSSSVDEHQQQPQLSPGTTTTTTSAYNTGVDTGQDHRQPH

SEQ ID NO: 125045 - protein, 122 aa, Heterodera glycines
  Coding regions on vcDNA: vcDNA=SeqID_51468; Strand=+; Position=1 -54,148-186,364-639
MSKIHISGLANPLPNVSLDIVVLPLLVQCLKRFYNFYNCKVFRIKKIVFRPLSPPSSTIAVSASETVPPIPSILVIELNNNNNHNDDVIEYDQLRLNDIPSTLIGHISSHSQPMPTIFGDFF

SEQ ID NO: 125046 - protein, 271 aa, Heterodera glycines
  Coding regions on vcDNA: vcDNA=SeqID_51469; Strand=-; Position=1 -430,512-894
MSSTQCLIKFCKVEQSKAKYVNLYGAPFVVTVTVLNTDGLPRRRTTKGNAPPIHSSQSHIFKINNNDNYCLFYALELMRYYSLYKRGIITRNKWRWTNNNQTTVLQQKVQLLLRDAGIPTTEPEYDAEIYIHQVQGLWSTKYPGEYKIFIFNDYQTRPITKSDVTDYQFPILLYHHDKHFDGIKTLSKFFNKNYYCLSCESVYERKSRHSMNCTSLCHGCREVGVDYPCEAQQGYFKKCLHCKNNFYNKDCYERHLHKDLCSKFQRCEECG

SEQ ID NO: 125047 - protein, 235 aa, Heterodera glycines
  Coding regions on vcDNA: vcDNA=SeqID_51470; Strand=+; Position=1 -109,176-231,1068-1422,1497-1682
MRPWTFGLVKPDGVANPIAVRWLLSAMHCEGFVITNGCRLTLTPDLAGELYSSHQDAFYYGRLIRHICSGPSVAMRMELRKLNPAQNAFDEDDEEGDELHGFSSSSSAFHRSATECQENAKKFDPLEAINRWRTLLGPSKLFANIYLSSCAEFDEIKCKNLRQMFAVSDTRNLCHGSDSLDSLCREFSLFEVDMKPVERPEIELFALDDYTLTEADYQTDNNRRNQDEEEEEEKG

SEQ ID NO: 125048 - protein, 19 aa, Heterodera glycines
  Coding regions on vcDNA: vcDNA=SeqID_51471; Strand=+; Position=1-57
MMMLLTCSSRSAFSPLQSF

SEQ ID NO: 125049 - protein, 22 aa, Heterodera glycines
  Coding regions on vcDNA: vcDNA=SeqID_51472; Strand=-; Position=1-67
GCWFESVVQHEYFYLFLSKKLK

SEQ ID NO: 125050 - protein, 487 aa, Heterodera glycines
  misc_feature (246)..(246): Xaa can be any naturally occurring amino acid
  misc_feature (485)..(485): Xaa can be any naturally occurring amino acid
  Coding regions on vcDNA: vcDNA=SeqID_51473; Strand=+; Position=1-1483
  Homolog annotation: Hit_ID=NP_498506.1; Match level="QueryCoverage =86%, HitCoverage=72%, E-value=7e-71, Identity=37%"; Hit description =RNA-directed DNA polymerase family member (3I9) [Caenorhabditis elegans] gb|AAA21080.1| Hypothetical prot
EVTKQKLDIDGLPYILIKQCADLLAPIISELFRIILDYGEIPNLWRTSFIIPIYKKGDKSNPNNYRPISLTCTLCRVFERLLAWNIVKHLEKNKILTDEQFGFLKSRSTTTQLLVSLDYFYKSIENGQNIDIIFIDFEKAFDSVPINLLIVKLQNIGICGKILKFLQNFLICRSYQVKIGENFSSFRTYSGVPQGSVLGPLLFLVFINDLLIIYQLQSELNYADDVKIYISHDNDISLALANLAKXTKDNGIAIAHEKCAALYLGKNNSRHEYKIGEKVILSVDCVRDLGVLVDQKLSFNNHISKILKAAYYKAYQILKILKTRNINTLILAYKSYIRPHLEYASEVWNISLKEQSKRMETVQKFFTRIVYKKCGLKAASYEKRLEICKLEKLSNRRSLTDMNMTFKIIRGLTHLDPKKYFEFSTRSQRKTFRIQNKRFSNKSRNNFFIRTINPWNCLPKTAIEIGTLAKFKNFVKEFYLENKSXVV

SEQ ID NO: 125051 - protein, 203 aa, Heterodera glycines
  Coding regions on vcDNA: vcDNA=SeqID_51474; Strand=+; Position=1 -63,158-706
MVSSHLFCIGNFMVVFLVMFLNNGGKPEIKLNSFWFGSFLLSNQNNCGNPEIKLNMVSSHLFCIGNFMVVFLVMFLVLSFLLSNHNNGGKPEIKLNCFWFRSFLLSNQNNCGKPEIKLNSFWFGSFLLSNQNNCGKPEIKLNMVSSHLFCIGNFMVVFLVMFLVLSFLLSNHNNGGKPEINEQFLVRLISLLTRTTVENQKLY

SEQ ID NO: 125052 - protein, 109 aa, Heterodera glycines
  Coding regions on vcDNA: vcDNA=SeqID_51475; Strand=-; Position=1 -123,538-744
MPMESSSNRREEFLEIELKKVREELAEYKRREMCAITTPKKKGILKKKPSAEYRPYVFDNFHPKHRRNKAEPTSSSTAALDIFDGQQDNANPTTTTLGSYYDGGLLLNL

SEQ ID NO: 125053 - protein, 63 aa, Heterodera glycines
  Coding regions on vcDNA: vcDNA=SeqID_51476; Strand=-; Position=1-284
GSGRINPANPAILQILHLKSAGSCAGLRILGNFKKFCINKKVFQSIAKYSNIFLNQKMMKMKN

SEQ ID NO: 125054 - protein, 21 aa, Heterodera glycines
  Coding regions on vcDNA: vcDNA=SeqID_51477; Strand=+; Position=1-62
LKSFAIKLEKIIHDNFQARRT

SEQ ID NO: 125055 - protein, 19 aa, Heterodera glycines
  Coding regions on vcDNA: vcDNA=SeqID_51478; Strand=+; Position=1-58
FSNFVGLGRALRDRFLNLF

SEQ ID NO: 125056 - protein, 268 aa, Heterodera glycines
  Coding regions on vcDNA: vcDNA=SeqID_51479; Strand=+; Position=1 -432,680-881,1178-1350
MEINFVIIFILFLIVLIDGIDEDLFNDLWKNLKPSTSKNIKKPIFGEINAIKEEKVVKNENDEQGNANQIEMEDIKPKLLQNIKKEKTLEEQNNNLKIKIKMPKIEMDKLGEESFENEFNEEADQNVSSADHNDSVDQAYYNIMKKLGQLRERMEESEETKMELTRKFDKMRKEKICGFKYDEKKISVIECEIAKKLGTNRNKIYQWKRKFGKSKIYSDAEKLEYVKRSKEIAERNSMLSERKIAEKLGISNDNLRRWKMKFGTKSIR

SEQ ID NO: 125057 - protein, 294 aa, Heterodera glycines
  Coding regions on vcDNA: vcDNA=SeqID_51480; Strand=+; Position=1 -435,531-894,1179-1262
  Homolog annotation: Hit_ID=NP_701342.1; Match level="QueryCoverage =91%, HitCoverage=13%, E-value=1e-10, Identity=25%"; Hit description =MAEBL, putative [Plasmodium falciparum 3D7] gb|AAL10509.1| erythrocyte binding protein 1 [Plasmodium falc
MPQINFVIILFIFLFVLIDGIDEDLFDDLWKNQKPSTSKNFKKQKFGEINAIKEEIIVKDEKYEQQNANKIEIEDTKPKELQKIKKEKTLVEQNNNLNRKIKMPKIEMEQLEEESYENEFDEQADQNVSSTDQSNSGNDEDYNNMNTEEINEMQIVNEFNLRNNKLRKENVYNKRTNTQFECEIAKKFDTNPDTIYKLKKELGQKRVKTEESEETKMELIRKFDKMRKEKICGFKYDEKKRSVIEREIANELGIKRNKIYNLKKEFGEKKRYSDAEKLEYVKRSEKMKIRNPMI

SEQ ID NO: 125058 - protein, 171 aa, Heterodera glycines
  Coding regions on vcDNA: vcDNA=SeqID_51481; Strand=+; Position=1 -343,628-800
MQIVNEFNLRNNELRKENVYNKRTNTQFEREIAKKLDTNRNKIYKLKKKLGQKRVKTEESEETKMELIRKFDKMRKEKICGFNYDNNKRSVIEREIANELGTNRKKLYKWKREFGEKKRYSDAEKLEYVKRSEKMKTRNPIISERKIAEKFGIDRLSLRRWTKKLGTKSIH

SEQ ID NO: 125059 - protein, 195 aa, Heterodera glycines
  Coding regions on vcDNA: vcDNA=SeqID_51482; Strand=+; Position=1 -367,425-645
MPQPLPLRDMPQIHHPPRNVTSIWIKLWLLFLSLWVFLQGIHVRQIQREYAVPQFADPPPNVPYHPPENVPVMLGLVFLAFLIFPDAFSGNSTNATTAAAERRATIRPPAAKRAVSSTRKRSGNSTSATTAAAERRATIRPPAAKRTGNFIPCLTPNTETSFLKQMHANPPRVMEAIRRLGEWRGRPTDPRRPPQ

SEQ ID NO: 125060 - protein, 177 aa, Heterodera glycines
  misc_feature (3)..(4): Xaa can be any naturally occurring amino acid
  Coding regions on vcDNA: vcDNA=SeqID_51483; Strand=-; Position=1 -130,202-291,418-480,528-557,621-766
  Homolog annotation: Hit_ID=NP_509897.1; Match level="QueryCoverage =93%, HitCoverage=12%, E-value=2e-44, Identity=59%"; Hit description =guanylyl cyclase (gcy-9) [Caenorhabditis elegans] emb|CAA91488.1| Hypothetical protein ZK455.2 [Caenorhab
KSXXIEFLFVKIGDAYMIVSGVPRENGNSHVQHIGDIALKMRSFVTNFKVFVTNFKVAHRPDDIMMVRIGFHSGSVAAGVVGLAAPRYCLFGDTVNMASRMESSGVANKIQESSGVANKIQISESSSNLISESSSNLLKCFYHHFIVMERGKIDIKALIDETICKILIYLLRAKASA

SEQ ID NO: 125061 - protein, 254 aa, Heterodera glycines
  Coding regions on vcDNA: vcDNA=SeqID_51484; Strand=-; Position=1 -105,301-371,498-613,667-801,875-972,1239-1444,1917-1935
  Homolog annotation: Hit_ID=NP_509897.1; Match level="QueryCoverage =96%, HitCoverage=22%, E-value=3e-90, Identity=65%"; Hit description =guanylyl cyclase (gcy-9) [Caenorhabditis elegans] emb|CAA91488.1| Hypothetical protein ZK455.2 [Caenorhab
HFFCQGYMQQAPEIIREFIFTKNLPQGCQAADMYSLGMVLYQILFKLEPFFERNLPPSKILQKIALASEDDQIIRPSFPNQHSEEAYNLQLLSALEACWLELALEACWLELPEMRPNIKRVKAIVNANLKSTGSGSLVDQMMKMMEDYTTNLEQLVKERTVLLEEAQQQADRLLKNMLPASVADDLKAGRSVPPLLYLGATVLFSDIRGFTRMASSSTPLQVVNFLNDLFSGFDAIIAKHDAYKVETVGLAYNL

SEQ ID NO: 125062 - protein, 92 aa, Heterodera glycines
  Coding regions on vcDNA: vcDNA=SeqID_51485; Strand=-; Position=1 -115,381-881
WRQRVWCSFGECFLAPNKLSMFVLIIFFYNFLFDYLHFKHSRGIIFNPLNPTKRILGSRCSLASIHPPPQQQHWSRSNPSFLYFLLVNPQKT

SEQ ID NO: 125063 - protein, 72 aa, Heterodera glycines
  Coding regions on vcDNA: vcDNA=SeqID_51486; Strand=+; Position=1 -83,557-692
  Homolog annotation: Hit_ID=XP_422386.1; Match level="QueryCoverage =95%, HitCoverage=20%, E-value=6e-13, Identity=50%"; Hit description =PREDICTED: similar to DnaJ (Hsp40) homolog, subfamily B, member 4; DnaJ-like heat shock protein 40 [Gallu
MSIKVPTLEGDIIPLNIKHVTKPGSTQRIHDRGIPNPKTGKRGDLVVEFDVRFPDSIAPAARELIANALPPN

SEQ ID NO: 125064 - protein, 43 aa, Heterodera glycines
  Coding regions on vcDNA: vcDNA=SeqID_51487; Strand=+; Position=1-131
TEINLPIDASSRLGNLNRSKTTSSGLSWRKAEFGEVIKTVAYL

SEQ ID NO: 125065 - protein, 58 aa, Heterodera glycines
  Coding regions on vcDNA: vcDNA=SeqID_51488; Strand=+; Position=1 -106,160-228
  Homolog annotation: Hit_ID=NP_497055.1; Match level="QueryCoverage =94%, HitCoverage=4%, E-value=7e-12, Identity=56%"; Hit description =glutaminase family member (2P6) [Caenorhabditis elegans]
CVHPCIALITRAIRNQLIIPNWTEFTGKVRELFEECRAETGGQVATYIPQLARADPEK

SEQ ID NO: 125066 - protein, 142 aa, Heterodera glycines
  Coding regions on vcDNA: vcDNA=SeqID_51489; Strand=+; Position=1 -279,334-483
MCLIVVSVDHRPAQQTPAGPLAVTNCVLRTGDGHRVEASGWQAHAGTLAALCVGSAYWFTNCLARAKYQRLDCWFRIGVGGPNALVVPHVAPEFPANVPPMLPVQIGAGRDAVRVLPNVTNAGDEQRADAELDNNNNNNVRK

SEQ ID NO: 125067 - protein, 686 aa, Heterodera glycines
  Coding regions on vcDNA: vcDNA=SeqID_51490; Strand=-; Position=1 -683,780-2165
  Homolog annotation: Hit_ID=NP_493834.1; Match level="QueryCoverage =98%, HitCoverage=50%, E-value=1e-116, Identity=35%"; Hit description= putative endoplasmic reticulum protein of ancient origin (2B142) [Caenorhabditis elegans] gb|AAF60594.1|
GIREKNDHDEKEFMARYVCRREAVWRIFELHMYDRSHSIMSLPVHLQGEQICYFDENMEEEEIRERLANGSELMAYFELNKTNALAKTLLYHQIPEKFCFKKGKWTERKTHFNTIGRMVKVSPAEPERYHLRLLLLNVRGACSYDHLKIVIDLNGTVKDCESFSAACLERGLIRNDEEWKRALEEAETFEMPWKLREFFALILVHCNPAKPEELWNVFKDALSEDLTMEQINVEDDVEQVFDLAEELDLGQRSYAMMYDEQRKVTDDVMRRIWNPVNEPAFYFLSGPGGTGKTHVNNTIVHMLRGQKKKVCTMAFTGIAATLLPTGRTLHNRFGLTLDMSNSSIGPRSKALQELKETDLFICDEAPMINKRALRTLDEKLREIMNNGIAFGGKVMLWTGDFRQTHPIQKRSTRAELVNSTIKRSEYWRLAKRYRLTKNMRALASEQEFARDLLEIRCGNLNNENDELILPENCICNGDLSEEIFGSIVSENWNEMAKSAILAPNNVDVSEMNNRVLDMLPGEEVVYTSIDIAQDENRQRVDEYLDEYLNALNPSGFPRHKLRLKKNAIVLLMRNLNIDMGLCNGSRMKVEEMQPNLVVCKILTGDKAGQVVYIPRITFCCSEEYPFDLHRHQFPLVLAFAMTINKAQGQTLEHVGVDLRKEVFSHGQLYVALSRARAWNKLRIRLD

SEQ ID NO: 125068 - protein, 91 aa, Heterodera glycines
  Coding regions on vcDNA: vcDNA=SeqID_51491; Strand=+; Position=1 -83,516-645,713-775
MRSLMFGLMYKSECAFFTYHNQYYDSFKIPGNEKFRTYIIRDNGGEALFPVDTWNHHQSVIDNMCRTNNAQEAFHLNLRRKFHTMHPALSK

SEQ ID NO: 125069 - protein, 86 aa, Heterodera glycines
  Coding regions on vcDNA: vcDNA=SeqID_51492; Strand=+; Position=1 -248,425-437
MSVRKCPSANVRPQMSVRKCPSANVRPQMSVRKCPSANVPLRRGIITLREARIRLPSPPPPPTSAPAQQMLVLTLTYLPGGRDKKQ

SEQ ID NO: 125070 - protein, 156 aa, Heterodera glycines
  Coding regions on vcDNA: vcDNA=SeqID_51493; Strand=+; Position=1-468
  Homolog annotation: Hit_ID=NP_504186.1; Match level="QueryCoverage =100%, HitCoverage=18%, E-value=2e-10, Identity=27%"; Hit description= vglm uuk m polyprotein like family member (5E780) [Caenorhabditis elegans] gb|AAB63927.1| Hypothetical p
CLLGGSACLFYRWYAQEKSKTVYEIMGCNSWEFIVYAIIRLETLGEKPKSTQVFLYPGRTLKWNNISLTPIGVTFPPAPVLNSDFVFDGNNMALTREPLTIDFNCKSRQEAIDFNCSLGVQACTDCIPDHSSGLVNCNCRSHNLEKLMESPERRLP

SEQ ID NO: 125071 - protein, 402 aa, Heterodera glycines
  Coding regions on vcDNA: vcDNA=SeqID_51494; Strand=-; Position=1 -295,349-572,626-959,1401-1756
  Homolog annotation: Hit_ID=NP_509552.1; Match level="QueryCoverage =68%, HitCoverage=16%, E-value=6e-38, Identity=34%"; Hit description =reverse transcriptase RNase H-like protein family member (XJ813) [Caenorhabditis elegans] gb|AAA85753.1|
MEFLANGKKLRVVYDASAHTRGTNSLNACLYRGPVILPDLVGMLMRFRCPKFPLLSDIQAAFLQIALEPEDREVTKFLWVKDASKPLAPTNLITYRFCPPFEEYESPVAKELAQSLYVDNTLLECESAEEALHKYAESKAILKEGLFNLREFVTNSPEVMKAIPEEDRLNKPKFPTNGLEKVATRRLVLSFLASLFDPLGLMGPCIQPLKLFFQTLWEEKKGWDDVLSEKEQTQWESFQENWKDQTIRIPRRSMLQGNPSLQLHAFVDASIHTFAAAIYLRAAEENLEEGSLDNEEKVFFVNTRTEELIDSPLIDPKKFSSWTKIVQVTLFVLRFLRLKLIQKEYPSKLFEIRRKEIAKVSEKGLFSAEDVLLAENLLIRMDHIKSAEDFLSYPSLKDSEGI

SEQ ID NO: 125072 - protein, 233 aa, Heterodera glycines
  Coding regions on vcDNA: vcDNA=SeqID_51495; Strand=-; Position=1-702
  Homolog annotation: Hit_ID=CAA82797.1; Match level="QueryCoverage =74%, HitCoverage=29%, E-value=4e-09, Identity=27%"; Hit description =gag protein [Ascaris lumbricoides]
MYIETAQENLGKELADQSVRADLIAERQNLCKIISLLEKYNGKWEAIFLRIKGPALQEEEQNYRDFKPEGKAFMHWVDQARGLVDTIEGALGLSELGDAIPQPNQPAQVVQQQQLVHQRHDVTLPPITLPKFSGEPRDWPLFWKLFETSVESLQIEDFKKHIYLLGCLPEKSIARRAIDLYPPSDENYPRVVEILKKRFGDEKTNGGVPPSGVTPPSQTSRIRSVSETILRVH

SEQ ID NO: 125073 - protein, 51 aa, Heterodera glycines
  Coding regions on vcDNA: vcDNA=SeqID_51496; Strand=-; Position=1 -57,395-493
MIADGSEDFEQLERSLSFEVADCIAADMDDGEGFVFMEMRKEGPSVELVEE

SEQ ID NO: 125074 - protein, 139 aa, Heterodera glycines
  Coding regions on vcDNA: vcDNA=SeqID_51497; Strand=-; Position=1 -81,148-246,293-381,426-576
MSNDKKDESSISTNTLVNKEKASIVQESSFVTPGIFRRRKMLTGRQLNDEGNNEAKEKSADFKWSIDQIAKIQPIEFDETEEFSLPPENWDPCAKFKTPQFENIDHFWTHNNLIAPSPGLFATGTKTFSFNKKGYFYTC

SEQ ID NO: 125075 - protein, 20 aa, Heterodera glycines
  Coding regions on vcDNA: vcDNA=SeqID_51498; Strand=-; Position=1 -56,945-951
MALVFGFLKKIFVFLCYVGR

SEQ ID NO: 125076 - protein, 69 aa, Heterodera glycines
  Coding regions on vcDNA: vcDNA=SeqID_51499; Strand=+; Position=1-271
VVHLIHRLNFTQIGLHFWALPSPAHSLHHQFHTLEIMEKVCMSKRTKWKTGRVQQPQVKTDGEKSIERE

SEQ ID NO: 125077 - protein, 21 aa, Heterodera glycines
  Coding regions on vcDNA: vcDNA=SeqID_51500; Strand=-; Position=1 -49,682-698
MSSFPDSTNYTFTADQEQFTH

SEQ ID NO: 125078 - protein, 67 aa, Heterodera glycines
  Coding regions on vcDNA: vcDNA=SeqID_51501; Strand=-; Position=1 -140,355-418
EIRISRAELSPLVGADLVRHLAKCSTAGEVMYELLKSAAYMHHIIEHAKKGKKQAKGLIFAIFVSKN

SEQ ID NO: 125079 - protein, 327 aa, Heterodera glycines
  Coding regions on vcDNA: vcDNA=SeqID_51502; Strand=-; Position=1 -292,600-945,990-1335
  Homolog annotation: Hit_ID=CAD26968.1; Match level="QueryCoverage =65%, HitCoverage=66%, E-value=2e-51, Identity=43%"; Hit description =transposase [Meloidogyne chitwoodi]
ETVVLENGLALYARPNDEREVEIFANGRRHELDNRWVVPHNLYLLKMFKCHINLEKVNSVSSVKYLHKYVHKPPDRARLELEEKNDHDEVKEFIDARRVRGPSDNSAQLPPSARLHQQKGCRIPHALTQQQKHQRVVTCTELLARLSAGMQLSQLITCDEKWVYLNNKTAQKQWLKPNELCEPTPRRLQHAPKVLLCVWWCSSGLVRYELVPRVHDQIRRPPFSAKFRGGVLLLHDNARPHVAFSTQQKIEQLRWAVLTHPPYSPDISPCDYYLFRSMEHFLRGKEFADQNEVENALDDFFGSKNDQFYKKGIEMLPERWGRIIDQN

SEQ ID NO: 125080 - protein, 73 aa, Heterodera glycines
  misc_feature (44)..(44): Xaa can be any naturally occurring amino acid
  misc_feature (49)..(49): Xaa can be any naturally occurring amino acid
  misc_feature (51)..(51): Xaa can be any naturally occurring amino acid
  misc_feature (53)..(53): Xaa can be any naturally occurring amino acid
  misc_feature (59)..(59): Xaa can be any naturally occurring amino acid
  Coding regions on vcDNA: vcDNA=SeqID_51503; Strand=+; Position=1 -85,128-172,211-257,307-348
ILKRSKMVDAQHFTQLLIGMMNSENEIRSEAEKQYEAIALKDKXPLLFXPXLXSSADVXSRSLALVLLRRLLS

SEQ ID NO: 125081 - protein, 55 aa, Heterodera glycines
  Coding regions on vcDNA: vcDNA=SeqID_51504; Strand=-; Position=1 -80,415-502
MTMDAETNDGEKRNGVAAAGGGGDQKISQKIFLLFVWLIKHIKNVRMIPTMLDLD

SEQ ID NO: 125082 - protein, 66 aa, Heterodera glycines
  Coding regions on vcDNA: vcDNA=SeqID_51505; Strand=-; Position=1 -120,174-254
  Homolog annotation: Hit_ID=NP_910409.1; Match level="QueryCoverage =87%, HitCoverage=21%, E-value=2e-09, Identity=56%"; Hit description =putative glycine-rich cell wall protein precursor [Oryza sativa (japonica cultivar-group)] dbj|BAD30592.1
MDQLISGLLGGGGGGGANSGDNQPQQGGGGSGNQLADMAGELIGGFLGGGGGGSGALGGGAGGGVK

SEQ ID NO: 125083 - protein, 347 aa, Heterodera glycines
  Coding regions on vcDNA: vcDNA=SeqID_51506; Strand=-; Position=1 -268,627-741,783-1026,1073-1240,1287-1535
  Homolog annotation: Hit_ID=EAL42187.1; Match level="QueryCoverage =52%, HitCoverage=37%, E-value=3e-20, Identity=34%"; Hit description =ENSANGP00000020626 [Anopheles gambiae str. PEST]
MDPEISDNFPAENEQSEEVFIDENENNLSKLQLTEPSASFLRYYQFNKGDKTAKCRICGVQISRKMGNTTGMDKHLKQHKKSLNFLLFLKEEYRNKFSIVKEEICTAKFLSFTTDNWQNVRKKKSFLSLTVHFIDSDFNRKWRILTTQPMPESHTGHNISLRLNDILTNFGIEPNQIHIFLRDAASSMICAVEELGYEHFDCFCHKIQLALTDALEHRTKRVGEVKEQLHLCRDLVAFFNRSKNFQNVFQRQQELIGAPKNGLIQDVTTRWNSSLFMINRITEQQRPLSLAHIDFPDLKMPDFEMLKNLSNVRNDRNYACKQFSKVLTPFDTFNLYLRFGGRVRGKF

SEQ ID NO: 125084 - protein, 74 aa, Heterodera glycines
  Coding regions on vcDNA: vcDNA=SeqID_51507; Strand=+; Position=1 -166,771-829
MATAVALRGNERIVQDGIIPSQNHLPCCIGNICLATFVPWPLFGAVAFSFNTSSRQSVIGNIPINNCISNCSEI

SEQ ID NO: 125085 - protein, 29 aa, Heterodera glycines
  Coding regions on vcDNA: vcDNA=SeqID_51508; Strand=+; Position=1 -74,845-860
MSDSIWEIFTILDKINLESEKAYVAAYYA

SEQ ID NO: 125086 - protein, 43 aa, Heterodera glycines
  Coding regions on vcDNA: vcDNA=SeqID_51509; Strand=-; Position=1 -3,359-487
MGNTLLPFSNSIVTNRNVLPLLKKARGQYKSKLRNMYDGHIND

SEQ ID NO: 125087 - protein, 52 aa, Heterodera glycines
  Coding regions on vcDNA: vcDNA=SeqID_51510; Strand=+; Position=1 -64,247-341
MLKIVMIGGTVVSSVAYHHSIVPVEYQARVCTERGSASELIIELNELDFSSF

SEQ ID NO: 125088 - protein, 30 aa, Heterodera glycines
  Coding regions on vcDNA: vcDNA=SeqID_51511; Strand=-; Position=1 -27,120-185
MLARKSRGARTNAREQEPAEREATASQFFI

SEQ ID NO: 125089 - protein, 96 aa, Heterodera glycines
  Coding regions on vcDNA: vcDNA=SeqID_51512; Strand=+; Position=1 -141,209-337,1259-1279
MALLLLPLLAYVAAQDGIKKQQQNNGGQSFTGSVNNAEIRRAVNGTEFMLECPRAAYLVRTHMAPDFEHPQLVRRLDWLHDGALVASYQQHFIINL

SEQ ID NO: 125090 - protein, 259 aa, Heterodera glycines
  Coding regions on vcDNA: vcDNA=SeqID_51513; Strand=+; Position=1-777
  Homolog annotation: Hit_ID=NP_498959.1; Match level="QueryCoverage =70%, HitCoverage=8%, E-value=1e-11, Identity=23%"; Hit description =zn-finger, CCHC type and RNA-directed DNA polymerase  and Integrase, catalytic domain containing protein (
MLRRSTGSNWSWDERLPFITFCYNTTPSEVTGFSPYKMLFGKPANFPGDHDINWQKNPAYTIDQETYLQIFRENIKDIINVAKKTAENSREKSKMYYDKRPNVTENKFGQGDHCMVIFPGSNSRSPHKKLMWNNFGPYKIIEISKSSAKLVPVDKKNAEPISVPLERLVRVPPGLPNISTLPKGRNVYRNVLNALLTPNLKLTEKEPKKRGNNGEIGRTDKKSIIQLGTIEFLGGDMELDGEGNYALSWSSICCGKGHE

SEQ ID NO: 125091 - protein, 37 aa, Heterodera glycines
  Coding regions on vcDNA: vcDNA=SeqID_51514; Strand=-; Position=1-222
FGPRGRLGPNPKIEKCAFLKIKILKTKPEGSLATCIS

SEQ ID NO: 125092 - protein, 77 aa, Heterodera glycines
  Coding regions on vcDNA: vcDNA=SeqID_51515; Strand=-; Position=1 -22,321-532
MNMSTHPEPGRARRAFTGRPGPGPVFFWKKTGPGRPVKRAFFERAARPGQFSKPGPGPGQFDRAKTGLNSASETAQN

SEQ ID NO: 125093 - protein, 159 aa, Heterodera glycines
  Coding regions on vcDNA: vcDNA=SeqID_51516; Strand=-; Position=1 -309,1046-1216
MSGEYRNGYAAPGATGAGAAGGGGGGGAYTEQQRFYDAATGAHGFSESSSWEQREHFERKMQKGAKQRGLVREGSAAALVRDGSRSRIVEGGASYANGLAIERISAQKPLDRLRNAFDAFESEFGVAELLDPEDVCEVDTPDERSLITYVSTTARSIGG

SEQ ID NO: 125094 - protein, 191 aa, Heterodera glycines
  Coding regions on vcDNA: vcDNA=SeqID_51517; Strand=+; Position=1 -288,611-691,919-1113,1273-1284
MFIDGIGKDRAAAEQALAMVGTQNAQLAELLAASAAQREEMLSTELKQLAELRDQLAEAEATAAAHQAMLVFRKKRQTNEDGVQLKGSQRAKVIAKVTQLEMEAQKIRGIYDATRLEAHRAIEAANAFTQIAHGLLQARNNTRTAQQLMKETHGHLRGVAEAATNAKSASKAMGASIDIGCNGSGCVEKKF

SEQ ID NO: 125095 - protein, 172 aa, Heterodera glycines
  Coding regions on vcDNA: vcDNA=SeqID_51518; Strand=+; Position=1 -87,632-1039,1156-1177
DFALFDRMTSFDQLMRGIRRRPNESVDELGNRISGLVRRAYPGLTEQQYDDYSIIRAISNPELAITLEMTRRPRATFDEFIAQAARAEATQSAARNSFRSNQTFQRQMPNSSYSSNNVPSNNYTSNWSRPEINTNKPTNVTCFMFASQLLGEQKRLGFECSLSSLLLDTIFF

SEQ ID NO: 125096 - protein, 371 aa, Heterodera glycines
  misc_feature (119)..(119): Xaa can be any naturally occurring amino acid
  misc_feature (124)..(124): Xaa can be any naturally occurring amino acid
  misc_feature (147)..(147): Xaa can be any naturally occurring amino acid
  Coding regions on vcDNA: vcDNA=SeqID_51519; Strand=-; Position=1 -26,1480-1775,2065-2877
  Homolog annotation: Hit_ID=DAA04499.1; Match level="QueryCoverage =95%, HitCoverage=25%, E-value=2e-56, Identity=36%"; Hit description =TPA: pol polyprotein [Schistosoma mansoni]
NFEFNSRPIVAKVSIYGRQSDAMLDGGAQISLISAEFFAQIMDMVDKTYSERRIVDINGKEVKCYGTVCLPIVRGTETARIRMFVVPTFGYDLLFGTNALNQRKAMLRKLNLSKIGMNXKIRLXHHWLKNARYSEKGRAGMIKDILXTRIDRSYKNEHGQLENLILEFEQIFALDDNELTQTAITQHIINTGSAPPIRNRMRPLAFAHREKVSMMLQDYLSRGLIRPSKSPWASPIVLVPKRDGSLRFCVDYRGINSVTVKDAYPLPNIDYILLALGGKKYFSTLDFLSGYWQIKMDEKSIEKTAFVTEFGLHEFTVLPFGLCNAVATYQRFMSRLFEDLINDFVYLDDILVASETFEQGSIEDCFERIQD

SEQ ID NO: 125097 - protein, 211 aa, Heterodera glycines
  Coding regions on vcDNA: vcDNA=SeqID_51520; Strand=+; Position=1 -114,359-435,651-746,793-846,925-1019,1920-2116
  Homolog annotation: Hit_ID=CAE68369.1; Match level="QueryCoverage =45%, HitCoverage=14%, E-value=2e-20, Identity=52%"; Hit description =Hypothetical protein CBG14124 [Caenorhabditis briggsae]
MSTMECFEDEDQEVHLMLGDECANETPKLANGTYNYPRRRPKPPRLTKDQTFKVPPQMTLDMPCKDEVLQLYEELQSSGVPQIMSRFEEVVGNLCREIDQKRDENERLQHQQKAERESYNKRMAALENEIDQQLLIAEKKARDEVGNCARESHTEEQFGGESLGDDADQSRVGGDQKRVRKSDTAHAVGAAAGAAERGRSTTNPTAAATAL

SEQ ID NO: 125098 - protein, 103 aa, Heterodera glycines
  Coding regions on vcDNA: vcDNA=SeqID_51521; Strand=+; Position=1 -129,232-308,1113-1218
  Homolog annotation: Hit_ID=NP_508523.1; Match level="QueryCoverage =95%, HitCoverage=13%, E-value=8e-11, Identity=36%"; Hit description =GTP-binding protein like (XD674) [Caenorhabditis elegans] gb|AAK39204.1| Hypothetical protein C33D12.6 [C
MKEVPILLVGNKVDLRNSGGDGTTKDESSSTFVSRKEGENLSELLGTDFIETSALDGTNVETALLLLVGEMLKTEDDQLKQTAMMLQNGGKSKKSKCLSCGNS

SEQ ID NO: 125099 - protein, 95 aa, Heterodera glycines; identical to SEQ ID NO: 124528
  Coding regions on vcDNA: vcDNA=SeqID_51522; Strand=+; Position=1-660

SEQ ID NO: 125100 - protein, 47 aa, Heterodera glycines
  Coding regions on vcDNA: vcDNA=SeqID_51523; Strand=-; Position=1-154
FEYPKRTLEKIDFFVFGAVPPNRCAQIYGETESFENSFPIACTLILR

SEQ ID NO: 125101 - protein, 88 aa, Heterodera glycines
  Coding regions on vcDNA: vcDNA=SeqID_51524; Strand=+; Position=1 -186,328-408
MAIKYGPKIAKYGHKMAKISKYGNKWQKCQNMDINFSKLSAKFLQIYWLKLHMRYISKFFDLRKINQKSEILSFLLIFDINLLIFKKI

SEQ ID NO: 125102 - protein, 51 aa, Heterodera glycines
  Coding regions on vcDNA: vcDNA=SeqID_51525; Strand=-; Position=1-155
LQIYWLKLHMRYISKFFDLVRRFDKDGFRFAISRSTFGNWSRIFSAITCNH

SEQ ID NO: 125103 - protein, 121 aa, Heterodera glycines
  Coding regions on vcDNA: vcDNA=SeqID_51526; Strand=-; Position=1-365
  Homolog annotation: Hit_ID=CAD22154.1; Match level="QueryCoverage =100%, HitCoverage=51%, E-value=4e-46, Identity=64%"; Hit description= pherophorin-dz1 protein [Volvox carteri f. nagariensis]
PPAPPPPPPPPVPPSPLPVTAPPVPVPPPPVSVPPPPPVPTPPPPLVPLPPLLVPTPPPTFVPQFPPPPVPPPVSPPPPPPLPTPPPLPPVPPPPPLPVPPPPLPSVPPPPLRSLPPPPPV

SEQ ID NO: 125104 - protein, 131 aa, Heterodera glycines
  Coding regions on vcDNA: vcDNA=SeqID_51527; Strand=+; Position=1 -144,405-561,727-819
  Homolog annotation: Hit_ID=CAE57976.1; Match level="QueryCoverage =78%, HitCoverage=23%, E-value=9e-38, Identity=74%"; Hit description =Hypothetical protein CBG01037 [Caenorhabditis briggsae]
VGHLKIQKFHLYFLNASSFHAQVFFLGIALVLFSSGVYFAEQSEPNTKFTSIPASFWYVLATMTTVGYGDLVPHGVYGKIVGSCCALIGVLTLALPVPIIVANFKRFYRQEIILAKMYEQNPPPKQVRDIN

SEQ ID NO: 125105 - protein, 152 aa, Heterodera glycines
  Coding regions on vcDNA: vcDNA=SeqID_51528; Strand=+; Position=1-459
MAEASSNGTEIHGTAIIRGTTIFAAYAMAFLELGTFIPTIPIVAFCASIVYKTSILHQNLKGILLAQLFGIIMNLWPRAFMLIAQIFVTKNIFLLPPNFISGASTAALTFNNMAGHVLIVERICATVYVGTYESYRSWTFTALWLPIMVKTY

SEQ ID NO: 125106 - protein, 117 aa, Heterodera glycines
  Coding regions on vcDNA: vcDNA=SeqID_51529; Strand=+; Position=1 -199,308-480
EFKYNLRKFNAAVIKCTTLIKATPLLWESGKMICLGTKSLIDCENAIKKFIEIIKGSGCPGASYTGLNFKRGKSMTALIFWTGKVVITGTKNNSEIDEMYHYILPYLKMAQKKLGRR

SEQ ID NO: 125107 - protein, 101 aa, Heterodera glycines
  Coding regions on vcDNA: vcDNA=SeqID_51530; Strand=-; Position=1 -51,256-378,817-945,1353-1355
  Homolog annotation: Hit_ID=CAE62202.1; Match level="QueryCoverage =92%, HitCoverage=17%, E-value=9e-28, Identity=63%"; Hit description =Hypothetical protein CBG06252 [Caenorhabditis briggsae]
MNCGKRVKLITAVENITPYLKLAPHKVEIVHYEPLVVVFRNVISDEEIAVVKQLATPRLRRATVQNSRTGGLEFASYRISKSAWLKGDEHPIIERINRRIH

SEQ ID NO: 125108 - protein, 270 aa, Heterodera glycines
  misc_feature (266)..(267): Xaa can be any naturally occurring amino acid
  Coding regions on vcDNA: vcDNA=SeqID_51531; Strand=-; Position=1 -219,1105-1227,1284-1361,1738-1857,2126-2378
  Homolog annotation: Hit_ID=CAE62202.1; Match level="QueryCoverage =90%, HitCoverage=44%, E-value=5e-61, Identity=49%"; Hit description =Hypothetical protein CBG06252 [Caenorhabditis briggsae]
MLLLFASASVLRVAVADVFTAMVDLENLLASESASTSVIEQYIEAERARLVQLSEWGDIYILKFLKFYARIKDSVMNPVNAYLLIKRLTRDWQRIRQLMNANPGDQFIKNITGNQIFFQVNQIFFQVKYPDDEDLDGAAQGLLRLQDTYKLKTTDLANGFVDGESVAKELNANDCFEIGRAAYNQKDYYYTLEWMQEALRRDPSAALEADILEFLAYALYQQGNQKRALTMTKWLVRLAPGHPRAAGGCARWCQNWDVKTQCPGNXXGGG

SEQ ID NO: 125109 - protein, 135 aa, Heterodera glycines
  Coding regions on vcDNA: vcDNA=SeqID_51532; Strand=+; Position=1 -333,458-532
MVQITFKEVDRLDRRREEILNTIVSAANIQGYFGNAVVEPLQYFRAASLTTMEFVFMPNDYIVRGPSIRDRMASFLRPGQTQWGVENPPDYGTKRPRSEIIGKLKKRLASRCLVNFYLNAQETVWTRLLEEVQKA

SEQ ID NO: 125110 - protein, 251 aa, Heterodera glycines
  Coding regions on vcDNA: vcDNA=SeqID_51533; Strand=-; Position=1-753
MIVRSPPLTRQRAQNAGIILNQEGQEIFRENRNNAENGLRQNEDGMSEHSNFSEPMMNTEQIHDALLDVGQRNVRDGEEDKGNENEQVDNANGFGGLNFENFENLEERTFNVHNRNVSLTDFDAGRMFENVRLERQQNLLPISFPIASTPVENRVANQMGMDQVRENFSVIARLEKELVINGEPQIVTRQQRNPTSVAQPQRVIHQMNLGRQNVQHQNYQHEYGMRQRVAPAPSAPIQQYVQFVEQPNMNT

SEQ ID NO: 125111 - protein, 109 aa, Heterodera glycines
  Coding regions on vcDNA: vcDNA=SeqID_51534; Strand=-; Position=1 -208,366-487
MAFDCRPYARKKSADGHRQFGEIFCLSNSPSGADGPPCRRPPSPPIRHRHSAVVAKSGHRTTAKMFIGLYVNACTYPQSRAKTQCHHAFSAPLLICVSHLPLLLPMGRR

SEQ ID NO: 125112 - protein, 140 aa, Heterodera glycines
  Coding regions on vcDNA: vcDNA=SeqID_51535; Strand=-; Position=1 -263,734-893
MVPWWSSNPSTLNSSMESIEAAAAGEQHRHVRPVHATPPPADEFDGIVIVGQGVTADATAAGDFVPCSTSTLAQSIERVFGNLQHQQIHPESYEEAKRLLVFAGLFFLLMCAFVLIKFQVELGKFLRRENHQKMVLKIPK

SEQ ID NO: 125113 - protein, 88 aa, Heterodera glycines; identical to SEQ ID NO: 124691
  Coding regions on vcDNA: vcDNA=SeqID_51536; Strand=-; Position=1 -96,135-305

SEQ ID NO: 125114 - protein, 401 aa, Heterodera glycines
  Coding regions on vcDNA: vcDNA=SeqID_51537; Strand=-; Position=1 -294,341-598,648-818,871-1353
  Homolog annotation: Hit_ID=CAE59883.1; Match level="QueryCoverage =89%, HitCoverage=8%, E-value=1e-13, Identity=23%"; Hit description =Hypothetical protein CBG03363 [Caenorhabditis briggsae]
MTKRLLPDQQQQGFHPLHSSVPIYANANLRGDFNMEKLVKLESELRKGTERHQLLVKGILEMIKSSSTHPLDNELAHNALTLLLRLVSLDGMAQEFLNEDGVKALLEMKRNPISAQMVTNGTTTPPTLNTLATLILRQCIDSDAALLQSAFEQMITATCNGQPISMQEITSRPMRTKRYQKDVKRVVRMLVPLAVRSPSLYMDAAKKCLAIKQNEILVKEQRGDVTGNGNAAAASDQFLKTLLSQIVTELTQFDTFADADKNTRLMQPPNLLKLIAEVLHSYPKMAVPIFIEQSLGEKSVLRWIVERFLLSAPVNDLSDTVYWAKAVVSELVSNSSSQRITDHVVGNIKSLLIECGDFDCTVVTSDESNSGAHAKFADKVTILAKLTMHLRECLQVRVIKS

SEQ ID NO: 125115 - protein, 62 aa, Heterodera glycines
  Coding regions on vcDNA: vcDNA=SeqID_51538; Strand=+; Position=1-186
MELKMKSAGATTSSPKNSISVINNDSGAVAAFAAATPPTKIVAAAKPSPPPPSQQQQQQSIR

SEQ ID NO: 125116 - protein, 209 aa, Heterodera glycines
  Coding regions on vcDNA: vcDNA=SeqID_51539; Strand=+; Position=1 -283,542-889
AHAAGGLSLSGALNEQLPPPPPLRHRASLNQQQQPKQRKLSADQRRHSALVDGTGTDKQQKKQRRQTHGCRDEQQPLLISNGPKTGANKKRKHVEKASRTGSNASTTSGGGGGSGAGLYNGVRKSAAAVSSDEAGNCVSEDDDVDSHEDENECVVNGSDDGGWMNNHVEDGQQQQQQQHEEDDGEASQSQIQSKGPSSDYLPFSSVLHH

SEQ ID NO: 125117 - protein, 130 aa, Heterodera glycines
  Coding regions on vcDNA: vcDNA=SeqID_51540; Strand=-; Position=1 -61,123-169,231-653
AKTFYTLTTIANLFQEKASRTGSNASTTSGGGGGSGAGLYNGVRKSAAAVSSDEAGNCVSEDDDVDSHEDENECVVNGSDDGGWMNNHVEDGQQQQQQQHEEDDGEASQSQIQSKGPSSDYLPFSSVLHH

SEQ ID NO: 125118 - protein, 287 aa, Heterodera glycines
  misc_feature (27)..(27): Xaa can be any naturally occurring amino acid
  misc_feature (45)..(46): Xaa can be any naturally occurring amino acid
  misc_feature (50)..(50): Xaa can be any naturally occurring amino acid
  misc_feature (104)..(104): Xaa can be any naturally occurring amino acid
  misc_feature (111)..(111): Xaa can be any naturally occurring amino acid
  misc_feature (131)..(131): Xaa can be any naturally occurring amino acid
  Coding regions on vcDNA: vcDNA=SeqID_51541; Strand=+; Position=1 -242,894-945,1630-1786,2272-2437,2767-2800,4082-4195,6212-6317
  Homolog annotation: Hit_ID=CAB62280.1; Match level="QueryCoverage =87%, HitCoverage=91%, E-value=2e-52, Identity=41%"; Hit description =hydroxyproline-rich glycoprotein DZ-HRGP [Volvox carteri f. nagariensis]
LLRIEVQALKTISYLAISNPTTKNQLXSVFGCAPAPTSPPPYAPXXAVEXSPGYCPYWWCCPAAAIAPTPPDIPPADAPLPTAAPPRPPPPPPLPPMPLYPPPXPPYPSSXPPPPMAAAAAAAPPPRPAPXPPPPAPPAPPGCRGVPYPYPPPNPPPFPPVHPLSIPTLPHSVCPMRPPPILHHLQPPIHSLPPPPPPIPTSSSSPVPSRTPPLPRSPLSSAPKPRALPRRPPPSAASAPLALPPSPPKWRQPARLPSRPLHPPPSFDPPLSSQLIPPIFCSPPFFF

SEQ ID NO: 125119 - protein, 181 aa, Heterodera glycines
  Coding regions on vcDNA: vcDNA=SeqID_51542; Strand=-; Position=1 -198,418-544,598-741,824-900
  Homolog annotation: Hit_ID=NP_991247.1; Match level="QueryCoverage =45%, HitCoverage=21%, E-value=2e-14, Identity=41%"; Hit description =hypothetical protein zgc:77712 [Danio rerio] gb|AAH65439.1| Hypothetical protein zgc:77712 [Danio rerio]
MMNGTDGSFLASSTVGATSAVNGGNANGAEAADGGEVVEAKPVVIGADDSGDPGEQQQNFTPVQPQVNAPMPVSTQQPQSPQTDASCFLRCRGLPYSANENDVRKFFGEFTVYDVHFTSSVDGKPTGECYVQFGDRESTAVAQQKDRQTMGSRYIEVFQVGDVEMDQLMRRMQVGIENWGI

SEQ ID NO: 125120 - protein, 119 aa, Heterodera glycines
  Coding regions on vcDNA: vcDNA=SeqID_51543; Strand=+; Position=1 -305,891-945
MIILLGSIVCLVPFNLSLLICQNCLLITLIILVNAGLTILMLFANPFTEAEAVGMEMRWRLAAVIEPLNLGTPPIGAEFANSFLFVFHISFDEGPSFHKGSGIHIIFVDYKMNRIIEKA

SEQ ID NO: 125121 - protein, 123 aa, Heterodera glycines
  Coding regions on vcDNA: vcDNA=SeqID_51544; Strand=+; Position=1 -358,876-889
MKRYKSDRRGVTVIRRGTNLMKRYKCDLKRYNSDKRSTKVIRRGKKVIRRGTMVIRRGTKVIRRGTHLMKRYKCDLKRYKSDLKRYKSDKRGTKVIRRGTPVIRRGTTMIRRGTTVIRREFLE

SEQ ID NO: 125122 - protein, 422 aa, Heterodera glycines
  Coding regions on vcDNA: vcDNA=SeqID_51545; Strand=-; Position=1 -810,1895-2353
  Homolog annotation: Hit_ID=CAF98481.1; Match level="QueryCoverage =34%, HitCoverage=33%, E-value=1e-46, Identity=66%"; Hit description =unnamed protein product [Tetraodon nigroviridis]
MPTTTTTTPSEIAPNCGDEVRPNEDGGWGGTSPSSQCETLAAASDLSPSDHQKNNAPSEQQPNIKPPPLHFGGLPVLPCGSETKFGGLTAGTPVRRHAPAQAEAEFQHNATEKLLSENAMASGYRDGKTPPLSAEIDQSVGEQQPLLKATRVDQQQQRKSSSLPPNGGTVWAAPSANAIPQHSSFSTNADHDDGPLFRPELRHAYSWPPLKGTVILAIERKSFVQKVCDLFKQATAVALPGGAREFNLRAELFWLKSAIRHSVCRLLNWQDNSNLYMVLEFISGGEMFSHLRRIGRFSEPHSRFYAAQIVLAFEYLHSLDLIYRDLKPENLLIDSNGYLKACKSPRGEDGVWHSFCKNAMPLKLDSQFAYDIPKLASLFPQITDFGFAKRVKGRTWTLCGTPEYLAPEIILSKACFLDEQIY

SEQ ID NO: 125123 - protein, 57 aa, Heterodera glycines
  Coding regions on vcDNA: vcDNA=SeqID_51546; Strand=-; Position=1 -13,66-226
MYVKKLSQKSADGSLMGFLAIWENLFSKRNPKFTNHQTHCPDHVHLQQAWEKDVDTS

SEQ ID NO: 125124 - protein, 92 aa, Heterodera glycines
  Coding regions on vcDNA: vcDNA=SeqID_51547; Strand=+; Position=1 -184,1047-1141
MNSQLLLAIRRIGTVTRRKFEENVVIERDEAKDGHRYGHCLLLQFTILCRKRRKGTKNGGESQFAMPLVVFGGTQKWVAGSAGTSSFLENGG

SEQ ID NO: 125125 - protein, 21 aa, Heterodera glycines
  Coding regions on vcDNA: vcDNA=SeqID_51548; Strand=+; Position=1-67
DGERASALLAQSLLWRRMIIS

SEQ ID NO: 125126 - protein, 503 aa, Heterodera glycines
  Coding regions on vcDNA: vcDNA=SeqID_51549; Strand=+; Position=1 -48,417-618,663-1216,1260-1566,1616-1667,1712-2060
  Homolog annotation: Hit_ID=NP_001004509.1; Match level="QueryCoverage= 96%, HitCoverage=33%, E-value=5e-61, Identity=31%"; Hit description =si:busm1-180o5.3 [Danio rerio] emb|CAD60788.1| novel protein similar to DNA polymerases [Danio rerio]
MPEEGYEKAENQSKIAECDVRAELKKNKEMKKFFESVPDKGPINPRDAYAGGRTMPFCLYAKATEEIEISMFDIISLYPFVNYDTPYPVGVPKIVVSRNFNVNWTVPDDIPYDGLLKVKVVPPKNLLYPLLPVHIDDMLLFPNCWACAKRAKNEFVMTKDVKKCNHRPAQRAFLGTFTSIELRKALELGYRVIGFYRAYHFEQFDSQLFKGYVRMFLKIKVEASGWPAEVKSEEEKRAFIAMYKAKYNISLDYDKIGLNPGLRMIAKLGLNSLWGKFSMRNTLSNTEIVGSMERWMELGRDNTIEFGRPVKISEEISRVVYRKKEEFIREHKVSNIVLSLWTTSAARLKLYEYMEQVYKKEGCKLLYCDTAFAHRKGRCPLVEGKFLGEMTREYADSEILEFVSAGPKQYALKLRRKKDGVIWHKTKIRGMTLDRRNEFKYDLFKEMVLDYKKGVKKVFHYPEKIGPTNDFRVLSKDVQKEYTPVQKKGIIDDHFNVLPFGYY

SEQ ID NO: 125127 - protein, 151 aa, Heterodera glycines
  Coding regions on vcDNA: vcDNA=SeqID_51550; Strand=+; Position=1-456
MNSEKSEKANSILLEAAKKETERAWRDVAALTDEVSDFAKSSRETLNRGIKSREKAPYANGIRELYLKMSDSIWEIFTILDKINLESEKAESTWRDFERYKTFDQATKLEEQSQNSLTEARRLHFESRRVQSQMLNYENRLQTIVWEHMGI

SEQ ID NO: 125128 - protein, 104 aa, Heterodera glycines
  Coding regions on vcDNA: vcDNA=SeqID_51551; Strand=+; Position=1 -177,972-1106
  Homolog annotation: Hit_ID=NP_572294.1; Match level="QueryCoverage =98%, HitCoverage=6%, E-value=3e-31, Identity=61%"; Hit description =CG4320-PA [Drosophila melanogaster] gb|AAF46122.1| CG4320-PA [Drosophila melanogaster]
MLKTGTKNRFPPSIIDEIPGVLSDRRTLLGELNWIFTAITDAIAWCRLPRSTFQKLFRQDLLIASLFRAFLLSERIMRENGCHVVSTPQLPRVHDHPLWEYWDL

SEQ ID NO: 125129 - protein, 136 aa, Heterodera glycines
  Coding regions on vcDNA: vcDNA=SeqID_51552; Strand=+; Position=1 -24,75-251,302-481,535-564
MPSLSMVFEIIILGLHLAIIFCAILGIYLDMGIEDNVFIISSAVLCVVICQLKAYFYKKKGVKSSCADMLVLLLHLVVFFVAILGIYIDMQTEDNAIIIGGAVLSLVICQLQNYSAAKKKENPNAGKISIFVLFGR

SEQ ID NO: 125130 - protein, 115 aa, Heterodera glycines
  Coding regions on vcDNA: vcDNA=SeqID_51553; Strand=-; Position=330 -479,574-771
  Homolog annotation: Hit_ID=NP_497592.1; Match level="QueryCoverage =93%, HitCoverage=32%, E-value=1e-14, Identity=37%"; Hit description =newt Ovary Ribozyme-Associated protein like (38.4 kD) (3D715) [Caenorhabditis elegans] gb|AAF36030.1| Hyp
MIPPEKFVPRKLMTPNYAKTKLLDVEINADEMSEEQLANELAEALGEKVPELMQKVVHFAGKSHAVELFKQCQEVERNGGMLTQNRLRRRTPGGVFMKLFNESKEISEENKAHLI

SEQ ID NO: 125131 - protein, 134 aa, Heterodera glycines
  Coding regions on vcDNA: vcDNA=SeqID_51554; Strand=+; Position=1-402
  Homolog annotation: Hit_ID=XP_146481.3; Match level="QueryCoverage =99%, HitCoverage=12%, E-value=4e-13, Identity=34%"; Hit description =PREDICTED: similar to carboxylesterase 2; carboxylesterase ML3; acylcarnitine hydrolase M1 [Mus musculus]
MQKKRRKKQKKKHHSEKELEKRVANGQKGENEGRKEENEGRKEENEGRKEEEFKMAKGTEEEEEEERRSGTYSSSGEEVYLNEREEEELLMVMEQGLDRRLGKERGQVGEGKDKQQQQNGDKEHKEEEEEQKQQ

SEQ ID NO: 125132 - protein, 242 aa, Heterodera glycines
  Coding regions on vcDNA: vcDNA=SeqID_51555; Strand=+; Position=1 -201,259-786
MSGVAEAEAVALELAFCRLCAAPATFSARTGKNGNAKAAVALRAPFLRRRPNGRASRCQCCRVRAQQSECLFRLKSANPWHWHFPLTFMANSPPRRSSRSFSSASSRFRRSHSRSVAAEKSRKGQKSRKGTDGPQSPDDRESVELRTFATDMEMREAMGKRENEREGEKANEAKEQRERHEQTKSYGHRRRYSHRHGCRSCCHRQSRKSRCHRRHRQKRAKQSLREEEESARKGEKMPKNKR

SEQ ID NO: 125133 - protein, 66 aa, Heterodera glycines
  Coding regions on vcDNA: vcDNA=SeqID_51556; Strand=-; Position=1-198
MSVNVKQKKTAPKRDVSSSPSQSSTSDSSEASNESVDEAKEETTPANDKVLTKYSMAAEIVNTVLK

SEQ ID NO: 125134 - protein, 406 aa, Heterodera glycines
  misc_feature (281)..(281): Xaa can be any naturally occurring amino acid
  misc_feature (299)..(299): Xaa can be any naturally occurring amino acid
  Coding regions on vcDNA: vcDNA=SeqID_51557; Strand=-; Position=1 -204,257-341,775-885,941-993,1034-1083,1128-1695
  Homolog annotation: Hit_ID=NP_499811.1; Match level="QueryCoverage =98%, HitCoverage=83%, E-value=9e-60, Identity=40%"; Hit description =protein-like protein (44.7 kD) (3O704) [Caenorhabditis elegans] emb|CAB05818.1| Hypothetical protein T12D
TEEKCGKEEQRQEDEEVPLPELDNSGVQTDKTGVQLSMGDLSKQVAEEEIERANESRESAMAAFSEGNYQSAFDLLTKAINYQSAFDLLTKAIELNPGSAILHAKRANLLKMSMMKAAIQDCDKAIAINPDSAQPYKFRGRANQLLGNWLLGNWTEAHHDFATSCKLDYDDVAYGWMKEVEDYDDVAYGWMKEVEPNAKKLQEYERAKQRRAEEKEQRERPNAKKLQEYERAKQRRAEEKEQRERLERVRRAQEANRKAESAADSGEGGAHFNGTLHGNVXGKFPCHSLFTIDLRSCGXPRIVKCHQKRPFADSEFDSKFQVISILFKKLMEIMQNPANMMKHMNDNVQKVLEKLGSKLGSASPFANETGRDSTPFGTATEGTPQQKSTADKGPEAPKKAPEPELD

SEQ ID NO: 125135 - protein, 43 aa, Heterodera glycines
  Coding regions on vcDNA: vcDNA=SeqID_51558; Strand=-; Position=1 -30,84-162,257-279
MYIKLLFAQKIEIYLFIAAAVDKNFLEEPDEKFGPTETGQEGR

SEQ ID NO: 125136 - protein, 139 aa, Heterodera glycines
  Coding regions on vcDNA: vcDNA=SeqID_51559; Strand=+; Position=1-420
MKSLLLKLFVGLCFIDFTSNIKSKFEDFLENQEAMKLIQNYQEKRIKTIKELHAELTKKGIKLAERSLRLYLCKIKSANSDTSKESPNIPEIKFEKCLSRDLTYTIYLIGNGSNWRKYRIMNENNADIYIACSKHSVKD

SEQ ID NO: 125137 - protein, 51 aa, Heterodera glycines
  Coding regions on vcDNA: vcDNA=SeqID_51560; Strand=+; Position=1 -142,426-439
MKCHAFHAHFDRFCDEKFTKEYVRSDCNDCFGSDCNKDQLKLSIGSKAIFF

SEQ ID NO: 125138 - protein, 189 aa, Heterodera glycines
  Coding regions on vcDNA: vcDNA=SeqID_51561; Strand=-; Position=1 -106,167-227,403-497,542-599,659-766,1208-1237
  Homolog annotation: Hit_ID=NP_510455.2; Match level="QueryCoverage =100%, HitCoverage=33%, E-value=1e-32, Identity=48%"; Hit description= rhodopsin-like GPCR superfamily (51.2 kD) (XP421) [Caenorhabditis elegans] emb|CAB03091.2| Hypothetical
IGSIKLPKIFFNNYLIALNCFQIRKAQRRKERLLREKRAREAERQTDSNSEKRAREAERQTDSNSTSIMLVIIVSIFLIVNLPTALFMAMLCVCLPPPPKFPFLEGVFPVTFFLEGVFPVTFLLVNNMLVMATYPINFGIYCFATYPINFGIYCFMSSSFRDTFWMLFCRRKSCTEGDRRNETINMVKS

SEQ ID NO: 125139 - protein, 108 aa, Heterodera glycines
  Coding regions on vcDNA: vcDNA=SeqID_51562; Strand=+; Position=1 -167,468-627
MDLLVFITKFATFFHLIVSLPIYLSVLAFLLRQRHRPQFTSSFYMLFIALGFVDLSKFLLYLIKKCAYWGYVPAIFYPLNQANSAANLIYFSLWALCLIQLQAFLILK

SEQ ID NO: 125140 - protein, 77 aa, Heterodera glycines
  Coding regions on vcDNA: vcDNA=SeqID_51563; Strand=+; Position=1 -228,545-550
MSLNRFCAICCSQMYRRHWSQIISKYLLAIILLFALAISAPILWHSVCFRLSEVRTPLGQGQHKMDGPVFMEIPTQP

SEQ ID NO: 125141 - protein, 89 aa, Heterodera glycines
  Coding regions on vcDNA: vcDNA=SeqID_51564; Strand=-; Position=1-271
GQIVADVVQNVVQTDAAATPAVQHGQQQQPQAVVELAADEPPPNGRPAHDEEKTPMTTSTSTTVLVVNNDENDADAQAGFFFEKFEFNL

SEQ ID NO: 125142 - protein, 287 aa, Heterodera glycines
  Coding regions on vcDNA: vcDNA=SeqID_51565; Strand=-; Position=1 -75,485-1270
MGQKHSYNLNRAKATRQSTQIIQDEIASTAEPTHPSEPVPLGVRTSLDGSDYVRREVERQEQQEKLAKCQENGTSGQGKGEEVPLESKANAVEGSQTVAEPVEEDVPKCNVVVLKCEENAMESQTGEDEVPKCQKNALENRSESVTEPFADTIPSPQANVHEVEAVPEFANDALKSEESAIDVQETGKAEVEAVQEVPTINQLVEECVAGTKDVLLEVQAVGLLIHENEEHSAQSQTDGGEVPKSGGEENGKTEQTGKAAREERWESIDQVLEDKTGASADVPEEEM

SEQ ID NO: 125143 - protein, 64 aa, Heterodera glycines
  Coding regions on vcDNA: vcDNA=SeqID_51566; Strand=-; Position=1-193
MAFAYTYKIWHIRRSYSVPIYALPSGKQRQQQQAQDDDDNDNEQQRGRPPLPPCPLPGFCRDGH

SEQ ID NO: 125144 - protein, 16 aa, Heterodera glycines
  Coding regions on vcDNA: vcDNA=SeqID_51567; Strand=-; Position=1-8,53- 95
MAHFIWHTKMPKQVGH

SEQ ID NO: 125145 - protein, 36 aa, Heterodera glycines
  Coding regions on vcDNA: vcDNA=SeqID_51568; Strand=-; Position=1 -48,110-172
MATFGMALLTILIGIGLSASSVRADDNKTKLKMEET

SEQ ID NO: 125146 - protein, 50 aa, Heterodera glycines
  Coding regions on vcDNA: vcDNA=SeqID_51569; Strand=-; Position=1 -18,156-290
MTKWCKKREGSAESFWYYWKQKDAEPMRIEEMHCVKCDPEKDKRCKYIPQ

SEQ ID NO: 125147 - protein, 92 aa, Heterodera glycines
  Coding regions on vcDNA: vcDNA=SeqID_51570; Strand=+; Position=1-304
MIGRAVRNRPFIFEGIFKFILYPRKMAISFFEKFYTSQKRLRMRRRAVHNRHFISQRIFIFRGYPRKMAISFFDKFYTHTNALEHDREGGAQ

SEQ ID NO: 125148 - protein, 92 aa, Heterodera glycines; identical to SEQ ID NO: 125147
  Coding regions on vcDNA: vcDNA=SeqID_51571; Strand=+; Position=1-304

SEQ ID NO: 125149 - protein, 129 aa, Heterodera glycines
  Coding regions on vcDNA: vcDNA=SeqID_51572; Strand=+; Position=1 -66,336-659
MKWGCSTIAGNCDFVNAKNDEMDKCLCPFGEKDVDFSNENLTIEIPAVMTTPTLTTLTTKETTTTTTTTTTTTTVTTEEPTKPKTTATLVELAQSTINEGAIRLPNYLFKRICKLQEMVFASAMVCIAI

SEQ ID NO: 125150 - protein, 239 aa, Heterodera glycines
  misc_feature (16)..(16): Xaa can be any naturally occurring amino acid
  misc_feature (114)..(114): Xaa can be any naturally occurring amino acid
  misc_feature (128)..(128): Xaa can be any naturally occurring amino acid
  misc_feature (201)..(201): Xaa can be any naturally occurring amino acid
  Coding regions on vcDNA: vcDNA=SeqID_51573; Strand=+; Position=1-725
  Homolog annotation: Hit_ID=XP_472587.1; Match level="QueryCoverage =95%, HitCoverage=67%, E-value=2e-34, Identity=38%"; Hit description =OSJNBa0006B20.10 [Oryza sativa (japonica cultivar-group)] emb|CAE02745.2| OSJNBa0006B20.10 [Oryza sativa
MRTKTGCQTIPTPKLXRPDYNGQTTPARLHRPDYNGQTITARLHRPDYTGQTTPARLHRPDYTGETTPARLQRPDYTGQTTPARLHRPDYTGQTITARLHRPDYNGQTTPARLXRPDYTGQTTPARIXARLHRPDYNGQTTPARHRPDYTGQTTPARLHRPDYTGQTITARLHRPDYNGQTTPARLHRPDYTGQTTPARIXRPDYTGQTITARLHRPDYNGQTPARLHRPDYNGQTTPE

SEQ ID NO: 125151 - protein, 433 aa, Heterodera glycines
  Coding regions on vcDNA: vcDNA=SeqID_51574; Strand=-; Position=1 -375,497-680,743-987,1043-1180,1234-1386,1430-1483,1549-1632,1782-1847
  Homolog annotation: Hit_ID=NP_497035.2; Match level="QueryCoverage =95%, HitCoverage=30%, E-value=1e-124, Identity=54%"; Hit description= ARF(ADP-Ribosylation Factor related)-Like, Complex locus. ARF(ADP -Ribosylation Factor related)-Like and
GIPIRPHFSISLQNAKESLEISCLPGTSQIRLRATAATCGGCGTVGSSSDDGGTTAFASGGPTGAGEVVLLDIKNEIEEFKKDLKFLQFIQSDDIYNIEQFISTLKVYHPVSETTFREEVAAVVDMFIDADHFNYFFTDRDGTLKSYSCSYVASIQPAYSGVIQAQFARRCAQTCAIVTTAPMMRLGILDVCTIPEGYYYIGASAGREWFVDPANKFKDQSIPDPDLEKLNYVFDSISELLEHPEFKIFAWIGSGLQKHYGHVTLAHQDVFGTVPRELREQIDQRIRAIVEDIDSTHQLLEVKTTETDIKVFIKSSLGHIFDKGNGIQLLIQHLKCDLREGTILVCGDSETDIPMLRTCLEHNPKNVYTVWVAPESKKELREKVSQLCKSFGNEHFLFVSSPEVLLGAMAQATGSGDKHRPRSNGLSTPPNGA

SEQ ID NO: 125152 - protein, 46 aa, Heterodera glycines
  Coding regions on vcDNA: vcDNA=SeqID_51575; Strand=+; Position=1 -46,125-219
MCDLHLFILVFTDLQRFKTHILTVFSPYFGPYLAIFELFSPYFGLF

SEQ ID NO: 125153 - protein, 82 aa, Heterodera glycines
  Coding regions on vcDNA: vcDNA=SeqID_51576; Strand=+; Position=1 -190,263-322
PYAPFLETIRCLGLIAYYATPTIKDIFRPSRIFITVPFIASAIAWAVFVLLKTFVCLRSLKFKRPRKFRFEKIYRSYGTSTM

SEQ ID NO: 125154 - protein, 32 aa, Heterodera glycines
  Coding regions on vcDNA: vcDNA=SeqID_51577; Strand=+; Position=1-249
THFVFINFEKFWTFRGFLLFWTFRGLDTLWGR

SEQ ID NO: 125155 - protein, 24 aa, Heterodera glycines
  Coding regions on vcDNA: vcDNA=SeqID_51578; Strand=-; Position=1 -61,659-672
MAQHPILLWADDVPSEQGKIVSID

SEQ ID NO: 125156 - protein, 46 aa, Heterodera glycines
  Coding regions on vcDNA: vcDNA=SeqID_51579; Strand=-; Position=1-138
VADFGCDGFHLVLVAMRDIDSDEELLYDYGERRPSVLAVNPWILGS

SEQ ID NO: 125157 - protein, 84 aa, Heterodera glycines
  Coding regions on vcDNA: vcDNA=SeqID_51580; Strand=-; Position=1 -148,242-348
MQQKLEMLLMDAVNREEKAMPQRTVQWKANGIGVQAENGDGKVEKLKMLGQQPYRTVKANFTIVFVNCFFLRSFGVLQLFSPWQ

SEQ ID NO: 125158 - protein, 83 aa, Heterodera glycines
  Coding regions on vcDNA: vcDNA=SeqID_51581; Strand=-; Position=1 -123,171-299
  Homolog annotation: Hit_ID=XP_314730.1; Match level="QueryCoverage =98%, HitCoverage=23%, E-value=2e-11, Identity=44%"; Hit description =ENSANGP00000005060 [Anopheles gambiae]
MPPKNAPKTSKKAEEKKKQKVLEDRTFGMKNKKLRAQMEKNIMGAPSKQFTPKKKQEDEDLKDINKIFKPVVQATQQKVSAGT

SEQ ID NO: 125159 - protein, 92 aa, Heterodera glycines
  Coding regions on vcDNA: vcDNA=SeqID_51582; Strand=+; Position=1 -52,245-336,407-541
MACGRLQTQQALPSSDFCSIPGELVFNSVNRPGIKCDMDAAYIAAEAIVCFIEDAGQTYVEFSFERRCPVQQRSAPEFGNEFRKYGAFCPLN

SEQ ID NO: 125160 - protein, 213 aa, Heterodera glycines
  Coding regions on vcDNA: vcDNA=SeqID_51583; Strand=+; Position=1 -103,155-319,597-713,795-1048
  Homolog annotation: Hit_ID=AAT42370.1; Match level="QueryCoverage =34%, HitCoverage=9%, E-value=3e-11, Identity=45%"; Hit description =dishevelled [Lytechinus variegatus]
VTFNLDSRRPFGMSIVTKNNRSGFAGIYVHEVNPGGLVALDGRIRPGFIILEVNDISLDDLSSKEALNLIISSVRNATETRGSVICLFDGQQPPICCIMPPQCQPNAAKPMASKSSTIPKTNPQQQGKVHEKQHQFAGAANCAVDGDIRMIQNPSTDITTTESGISSVECSIGQLEPSTKAKGASTGNRKRSKTTETKKRRGSGGIGTALRRL

SEQ ID NO: 125161 - protein, 130 aa, Heterodera glycines
  Coding regions on vcDNA: vcDNA=SeqID_51584; Strand=+; Position=1 -108,418-702
  Homolog annotation: Hit_ID=NP_741410.1; Match level="QueryCoverage =85%, HitCoverage=20%, E-value=1e-09, Identity=31%"; Hit description =lin-12 And Glp-1 transcriptional regulator, suppressor of hairless homolog., Lin-12 And Glp-1 phenotype L
MTDRRYPIRDGAQWTIISTDTIQYRFFEALRPVQNEEGVDYVLGARCSLLSVPCPLSSPSHSPTTASSPPFLHFLNGTTTVSYDSDQELEFPLSLVRDDGVIYATQLSVSYTRPREQQFRTGIQGTQPNS

SEQ ID NO: 125162 - protein, 22 aa, Heterodera glycines
  Coding regions on vcDNA: vcDNA=SeqID_51585; Strand=+; Position=1-66
CVRRPLWRNSFHLLPPIRFLSS

SEQ ID NO: 125163 - protein, 135 aa, Heterodera glycines
  Coding regions on vcDNA: vcDNA=SeqID_51586; Strand=+; Position=1 -69,118-456
MPKEGPKMATARGAKNLKQLAFEVERFVAANLTDANERQSAEQRMVVALGAKPPRRKAINYRTLKEQRTEAKRKTMEGEDGQQPEKDLWRMVKEGKVRKREGGRKRKNGSGVLKKWKKEKQKMSGRKKDKKMNAC

SEQ ID NO: 125164 - protein, 50 aa, Heterodera glycines
  Coding regions on vcDNA: vcDNA=SeqID_51587; Strand=-; Position=1 -48,94-196
DKLQWCGLAIHRRTLSLTVDYCRYRQRRPSISFPSSALRSSDHFRFICNT

SEQ ID NO: 125165 - protein, 136 aa, Heterodera glycines
  misc_feature (17)..(17): Xaa can be any naturally occurring amino acid
  Coding regions on vcDNA: vcDNA=SeqID_51588; Strand=-; Position=1 -154,223-478
TKTEAGLSYDDAFSRIXCKGSEEFNSPFKSEISSVEFLKMITQFAMRTLIREPFCALTSSAQNRPLRQRLFVSGRGIGQGSSLSVALCNLYLGWVERQICLHSPEMGLTNCAITLFCCRYMDDYLIISNKRERVEK

SEQ ID NO: 125166 - protein, 48 aa, Heterodera glycines
  Coding regions on vcDNA: vcDNA=SeqID_51589; Strand=-; Position=1 -79,157-267
DLNNCYTSFEHKVLDEILHKITPSDSKFVVVSVQVNSKIYKYRKTKTL

SEQ ID NO: 125167 - protein, 106 aa, Heterodera glycines
  Coding regions on vcDNA: vcDNA=SeqID_51590; Strand=+; Position=1 -125,532-610,1437-1553
  Homolog annotation: Hit_ID=NP_498638.1; Match level="QueryCoverage =62%, HitCoverage=11%, E-value=2e-20, Identity=71%"; Hit description =ALDH9B2, ALdehyde deHydrogenase (alh-12) [Caenorhabditis elegans]
MEIVKEEIFGAVMLILPFKTEQEAIARANATQFGLASGLCTTNLARAHRVAAQLKVGTVFVNTYNDAEILQIVFETMLPSNPKRSGAVEGQSTGGDHVDNDEQRLL

SEQ ID NO: 125168 - protein, 74 aa, Heterodera glycines
  Coding regions on vcDNA: vcDNA=SeqID_51591; Strand=-; Position=1 -133,170-261
MAEQFVQPETAEEQQVKAKKPRVDERFLWKITRGQFVLAIRLCSAFIGLEQFISQQRQDTSAGRWASGDWTRDV

SEQ ID NO: 125169 - protein, 104 aa, Heterodera glycines
  Coding regions on vcDNA: vcDNA=SeqID_51592; Strand=-; Position=1 -18,193-294,501-560,622-756
MHPSIFQVKGHQRFYALVAFHRTSVVLSGLNYAQAKNVEKIIAQISGLNPRRRLETAPSKAFATAAELLEYHQESNTTSETTNIVLLIHDGFNTDMGNETFEAM

SEQ ID NO: 125170 - protein, 19 aa, Heterodera glycines
  Coding regions on vcDNA: vcDNA=SeqID_51593; Strand=+; Position=1 -34,394-419
MAIIQGTCGGRAYQSQCDN

SEQ ID NO: 125171 - protein, 147 aa, Heterodera glycines
  Coding regions on vcDNA: vcDNA=SeqID_51594; Strand=+; Position=1 -169,281-555
MTKGVNVEKCQKFKERRGDSMRRIEENLWATVKLVKTEYAWAGEKCETTVNDYIEKEPSDLYWATHAPVGEFLAEITDDAIVVESEQSVFYFEKENTGREGIIGVPEDAYKMSNDVFIIIHQIDHRFKREAKKKWSLTEKKGQLNRK

SEQ ID NO: 125172 - protein, 192 aa, Heterodera glycines
  Coding regions on vcDNA: vcDNA=SeqID_51595; Strand=+; Position=1-579
  Homolog annotation: Hit_ID=NP_726915.1; Match level="QueryCoverage =96%, HitCoverage=39%, E-value=6e-11, Identity=30%"; Hit description =CG32774-PA [Drosophila melanogaster] gb|AAF45929.2| CG32774-PA [Drosophila melanogaster]
MQSTKAPLLSTTQITPKVREVITTEAPPITTTQTVKIELTTKPRKIEPKVKVETPKSFSKGIQFKRVRNEQQIYKIMGIRKGTILTTTIPFISTTQAPKITKPTTVSSVTVPTKSSQNVKTTMKQKVDTKLPFIKTTVKPTVTVTTKKTSKTMPVTVTLAPKTEKTVTTPKPIFTKVMTTVATTTTISPIKL

SEQ ID NO: 125173 - protein, 95 aa, Heterodera glycines
  Coding regions on vcDNA: vcDNA=SeqID_51596; Strand=+; Position=1 -183,987-1091
MSDRSSSPICTGNPMIDVARLLLMNTSPEVRKELEKDGRLLKQYLEVHRTEGGQNQFDLEKTGDCVQQIDAMLGEVRLNTNPLPWYNNHKRIFFE

SEQ ID NO: 125174 - protein, 131 aa, Heterodera glycines
  Coding regions on vcDNA: vcDNA=SeqID_51597; Strand=+; Position=1-396
MWIIRWSQQTTKLKNAISNEENDVSNENDGIGSEDNSSNDVVSNGEENLTVTIRQIESAMPTSLLFVMILLNYLIYSFQRTDEMDRNMKDIAASVRLLLRQQRGRWVAGRWLIGLLMGGQCFVAERIQEFL

SEQ ID NO: 125175 - protein, 421 aa, Heterodera glycines
  Coding regions on vcDNA: vcDNA=SeqID_51598; Strand=-; Position=1-1263
MITRSLHRNVNQRRVVGENEEQNGGNSQQNNGNNHHSEPMMEDDEIRRALLDVNGQQNEQNQQLNADEERRLLDQSNLNGLRNLGENFGWNLGNNRQNENAAHMAQRINNFMTSTPNISPGHQARQNFNFVDNRVNRRVVERPRDARGRFIRIENNDEQEMPNFLQNPPRNPQIPPVNQQQANNLGNFGIPNNPNLIQPLQFGMNGMYAPGAWPQQPMMAYPPQNFQMFYPPNFVPQMPAQNFVPFMNNWAPNAFQPQIPQPAIQPMRAQPTNVVQQQQIPPPTNQAMAQQNPQQEVNRQTTGLSGIEYAMILDRLPDIKGNEGSDSIRNFFKKFSQYTSEWPNKKRIESLEAKLSGRAERAYNAALATEPFAYENIKRNILQQLEETDCREMSAFDDLMNGVYRKSGENLDDLANRISSL

SEQ ID NO: 125176 - protein, 45 aa, Heterodera glycines; identical to SEQ ID NO: 124814
  Coding regions on vcDNA: vcDNA=SeqID_51599; Strand=+; Position=1-531

SEQ ID NO: 125177 - protein, 94 aa, Heterodera glycines
  Coding regions on vcDNA: vcDNA=SeqID_51600; Strand=+; Position=1-566
LFEYPKRTLEKIDFFVFGAVPPNRCAQIYGETESFRNSFPIACTLILRWIFAPHNCLSTPNGQLKKSIFLFSGQYPRTDAPRFMGRPNPSGIAS

SEQ ID NO: 125178 - protein, 124 aa, Heterodera glycines
  Coding regions on vcDNA: vcDNA=SeqID_51601; Strand=+; Position=1 -91,324-607
MASKESDIWNFFTKISSEVAKCRLCENQLAYDIWAQPKSPCGISIPSTISGDPDSDFLSKIEAELACFKAGQRMEVNGDLFSWWNQNTGRLPELSKLARMVHSIPATSVSSERLIWLWFDLILV

SEQ ID NO: 125179 - protein, 98 aa, Heterodera glycines
  Coding regions on vcDNA: vcDNA=SeqID_51602; Strand=-; Position=1-297
  Homolog annotation: Hit_ID=CAE75230.1; Match level="QueryCoverage =100%, HitCoverage=99%, E-value=4e-14, Identity=37%"; Hit description= Hypothetical protein CBG23181 [Caenorhabditis briggsae]
MWKRKWKKNRKWKRKWKRNRKWKMNRKWKRNRKWKRKWKRNRKWKRKWKRNRKWKRKWKRNRKWKRKWKKNRKWKRNRKSNKGKEEGTKKEESKRKRE

SEQ ID NO: 125180 - protein, 416 aa, Heterodera glycines
  Coding regions on vcDNA: vcDNA=SeqID_51603; Strand=-; Position=1 -667,763-1345
  Homolog annotation: Hit_ID=AAS07042.1; Match level="QueryCoverage =68%, HitCoverage=20%, E-value=2e-17, Identity=37%"; Hit description =minus agglutinin [Chlamydomonas reinhardtii]
MRRELADKPAKVELTKGISVLLRRGGEDEDGEVVDTPPRPPAPPPPPPPPPGRRPWRGPNLPPPPPPPGRRPRLPPSPPGRAPSPPGSPPPRPQRPPRPSRPSRRNGRLEQWEKRRHDIQRRRPVVRDLLAEAAAAPLPESDTDDEYMLESGLALPTPSQYYGDLPVLPYQHQIDQMDTAAQHRIAIRRKLKKDEAYDDDDSDRKKYRVYYPPSPPRLPLPPPRFTTKSRAASVEKEPEFPLDPRPSTSRQAGYLPPPKIIPKPEPTKRPVPYRIPKREPKIVEQQPQPLQQPLPASAVEEEMPTIPPPRRGTKRHYPVNGENDGEVRIRKRVRQARRVRVQYSPEPGPSTSAQRDEQQQQRELFAIPSNQLTMTQRIERLHIKCNHYADRMGVRGNTINTANGKPLAHSNLRMAL

SEQ ID NO: 125181 - protein, 75 aa, Heterodera glycines
  Coding regions on vcDNA: vcDNA=SeqID_51604; Strand=-; Position=1 -32,203-278,625-709,1252-1286
MISKQLAQWKIILFLAIYYLICAFVFTPCLTKFECAVEALDGKLGTFLAKVAHHRRLILYCLMTHLQKLLIIFFE

SEQ ID NO: 125182 - protein, 37 aa, Heterodera glycines
  Coding regions on vcDNA: vcDNA=SeqID_51605; Strand=+; Position=1 -10,116-219
MNLIKVISLKHYIKWPSDVINLIISNNTSSLIRLRLV

SEQ ID NO: 125183 - protein, 358 aa, Heterodera glycines
  Coding regions on vcDNA: vcDNA=SeqID_51606; Strand=+; Position=1 -53,1044-1319,1370-1790,1882-2162,2217-2262
  Homolog annotation: Hit_ID=AAL78214.1; Match level="QueryCoverage =39%, HitCoverage=74%, E-value=4e-10, Identity=29%"; Hit description =putative esophageal gland cell protein Hgg-20 [Heterodera glycines]
MRQWKFYCHKTKFLRFLSFISGDCWLCVFNLLSPRQLGFGIAMISHRFDFYVDEHFKTRKWTLGLIRIWSKIGENGTKKMKIVNGYGKRMPIPQIQMPRKVIGFNYISIYYIDQNAIAFLRHFHQLFATCPINLAIETENDRILVFILRNIWPMIGKNIHFMELSAGIFHRFRQFVPSILNDCPSLRFVCFNFHNLFAEFPCDDNAMASDGQAVAKWLFTPLQNDVPKMYKCWLKNDDSSWSSKIEAFKAAFANASSPVNFIVTIWFSFASSVVPFDLTNELTREQLTLKRTDYSNRFLLIRCPISRDASKWAKWEKEAIDWRICGQCNRIEIQIYVERQIGDGLLDATPGTSDRQQK

SEQ ID NO: 125184 - protein, 99 aa, Heterodera glycines
  Coding regions on vcDNA: vcDNA=SeqID_51607; Strand=+; Position=1 -106,583-775
  Homolog annotation: Hit_ID=XP_421743.1; Match level="QueryCoverage =95%, HitCoverage=7%, E-value=1e-39, Identity=73%"; Hit description =PREDICTED: similar to hSLK [Gallus gallus]
MKNNERRDSFIGTPYWMAPEVIICETFKDQPYDCRADIWSLGITCIEMAQMEPPNHNMNPMRVVIKVQKSEPPTLVQPHKWTPEFSDFLRKCLVKNVDS

SEQ ID NO: 125185 - protein, 40 aa, Heterodera glycines
  Coding regions on vcDNA: vcDNA=SeqID_51608; Strand=-; Position=1 -75,140-315
  Homolog annotation: Hit_ID=NP_872232.1; Match level="QueryCoverage =95%, HitCoverage=39%, E-value=2e-09, Identity=68%"; Hit description =predicted CDS, putative secreted or extracellular protein precursor (5U483) [Caenorhabditis elegans] emb|
SFTLRTCAMKSTGCIAGTRTCRFSGGKGSCQRCEGDLCNL

SEQ ID NO: 125186 - protein, 110 aa, Heterodera glycines
  Coding regions on vcDNA: vcDNA=SeqID_51609; Strand=+; Position=1 -34,862-1157
MISKKLANLENKFNPSDVCRAIDRSPQFHSLCLRSSVVKQKGFIPKHLRPPWLDSSLFEDNKLKAEMKVSANGCYACYRGRKASNGTNEDEDYCACVVRYSQRKGWAYYT

SEQ ID NO: 125187 - protein, 111 aa, Heterodera glycines
  Coding regions on vcDNA: vcDNA=SeqID_51610; Strand=-; Position=1 -111,389-532,792-872
  Homolog annotation: Hit_ID=CAE56942.1; Match level="QueryCoverage =80%, HitCoverage=67%, E-value=8e-10, Identity=35%"; Hit description =Hypothetical protein CBG24787 [Caenorhabditis briggsae]
MNSKSTESGRNSSPLSAEDEPPVKEIMWPPHGHVYQQEFMLPAYCKPKLIPLKSVTLEKLEKMQAENAEKLRKMEQEAESEQQQQDGSKHENAPGSVGGQSGPPDIWKAEE

SEQ ID NO: 125188 - protein, 146 aa, Heterodera glycines
  Coding regions on vcDNA: vcDNA=SeqID_51611; Strand=+; Position=1 -118,220-542
MSYAIMKMSIVLLLVPIALIFAFLLFKINNSLPTNTNSKSDTFIVKKFKESELAHRLLDGKFGIEIGASSHNPFGLDTLNVDYTDDPTAFFQQDQIKNSGLQLMTKTVRASPIVLEPFHTIVFIHFKIFDTDAKSDQKNWSNEQKD

SEQ ID NO: 125189 - protein, 105 aa, Heterodera glycines
  Coding regions on vcDNA: vcDNA=SeqID_51612; Strand=-; Position=1 -87,345-428,609-701,752-802
  Homolog annotation: Hit_ID=AAK50002.1; Match level="QueryCoverage =93%, HitCoverage=14%, E-value=5e-10, Identity=36%"; Hit description =ORF73 [Human herpesvirus 8]
PLIVPFIQDDEIKRQAEKIKLLKQELEEKDAEIKRQAAEIKRQAAEIKRLKQQLEEKEKKLLEQEEKLAQQGQKILELENEVGALRKIVNAMSEQFMPKDKHQKM

SEQ ID NO: 125190 - protein, 77 aa, Heterodera glycines
  Coding regions on vcDNA: vcDNA=SeqID_51613; Strand=-; Position=1 -87,146-292
MAMLNASFDKFNISNSDKIRTQRLISMSESCEEWKTCTKRETYALLDQELNKLLTTSPPEKMEANFMGISTKSKMEI

SEQ ID NO: 125191 - protein, 44 aa, Heterodera glycines
  Coding regions on vcDNA: vcDNA=SeqID_51614; Strand=-; Position=1 -93,605-646
MRRMDKDPMQIKAKKHKIEFAEDITPQQKQKLSNDTQNVWIEQV

SEQ ID NO: 125192 - protein, 118 aa, Heterodera glycines
  Coding regions on vcDNA: vcDNA=SeqID_51615; Strand=-; Position=1 -157,542-741
MCQSKGRKRKMVEAKKEGIDEKKAAQCFTVSKILAMFVGRDKSQFYYIDWGEEYVGQESWEPLSYINALEMVAEFVERSTIDCVLKALLGEQSVPEHIAKKLRNSDKFKECTDEFKYF

SEQ ID NO: 125193 - protein, 212 aa, Heterodera glycines
  Coding regions on vcDNA: vcDNA=SeqID_51616; Strand=+; Position=1 -48,92-367,413-612,1095-1209
  Homolog annotation: Hit_ID=NP_001004509.1; Match level="QueryCoverage= 54%, HitCoverage=8%, E-value=5e-20, Identity=40%"; Hit description =si:busm1-180o5.3 [Danio rerio] emb|CAD60788.1| novel protein similar to DNA polymerases [Danio rerio]
MTHSGDMWQRIQVLELAKAFECGYRVDRFYRAWHYEAADDDLFKGYVRLFLKLKEESSGFPKGVESDEQKRQWAEEYKEKYGIAIELCRVQKNPGLRYISKLMLNSLEGKFSMRNSLSKNAVIDRESAFYELACDHKVELCDIVEYSGDAMRVIYRDKEEFVTEHKSSNIVVSLCPTRESKVVTRESHKMYKPVCQKGIIDEELNVMSFGFC

SEQ ID NO: 125194 - protein, 251 aa, Heterodera glycines
  Coding regions on vcDNA: vcDNA=SeqID_51617; Strand=+; Position=1 -164,210-261,316-346,695-867,1264-1294,1337-1365,1412-1469,1511-1562
  Homolog annotation: Hit_ID=NP_741797.1; Match level="QueryCoverage =98%, HitCoverage=42%, E-value=3e-73, Identity=62%"; Hit description =MEChanosensory abnormality MEC-2, stomatin-like protein required for mechanosensation (51.9 kD) (mec-2) [
NLGFCGFLLTILSVVFLLITAPFSLFFCVKIVKEYERAVIFRLGRLIPGGARGPGLFFVNPCLDTLFFVNPCLDTFRKVDLRVLTFDVQPQEVLTFDVQPQEILSRDAVTVAVDVVVYFRISNATISVTNVEDCSRSTKLLAQTTLRNVLGTKTLAEMLSDRDHISLKIQETLDEATYPWETLDEATYPWGVKVERVEIKGVKVERVEIKDVRLPFQLQRAMAAEAEAREARAKVRAMAAEAEAREARAKV

SEQ ID NO: 125195 - protein, 170 aa, Heterodera glycines
  Coding regions on vcDNA: vcDNA=SeqID_51618; Strand=-; Position=1 -36,421-486,542-598,664-729,784-843,900-959,1015-1074,1131-1238
  Homolog annotation: Hit_ID=XP_323972.1; Match level="QueryCoverage =68%, HitCoverage=17%, E-value=1e-09, Identity=40%"; Hit description =predicted protein [Neurospora crassa] emb|CAD37056.1| hypothetical protein [Neurospora crassa] gb|EAA2962
MRQQTGRENWGGFYTPGGTETTAAANARRGQKRRVFKLKGNVEMNEADRTANEELDNVINISANANANNRTNGEGVAVAVNDGGASADTGTNTETVAVAVNDGDANANNETNCQGAAAGMSDGGANANNGTNAETAATAQNNGLEGNADNGTNGANANNGTNTETVSNCN

SEQ ID NO: 125196 - protein, 102 aa, Heterodera glycines
  Coding regions on vcDNA: vcDNA=SeqID_51619; Strand=+; Position=1 -189,908-1027
MLKLNFIIIFFNILLFISILAVDDLDFLDDLLNDLKTTTTQNLLKKQKFEENNGGFPSEQGFKVLTSRQIIVFDPFLKRDNPSPSKFVDFVQLGAPGDKGLA

SEQ ID NO: 125197 - protein, 1102 aa, Heterodera glycines
  Coding regions on vcDNA: vcDNA=SeqID_51620; Strand=+; Position=1-3307
  Homolog annotation: Hit_ID=NP_498959.1; Match level="QueryCoverage =76%, HitCoverage=39%, E-value=4e-60, Identity=26%"; Hit description =zn-finger, CCHC type and RNA-directed DNA polymerase  and Integrase, catalytic domain containing protein
MQQAAPVQHLQNDRNEQPQNIENRPINTANTGVAENSVNDGEILAHTMNSDQILHAVLNVGSANRQSGHGQDEENVENQDLAIHPNLTQQHGGLRMRFRRLPNLEENSERELWQAGNENNSGHHSHHILNRNFLRTSTPNNEHIIHELHIQHPRQNPPNIQANPNFVRQNLQKTVTANQRQANPNVLIPPPQVIQQPIAVYPPVQPPIPETYWGYPAPYYPHPPPPMGYPNQQMFGNANTKVPQPTQIRQPYNHQIPTQINAQQTALNGLECVLILDKLPDIKGNEGNDSIKSFFKKFSQYTSDWPNKKRIDSLESKLSGRAERAFNSALANEPFIFENIKRHILQQLEATDCHEMAAFDELMQGIRRKPREGLDDLADRIVSLVRRAYPGLTRNLADEYSIKHLIRSFDNAELALSLELNRRPGMSFDEFVALAARAETTQNAARRANSDRTQQNFGRSQPHRQYDGPMAKQSTNAFEPNKFQRFNENRITCQSCGREGHVARNCFKRFADQDQRRYFGQNQNATGANRAQMPTHSNPNVSQKSEQNQFGQRQQHQQSRNFLKQNFLVEQNEKQVESSNVQCAGVISNTPEMLDFFRKFWTKCNETVDDGQKEAFPIGKIMAIKVKIYDQSADSMMDSGAQISLVQASFVKHLLENSTLQVENLKIFSKTRNVVDINGKIVECYGIIILPITRKGCEAVDVPFHITDAPIGLPILFGTNAMGLLGFKLFDSQNGELIEFECADNKSDYVRIVYSTLIEPHSTKFVELSVSPKFSGKDFILSPNDERNDLRVEPSLNKERRGKTIAAITNFSQNALTLKENEEVAVVEAIEDVADVENCLGDSWLFSEPSEVKMEKPKPENEETNAKFGLLSKENSEILENLLNNFSRIFAFHDYELTQTEMVKHQIDTGEAIPVKQRMRPVPYAYREKVAAMIQEYLGRGIIRHSISPWASPIVIVPKKDGSLRFCVDYRGLNAITRKDCFPLPNIERTLLMLGGRKFFSTLDFLSGYWQIKMAKNSIEKTAFSTEFGLHEFTVMPFGLCNAVATFQRFMSQLFGSKLNDFVFVYIDDVLVASESFEQHLIHLKFVFEQIQEAGLKIKISK

SEQ ID NO: 125198 - protein, 1400 aa, Heterodera glycines
  Coding regions on vcDNA: vcDNA=SeqID_51621; Strand=+; Position=1 -719,870-4330,4351-4373
  Homolog annotation: Hit_ID=NP_498959.1; Match level="QueryCoverage =80%, HitCoverage=54%, E-value=1e-155, Identity=31%"; Hit description= zn-finger, CCHC type and RNA-directed DNA polymerase  and Integrase, catalytic domain containing protein
RLNENRITCQNCGREGHVARNCFKRFGDQNQQRYFGQNQNATGANRAQMPTHSNPNVSQKSEQNQFGQRQQHQQSRNFLKQNFLVEQNEKQVESSDVQCAGVISNTPEMLDFFRKFWTKCNETVDDGQKEAFPIGKIMAIKVKIYDQSADSMMDSGAQISLVQASFVKHLLENSTLQVENLKIFSKTRNVVDINGKIVECYGIIILPITRKGCEAVDVPFHITDAPIGLPILFGTNAMGLGKDFILSPNDERNDLRVEPSLNKERRGKTIAAITNFSQNALTLKENEEVAVVEAIEDVADVENCLGESWLFSEPSEVKMEKPKPENEEANAKFGPLSKENSEILENLLNNFSRIFAFHDYELTQTEMVKHQIDTGEAIPVKQRMRPVPYAYREKVAAMIQDYLGRGIIRHSISPWASPIVIVPKKDGSLRFCVDYRGLNAITRKDCFPLPNIERTLLMLGGRKFFSTLDFLSGYWQIKMAKNSIEKTAFSTEFGLHEFTVMPFGLCNAVATFQRFMSQLFGSKLNDFVFVYIDDVLVASESFEQHLIHLKFVFEQIQEAGLKIKISKCQFCAEELKFLGHILTRNGIKMDAEKTKPILELPVPKSKKDLHSFLGFMTYYRKFIYSFGSVAAPLFKLLKKDVKFQMGEAETQAVSTLKEKILSEVVLYFPDFKAAMENPSRKFIIMTDACKTGISAVLCQSDNENRIRPIYFASRQCNNFESRYCPTELEALAVRFGVKKFSQYITMIPTKVLTDHKALVPMFKSKSETGNARVDKWIMELSARFILEIEYNPGKANIIADVLSRSGALKPRELAEKIFRVEQVDGNISASVPKMEMIEWVNAIKESELGNLYQFLEKRKLPEDKRECQRLFDTIHKFTLIEGLLYFHDSNYGNLRLFVPQKFRNKLIEERHEGKCAGHLSGKKIFGQLAERYFWPNMRADCVNAVLKCRICAHTRNPRANAPELRPVITAEPFELICMDILSIGMSERGNRYVLVMVDHFTKYLITAAIPDKSVESVAKAFVEQLVLVFGKPKRIHSDKGAEFVNKTMEEISQILGVEKSTTAGYDPNANGQAERANQTILNMLKRSTDSNWSWDDRLPFVTFAFNITPSETTGFSPYNLLFGRPVNFPSSDNVNFTVNPSYTIDEESYLQLFRENLLKILENAKNNSDKSRERMEKWFNSQPKVTLQKYQKGERVMVIFPGANKRSTHKKLKWNIFGPYQILEISKSSAKVTPADKKNADPICVPLERLIRAPDGLPNISTTPRGKNAYKNVLNVMTILIFEEKSMEFEQENFLGKTKTSSGTMNFSEEEENMDIAEAEIKWTMTCEGGGHVLCKKLLAGDLDPVLSKTQGIGAMVVQTPLQGLITLFILRSNVSMSASKDLLKVANQLEKLGHFDFGP

SEQ ID NO: 125199 - protein, 221 aa, Heterodera glycines
  Coding regions on vcDNA: vcDNA=SeqID_51622; Strand=+; Position=1 -43,101-321,612-839,1023-1082,1167-1280
  Homolog annotation: Hit_ID=CAE62259.1; Match level="QueryCoverage =97%, HitCoverage=68%, E-value=1e-43, Identity=29%"; Hit description =Hypothetical protein CBG06318 [Caenorhabditis briggsae]
MKVAFFLNGTPVQSSDRVQVLYQNGFALLSIAEVTEQDAGYYVCQAENEIGSAETSATVVVVPRTGDGKFLAESEVYEHDVEDMRELQQLLASALAQVNNFGFVSLTIHPTYPEDAGVYSCMLTNSLGQAQADANLSTISSGDIMSDPLHAGALPTIQAHEEYQVHMGPMFQPERPEEFQSVEQPRFARPLDGQVEVEQEQPVHFECRVQPANDVVRREMK

SEQ ID NO: 125200 - protein, 419 aa, Heterodera glycines
  Coding regions on vcDNA: vcDNA=SeqID_51623; Strand=+; Position=1 -218,394-488,885-1174,1775-2036,2214-2442,2500-2667
  Homolog annotation: Hit_ID=NP_503758.2; Match level="QueryCoverage =100%, HitCoverage=75%, E-value=1e-119, Identity=31%"; Hit description=prion-like Q/N-rich domain protein PQN-43, Prion-like Q/N-rich domain protein, kettin (468.7 kD) (pqn-4
KSRIFSDPQHPSSYARIQEMEAPKPLPEEVPEPDKQSPQFTKALSASAGHVAEAESVYLEAQYGPLDDNSIVCEWLFNGQPLMKAHRFVLSQDFGFAALTILYIGTYTLLIRNAAGESSSSVELSCEGKAALLSDPIHPQSVARIAELEAPRPLPEEPAEPEKQAPQIVKQLTVATQGEGGPAETQALHFDAQYTPTDDNSQAQTSASVQIEGGALILEDTQHPESFRRIQELEAIRPAEPEEPEIVPEAPQFTQELTGLVDDLADGMPLHLDGTVMPITDPKLRIEWFFNGQPLQFSSRIRTIHDFGYVALEFAHLLPSDSGTYTCRATNEVGQAESSITIECETKRNLYLDSQHEQSWQKIQEIEGRQPTKEPSPELHFLPPTFIVPLSNFEDLVEGDVVRFECRLQPVNDPTLKAI

SEQ ID NO: 125201 - protein, 50 aa, Heterodera glycines
  Coding regions on vcDNA: vcDNA=SeqID_51624; Strand=-; Position=1 -113,258-297
MRATDCGWIGSLSSAALPSQLNSTDEEDSPAAFRINSVESVSADYPITDQ

SEQ ID NO: 125202 - protein, 419 aa, Heterodera glycines
  Coding regions on vcDNA: vcDNA=SeqID_51625; Strand=+; Position=1 -156,223-405,454-614,747-833,901-985,1080-1163,1213-1542
  Homolog annotation: Hit_ID=CAE62259.1; Match level="QueryCoverage =99%, HitCoverage=78%, E-value=1e-102, Identity=29%"; Hit description= Hypothetical protein CBG06318 [Caenorhabditis briggsae]
NWTRTFENVELEHLGRIVQLVGHVEPEGDPNMTIAWFLNGMPLQNANRFRQEKNFGEVVLHILEKNFGEVVLHILHVLPHDSGVYTCTASNAQGEATTSATVKVAGYEKILKDVQHPDSWNQIQILEAPKIREEIEIEEILEAPKIREEIEIEEVKEKPRFLTQLESVADAPEGTPVRLEATFQPARDNDLICTWEFNGSPLGASQLIRTRNDLGWAALDISAVNMDHAVNMDHEGVYTLKIVNSEGEAATSASIKVAGVGNVAGVGNILGDTQHEESWRQIQILEAPLERPPSPPALEYPPPTFQQQISDILERPPSPPALEYPPPTFQQQISDIECDEGDVVEIRMLSMPDDDPNVENQWVRERKCPLVHARKYANRETFGLCAFDVGYTIPEDERPVNLRYWGKPEKNGTSKKDSP

SEQ ID NO: 125203 - protein, 108 aa, Heterodera glycines
  Coding regions on vcDNA: vcDNA=SeqID_51626; Strand=+; Position=1 -231,660-755
MHRAECQRRGEHRGDHRSADTGRAGGADGAATAGGNTGRRGGRIRALGVPRDAHQRPATAGALAEERTTAAGRQSLCVVDNLEHHLRQFTKAQLALTAEDAWQPGKMI

SEQ ID NO: 125204 - protein, 236 aa, Heterodera glycines
  misc_feature (234)..(234): Xaa can be any naturally occurring amino acid
  Coding regions on vcDNA: vcDNA=SeqID_51627; Strand=-; Position=1 -101,250-382,732-852,912-969,1000-1176
  Homolog annotation: Hit_ID=CAE57468.1; Match level="QueryCoverage =72%, HitCoverage=30%, E-value=2e-37, Identity=45%"; Hit description =Hypothetical protein CBG00434 [Caenorhabditis briggsae]
IDGIGVHWYTLGGHSEQDKFHAQHPDKMIISTEACTGFIFHSGPRLGNWTRGWQYGWDIVQNLRHWSGGWVDWNLCLDMNGGPNWVHNFVDAPIIVNAERDEFYKQPMFYFLAHFSRFMPPGSVRIGSRFMPPGSVRIGSTLFASDSVQHVSVTTPHGHKVLVLINSATNTLFASDSVQHVSVTTPHGHKVLVLINSATNPFKIRIDEVGRSDGEETPVIELGPEAIMTLIWKXNI

SEQ ID NO: 125205 - protein, 200 aa, Heterodera glycines
  Coding regions on vcDNA: vcDNA=SeqID_51628; Strand=-; Position=1 -204,1055-1196,1394-1533,1583-1654
  Homolog annotation: Hit_ID=NP_741501.1; Match level="QueryCoverage =93%, HitCoverage=37%, E-value=5e-33, Identity=39%"; Hit description =glucocerebrosidase (4S421) [Caenorhabditis elegans] emb|CAD42642.1| Hypothetical protein F11E6.1c [Caenor
KGCQRRYSPGQDSFVCACDVSHCDAFEDGSVDEVPSDTLVTYSSDRKWKRLERKEMPMRAKGAATEGAVLRLSVDPSDKYQTILGFGGAFSDSSGINLNALSAPIRRHLLEAYFHSAGIRYSFGRVPIASTDFSTRQYSYVDQEDDFDLSTFSLAPEDFEQKIPFIKEAVRLSGIPFIKEAVRLSGEKFRLFACPWSVPF

SEQ ID NO: 125206 - protein, 19 aa, Heterodera glycines
  Coding regions on vcDNA: vcDNA=SeqID_51629; Strand=+; Position=1-58
GPGSRSRVLKSSGPGPGRA

SEQ ID NO: 125207 - protein, 42 aa, Heterodera glycines
  Coding regions on vcDNA: vcDNA=SeqID_51630; Strand=+; Position=1 -85,358-401
MLLCSKISHFLLLLLGALLLLSFISMGNVSKNPQNGFAKNTK

SEQ ID NO: 125208 - protein, 154 aa, Heterodera glycines
  Coding regions on vcDNA: vcDNA=SeqID_51631; Strand=-; Position=1 -148,195-415,470-565
MNQQQVIKTKRNNDKLVHDGALYVFHKFSNDGLKKFWRCEFHGPADQCKGRLHTDLNNVVQKLVGVHSCDMNAAHVECQRLVTGLKRRAAETCEAPATIRAQVLQNTCTPVLASFPSKDATKKVIKRLRREENAPRVEPLNLEQLEITGYLSCL

SEQ ID NO: 125209 - protein, 28 aa, Heterodera glycines
  Coding regions on vcDNA: vcDNA=SeqID_51632; Strand=+; Position=1 -39,121-168
MAVRKRRYENVQKANRRHLALSNDTINV

SEQ ID NO: 125210 - protein, 300 aa, Heterodera glycines
  Coding regions on vcDNA: vcDNA=SeqID_51633; Strand=+; Position=1 -160,319-453,697-759,812-867,935-1013,1067-1126,1414-1512,2390 -2458,2513-2593
  Homolog annotation: Hit_ID=NP_509546.1; Match level="QueryCoverage =82%, HitCoverage=82%, E-value=2e-74, Identity=54%"; Hit description =tetraspanin family member (tsp-11) [Caenorhabditis elegans]
TNLKNNGHFKIPFLEYLLNSKICVICCLVCVVLGVWLIFDRYAVDNLATAIGHQFKASKPTAVRQIGYLLLFGGIAVIVVASLGCCGAAKEWRPLLCCYASCLMVILAVEIAAGIYAAMHSHHSHMFDKDFRQILRASLRMYNYNGTENGVEGSDSMLVKTAWDKLMQEKSCCGVDSRVGEFQQKSCCGVDSRVGEFQQSGWYQMTKGRHEFPPACCPPKKNGKLAPSCPTVFRFGEGCHDHLYYEHYVRIAFAISFLILSTIFKLLPHLPFVSTIFKLLPHLPFVQLFCVLFTHKLHFR

SEQ ID NO: 125211 - protein, 36 aa, Heterodera glycines
  Coding regions on vcDNA: vcDNA=SeqID_51634; Strand=+; Position=1 -86,126-150
MAPTLHISITQCNNNSTMMKMAWNYLPLRGNGSLFY

SEQ ID NO: 125212 - protein, 81 aa, Heterodera glycines
  Coding regions on vcDNA: vcDNA=SeqID_51635; Strand=+; Position=1 -113,753-884
MGRTVKDEEIPEEKEQKGDETFGRIPDSSIPKSLILITLPPVGAAEETGRTPVVVKSKQGSEGRKSRAVPNRPTKGQGRSS

SEQ ID NO: 125213 - protein, 362 aa, Heterodera glycines
  Coding regions on vcDNA: vcDNA=SeqID_51636; Strand=+; Position=1-1086
  Homolog annotation: Hit_ID=NP_912739.1; Match level="QueryCoverage =77%, HitCoverage=22%, E-value=6e-38, Identity=34%"; Hit description =unnamed protein product [Oryza sativa (japonica cultivar-group)]
MYNPQGIITLAQHKVAELEALADIDWRLHSCFNLSCVHFSLPDPPTSIAKNTDAAIEEFFFGDDDLNLPPGQPNPRPQPNTPPPLNSDQQKVFDAVLLAIQSNPRDSTVPRRFFIYGDGGTGKTFLFGQIIRRLRKAPYTYKVLATASTGCAAILLPYGKTAHSTFRLGREVSLDKLPSIPLESFFARRIREAQLIIIDEITMLHNTVIEVIDRVCKEMAIRQHKDLLFGGKTVIFSGDFKQSLPVVPHEGLTAQVTACFQTSPLFGQFTTMKLTINQRLGQGQQAYLQMCRQIGLGETGEHFWIPPQFLVKSKEELIDYVYPNFQQLLGNDKELLNRLILAPHIDTCDEVNEIMMANVPGQ

SEQ ID NO: 125214 - protein, 37 aa, Heterodera glycines
  Coding regions on vcDNA: vcDNA=SeqID_51637; Strand=-; Position=1-111
MSLQPSPFNGSPEKPDLHWQSKPPTKFVHTVFACGHT

SEQ ID NO: 125215 - protein, 115 aa, Heterodera glycines
  Coding regions on vcDNA: vcDNA=SeqID_51638; Strand=+; Position=1 -216,690-821
MQIVKIWMALFAVNAMMGLSKCQTHRPAPNAKTSMSATTKQCAIMQQPVQMWRAATFANVWTVSLAMAKSAMRQFCFQLGRNAIFLEFQTSKWIPKLCNWTCQCKYLDKIIPNFT

SEQ ID NO: 125216 - protein, 29 aa, Heterodera glycines
  Coding regions on vcDNA: vcDNA=SeqID_51639; Strand=+; Position=1 -61,447-475
MCQLIRLSSSQLLLLLPKICALIPIVLGR

SEQ ID NO: 125217 - protein, 19 aa, Heterodera glycines
  Coding regions on vcDNA: vcDNA=SeqID_51640; Strand=-; Position=1-58
DCWGREFESHRASYLLCST

SEQ ID NO: 125218 - protein, 110 aa, Heterodera glycines
  Coding regions on vcDNA: vcDNA=SeqID_51641; Strand=-; Position=1 -118,178-392
MPGKKNGVLCKKPANNGQNNELFDKICPNMATKWPVARKDRQPISPPLVAQSIIKRSGQLGQPGEPGLRVLEGQARETAAGQSDGLGEFDGKNQLGQIAASGALGYRQHG

SEQ ID NO: 125219 - protein, 128 aa, Heterodera glycines
  Coding regions on vcDNA: vcDNA=SeqID_51642; Strand=+; Position=1 -26,4359-4459,4751-4879,4973-5063,6293-6330
  Homolog annotation: Hit_ID=BAC06575.1; Match level="QueryCoverage =95%, HitCoverage=38%, E-value=3e-61, Identity=92%"; Hit description =As37 [Ascaris suum]
IAQKIKKFVVPQGAPTFTRKPQILQKTSDSGDPAIVFDIGFQADQNPEVIWLNPKGKKMKESSRIKFGLTPDGGANTYTAQLELKNYKAKDSGTYTCNIKNDAGEANVELTLNIEGPLDDAGDDESQA

SEQ ID NO: 125220 - protein, 88 aa, Heterodera glycines
  Coding regions on vcDNA: vcDNA=SeqID_51643; Strand=-; Position=1 -106,461-621
MPKPKLLVDQLELLLNTGNGADVYFLVAEDEEKEATPSNPVVVTDICAVPFKAMLRFIYTNNLSVLDGQNAMAVFYAGQKLKFISPMD

SEQ ID NO: 125221 - protein, 68 aa, Heterodera glycines
  Coding regions on vcDNA: vcDNA=SeqID_51644; Strand=-; Position=1 -57,694-843
MAGSPESDVFCKICGLRVKALESKFVCKKCGKKMHLDDICYCHKATTKCHCNARKCCDTKPEECGSFI

SEQ ID NO: 125222 - protein, 160 aa, Heterodera glycines
  Coding regions on vcDNA: vcDNA=SeqID_51645; Strand=-; Position=1 -201,592-873
MRQLDASILFNFPSLRFVGFIGDILPEFPPADDDDIAANASSDGQAVAKWLFSPRHDNLPKLLLVTIAFSIASSPVAFSICVVFPYSFPFPVVLPFEHTNEFTQEKLRLSKKFVNVFKLIRCSIAAADDEKWMMEIDEVIRGQKNSKIWICIGDDGVNNG

SEQ ID NO: 125223 - protein, 176 aa, Heterodera glycines
  Coding regions on vcDNA: vcDNA=SeqID_51646; Strand=-; Position=1 -138,183-467,518-625
MVEIETVIFPFENIVCRQFDVTVKVLKWRFMYNNESFVVALNNKTGGIVSYDELPVIYGSVEHRIDLGRHLVLSIFPLLKDEAIYEAKLYCIEKTKALISHFQIDAKMCQKECSKMIFHKEIQCPTDQYDITVWKWNNAAEKASITRKEVRMHFTKLFIMEGQEHRINYVLERDKN

SEQ ID NO: 125224 - protein, 123 aa, Heterodera glycines
  Coding regions on vcDNA: vcDNA=SeqID_51647; Strand=-; Position=1 -309,390-452
MRCLRKFRQLFWAKNPSKNFVKELSDIFTEYSNSFMENWISFEKFGSKNFDRYRAFVWKQITEKSKRSEERIEMDKFVGKLFERRQFFELEKYDANFEKLFAIKVFIPKIIGGNRSNGNEFYQ

SEQ ID NO: 125225 - protein, 36 aa, Heterodera glycines
  Coding regions on vcDNA: vcDNA=SeqID_51648; Strand=-; Position=1 -84,141-167
MNGSGNIVRRFFLFQIKCANALTKNRRTNSKLIISI

SEQ ID NO: 125226 - protein, 298 aa, Heterodera glycines
  Coding regions on vcDNA: vcDNA=SeqID_51649; Strand=-; Position=1 -170,345-447,623-803,923-982,1050-1142,1607-1797,1882-1948
  Homolog annotation: Hit_ID=AAN60526.2; Match level="QueryCoverage =97%, HitCoverage=57%, E-value=5e-82, Identity=48%"; Hit description =Colmedin (collagen plus olfactomedin) family protein 2 [Caenorhabditis elegans] gb|AAR87492.1| collagen/ol
MKRHLKASLKSDPKKTVASLMIILSIVLFHRCFLDGVGKPIFHAHANTFYGAWMRDAYPRSAADLNKRWLAVHFEGDSLMEFASEADLRRGRPSVSHSLPHPFRGSNSVFFNGSFFYHRSGTPMLAKYELHSHRYDEVQIAEGIAHKYDDYLFNASKSYMDIAVDENALWLLFHFEDVPYLLLFHFEDVPYLSVAKMDINNLSMYSIWNLTMINHTDVSNGFVLCGVLYLVRSSTELTTDISVAFDFYREKYRQPNIRWVNLYGNANHITYNPFDRRIYMYDHGYLLTLPARISWRAK

SEQ ID NO: 125227 - protein, 68 aa, Heterodera glycines
  Coding regions on vcDNA: vcDNA=SeqID_51650; Strand=+; Position=1-204
LPSHYDRDGANANANHALLARGDLANDDGNNDPMGFGQAEADQTARHRRGPALILLLVVLPLVVGAFT

SEQ ID NO: 125228 - protein, 19 aa, Heterodera glycines
  Coding regions on vcDNA: vcDNA=SeqID_51651; Strand=-; Position=1 -42,205-222
MPNYKFSCSLIANPTKNEK

SEQ ID NO: 125229 - protein, 73 aa, Heterodera glycines
  Coding regions on vcDNA: vcDNA=SeqID_51652; Strand=-; Position=1-221
MGLWSTTTCPLWDCGQQRPAPYGIVVNNDLPLMGLWSTTTCPLWDCGQQRPAPYGIVVNNDLPLMELWSTILD

SEQ ID NO: 125230 - protein, 59 aa, Heterodera glycines
  Coding regions on vcDNA: vcDNA=SeqID_51653; Strand=+; Position=1-177
PGLKCPAEAKIFFYFREKIEIFPKKIPVDRARKTMFWKWSPFLWEKSLKNPKIQKPENL

SEQ ID NO: 125231 - protein, 67 aa, Heterodera glycines
  Coding regions on vcDNA: vcDNA=SeqID_51654; Strand=+; Position=1 -67,115-251
MERLIATSEMVKGVQIVQEKPGTPIIAVIVPKSFNQITVADLKQEMIAICREQKANCMINQNFIFTK

SEQ ID NO: 125232 - protein, 190 aa, Heterodera glycines
  Coding regions on vcDNA: vcDNA=SeqID_51655; Strand=-; Position=1 -359,1043-1256
MAKEYFSIVIKMLGQMPPKIKNLFENDIEILNFKFKNKYQQNIGGGGGGTINLDKILVENAMDYDEDTLRQTHRSLIERFAIKIGRMLEMTINNAFVPSNDIMAIIELHIYQTFSEGLKNWNKISKSLSAQMHESPSKLPIDVKLLTKYFVSMKIAISFISAAIEVPMFTDYKNTKSIQLIKSGYFLQKF

SEQ ID NO: 125233 - protein, 199 aa, Heterodera glycines
  Coding regions on vcDNA: vcDNA=SeqID_51656; Strand=+; Position=1 -324,427-702
  Homolog annotation: Hit_ID=CAE75311.1; Match level="QueryCoverage =47%, HitCoverage=14%, E-value=3e-11, Identity=41%"; Hit description =Hypothetical protein CBG23281 [Caenorhabditis briggsae]
RCFHPSFPICSMRLFHAFTGDSPVNKQFLLFVIFLCFVATAAVGPTRRSAIRNAPREAKADEATPKCDLGDIELNSEEFVHTCDEDKFENANIYCKGKLLEARKSGLSAVNYHQLLDDNDSKDFVDRPLRRNASEVLRQFEQKFGGQNESASSIDVEELRDFLDENFDRAGGELKKWENGRIIGRGASKENEKGEEKPN

SEQ ID NO: 125234 - protein, 161 aa, Heterodera glycines
  Coding regions on vcDNA: vcDNA=SeqID_51657; Strand=+; Position=1 -102,164-547
  Homolog annotation: Hit_ID=NP_505959.1; Match level="QueryCoverage =44%, HitCoverage=11%, E-value=4e-10, Identity=48%"; Hit description =trehalase (tre-3) [Caenorhabditis elegans] emb|CAD54509.1| trehalase [Caenorhabditis elegans] emb|CAB0125
MQKKAFWLATKWVLSNYRVYRSEVPRGNMWEKYAGEGRDLVVAIGLFLCQSGFGWSNGVILDLLTTFGDRMEFKNDLEEDPSAVAKEVIKAEPPNLPTPNPNITPVLNGPFVAVGPQGEGIGIPRPSGALRTAMAPRHTLCRWLWWWTSVLMALLVTRTIH

SEQ ID NO: 125235 - protein, 182 aa, Heterodera glycines
  Coding regions on vcDNA: vcDNA=SeqID_51658; Strand=-; Position=1 -59,137-316,466-541,587-715
  Homolog annotation: Hit_ID=NP_723616.1; Match level="QueryCoverage =98%, HitCoverage=62%, E-value=2e-25, Identity=34%"; Hit description =CG6720-PB, isoform B [Drosophila melanogaster] ref|NP_477137.1| CG6720-PA, isoform A [Drosophila melanoga
IAAQRLHAEFKQLSQLPLQGCQASPNSENICQASPNSENIFQWIAVIEGPKETVYEGGTFFVELNFNKNYPFDAPEVVFLTRVYHCNISNGKMRLQVISRQSWRPSFGVATVLQSIISLLCNCDPYNSLVPLIGETVLQSIISLLCNCDPYNSLVPLIGEQYQQQPEEFNKAARIWTERFAH

SEQ ID NO: 125236 - protein, 108 aa, Heterodera glycines
  Coding regions on vcDNA: vcDNA=SeqID_51659; Strand=+; Position=1 -235,395-483
MSKHQKSAVTPPTTTTTAAESGGERDGRTETTSGQRKRHSANQTDSANGAAGGQGLFPGFGFCWEVFMSTKIATLFVIGSNNAVVLSSSESAAKEAKVRKMSTTSQNK

SEQ ID NO: 125237 - protein, 135 aa, Heterodera glycines
  Coding regions on vcDNA: vcDNA=SeqID_51660; Strand=-; Position=1-408
MKRTNATNITPPRAKRSMAPAMDPITAALAEQERQRRLVFIGLPESNAVCPSERVQEDREATTKILDHLEVEAEPTTVFRLGRYDPQRTTPRPLKVVMPTPTHQHVALGGWKRERARVRSQQNQTRLFVRPALSK

SEQ ID NO: 125238 - protein, 69 aa, Heterodera glycines
  Coding regions on vcDNA: vcDNA=SeqID_51661; Strand=+; Position=1 -78,431-562
MLINNLPFSSVEEAEKQALAQYPDALNAMQAMWNKVKEMKSCLATCFAGRVQNQTAQQIVQQFSVKSIK

SEQ ID NO: 125239 - protein, 109 aa, Heterodera glycines
  Coding regions on vcDNA: vcDNA=SeqID_51662; Strand=+; Position=1 -129,684-882
MAELLLSNGQAIRQRKRGGVGEVVQEFDAFLKVSDDVKEEPKAIKFVDDEIEEGLQEVEEEKERNERIEMEIKRAEAKAKGRGEGTAEEHVIMMIGNGFGIFQIIASGR

SEQ ID NO: 125240 - protein, 43 aa, Heterodera glycines
  Coding regions on vcDNA: vcDNA=SeqID_51663; Strand=+; Position=1 -42,364-453
MLKGCLYVILELIANCYVQLKIQLDRFMGSGQTPKKQGVFILN

SEQ ID NO: 125241 - protein, 205 aa, Heterodera glycines
  Coding regions on vcDNA: vcDNA=SeqID_51664; Strand=-; Position=1 -150,218-484,538-738
  Homolog annotation: Hit_ID=AAP30770.1; Match level="QueryCoverage =84%, HitCoverage=50%, E-value=2e-21, Identity=41%"; Hit description =putative gland protein G17G01 [Heterodera glycines]
PSFFFWTEKTENLLDTVVDSFSAQLLLALCSLLTIGIGFFRMLRSAAEYESNPMLFLIKLKSVLLLSGYELQKFACFPLSRLLILFFIFKCFDYCMALYSVLCWCCSAWASSCLLLYWTPYWSCMNFRADDTNVPLVTFVFDIVMVCSFVFEMFFNNSLVKKRPENASFAAANRKLRNDVATECANVAIHRQQQQKNGSAIIMQT

SEQ ID NO: 125242 - protein, 19 aa, Heterodera glycines
  Coding regions on vcDNA: vcDNA=SeqID_51665; Strand=-; Position=1 -56,320-323
MPTQFIKVLLKNQLITIKI

SEQ ID NO: 125243 - protein, 103 aa, Heterodera glycines
  Coding regions on vcDNA: vcDNA=SeqID_51666; Strand=-; Position=1 -108,167-261,538-646
MSQKSCMEDYKRQIANEETFNNKEISMRFPNFVSFAELLDPSKGLYNQNEDKLKLAIDVTVKLVHGKRYKILNRFFTPLATPLAESETMEKTTIHADFSSQKF

SEQ ID NO: 125244 - protein, 62 aa, Heterodera glycines
  Coding regions on vcDNA: vcDNA=SeqID_51667; Strand=+; Position=1-191
FNTPFHFFFACLIFFQPFFLTIPKLEIGPLIFLEFFMVSYNKNECLIYNLDRSNTNMAIFAT

SEQ ID NO: 125245 - protein, 132 aa, Heterodera glycines
  Coding regions on vcDNA: vcDNA=SeqID_51668; Strand=-; Position=1 -179,1454-1673
MLARRKAMRKCFANYVDDGPLVIRDAFMGGRTGPMKLLRRAGPGEKISYYDFTSLYPYVNQLTVSNYSLTHLYSLTRPQTALSHPALSHLISDCSLAHLYSLTRPQTALSHSALSHLITDCTLPSCTLSFHL

SEQ ID NO: 125246 - protein, 88 aa, Heterodera glycines
  Coding regions on vcDNA: vcDNA=SeqID_51669; Strand=+; Position=1-267
MRTTDLTACSPSSPIAVFNTAGASNSSSDEVWLMFFFPAGAGPMPGVALSPSRTPQYDKGQFPWAQLVEYKRSAFFKFFIFSEIFMWF

SEQ ID NO: 125247 - protein, 101 aa, Heterodera glycines
  Coding regions on vcDNA: vcDNA=SeqID_51670; Strand=-; Position=1 -115,196-386
MALKSDTLPKGRKTFAKCGKEQPYVNLESTNTENKKTEAKSSPPEKTDKTATKRREYERMAPKPDKLATNNSGEYERLATAQKEKRREGGQMGKNWGKKEK

SEQ ID NO: 125248 - protein, 81 aa, Heterodera glycines
  Coding regions on vcDNA: vcDNA=SeqID_51671; Strand=+; Position=1 -115,218-348
MNNIDDICKEIELRLSVHGALLGSGWATMETTVTSLLNNNQNDISILKSLQLEQEANAGLLVQKVDGLLAGNAADITAMGS

SEQ ID NO: 125249 - protein, 150 aa, Heterodera glycines
  Coding regions on vcDNA: vcDNA=SeqID_51672; Strand=+; Position=1 -334,435-505,553-600
  Homolog annotation: Hit_ID=NP_012721.1; Match level="QueryCoverage =78%, HitCoverage=12%, E-value=2e-36, Identity=60%"; Hit description =Mnn4p [Saccharomyces cerevisiae] sp|P36044|MNN4_YEAST MNN4 protein pir||S78475 mannosylphosphorylation pr
MRKERKKWEEEERKKSEEEERKKWEEEERKKREEEERKKSEEEERKKWEEEERKKREEEKRKKREEEERKKREEEKRKKREEEKRKKKEEEERKKCEEKERKKREEGKKREGRLRSKKKLNVYSGFDHKRSSLNKTMDTDYDDSFWSDSD

SEQ ID NO: 125250 - protein, 526 aa, Heterodera glycines
  Coding regions on vcDNA: vcDNA=SeqID_51673; Strand=-; Position=1-1580
  Homolog annotation: Hit_ID=AAN87269.1; Match level="QueryCoverage =71%, HitCoverage=15%, E-value=6e-49, Identity=33%"; Hit description =ORF [Drosophila melanogaster]
MKHPSHSTLLGYIREKHWIPKGRRFIRNTILSERHGCLNCRKERLKPYAYPQMPNLPSERVAMIRPFEKTGVDYFGPLTIKGGVKVYIALYTCLVIRAVHLEVADDCTATEFLRTFRRFSSRRGLPSLMWSDNGTNFIAGAECIKEEWRREILVETSHSGVSWKFNVPRAPWQGGAWERLVGITRSALRRTVGKSLMERQEFDTLVCEIEAVVNTRPLTFQSEEEFTQPLRPVDFLLPYKRVETSLPLSDEDPMDPDYAYQPRKRGELHQLMRVAIKRIDRFWKQWKTEYLLSLRERDRTNRAEGSLPREGDIVLVEEEEDPRSIWTMGKVEKLLKGRDGLVRTARVHTKGKTLVRAINLLYPLEINTSAEDEVSQIQVTAIMDSPSAVMEGRDPQTVTTESSLPPGTVMQDSQIVTTESSLSPVRGRNERQAVKERIRKRQPTEEVRGKGKLKKNGPYDPLRPGNYRIPRRNPFFPSQVAYNEQTRTYRRRRGRTIDLSGLRKLFAGLGGGKGGTGKSFGDSEKC

SEQ ID NO: 125251 - protein, 167 aa, Heterodera glycines
  Coding regions on vcDNA: vcDNA=SeqID_51674; Strand=+; Position=1 -288,524-739
MQKRLVEQWELVKARQSPDEGPFALTKTHLRLEKSLLNSETEPTEEEMVAESTMSLFSRECASFASTFILGESFSPKNVKKEAIVSQIAQILLMDKYATSFDEQTAVQILIHALQSLQMYVSDELAAGPILTLIFNIYSTFRPKYPALLEVLRQVSVNILVLYYLSV

SEQ ID NO: 125252 - protein, 146 aa, Heterodera glycines
  Coding regions on vcDNA: vcDNA=SeqID_51675; Strand=-; Position=1 -132,254-380,541-720
  Homolog annotation: Hit_ID=AAK52453.1; Match level="QueryCoverage =95%, HitCoverage=13%, E-value=3e-41, Identity=57%"; Hit description =DNA-dependent ATPase SNF2L [Mus musculus]
RIQKRHAIKQALEAKINKYKAPQHQLRLQYGTGKCKNYTEEEDRFLLYNIYEIGLDNENLYDELRQNIRTAPQFRFDWFIRSRTAMELQRRCNILISLVEKEMGDLGLEQKGAQGGRGGRKKQSTQEKAEASTGATKRKEPSGATA

SEQ ID NO: 125253 - protein, 49 aa, Heterodera glycines
  Coding regions on vcDNA: vcDNA=SeqID_51676; Strand=-; Position=1 -137,262-274
MAKTQYYGQSLMDTGTAAFIFVNAIADHDGMARGQSPRQRAAKATIAFL

SEQ ID NO: 125254 - protein, 42 aa, Heterodera glycines
  Coding regions on vcDNA: vcDNA=SeqID_51677; Strand=+; Position=1-126
MARKLHFCALIWLVLWLALSTVRQVFDIIGKLWALVLIDMVQ

SEQ ID NO: 125255 - protein, 47 aa, Heterodera glycines
  Coding regions on vcDNA: vcDNA=SeqID_51678; Strand=-; Position=1 -74,253-322
MTHTTIGGPRGLKVILITEPISMANDERFSDEKFSVERFSDETFGHR

SEQ ID NO: 125256 - protein, 70 aa, Heterodera glycines
  Coding regions on vcDNA: vcDNA=SeqID_51679; Strand=+; Position=1-210
MQENNSSSDEEGQLLSSSSGNEEAANQELIQFIEFKSKRGASLLARDGFEYQFERNSALVDNVEYWKCVK

SEQ ID NO: 125257 - protein, 87 aa, Heterodera glycines
  Coding regions on vcDNA: vcDNA=SeqID_51680; Strand=-; Position=1 -145,311-426
MKPKRRKKRDLGKCFNGFILCFFVFVIMPITNLSNAIVTTLKLDEDSKISRALDKLSVQNNNKEAEECPICLESFELGKKNPVLKCS

SEQ ID NO: 125258 - protein, 50 aa, Heterodera glycines
  Coding regions on vcDNA: vcDNA=SeqID_51681; Strand=+; Position=1 -40,175-287
MNEQLAKKNRRRDEKSCNKSISIQFIMRNVALSYGHFATYAWMLYWILKI

SEQ ID NO: 125259 - protein, 118 aa, Heterodera glycines
  Coding regions on vcDNA: vcDNA=SeqID_51682; Strand=-; Position=1 -340,577-593
  Homolog annotation: Hit_ID=AAP30754.1; Match level="QueryCoverage =54%, HitCoverage=34%, E-value=5e-29, Identity=98%"; Hit description =putative gland protein G11A06 [Heterodera glycines]
MAAIELFWPTSKHLLPVILLVISGEWIKLMDHLPIIIIYFKYFYVFPLFDECAHSLGFVRAMFAIAASASSHASNNSEWQALSTQFGQKVTEIDSKCAEFGISIGKVPIDGPKDKIFH

SEQ ID NO: 125260 - protein, 63 aa, Heterodera glycines
  Coding regions on vcDNA: vcDNA=SeqID_51683; Strand=+; Position=1-190
MEKNLNFIRQAKCKNPPRAVQKKQQQQQQLQLMQNGGPDAYELKEVFGYYNNGCHEAYYVSWL

SEQ ID NO: 125261 - protein, 78 aa, Heterodera glycines
  Coding regions on vcDNA: vcDNA=SeqID_51684; Strand=+; Position=1 -157,210-289
  Homolog annotation: Hit_ID=AAP30754.1; Match level="QueryCoverage =100%, HitCoverage=41%, E-value=9e-38, Identity=98%"; Hit description= putative gland protein G11A06 [Heterodera glycines]
MFAIAASASSHASNNSEWQALSTQFGQKVTEIDSKCAEFGISIGKVPIDGPKGDHSQRNVPSTDSVISMPGLTGSHKH

SEQ ID NO: 125262 - protein, 119 aa, Heterodera glycines
  Coding regions on vcDNA: vcDNA=SeqID_51685; Strand=+; Position=1 -82,146-214,271-493
QIYVFIQSFVVFQESHKNSLISAIFIKCFAIYFLSIFDCSFAFFYFSTFSAFFAIQFRFRPSHQKCQPTIGFTACCCCTALIWSLAINSAEGSNDDTIKSSRSANCSICYVMVDNIIVK

SEQ ID NO: 125263 - protein, 38 aa, Heterodera glycines
  Coding regions on vcDNA: vcDNA=SeqID_51686; Strand=-; Position=1-142
FMENFMNFLSSNKIKSVFVVQHWDGLVQKYQHFCGFRL

SEQ ID NO: 125264 - protein, 73 aa, Heterodera glycines
  Coding regions on vcDNA: vcDNA=SeqID_51687; Strand=+; Position=1 -94,194-321
MPEGVNCLRVGHADAHRDSYVIVCGCGTTIWGFRLDGTDVFWTALGYEVNVIELCDMDGDGQNEAKNNGEKLI

SEQ ID NO: 125265 - protein, 236 aa, Heterodera glycines
  Coding regions on vcDNA: vcDNA=SeqID_51688; Strand=-; Position=1 -263,369-550,642-758,806-912
  Homolog annotation: Hit_ID=AAH39907.1; Match level="QueryCoverage =86%, HitCoverage=22%, E-value=4e-46, Identity=48%"; Hit description =GCN5 general control of amino-acid synthesis 5-like 2 [Homo sapiens] gb|AAH32743.1| GCN5 general control o
MGGSENLPLTVPSASASSSSSSCSLTFSEFLRLGQSEIYLTIHEAKKSIAEQEEQRGVISMHVCWNDFSPDQNKRKVRWLFEIQQLFVQLPKMPREYIARLVFDRSHRNLMVYKKNKGAIASICYRPFAEQGFAEIVFCAVAADEQVKGYGTHLMNHLKDFMVSQLGIFHLLTYADEFAIGYFAKQDFVMQIPLPQGRYKGQDFVMQIPLPQGRYKGFIKDYQVATLMYCQLHPKS

SEQ ID NO: 125266 - protein, 55 aa, Heterodera glycines
  Coding regions on vcDNA: vcDNA=SeqID_51689; Strand=-; Position=1-165
  Homolog annotation: Hit_ID=NP_509479.1; Match level="QueryCoverage =89%, HitCoverage=9%, E-value=6e-10, Identity=67%"; Hit description =troponin T (tnt-2) [Caenorhabditis elegans] pir||T16441 hypothetical protein F53A9.10 - Caenorhabditis ele
NIRKNLEPPKYVEQVKAEGDAAKPPVPVIPLQLPADDGQAAAAPAEAAAPPPPEK

SEQ ID NO: 125267 - protein, 236 aa, Heterodera glycines
  Coding regions on vcDNA: vcDNA=SeqID_51690; Strand=-; Position=1 -57,872-1169,1733-2088
MPKLNDFGWHFDAAVRQSSIVDHGKLKTELAQQQRAVAEREAAWDRERAELNQTVRSLNNTLEELEQELRQREVHGREMQLQFERTVVERDMAQMELLDNAKQSNHNQQHHHQQEHINAAAHRSSMLHLASSNSAESGTAEEHNSSTAAAHVDGGGPSLASSSGIDSSTTSFSVTADAKEIDTKHLRLARRKLIECRQKVARLLRSAEKAMLGERLGRDDLFGSYLGKTKKKRFKF

SEQ ID NO: 125268 - protein, 171 aa, Heterodera glycines
  Coding regions on vcDNA: vcDNA=SeqID_51691; Strand=+; Position=1-514
  Homolog annotation: Hit_ID=AAM11674.1; Match level="QueryCoverage =98%, HitCoverage=19%, E-value=2e-41, Identity=47%"; Hit description =pol protein [Drosophila melanogaster]
ELGGRKFFSTLDFMSGYWQIKMEENSIEKTAFTTEYGLYEFMVMPFGLTNAVATFQRFMSRLFDGMINQFLFVYIDDILIASESFEEYLIHIELVFSRIKTAGLKLKLEKCHFCATELPFLGHILTREGIKMDADKLKPVIELPTPTTKKELHSLLGFKTYYRKFIHSFGT

SEQ ID NO: 125269 - protein, 177 aa, Heterodera glycines
  Coding regions on vcDNA: vcDNA=SeqID_51692; Strand=-; Position=1 -198,1458-1544,1842-2090
  Homolog annotation: Hit_ID=NP_508221.2; Match level="QueryCoverage =88%, HitCoverage=16%, E-value=1e-22, Identity=37%"; Hit description =putative protein family member, with at least 8 transmembrane domains, of bilaterial origin (XB793) [Caen
MVWLGLFFAPLLPAINNVKLVIFPFYCPVCLCSFVLIPLPDHHHVYPWLGLCHLQCAGPGNFSGVELLILFIVFLISLVRGLRKANTDLQKQLIHERTEEKRKIFELAGGANRNKTKASTKAEEQRKKMGGGAGRKLEQGQHLPEVERKRREPWRLFANLAKNVRKGTKKGGGKRKT

SEQ ID NO: 125270 - protein, 152 aa, Heterodera glycines
  Coding regions on vcDNA: vcDNA=SeqID_51693; Strand=-; Position=1 -87,330-539,807-968
MHTDPKWGKAAEEAMRYFTSLVETLNTTPRKQFVKLSDEIFEAGTNFVDGCERPVKLSSDEQNQFGVRTSHLNGPWTQQVDRRLRWFSYRKYFEHNEQQKFVPKCAAELAEAQQIVQKCSLNFDAIGPQLNECDVEFATAVPFCPFNTLITI

SEQ ID NO: 125271 - protein, 65 aa, Heterodera glycines
  Coding regions on vcDNA: vcDNA=SeqID_51694; Strand=-; Position=1 -114,169-351
MCSPVIGFSMSVPRLFSIAIAPICSRAYLDASKLKHSKLPISFVYCFCFCCFNVCILRFLSEILR

SEQ ID NO: 125272 - protein, 136 aa, Heterodera glycines
  Coding regions on vcDNA: vcDNA=SeqID_51695; Strand=-; Position=1 -135,796-972,1061-1159
MPKESHEYKQIREVLMKIKKKKFILYGEDKVAVRDVATAIRNIKGADHYFKQFEKFVEAMPKESHEYKQIREVLMKIKKKKFILYGEDKVAVRDVATAIRNIKGSGVGNSWKNRDRDMSGPRSGFTIGTGPTGTFT

SEQ ID NO: 125273 - protein, 55 aa, Heterodera glycines
  Coding regions on vcDNA: vcDNA=SeqID_51696; Strand=-; Position=1-165
MMSPRTFNSKEYSHYREMEDKMTFMAFWAYVLLSAKSKILIDLWVTGDATFDHDW

SEQ ID NO: 125274 - protein, 77 aa, Heterodera glycines
  Coding regions on vcDNA: vcDNA=SeqID_51697; Strand=+; Position=1 -59,821-995
MSKERRKNKLIQFYENWKSLSGGGRWCFDGGGTANAAAVVAVVPGQQCPMQTVHNQLIRADGKRRVGHRSDQLGGTN

SEQ ID NO: 125275 - protein, 20 aa, Heterodera glycines
  Coding regions on vcDNA: vcDNA=SeqID_51698; Strand=+; Position=1-61
MNHKKLEHEGHLYVFLSNFG

SEQ ID NO: 125276 - protein, 61 aa, Heterodera glycines
  Coding regions on vcDNA: vcDNA=SeqID_51699; Strand=+; Position=1-183
MTPPHPHHRRQQQQMPSAQSVGSAAQFGRQPFGAGGGPIMANNAIANRKKRRFADKMVAPE

SEQ ID NO: 125277 - protein, 91 aa, Heterodera glycines
  Coding regions on vcDNA: vcDNA=SeqID_51700; Strand=+; Position=1 -39,505-741
MFGPDLGRSQEKETFTGQLPRTKHIFFGLLNPEGSARVREWVCHLWKVRNVPPGFRDSVRSNSMDAVQSFSVLAHIRAVDRPTITIQKSTF

SEQ ID NO: 125278 - protein, 151 aa, Heterodera glycines
  Coding regions on vcDNA: vcDNA=SeqID_51701; Strand=-; Position=1 -36,82-268,321-466,513-599
MAHLGKIQIFTKAQPLSPGDLDGLETAVYQFKAFLDEQPMVRTLLSKKTKAHLLLHHFVPFARQHGFLALLDEQGDEALHSVWRRLEQLWKTMPDSEQMRQQLEHHFVSNWLLDTGRLDELKLREEEQREQAEEDKTNEESDQDADVDIVD

SEQ ID NO: 125279 - protein, 29 aa, Heterodera glycines
  Coding regions on vcDNA: vcDNA=SeqID_51702; Strand=+; Position=1-107
VVCEKVTKGVGPRFDSQCMLLMYFYDFNE

SEQ ID NO: 125280 - protein, 113 aa, Heterodera glycines
  Coding regions on vcDNA: vcDNA=SeqID_51703; Strand=-; Position=1 -214,734-859
LKKKELANSPGIFQMITDHLAKDHQMNDCRSLIALSDVQTIRDVVRSLRNRWSARTLPMRVCRDWTKRNVNASDRLRVQRPSDAIWPIYVPRLGQNDVGPFGQMQCLPEYHFP

SEQ ID NO: 125281 - protein, 129 aa, Heterodera glycines
  Coding regions on vcDNA: vcDNA=SeqID_51704; Strand=+; Position=1 -296,375-468
MDEEMLEFGDSLPSTSATPIGDLVPFPSTPTAPMDTGEMTPPPVAIDERSPRIEQLEKQLKDRDDTIQFLREQVRNREALISDLRRVRHHQRRHQHQQNNAKQRKTKEGHRRAPTQLAKTVDGADFGCH

SEQ ID NO: 125282 - protein, 25 aa, Heterodera glycines
  Coding regions on vcDNA: vcDNA=SeqID_51705; Strand=-; Position=1-76
REKKIMFFSGTLYLLVHISFFETVC

SEQ ID NO: 125283 - protein, 322 aa, Heterodera glycines
  Coding regions on vcDNA: vcDNA=SeqID_51706; Strand=-; Position=1-966
MANGRVWGRPINKICPLEEAPPKMAEMDDQADQAVHVRHEVQTVETQSEAREQNTPSAARKDGENEGSKGEESAEKRGREVEAVHPDGRVNREIREDSSREKAPNDSDGENGGDTAPLKSAVSEKAAEVPSAAQGKAGTLAHPHSAQRHEKKYLGDSSMAPSLLKVPTKFQPNSTRSEGGDRFGADGPQAVQAGEIGGEFPEAPAVEQHQNELEQTPNKPVEEVHDGKDVREVQAVPGAEQRKSARTRRNREIWSPERHVSRKRGLIKPKTGMALLIMLISIVGTFGCQPSMRSSGMDPNLPFQEGPKMPCTMECAKRGVTI

SEQ ID NO: 125284 - protein, 229 aa, Heterodera glycines
  Coding regions on vcDNA: vcDNA=SeqID_51707; Strand=+; Position=1 -56,294-347,855-937,987-1123,1167-1526
  Homolog annotation: Hit_ID=CAE58895.1; Match level="QueryCoverage =62%, HitCoverage=25%, E-value=4e-44, Identity=58%"; Hit description =Hypothetical protein CBG02142 [Caenorhabditis briggsae]
VQEVIFYIRVGHAEKRANGIFRTAQKKEKKRTEIALRSSPILRGFTCGLWMVFHSLTVNAFRQNSDQQKQFHPVAVLLTIKDWVTHFFACEHCRAHFHRMTTKTAKIEAAVRQKEDVFLYLWKAHNLVNGRLRGRETEDPKFPKYQFPPKFLCPECRRGDKFDEGKVREFLLKYYGRVRPIDGEQRTTENGRGNGEHGGGGEEKEEEADKQQRNERMPKVIGGTAEEEK

SEQ ID NO: 125285 - protein, 178 aa, Heterodera glycines
  Coding regions on vcDNA: vcDNA=SeqID_51708; Strand=-; Position=1-535
KCIDFFQKNGCPAEKRQLEEIMAKSGAIRHAKTQEYTGPDIPLFLFFESILGDHIKRLLLASTEIRSIGTPFSMDIAALLDEIRELHVFGRADLLTTEQITDFSNKYLGIHGYFKAKNFFAFFSHSPFKNWETYPTAFDTNNAAGFTPKLHWLLAHGPDFAKRWGWFAWISEQGIEHL

SEQ ID NO: 125286 - protein, 589 aa, Heterodera glycines
  Coding regions on vcDNA: vcDNA=SeqID_51709; Strand=+; Position=1 -1768,3274-3308
  Homolog annotation: Hit_ID=NP_510849.1; Match level="QueryCoverage =99%, HitCoverage=43%, E-value=1e-129, Identity=41%"; Hit description= predicted CDS, zn-finger, CCHC type and RNA-directed DNA polymerase and Integrase, catalytic domain cont
EMRDLRAPLDLLFKKDTPWFWGPDQQKAFDQAKQVLQSDLLLTQYDPSLPIIVAADASQCGIGATISHVFPNGVERVIEHASRTLTPAERNYAQIEREALSLIFAVQKFHRMIYGRNFTLLTDHKPLLAIFGNKNGIPIYTASRLQRWALILSNYDFTIKYVKSANFGQADVLSRLISEHRTDEEVIVAHTSDNDVDSTEEVDNLEQLPVDAKEVSELTTSDDLLQQVAQFVRSGWPNKCPANELMPFYSRRDTLTLVGGSILTGNRVIVPAPLRQRVLKTLHFAHPGIVRMKALARNHVWPGLDSDIEAMVKHCAECQFAAKMPPKAPLRPWPIPGEVFGRVHIDFAGPCADGNIYLILVDALSKWPEVMQMRTTTAKGTIEALNLVFHRYGAPKEIVSDNGPPFTSHEFKDFCRLKGIKHKFSPPYQPHCNGQAERMVDTFKRQAKKNAKSNQQWISEFLFAYRSSPSPILNGFSPAELFLGRTLRTPLSMLEPSAEREQQPTGQYQSRMSQQYNRHHGTKSRSFNSGDSVFLNYGRSGKPSWLEGKIVRGSGLIWKIEIPILGITVTRHVNQMRSKFGSSTFLDVR

SEQ ID NO: 125287 - protein, 121 aa, Heterodera glycines
  Coding regions on vcDNA: vcDNA=SeqID_51710; Strand=-; Position=1 -5,552-700,2304-2515
MSEISKIFWKKNSKSHACLFSPLQMPQCCTRWTPWPSGNSPRCASTPVSNIAQHPYFSAYTQFRDLKRVLTTNIVACFNVPIPLQTAALRPFIFRTKLRTKWEMQQIVGRSCEVGGRHLSV

SEQ ID NO: 125288 - protein, 72 aa, Heterodera glycines
  Coding regions on vcDNA: vcDNA=SeqID_51711; Strand=-; Position=1 -30,618-728,1055-1132
  Homolog annotation: Hit_ID=NP_509299.1; Match level="QueryCoverage =81%, HitCoverage=14%, E-value=4e-21, Identity=81%"; Hit description =calponin (44.8 kD) (XI306) [Caenorhabditis elegans] gb|AAB52603.2| Hypothetical protein C53C9.2 [Caenorha
MEHHQGQETWVPLVEYKKEWETILDKEGEGILPKQSGDYGFASQAGEVNIGARRNQVALIRGRLPNDRRKED

SEQ ID NO: 125289 - protein, 94 aa, Heterodera glycines
  Coding regions on vcDNA: vcDNA=SeqID_51712; Strand=-; Position=1 -96,2170-2358
MSKCTNYHIHLNIQYCTREYRVTVIGLRRTLTLPCSIIEHYGQKKCNGCEPSCDNPNPKICTKKKCNCSCECLPGLFRNKKSGKCVKKCPYKAD

SEQ ID NO: 125290 - protein, 52 aa, Heterodera glycines
  Coding regions on vcDNA: vcDNA=SeqID_51713; Strand=+; Position=1-187
HIYLSIKLINLDNNCKNLEMFVFFLSHFAKSSCSPIHKHFTSPSVFFSIQSQ

SEQ ID NO: 125291 - protein, 54 aa, Heterodera glycines
  Coding regions on vcDNA: vcDNA=SeqID_51714; Strand=-; Position=1-329
ELLVLFDSSMCLLLICKISKIFVKFQKSYGQKELKNPVIRTFFALIFLCINKNF

SEQ ID NO: 125292 - protein, 258 aa, Heterodera glycines
  Coding regions on vcDNA: vcDNA=SeqID_51715; Strand=+; Position=1 -163,479-1092
  Homolog annotation: Hit_ID=NP_700900.1; Match level="QueryCoverage =67%, HitCoverage=95%, E-value=5e-25, Identity=34%"; Hit description =hypothetical protein PF11_0035 [Plasmodium falciparum 3D7] gb|AAN35624.1| hypothetical protein [Plasmodiu
MEAEALPRAAERRKGAETEEEQEEQQLISWLHHAQWDTIAELLENEWVREQLKIGFISNDEAKERLTYLVSFEMANEIVAFLNLATEKEKKEKIKEMKKKYEKTKEEKEKKEEKEQSEQKKLADKNMREMIREEEKMKELKVRREQMQREKQKKKAEERERERERREKETSAKMKREESEEKSSRDREEKEMKETKEEKEGKEKGAAKRKEKGKKKGKTQTEEREESERGKMEREKEAEEKSLESEMAQVQLDGKRNV

SEQ ID NO: 125293 - protein, 708 aa, Heterodera glycines
  Coding regions on vcDNA: vcDNA=SeqID_51716; Strand=-; Position=1 -1110,1158-1168,1267-2027,2071-2315
  Homolog annotation: Hit_ID=NP_001004509.1; Match level="QueryCoverage= 46%, HitCoverage=22%, E-value=8e-39, Identity=31%"; Hit description =si:busm1-180o5.3 [Danio rerio] emb|CAD60788.1| novel protein similar to DNA polymerases [Danio rerio]
MVAKTCNWPRWKFSRYLNNQYGQQEQLKHDAVQLMLQVNAPMDLDGYDADTFVPHVVDYWNNAQRQHRFAVFIFGSLGQYKPLYKYIDNTYDTPLLLYFNEDHFDGVQKQGGLQPYCLECERPYRRMSTHSKSCKARCVLCSRVGPAFPCPSSAGFFKKCKECNKKFTNNGCYQHHLQSGFCKRSKKCKDCGAVWDVVNNTQNGRKGHVCGERFCKMCNNYHNIERGCYIQPIEPKESDAYRIVAFDLETMQHTPSEKPEKREHLPNFIAARVACPDCIENESWREASGGCEVCGPNRTVAFCQRHFTETTVDKQVVAESPLEAFVSWLINDLPLAYDTYAFSHFGGRFDMVLVFRELFKRGYNPDMLRKGNKIFSTTYPIEHPKVLILNENVEWTSVRDNPYKLSLLKVWVIPPRKCDVPVLPVKVNERLCFPLCMQCALDYPKGGVNFDYQCEHDDQQRGWVTTCTSIELDAALEEGYRVTKVFRLLKYKHGDDKLFRPYIAEFMSQKIEASGFDASIKGNTELEQQFITECAEKFGISIDKNNMKVNKGKRSLEKLCLNNLWGRFSLRNFGLAQTLITDDPSVLAEYLDNRSVDVTSIDELDADHILISYVQKEWVEEHECSNIVISLWTTSKARLLLLKAMQKVMRTPGCRLLYTDTDSLIFVHPIGMNPLQTGPHLGQFPDEYPNHEIVEYCSGGAKQVNLSF

SEQ ID NO: 125294 - protein, 67 aa, Heterodera glycines
  Coding regions on vcDNA: vcDNA=SeqID_51717; Strand=+; Position=1 -99,691-795
MDKIDGTKTVVNKCILIRILKLKNLFDGNIFQNCPFGVLKHLWGAKIQRRIKVQTIGKLFPKDSVSP

SEQ ID NO: 125295 - protein, 203 aa, Heterodera glycines
  Coding regions on vcDNA: vcDNA=SeqID_51718; Strand=-; Position=1 -355,572-828
MLIDAAAPPFMEEPVAATAEEDQFKSESSDESASSLFEEEESESDSDQEFSNKKSLTNKKRRSIDGGKHHPLKNWRQLINEYYLIKNAQNITDKKIAEQFGITRKTLCTWKKKHEAECVAQKQLAPFQNEHNVSKMEKLSTTITGKAPMMDKRRANKVKIGGGTSMAKKLKIGTSAGSSKAQKIEPQQHDKEKKSISILFRQF

SEQ ID NO: 125296 - protein, 563 aa, Heterodera glycines
  Coding regions on vcDNA: vcDNA=SeqID_51719; Strand=-; Position=1 -102,246-1614,1990-2210
  Homolog annotation: Hit_ID=EAA15475.1; Match level="QueryCoverage =83%, HitCoverage=52%, E-value=9e-14, Identity=20%"; Hit description =immediate early protein homolog [Plasmodium yoelii yoelii]
MLWPIIFGLLFLTIELESVDRDKNRRDRVEPGSSEQTLPQNDIENMPFDDFVDDLFTLPQKHVENMPFDDFVEDLFQTNYAHAKPQIPIKPSAGKQRNDQPTTSRFNTVPNRAKQTQTRRIDQPTTHQTDHSMIKGKGIEIGRQISDQSTTSRFNTVPNRAKQTQTRRIDQPTTHQTDQSMIKGKGIEIGRQISDQSTTSRINTVPNRAKQTQTRRIDQPTTHQTDQSMIRGKGIEIGRQISDQPTTSRINTEPKQTKLTQITQNRPTDQLTTHRTDQSMIRGKGIVMGGQVSDLSTIAMKDNKQTERQIFEKPTSSRNNTEPKRNKQTQTRRIDQPTRTDQPLFRAKGIVMERQVSDRSMASDQSTITTKGIVMGKQTSDQSMISANERKQMERQISDQSTISTKGSDQSKISEIEPQPMMDNRKLKEKQTDPIQSSNLSRSKTEPMGQKQTKRQLNDQPKFNRTKSDLLGNDKQTEKQMSRSNSEPAKKTDEEKRQIVHQFIELKKKYLHLTDENYDLPFIEMEERIAGEMGLKRSTILSWKKEFEKNKKRNFLKPHFWKK

SEQ ID NO: 125297 - protein, 169 aa, Heterodera glycines
  Coding regions on vcDNA: vcDNA=SeqID_51720; Strand=-; Position=1 -141,280-452,561-753
MSKELYPLYPSNSRVIDLRSKITPAPMSKTKQFFNELQRIAGSSPTKSSSSLHMKRAYESERWFSPRVDSDQADTSGPPRRSILTQSRLQLLSAQRGRETRKPYWRCPMPSARSIDTEITQPSLVDIIATPLARQGPIKPFRHREPETGRKTNSFAVDEDILTVEEKEK

SEQ ID NO: 125298 - protein, 123 aa, Heterodera glycines
  Coding regions on vcDNA: vcDNA=SeqID_51721; Strand=+; Position=1 -45,392-718
MTTSFAILAQIKRDINETDSSSEWDENEALEDEEKEESQIIGAPSELLVMATHDSVQVSWLPPRDDNVLIRGYLVGRRFNNHTAIFFFQRSVGVLTYRTWKRRRLTRRLGILLFEGSNRTVNM

SEQ ID NO: 125299 - protein, 364 aa, Heterodera glycines
  Coding regions on vcDNA: vcDNA=SeqID_51722; Strand=+; Position=1 -40,93-156,261-404,473-538,620-761,858-944,1003-1130,1304-1464,1526 -1631
  Homolog annotation: Hit_ID=CAE67977.1; Match level="QueryCoverage =99%, HitCoverage=99%, E-value=4e-63, Identity=41%"; Hit description =Hypothetical protein CBG13583 [Caenorhabditis briggsae]
PLTTLRFWVVSVFGTSITSIALCSIVENLFFFYLFSTSRKHHRTTFNMYMMFISLFDIFISISYILIQSMNVLMDFLRSLTLFRIWHIYMVPFLTISHCAITSHIYMVPFLTISHCAITSASFLILAATIERYLAATIERYLLTANSKHIRLVQRNRRYIIAFAILMGIISKVTICLEFKISYLEDCANTMNEIEINFADFVFDTDYHLWRFYYRNFVTIFFPFFALLWRFYYRNFVTIFFPFFALLVRLIIIYYLIICFINNLYINNNFNLKLIFPQKKVTRAATITTILLVCSYLVSNIISVALTTWEHIDKPSLVGEYIQLYLISILYLISIDMSSLLTVCSCAFRPLIYLICQPALRKEV

SEQ ID NO: 125300 - protein, 36 aa, Heterodera glycines
  Coding regions on vcDNA: vcDNA=SeqID_51723; Strand=+; Position=1-112
YREAIPEGFGLPIYLRASVRRDCPETQKSIDSSVRL

SEQ ID NO: 125301 - protein, 50 aa, Heterodera glycines
  Coding regions on vcDNA: vcDNA=SeqID_51724; Strand=-; Position=1-396
LLFKYAKNFRLNFFFINWSEANQILREHQKDKEKHCYDANSSNSEFKIFY

SEQ ID NO: 125302 - protein, 87 aa, Heterodera glycines
  Coding regions on vcDNA: vcDNA=SeqID_51725; Strand=+; Position=1-264
MQQHVQKRDDKPGTELPGLARPMTDPKSAKKGQIRIWVKGFVVPPLEAWPLEDRPLKDPPLEDPPLEDWPLEDPPFADIPDIEGPTF

SEQ ID NO: 125303 - protein, 112 aa, Heterodera glycines
  Coding regions on vcDNA: vcDNA=SeqID_51726; Strand=+; Position=1-339
  Homolog annotation: Hit_ID=YP_074992.1; Match level="QueryCoverage =98%, HitCoverage=38%, E-value=1e-22, Identity=46%"; Hit description =hypothetical protein STH1163 [Symbiobacterium thermophilum IAM 14863] dbj|BAD40148.1| conserved hypotheti
MSSPQKSSPQKSGPQKSGPQMSGPQKSGPQMSGPQKSNPQKSGPQKSGPQKSGPQMSGPQKSNPQKSGPQKSGPQMSGPQKSNPQKSGPQKSGPQMSGPQKSGPQMSGSRNF

SEQ ID NO: 125304 - protein, 329 aa, Heterodera glycines
  Coding regions on vcDNA: vcDNA=SeqID_51727; Strand=+; Position=1 -28,128-278,499-636,765-827,973-1065,1173-1342,1406-1484,1845-2117
  Homolog annotation: Hit_ID=NP_502082.1; Match level="QueryCoverage =95%, HitCoverage=21%, E-value=1e-125, Identity=68%"; Hit description= phasmid Socket Absent PSA-4, homolog of SWI2/SNF2-related matrix -associated actin-dependent regulator of
RDIPCPCISGDEAKAELLDEWLDQHPGYELVSRDSGATDSEEEEEDVQTEEEEEEEELTDLDEEQRNRRIIEKARNEEDEYDNKNARAQMESYYATAHRVKEKVVKQHSTLGGGDDTLQLKPYQLKGLQWMVSLYNNNLNGILADEMGLGKTIQTVALITYLMEVKKVNGPYLIIVPLSTISNWKIELDKWSPHVVKIIYKGDKDQRKRLEPLVLVRKGAFNVLLTTYDYVLKERSLLGKIRWKYMIIDEGHRMKNHNCKLTLTLNAYFTAQHRLLLTGTPLQNKLPELWALLNFLLPSIFSSCDSFEQWPSVKMGERVNISFWEKVPI

SEQ ID NO: 125305 - protein, 101 aa, Heterodera glycines
  Coding regions on vcDNA: vcDNA=SeqID_51728; Strand=+; Position=1 -50,332-587
MACTCTWIQEKYRPGSRMDLTPEQERELYNAYNRPNVPEDLTEAELSHEVHLGAFNQAMQMRHALSTTDLNAAPKDISITLPFTPEVIRNKTIFWFRAVIF

SEQ ID NO: 125306 - protein, 87 aa, Heterodera glycines
  Coding regions on vcDNA: vcDNA=SeqID_51729; Strand=-; Position=1 -146,212-402
IRHAFVISIRQLRLAIEIGDPVLISRCFLYIALAFAQKGQFLPALKIVRQEWNRDTELRSAFLLNCTRGIWSSIKWLKMNRKVMMLK

SEQ ID NO: 125307 - protein, 550 aa, Heterodera glycines
  Coding regions on vcDNA: vcDNA=SeqID_51730; Strand=-; Position=1-1653
  Homolog annotation: Hit_ID=CAA82797.1; Match level="QueryCoverage =29%, HitCoverage=24%, E-value=9e-11, Identity=32%"; Hit description =gag protein [Ascaris lumbricoides]
MERNSEPLDEEAANGNGNQGDLPSDRQDGERANAAQQTKTKKGMDAQGLGTSQTGVTPAASKNLRSGAITVRSARDRIERAAETLSSRIAEARELMDSDFTRGEAPEHAARLMAMERGLGQVTRIFEGHFDKGIAEAGAAPEERQDFLYDFVAAPLPASTKYLQLREHPTPAELLQIAAEHLGDMQAMRQTFEDEEREQSISRSSRSVDTEDSHPSKELPRTMARRSMPEWETSFRDALARFQAGQVGQAPQRFEQANRVAPPVMPNMAALIQRRSNAPSVASVRVNNPVREWMARNRGGENEPPAQQQPQAQQPLQAEQQRFERLTLNDQGQAFPRASHHARIRKEEHPSRERLRTQGAAPSHHHHSETRADTLTTFETVRLQPPTFSGKPEDWTTFWAYFQRAVDDKPIPGFEKQLHLLRCLKEGSPARRAVEVYPPSDGNYPVVVQLLKERFGDTNDLQRAIRAQLLHLPPAKDNVASLTAMIDEFERGVCQLEQLGANVDDESFGPLLEAKLPVSILTELRIRESMMGAKWTVRESQKQSRHQSNA

SEQ ID NO: 125308 - protein, 216 aa, Heterodera glycines
  Coding regions on vcDNA: vcDNA=SeqID_51731; Strand=+; Position=1-648
DRQDGERANAAQQTKTKKGMDAQGLGTSQTGVTPAASKNLRSGAITVRSARDRIERAAETLSSRIAEARELMDSDFTRGEAPEHAARLMAMERGLGQVTRIFEGHFDKGIAEAGAAPEERQDFLYDFVAAPLPASTKYLQLREHPTPAELLQIAAEHLGDMQAMRQTFEDEEREQSISRSSRSVDTEDSHPSKELPRTMARRSMPEWETSFRDALA

SEQ ID NO: 125309 - protein, 18 aa, Heterodera glycines
  Coding regions on vcDNA: vcDNA=SeqID_51732; Strand=-; Position=1-56
PYRDRDLSFSKPGTGNWD

SEQ ID NO: 125310 - protein, 21 aa, Heterodera glycines
  Coding regions on vcDNA: vcDNA=SeqID_51733; Strand=-; Position=1 -30,325-360
MTINCEKEEKQRIFMLKYYKM

SEQ ID NO: 125311 - protein, 64 aa, Heterodera glycines
  Coding regions on vcDNA: vcDNA=SeqID_51734; Strand=-; Position=1 -91,262-365
MNKRLPNELIWEIVAAIPIMYLFGGVAKKPDRSCSKFREALCTEEVTVRRIVHTVRLHSIWIRK

SEQ ID NO: 125312 - protein, 315 aa, Heterodera glycines
  Coding regions on vcDNA: vcDNA=SeqID_51735; Strand=-; Position=1 -491,585-712,934-1259
  Homolog annotation: Hit_ID=NP_502797.1; Match level="QueryCoverage =33%, HitCoverage=30%, E-value=4e-17, Identity=41%"; Hit description =HASI (4P602) [Caenorhabditis elegans] emb|CAB16520.1| Hypothetical protein Y57G11C.19 [Caenorhabditis ele
MKFAKKMLMIPEAEYLALRSAMNSGDYLQNEKASLDAKISQNLQDPGISEDLKAKRHDWLYKERRTVKGILENRPQKVVIENHVPGPNVAPYLGLNTQSKPQETDEPRKIIIPRKRLEEQTPDPESDNDTINELTPEPQTTSTLKTPIPIKTIIHPTLLNGLFRDVLLYLAGKKDETPRGAKFLKDRLLKDPTVKDMVDKSKVMWGQKQKTYTIHKPIRKRFPRLKTIPSGFHTDWQCDLCIFDQLKKHNDGYKYLLVCIDVLSRMIFSAPAKSKKSEDVIEAFDRVFEKSKIIPMKIYSDEWAVNSQAKEKMKK

SEQ ID NO: 125313 - protein, 231 aa, Heterodera glycines
  Coding regions on vcDNA: vcDNA=SeqID_51736; Strand=+; Position=1 -54,141-514,559-825
MNAHVQAQIGFNVGIFNANLGGSLRWNQAEAQSLARDARADRCHRQRDERNAAVQNARGRTDQNAAARRIDLRFAREEVQRYVVEAETIAEQARDRRRHAERRGKQRNELMISVVGSTICDGLKSEQLHKQRKRGVALTESLVRDSIELEERWEPFTPPPFTSFPTASPTRIAPFVVPTTDFGTDTVRPPPHVTPPSDLTSLFTSTVISPRTRPKPYTRHSATVPWETGIP

SEQ ID NO: 125314 - protein, 137 aa, Heterodera glycines
  Coding regions on vcDNA: vcDNA=SeqID_51737; Strand=-; Position=1 -187,332-557
VVALPSSVVLFANAVTGTFLFVAVFALFAIIRFEHATAFASDAGQRERRTICTVVAGTDHRGHRSDGRLGFVVRLANGAPKSAGDEHPSGGIVGIGRQRLTARSVVVLDGGAHANSTGPRHSGRFPALLTIDDVEFY

SEQ ID NO: 125315 - protein, 443 aa, Heterodera glycines
  Coding regions on vcDNA: vcDNA=SeqID_51738; Strand=+; Position=1 -343,393-581,635-786,830-943,996-1307,1360-1581
  Homolog annotation: Hit_ID=CAE68875.1; Match level="QueryCoverage =99%, HitCoverage=41%, E-value=1e-175, Identity=70%"; Hit description= Hypothetical protein CBG14838 [Caenorhabditis briggsae]
MIGVSGALLTTLGTLNPDPQTLSQMCAAIASGSLIGSIVATRIKVTDLPQLVALFHSFVGIAATATCVSNYLAEFSHFLADPAGTVAVKTCLFLGAYIGGVTFTGSLMAYGKLQGLLGSAPTLLPARNMLNFALLSANVAALGFYLTTDSMAMGLSMLGTTSLLSSLMGVTLTMAIGGADMPVVITVLNSYSGWALCAEGLMLSNNLLTIVGALIGSSGAILSHIMCKAMNRSLFNVILGGVGTKSQKGGKAQEITGTAQFAEVDQVVDMIKDAKNIIIVPGYGLCAAQARYPIAELVKYLRERGANVRFAIHPVAGRMPGQLNVLLAEAGVPYDIVEEMDEINDNFPDTDLTLVIGANDTVCPIAFTDCVNRAAEEDPNSSIAGMPVLKVWHSKQVVVMKRTMGVGYAAVDNPIFFDHNTQMLLGDAKKVCDKLLAGVKSGT

SEQ ID NO: 125316 - protein, 114 aa, Heterodera glycines
  Coding regions on vcDNA: vcDNA=SeqID_51739; Strand=+; Position=1 -117,202-297,352-483
  Homolog annotation: Hit_ID=NP_492378.1; Match level="QueryCoverage =89%, HitCoverage=27%, E-value=2e-26, Identity=52%"; Hit description =Malate/L-lactate dehydrogenase (40.5 kD) (1J377) [Caenorhabditis elegans] emb|CAB09417.1| Hypothetical pr
MKGLPNLAMMGELFCGLLGGASFGKNVRSWREVQKAANLGQCFVAIDPECFAPTFVDYLQLFLDQTRGLKPRDPSKSVLVPGDPERMNSERSAKAGGVIYSAGQIRDLLSRRST

SEQ ID NO: 125317 - protein, 143 aa, Heterodera glycines
  Coding regions on vcDNA: vcDNA=SeqID_51740; Strand=+; Position=1 -78,583-660,718-993
  Homolog annotation: Hit_ID=Q13423; Match level="QueryCoverage=61%, HitCoverage=8%, E-value=1e-28, Identity=73%"; Hit description=NAD(P) transhydrogenase, mitochondrial precursor (Pyridine nucleotide transhydrogenase) (Nicotinamide nucleotid
MDEDFAKVGAKIVNREEALRADVLLKGAIVRGFDTRPAVKDQVKSLGAEFLEVKIQESGEGVGGYAKEMSPAFIEAEMELFRQQCREVDIIISTAAIPGKKAPVLFTKVILFKMAVLFMPISGHDRPDEARLRFGGLSGRSRR

SEQ ID NO: 125318 - protein, 95 aa, Heterodera glycines
  Coding regions on vcDNA: vcDNA=SeqID_51741; Strand=-; Position=1 -58,609-838
MTKFLVYEHRAPGHQQMLLKISSQGPTQRKPSDGCIAQLNSWHYAEQENDKKSEYSQQWCAKKEGMRKNRKLNGPIRMVEKGRSTANSKKNSLKI

SEQ ID NO: 125319 - protein, 435 aa, Heterodera glycines
  Coding regions on vcDNA: vcDNA=SeqID_51742; Strand=+; Position=1 -469,516-783,835-1406
EYVGEVPTVEPKFVLQKNKLEIEGPIIYAVNCLTKISQLYFDKYSAWNYKRKLNKLFTYHFEPKLLNEHRLNYNVKLVNEKPKVPINEMILQLAIDTAYGCQTNESVDGIFRQNFNEILGEMFKKAEQRAKREDNYGIFVTYDIIVRSIFDDYCLWTDDAIFTEFVKGQETNFEKFYRMLKEYYSNSVKSKEFYLQKYGAYFGLVYLMRKNWQCAKVGEDLKEKCQKYKKYLHILYEYFFRISAEAKNPNMTNQLPAVKPVFECSNKYWYSIIFIIQILNDFSICFWKNGEKECENAYGNYEMELQNEKETNHAIEEEEKNGQNLERKSKKQSTEIGKLRTEFDQKMEEIYENTKEKEAEEKAKLEKALAKVPNDLEIKKMEKKYEQILAAREIAAEEKSKLVKKMAKLAINRERKMMEDEFEEKFGAFNSSPFA

SEQ ID NO: 125320 - protein, 367 aa, Heterodera glycines
  Coding regions on vcDNA: vcDNA=SeqID_51743; Strand=+; Position=1 -176,232-452,551-649,677-734,784-950,1000-1127,1182-1215
  Homolog annotation: Hit_ID=CAF98721.1; Match level="QueryCoverage =96%, HitCoverage=28%, E-value=1e-56, Identity=35%"; Hit description =unnamed protein product [Tetraodon nigroviridis]
IERKRGHPAALHSDIGFNEPGQLNDGPLCKCSWASKQSGIRHDKFVGEQFVAKCQQNSSSIETLYHYVLVVDPSIETLYHYVLVVDPSPCAFSRRPTAIQYDGHSYEFEGFSIFFHRPLPRIPQTPINQWTNDFQLRLVKENMPESFTVDDLELFYEFLFEEVLELYDLNRFSTDKHSENLGCPFYHCMPRFARKLPDTDKHSENLGCPFYHCMPRFARKLPDDGKELLPMSDGKELLPMSAVLTHFTREFSPLVDDNMANYFCRDKTAFIEFALQKKGQICLNPSKRPMALRVDMIRVQFGPRPMALRVDMIRVQFGPDKPRLYPILVHFGVKPTAYAFMKRPQYQEALKKHIKFYQEALKKHIKF

SEQ ID NO: 125321 - protein, 415 aa, Heterodera glycines
  Coding regions on vcDNA: vcDNA=SeqID_51744; Strand=+; Position=1 -172,231-406,509-587,627-784,843-888,939-1085,1153-1191,1242 -1331,1421-1605
  Homolog annotation: Hit_ID=NP_477436.1; Match level="QueryCoverage =94%, HitCoverage=25%, E-value=1e-114, Identity=54%"; Hit description= CG8730-PA [Drosophila melanogaster] gb|AAF59169.1| CG8730-PA [Drosophila melanogaster] gb|AAD31170.1| ri
RWHSYGILAYASNQIHFRLEFLGDAVVEFLTTIHLFFLFSDLDEGGLATFRSALVQNRHLAVQNRHLATLADRFELHKFMVYSHGPDLCHEADLRHAMANAFEALMAAMFLDSNLEECDRVFSNVLFKDDKLLRNIWVALPEHPLKRNNPFGDRHLIEKVQRNNPFGDRHLIEKVQCLQLLANFEESIGVRFKHIRLLAKAFTRRNVPYNYLTLGNGNNQRLEFLGDTVLQLLTTEYLYKHFLLTTEYLYKHFPLHQEGHLSLLRTCLVSNKTQSLVCDELDMTRFLVIPETLAQLRLKDKADLNEAFVGALYVNEAFVGALYVDRGLIYCRQFCRSCFFPRLKYFIMTQRWNDYFIMTQRWNDPKSQLQQCCLALRECGSGDPDIPEYKTIGVEGPTNTRIYRVAVYFRLTLEK

SEQ ID NO: 125322 - protein, 131 aa, Heterodera glycines
  Coding regions on vcDNA: vcDNA=SeqID_51745; Strand=+; Position=1 -13,414-620,900-1075
  Homolog annotation: Hit_ID=XP_319106.1; Match level="QueryCoverage =54%, HitCoverage=5%, E-value=4e-13, Identity=55%"; Hit description =ENSANGP00000022340 [Anopheles gambiae]
MTPDGPLVHKIKLAQLETLVDSLCANMVSQNEQLRDVSSIALKTVLNELPSGSITTQMFLCVRRVIPKLIETLKLEFLLKFRLGIWNCELDAGFVIIDPEKLQDQVFMTKFSNHPLILIKFKKYQFAISAQ

SEQ ID NO: 125323 - protein, 43 aa, Heterodera glycines
  Coding regions on vcDNA: vcDNA=SeqID_51746; Strand=+; Position=1-129
MNDYLGTITTNITKTLTDSAADGTMKIEILRFISLLLNTHEPE

SEQ ID NO: 125324 - protein, 124 aa, Heterodera glycines
  Coding regions on vcDNA: vcDNA=SeqID_51747; Strand=-; Position=1 -125,653-902
MSSSRQNAHHARSGSGADAVRGNSRERGHRSALELPRGRLCWRHYEQLLQPEHDRNGAVIRRPMRPRLAYRQVMQHINRGNFDRFCGQHLTWDITDPRNDEEVAYQMCQTLLQERAKEDDKNWG

SEQ ID NO: 125325 - protein, 141 aa, Heterodera glycines
  Coding regions on vcDNA: vcDNA=SeqID_51748; Strand=-; Position=1 -298,343-468
MQRPILMTAEQAKALEAERIEAQKRMAADRRVQDRLRQADQFLKQHLDQQKRLKQRNLVWGRHAAYERYINERLEKLKADVNALRKSARESINFTEINLFLPTRQAVEAYCADIIRYANHHAELDVQKAIKEHQQILERRK

SEQ ID NO: 125326 - protein, 29 aa, Heterodera glycines
  Coding regions on vcDNA: vcDNA=SeqID_51749; Strand=+; Position=1 -43,889-935
MGDGIVGQVQAGQPSIWGKKEKEIFGKIK

SEQ ID NO: 125327 - protein, 77 aa, Heterodera glycines
  Coding regions on vcDNA: vcDNA=SeqID_51750; Strand=+; Position=1 -97,390-526
MKHQKIMVKLNTLQAKMLKMEQDKQQTEMEKNASVDQIKKLNTEQQRLFQRISTLEKINQQQNVNKFMGRGEEKNFS

SEQ ID NO: 125328 - protein, 74 aa, Heterodera glycines
  Coding regions on vcDNA: vcDNA=SeqID_51751; Strand=+; Position=1 -63,161-275,1124-1170
MEMELKETKNLHMITKLELENVALRERMKHQKIMVKLNTLQAKMLKMEQDKQQTEMEKNVVLQFPTKLLGCQFV

SEQ ID NO: 125329 - protein, 106 aa, Heterodera glycines
  Coding regions on vcDNA: vcDNA=SeqID_51752; Strand=-; Position=1 -4,103-419
MHTRESSFSGSGRGDGELINRDSEALIDQLSQESVPEIRDREFDPGQGRIISKENGILFQKFPTFQFRVPSLLAKPLTRKSRCRTDQTRELIIEPGNSRIFCQAGD

SEQ ID NO: 125330 - protein, 191 aa, Heterodera glycines
  Coding regions on vcDNA: vcDNA=SeqID_51753; Strand=-; Position=1 -105,174-252,1124-1515
MDEHEKDPDTYGNWQYEEKPCACHCSYLRAKKFYRVDCDFMDRTTKIVLDAFLSDTALSGLVEILIKKNWHFENGFALSIAVRSSTVPSFITDITHTALEVHYECILCLEIAYKTYEIVCEDETSDRWGRYMTTYGDEPIVGIRTTDFDGIQRVFDGMWKDYNLIVSNCKHWTDNMIRRLMSVKAEIPINK

SEQ ID NO: 125331 - protein, 129 aa, Heterodera glycines
  Coding regions on vcDNA: vcDNA=SeqID_51754; Strand=+; Position=1 -275,1494-1607
MQVKLIFYVFYATVLDYSDKWFNLFDDVSEANQILNSIPKDELQKLNSEQKWMKLFEADLPHLYKLVSIVLSVPVSNAFVECFRFAAHNGLINSSTSQSPGLNSPAFQWPGLNPPAFQSTGTQLSGNPI

SEQ ID NO: 125332 - protein, 26 aa, Heterodera glycines
  Coding regions on vcDNA: vcDNA=SeqID_51755; Strand=-; Position=1-77
FLFFLCTQPIVRRFRKRERFFGADLG

SEQ ID NO: 125333 - protein, 64 aa, Heterodera glycines
  Coding regions on vcDNA: vcDNA=SeqID_51756; Strand=-; Position=1 -44,96-246
MSDNPKEAEKMEKAITARPPLLITCQGIPLALLQFMRPIVFYASNRLLCVQSLFMRPIKVLCVQ

SEQ ID NO: 125334 - protein, 151 aa, Heterodera glycines
  Coding regions on vcDNA: vcDNA=SeqID_51757; Strand=-; Position=1-456
MLVKRLSQQKRRSSACDSLVAKANMAKRDAFRHFGSHVQLCVMIKITTFSLTFNADYCGALTEKVLKNLQTNKCEEREKRTEVLEEFNREHFGNMLTSLLIDFSEMNALKQLLKHPGAKTRLLRLVGLAELFEKFWEKLGLTGEEFTDSGK

SEQ ID NO: 125335 - protein, 234 aa, Heterodera glycines
  Coding regions on vcDNA: vcDNA=SeqID_51758; Strand=-; Position=1 -379,719-1044
  Homolog annotation: Hit_ID=XP_531378.1; Match level="QueryCoverage =52%, HitCoverage=93%, E-value=9e-17, Identity=31%"; Hit description =PREDICTED: hypothetical protein XP_531378 [Pan troglodytes]
MHVATHTVERRYEEEIAEIDGRYDEEFAQLDRRYDDQSAEIDRRYDEAIAEIDRLYDEEVAEIDRRYEEKSAPIERRYGDETAVIERRYREESAEISRRYNEEKAVIDRRYNEQMAKVERQGPNNYTIPFSTRQPNPVASVPLQSLAPNYATNYCQQPLGLHFAARPPTSASSALSPNYGTNYCQQPLGLHFAARPPTSASSALSPNYGTNYGQHLMGHLPGHYHLISSVIIPK

SEQ ID NO: 125336 - protein, 132 aa, Heterodera glycines
  Coding regions on vcDNA: vcDNA=SeqID_51759; Strand=-; Position=1 -30,131-357,514-655
MTLGSAYAVQPVLMLNASKWQWPHSVRRMQRLLTKATTATNDDKTATETTTTTAPQQQSQDGAATTAATAQPSVTNTDSRMMFTIKKTKCTNGTHAFRRSRFGASSFSTIAFFFDIQIQHCWYHSKALNMLY

SEQ ID NO: 125337 - protein, 60 aa, Heterodera glycines
  Coding regions on vcDNA: vcDNA=SeqID_51760; Strand=-; Position=1 -100,639-721
MTDCLQIFNKSAKSKDPPKNRKLVIKQLVNLAQTFSKIIYLFRMLNLVCLIQNYLKLNNS

SEQ ID NO: 125338 - protein, 139 aa, Heterodera glycines
  Coding regions on vcDNA: vcDNA=SeqID_51761; Strand=-; Position=1-420
MFPTFLLLLLPLFALLLSECRGIELVLRNNSSLNQLNISLPHAPSTKISKKILVKFSEESFRPIFAFAGTSLDRPYLYVDESDNIKSVNHKAMENAIKNDLAVQKKNANIKHAIEDTTYDIQQINLKQHQIKRQVDCKF

SEQ ID NO: 125339 - protein, 41 aa, Heterodera glycines
  Coding regions on vcDNA: vcDNA=SeqID_51762; Strand=-; Position=1 -40,605-690
MNTSFEKCKYIVIVQKLAGAKTTWPAFFVRKFCVLSPLFAL

SEQ ID NO: 125340 - protein, 124 aa, Heterodera glycines
  Coding regions on vcDNA: vcDNA=SeqID_51763; Strand=-; Position=1 -209,270-435
MRATNVLLAVVPFVYVLFNFMYNLKNFLKFFQTNKSQNIFLEHHYWFVVGSYFLFCANFALNFILYSMISPVFRKEFCRKWLRKRATIRPRSTTMTTKDVQTESAKKSLQMKPIETKTAAETII

SEQ ID NO: 125341 - protein, 113 aa, Heterodera glycines
  Coding regions on vcDNA: vcDNA=SeqID_51764; Strand=+; Position=1 -94,325-572
MDGKEFMSQFNLIWRNPWSESNKVHLIRKKIGKNASSYCVNNLGIIFDEQMKKLKNGTPISLEPKCNRRLHLQVFWQLRWTLEKMPEFTSISAQKKNAIAFLDGCIKVLRYTE

SEQ ID NO: 125342 - protein, 29 aa, Heterodera glycines
  Coding regions on vcDNA: vcDNA=SeqID_51765; Strand=+; Position=1 -15,68-141
MTLTKNVEIVTRTVGNGQTKANANGTFFG

SEQ ID NO: 125343 - protein, 45 aa, Heterodera glycines
  Coding regions on vcDNA: vcDNA=SeqID_51766; Strand=+; Position=1 -97,245-285
MCRRGGRGKRQISMLLEGAAGSPPGGHSEDQKGQKSMPESNGMPT

SEQ ID NO: 125344 - protein, 99 aa, Heterodera glycines
  Coding regions on vcDNA: vcDNA=SeqID_51767; Strand=+; Position=1 -138,755-879,1072-1108
MPIQCHHRWNTLMEQQQQRLHPNDENANKQLNATPLCQSRRAKSPLVTGLGTIGKRHHQFGNGMPNNSNSSQENNANSPCQLSTDSEVLNIKLKNEVMN

SEQ ID NO: 125345 - protein, 76 aa, Heterodera glycines
  Coding regions on vcDNA: vcDNA=SeqID_51768; Strand=-; Position=1-233
  Homolog annotation: Hit_ID=AAP30755.1; Match level="QueryCoverage =98%, HitCoverage=32%, E-value=4e-31, Identity=86%"; Hit description =putative gland protein 29D09 [Heterodera glycines]
IAKMEINYEDECPYNLGFARAMFDLAAAAAGHAGNGTEWQNMKSKFVQESQAIKAIGQDLNIKVTDVHFGATSKGK

SEQ ID NO: 125346 - protein, 267 aa, Heterodera glycines
  misc_feature (3)..(3): Xaa can be any naturally occurring amino acid
  misc_feature (250)..(250): Xaa can be any naturally occurring amino acid
  misc_feature (266)..(266): Xaa can be any naturally occurring amino acid
  Coding regions on vcDNA: vcDNA=SeqID_51769; Strand=+; Position=1 -280,447-767,813-899,1841-1888
  Homolog annotation: Hit_ID=YP_050229.1; Match level="QueryCoverage =82%, HitCoverage=59%, E-value=4e-57, Identity=50%"; Hit description =ABC transporter, substrate binding protein [Erwinia carotovora subsp. atroseptica SCRI1043] emb|CAG75036.
KKXFGKYSSPSKFSKASSSKSGSSVSRGQLKEETRTLDEIYMAALKEGDKFILYAGGDFPGDIDGIKGAFEARLPMEVIVDYSKFHGPRIDIQLENNSLVPDVVQLQTLHDFPRWKKRGMLMQYKPKGWNAIYEGYRDRDGYFTGIMIAVFSNNVNTQVSNESDWLRNATDCLKPIFANGRIIQTYPNDDDAVLFWFKQVVDKYGWDYDKLAARKPVMVRGTQVVDKYGWDYDKLAARKPVMVRGTGVVXAQISVGHVTKWFSVLXI

SEQ ID NO: 125347 - protein, 56 aa, Heterodera glycines
  Coding regions on vcDNA: vcDNA=SeqID_51770; Strand=-; Position=1 -70,295-395
MRGSVQTFVCLLDGEFTLCKAGGGPPTFQAEFADFLRQKQFGGHGIGQIGTGRTGR

SEQ ID NO: 125348 - protein, 179 aa, Heterodera glycines
  Coding regions on vcDNA: vcDNA=SeqID_51771; Strand=+; Position=1 -99,251-571,2457-2575
  Homolog annotation: Hit_ID=CAE72291.1; Match level="QueryCoverage =59%, HitCoverage=6%, E-value=5e-28, Identity=59%"; Hit description =Hypothetical protein CBG19421 [Caenorhabditis briggsae]
MGIVLTVSSQEEADDRQILEANLRADEWQYAGDANYSLSDIVLQPYDAFTKIHTVKLQHILYNERNGIRSGQISHLVEGYLTKYGLPLEHAAHNQCTVLAKFGSLNERTIASFTDALENVLFHYPKKRETAPTYKYDEVQANYSLSEQRTEEKAEEAKRGAAEEFEADFSKMDAENPAQ

SEQ ID NO: 125349 - protein, 27 aa, Heterodera glycines
  Coding regions on vcDNA: vcDNA=SeqID_51772; Strand=+; Position=1-82
MPPHFCSHQNGRTVWARNDRSNGHGDA

SEQ ID NO: 125350 - protein, 283 aa, Heterodera glycines
  Coding regions on vcDNA: vcDNA=SeqID_51773; Strand=+; Position=1 -288,342-602,1009-1311
  Homolog annotation: Hit_ID=NP_505566.1; Match level="QueryCoverage =51%, HitCoverage=8%, E-value=2e-14, Identity=36%"; Hit description =AdaPTin or adaptin-related protein (apt-10) [Caenorhabditis elegans] emb|CAB02795.1| Hypothetical protein
ANYSLSEQRTEEKAEEAKRGAAEEFEADFSKLDAENPAKRWAAAFEQATLMPPSDSEVNLAHKMNSDGSEDPFDISAALEGTKRATGGEPFAPMPTLESSPSFDPFEVIPVEELIAKAREKAELERAKREAEHEGEFVAENRIARPNDHLSASHLSSPTPEGGSPVSSVARPVGFYDDFKGAQANYSLSEQRTEEKAEEAKRGAAEEFEADFSKLDAENPAKRWAAAFEQATLMPPSDSEVNLAHKMNSDGSEDPFDISAALEGTKRTGGEPFAPMPTVDEND

SEQ ID NO: 125351 - protein, 134 aa, Heterodera glycines
  misc_feature (112)..(112): Xaa can be any naturally occurring amino acid
  Coding regions on vcDNA: vcDNA=SeqID_51774; Strand=+; Position=1 -370,545-577
  Homolog annotation: Hit_ID=CAE72291.1; Match level="QueryCoverage =89%, HitCoverage=7%, E-value=7e-33, Identity=60%"; Hit description =Hypothetical protein CBG19421 [Caenorhabditis briggsae]
LFVCLFTDHFRCPQIQANYSLSDIVLQPYDAFTKIHTVKLQHILYNERNGIRSGQISHLVEGYLTKYGLPLEHAAHNQCTVLAKFGSLNERTIASFTDALENVLFHYPKKRXTAPTYKYDEVQINCYDECEASV

SEQ ID NO: 125352 - protein, 83 aa, Heterodera glycines
  Coding regions on vcDNA: vcDNA=SeqID_51775; Strand=-; Position=1-474
SSRIKVILRPDVPPWHTSATALAMCEQLSTHIGPDAGAFGLHRKRRISSASRHRGARILQSRLSGISIASHHWSIDQTHEPNT

SEQ ID NO: 125353 - protein, 147 aa, Heterodera glycines
  Coding regions on vcDNA: vcDNA=SeqID_51776; Strand=-; Position=1 -39,89-288,332-536
METKDEAIAFTEKYEHFIVIECKGSSHNVDKFCDFVGKRLRYELLEFVENPLAIWVDFCHVRPKMIGPTECPSADLEKNGNSIGLRHWLVGIQMAAEQKANSAFKRKLRDNLRKKLDVKIKEDFEKGSFHNVQLKSEFAEKENLRKW

SEQ ID NO: 125354 - protein, 153 aa, Heterodera glycines
  Coding regions on vcDNA: vcDNA=SeqID_51777; Strand=-; Position=1 -297,572-706,1032-1061
  Homolog annotation: Hit_ID=NP_508537.1; Match level="QueryCoverage =96%, HitCoverage=13%, E-value=8e-34, Identity=38%"; Hit description =spectrin (spc-1) [Caenorhabditis elegans] gb|AAB53876.1| Spectrin protein 1 [Caenorhabditis elegans] pir|
DSTDVRREKLNKAITVHQFLRDIDEEESWIKKKKEFQNFIGRVEEEEAWLNEKQQILSSPNVGENMAAVQGLLKKHDTFEVDLQMHQQRIDELQRQGEQLINSGNHHAKNIGTRTEQLLKHLILIKELAVQRLQKLRDNNAYMQDSTDVRREN

SEQ ID NO: 125355 - protein, 99 aa, Heterodera glycines
  Coding regions on vcDNA: vcDNA=SeqID_51778; Strand=+; Position=1-297
DLRKTEEELNLLRKQYNERGTLLKEEREAKAKARRETDRLRELLLFNGGDEEAKDPLDKLEEFEGGNVGEITDQTKAEESDQAEEGKAEQRGQVDPFTE

SEQ ID NO: 125356 - protein, 259 aa, Heterodera glycines
  Coding regions on vcDNA: vcDNA=SeqID_51779; Strand=+; Position=1 -127,1051-1701
  Homolog annotation: Hit_ID=AAG00551.1; Match level="QueryCoverage =96%, HitCoverage=61%, E-value=2e-12, Identity=25%"; Hit description =retinitis pigmentosa GTPase regulator [Homo sapiens]
MNDVLRGQNDALNREREKLKAELDELNAFLDDIEAETELKSMSKTKERGRKNGQKGRKTKGGKGKAKGGKGNERRQRGETSAKERGQQQKNSANGGQFERMGRTAAESAGTGQTLCGHLQGKRRKERERIKRKCEGTIGKSGQNIGRISPIGGTTPNRTHRSTERKKRSGGTEEERRSGNGRGDEQKRRKEADGRMGSGRSGGAVGEADEGIGEAAEEDGGGAGGDGEGADEAQRDHQSQGRERETAQRGRGHEGCESA

SEQ ID NO: 125357 - protein, 290 aa, Heterodera glycines
  Coding regions on vcDNA: vcDNA=SeqID_51780; Strand=-; Position=1 -378,763-821,874-1309
WLNDWISRVDGKAIYTTDGKVIYCQACQQQVKASLFIYKQHDYNNINNEKHFQVPSKMFYQLKQHNETAKHKANVELFMRPCGSKKQQFLTTQTTKKLDEFSMDLCTALTSANIPFFKLENQGFRADDLLLLVTDAARYMVKAAQGLKIFYPNLIHLTCLCHGLHRVCEEIRGLFPNVDKLIASTKKTSSKAPSRLAKFRERCDLPLPPRPIITRWGTWLNAADYYCQNLNQIGAIIRDFNPSDSDAIRQSQIAFDCSGIRGDLAFIKSHFDILPGAIEKLESRNLTLIE

SEQ ID NO: 125358 - protein, 120 aa, Heterodera glycines
  Coding regions on vcDNA: vcDNA=SeqID_51781; Strand=+; Position=1 -112,142-392
MAIPPLKAFFGQKVNLTGQLARTVPRHLKFSKDLQILTFVPSETVDCTVVQQYGNATFTVCECGVHTPGTVREKLGKSKGTSKKEGIDGEGIWGPTFAEGPENRATLRKPSQRRTDRDAC

SEQ ID NO: 125359 - protein, 66 aa, Heterodera glycines
  Coding regions on vcDNA: vcDNA=SeqID_51782; Strand=-; Position=1 -60,188-304,361-384
MPGGRGGQGMCDLLTPLCANEGIYRLAYIFRQNGGSFSRIDLLERKYLDTYGTRLSTSEPSKSNKK

SEQ ID NO: 125360 - protein, 28 aa, Heterodera glycines
  Coding regions on vcDNA: vcDNA=SeqID_51783; Strand=+; Position=1-86
MANVLGVSIFILVIFYHYIVANQKKQSP

SEQ ID NO: 125361 - protein, 94 aa, Heterodera glycines
  Coding regions on vcDNA: vcDNA=SeqID_51784; Strand=+; Position=1 -224,305-721
KPEMFPKKIRRTKLSLSFSSCLSFNKERRTYLNEEFNVSKCFVREGRNLCKVKPRIKNKMVKVGFSFRVFTPFQFSWEAKSPCSNCRSAIRTIR

SEQ ID NO: 125362 - protein, 57 aa, Heterodera glycines
  Coding regions on vcDNA: vcDNA=SeqID_51785; Strand=+; Position=1 -70,124-227
MGIVARRLLKNRAIQKQLDRRQKNLKTLRRQHAAAGRPPIVVHSAVLGLPGPRPYIK

SEQ ID NO: 125363 - protein, 224 aa, Heterodera glycines
  Coding regions on vcDNA: vcDNA=SeqID_51786; Strand=-; Position=1 -138,193-414,556-868
  Homolog annotation: Hit_ID=NP_956267.1; Match level="QueryCoverage =95%, HitCoverage=42%, E-value=4e-39, Identity=36%"; Hit description =ubiquitin specific protease 14 [Danio rerio] gb|AAH44553.1| Ubiquitin specific protease 14 [Danio rerio]
MVKIKIKWGTKELNVDANPEEPPLLLKAQLFGLTNVPPERQKLIVKGKTISDEAWNGIKIKDGTVIMLIGSTESMLIKAENAESSGHANSTETEPRQQFPIGLRNLGNTCYMNSSLQCLKIVPEFETALKQYNPNQSVDGSNQRIKLFTNSMKKLYNEMNVLAKDQTADSPEVIPLFLVHVLRQTFPQFDTQDERGNHQQQDANECFCEMLRMISDETVFTPET

SEQ ID NO: 125364 - protein, 231 aa, Heterodera glycines
  Coding regions on vcDNA: vcDNA=SeqID_51787; Strand=+; Position=1 -210,464-593,739-933,1048-1206
  Homolog annotation: Hit_ID=CAE57379.1; Match level="QueryCoverage =90%, HitCoverage=76%, E-value=2e-33, Identity=38%"; Hit description =Hypothetical protein CBG00325 [Caenorhabditis briggsae]
MHSVAFSSLSTEEARLNFEQIFHENGFVRIDGVFSTEELAELRDAVKLIVEGFDPKDHPRTTFNTSDEEKHVSDSYFLESVDKIRFFYEEKAVDEQSGKLKVPKEMALNKIGHENCQSDRRCSASRDAKHVHLQSPLEFRPFQRMALIQKFKQPKIGGSTNEHVDSTFLHTENGDNLLDANYLSATKQYKFTRTETKHNGKKASSDGPLLKFVGNRPSFEGCNFIALECQP

SEQ ID NO: 125365 - protein, 88 aa, Heterodera glycines
  Coding regions on vcDNA: vcDNA=SeqID_51788; Strand=-; Position=1 -197,257-326
MNEVTNEKLTLKLSKELGYNCLYNWLLQRCPIGETAPAIKWEDSVNPSANLNNVTFDLCSFDKSIGPLSPPTKEEKEEADQSNGNVVC

SEQ ID NO: 125366 - protein, 92 aa, Heterodera glycines
  Coding regions on vcDNA: vcDNA=SeqID_51789; Strand=-; Position=1 -139,191-330
STYDKVLALLESKEGGNEERKQRAEELRKRTTELLAKIKRSREEKISLIERADSLDVELNSFHTSTEELSDQIDQVTSEIDRRVEFHATCDA

SEQ ID NO: 125367 - protein, 214 aa, Heterodera glycines
  Coding regions on vcDNA: vcDNA=SeqID_51790; Strand=+; Position=1 -286,334-694
TDSIYYVAKNGRRLVPEGEGLGQMKREHTDRRIFEFISGGPKNYGFRHCDRVTRADEKAELKVRSFRLSYATNQLLNFESMKQLVLEHYNFDGEIDPALYMNDECYVCPGSSRSIRVTFPQIGRSPCSDLYTYQAHKDYRPHYVKGRVRPGMETLPFGYRNGFTRANTQQQQQQPQINEMHGRNVNDGDDAAFRDLPGCSHWQPTHYRNRYNYQ

SEQ ID NO: 125368 - protein, 184 aa, Heterodera glycines
  Coding regions on vcDNA: vcDNA=SeqID_51791; Strand=-; Position=1-555
MEEEEDSHIVRAEALSEREGGVAVAAANKGQTQKTSDDNNDDHDGAHQQVVVMARGGEDARAKAEASGGPRSVVETRISDNQRGGERLALGSAIIHRQGRRRGGGGGGGGRNRNRQRGKEEQGRGRRPIANDKFHPRPPQYMELNNRQKGNEQVTVNNNVHTMSPVSYPYLLRKQVGRECFCTC

SEQ ID NO: 125369 - protein, 374 aa, Heterodera glycines
  Coding regions on vcDNA: vcDNA=SeqID_51792; Strand=-; Position=1 -43,150-430,562-765,816-1020,1072-1334
  Homolog annotation: Hit_ID=NP_741632.1; Match level="QueryCoverage =97%, HitCoverage=7%, E-value=3e-55, Identity=35%"; Hit description =SMAll body size SMA-1, betaH chain spectrin homolog required for embryonic elongation and morphogenesis; e
QKRWQGNTNDKIISIRERIRERIEKVKRLLDEGVELEQFEAKLSEMCEWVEEKEKRVKAQTAEAGGASLEQKLDRLKRQQALQREMDANGTRIDKMRERLERLRGRHGTETAVSRADEFLLRWSKLSEAMRKLHAALDEARDLLELEQLADRLCTFVRAKEGMVGAEDLGKDLEHCQSLSSRLDRLDESQGIDEGTLAEANRLSSRLDRLDESQGIDEGTLAEANRLGGRLIGRKSAESDYVRKRLAEVNEGWQRLAGRLSIYRTLLNAALAVHRFNHNVEETNERIGEHRFNHNVEETNERIGEKAAQLGGTEMGKDMETVERLIRAQDAVERDMSAIHRKLNEHDEWAQQLLDGELPLRDSVLDVLFPLFIL

SEQ ID NO: 125370 - protein, 224 aa, Heterodera glycines
  Coding regions on vcDNA: vcDNA=SeqID_51793; Strand=-; Position=1-675
  Homolog annotation: Hit_ID=EAL30356.1; Match level="QueryCoverage =94%, HitCoverage=38%, E-value=9e-21, Identity=27%"; Hit description =GA11331-PA [Drosophila pseudoobscura]
MAKEAARGAGSVLAVRSFLADGAELEEWMEQQKQTTNSEECGNDLEQCEQLRTKFEEFRQSLRMGDERMAKVEEAEGELISHVDDEKLAQKVAIMSDRLRTTWAQIGQLTERRGRKLKEAERTHRLRREAEVLAERIREKTAEIPTEVGKDAKQAYALMLANEVLENEVAQLHEQLQVGGTAVPDGFGLIGSHFKLLLERFESVESPNPLVDFLPGTNGFVRLP

SEQ ID NO: 125371 - protein, 138 aa, Heterodera glycines
  Coding regions on vcDNA: vcDNA=SeqID_51794; Strand=+; Position=1-416
  Homolog annotation: Hit_ID=XP_421149.1; Match level="QueryCoverage =99%, HitCoverage=3%, E-value=1e-10, Identity=27%"; Hit description =PREDICTED: similar to Spectrin beta chain, brain 4 (Spectrin, non -erythroid beta chain 4) (Beta-V spectrin
LQNEIVPWRKAFGELRQRGEQLAKRGHESVAERMERVENQAKALEGMAKEAARGAGSVLAVRSFLADGAELEEWMEQQKQTTNSEECGNDLEQCEQLRTKFEEFRQSLRMGDERMAKVEEAEGELISHVDDEKLAQKV

SEQ ID NO: 125372 - protein, 219 aa, Heterodera glycines
  Coding regions on vcDNA: vcDNA=SeqID_51795; Strand=+; Position=1 -255,552-624,1411-1454,1502-1756
  Homolog annotation: Hit_ID=CAE70669.1; Match level="QueryCoverage =83%, HitCoverage=82%, E-value=3e-39, Identity=50%"; Hit description =Hypothetical protein CBG17377 [Caenorhabditis briggsae]
QISLFRKSRHPFADRKRRFFLPSFSFVGGPGRGKGTQRERIVEKFLLHISSSRRFRSRARSCIGSVLGKQLEGNSDAGGLVPFDTVLAIVKGAMLKKRESSNGFLIDGYPREVTQGERFEQEIQSPVLVIYFEAIQSPVLVIYFEAGDETLVKRLMGRGRSDDNVETIKNRLHTFVESTKPVVDHYGKQGKLVKVSQSATTNKCWICWIWNRSVRKCRA

SEQ ID NO: 125373 - protein, 267 aa, Heterodera glycines
  Coding regions on vcDNA: vcDNA=SeqID_51796; Strand=-; Position=1 -128,170-513,2331-2378,2910-3193
  Homolog annotation: Hit_ID=AAN32890.1; Match level="QueryCoverage =40%, HitCoverage=65%, E-value=2e-51, Identity=93%"; Hit description =secretory protein 4D09 [Heterodera glycines]
MGKIGGKWEKFGEEKLAKSDAINLLLEKLHLLDDELNELTFGGANERESAAVKAMEMILKLETEKEGQFEFGRGKMGKKTDKTTQQLHLQTIGTLKAKELLKAELNGNEKQWKGQNGKTMSTQKKMKQLLLSKEKAEKKFLTKFINGMKAMITQQKLDEVEGFRNMNIGDNNKVDAGKEPAADKATKKGKAQKAGTKPAAATNEPAAAKGTKNGKAPKTKAKQEVATNEPAAANEWNDQLMGMSVEKFNEELAVLLPKDRTLLWKML

SEQ ID NO: 125374 - protein, 210 aa, Heterodera glycines
  Coding regions on vcDNA: vcDNA=SeqID_51797; Strand=+; Position=1 -439,579-771
  Homolog annotation: Hit_ID=CAA82797.1; Match level="QueryCoverage =68%, HitCoverage=22%, E-value=7e-14, Identity=35%"; Hit description =gag protein [Ascaris lumbricoides]
ACNGTRSSRSRFQQVREKGANNRQSRRSSTEAARLARPHKHTHSSIPTLPQQGGQRRAGRSSSSFKSAIGTHALSKAEKFNLLRNLLGGEAREVVAGFRLEDNNYDTALQLLKDTYGAPDEHIRALHFELANLKPCKNLCDTKEFLLQLERLTRELNNTGEDIEGPPTFLMLEKKLTPGFLRTILTKKGEDPARWNTTKFRDVLNEAVRK

SEQ ID NO: 125375 - protein, 574 aa, Heterodera glycines
  Coding regions on vcDNA: vcDNA=SeqID_51798; Strand=-; Position=1-1725
  Homolog annotation: Hit_ID=CAA82797.1; Match level="QueryCoverage =28%, HitCoverage=25%, E-value=9e-20, Identity=37%"; Hit description =gag protein [Ascaris lumbricoides]
MAAPIQQKLSAALKVLSRTRTAAELNIQADQAASNLENAFNFEAQLEKVQKEAKTMDIFLDDVRESLTAWADLLRKLPATERDPAEADFNKFEKKERTTDKVDEAALKLRDLRDLISTLTVQSRLYRSKADKEERDAQAAHANAMQHTSQQQPNKTPSFTPPFYQFQPIQLDKFFGNKRKWPEFYESFKSAIGTHALSKAEKFNLLRNLLGGEAREVVAGFRLEDNNYDTALQLLKDTYGAPDEHIRALHFELANLKPCKNLCDTKEFLLQLERLTRELNNTGEDIEGPPTFLMLEKKLTPGFLRTILTKKGEDPARWNTTKFRDVLNEAVRKESQIQEVMGEYGHSPQQRPQPQRPNFSASKFRDRAPIPQQRERTFITSAVDDNHKRLINRQPQHRPQQQRPRAPQPQQRNCALSTIKGNFQLNVPMRPTINDNFQLNVPMRSTIKGNFQLNMPMRHSINASLQVHASSVTTITGMKNAGNTAQFNSEEKCCAQRHYASNASKAIIKQAIAHNRKDASNANNLIQRHYVMQTKNHRTKSQQQCWGKHNKMCQSQLKTEATNQRHRHRKCAMP

SEQ ID NO: 125376 - protein, 264 aa, Heterodera glycines
  Coding regions on vcDNA: vcDNA=SeqID_51799; Strand=+; Position=1 -574,759-979
  Homolog annotation: Hit_ID=CAA82797.1; Match level="QueryCoverage =64%, HitCoverage=26%, E-value=8e-18, Identity=33%"; Hit description =gag protein [Ascaris lumbricoides]
MPPMEAPTFTAPLYQFSQSSWTKFFGQNLKWPEFYESFKSAIGSQLISKAQKLNLLRNLLGGEARELIAGFRLEDQNYETVLQLLKDTYGAPEEHIRALHFELANLKTCRSLRDTKDFLLQLERLTRELNNAGEDIEGPQVFLMLEKKLTPAFLRNILNKKGEDPANWTTTKFRDVLNEAVRKEVQIQEVMGRNCGSPNRGDQGQLKRLTTCQSGMAQHKQGQGIRLHPASSAMALTGMRNARNSVPFSNGQPLFEKKACASSA

SEQ ID NO: 125377 - protein, 500 aa, Heterodera glycines
  Coding regions on vcDNA: vcDNA=SeqID_51800; Strand=+; Position=1 -527,1163-2138
  Homolog annotation: Hit_ID=XP_306328.1; Match level="QueryCoverage =82%, HitCoverage=38%, E-value=3e-33, Identity=27%"; Hit description =ENSANGP00000015433 [Anopheles gambiae]
MEDTKVLGIKWTPRYDQLVFSMPHFDSPITKRNILSHIAKVYDPLGLISPALLPAKHFLQIVQNANYKWDDPLEEDLKLMWIKLMHAWDGFGFNSLVEFPRHIIAGISEEFHCYCDASKSGLGNALYQVAETHYNKRESNLIFGKSHVKPLKVAYHNSTIPKLKLQALTLGVMATNSSSIEPLRCQGRLENADLPNESKHPTFLPAEAWTTKLIVIHYDRALKHCGPRTLLSKLRENYWITKGRQTVQHILNSNKFGCLKCRLVRLKPYAYPDAPDLPEDYSAEAFLRAFRRFAARRGIPSLMMSDQGTNFTAGAKTIQENWTVQLFPNEISGQLAHQGVTWLFNTAHAPWRGGAWERLVGITKNALRRSIGRNLLTWEEFCTLTVEIETIVNYRPLIFESDREPSPVIRPIDFLIPYWPAETNFQVIAVDPEDPEYTEHTCRRWRLNAWKLGDSPEDRSEDSPEDRSEDRLEDRPEERNEEVLWRTEEDSRMFPCDLCD

SEQ ID NO: 125378 - protein, 254 aa, Heterodera glycines
  Coding regions on vcDNA: vcDNA=SeqID_51801; Strand=+; Position=1-762
  Homolog annotation: Hit_ID=CAA82797.1; Match level="QueryCoverage =81%, HitCoverage=31%, E-value=1e-12, Identity=25%"; Hit description =gag protein [Ascaris lumbricoides]
MSNLIRMVLGPQVAILRQRVNTARTHVDREEDEEVNNAALMEAKVLLLKVLQRVEAELAKWENVISGLQGQEKQTEQERLETFINEREVANLLADAHATMDEILVALAGESEYDGSENGDNAVRENAQRQRQSPAREERQLPSRVQRQSPVREVLHQPRIRLPELRMPIFSGDPLEWPTFWQSFENAVHNQAHLQPIDKMNYLMGCLKGKASRAVIGYRGGQNYENMVETLRRLFGNPQVIVEALQAELFNLPN

SEQ ID NO: 125379 - protein, 75 aa, Heterodera glycines
  Coding regions on vcDNA: vcDNA=SeqID_51802; Strand=+; Position=1-228
LRQIFACGTACVVTPVGRILYIRQGNGRAGRMEDMQIPMPNSDEEPLNIMQRLYKAITDIYYGRQKREEWTRIVV

SEQ ID NO: 125380 - protein, 136 aa, Heterodera glycines
  Coding regions on vcDNA: vcDNA=SeqID_51803; Strand=-; Position=1 -40,313-683
MKIWCLFRHLMTPYTIVRDPSTLFPAEKQINYSAGQKRTVFNLTFVKCVAEIAYFRVINENDQSKDAFLEFKVVPGINALNEFLGFLHFDQSIGQQISHKFKSEFFSTESPLAESVVNQVMQLAFSFAARVILCIM

SEQ ID NO: 125381 - protein, 73 aa, Heterodera glycines
  Coding regions on vcDNA: vcDNA=SeqID_51804; Strand=-; Position=1 -90,565-696
MCMALPTKVLNTKFGTLSPLSASQPCKHPFVFVRVLCVCIVLCAVHSLFLLPALFTFLDAICKLFRQFMCQRR

SEQ ID NO: 125382 - protein, 153 aa, Heterodera glycines
  Coding regions on vcDNA: vcDNA=SeqID_51805; Strand=-; Position=1 -36,154-439,630-769
MIKITKAGTNESHEYFFTEKQLLLYNYRTSYGHNVPIVLGFGIEPSVYKTFQVRYENARIARENYRYVVEYIITVKLKMDNYPQHLVSENFIRPLKSTFILISSIIITAHFVWPKMFSSRTMHSKLIWTPHITEVHMVELDQCQDQLPMSKVA

SEQ ID NO: 125383 - protein, 44 aa, Heterodera glycines
  Coding regions on vcDNA: vcDNA=SeqID_51806; Strand=-; Position=1-134
LARHNSALRLISQKIKTFFLRTHGCSIHPPNFIWKSHGHLGTFL

SEQ ID NO: 125384 - protein, 119 aa, Heterodera glycines
  Coding regions on vcDNA: vcDNA=SeqID_51807; Strand=-; Position=1 -126,203-293,354-496
  Homolog annotation: Hit_ID=CAE60552.1; Match level="QueryCoverage =72%, HitCoverage=15%, E-value=4e-13, Identity=38%"; Hit description =Hypothetical protein CBG04179 [Caenorhabditis briggsae]
MMRERTFTPKSDTWAYGVLCWEIFSNAQQPYQFMSNNDVAPMVLRGTRLRFPNVTPPPFAEFISANVWTADDVRRYSMRDVLAWIEQHIDELIDDTTASRHDTTTTRNRGSRQGSRSGP

SEQ ID NO: 125385 - protein, 119 aa, Heterodera glycines
  Coding regions on vcDNA: vcDNA=SeqID_51808; Strand=-; Position=1 -86,169-395,465-511
MVTKVFLLFPGETSVTFLLEKFFLIYSFWVWPMPLQLKEINYAKEGAFLNWSPEREWFERKQSEVGHAQIGMEMPIISPIIPHKNMANKIQPSVAKNILNEFLNEFKQFMAEENLSKNS

SEQ ID NO: 125386 - protein, 177 aa, Heterodera glycines
  Coding regions on vcDNA: vcDNA=SeqID_51809; Strand=-; Position=1-534
MVVLSVFCAELLNCRVSQLCDRLNHPEDRTYILNSLKGRKVTTTYKDRNGMTKTFFIGGLSEKGAALTMAYGCLSRPFNINIAAHFYARHRIKLHHPYIVCIIERFSKGKEDRLYPMELLELTEDNPIWQQWSGPLFAERDPTPPRTSGRFENDVDDDETLKDVGRNQCTQSPDLFW

SEQ ID NO: 125387 - protein, 443 aa, Heterodera glycines
  Coding regions on vcDNA: vcDNA=SeqID_51810; Strand=-; Position=1-1332
  Homolog annotation: Hit_ID=CAA36712.1; Match level="QueryCoverage =74%, HitCoverage=88%, E-value=3e-21, Identity=30%"; Hit description =proline-rich protein [Triticum aestivum] pir||S14959 proline-rich protein - wheat
MANKFLLVPQEIYRGLTSASDTGVINLDAVRHDLDRARGERTNPTTKNVRYNQQLRRYLQMRRELADRPTKVELTKGLSVLLKQDGGVDDDDGEVVNTQPRPPAPPPPPPPPPPPHQYHRRHPSPPDQQSSSSDDSHPPHPPRPPRPQRTKKNHHSSIKYGRLNQWKQRRRDLQQQPVVRDLLAEAAAAPLPESDDDDEQMLEGGYLLPTPSQNYGDMPILPDYADEIEEMDTAQQRLASRRKIKGEGIDKNKKYKIYYSPPPSPTLPPVYKRPDHPPPPPRSIPKVELKRGPQPTKLKKSASPPPPPLPPHRAKREPKIELAPPPPPRNVSTRELKIELAPPPPRHFTKREPKIEVDPRPSTSKQAGYFPPPKIKTEPKHELQPTKRPVPYRIPKKEPKIEEKPLQQQQQQQQQPPPPPAVVVERKCPMFLHLGGGPNAHTP

SEQ ID NO: 125388 - protein, 277 aa, Heterodera glycines
  Coding regions on vcDNA: vcDNA=SeqID_51811; Strand=+; Position=1 -79,1287-1441,1802-1872,1929-2071,2182-2278,2329-2434,2485-2564
  Homolog annotation: Hit_ID=NP_503790.1; Match level="QueryCoverage =97%, HitCoverage=41%, E-value=2e-58, Identity=46%"; Hit description =matrix metalloproteinase (62.5 kD) (5D384) [Caenorhabditis elegans] gb|AAG23982.2| Hypothetical protein C
SDEKIIFILVKNSSSSDQPLLSPISSALDSIRSAVRKFQEFAGLPTTGDLDNQTKQKMAKPRCGIQDVQMLTSGSQIFKWRKRRVTFQLMQSTNDIPERMQKQAIQMAFDTWSKIVPLDQAIQMAFDTWSKIVPLDFSEASRYDTPDVKVLFARRNHGDPWPFDGRGGVLAHATFPQDGKLHFDDDENWVFMDGRKIGNHRFTHRFTDLYWVALHEIGHVLGLSHSNIETAIMAPFYQDLVDWRGNYKRPDLVDWRGNYKRPELTQDDVRAAQQIYG

SEQ ID NO: 125389 - protein, 32 aa, Heterodera glycines
  Coding regions on vcDNA: vcDNA=SeqID_51812; Strand=-; Position=1 -84,127-141
MADVLLLTYITKLCSAIFISAHNLKIIYKPFL

SEQ ID NO: 125390 - protein, 28 aa, Heterodera glycines
  Coding regions on vcDNA: vcDNA=SeqID_51813; Strand=-; Position=1 -27,936-995
MNAVRLRVWKILEILLSNICAITLNVYA

SEQ ID NO: 125391 - protein, 36 aa, Heterodera glycines
  Coding regions on vcDNA: vcDNA=SeqID_51814; Strand=-; Position=1 -36,330-404
MANNSHTLIQPPLALLAMRLICGFFALMKCGIVPMI

SEQ ID NO: 125392 - protein, 31 aa, Heterodera glycines
  Coding regions on vcDNA: vcDNA=SeqID_51815; Strand=+; Position=1-95
MATAGKAYDLTMKICFMHRPTIQKIMQISSA

SEQ ID NO: 125393 - protein, 57 aa, Heterodera glycines
  Coding regions on vcDNA: vcDNA=SeqID_51816; Strand=-; Position=1-174
RDEQPMSERKIVVKWSTAALAESERGHKEFAQHRIFPHFGRHSSPLHFFLRFNYPSL

SEQ ID NO: 125394 - protein, 24 aa, Heterodera glycines
  Coding regions on vcDNA: vcDNA=SeqID_51817; Strand=-; Position=1-80
RTLSTAVRQRSSKIYSMPQILWAG

SEQ ID NO: 125395 - protein, 130 aa, Heterodera glycines
  Coding regions on vcDNA: vcDNA=SeqID_51818; Strand=-; Position=1 -88,217-300,363-572,653-663
MKKKGQQQENTVLENTVLGKSKIPSDGKKAAKASGKEVKVMKEKGQQQENTVLGKQNATAKLQCKRDCVVSMIKHGWLNKDNQNDIKTQLVRLQLFKSKAAIPSMHDYESEFGDKRAQSTALANVSVACC

SEQ ID NO: 125396 - protein, 103 aa, Heterodera glycines
  Coding regions on vcDNA: vcDNA=SeqID_51819; Strand=-; Position=1 -76,132-367
MYTEPTKDMTLARTPLFKTPSDGTDDQEDDKRDDNSLSGCENSTDSDAENTDEENASLEYNAAPSPERSNKKEVVAAAVTKAVTFSDVVYENVKPVAKPRGKK

SEQ ID NO: 125397 - protein, 64 aa, Heterodera glycines
  Coding regions on vcDNA: vcDNA=SeqID_51820; Strand=+; Position=1 -61,153-286
MSGRKCPILAWAAKSNKKVLETTKNNQLYVERIRKVRQQLQERRPLFQWTLKDFNRCAFAELLS

SEQ ID NO: 125398 - protein, 25 aa, Heterodera glycines
  Coding regions on vcDNA: vcDNA=SeqID_51821; Strand=-; Position=1-77
VSARNALADAFRGLLPASVAAAVAP

SEQ ID NO: 125399 - protein, 113 aa, Heterodera glycines
  Coding regions on vcDNA: vcDNA=SeqID_51822; Strand=+; Position=1 -228,857-970
MKTLCKIQMANVWRKNGPNSTGKSIPKWLDILGFIGEMRHVQIQIDAFVKNLLIGTEKCDDGMVNVTERQSFITSQIHHNLSVQYFTIIFHCLKLNKQPAGQMGIVMSPDLGL

SEQ ID NO: 125400 - protein, 72 aa, Heterodera glycines
  Coding regions on vcDNA: vcDNA=SeqID_51823; Strand=+; Position=1-216
  Homolog annotation: Hit_ID=CAE60358.1; Match level="QueryCoverage =88%, HitCoverage=36%, E-value=3e-22, Identity=75%"; Hit description =Hypothetical protein CBG03955 [Caenorhabditis briggsae]
MQAPQPLPNLHQIFQAVDRDRSGQISADELQRALSNGTWQPFNPETCRMMISMFYYNNDGGISFARVQSLWN

SEQ ID NO: 125401 - protein, 34 aa, Heterodera glycines
  Coding regions on vcDNA: vcDNA=SeqID_51824; Strand=+; Position=1-105
HINFDDFIQLCVVLQTLTAAFREKDTDLDGWIRI

SEQ ID NO: 125402 - protein, 75 aa, Heterodera glycines
  Coding regions on vcDNA: vcDNA=SeqID_51825; Strand=+; Position=1-229
  Homolog annotation: Hit_ID=NP_490685.1; Match level="QueryCoverage =98%, HitCoverage=77%, E-value=4e-11, Identity=39%"; Hit description =transposase (1A616) [Caenorhabditis elegans] gb|AAB54166.1| Hypothetical protein F53G12.11 [Caenorhabditi
ADPALYWEVNSQKWPMIGAVVRKFLSPPATSSESERLFSTAGLISDDLRKSLQAENLAKLLFLHHNLLLTGFSIE

SEQ ID NO: 125403 - protein, 85 aa, Heterodera glycines
  Coding regions on vcDNA: vcDNA=SeqID_51826; Strand=-; Position=1 -155,260-362
MATKKERRQFTNVMIRARPTGPGHFWQPGFCPGNTGYSPRLSTKKLGFLHKIYFSWIFVKEIQAQAFFKMSSSREDNVEIRSPKI

SEQ ID NO: 125404 - protein, 96 aa, Heterodera glycines
  Coding regions on vcDNA: vcDNA=SeqID_51827; Strand=+; Position=1-291
MFLIWIWLLLRKAFFEAFCQIADKSAVVPARFVTFSLSFHSFHAGSKRAYRWMTEHRENGGATAETEATTEANGTAAKNKVIRPEAEENGKQVPKM

SEQ ID NO: 125405 - protein, 46 aa, Heterodera glycines
  Coding regions on vcDNA: vcDNA=SeqID_51828; Strand=-; Position=1 -104,996-1032
MNEKRNRYFLPGNVKGFKDFFALSLSERQLATNEIVFLGVPITIKG

SEQ ID NO: 125406 - protein, 137 aa, Heterodera glycines
  misc_feature (7)..(7): Xaa can be any naturally occurring amino acid
  misc_feature (9)..(9): Xaa can be any naturally occurring amino acid
  misc_feature (124)..(124): Xaa can be any naturally occurring amino acid
  Coding regions on vcDNA: vcDNA=SeqID_51829; Strand=-; Position=1 -39,1675-1873,2239-2390,2717-2740
  Homolog annotation: Hit_ID=NP_501751.1; Match level="QueryCoverage =98%, HitCoverage=30%, E-value=6e-27, Identity=42%"; Hit description =fatty acid desaturase (52.3 kD) (fat-4) [Caenorhabditis elegans] emb|CAB61031.1| Hypothetical protein T13
TFNFFSXRXIRFNRSFDVLRSRVRSLGLLRADDAFFVLKFVQCVALIAFAVFLQSRDFFLASAFCMGIAWQQLGWMIHEYGHQQHFGSWWWNDVCGYVCGNLMQGFSLGGWKVSRKEKHFSDFXIYCDSDLSLAPSL

SEQ ID NO: 125407 - protein, 37 aa, Heterodera glycines
  Coding regions on vcDNA: vcDNA=SeqID_51830; Strand=-; Position=1 -18,372-467
MIGLTIQDPVVIAGVIISIGFSVDIPAHISAFYGHII

SEQ ID NO: 125408 - protein, 19 aa, Heterodera glycines
  Coding regions on vcDNA: vcDNA=SeqID_51831; Strand=+; Position=1 -52,157-164
MTQMLRKHAGSKCCFLSEI

SEQ ID NO: 125409 - protein, 221 aa, Heterodera glycines
  Coding regions on vcDNA: vcDNA=SeqID_51832; Strand=-; Position=1 -30,90-212,391-433,534-796,849-941,1036-1149
  Homolog annotation: Hit_ID=NP_491005.2; Match level="QueryCoverage =96%, HitCoverage=19%, E-value=3e-36, Identity=42%"; Hit description =PaTched Related (ptr-12) [Caenorhabditis elegans]
MNSLLNSLSEVLEDTGPAILISALTNITSDLVGMWTGSPEITLLCIGNIASISFDFFYQITLFTAVLIICARLEFKAELKSIEQNHNSNSTSATGTISSTDSNSDEHNDTSSRAKFTSNFERIANAYIKFVSNIFASIGIVIVSAVFFVICFRAVLGFEINLTMVKLFPPDSPLLEVDNYREDKLMPFYTMAQIFVNNPGDLSNATRRHKLHQFIDEMEHL

SEQ ID NO: 125410 - protein, 87 aa, Heterodera glycines
  Coding regions on vcDNA: vcDNA=SeqID_51833; Strand=+; Position=1-264
MFLTQNKYSNEQKSQKLKQYFEIKELKPTISDGIIAEKLGIGFSTIKNGFWNIDFCEEVYAIRNVFVNVKINFCFILFFFCDQMANI

SEQ ID NO: 125411 - protein, 181 aa, Heterodera glycines
  Coding regions on vcDNA: vcDNA=SeqID_51834; Strand=+; Position=1 -104,697-877,1047-1307
  Homolog annotation: Hit_ID=CAE61901.1; Match level="QueryCoverage =77%, HitCoverage=25%, E-value=2e-52, Identity=72%"; Hit description =Hypothetical protein CBG05893 [Caenorhabditis briggsae]
MAIHPGDPSIKQDLAYLEVQHTPISPLDTFLDVVRLTPLGIVSLIAGNLLELDDLSDTAAVLLLYVVTVLTAFTAHTMVTMPLLYFVFTRRNPFKVVHGMLQALVTAFGTASGGAALPVSMRCMEEHLGVDRRITRFVLPLGSTINMDGNALYEAVAVIFIAQLNNVTLTLTEVITVRRVK

SEQ ID NO: 125412 - protein, 36 aa, Heterodera glycines
  Coding regions on vcDNA: vcDNA=SeqID_51835; Strand=-; Position=1 -49,96-156
MHTCASSFSEQKRHKKSDQTIKEVSRSRRTDSLTRP

SEQ ID NO: 125413 - protein, 29 aa, Heterodera glycines
  Coding regions on vcDNA: vcDNA=SeqID_51836; Strand=+; Position=1-104
FFLFLAASIFYNNLSAWSDVRQTEKIIKI

SEQ ID NO: 125414 - protein, 54 aa, Heterodera glycines
  Coding regions on vcDNA: vcDNA=SeqID_51837; Strand=+; Position=1 -78,463-549
MMSASFAEIGENAGKLWSIPQRFEKKFLGNHLEINLFMLITEPIGISVRFLSCA

SEQ ID NO: 125415 - protein, 95 aa, Heterodera glycines; identical to SEQ ID NO: 124528
  Coding regions on vcDNA: vcDNA=SeqID_51838; Strand=+; Position=1-820

SEQ ID NO: 125416 - protein, 68 aa, Heterodera glycines
  Coding regions on vcDNA: vcDNA=SeqID_51839; Strand=+; Position=1-370
AVLVRFITAPNLLASQQSLLNLPDRTGAHDSTVPSTPPKAKRYNQNIKKNFLKNFFSIFLFDTKASEC

SEQ ID NO: 125417 - protein, 19 aa, Heterodera glycines
  Coding regions on vcDNA: vcDNA=SeqID_51840; Strand=+; Position=1 -49,131-141
MLPEWKISTQIIATYNARK

SEQ ID NO: 125418 - protein, 125 aa, Heterodera glycines
  Coding regions on vcDNA: vcDNA=SeqID_51841; Strand=+; Position=1 -174,520-723
QINAAPPPNVTALPANAKSSIRRPCSKRAPKATSSTRRSSTRQVNLAECRVVVKMPKLVDQSELTISPLIHSSSVLRESHSNFTSTRNAVRSGAKLISKYGGRETTDKVGFGDQMKFSKGAQPCK

SEQ ID NO: 125419 - protein, 45 aa, Heterodera glycines
  Coding regions on vcDNA: vcDNA=SeqID_51842; Strand=+; Position=1 -131,438-444
MCQLLVLLVLILLDMLLLLLLLLDMLLLLLINNGCAVDDNLHVRS

SEQ ID NO: 125420 - protein, 144 aa, Heterodera glycines
  Coding regions on vcDNA: vcDNA=SeqID_51843; Strand=+; Position=1 -288,668-814
MQWIKFNCTLCPIGLHCFYPRKYAKPVLCAHPSVNNITDFLSTGQLEEAATTATTTTPFPTTADVSAAAECAPPPAQLTAWIAVCTALVALLVIAEAAGQRRADGAIEEGEEPVYDEVPLDSDIVVEMRDGENGEEEEEDDSDF

SEQ ID NO: 125421 - protein, 127 aa, Heterodera glycines
  Coding regions on vcDNA: vcDNA=SeqID_51844; Strand=+; Position=1-384
MTTAKHQRTPDDEEEKNLRRKAKVALDLVEAGLAADAMMQDGTRWKKAKTAINVLANLLLAESLTDVSPTFDQQQQQQQQQLSSKEEEKREECTNNSSAAATTESAPDGDVMDDFVNSIQAATSNMQ

SEQ ID NO: 125422 - protein, 32 aa, Heterodera glycines
  Coding regions on vcDNA: vcDNA=SeqID_51845; Strand=+; Position=1-100
YTFETIGQDKKRMKLMPHETRNWLCFVENILT

SEQ ID NO: 125423 - protein, 148 aa, Heterodera glycines
  Coding regions on vcDNA: vcDNA=SeqID_51846; Strand=+; Position=1 -23,467-743,906-1052
  Homolog annotation: Hit_ID=NP_509362.1; Match level="QueryCoverage =100%, HitCoverage=48%, E-value=2e-46, Identity=60%"; Hit description= dauer or Aging adult Overexpression DAO-3, methylenetetrahydrofolate dehydrogenase (dao-3) [Caenorhabdit
NELFTPVIQLPLECTNAIDTDALLDRINPEKDVDGLNHVNTGKLARGELGDGILPCTALACLKLVQNATGQEDFAKGKHVVVVGRSRIVGGPTAALFMRHDATVTICHSRTERLAEHCREADILIVAVGQRGMVRGDWIKPGAVVIDC

SEQ ID NO: 125424 - protein, 116 aa, Heterodera glycines
  Coding regions on vcDNA: vcDNA=SeqID_51847; Strand=+; Position=1 -63,219-506
MAIHSSSGQCAKGVQMLVEVVAFANASSPVNFIVAVWISAPFAFPAQFDQTNEVTREQLTFKRIGKSIRHLLLIRCPIVRDTNKWAKWEKEAIDWQFNDQWNRIDIQINNERKMGQ

SEQ ID NO: 125425 - protein, 44 aa, Heterodera glycines
  Coding regions on vcDNA: vcDNA=SeqID_51848; Strand=+; Position=1 -126,618-626
MEKLKNFTVVDLCKVLALPDKEFEELAVTDHFFPHTFLIFCGKI

SEQ ID NO: 125426 - protein, 103 aa, Heterodera glycines
  Coding regions on vcDNA: vcDNA=SeqID_51849; Strand=-; Position=1 -138,189-247,301-415
SLELSVLRWRLRFLLRCFSRLLLPLSRIACRYALNPSFSLKKIDKDSSFAFVVLCRHENTIYATQIANVLDVGELRNNKVKFKELIVFEEMPQDFCVLIEVCY

SEQ ID NO: 125427 - protein, 27 aa, Heterodera glycines
  Coding regions on vcDNA: vcDNA=SeqID_51850; Strand=-; Position=1-89
QIKEDLCDYWVQFRDLGPQIIKNVRSS

SEQ ID NO: 125428 - protein, 91 aa, Heterodera glycines
  Coding regions on vcDNA: vcDNA=SeqID_51851; Strand=+; Position=1-842
LFEYPKRTLEKIDFFVFGAVPPNRCAQIYGETESFGNSFPIACTLILRWIFAPHKCLSTPNGHLKKSIFLFHKYFFQGSALKRCAQILFTT

SEQ ID NO: 125429 - protein, 179 aa, Heterodera glycines
  Coding regions on vcDNA: vcDNA=SeqID_51852; Strand=-; Position=1 -279,384-644
MDIWAAGITIFTMAFFTTETNALEEHQKIGELFRSEKLNSVDGGLSDSLMHKLKLPRESAQSGSKDWWQRYLSTVTNILSVWQKMPAIAFLSANMLNIEPKKRMTAQGIVAFLDGKCKPTDYPKTHLKMALFGEVSAEKLLKMINYENERFIKREWATAEKSVRRFLKELENRTEFCDQ

SEQ ID NO: 125430 - protein, 232 aa, Heterodera glycines
  Coding regions on vcDNA: vcDNA=SeqID_51853; Strand=-; Position=1 -195,526-647,764-933,987-1085,1227-1339
MNAASSLLLIVFLFYFQFDCALLSFECRGVPTDQMEPFQYPSTQWRRPTESTAQIKIFFKKLAHNIFMGFSTDANHYLPKNKCIAIKIYEEEFKKEYLNSVKILKNGNIDETNLIIDDNSNLTVFEHGERDLDEELQRGNFSSRELNSMVKSIINSLVAFHKVGIHLDIKPMNLIVFERNDFFGKVKELKLIDFDGSVLYSDEQRKMIKINEDSIGCTKTYAAPELLQVRIK

SEQ ID NO: 125431 - protein, 27 aa, Heterodera glycines
  Coding regions on vcDNA: vcDNA=SeqID_51854; Strand=+; Position=1-4,35- 114
MGLGMYFRFYCSFKFQKIVRIVCDVIN

SEQ ID NO: 125432 - protein, 153 aa, Heterodera glycines
  Coding regions on vcDNA: vcDNA=SeqID_51855; Strand=+; Position=1 -61,107-136,184-240,307-366,595-848
  Homolog annotation: Hit_ID=AAP30775.1; Match level="QueryCoverage =100%, HitCoverage=100%, E-value=4e-68, Identity=74%"; Hit description=putative gland protein G32E03 [Heterodera glycines]
MRAILFLAMVCLVMAVILETANSKAVKNKKGAVATPAKGKAAPKGAAKGGIKKDAKSKGKGKKDAKGKKVNPMAAVKAVPKAAENAQKGPSSAEVVAEENNLDTEAVDDLGAEESDFDQLAEDELLEDDAMDGEADEWEGMGEETEMDSQMAL

SEQ ID NO: 125433 - protein, 244 aa, Heterodera glycines
  Coding regions on vcDNA: vcDNA=SeqID_51856; Strand=+; Position=1 -120,164-260,829-1019,1879-2205
MKRISRLICRVGSVHALGHRTNAARLIRTQISDHRKMREWLSDLLSRRFGPKCKFGIWYETGSAIPSAKSPEMGQIVFAVDDSVRDAYFARKIKKDVMLINYAGLWMLGLDFLPMNNRDTLQMHVYRDCGCEMHAWDNKTNEEFVDNEMRKLARERKFKAMDDEDEEEKGGGEEGEEGSGKGGKGTNKDKYIEVQLVARKYFYEVKVGDRKVFNYFPKSDEWWKTWQMEDITQVEASGQAEGQI

SEQ ID NO: 125434 - protein, 68 aa, Heterodera glycines
  Coding regions on vcDNA: vcDNA=SeqID_51857; Strand=+; Position=1 -127,270-346
MAFEVFPLLSVGDSILIEGKLKDNATIFKINLFHDVNEKNPYASDLVLQILFNFTGDGTIQLSSLIHQ

SEQ ID NO: 125435 - protein, 274 aa, Heterodera glycines
  Coding regions on vcDNA: vcDNA=SeqID_51858; Strand=+; Position=1 -64,114-226,426-1071
MHFPKHFIFLAILFLLLGTARSALVENDCPICDNEMKKENQRIVSLSCEVIFYSTRAYLGSIATLTSVQQQPQNASWWTHQHQTNMQSGQWPNPWNNVNQQPWRAYYQQQMPNPPSGAQTHPQNVQHDSRTNPEHVRMPWTNLQQQPAHAQHWNANEHQQAPNAPWWSHYTWQHAGHPQMPWAYAPQQSTHTPWWTNPAHMWWQQDANASQVNAHNIHVDGNATVVQEGNDLIINGQRHRNAAARGVSISTGGRVNHDGVQTRETSFQSKFWAE

SEQ ID NO: 125436 - protein, 86 aa, Heterodera glycines
  Coding regions on vcDNA: vcDNA=SeqID_51859; Strand=-; Position=1 -100,187-347
MVHKPFSLCLSVFFISAFFFVYSADESIKPPTRNVLITAEEEKQRDVEGFLAIKAIHAVLDDDNSGSIDRFESADVCASEMTRTHQ

SEQ ID NO: 125437 - protein, 97 aa, Heterodera glycines
  Coding regions on vcDNA: vcDNA=SeqID_51860; Strand=+; Position=1-293
MGKNCGNDEKSKGEQFNGRMMVHPRTNQGKMAWWQSISDEAMLRDHLEHIIGQLVNVSKPLSPVRFVSEKATTSSAEADVSNGTHSEEQPECSVARL

SEQ ID NO: 125438 - protein, 78 aa, Heterodera glycines
  Coding regions on vcDNA: vcDNA=SeqID_51861; Strand=-; Position=1-237
MHGLFILGRLVPVLVLLALLGGLLHTGAQESISTRSTRAEGTLMCGKLPASKVYVRLFKTNSDGQQAAEWAFLIAIKI

SEQ ID NO: 125439 - protein, 88 aa, Heterodera glycines
  Coding regions on vcDNA: vcDNA=SeqID_51862; Strand=+; Position=1 -76,218-296,488-601
  Homolog annotation: Hit_ID=NP_871961.1; Match level="QueryCoverage =52%, HitCoverage=32%, E-value=1e-10, Identity=65%"; Hit description =transthyretin-like precursor family member (15.5 kD) (2F18) [Caenorhabditis elegans] gb|AAO38659.1| Hypot
IWLHLGPDPDDTLDEKFVDAAGAFKLNGYTRELTDIDPVLYVWTDCNDGHTEILIDYSDHYVIRSLVKTRKPMIGLTSEWSISSQGVK

SEQ ID NO: 125440 - protein, 35 aa, Heterodera glycines
  Coding regions on vcDNA: vcDNA=SeqID_51863; Strand=-; Position=1 -4,144-244
MVICDKMICILPVLLFFCQALDGQQTRKIHALDGK

SEQ ID NO: 125441 - protein, 171 aa, Heterodera glycines
  Coding regions on vcDNA: vcDNA=SeqID_51864; Strand=-; Position=1 -174,824-955,1558-1767
MDNFSNWIISNATKFYCFSIILSVPSILLYIGEMFAIVKNKETRANSFYRLFCVRGISFWNKLFWLLIMVMLAIPSLTCYPIMQMHATLSENANGTFLIMEPAHSIFSYKNQTPSHAAQFQRYTPLKKISTLYKISTSVGDYVKSILGVLYKFCHPSYAMLIGIFCTVNRK

SEQ ID NO: 125442 - protein, 34 aa, Heterodera glycines
  Coding regions on vcDNA: vcDNA=SeqID_51865; Strand=+; Position=1 -71,365-398
MFGLKFKLGCAYFTYLNRYYVMCRVLGQVVSEIL

SEQ ID NO: 125443 - protein, 108 aa, Heterodera glycines
  Coding regions on vcDNA: vcDNA=SeqID_51866; Strand=+; Position=1 -106,590-739,796-866
MPTDKQIDDGTALKTMHEQIVWKLLNNKAFRDKLKKIEINKKRMSDLIGDGTEIGNNLLSESHKRKFEPKGKEIIKMGNQKETQKAAKGNGQKQNETPKSDEQSKKKS

SEQ ID NO: 125444 - protein, 17 aa, Heterodera glycines
  Coding regions on vcDNA: vcDNA=SeqID_51867; Strand=-; Position=1 -45,107-115
MAQKLKMAKYRMQHTSC

SEQ ID NO: 125445 - protein, 28 aa, Heterodera glycines
  Coding regions on vcDNA: vcDNA=SeqID_51868; Strand=-; Position=1 -16,376-446
MKINDDVAKANRTLNNHTNALVVENAFS

SEQ ID NO: 125446 - protein, 67 aa, Heterodera glycines
  Coding regions on vcDNA: vcDNA=SeqID_51869; Strand=-; Position=1 -55,305-453
MAHCHDYESKLGQAKVRWVETEISKSAGPDRSDIFRNNRFPGPASQKPVKPDFQIAGPGTGFRFGKI

SEQ ID NO: 125447 - protein, 180 aa, Heterodera glycines
  Coding regions on vcDNA: vcDNA=SeqID_51870; Strand=+; Position=1 -188,241-401,468-542,614-732
MPCQCNSSKLRAVHVRVWQHRMYESGPLQFITHDAVLITWHCRACNGRFFQTFEFSTSGKSDRWGRYRLYQSKERRFDINVTYQDIRQVYDQMPGAGMYHVIYRNCKHWADKFVPLIRSKSRIDDVTCACDNWHFRATKIEVYMNGEEWVILVRFICENCRRFPNMMFSVLFGEFGKVMR

SEQ ID NO: 125448 - protein, 85 aa, Heterodera glycines
  Coding regions on vcDNA: vcDNA=SeqID_51871; Strand=-; Position=1 -55,305-507
MAHCHDYESKLGQAKVRWVETEISKSAGPDRSDIFRNNRFPGPASQKPVKPDFQIAGPGTGFRFGKNLNSHMYFNAKINKNRAKC

SEQ ID NO: 125449 - protein, 77 aa, Heterodera glycines
  Coding regions on vcDNA: vcDNA=SeqID_51872; Strand=-; Position=1-234
MAKPTVNIPSNAGPITFVPPIRYYNNRPLQLSIDFHPTPVGFFWGERVHSLTSTATRESPSNFSRQQGPCLWAAWSR

SEQ ID NO: 125450 - protein, 258 aa, Heterodera glycines
  Coding regions on vcDNA: vcDNA=SeqID_51873; Strand=-; Position=1 -60,295-495,762-1277
  Homolog annotation: Hit_ID=NP_702308.1; Match level="QueryCoverage =80%, HitCoverage=3%, E-value=6e-17, Identity=32%"; Hit description =hypothetical protein PF14_0419 [Plasmodium falciparum 3D7] gb|AAN37032.1| hypothetical protein [Plasmodium
MSERFLADTKMYKQMVSEKKNVPLLWENGPEDVTLLSVLAICTEEIFAQIRRIEKMQNFSAKNKATEKFSEEFLLEFTLCLNRNLKKIEYLTANEQLSASSDSSDGEEIFTDAKENFKKKNEKETKIINKIEEKTEKNSENLNEKEKESSNLNEENSKKEKKKEKEKAKWKKKEEEKGKKKGKILSKSEKFKNSKASEETETKEKGNSEELKMKNEKEIKNGKNNRKWERNNERTVEKHSAEQKWEMTAETSGKWNWI

SEQ ID NO: 125451 - protein, 75 aa, Heterodera glycines
  Coding regions on vcDNA: vcDNA=SeqID_51874; Strand=-; Position=1 -46,105-286
MAMISNAHHETLGFLFSFQRYNDLYAQLYESFFEANTKVGRWRARIVLDTFLYGEWAEDFLGNESQKISTGASSF

SEQ ID NO: 125452 - protein, 57 aa, Heterodera glycines
  Coding regions on vcDNA: vcDNA=SeqID_51875; Strand=-; Position=1 -124,173-240,701-836
MDSPRHVIAHPLNFRLFARILVRGSKENNLVWANCYVANGIHWLQYIDRPCNATGLS

SEQ ID NO: 125453 - protein, 97 aa, Heterodera glycines
  Coding regions on vcDNA: vcDNA=SeqID_51876; Strand=+; Position=1 -128,370-535
MLIFKDVLAYKDIFYFQERGPNFRDVLAIQGRMATLSKPLSIHLIDIQKPQNEAKASDLGALDITDYNSQDEKDDLEIDRTYLVNRKGTDVITRDRI

SEQ ID NO: 125454 - protein, 405 aa, Heterodera glycines
  misc_feature (248)..(248): Xaa can be any naturally occurring amino acid
  misc_feature (396)..(396): Xaa can be any naturally occurring amino acid
  Coding regions on vcDNA: vcDNA=SeqID_51877; Strand=-; Position=1 -114,179-238,390-436,487-550,605-686,1056-1318,1372-1466,1683 -1770,1921-1980,2056-2268
  Homolog annotation: Hit_ID=NP_497744.1; Match level="QueryCoverage =96%, HitCoverage=95%, E-value=9e-82, Identity=41%"; Hit description =galanin receptor 2 (3E774) [Caenorhabditis elegans] emb|CAA88290.1| Hypothetical protein T27D1.3 [Caenorh
LIVPFSLPIRCVVVRSFRPLLCFFSLLTFVGLLGNLLNLLVIVAIIGDKRMRKSVMNLLLLNLAIADALNLLATTVEWVPTLRHNGPVWVLPANLLATTVEWVPTLRHNGPVWVLPAVLCPIIRYLECVFLFTSILTQLVLCPIIRYLECVFLFTSILTQLVVCVERFIAIAVPLHARRLCSRKNILLTICAVWCVVALAALPYATHNKKAENCKKTHALTIELFSVSFACTNFNRKSYFWHFYKFAXFVVLFLFVVLFLLPGIIFLFLYTKICRILWAKNDKLYDRANSCVGSPVSGAHEEALKTRRTVVKMLVACVSVYFICYSPIQAFLMQRGLFNLSIHPPYEFVLLMNALAILCSACNPLLYTLFSSRFRARIGHLLCLCCDIFYRRNNKXNAKKNRQSN

SEQ ID NO: 125455 - protein, 262 aa, Heterodera glycines
  Coding regions on vcDNA: vcDNA=SeqID_51878; Strand=+; Position=1-789
  Homolog annotation: Hit_ID=NP_001004509.1; Match level="QueryCoverage= 98%, HitCoverage=17%, E-value=7e-16, Identity=29%"; Hit description =si:busm1-180o5.3 [Danio rerio] emb|CAD60788.1| novel protein similar to DNA polymerases [Danio rerio]
MEELQRRGVRPRRLVATGLRVYTLELGGRNQRSVVAKDSLNFFGCALSKLPAMFGLDGVPEKPFFPYNYIRAENMDVVHVGLPPAVDYDPDRMRPAERDAFQRWHAEEQQRRPNRLFVLRRELLRYCANDVRILRRACLRFRHVVGELSGGVEPFLAASTIAGLALVIYRQRHLPRDLMVHTPEGGFLRGRRASAASRHFFALLERLRPQWRGRLRTARWSIGEACVEDDGYRLDALLYRPVPLRPLVIEFNGCFFHGKEGE

SEQ ID NO: 125456 - protein, 132 aa, Heterodera glycines
  Coding regions on vcDNA: vcDNA=SeqID_51879; Strand=-; Position=1 -285,815-925
MGSDGEEEEEVEMEERGDQQGQTDEAEKRMRNGRTMTAYNANEDNAMNNNIISPCSSSSTITIEGRTTSDDGVRRHGIAGGAVNSSEQSYEAPKLRDPVELDAMKRELFDALVDKKARQQQRKRVRFSCIRQ

SEQ ID NO: 125457 - protein, 130 aa, Heterodera glycines
  Coding regions on vcDNA: vcDNA=SeqID_51880; Strand=-; Position=1-390
MATLFHLLIPAFAQVWVLSSELTRYLFIDLAFARPFFFTYAKSCLLSLLLLRYSCNCCTEEADASKKDGTEDTAGGDGGGGGHHNDANDDEDDGMASGSSRNGVSNRKSKKKRSSSSSGGGTAKTTKSGT

SEQ ID NO: 125458 - protein, 28 aa, Heterodera glycines
  Coding regions on vcDNA: vcDNA=SeqID_51881; Strand=+; Position=1-3,66- 149
MGKQKLLRIMGKLPKMVKFKHHKFGVLL

SEQ ID NO: 125459 - protein, 69 aa, Heterodera glycines
  Coding regions on vcDNA: vcDNA=SeqID_51882; Strand=-; Position=1-210
MARNSVSLFDTTIICAYNASFAFPVKAAEQREHWRPGGPADGGTVQQRHRRGGGDGDDDYGRGHLMSDD

SEQ ID NO: 125460 - protein, 130 aa, Heterodera glycines
  Coding regions on vcDNA: vcDNA=SeqID_51883; Strand=-; Position=1-393
EYFGDLWTFYLGTGTKNKFLGVSGIDFLAIQLHKSKNKMGEINLHKRDSNLWGQKQTPNAQPPHHRTTQNGTNVYSIYWDRKKFGTSYLGTRTHFAENKTTFLKNPWVLYAPTKFHSETPRTPQDLPLLA

SEQ ID NO: 125461 - protein, 175 aa, Heterodera glycines
  Coding regions on vcDNA: vcDNA=SeqID_51884; Strand=-; Position=1 -45,602-1084
MDEERERETNGNGETAERDKLEQALAYIERRCHVMEQIGLDQGIVLGRLDEFRPAPGDVFTFRGSKGTQTMLTAKALGYSEKELDELQVQIRVSKRAKGQLKKQSKMKIELIAVKVNANGICGGQNDNERPIERHRTNADHENGVGHHTDCPIGKCCQKHTVGGRTAPARKRRIH

SEQ ID NO: 125462 - protein, 113 aa, Heterodera glycines
  Coding regions on vcDNA: vcDNA=SeqID_51885; Strand=+; Position=1 -51,356-646
MNLYFYIFSYYLAVLSRAITTPKKSPAEAEGKNDRNPAYWKGYRKHFDKMLKQMWKSAKAKAMSERKQFFKNQQRRSIEQKDRNQTEQSEMAKKCAELNDKFGIIYKAPIICF

SEQ ID NO: 125463 - protein, 48 aa, Heterodera glycines
  Coding regions on vcDNA: vcDNA=SeqID_51886; Strand=+; Position=1-148
IFEKKTGLGALCQFILTRTGSPRWSRTGQTGLKSLLNKTIGGPGTNKP

SEQ ID NO: 125464 - protein, 147 aa, Heterodera glycines
  Coding regions on vcDNA: vcDNA=SeqID_51887; Strand=+; Position=1 -186,2461-2718
MDKNYFPLHNLISKLGTPTLLDEKKWLNKAGQVSLGQNIGAQKKASVTPSSSQSAEALSNKKPKSKSQAKGVTKKDFNELLKQMWESAEKEAMEKQKLFNVENSNLASSNKLKDILEREKLKIKRAELDDKFGIFYIDEKSPLAKVI

SEQ ID NO: 125465 - protein, 68 aa, Heterodera glycines
  Coding regions on vcDNA: vcDNA=SeqID_51888; Strand=-; Position=1 -160,559-605
MTLPERARDEYNAYIALANGATEEQKRRGTHLAAFINLFYFFMQCVMDDEDLKDLSKMAKNIMPTYQK

SEQ ID NO: 125466 - protein, 91 aa, Heterodera glycines
  Coding regions on vcDNA: vcDNA=SeqID_51889; Strand=-; Position=1-1140
SVHLNNFYPKNFFWVFGAVPLNRCAQIYGETESFRNSFTIACTLILRWIFAPHNCLSTPNGHLKKSIYFCFRGSPPEPMRPDLWGDRILRE

SEQ ID NO: 125467 - protein, 76 aa, Heterodera glycines
  Coding regions on vcDNA: vcDNA=SeqID_51890; Strand=-; Position=1 -110,282-402
MGTGIAGVRVGVVLYCPLIQYMRDLDVLSHDFSAQNGFFVGTTAFALFISAGTFLNSATYGRFLNPLPLRRQINMD

SEQ ID NO: 125468 - protein, 85 aa, Heterodera glycines
  Coding regions on vcDNA: vcDNA=SeqID_51891; Strand=-; Position=1 -3,202-456
MLIDEDLIILLNDLKATPDQAKKLDDQSRTSAVDQHKKKMLEAYFGFIYLIFSFLNQYFYRHCNNPISEHTCSSQKTELDVENLF

SEQ ID NO: 125469 - protein, 184 aa, Heterodera glycines
  Coding regions on vcDNA: vcDNA=SeqID_51892; Strand=+; Position=1-553
MPSLEKIPSMNNGLRQATIHSPYRLMPSDSEEYLIVQEEEGEEQKGKETVREKGVDERAEAEKRLAGKQTVRHQTEQSSKSTMQSSTETGLILMPEAKLGSLPSADAMTTKSEVVVEETTEVEVHEEGERVEEEEKQRTEREAPDEREEERPKSAASRTGTPTIWDQYKILGDQFAKYGSLEIE

SEQ ID NO: 125470 - protein, 228 aa, Heterodera glycines
  Coding regions on vcDNA: vcDNA=SeqID_51893; Strand=+; Position=1 -358,406-731
  Homolog annotation: Hit_ID=EAL45229.1; Match level="QueryCoverage =97%, HitCoverage=26%, E-value=4e-13, Identity=25%"; Hit description =hypothetical protein 208.t00006 [Entamoeba histolytica HM-1:IMSS]
MEQYRETDKEQQKKGELGKKQERHGMKWGEFEEEEREERKEKEGEKKEKEGEEEEKEEQRGEEKDAGRSIPADTLREGALSIGFVMPSQVGAQRKVLTRAADQSHAAPPFPQIKRRAFGNERLFEKKPAEPKQTFVKKPIRGTDFVVVKGRAEEGKEVRESTRSMMGQRKRDAFVRGQQRDAQMEETERMRGESQEERALKRESQEEGLRKRESEEERARKRESHEEG

SEQ ID NO: 125471 - protein, 42 aa, Heterodera glycines
  Coding regions on vcDNA: vcDNA=SeqID_51894; Strand=-; Position=1 -106,307-457
IGLLTMTAFCYPNEMVHSVRVGIAHSQSAWHNFKQAPEPKSS

SEQ ID NO: 125472 - protein, 225 aa, Heterodera glycines
  Coding regions on vcDNA: vcDNA=SeqID_51895; Strand=+; Position=1 -72,124-729
VLISDQPMNTKKPSAINREALNESVSASPGHGSKSKDFRNCNDIKLATRKTNEWGKAQLKGCTKELCIRCVLDADMYYRTMHIYDGHLAKSRDACEQMAKEKAQLAEEVARHRRDRTELTTKYQQLEALLHHEEQGQQRQMDDILKERNIKMGELQAKVDELTGIIGQRDAKIAEMTNQFAMTMSIKMEKAEQKPEVPKKVHLLALLQFIRPKKDLTTLMHHNFF

SEQ ID NO: 125473 - protein, 89 aa, Heterodera glycines
  Coding regions on vcDNA: vcDNA=SeqID_51896; Strand=+; Position=1-270
QAISGAADQASELFSQTPGYPEHCRHPPHSCVAFSAWLYRRVFGVCGFICRLFFTHDQPLLSNGRRGLFGTNRTRKTSAVCPAKLWRKL

SEQ ID NO: 125474 - protein, 39 aa, Heterodera glycines
  Coding regions on vcDNA: vcDNA=SeqID_51897; Strand=-; Position=1 -10,309-418
MTNSFKTNFTCFPYFLSSKVPSPRKMNPLVCTADFAVAK

SEQ ID NO: 125475 - protein, 25 aa, Heterodera glycines
  Coding regions on vcDNA: vcDNA=SeqID_51898; Strand=+; Position=1-75
IGFLAIIGIGDLIGIGFCLARHIPG

SEQ ID NO: 125476 - protein, 90 aa, Heterodera glycines
  Coding regions on vcDNA: vcDNA=SeqID_51899; Strand=+; Position=1 -170,827-929
MLRVGVGTVELIAGTKMCHYVDHFGSASKRRHLAPCHIGCGGGETVTAANEFPNANRVFTVGESDSYICFDPIRILNPNSNKKSKLQIFF

SEQ ID NO: 125477 - protein, 183 aa, Heterodera glycines
  Coding regions on vcDNA: vcDNA=SeqID_51900; Strand=+; Position=1 -498,828-881
MPSNVPLRIVVLRLARHSSKFVSLILLVAFVKEIGRNSTIIYRHYPLFAVPSGIFTNDEFVCVYQFNFYLIHGVPGLYPLKFPIQNRISFWNIAKANRGTLAMEIEKFSEFAREVGRMQFSDAVGINGFQWEIFAGINTKKKSTEKCLGFGLLFTTVSEKSENNVNNLRKKSLVVNGAVKLFL

SEQ ID NO: 125478 - protein, 113 aa, Heterodera glycines
  Coding regions on vcDNA: vcDNA=SeqID_51901; Strand=-; Position=1 -66,279-554
  Homolog annotation: Hit_ID=AAL93203.1; Match level="QueryCoverage =84%, HitCoverage=14%, E-value=5e-12, Identity=37%"; Hit description =transposase [Bactrocera dorsalis]
MGDKVDANGTVKRTAWHNNKDLVEVNEYLRAKKININEDPISYWSGANELKWPLLTKLSKKYFSAPATSTESERLFSTAGLIVTDLRKRLLPENVDKLLFLHHNLKIYDFDYE

SEQ ID NO: 125479 - protein, 131 aa, Heterodera glycines
  Coding regions on vcDNA: vcDNA=SeqID_51902; Strand=-; Position=1 -237,687-845
MGVKGKNGIQRDWHIIITGHTYSHDKKGGGRGKAERSTIREIHRCRAKGDVKAKNGWRGRNPRVTLGVIIGTLGWGMVVVRWSSTFQMLDRFLQNKTVVGLLCAEDISFPNFSADDWRIISALKQVVPNAC

SEQ ID NO: 125480 - protein, 285 aa, Heterodera glycines
  Coding regions on vcDNA: vcDNA=SeqID_51903; Strand=+; Position=1 -672,718-903
MLIAFVRNEQKMQISEYSMEKYEIHFGILYYMRKNWKCSKISEEFEEYEWTECQKYRKYFDILYEYLCREYVGIPTVKPKFVFEDRIEIEGPIIYAVNCLARISRFYFNSDEFYKLNRLFKWVYNFEPKLLNEERLNFGIKLENEPKLPINEMILQLAIDTANEWQTNESLEGIIRQNFDNKLEEMYKKAEERAKEYGPWGANEINDDKHMIIAYSKFDDQRTWTDDAFFSEFVKGLTTNSKKFFKMAKEYSNYLRLKKEKGNYILTDERPMILWVKGIENRKSI

SEQ ID NO: 125481 - protein, 251 aa, Heterodera glycines
  misc_feature (15)..(15): Xaa can be any naturally occurring amino acid
  Coding regions on vcDNA: vcDNA=SeqID_51904; Strand=+; Position=1 -47,3753-3903,5567-5725,6056-6453
  Homolog annotation: Hit_ID=CAD22154.1; Match level="QueryCoverage =97%, HitCoverage=50%, E-value=4e-43, Identity=40%"; Hit description =pherophorin-dz1 protein [Volvox carteri f. nagariensis]
FTLASHCCQLFLIIXTDSLPEKKTAELPLPPAEKIESLPLPPLEKMKTPPLPPADKMPSPLPPSSKPPRPPRPPPPPPPPGQHPPRRPPSPPGPGPSPPGSPPPRPQRPPRPPRAAAPPPPPPSRPPPSRPQPKIETPRPPPRPSLKKEPQPLLDPRPSTSQQVDRKPKREPKFDLDPRPSTSRQAGYNPPAEPKHEQKPSKKPPPRATPYHIPKREPKIEETLPRQQPSPAAPQVPPVPPPRRGTKPPPP

SEQ ID NO: 125482 - protein, 22 aa, Heterodera glycines
  Coding regions on vcDNA: vcDNA=SeqID_51905; Strand=+; Position=1 -31,272-309
MVKTGTLVLSYQYKTLKANERN

SEQ ID NO: 125483 - protein, 419 aa, Heterodera glycines
  Coding regions on vcDNA: vcDNA=SeqID_51906; Strand=+; Position=1 -693,787-1039,1094-1407
MLIDFVKGQQEIQISEYSKQKYEAHLGIVYFMKKNWQCSKISEKFEEYERTECQKYRKYLDILYEYLFREYVGIPTVKPKFIFKDKEEQFEINGPIIYVVNCLVKISRFYFNSKWNKIYKYKLNKLFKSVYNFEPKLLNENRLNYGIKLENVQKLPINEMILELAIDTANEWQTNESLNGIIRQKFEENLQEMFQKAEENAKKDYSRRVNIINDDKHKIIIFSKFDDQWTWINDALFSEFVKGQAATNFKQFSKKFIEKYSKKCLENYEAHLCVVYFIRENWQQCEANCKDNAKCQMYRNHFNILYEYLFRLYAEAKNPSESKQLAPVIRPIFFGPNGIALSLIEVVSSFNHVSKYSCNEMFGQISKLYPMKLVNEVEFNYDENNKDALNESTDLNESTVTDEIIRKEFEQKMKKIYEG

SEQ ID NO: 125484 - protein, 188 aa, Heterodera glycines
  Coding regions on vcDNA: vcDNA=SeqID_51907; Strand=+; Position=1 -241,954-1251,1504-1531
MPLINLGFPIICAHFCQILSNPDDNRANEDGRLLSFNQIGEFIEAIKEPNFKQIITFGRPTVPINEVTEESEEADWTDKLGNKMIQAGEQYGTTNLIREINSRINTAEPIIFEYIRNENSVTCADQPDNCQEMVKVAKAQLSVRLLISMAKQIVQEKILHQIYNNPLQKARLCKWWYRFRLIEDIWSY

SEQ ID NO: 125485 - protein, 83 aa, Heterodera glycines
  Coding regions on vcDNA: vcDNA=SeqID_51908; Strand=+; Position=1-252
MPSASAGTVSVSNGTKANGNQPNKHMQMLAMAGPAPFSDSPEAIAIRDAVDYTQKITLEMAYNNTGEHSALSAMTQIGGAWGY

SEQ ID NO: 125486 - protein, 59 aa, Heterodera glycines
  Coding regions on vcDNA: vcDNA=SeqID_51909; Strand=+; Position=1 -75,126-230
MLKEWTDRSDEFIRNFTSTFNSDGPIGRFLSSRSPTPALEEQEEAAASDDDEDEEHNEA

SEQ ID NO: 125487 - protein, 98 aa, Heterodera glycines
  Coding regions on vcDNA: vcDNA=SeqID_51910; Strand=-; Position=1 -14,202-350,643-776
MTEKRSHTKIVKNNKKRQIHSLIFSSLSITFENVFDQTEVEDLCTEHQLQTIPFDVYAFPGPLQRTVEAIPLLKYMPFMPKQKKANANLRNGFGENKF

SEQ ID NO: 125488 - protein, 126 aa, Heterodera glycines
  Coding regions on vcDNA: vcDNA=SeqID_51911; Strand=+; Position=1 -50,509-731,1128-1235
MPLSVPRNPYFEHFGPKYRMTLSKPPLVSLPYMSDKLLPFVPKSAIYSQLFVSNQTQNEWHEDTFRLKLNLEGCKHLWKTKQPQMMFKIEKVLLAECPFCLQYTDDEDKLPHRLKACNVKIFHNEH

SEQ ID NO: 125489 - protein, 126 aa, Heterodera glycines
  Coding regions on vcDNA: vcDNA=SeqID_51912; Strand=+; Position=1 -112,250-518
MDYPPTDCPFMVYPLTDLSITDGLFTHGLSTNGLSTDVCREDILFLESGKKDQPAQTNTIKKVVYRKMKKETVHEFVIRQPVLQNGEGGIRFTYELELDENGKISEKNVNDQSLKVVDERAVIMFI

SEQ ID NO: 125490 - protein, 110 aa, Heterodera glycines
  Coding regions on vcDNA: vcDNA=SeqID_51913; Strand=-; Position=1 -39,102-265,608-734
  Homolog annotation: Hit_ID=AAR03852.1; Match level="QueryCoverage =80%, HitCoverage=31%, E-value=1e-23, Identity=62%"; Hit description =cytochrome c1 [Tigriopus californicus]
MSFRSAAALGLNLRKASKFVLFGALATGGSVLLYSLENSGARAYDFVVHPSHLPWSHGGLMDAIDMRSVRRGYQVYKQVCAACHSLKFIRYNHFVDNFMTRDEAKTEAAE

SEQ ID NO: 125491 - protein, 337 aa, Heterodera glycines
  Coding regions on vcDNA: vcDNA=SeqID_51914; Strand=-; Position=1-1011
MKHTTRMLLVPEELYRSLLARSSAPVADASSARGGLPQHMTPIEHTAKRMARAAHSGGVTQSTDGVSPASKQHLLNDDERLIHYQQEFKRFKKLLEDEQERPAPVRLTQLPTDEASKGLLRDALSEAARTIQQQQPQPRQPAPHQQQQQSSQSDSSPMRQPPRRRQRPAKRTHRTTSASTDGAEASRFPSSSSAVSLLTRTDNGGKGGAETTEREDSSNDDRPQNVAAVDPARKGQRKEADVQLHPSTSTATAVPAAVLRDTEQRKRQAIDYALRNAGTLGIGDGQQVYRLMQGAYRPMQNSDLDALLTFHFAEPQPEKAPPGYKTFIGNAAQDPRM

SEQ ID NO: 125492 - protein, 352 aa, Heterodera glycines
  Coding regions on vcDNA: vcDNA=SeqID_51915; Strand=+; Position=1 -86,141-419,467-887,942-1210,2067-2070
  Homolog annotation: Hit_ID=AAL78214.1; Match level="QueryCoverage =42%, HitCoverage=78%, E-value=3e-17, Identity=32%"; Hit description =putative esophageal gland cell protein Hgg-20 [Heterodera glycines]
MFLLLVGCGTILWFFFGLFKKRRLPHKKIFICSDCWLLVFDFLAPSQLGLEIALISHRFDFYVDEHFKTCKWKLNKQFLIQWDIEENGTKQMQIVNSDGNPLPIPQNPLPNKVIGFRDIQIIYIDQNVVAFLRHFHRRIFAVCTMDLYIITENVRILDFVLLNIWPMLRDAIRVMYLNTIAFRRLRQLAPSLLSDCPSLRFVSFKDAILPAFPPDDSANASDGQTVAKWSFTPCPDGRSKWLKCFVNAPVDQWSSMIEQFKAAFSNASSSATFFISFHFPPSSPLDFIVPFDLINEVTGEQLTLGQSSANACWLTRCPIAWDERNWENMRNEMYVRLNPIEIRIRDGGYGDG

SEQ ID NO: 125493 - protein, 123 aa, Heterodera glycines
  Coding regions on vcDNA: vcDNA=SeqID_51916; Strand=+; Position=1 -285,454-540
MMIINFGPHKFSILIIGVITVQVCLFSSISSNSIRSKRQYVQQQQQQQHNEEYFVQQLIGGQFQQNSYVVPNQQQQLNPNLALQQQQIVPINGQPHLNSQPLPQQQESAQQQISPINGRQSVC

SEQ ID NO: 125494 - protein, 81 aa, Heterodera glycines
  Coding regions on vcDNA: vcDNA=SeqID_51917; Strand=+; Position=1 -155,416-503
MSNQNRMPMPNTNKNNAKRLTRYNEQYAKIMLALSAGAYFRSAHSAEECVANWLPEPNQWHIYASINQTCDILDNPCSSYT

SEQ ID NO: 125495 - protein, 98 aa, Heterodera glycines
  Coding regions on vcDNA: vcDNA=SeqID_51918; Strand=-; Position=1-294
  Homolog annotation: Hit_ID=NP_741868.1; Match level="QueryCoverage =94%, HitCoverage=13%, E-value=5e-15, Identity=42%"; Hit description =apical Junction Molecule AJM-1, Junction Associated Molecule JAM-1, putative protein, with 5 coiled coil-
MSFSLRLRYSRNVEEEERRVREGQERRKREEEERRKRVDEQRRRWEQQEVEQLERIRRERERMEQALEAQALDRERVERDRIGRDRAEREAAEKRRRE

SEQ ID NO: 125496 - protein, 13 aa, Heterodera glycines
  Coding regions on vcDNA: vcDNA=SeqID_51919; Strand=-; Position=1-66
NLFFNLKFIKAIN

SEQ ID NO: 125497 - protein, 376 aa, Heterodera glycines
  Coding regions on vcDNA: vcDNA=SeqID_51920; Strand=+; Position=1-1128
MFLSGKDDESSISAIDRKLWQGKTTIKISDLEKAQNDMGKLEDGVNRAFRCLNRSLNQKVNWVKDVVANTNANFETLKVQFETLTERVDMLDQDSDGTNSGGTVSITNLNRASRALFVTPMGNAQPNQVVPNQVPIHQLSSEDEDDGPTLFGLNMLSSGPTVGSGLEMFCEESVFAFDDWAERFKDYLSVSGKAYTEQEKVTRLKLALRDTPRALFKELLPAQTDTLDSALSELRQKLDSPQRREIAKRTLSLCKQREDETVAQFLRRLTPLVDATNSSLTGDIRKEKICEEFLDRLKPNISFLIRLVGLSRAKDLDLVRAQAEELEALLLMNKGDEASRLSQAVHALSNQSPQSNWSTEANPNNDRAGQWSSGNN

SEQ ID NO: 125498 - protein, 84 aa, Heterodera glycines
  Coding regions on vcDNA: vcDNA=SeqID_51921; Strand=-; Position=1 -88,121-287
MENGCGLKLRNGIEIKCEMELKLNMKIGEMKNGQKGKILREGPGRARGGKPENEFCPGIEERKNGKRDGEDFASPELLGVESPG

SEQ ID NO: 125499 - protein, 82 aa, Heterodera glycines
  Coding regions on vcDNA: vcDNA=SeqID_51922; Strand=-; Position=1 -121,274-401
MNEEQISADDAIVSATSDDKLESFSKEMAGLIISPHDGVKIQPKHKYAIVCGKTLITIMGNRMLMTLVGVVHIGLFKLVVHG

SEQ ID NO: 125500 - protein, 26 aa, Heterodera glycines
  Coding regions on vcDNA: vcDNA=SeqID_51923; Strand=-; Position=1 -43,118-155
MQIRGKDFCFQKCTAESDFFSFYYNV

SEQ ID NO: 125501 - protein, 30 aa, Heterodera glycines
  Coding regions on vcDNA: vcDNA=SeqID_51924; Strand=-; Position=1-90
MNLVEENLESTSNANSLIEPIIASPNAQGT

SEQ ID NO: 125502 - protein, 169 aa, Heterodera glycines
  Coding regions on vcDNA: vcDNA=SeqID_51925; Strand=+; Position=1 -126,171-266,314-525,568-641
MRRETEEITRERAVHRQQSLRRPPLARTMNGSIGGTKIYTPFSSYVNQLYMNAAFGSGDESSSTETNAVDEKRKARVRGLLEQIPVDIYTEGAKGPAECAICMGDFEVSLWSSFMIYGKSICSSGGRLHSLFALCPFLSPPMHRRLAPPLLHLSVLHGTGGLRAAFRLH

SEQ ID NO: 125503 - protein, 96 aa, Heterodera glycines
  Coding regions on vcDNA: vcDNA=SeqID_51926; Strand=-; Position=1-291
ILQDLFKMISARRWIHVAHTKILGTSVKKSKLKYLEDFYMGMGEKCIQRDLGIISVFGDSCRHFAPLFHLKRGKNTDHSLLMFWVVTSPPSFAVFC

SEQ ID NO: 125504 - protein, 20 aa, Heterodera glycines
  Coding regions on vcDNA: vcDNA=SeqID_51927; Strand=-; Position=1-61
DSTVEEKTKESDLSSVQQPN

SEQ ID NO: 125505 - protein, 23 aa, Heterodera glycines
  Coding regions on vcDNA: vcDNA=SeqID_51928; Strand=+; Position=1 -68,191-194
MRQIINFYLFVLFFAPNFAEKLR

SEQ ID NO: 125506 - protein, 150 aa, Heterodera glycines
  Coding regions on vcDNA: vcDNA=SeqID_51929; Strand=+; Position=1 -92,595-753,1005-1208
  Homolog annotation: Hit_ID=CAG00991.1; Match level="QueryCoverage =75%, HitCoverage=24%, E-value=2e-11, Identity=37%"; Hit description =unnamed protein product [Tetraodon nigroviridis]
WNATNGGAWPIPPGALCRCKFLPQHFDRKEIIIRSTDVDRALESAQSLLSGMFPPQSDGDRFDPALNWAPIAIHATREANHDSLLNPSGFPCARYKHLRQIVADEISAHLLDKYRPLVDFVRPHLNISKEKPIKMVQLMALRHIKPEVKA

SEQ ID NO: 125507 - protein, 146 aa, Heterodera glycines
  Coding regions on vcDNA: vcDNA=SeqID_51930; Strand=+; Position=1 -70,178-272,627-758,810-953
MEIRQKSWLPYFNGNEEITRLNGGVLLNDLLRRFNIVSQGNAKKLDASKMVLYSSLFYRRNQILEPMAIAGCEAKCDLINFLQILEPRSIRGGEEELKILCDEKVPNSAARRMGNIPGFAKSLIIAIFISIAAINHGTQSTVINVR

SEQ ID NO: 125508 - protein, 115 aa, Heterodera glycines
  Coding regions on vcDNA: vcDNA=SeqID_51931; Strand=-; Position=1 -126,247-297,983-1150
MFQLLRIQRIQLIVQKQANGKFVVSSFCPPFLRLVFIFAFASAVSRPPPPPAKKTHKGKIVPPSMLSKPQKIEPFKVNQSFFAHSSPICLSFPLFKPQPSPMGLPHPKKGVRTGI

SEQ ID NO: 125509 - protein, 274 aa, Heterodera glycines
  Coding regions on vcDNA: vcDNA=SeqID_51932; Strand=+; Position=1 -153,1722-1845,2080-2272,2315-2669
MNAEDTITTTITFTLPRSAFLFGALGAAEVGAVRGTSEGGTAEEGPEGAIGHQNTGKHQKAAKAANRSIPLQEFLPNTSAPSTEDRKILAAEGVLAPYSVKSLLARLGSQPFSLSIDASNFGHEKLFPLVLRFFTKPNGIEIRLLDLEALPGESSIEVHQWITKIVEKHNLDFSNLTAFSADNTKSNFGGEERRGENNVFFRLRQQQERLIGVGCVCHVLHNAAKRATDNLRIAGNALDIEAVVFKLAGHFKNSTLRTEELKGFCDELEVQSRN

SEQ ID NO: 125510 - protein, 62 aa, Heterodera glycines
  Coding regions on vcDNA: vcDNA=SeqID_51933; Strand=-; Position=1 -153,219-254
MVKFWLTLFFVFTGNNLYSIFAHKPNFSQCGISDFEPDLDNVPNVKIGTNHKVIKMEEFVLV

SEQ ID NO: 125511 - protein, 124 aa, Heterodera glycines
  Coding regions on vcDNA: vcDNA=SeqID_51934; Strand=-; Position=1 -52,110-265,316-411,988-1056
KPIAFTANARPICLIEYGSNNHSTFIVAGWGITSPYCLKDSKPGPSNQLMYGKMKISPPENCQSASIKKFKRVAIEDDENSSHHNKHYQIICVVPGPSVIESQYAQIDCNWIEEATNGEVKCIE

SEQ ID NO: 125512 - protein, 69 aa, Heterodera glycines
  Coding regions on vcDNA: vcDNA=SeqID_51935; Strand=+; Position=1 -76,292-362,417-476
MDVSSRACPTQKVQRTAPQGSAEPNENLTLEAAAVDDQTQQTVQTEPEMNLQAAPEDLQNVVDQNESEV

SEQ ID NO: 125513 - protein, 118 aa, Heterodera glycines
  Coding regions on vcDNA: vcDNA=SeqID_51936; Strand=-; Position=1 -81,182-275,336-517
MFSNADSLVQRMRHLMTTGEGADVHFLLIPAHKLLLKTASSIFDKMFSTNTFNVKSEDATWEVISSVEVIDVDVGTFKTMLRFIYTNECCGLNEHNAMEVLYAGQIYSLFISKFIILI

SEQ ID NO: 125514 - protein, 81 aa, Heterodera glycines
  Coding regions on vcDNA: vcDNA=SeqID_51937; Strand=+; Position=1 -46,105-292,842-853
MGHHNSATFLFGLLLGYFLPELAAQLSKDEQDYCVKFSNNLRSNVATGNQQNKGGGKLPSATNMLELAYNETIGQTAQPKR

SEQ ID NO: 125515 - protein, 104 aa, Heterodera glycines
  Coding regions on vcDNA: vcDNA=SeqID_51938; Strand=-; Position=1-315
MKCSTDLKTFDAKELVANFLIGDEKAGANPPRRARVLAFNKGTDGQRIGKEFDTDEEDRHGDSVFSVPNTNPWAGPSKTKKYRKKGRKATRRSGGLPIHQSLNR

SEQ ID NO: 125516 - protein, 150 aa, Heterodera glycines
  Coding regions on vcDNA: vcDNA=SeqID_51939; Strand=+; Position=1 -289,550-713
MTFSFFIYSIYYIVYINLNKIFSCFLLMLNFLLLLLAINATNFDEIAMEESIGVDQTDKQQQNKSDEHNTASSASADPSPPNIEFAEQKAQKQKNIIKKGRTDAEKYEIVKQYHKIKEQKPKLRNIDIAEQLNISETSLRNWRRELKRRF

SEQ ID NO: 125517 - protein, 206 aa, Heterodera glycines
  Coding regions on vcDNA: vcDNA=SeqID_51940; Strand=-; Position=1 -57,111-332,412-573,625-665,809-947
  Homolog annotation: Hit_ID=NP_501024.1; Match level="QueryCoverage =82%, HitCoverage=24%, E-value=1e-25, Identity=41%"; Hit description =spermine synthase (4H401) [Caenorhabditis elegans] gb|AAC47920.1| Hypothetical protein C01B10.8 [Caenorha
GIERVHFGLYAQGVCRPKKSPTNAFPWLCLPLQINLLSLGSADVTDQIGHGFSKISGKWSVEQVEVEGGATRRRLVFLDSANLIQSEVEVVRKSKNGNRWHIVWSDLSCQHHKMMLSAFTLLPSLSSAGLADALEAPLRIALLGLGGGILAKFMHDKFKQSEIVAVEIDPEVLAIARKLFDFPTESDRLEVVICDAMDFLCENSAQ

SEQ ID NO: 125518 - protein, 487 aa, Heterodera glycines
  Coding regions on vcDNA: vcDNA=SeqID_51941; Strand=+; Position=1 -1344,1417-1536
  Homolog annotation: Hit_ID=CAE75525.1; Match level="QueryCoverage =84%, HitCoverage=96%, E-value=2e-37, Identity=20%"; Hit description =Hypothetical protein CBG23547 [Caenorhabditis briggsae]
MILHGKPTGHSGLVINNPLATITYLILDKKQSSPVRQIDPNGEISAVKNAASADQIPDKSADQIPDKSADQIPDKSADKIPDKSADQIPDKASAARNAASADQIPDKASAARNAASADQIPDKASAARNASSADQIPDKSADQIPDKSADQIPDKSADQIPDKSADQIPDKASAARNAASADQIPDKASAARNAASADQIPDKASAARNAASADQIPDKASAARNAASADQIHDKASAAKNAASADQIPNKASAARNAASADQTDKASAARNAASADQIPDKASAARNAASADKIPDKASAARNAASADQIPDKASAARNAASADQIPDKASAARNAASVDQIPDNDKAPGVKNVMSNSVFADEPNKTLSVQAATDEKNAAGGNKSKSAENNALSSAANDESLASDEADNAVPNSSDEKSVPKAGDNTKKSASPNGNSSVPTLVQNWAANPPQLFETILAIIWLLRQTERQQPLRICWHKHRCILMK

SEQ ID NO: 125519 - protein, 139 aa, Heterodera glycines
  Coding regions on vcDNA: vcDNA=SeqID_51942; Strand=+; Position=1 -138,196-238,307-449,516-611
  Homolog annotation: Hit_ID=AAA98565.1; Match level="QueryCoverage =70%, HitCoverage=65%, E-value=4e-18, Identity=47%"; Hit description =fatty acid binding protein homolog As-p18 [Ascaris suum] sp|P55776|FABH_ASCSU Fatty acid-binding protein h
MRFTSIPLIFCLIALVCVIASVPELPQKFLKSWSVDHSENFDEYLEAKGYGWFMRQVVKLAGITKTFSKNENGTYACKIETTKKNVEWPSFKLGEEFQAEYLDDSVPKQIGFTLFTKRFKMKLLKSTEFSIFLPKRTPF

SEQ ID NO: 125520 - protein, 58 aa, Heterodera glycines
  Coding regions on vcDNA: vcDNA=SeqID_51943; Strand=+; Position=1 -3,859-978,1068-1121
MITFDYNPTTDELIETHKKVDSEEKPDIYKYNIDSDGFLVMQMEYNGVKTKRFYKKNE

SEQ ID NO: 125521 - protein, 51 aa, Heterodera glycines
  Coding regions on vcDNA: vcDNA=SeqID_51944; Strand=-; Position=1 -93,1417-1479
MVPPPIPPPPPPPLLAQPLPFPNCPPPCMQQLLVVAFVRPAICHAPLICAA

SEQ ID NO: 125522 - protein, 228 aa, Heterodera glycines
  Coding regions on vcDNA: vcDNA=SeqID_51945; Strand=-; Position=1 -111,176-337,600-659,787-936,1332-1478,1534-1587
  Homolog annotation: Hit_ID=CAD22154.1; Match level="QueryCoverage =95%, HitCoverage=55%, E-value=2e-52, Identity=48%"; Hit description =pherophorin-dz1 protein [Volvox carteri f. nagariensis]
MIKLLPPPPPPPPMPLPPPPVPVPGPVMPLGPPPCLPVCQPACTIHCIFPPAAAMSPPIMQMPPFASPVPFPPPPPPPPPPPPPVPMVALFAPQMPCAPPCMPTCAPACVQEFPPIVFPPPPPPSPPPIYLQPPAIPPPPPLPLPPPPPAIMPCPAMCQPMCMPQCMMPMPPPLPPPPPPPMAMAPPMFVVPPAQFAPPPPPPLPRLPPMALMAPPPLPPMECVAQCQ

SEQ ID NO: 125523 - protein, 75 aa, Heterodera glycines
  Coding regions on vcDNA: vcDNA=SeqID_51946; Strand=+; Position=1 -114,340-453
MCLHAKVGHKFSCKCNGHGLALRSGITDAKCDDGKWEKLNDLNFKNAHSCINLPNCNNLCTKIFVTVQENAKKHF

SEQ ID NO: 125524 - protein, 53 aa, Heterodera glycines
  Coding regions on vcDNA: vcDNA=SeqID_51947; Strand=-; Position=1 -47,231-345
MADLKKMKRDTEAEKTKLTTLSPNMALDLVSGFSTNLYSSNFMHGVGAVQAQG

SEQ ID NO: 125525 - protein, 112 aa, Heterodera glycines
  Coding regions on vcDNA: vcDNA=SeqID_51948; Strand=+; Position=1 -140,535-599,658-789
  Homolog annotation: Hit_ID=CAE66729.1; Match level="QueryCoverage =98%, HitCoverage=11%, E-value=7e-20, Identity=50%"; Hit description =Hypothetical protein CBG12078 [Caenorhabditis briggsae]
MAIELNNNNACASTEEDTSSSPNAANLTGTPSGEAMSGEESARLKRSYVLQELVESERTYVQDLASISDGYIASLREMELSDEDREKVKIIFANIEQILDFHKTFFLKEIEK

SEQ ID NO: 125526 - protein, 21 aa, Heterodera glycines
  Coding regions on vcDNA: vcDNA=SeqID_51949; Strand=+; Position=1 -54,577-588
MRTRPIWQVKQRLLTSQKKGF

SEQ ID NO: 125527 - protein, 145 aa, Heterodera glycines
  Coding regions on vcDNA: vcDNA=SeqID_51950; Strand=-; Position=1-816
IIFIQKIFFFVFGAVPPNRCAQIYGETESFGNSFPIACTLILRWIFAPHNCLSTPNGHLKKSIFFVFGAVPPNRCAQIYGETESFGNSFPIACTLILRWIFAPHNCLSTPNGHLKKSIFLFSGQSPRADAPRFMGRPNPSGIASL

SEQ ID NO: 125528 - protein, 158 aa, Heterodera glycines
  Coding regions on vcDNA: vcDNA=SeqID_51951; Strand=+; Position=1 -107,341-436,481-524,596-730,814-910
  Homolog annotation: Hit_ID=CAE69116.1; Match level="QueryCoverage =96%, HitCoverage=20%, E-value=4e-43, Identity=59%"; Hit description =Hypothetical protein CBG15142 [Caenorhabditis briggsae]
SFANRREIGHGLLAEKALRQVMPEQFPYTVRLACQVLESNGSTSMASVCAGSLALFDAGVPLLANHVAGLALGLFTDGEGKRTEYTLMTDLMGYEDYAGDMDLKIAGTQTRFTAMQMDLKICGLPLSVLRDALLQGKKGIVHLLGLMRDTIAEPRFVQ

SEQ ID NO: 125529 - protein, 105 aa, Heterodera glycines
  Coding regions on vcDNA: vcDNA=SeqID_51952; Strand=+; Position=1 -3,155-262,789-995
  Homolog annotation: Hit_ID=CAE75060.1; Match level="QueryCoverage =64%, HitCoverage=3%, E-value=9e-09, Identity=43%"; Hit description =Hypothetical protein CBG22974 [Caenorhabditis briggsae]
MSSGRARRENGSFYIIVEERNHANLMEKLEDYAKIEKACRKLHRQKELSDQLTPTGKEIITNLFGELEDEEEYLPYLINKCGPSKRRRLYDRKVWTDGGETLENV

SEQ ID NO: 125530 - protein, 172 aa, Heterodera glycines
  Coding regions on vcDNA: vcDNA=SeqID_51953; Strand=-; Position=1 -63,126-302,505-783
MGTIVKRSLRAKAIIGLLQREVVLSRSALDRTKAKFRKRKNGLKSDLRATLKNLGAAEDDLAAAEDDLAALRARAAALHNQVQQLKQIAPKAKLKKLGLADIGPDLSSESEEDEEEENAADNTEQQQQDDANDNVPDDLTINERADAALRTLMPLTTSRESRAENATTQSTF

SEQ ID NO: 125531 - protein, 108 aa, Heterodera glycines
  Coding regions on vcDNA: vcDNA=SeqID_51954; Strand=-; Position=1 -171,453-608
MAFAQFLVNASLSLLKAPKATITIAWKSQSITDVEIECYEVQYKNVNEVWKTIKCPQHAFLPKKSYTAVVKNLKPATLYALTVVALNKHGNTVDVLTMSPVATKPRFT

SEQ ID NO: 125532 - protein, 50 aa, Heterodera glycines
  Coding regions on vcDNA: vcDNA=SeqID_51955; Strand=-; Position=1-150
MEERIIEKFDQFKEEMEQKITTKFDQISTKLDEMKDELRLEFNQKFDALE

SEQ ID NO: 125533 - protein, 129 aa, Heterodera glycines
  Coding regions on vcDNA: vcDNA=SeqID_51956; Strand=+; Position=1 -63,544-870
  Homolog annotation: Hit_ID=EAA68209.1; Match level="QueryCoverage =80%, HitCoverage=5%, E-value=8e-10, Identity=32%"; Hit description =hypothetical protein FG10435.1 [Gibberella zeae PH-1] ref|XP _390611.1| hypothetical protein FG10435.1 [Gibb
MSLLWLGKENIPPSFEKHEILLNFSSGTDNSSTGAATASSLNSSNSSTTTTTKTSANDGDEQRRIKRTKTMATTTTTTDSGKSSSKSRTTTTTINTTTTTSSSTSSSKKLLVVDENAKTCGGVGIGADG

SEQ ID NO: 125534 - protein, 76 aa, Heterodera glycines
  Coding regions on vcDNA: vcDNA=SeqID_51957; Strand=+; Position=1 -106,225-349
MTSDDGQASLSTVHQRKMTTSIKTTEHLSKKKKKKWMLLISLDVMSRRMKTNAENGRTAELSDFLFGWINFIFFFP

SEQ ID NO: 125535 - protein, 70 aa, Heterodera glycines
  Coding regions on vcDNA: vcDNA=SeqID_51958; Strand=+; Position=1 -157,1706-1761
  Homolog annotation: Hit_ID=AAP30754.1; Match level="QueryCoverage =74%, HitCoverage=27%, E-value=8e-18, Identity=82%"; Hit description =putative gland protein G11A06 [Heterodera glycines]
MFVIAASASSHASNNSEWQALSAQFGQQISEIDSKCAEFGIGIAKVPFDGPKVKICAIYVKINIIKAINE

SEQ ID NO: 125536 - protein, 83 aa, Heterodera glycines
  Coding regions on vcDNA: vcDNA=SeqID_51959; Strand=+; Position=1 -103,184-332
MSKNGKQKQFAKELGIDRKTLSKWKKEFGIEMSKRYSNEEKMSKMNDYYEMKKANPSLSDKEIAGILKIGFATLTRWKKENNS

SEQ ID NO: 125537 - protein, 260 aa, Heterodera glycines
  Coding regions on vcDNA: vcDNA=SeqID_51960; Strand=+; Position=1 -93,626-877,951-1080,1358-1492,1538-1710
  Homolog annotation: Hit_ID=CAA65507.1; Match level="QueryCoverage =99%, HitCoverage=99%, E-value=4e-41, Identity=39%"; Hit description =cuticular collagen [Teladorsagia circumcincta]
MGKEMQYLKAEAESIRNVAIFGVCIATVASLVTRTQVLSDVNGGAPRAPAAGAATPKQRQTRSAHHHLDTVLRNGRLSLWKRSGYGAESGGVTGGGGGGACCGCGTSEQGPPGPPGAIGEPGADGQPGAAGNAGEDAAPPPPAPYIEPCQECGTAQDGLPGPQGAPGPDGRPGEPGAPGERAIPGPQGDEGAPGVDGVPGTPGEPGPPGPPGSLEQGAENFVFLDRNNWNKMPDYAPIVGPPGPPGANGQPGTDGTPGGM

SEQ ID NO: 125538 - protein, 25 aa, Heterodera glycines
  Coding regions on vcDNA: vcDNA=SeqID_51961; Strand=+; Position=1 -72,380-385
MPRVEKNFGFGFRVESKNLGIRDQF

SEQ ID NO: 125539 - protein, 19 aa, Heterodera glycines
  Coding regions on vcDNA: vcDNA=SeqID_51962; Strand=+; Position=1-58
DCWGRGFESHRASYLLCST

SEQ ID NO: 125540 - protein, 79 aa, Heterodera glycines
  Coding regions on vcDNA: vcDNA=SeqID_51963; Strand=-; Position=1-240
MLFVSLLATFCFQPSRCAFFDKHRKRNAMDNVNGECAEDGCVSDVEAGSGAEDGDELLDDDDVQQQQHLKSEESEFKML

SEQ ID NO: 125541 - protein, 86 aa, Heterodera glycines
  Coding regions on vcDNA: vcDNA=SeqID_51964; Strand=-; Position=1 -163,1156-1253
MDGPKATVIRMAPQQQHGWALGNGRAATTTGELPHLRRRDFIGKTKNIAKRSTAVGVGTVQKGNIQAKGHEKVSQSMLHINWHFYF

SEQ ID NO: 125542 - protein, 59 aa, Heterodera glycines
  Coding regions on vcDNA: vcDNA=SeqID_51965; Strand=-; Position=1-178
QNGHQKQQQSVHFAPEDPQQRTPWDIYYHKESVSAAHTTAAYTIFEWDYLEILTTAVAS

SEQ ID NO: 125543 - protein, 50 aa, Heterodera glycines
  Coding regions on vcDNA: vcDNA=SeqID_51966; Strand=+; Position=1 -30,618-740
MLLKLADYFQNYFLNLDVNKFRAFFKANNEQLFLVVSKEFLCVLFVRLCG

SEQ ID NO: 125544 - protein, 61 aa, Heterodera glycines
  Coding regions on vcDNA: vcDNA=SeqID_51967; Strand=-; Position=1 -27,145-303
MGVNIYDAFIGILKKAWTWTWISWTKIRENPGPEKIQAPRDLDPGKIQAWTQVHADLFYYI

SEQ ID NO: 125545 - protein, 32 aa, Heterodera glycines
  Coding regions on vcDNA: vcDNA=SeqID_51968; Strand=-; Position=1 -65,276-309
MDVEINFTALFGVFGSKIIFVSAANWVTSRNE

SEQ ID NO: 125546 - protein, 459 aa, Heterodera glycines
  Coding regions on vcDNA: vcDNA=SeqID_51969; Strand=+; Position=1 -285,333-735,776-1038,1305-1542,2173-2363
MRSLGSSISAKLTPMHSFDALMSAQLAPSHSFDTAADLIGHNHSFDQMDSKKAGKSLINDKKQKHIELEADQFVAFMLKKMLKKVPVEFKERLKIFQKQKRNRTLAEELSNLTSKQNLLMLLELYYMANSMGEIFLKQIAANDQTDLRRFGGKNSLIDFEYYEETNQKFSKIYQTILINEPTKKSANKMFPFRRTKSGKAFFWFNSHKTFLVANEWRDGAENILEWKFKVKIASTKLGKIIRTIGQFIRIKCGKYLWNLDEETDEIQNCAKQINFSELNQIFLKKFAKNNENTLGLLNLVGNLLNVEALTNSDTNEKVSSPYSEDIFTEIESYEQKIHILNGLLNFGRLFMNSFLALAMKITEENRTINWKNISIIFTRNKNAEEENYLLKKLMIEVAEIALNLVLNRFKTRKTKRNWHFSFFKNSNPDIFVVIRILDKLNVKNQGKVEPMPSADNERF

SEQ ID NO: 125547 - protein, 63 aa, Heterodera glycines
  Coding regions on vcDNA: vcDNA=SeqID_51970; Strand=+; Position=1-346
NRNYAQKAFQTILALPIPSTIAFIHPIMSAKIIRVPKIACDLSLAKNGVSKIVITLKKLLKQF

SEQ ID NO: 125548 - protein, 163 aa, Heterodera glycines
  Coding regions on vcDNA: vcDNA=SeqID_51971; Strand=-; Position=1 -94,460-646,854-1064
MPAFAGGGGFVVSPMNAVQNMHHSTKNKVTIGPICSSWSLIWSQSTDFSAIYFAALHSHYATLLPHLSEPQPSDRPEFLRKQCNTTAYQIVKHCLEQSALKIKDLLVSYLKLASFLHVFPLASDMNLLRESMKQIRSQIMPQNAAAFQDYVEVHMKQIFTNRG

SEQ ID NO: 125549 - protein, 143 aa, Heterodera glycines
  Coding regions on vcDNA: vcDNA=SeqID_51972; Strand=-; Position=1-430
  Homolog annotation: Hit_ID=CAE62128.1; Match level="QueryCoverage =58%, HitCoverage=31%, E-value=9e-14, Identity=46%"; Hit description =Hypothetical protein CBG06172 [Caenorhabditis briggsae]
MLFASSVFRFFLRPPPKRYSSFLLNTMWSPLFCLLVFAGLAACCVCESFRPFRGTFPASALPQIQYVNDKPYYLMQNMECRGGKIYEINQVQVKFNGPSFHFCLIRMPKLKDIDECKAACVTRNCRAVNLFQLGEFQFKCEIL

SEQ ID NO: 125550 - protein, 99 aa, Heterodera glycines
  misc_feature (37)..(37): Xaa can be any naturally occurring amino acid
  misc_feature (57)..(57): Xaa can be any naturally occurring amino acid
  Coding regions on vcDNA: vcDNA=SeqID_51973; Strand=-; Position=1-398
  Homolog annotation: Hit_ID=EAA16552.1; Match level="QueryCoverage =92%, HitCoverage=85%, E-value=8e-13, Identity=51%"; Hit description =hypothetical protein [Plasmodium yoelii yoelii]
RTASTDPTTSFLSAAIILCIMRAGITAAAGTRLDLSXYSLKGLNCTHSDDRPHKRSXLVISRHYLLALRVVTISQVPSPESNPYPPLPVITMVVRYITI

SEQ ID NO: 125551 - protein, 231 aa, Heterodera glycines
  Coding regions on vcDNA: vcDNA=SeqID_51974; Strand=+; Position=1 -54,99-318,673-847,925-1079,1368-1459
  Homolog annotation: Hit_ID=NP_496944.1; Match level="QueryCoverage =48%, HitCoverage=24%, E-value=3e-17, Identity=39%"; Hit description =pm10982402 : related to human and mouse MAN1, a component of the nuclear membrane, LEM domain protein (le
MAWGFFSRPLGTSTPCSDTGDKYVGYASSKYKRHSPSFDQATVRFFDTKKISPDISRWIAHAIVAFFALLFFTYIAKAHSETVSSGISLTAVGLFIFGIYKLASFRNYRKVEENRKLILLVERITDIIYESGTSGVAEPHVRDMIMPPTKRSEEEAKRWKEAARFINNEDSRIRTEIRLINGTECNVWIWVGAGKERWQGTALLEGSPMARVPEQALTRCLKLRGVNFSPK

SEQ ID NO: 125552 - protein, 29 aa, Heterodera glycines
  Coding regions on vcDNA: vcDNA=SeqID_51975; Strand=-; Position=1-90
ESSGLRRNHPTIWPVIPSMTLRIGEDQFG

SEQ ID NO: 125553 - protein, 36 aa, Heterodera glycines
  Coding regions on vcDNA: vcDNA=SeqID_51976; Strand=-; Position=1-109
PPHTVSLSRPSPPSVPSNSFGIFILRNPFPLIGGIK

SEQ ID NO: 125554 - protein, 146 aa, Heterodera glycines
  Coding regions on vcDNA: vcDNA=SeqID_51977; Strand=+; Position=1 -124,597-767,813-958
MHFIVRLAQHSLAHGVARTFFDFVQCLPKTEEELQQKWTRTGFRGRNSWCLSEDTDCTEYIERFGTVATVDAVLSALLGESVPASIADELQANPKFGQVLAKFDDIEDEFILRTTKYNILFAKGLMESAEGQGIIEDVSTQMHFLI

SEQ ID NO: 125555 - protein, 180 aa, Heterodera glycines
  Coding regions on vcDNA: vcDNA=SeqID_51978; Strand=-; Position=1-543
MAQFNAMFPNLNSSVVESVLRNCDGDVSRTIDELLRRSGQEEGNNSETDERRKSVSTPPRDQCANDEKIALLVQNREFLRYLRRDPNFQREMLGRSNSSDYRHRHHSSTHRSRNLPVLLTSSRTSQSPNSIRFFRTSADVMTNPAEDSVGRVPEGPLVEFQTSEQECNSRRTFDCKRKEE

SEQ ID NO: 125556 - protein, 16 aa, Heterodera glycines
  Coding regions on vcDNA: vcDNA=SeqID_51979; Strand=-; Position=1 -41,408-417
MVCVLKIFNCSIQMYS

SEQ ID NO: 125557 - protein, 33 aa, Heterodera glycines
  Coding regions on vcDNA: vcDNA=SeqID_51980; Strand=+; Position=1-118
AASRPRTSALRPFFKFCWAYTGASRPFLNLLGY

SEQ ID NO: 125558 - protein, 34 aa, Heterodera glycines
  Coding regions on vcDNA: vcDNA=SeqID_51981; Strand=+; Position=1 -57,558-605
MRRPFFLGMSFICRKKTQKNIASIKIMTLQMNII

SEQ ID NO: 125559 - protein, 185 aa, Heterodera glycines
  Coding regions on vcDNA: vcDNA=SeqID_51982; Strand=-; Position=1 -95,151-387,428-652
  Homolog annotation: Hit_ID=NP_495140.3; Match level="QueryCoverage =61%, HitCoverage=14%, E-value=1e-34, Identity=61%"; Hit description =general substrate transporter family member (2G77) [Caenorhabditis elegans]
MCLSLREEMTFSLLFMLAGKVCIQGAFNILYIFTSELYPTVIRNSAVGTCSMMARFGSAASGYIAILSDVTLPTVPMAIFCIFSLFAGVLIYFLPETRDLPLPETMWDAVRMLNNTEANRCVGGIQMEEGDRDESYGQSERKKRRKGRGDGRDGKEEEEEEEREEEEEEEDEEEEDVPLYTNASK

SEQ ID NO: 125560 - protein, 244 aa, Heterodera glycines
  Coding regions on vcDNA: vcDNA=SeqID_51983; Strand=-; Position=1 -66,141-354,956-1107,1711-1911,2264-2365
MLFAQSSQYDADLPCTSAQALQHDQQRQQQVLVETFMDGRLRLLCSTRPDENGVGDGGGCGEDGGTTGANAVGGLERMSADVLVNFCASDILSEIAHAILPRPVQGDVVDLDELVEFDLAMCYRNVLDLSTEDGHCSVLFTHPLLNFVGIACQSGDILQCYMDLMAELAQHGWADFVAAHSSALFSCLVDSFDTGNKFEPSGASKGAAASLEDPALRVHLVGDDPRRPRRGQPKQLVSYELGVS

SEQ ID NO: 125561 - protein, 250 aa, Heterodera glycines
  Coding regions on vcDNA: vcDNA=SeqID_51984; Strand=+; Position=1-750
MSGFLRTKIAIELKALEKAKTATELYAEPDQTLTSLENAILLESAAERIKSEVEAVNAKIEQIWITASKWHDVIQKMDKDERKSEQTAYEQFQTTEKLNTKMEAANTKLTELKDLEMKVEAGAKLQRSKADRDARVEQREHAKAMSKSNAEADKGNNRARGNEMTAALYQLPTLRIKPFGGDKREWPMFEEAFKVAVDQKPGSKTEKLNLLKSLVEREAALLIGGLRLEEKNYEIAMKLLKDTYGDKGEY

SEQ ID NO: 125562 - protein, 41 aa, Heterodera glycines
  Coding regions on vcDNA: vcDNA=SeqID_51985; Strand=-; Position=1 -50,110-185
MSDNRKEAAERKMAKAIFVSADCWLCVFDLLPAYQLGLGIA

SEQ ID NO: 125563 - protein, 105 aa, Heterodera glycines
  Coding regions on vcDNA: vcDNA=SeqID_51986; Strand=+; Position=1 -68,112-358
MFVGCCAILWFYWDRLKKPKKKIFISADCWLCVFDLLTPSQLGLGISMISHRFDFYVDEHFKTRKWALTHIQIWRRIGENDTKEMEICHDGGNPLPIPQIPLPRK

SEQ ID NO: 125564 - protein, 21 aa, Heterodera glycines
  Coding regions on vcDNA: vcDNA=SeqID_51987; Strand=-; Position=1-63
MAEKANERKKKIVQTKEKRGK

SEQ ID NO: 125565 - protein, 44 aa, Heterodera glycines
  Coding regions on vcDNA: vcDNA=SeqID_51988; Strand=+; Position=1 -55,335-411
MTCEGCSNAVKRVLGKLEDKVKLLSVDLNAKEVQVESSSMGQDE

SEQ ID NO: 125566 - protein, 31 aa, Heterodera glycines
  Coding regions on vcDNA: vcDNA=SeqID_51989; Strand=+; Position=1-9,56- 142
MKRDREEQQEEIGGKESDGESNGEEEQFDFE

SEQ ID NO: 125567 - protein, 92 aa, Heterodera glycines
  Coding regions on vcDNA: vcDNA=SeqID_51990; Strand=+; Position=1 -151,493-570,624-673
MCNFAVFIHIPIEPGILKWPGPGSGPGLGKWTGTGSRDRESRFSGTPGPGENQATPTEFVAKLFAGITDRFIESAAARLPLLGRQCTDNYGS

SEQ ID NO: 125568 - protein, 58 aa, Heterodera glycines
  Coding regions on vcDNA: vcDNA=SeqID_51991; Strand=+; Position=1 -72,134-238
MAFRAGAGTGRELAQRPDQYLDILTNFDCCWSTPDEVHAIAEQLDEFVHHEIRLVFIF

SEQ ID NO: 125569 - protein, 212 aa, Heterodera glycines
  Coding regions on vcDNA: vcDNA=SeqID_51992; Strand=+; Position=1 -129,299-373,423-512,613-684,914-1186
MFNRSREVYKYFVRCSKTTAWSLIKVSRTVQQFLDELSSFFTLTVSTDQTNSATSDPRPLPVVTESVPEESTYDPPWDDRPLRFIETMAAFEAHRSTNVVPTVPSTSAAAPRPLPVVTESVPTSEIPALFAEFLRTNCVGHVPKEVLVAYLEEAIKILNCGGGQSANTPKISKFRKVLFHSLQNNRTRRAQWGFTGSPGITFLDQPPGRAIR

SEQ ID NO: 125570 - protein, 34 aa, Heterodera glycines
  Coding regions on vcDNA: vcDNA=SeqID_51993; Strand=-; Position=1-102
IKVNVEASNQVENAFFMLNISKLVRRKKRHMPQN

SEQ ID NO: 125571 - protein, 90 aa, Heterodera glycines
  Coding regions on vcDNA: vcDNA=SeqID_51994; Strand=+; Position=1-273
  Homolog annotation: Hit_ID=XP_223980.2; Match level="QueryCoverage =98%, HitCoverage=8%, E-value=2e-16, Identity=43%"; Hit description =similar to RPGR-interacting protein [Rattus norvegicus]
MKDYIDEVSAEDESEEEERDDDKSDEEEEEEEERKKGRKKGNKDEEEDAESDDDEEEEEEEREKEKGKEREKEKGKEREKEERKERRRRR

SEQ ID NO: 125572 - protein, 59 aa, Heterodera glycines
  Coding regions on vcDNA: vcDNA=SeqID_51995; Strand=-; Position=1 -127,182-231
MQVSQMRTMSLSVASLVALLVLLAISSHPTFASPISSRDLNDAAEAGPLQAVEKRRNAE

SEQ ID NO: 125573 - protein, 79 aa, Heterodera glycines
  Coding regions on vcDNA: vcDNA=SeqID_51996; Strand=+; Position=1 -205,319-353
MPKIRKMHSLDALEGCNVFPSAADKTTEEIKGSPLAMGCVVVVVYDENSIIFHGRWDIGRKLERIWRMAVKFNWVVIDK

SEQ ID NO: 125574 - protein, 202 aa, Heterodera glycines
  Coding regions on vcDNA: vcDNA=SeqID_51997; Strand=-; Position=1 -101,148-655
MVTSLAFVPLEDLTPALAALEDHLPGELEGVLDWFVINYVGRLRNNGTRTRPLFRPEEWSVYERTMSGTDRTNNFAEAYHRTLQHAIGQGHPTIWKFINILREHQKVIDVDFEHFLAGNAPPPKAKRYRDTDKRILRILQRYNEEKAQPQIENDQGNIAKTKTKIRLLKCLGEFRAIIKRIVDFFVNFICYYILDKTEIFKN

SEQ ID NO: 125575 - protein, 45 aa, Heterodera glycines
  Coding regions on vcDNA: vcDNA=SeqID_51998; Strand=-; Position=1-135
MFFGSICANLSFAGDEKRMEWYQNQLVTVSTSIISNVDPYVSANF

SEQ ID NO: 125576 - protein, 217 aa, Heterodera glycines
  Coding regions on vcDNA: vcDNA=SeqID_51999; Strand=-; Position=1 -135,559-702,888-1038,1091-1165,1258-1306,1351-1450
PESDEYKALMKLQKTMDENFEKLQSTIAVSERVIALRGNLRDYKNNVRRPMKTLRRYVSLFWDPAIVKTDKDVERFIGLCDDPDKQTPLSILDYIQTYTVDDCTIGLSPEQIERQAEFVPMLNKIRMQISSQIEREKFDSISAELVIWFTELETDSANSVLQKVENNIAVKEIFLETGTYGPISVCLLNDIVVGKNFHRKEIKELENIIRLDVVKLV

SEQ ID NO: 125577 - protein, 206 aa, Heterodera glycines
  Coding regions on vcDNA: vcDNA=SeqID_52000; Strand=-; Position=1 -291,463-746,810-855
MFGKNINRLELFVGFFHRLRKFVPSILNDCPSLHVLTIHVTNFFIEFPADDSAAASDGQAVAKWLFTPLQNDAPKVLKCAWDLDAVNLPSKIAAFKAAFASASSPVNFIVIVWFRPLPFADPVVPSVLTNQLTREQLALKIIDDNCTRFLLIRCPIVRDADKWAKWEEEAIGYHQWNQIGIEMNDEDNIGDGLLDAIRCPNDQQQK

SEQ ID NO: 125578 - protein, 84 aa, Heterodera glycines
  Coding regions on vcDNA: vcDNA=SeqID_52001; Strand=+; Position=1 -90,143-304
  Homolog annotation: Hit_ID=NP_498789.2; Match level="QueryCoverage =97%, HitCoverage=5%, E-value=4e-15, Identity=46%"; Hit description =UNCoordinated locomotion UNC-36, calcium channel, voltage dependent alpha2/delta subunit 3 (unc-36) [Caeno
MGCQDMIMLITDGAPGFFRETFELFNPEKRVRFFSFVVGEEAKDFEQVLIPYIRPNLNLKKVRWMACANRGFMAHISSMADVQE

SEQ ID NO: 125579 - protein, 341 aa, Heterodera glycines
  Coding regions on vcDNA: vcDNA=SeqID_52002; Strand=+; Position=1 -104,181-310,392-564,616-735,797-932,992-1062,1111-1210,1442-1461
  Homolog annotation: Hit_ID=NP_740927.2; Match level="QueryCoverage =99%, HitCoverage=28%, E-value=8e-67, Identity=45%"; Hit description =PMR-type Golgi ATPase (106.5 kD) (pmr-1) [Caenorhabditis elegans] emb|CAF32230.1| Hypothetical protein ZK
VAAIPEGLPIVASVTLAIGVMRMGSLNAVVKKLSAVETLGCVTVICSAVETLGCVTVICSDKTGTLTKNEMTACIVVAADDTRAEVNAKGYGSGSGGECRLSNGERVVGHSHPAISRVLEIGCVCNNSHLANGTIIGQPTEGALLVLATETQLDISRSTQLDISRSYFRRLNEMPFNSDNKWMGVQVEPINRVRIIFIKGAIDRVLKGAIDRVLGMCVGYLDNGVAHRPLDVQRREHILHLATGLGQSGLRVIAIAMACGKDMNSLYYVGLVGIMDPPRPGCRQSIETVQNAGVSVKMVTPPRPGCRQSIETVQNAGVSVKMVTGDALETAISIGTRLNIF

SEQ ID NO: 125580 - protein, 209 aa, Heterodera glycines
  Coding regions on vcDNA: vcDNA=SeqID_52003; Strand=-; Position=1-627
  Homolog annotation: Hit_ID=NP_920291.1; Match level="QueryCoverage =100%, HitCoverage=14%, E-value=2e-34, Identity=38%"; Hit description= putative helicase [Oryza sativa (japonica cultivar-group)] gb|AAP52578.1| putative helicase [Oryza sativ
MTNQDVVPYNPYLIKRFKSHINIEKVADIKAVKYIYKYIFKGYDAATVRCVTTEKGTVKELIYDEAGSFLDARYLSPVEACWKIFKFQLQEKSHSVQRLPVHLENEQTIFFDENDEEEKIIEKKDKKSKLMAYFDFFKENPNSPLFLYPEMPKFCVWNPKQGKWILRKNHTISKTIGRMYPVSPTEGEKYYLRYLLLHVSGKSFEDLKT

SEQ ID NO: 125581 - protein, 139 aa, Heterodera glycines
  Coding regions on vcDNA: vcDNA=SeqID_52004; Strand=-; Position=1-418
MVRKKQNFSVGNSNEFPNTSSNNQQQIAGFEAPVKSGETIERVVSSLKKQSDHIENDNDRKTIKRKANNFDVIDLDEVFEEFFVGNNCNLSEKDKQIENSEQTTISRMQLSRMNMSSEKADVSREKDRKRKVSRNQMSE

SEQ ID NO: 125582 - protein, 48 aa, Heterodera glycines
  Coding regions on vcDNA: vcDNA=SeqID_52005; Strand=-; Position=1 -93,363-416
MRENREQKANASATVFVTEIAAFVVFFWLSFKVSTDFWKNIFAIYQQF

SEQ ID NO: 125583 - protein, 350 aa, Heterodera glycines
  Coding regions on vcDNA: vcDNA=SeqID_52006; Strand=-; Position=1 -227,290-851,980-1242
DSVETLPRGQSNRYHLYNSSASLEMNSVPQPLHIHQQQQHQQQQVGQQQHLGGTPLTPRNAHVVYTRVDRQVDCPPIAKMDFTVSGSAVSNGVVGPPHDSPHNLQQRHQFSGTVSASGAGGTPPLPPPPSLTAANRGITTAAANVQQYNRNDSNGYQTVGGRANAAGGAAMLSFVNGTTADGDDGKGGNCDAAEHGVTSAGEHQQQKAAKHQHHQQQRMAHIVRPIVYVGGGGGVAGGASPSPSTIRSATGQSQAQKTTPTSAIVKHSLIIFIFSTVHKFAYNNNGAKVPVGRAMVQPRVNLAVSSSNAIATPYGCSSSSSQYASVRVNPSNAGSVSNNAIIENDESEVK

SEQ ID NO: 125584 - protein, 35 aa, Heterodera glycines
  Coding regions on vcDNA: vcDNA=SeqID_52007; Strand=+; Position=1-105
MLLLSDLLLLVLLLLMNVQWLRHRIHFQTGRRIVK

SEQ ID NO: 125585 - protein, 141 aa, Heterodera glycines
  Coding regions on vcDNA: vcDNA=SeqID_52008; Strand=-; Position=1-426
HSITGDSTHQHSNQRDSTLQHFNHWDSTLQHSITGTQLSSIQSLGLNPPTFQSTGLNSPAFQSLGLNPPTFQSTGLNPPAFQSLGLNSPAFNHWDSTLQHSITGTQPTNIPINGTQLSSIQSLGLNPPTFQSPGLNLSKFL

SEQ ID NO: 125586 - protein, 263 aa, Heterodera glycines
  Coding regions on vcDNA: vcDNA=SeqID_52009; Strand=+; Position=1 -513,609-884
  Homolog annotation: Hit_ID=AAC61752.1; Match level="QueryCoverage =44%, HitCoverage=36%, E-value=1e-27, Identity=55%"; Hit description =nuclear hormone receptor [Brugia pahangi]
HFLVRLSAVPLPGASPVASVCDERCPLCFSRSSYLLPSRTLFPEFVLRCPTSKFRLFVRPTRRHFLVLARFTDHFQSPGRANGRGANARGAQIMCRLQRLRNLVSGRNGMKLRRREGRALPAGKSANELVTVRPLFPQQSLAFGFSQHYGALTCEGCKGFFKRTVQKKSQYVSSSLFWSFITQSLGRCQYCRFQKCLEVGMVREIVRYGSLQGRRGRLPSKVKSSSGGIGGSAGTAMPIGMGGGVQPEPAPSPPLPILTIIAK

SEQ ID NO: 125587 - protein, 113 aa, Heterodera glycines
  Coding regions on vcDNA: vcDNA=SeqID_52010; Strand=+; Position=1 -20,273-423,708-878
MELFYAGKLLNRILDLHKADQSPTTITEQPKSEPTEEIGVDQNLNPVVQAGLAHFSLLTHGFGGHSVQAVLETMIRVINECNVVLTRKYQSPINAVTAAGQQNAVLSMPFDLP

SEQ ID NO: 125588 - protein, 60 aa, Heterodera glycines
  Coding regions on vcDNA: vcDNA=SeqID_52011; Strand=+; Position=1 -135,285-332
MMLIDTIDHGTRQLGPGTFGPQRFFGYNFFFFVIQIKHCWYHSKAANRASEGLSNDTNDV

SEQ ID NO: 125589 - protein, 396 aa, Heterodera glycines
  Coding regions on vcDNA: vcDNA=SeqID_52012; Strand=+; Position=1 -55,564-792,856-941,998-1092,1260-1324,1386-1461,1527-1629,1680 -1879,1982-2041
  Homolog annotation: Hit_ID=CAE74885.1; Match level="QueryCoverage =99%, HitCoverage=83%, E-value=3e-61, Identity=35%"; Hit description =Hypothetical protein CBG22748 [Caenorhabditis briggsae]
DKLMKLGKFQTIYTFYMSKRQTFLSSFSKNYSTIEEKLRRFSIFVANFEQLEKIGREGEVYGITTFFDWSDEELKEVITDQTKELTDRLHFQFRPMDANFKRPSEFDWFRPMDANFKRPSEFDWRKKGVVNHVKNQMRCGACWAFRCGACWAFATAAVVESQHAIHNGTLLTLSEQQMIDCDQSNNGCEGGNRPNAFRYVRDNGLLREDNYPVSRPPYVRDNGLLREDNYPVSRPPSQFATFVDPTQRTFVDEVRVDPTQRTFVDEVRTLPSDEQQIADFVVEKGPVSFGMNVTKTMFHYVGGIFSPTADEFGMNVTKTMFHYVGGIFSPTADECQFHSMGRHAMEVVGFGEDEKSAFWIMKNSWGSSWGINGGYMLLFRVDACGLSREVHTALIT

SEQ ID NO: 125590 - protein, 115 aa, Heterodera glycines
  Coding regions on vcDNA: vcDNA=SeqID_52013; Strand=+; Position=1 -271,320-398
  Homolog annotation: Hit_ID=A35810; Match level="QueryCoverage=76%, HitCoverage=14%, E-value=2e-14, Identity=44%"; Hit description =alpha,alpha-trehalase (EC 3.2.1.28) precursor - rabbit gb|AAA63460.1| alpha,alpha-trehalose glucohydrolase sp|
DKDKANSYHKEFQTFREDVHDLFYDKGGWFDYDLKNQKLINRFYGSIVVPLFARCYHTADVEETEKMLTQLEEFDKKNQIMSQKFGVPTSAIASGQQWDFPNIWPVKAESVVYYN

SEQ ID NO: 125591 - protein, 219 aa, Heterodera glycines
  Coding regions on vcDNA: vcDNA=SeqID_52014; Strand=-; Position=1 -61,104-250,308-353,408-530,733-800,860-1074
MIGQLFASVLPLVLFANLINVGEMVRGGSNSLSMTNGGGPPIQQQNPSINLVTNVAHSLNNLRLNPSAEENQHQPTPVNAAQPKIRQNPNKKGVKVGSKMKLQQKLKSGVKSKDLGEKKSKLGMAMFYVFMLIRLFVPHTHVPTNVMLRYDNHFVPIEQQFVSCQPMDNNGIGQKCEFIVEQMAMNKNMPNVSIWANLDGDKETIQQLGHQVGIIHSFN

SEQ ID NO: 125592 - protein, 15 aa, Heterodera glycines
  Coding regions on vcDNA: vcDNA=SeqID_52015; Strand=-; Position=1 -33,144-158
MYCNTKVHKMNILCL

SEQ ID NO: 125593 - protein, 100 aa, Heterodera glycines
  Coding regions on vcDNA: vcDNA=SeqID_52016; Strand=-; Position=1 -104,146-344
MTVTSNTEFRLIECVPILEEVAREFGCITPLPNLGSHRDYRVSGCMMIRTLTSLNRLYIFDAEDCIEVNGKYVSYFIAILGEGFLKARGRHEPKSGQRIL

SEQ ID NO: 125594 - protein, 78 aa, Heterodera glycines
  Coding regions on vcDNA: vcDNA=SeqID_52017; Strand=-; Position=1-235
MPYFRILSLAFSFLKGVPHPDFGEAVVAVCEPSDAFAEKLSGVAHQLTDDEKSAFRQTLAPYKIPKAVQFMPLPRNHL

SEQ ID NO: 125595 - protein, 16 aa, Heterodera glycines
  Coding regions on vcDNA: vcDNA=SeqID_52018; Strand=+; Position=1 -32,970-988
MLVTTSSTSGGKNWDF

SEQ ID NO: 125596 - protein, 17 aa, Heterodera glycines
  Coding regions on vcDNA: vcDNA=SeqID_52019; Strand=+; Position=1-52
MEKACKIWRDYIDFSAL

SEQ ID NO: 125597 - protein, 95 aa, Heterodera glycines
  Coding regions on vcDNA: vcDNA=SeqID_52020; Strand=-; Position=1-701
LFEYPKRTLEKIDFFVFGAVPPNRCAQIYGETESFGNSFPIACTLILRWIFAPHNCLSTPNGHLKKSIFLFSGQSPRTDAPRFMGRPNPSGIASL

SEQ ID NO: 125598 - protein, 51 aa, Heterodera glycines
  misc_feature (22)..(22): Xaa can be any naturally occurring amino acid
  Coding regions on vcDNA: vcDNA=SeqID_52021; Strand=-; Position=1-156
KNRFSLVSVWGTQTFMGSKNPXQIKVQAIGKLSPKDRSPHKSGRIGSGGLP

SEQ ID NO: 125599 - protein, 72 aa, Heterodera glycines
  Coding regions on vcDNA: vcDNA=SeqID_52022; Strand=-; Position=1 -71,201-348
MVKKFFLLSTNMPFLRVYLGRGRGYILIDFTMLIFQKLAKFLENMCNEGIEADAMKAGGPAVSLGATGKMHK

SEQ ID NO: 125600 - protein, 150 aa, Heterodera glycines
  Coding regions on vcDNA: vcDNA=SeqID_52023; Strand=-; Position=1 -39,152-351,485-608,660-749
  Homolog annotation: Hit_ID=NP_871956.1; Match level="QueryCoverage =87%, HitCoverage=72%, E-value=3e-17, Identity=43%"; Hit description =lipase, class 2 family member (19.5 kD) (2A845) [Caenorhabditis elegans] gb|AAN60535.1| Hypothetical prot
MIRAITQFTHSSQAILGGVCVDTEEQLGPPLTHLVHTFIGVGGANREAVHLCRLFEWAMPCNPVNGMRCHSQFLYDINSKVGYEATTRIFVIRSMDDGTVGTRDCEGRSVSAIDGQNDEIVLRNYSHQMVIFGTGDNSSNFYILINCFLK

SEQ ID NO: 125601 - protein, 93 aa, Heterodera glycines
  Coding regions on vcDNA: vcDNA=SeqID_52024; Strand=-; Position=1-282
MCPPATNRTTDTDHIKVAAATVDDSRATVGEGLADGDDDASQLRHASTPLLTRYYFDAVTAQCYPFGAQTCGGNENRFETKEKCLTKCRIGTD

SEQ ID NO: 125602 - protein, 71 aa, Heterodera glycines
  Coding regions on vcDNA: vcDNA=SeqID_52025; Strand=-; Position=1 -116,652-925
QYSVFILLCLFLIAEFGHTSAECQKDKTEATKEALLLQYFFARGFPFLSDSDDLPTAAADEVKQKLTNKCD

SEQ ID NO: 125603 - protein, 53 aa, Heterodera glycines
  Coding regions on vcDNA: vcDNA=SeqID_52026; Strand=+; Position=1 -146,220-235
MASKIGGPGSLGDPSLWGSSSRTSTAILLNKNDAADEECPNWRCVIMGNNLRS

SEQ ID NO: 125604 - protein, 52 aa, Heterodera glycines
  Coding regions on vcDNA: vcDNA=SeqID_52027; Strand=-; Position=1-157
MSKVSKPVKEKATKDVSIIEKEEPECFYVKKILAMYVCHDKEKSRLFYIDWE

SEQ ID NO: 125605 - protein, 146 aa, Heterodera glycines
  Coding regions on vcDNA: vcDNA=SeqID_52028; Strand=-; Position=1 -164,1430-1518,1594-1781
MCERRVGNVLTDRKCGGSDALVVRRQTDQTRANEVQNFLRKIHAQKSTSAKPTKRLALFLPSALSKLHESVQQCIRNASDFVGSISKFCVFIEHSDSDVLDALLLASTDDDDGTATNDDRDTNKNISNQHQQDDEDGTDHRHDDLR

SEQ ID NO: 125606 - protein, 98 aa, Heterodera glycines
  Coding regions on vcDNA: vcDNA=SeqID_52029; Strand=+; Position=1 -35,94-217,276-410
  Homolog annotation: Hit_ID=NP_871691.1; Match level="QueryCoverage =100%, HitCoverage=34%, E-value=7e-17, Identity=46%"; Hit description= putative protein, with a coiled coil-4 domain, of eukaryotic origin (3G119) [Caenorhabditis elegans] gb|
MVSPDEVAEEYRAALSELTRNDKTQINLLTILAEDYASYASAIVAVIEERLFKCPSPMKIVMLYVLDSIVKNIPATSGAYRDLFAKRIVDMIVHVFKE

SEQ ID NO: 125607 - protein, 206 aa, Heterodera glycines
  Coding regions on vcDNA: vcDNA=SeqID_52030; Strand=+; Position=1-621
  Homolog annotation: Hit_ID=A34043; Match level="QueryCoverage=27%, HitCoverage=39%, E-value=9e-12, Identity=56%"; Hit description =hypothetical proline-rich protein 1 - polychaete (Owenia fusiformis) (fragment) sp|P21260|YPRO_OWEFU HYPOTHETI
MRKEHADRPTKVELTKGISVLMNRGGEEGEVVDTPRRPPAPPPPPPPPGRPLRRPPPSPPGPGGPSPPSPPPRPQRPPRPSRTSRRSGRMEQWRQRRYDIQQRQPPPLVVRDLLAEAAAAPLPESDDDNDADDEYMLENGFALPAPSQYYGDLPVLPTMRKKLRKWTQLSAGLPSEENYSRTRLTMMMINAKNIGFINLHHCLAQK

SEQ ID NO: 125608 - protein, 107 aa, Heterodera glycines
  Coding regions on vcDNA: vcDNA=SeqID_52031; Strand=+; Position=1 -263,350-410
MHSETVFIYAQEQEPKHNDKNWKAPLGAVLKHQILDPPQGFGIPVSGITDFYIYLRRCAAFFPANAENADLFSINIIMPNNTEGLTIWYSIPAADFQKFKSLAVHIL

SEQ ID NO: 125609 - protein, 253 aa, Heterodera glycines
  Coding regions on vcDNA: vcDNA=SeqID_52032; Strand=+; Position=1 -283,637-835,1110-1244,1587-1733
  Homolog annotation: Hit_ID=NP_508537.1; Match level="QueryCoverage =98%, HitCoverage=81%, E-value=2e-71, Identity=28%"; Hit description =spectrin (spc-1) [Caenorhabditis elegans] gb|AAB53876.1| Spectrin protein 1 [Caenorhabditis elegans] pir|
ENRKPNFFLALTQDRVQKMYPKIASFSYTFFFKNSELNTHQPQVEVVRSKGKELAKSSEIGGPEIERRIKALDQSWTQMVELAEDRQKKLQESEEFQNFIGRVEEEEAWLNEKQQILSSPNVGENMAAVQGLLKKHDTFEVDLQMHQQRIDELQRQGEQLINSGNHHAKNIGTRTEQLLKHLILIKELAVQRLQKLRDNNAYMQFMWKCDVVESWIGDKEPHVRSADYGRDLSSVQLLLNKQDTFDNGLNNFE

SEQ ID NO: 125610 - protein, 72 aa, Heterodera glycines
  Coding regions on vcDNA: vcDNA=SeqID_52033; Strand=-; Position=1 -77,135-276
MAKRSLLAKNASTNDLTQYINPVLANRRRSSLFCTAVDPAMKRLRQREAYKTAMCQVGAFTALGKKHWLRLF

SEQ ID NO: 125611 - protein, 80 aa, Heterodera glycines
  Coding regions on vcDNA: vcDNA=SeqID_52034; Strand=+; Position=1 -13,1043-1272
MRYKNGGKGLYFEEKKSKCFPSGPYRPQWIFYTGTREWGGPLDSFVSVVKPKSTISKQQVKQGIGRFGAAVLAPASVFLL

SEQ ID NO: 125612 - protein, 52 aa, Heterodera glycines
  Coding regions on vcDNA: vcDNA=SeqID_52035; Strand=+; Position=1 -118,260-300
MAATKCSEVLMIGRKKVNRLIMAGLISELQGNDGRNGQKGKCEKISSLRRVA

SEQ ID NO: 125613 - protein, 178 aa, Heterodera glycines
  misc_feature (26)..(26): Xaa can be any naturally occurring amino acid
  Coding regions on vcDNA: vcDNA=SeqID_52036; Strand=-; Position=1 -83,670-797,1045-1187,1248-1380
  Homolog annotation: Hit_ID=CAC83611.1; Match level="QueryCoverage =96%, HitCoverage=57%, E-value=4e-37, Identity=47%"; Hit description =EXPB1 protein [Globodera rostochiensis]
WDLAKLKLINLLFLIFYFCSFGPINXLNTCLSESSASDSISAQLNKPISGGQFTFYGIGGQGACGLDIATPTKSAAGSGTLFNSDAAWVESCLPDARYLLNDLVCINRCVKIEYKGNTLTVPINNKCSECAKDHLTVPINNKCSECAKDHVDLSEEAFNWLEPGGGSVGVAKSEKAKT

SEQ ID NO: 125614 - protein, 128 aa, Heterodera glycines
  Coding regions on vcDNA: vcDNA=SeqID_52037; Strand=+; Position=1 -240,488-634
  Homolog annotation: Hit_ID=CAC83611.1; Match level="QueryCoverage =69%, HitCoverage=32%, E-value=2e-22, Identity=55%"; Hit description =EXPB1 protein [Globodera rostochiensis]
MPSFLPMLILLLSVQLLSFLPCSFSASLSVAPAYTTKDTCLSESSASDSISAQLNKPISGGQFTFYGIGGRGACGLDIATPTKSAAGSGTLFNSDAAWVESCLPDARYLLNDLVCINRCVKIEYKGNT

SEQ ID NO: 125615 - protein, 948 aa, Heterodera glycines
  Coding regions on vcDNA: vcDNA=SeqID_52038; Strand=-; Position=1 -294,573-812,933-1044,1092-1145,1201-1472,1534-1667,1787-1915,1983 -2171,2268-3309,3358-3534,3582-3782
  Homolog annotation: Hit_ID=NP_492097.1; Match level="QueryCoverage =92%, HitCoverage=65%, E-value=1e-156, Identity=58%"; Hit description= related kinase (1I38) [Caenorhabditis elegans] emb|CAA98148.1| Hypothetical protein ZK524.4 [Caenorhabdi
QQQQNRIVISITSHCSSMSTSNKLRRKNSSSATPSSASLLHINDARIAGLYDLEHTIGKGHFAVVKLARHVFTGEKVAVKVIDKTRLDPVSQAHMMQEVRCMKLVQHPNIVRLYEVIDTQTKLFLILELGDYDMYEWVMRRPYEKGGGGEAEAQLYFSQIVKAINYCHKLHVVHRDLKPENVVFFERLGMVKLTDFGFSNLFVPGEQLQTSCGSLAYSAPEILLGDSYDAPAVDVWSLGVILYMFVCGRLPFQESNDSETLTRILDCKFSFPDHVSVDCRRYSFAGILCDYIVSPAPLIRLISSMLLRDPSRRATLEQIVQNKWVKAGDKGHAEALPLIIRDHLPACAHATIVEQMVAGKIGGEEEILCAIELNEYNHLTATYFLLAERVLSCYRQAQANRLMAAVEECQMGDLSSQLSNGGGTAATTANQNRSRSRSNSWRGPAPRRAYSILKEESEEELSSYNLRSSSRQSSRFFNVVPSSAGVAVSAKPRDASARSNLLATSRANSNDSFAPGPSAILEDEVEADEQQKPTSSTDQSQSQSEDDALASLPPSTSSTAQSVDFPPPSATSTPFLQRILAPICEFRDQSPDTAVDSVQSAFPFDVPLVANESASGGGIVRRIRPHSAVFGASAPRPVPGRGVALPSSAGHLPPLPSSPEKMRTTRNGHNHSRMRNASSLEMFPISNGIGGKENGSSFLLLEPCSATSPPTPNPNNNGVVHCWPNMLLERHPNFTNLCNLPISSAANLIKRPSSSSLTRRRVVFSARAFVFDFHFLFRNSSPSAPLTFRATSSLHSSCDRISPHAIQELLEFSRLSGRMRRTASPDSRLSSRSPSPSCLSSGRTSPAMSGIVSRLKTTNFLPSTGGMRKLSSSPHLLGICEETEEGGDMQDLLGQGNSAFCPDTFITSRANGTSRRQDFQCNGKSASAVVVRSARSASMGLGTIGRMS

SEQ ID NO: 125616 - protein, 127 aa, Heterodera glycines
  Coding regions on vcDNA: vcDNA=SeqID_52039; Strand=+; Position=1-384
MFGQQWTTPLLFGFGVGGLVAEHGSSSRNEEPFSLPPIPFEIGNISRLEALRIREWLWPLRVVRIFSGDDGSGGRWPAEDGSATPRPGTGRGADAPKTAEWGRIRRTMPPPLALSFATSGTSNGKAL

SEQ ID NO: 125617 - protein, 115 aa, Heterodera glycines
  Coding regions on vcDNA: vcDNA=SeqID_52040; Strand=+; Position=1-582
  Homolog annotation: Hit_ID=NP_492097.1; Match level="QueryCoverage =100%, HitCoverage=11%, E-value=7e-36, Identity=61%"; Hit description= related kinase (1I38) [Caenorhabditis elegans] emb|CAA98148.1| Hypothetical protein ZK524.4 [Caenorhabdi
RILDCKFSFPDHVSVDCRRLISSMLLRDPSRRATLEQIVQNKWVKAGDKGHAEALPLIIRDHLPACAHATIVEQMVAGKIGGEEEILCAIELNEYNHLTATYFLLAERVLSCYRQ

SEQ ID NO: 125618 - protein, 128 aa, Heterodera glycines
  Coding regions on vcDNA: vcDNA=SeqID_52041; Strand=+; Position=1-387
MQTRYASSVRFHLIGFTSSLTLSSKCFATFPHGTCSLSDSWPYLVLDEVYHLIWAAIPNNPTPRHVKMGRHRQLDRSCTFSGAPVKGNLNKRANPSSRSIRYTSQPQRSCDSALDSSQFTRRYYGNPR

SEQ ID NO: 125619 - protein, 367 aa, Heterodera glycines
  Coding regions on vcDNA: vcDNA=SeqID_52042; Strand=-; Position=1 -909,1483-1677
  Homolog annotation: Hit_ID=NP_871945.1; Match level="QueryCoverage =64%, HitCoverage=25%, E-value=2e-14, Identity=34%"; Hit description =3'5'-cyclic nucleotide phosphodiesterase family member (2H918) [Caenorhabditis elegans] gb|AAO38607.1| Hy
SCDSERGDCCGVDFGTGRATKTGDKGTQRLLRRHRDTGDSRAVVADTAVVVATMPSSQSLSSSAATAAETTTSNNDNGNSKKKSLRERLRHPDLHLGSLFTSGKSGGGFGAFRRATLSSGCNDGRKAARRQHHHAVAAAANSRHATASTTVAEESPPPPLAGGCGDDTQSLLSSVDLNKSEEQPYHHQQQVPSSSSSYQPAPVPTRGRLQPSVSVSCSTGAGAVGGSSYNYHTHLGGMGAHGRRESFLYRAGGFGMTDDTSPVLQLRDYATVSGCGNSGAAGLQRPASRASSVASSELTTAAMHGDDFIVTPFAQLLASLRNVRANLVAIANLPQQCTALAPDDGTAIATINVGGATSSANMNNVIQ

SEQ ID NO: 125620 - protein, 223 aa, Heterodera glycines
  Coding regions on vcDNA: vcDNA=SeqID_52043; Strand=-; Position=1 -187,599-1083
MDKPKCDDQWVIKQMLNNLGTSPTQEEIHMRIMAHLIETNVPFFDFMHQSATNLPHSFLSEYGSINAKELNIFYKNYLLKQSKIVGSWEIKMIMKLLFKQSAEVEQKMHQTKKNEVQWQLKNEFSKGQINEFYGPQMLKKAQKMSAPELIGQIVEHAQIFSKYTAAVCQKAAEPYAKIANAKAELFAMLKASAGEMPKDIETNEQSIKKNDTLLGFICKLTQC

SEQ ID NO: 125621 - protein, 80 aa, Heterodera glycines
  Coding regions on vcDNA: vcDNA=SeqID_52044; Strand=-; Position=1 -122,294-313,732-751,817-841,891-944
  Homolog annotation: Hit_ID=NP_499831.2; Match level="QueryCoverage =100%, HitCoverage=23%, E-value=1e-21, Identity=53%"; Hit description= protein kinase associated with lack of intestinal cells and excess pharyngeal cells, similar to Drosophi
PGNLLVNSNCILKICDFGLARIFDRCDVQNMTHEVVTQYYRYNEKVDAQGPIDQLNMVIDLLGTPKPDEMRECCEGALKH

SEQ ID NO: 125622 - protein, 19 aa, Heterodera glycines
  Coding regions on vcDNA: vcDNA=SeqID_52045; Strand=-; Position=1-60
EPVNSCIGCKCRRCCTPNS

SEQ ID NO: 125623 - protein, 138 aa, Heterodera glycines
  Coding regions on vcDNA: vcDNA=SeqID_52046; Strand=+; Position=1 -155,256-439,497-571
  Homolog annotation: Hit_ID=NP_989519.1; Match level="QueryCoverage =92%, HitCoverage=16%, E-value=5e-44, Identity=67%"; Hit description =aconitase 2, mitochondrial [Gallus gallus] gb|AAN63562.1| aconitase precursor [Gallus gallus]
MRIFGNVQLCAVRRLHTSVLRRSMAVPMSRYEPNSRLPYQKLDANLAVIRKRLDRPLTLAEKIIYSHLDDPQNQKLERGVSYLNLRPDRVAMQDATAQMAMLQFMSSGIPAVQVPTTIHCDHLIQAQVGSEKDLYRAK

SEQ ID NO: 125624 - protein, 80 aa, Heterodera glycines
  Coding regions on vcDNA: vcDNA=SeqID_52047; Strand=-; Position=1 -141,186-284
MEAPAEIDEIYRPHEARIHEAFFNTLSKPIHSKNERRNRAEGIFTTSESQQDRERIHVTWRHFGQKTKFFLDRNEHDLFE

SEQ ID NO: 125625 - protein, 54 aa, Heterodera glycines
  Coding regions on vcDNA: vcDNA=SeqID_52048; Strand=-; Position=1-164
TGAHRPLAPTPCPGHRRQQRAQKGGQQRGHAQHSAHLRADGHARAAVGAEASRT

SEQ ID NO: 125626 - protein, 80 aa, Heterodera glycines
  Coding regions on vcDNA: vcDNA=SeqID_52049; Strand=+; Position=1-243
MTRPHLRNAPGTFSVLVPHLIFTDKKILYVSVFFSFLIGCDAKTRKCLRQHLYELLYGQFVNGQSVSNGQSVRIFDFLDT

SEQ ID NO: 125627 - protein, 62 aa, Heterodera glycines
  Coding regions on vcDNA: vcDNA=SeqID_52050; Strand=+; Position=1-186
MNCPMTDCPMIDCPSGCRRVYLYSMLSPFHHNLASNFINPSSKSHVHRQDEVQNGSNYQQKE

SEQ ID NO: 125628 - protein, 119 aa, Heterodera glycines
  misc_feature (29)..(29): Xaa can be any naturally occurring amino acid
  Coding regions on vcDNA: vcDNA=SeqID_52051; Strand=+; Position=1 -191,337-503
  Homolog annotation: Hit_ID=NP_509391.1; Match level="QueryCoverage =100%, HitCoverage=19%, E-value=2e-24, Identity=48%"; Hit description= placental protein 11 like precursor (62.8 kD) (XI865) [Caenorhabditis elegans] gb|AAF99995.2| Hypothetic
EWRGEIVDGHHSWVRFYLQEKAGDIEYTXYYVKPRHGNFIGTIQYKWKQYLKRIGGFMIGTSPAFDFSLLTVCILTEPGDRKCKFQLKETPMFVSSFLEDCVIDGSFRHNFCIATAYPG

SEQ ID NO: 125629 - protein, 127 aa, Heterodera glycines
  Coding regions on vcDNA: vcDNA=SeqID_52052; Strand=+; Position=1 -116,315-500,548-882
FSPFIIYVPDWHYYGTVFCAILPQFLALFCPLFPNLFLANFWLCFAQIFNPLFCLFLHIFVPNFPIYFLPIFRIILPQFLTLSFANFCTFLCQISLFISCQILHIFVPNFPIYFLPISCIYFPHFLI

SEQ ID NO: 125630 - protein, 38 aa, Heterodera glycines
  Coding regions on vcDNA: vcDNA=SeqID_52053; Strand=+; Position=1 -112,272-276
MKPMQFASFSPVAIIFLLFLVTELWAGCVLSTQKPKKD

SEQ ID NO: 125631 - protein, 374 aa, Heterodera glycines
  Coding regions on vcDNA: vcDNA=SeqID_52054; Strand=-; Position=1-1125
  Homolog annotation: Hit_ID=XP_515058.1; Match level="QueryCoverage =99%, HitCoverage=36%, E-value=6e-21, Identity=26%"; Hit description =PREDICTED: similar to KIAA0845 protein [Pan troglodytes]
DERVQKAGKKRGRTEKKKCKETEESESSEEESKEQKQGGKEGKGKKEHSKGEEETKDEERRGEKKEDEESKEKRAEPTAAEEKASPKDQAQSLYEEAKPASAAVPAEAAPAENAPAGDAAYGMAPNASQSPPESAAAPAGGAGYGATNASLPPPPAEPPKDQAKSLYKEAKTKPASGTAPAEAAPAESAPAGGAPAEGGASNASLPPPPPPDHPPPKDQAQSLYEEANKPPVSAAAPAAGAGYGASNASLPPVLPPPPPPAESEAQKGAGYGGGGTPAEEKKEKTPDEQLADVLKEGKKKGLIVDKREEEGEKERERKKKKKKKEEEQRETERVEEEEKEREETEERGKKKEKGEEKKEENRDTEAQTSSGEAQ

SEQ ID NO: 125632 - protein, 353 aa, Heterodera glycines
  Coding regions on vcDNA: vcDNA=SeqID_52055; Strand=-; Position=1 -542,668-754,923-1069,1113-1259,1303-1441
YRFLGRFMLNYIWNSNYPEDVLKSLFLMCLTYAMKGAEAMNIVANHFIFLLTARHLDYEIAVHFKNIKKIDGTMAETILTRFEIVDQSNKAKERPSICEESFVIDITAIESGKQRKKLAGKGRRPDFNIPYSICDGTTFELMNNDNFCLFRAFEFLRMKHVLPQQRFSEYKRNPGWQLNDEYYAELHPDTFRLFCFGTSGKMKPLWKADCEMPYSHQNQHNSKCKWKCHNCQRVGSDFRGNCIDSNDNFFETCLGCSKTFKCRKCYEHHCKLSQCKIKRGTEVTTIEKSICKSSKKCVDCGIIYQTRVHKDKPHVCGQKFCKVCLGFHVPRECYIPYRAKKKTEERIIFFDFE

SEQ ID NO: 125633 - protein, 97 aa, Heterodera glycines
  Coding regions on vcDNA: vcDNA=SeqID_52056; Strand=+; Position=1 -22,71-201,394-505
  Homolog annotation: Hit_ID=NP_508182.1; Match level="QueryCoverage =98%, HitCoverage=28%, E-value=2e-29, Identity=60%"; Hit description =mob protein (38.7 kD) (XB564) [Caenorhabditis elegans] gb|AAA82341.1| Sphingomyelin synthase protein 2 [C
LFDGHSLMDVLIAYWLMDVLIAYWLTSHVFWSYHQQFEMPTAQRTQSALSNIWWFWLCYWFESEVPDTGPIVNDWNWPFAQPHFMHTLMAKLNAKLQ

SEQ ID NO: 125634 - protein, 94 aa, Heterodera glycines
  Coding regions on vcDNA: vcDNA=SeqID_52057; Strand=+; Position=1-285
MPPYGYMPQNVPQMGYQQAPLAPPQVSVPQGKTGGYKPSCAGPAPAPVPCVAEVLTQLVADFTTFTTEFNNNLSAFSTEFAQLSKWLRENVGVA

SEQ ID NO: 125635 - protein, 86 aa, Heterodera glycines
  Coding regions on vcDNA: vcDNA=SeqID_52058; Strand=-; Position=1 -45,218-433
MKWTSHMRAAFSKTLLIVYLNSYFHFTLPIINSLLIVATIRKMERTVGSCVRHNSVWTKCDKRQIPEKGNVSPFGIDKIYPYDSKG

SEQ ID NO: 125636 - protein, 67 aa, Heterodera glycines
  Coding regions on vcDNA: vcDNA=SeqID_52059; Strand=-; Position=1 -116,358-445
MLYMTYAGAAPTLLKCGQHVFPDAEKANKRCEALAGMAKSNQANCTSQNAEWAIQFRSVNVEFDMHW

SEQ ID NO: 125637 - protein, 75 aa, Heterodera glycines
  Coding regions on vcDNA: vcDNA=SeqID_52060; Strand=+; Position=1 -203,662-686
MRTCQQLNSPSTKRSPINRRIGPSVNINLRAQTQNCLKTVDVGLNRPEKWKKGLICANDFFHRMAQLFQFYNKFL

SEQ ID NO: 125638 - protein, 187 aa, Heterodera glycines
  Coding regions on vcDNA: vcDNA=SeqID_52061; Strand=+; Position=1 -38,209-734
MAHLEISRNSQRPYIDHSVIAFLRSNKQIFNGTRFALSLSVQAPKNAAQPIWDVLAREIWSIIAPNIRRLYVPDADHLDNLRSRTSPTILTDLNINSILSGHLLPDVLGDFDGPNATASAGQSLSKWLHTPTTDGKPKRLRCDDFNGQGNAEWVHNFKEGAPSFLLFCHSFASFSATKFSTINAICF

SEQ ID NO: 125639 - protein, 69 aa, Heterodera glycines
  Coding regions on vcDNA: vcDNA=SeqID_52062; Strand=-; Position=1-207
  Homolog annotation: Hit_ID=NP_500247.1; Match level="QueryCoverage =94%, HitCoverage=34%, E-value=2e-20, Identity=60%"; Hit description =putative cytoplasmic protein of ancient origin (4D482) [Caenorhabditis elegans] gb|AAF60889.1| Hypothetic
MPNLKDNTYFVPRNRYVVYAERIWLDYDASQIPPEWHRWLHHICDKPPTVEPPPERKKWMLEHEPNNSI

SEQ ID NO: 125640 - protein, 90 aa, Heterodera glycines
  Coding regions on vcDNA: vcDNA=SeqID_52063; Strand=+; Position=1 -142,188-318
MKRCIPCGGDLSSFGRRCRTLNKCANSWSIISSQIGYGHRQTRRIEAEGGGTTVASGGRQNEMKKVIKKLTSMSLTDRGLMVFIFITSGR

SEQ ID NO: 125641 - protein, 59 aa, Heterodera glycines
  Coding regions on vcDNA: vcDNA=SeqID_52064; Strand=+; Position=1-180
LIALVCLIGVLMFFAHSLRDEPLPTGAVKTPTAPDENTVDAYYKSHAVAESSDMDNNFA

SEQ ID NO: 125642 - protein, 38 aa, Heterodera glycines
  Coding regions on vcDNA: vcDNA=SeqID_52065; Strand=-; Position=1 -88,430-458
MPITRRVLCAVCGKKIGGNFTTRQAYQCRAKKLIGPNS

SEQ ID NO: 125643 - protein, 320 aa, Heterodera glycines
  Coding regions on vcDNA: vcDNA=SeqID_52066; Strand=+; Position=1 -279,338-749,812-1084
  Homolog annotation: Hit_ID=AAL78214.1; Match level="QueryCoverage =45%, HitCoverage=76%, E-value=2e-17, Identity=33%"; Hit description =putative esophageal gland cell protein Hgg-20 [Heterodera glycines]
FICGDCWLDLFDFLPPSQLGLEIALISRRFDCFVEEHFKTRKWTLANEIKIRGVIGQNGAIEMGIVNSDGKALPIPQIPLPNKVIGFGSIFIHFIDQNVLTFLRRFHRFFSVCATKLYILTENVRISEFVMRNIWPLFKNTIHVMCLNPIAFRQMRQLAPSMLNDCPSLRVVFFDGGILPEFPPDDSANASDGQAVAKWLFTPRPDLTKILGIENLTVDQLLTTVEQIKAAFSSASSPVNFSISVDFPSSSPIDSVEPFQLTNEFTGEQLVLLQENAYGFVLIRCPIVPDDKKRQKFKKELGDRWNQMKIAFTDQLVDNG

SEQ ID NO: 125644 - protein, 338 aa, Heterodera glycines
  Coding regions on vcDNA: vcDNA=SeqID_52067; Strand=+; Position=1-1017
  Homolog annotation: Hit_ID=NP_913627.1; Match level="QueryCoverage =98%, HitCoverage=24%, E-value=2e-40, Identity=33%"; Hit description =putative helicase [Oryza sativa (japonica cultivar-group)]
MAIPQHKDLLFGGKTVIFSGDFKQSLPVVPHEGLTAQVTACFQTNPLFGQFTTMKLTINQRLGQGQQAYLQMCRQIGLGETGEHFWIPPQFLVKSREELIDFVYPNFQQLLGNDKELLNRLILAPHIDTCDEINEIMMANVPGQVREYLSSDKPLDERPLDIDEIESEVAALNRRTDSGMPPHRLRLKVGSVVVLLINKSDKEGLINGTRIVLEELGDDRLVGRVINSNAVGGQVKFFIERTRNVYEDKTPGGLKYERLQFPIKPAFAMTILKGQGQTINTVGIDLERDVFSHGQLYTAFSRATDGNNVRVYAPRRETDAQGQTKVLNIVAKNMLKLQ

SEQ ID NO: 125645 - protein, 557 aa, Heterodera glycines
  Coding regions on vcDNA: vcDNA=SeqID_52068; Strand=+; Position=1 -201,253-1086,1188-1826
  Homolog annotation: Hit_ID=NP_508324.1; Match level="QueryCoverage =86%, HitCoverage=21%, E-value=3e-74, Identity=33%"; Hit description =predicted CDS, peptidase family A16 and RNA-directed DNA polymerase and Integrase, catalytic domain and Z
MLVPVDEEPDILVGMADFWKFFNGVQRVSPQLFKVQTLIGSTVCGRDEIPSRPTADHPLSVMPVTVHKNESISDLDSLRQFWDLQNIGIRDDPLENDDDTAQQIFDQTTTRLANGRYSVGWPWKNFPPDLPSNFAMAHRRLSSILNRLQHFPELLAKYEAAIQEQLRLGLIEPAVRTRGLEHFLPHHCVVTHKGILMRFRLAGIALWGDLKKAFNSLSLLECDREFCKVLWVNDVRKPPLPDNVVIYRWSRVPFGVIASPFLLAATIQKHLKQDGSPLAIEMAENAYVDNLLMQCTSPSEALNKYMSSKTLFRACQMNIREFICNSDEVMCRIPKEDQLVKEVPKQLASVFDPLGLVCPALHVAKMFFQSLWETKLDWDDSLPTEKVQEWNTIATTWNQQKVRVPRRVIPLEVTSHQLHAFVDASKDAYGACIFIRAQHEVAITAHLIFAKSRVKPKGSNLTIPRMELMGMLIGIRMLQFAEKQLGLAIRHKFIWCDSKPVLGWVSSSEQQPRFVENRLKEIRAVDQVRFLYISTEQNPADVASRGCTVLELTSHPL

SEQ ID NO: 125646 - protein, 68 aa, Heterodera glycines
  Coding regions on vcDNA: vcDNA=SeqID_52069; Strand=-; Position=1 -119,1302-1389
MFQIAANIFRYERNRTERLFLYLQIVTGKWARRKCFSGKNLAHYILDLYRLCEFYEVDDEWTRKLWVK

SEQ ID NO: 125647 - protein, 20 aa, Heterodera glycines
  Coding regions on vcDNA: vcDNA=SeqID_52070; Strand=-; Position=1 -59,391-394
MAIIRDMLLDDIELFQRSSM

SEQ ID NO: 125648 - protein, 168 aa, Heterodera glycines
  Coding regions on vcDNA: vcDNA=SeqID_52071; Strand=+; Position=1-507
MMFNRELRTKLDLVQPVFNPKKREEKEEKQKVVDNYRDRVKRNFDRSTWKRSFDIGLKIFARNFRDGTKWMEGEIVRQISPSLFLVRTKRGIWKRHLDQLKSNETDSESADTDSNSSMAEQAEMDTDVENQPDIDAQDEPQNVLTNDQEELRRSSRQRKPRTIFDPSR

SEQ ID NO: 125649 - protein, 145 aa, Heterodera glycines
  Coding regions on vcDNA: vcDNA=SeqID_52072; Strand=+; Position=1 -203,708-942
  Homolog annotation: Hit_ID=CAE64782.1; Match level="QueryCoverage =88%, HitCoverage=25%, E-value=7e-14, Identity=30%"; Hit description =Hypothetical protein CBG09575 [Caenorhabditis briggsae]
MYSGFVWQQRYCAGAEWVLKVDDDIAVHLRRMVEWTEKKFQKIATEHPLIYFGVPADRGLSRDKNSKWYVPYGMFTGEHFPPFLYGGCYLTTPSTIKAVLEQAHKTDSFYLEDVLYTGILAELANVTVSDQLSHFYGNGLQVINN

SEQ ID NO: 125650 - protein, 72 aa, Heterodera glycines
  Coding regions on vcDNA: vcDNA=SeqID_52073; Strand=-; Position=1-219
  Homolog annotation: Hit_ID=NP_701782.1; Match level="QueryCoverage =91%, HitCoverage=8%, E-value=2e-12, Identity=55%"; Hit description =hypothetical protein PFL2110c [Plasmodium falciparum 3D7] gb|AAN36506.1| hypothetical protein PFL2110c [Pl
KVEDKVEAEQKVEEEQKVEDKVEAEQKVEEEQKVEEEQKVEDKVEAEQKVEEEQKVEEEQKVEERQLENYLF

SEQ ID NO: 125651 - protein, 219 aa, Heterodera glycines
  Coding regions on vcDNA: vcDNA=SeqID_52074; Strand=+; Position=1 -235,1435-1616,2507-2749
MRISAIHEAIRDDDQMTLKQLVDDWDTATGRDQHGRTPLHIAVGMRERGRERAFGQSVIGQSVMGQSVIGQSVMGQCVSLPFSASLRQAFIHFFKFSLFFVSSCLTDDQQRAQMTRILCRAGAESAATATKRHNENAAGRHTEEADDMLVLNELHRRDGLIGEEAEEEEDEDDGGGGDVDQSADEIEFGHVAARRLAAKAKNAAMIKGWVWAIRLIDIY

SEQ ID NO: 125652 - protein, 127 aa, Heterodera glycines
  Coding regions on vcDNA: vcDNA=SeqID_52075; Strand=-; Position=1-384
METVEEDSEKERAEEKRLEEEKPEEKGSDGNEETESEGKGKKRGDEESQLTDDTAEKEKELVSLTIEEKTVEISESEVVNCDEREGKEKSVPPVETEAAGRSTQRQRVQGSTTADEEATIAAFFDFK

SEQ ID NO: 125653 - protein, 312 aa, Heterodera glycines
  Coding regions on vcDNA: vcDNA=SeqID_52076; Strand=+; Position=1 -52,134-1020
  Homolog annotation: Hit_ID=CAE56152.1; Match level="QueryCoverage =93%, HitCoverage=33%, E-value=1e-22, Identity=23%"; Hit description =Hypothetical protein CBG23765 [Caenorhabditis briggsae]
MVKLKVILNEPVSQHEQVLILSMISATISNPMLCHHRAQKNYDVRIDRDTTQCKLIANLFDEPQRELEVDIYQPNSEPFTFKAHRCLKVKQSQKFWTNLLNDKFSDPVSVSTLPTTIEDCQEMINYEKCEFGPLSGQSNEQFHTNQELHIDYSWWKFGKDKSEVNNCYHAIITLLGKPGSESLGSPTEEVSKCKFSKGSCRLGDNAILIWNLDSTEHQRACLYNKVTTENGKFTKRMWISKNSQFALSFQENAKSVESCGHTLKLSDQGFAVPSWQFRIITGKTTHRIKREQWWPREKPLDQNEKAQQQLHN

SEQ ID NO: 125654 - protein, 120 aa, Heterodera glycines
  Coding regions on vcDNA: vcDNA=SeqID_52077; Strand=-; Position=1-477
  Homolog annotation: Hit_ID=CAE71836.1; Match level="QueryCoverage =96%, HitCoverage=18%, E-value=2e-11, Identity=30%"; Hit description =Hypothetical protein CBG18877 [Caenorhabditis briggsae]
CKFSKGSCRLGDNAILIWNLDSTEHQRACLYNKVTTENGKFTKRMWISKNSQFALSFQENAKSVESCGHTLKLSDQGFAVPSWQFRIITGKTTHRIKREQWWPREKPLDQNEKAQQQLHN

SEQ ID NO: 125655 - protein, 124 aa, Heterodera glycines
  Coding regions on vcDNA: vcDNA=SeqID_52078; Strand=-; Position=1-375
  Homolog annotation: Hit_ID=AAG00551.1; Match level="QueryCoverage =94%, HitCoverage=55%, E-value=3e-10, Identity=33%"; Hit description =retinitis pigmentosa GTPase regulator [Homo sapiens]
MAVGALGGGRAEGRAKGSRKKAEEEGKKEQAKEKKGGGRGREGRGVATEENGGGRRRERRGKGAATEEHEGERKEERRDGKREEGEGNASASNGQTHLFLAERIKQKQQNKTQKRQQKKQNEKC

SEQ ID NO: 125656 - protein, 157 aa, Heterodera glycines
  Coding regions on vcDNA: vcDNA=SeqID_52079; Strand=+; Position=1 -54,219-404,726-959
MTRMDDGGDAYLSCGSEKYTAGVRVVEGALSVGDHHQQTAEWWQLLCCQSDSVRVRAEDCVETKFINDFRRSSSFSSGAQHFHHYTFADENMAADFRRRRAEIANAKVNSYAVPTVNVEENGKRQIMTTTIGKKSENTTTARRNSTSTEHQPQKVNG

SEQ ID NO: 125657 - protein, 34 aa, Heterodera glycines
  Coding regions on vcDNA: vcDNA=SeqID_52080; Strand=+; Position=1 -62,519-561
MTFFCAVAERKEFQKVVKADVHLEVDQAFNMQDD

SEQ ID NO: 125658 - protein, 341 aa, Heterodera glycines
  misc_feature (101)..(101): Xaa can be any naturally occurring amino acid
  Coding regions on vcDNA: vcDNA=SeqID_52081; Strand=-; Position=1 -191,385-503,623-694,836-866,923-1063,1207-1280,1370-1467,1523 -1629,1671-1808
  Homolog annotation: Hit_ID=CAE60801.1; Match level="QueryCoverage =93%, HitCoverage=27%, E-value=1e-107, Identity=63%"; Hit description= Hypothetical protein CBG04493 [Caenorhabditis briggsae]
NGGENVSLSDSECGGGTEFNGMAGGSSDRMPNGGAKMSQSMHRLTSLSDYDKRKRKKHELLEEAMKARTPFALWNGPTVVAWLELWVGMPSWYTEACRCIXQSGSIMSALSDQEIQREIGVSNPLHRLKLRLAIQEMVALTVALTSPSSPQILRFGMAFGEMNHEWVGNEWLPSLGLGKYRTEFMECLVDARMLEHLSKRDLKMKMIDSFHRTSLHYGIVCLKKLNYDRKQLEERRNASENVNRDLMLMVWSNERVIKWLEEIGLGAFVVNAVDSGVHGALMALDGTFDVPAMAHALDGTFDVPAMAHILQIPDSDSARRTLEEEFQKLVANCRGRGEPRD

SEQ ID NO: 125659 - protein, 241 aa, Heterodera glycines
  Coding regions on vcDNA: vcDNA=SeqID_52082; Strand=+; Position=1 -549,733-908
  Homolog annotation: Hit_ID=NP_509736.1; Match level="QueryCoverage =97%, HitCoverage=56%, E-value=1e-38, Identity=35%"; Hit description =cathepsin L-like cysteine proteinase family member (45.7 kD) (XK958) [Caenorhabditis elegans] emb|CAA8907
MEPALKRTFKKGIDYPTHFDWRERGVVTPVKAQGKKGAERNWDEQLPIRKKYAPKVCAARAGHLRRWQPQNRPTQLRTGSCAVCLSRSCSTATWRTTHAKGATWTKRSGRVGQTILFGKAKKHRFIHDIGLETEDEYPYLAHRQNVCMMHEGNRNLTKIDVAVFINPDEQSMIDWLINFGPINVVGLHSMLVVGYGENIYGDKYWIVKNSWGQKWGQEHGYLNFARGVNACGIEDEPIGLM

SEQ ID NO: 125660 - protein, 59 aa, Heterodera glycines
  Coding regions on vcDNA: vcDNA=SeqID_52083; Strand=-; Position=1-177
MSPLRTYVVRPNGADPLFVPTSWNHHDSIIANLARTNNAQEAFHLALRRQFAKEHPPIT

SEQ ID NO: 125661 - protein, 86 aa, Heterodera glycines
  Coding regions on vcDNA: vcDNA=SeqID_52084; Strand=+; Position=1 -151,194-303
MDLIEPLFPILFTLEKNEFLLESKDFNYSHFFSMIEDITGRSHVKEICFYTKDGGDRKIGRSRKAMAIVLMYGLMNGKSLELFLCS

SEQ ID NO: 125662 - protein, 147 aa, Heterodera glycines
  Coding regions on vcDNA: vcDNA=SeqID_52085; Strand=-; Position=1 -3,164-604
MVHNSRRYDNCGPAIADRTIADDNCGRQLRTTIADRTIADDNCGRQLRTTIADRTIADDNCGRQLRTVLLRTTIADDNCGRQLRTVQLRTTIADDNCGRQLRTVQLRTTIADDNCGPYFCGPYFCQKINWKGGPRQYDPFRITNLKS

SEQ ID NO: 125663 - protein, 413 aa, Heterodera glycines
  Coding regions on vcDNA: vcDNA=SeqID_52086; Strand=-; Position=1 -336,395-812,1161-1200,1243-1338,1386-1516,1566-1785
  Homolog annotation: Hit_ID=NP_001004509.1; Match level="QueryCoverage= 53%, HitCoverage=15%, E-value=6e-27, Identity=33%"; Hit description =si:busm1-180o5.3 [Danio rerio] emb|CAD60788.1| novel protein similar to DNA polymerases [Danio rerio]
LHVARVQKVLPQRQGMLLRSGKTAGPMRERDAKRMEFLRGKVNRMDVYWECEIHRMLERSKEMRKAFEDYVDDGPLVIRDAFMGGRTGPLKLLRKAGPGEKISYYDFTSLYPFTTCYPIGTPKVHVLNQEAEWRSAADNPYPLALLKVWVEPPRRVDVPVLPVKVGERLCFPLCITCAKEHPTGGVDNDYHCEHSDRQRGWVSTCTSIELNEALDEGYLVTKVFRVLEYEQSDDKLFRPYIAEFMAKRSRPKKDWVDEHSCSNIVISLWTTSAARLVLLKAMQKVVRSPGSDLLYTDTDSLILVHPEERCPLKTGPHLGQFTDEYPDHDIVEFCSGGAKQYGLCLRRKGAEAGAQLEHVLKVRGLTLNYDVINNQGMRYENFKEEVVRYATSGEYEPIIITYPNFLRPNIREG

SEQ ID NO: 125664 - protein, 119 aa, Heterodera glycines
  Coding regions on vcDNA: vcDNA=SeqID_52087; Strand=-; Position=1 -60,109-407
  Homolog annotation: Hit_ID=NP_507780.1; Match level="QueryCoverage =99%, HitCoverage=8%, E-value=8e-10, Identity=37%"; Hit description =predicted CDS, DNA polymerase type B, organellar and viral family member (5T899) [Caenorhabditis elegans]
MVLVFRELFRIGFNPEMLRRGNKMYEMKVRKQKRRNPNIVFRDSFNLMPCALAALIPSYGLDVEDKPFFPHLANRPENYGREIHPTPEDYLASGMMPSKRQKFDVWYAEHRHEPFKLDE

SEQ ID NO: 125665 - protein, 174 aa, Heterodera glycines
  misc_feature (136)..(136): Xaa can be any naturally occurring amino acid
  misc_feature (163)..(163): Xaa can be any naturally occurring amino acid
  Coding regions on vcDNA: vcDNA=SeqID_52088; Strand=-; Position=1 -419,912-1022
  Homolog annotation: Hit_ID=AAG23159.1; Match level="QueryCoverage =91%, HitCoverage=69%, E-value=8e-62, Identity=71%"; Hit description =polyprotein [Heterodera glycines]
EVFEMTNSTASATIEKLRYLFTRHGIPETIVSDTGTQFSSSEFAKFVAANGITHLFSAPYNPMSNGQVERIVDTFKRAFRKLKGEGKPNKEIIDTFLITYRTTPNDSLPDLKCPAELLLGRRPRTTIDLLRPPPHXPFETFCPRFISSSFASLFLQCLLSSCXRQTHACLLIDL

SEQ ID NO: 125666 - protein, 253 aa, Heterodera glycines
  Coding regions on vcDNA: vcDNA=SeqID_52089; Strand=-; Position=1 -119,259-676,729-953
MALISPRFDALVDKHFDGKTELTLWKWILIHKGKGPKSELYIDHSVIEFLYSNKQIWDRISTNLELSKYCHQSIWDVFDHQIWPIFATNIRHFGFCGADLDKLRRRISSTILADLVQLNSIDSGYLFPDGIADDGPNATAGQALAKWLHTPTKNGQPKRLYRNGYVGPLKLEWVNNFKETFRRATTSVSYNIQLYFFMEPTSIEQFELVNEMTNEKLTLKYSEEYNDGSLYNWLLKRCPIGETETAPVKWKDR

SEQ ID NO: 125667 - protein, 24 aa, Heterodera glycines
  Coding regions on vcDNA: vcDNA=SeqID_52090; Strand=+; Position=1-72
MDDCQTSATAHVGKWDGEESGGLR

SEQ ID NO: 125668 - protein, 232 aa, Heterodera glycines
  Coding regions on vcDNA: vcDNA=SeqID_52091; Strand=+; Position=1 -99,164-373,466-616,746-983
KSMKSDRSSSQQEQMRKRMRQRKQQYNNENQIDENITPRKMGPLCSDFPSPSTAPPLKRHIVLHNCGRKVQSAGRTTRHGDGEAAGNEPSSWLNRKFYIVVNNGKPIEVYCTDLIHRVKQCPQRQRLGVEDGQRFLRVVDRWREEWNHGVQMPPSKLVAMDTSVNNRYIDEKHFHFAAKPPTLYYNLDEEDILWLKKRPTAVGADKCKGRTSSIAPRTFVDAMNCFELLTYK

SEQ ID NO: 125669 - protein, 117 aa, Heterodera glycines
  Coding regions on vcDNA: vcDNA=SeqID_52092; Strand=-; Position=1 -327,1009-1035
MQGFSDPADAEQDPAGLIPQIPHFPKNALLRTRILKNPARGSVPGLALPSTDRFSTVTVRAIVEVASMCHRRSCRYRRCFATASVSASRNIVAVVIVVLGVVIVVALPLTIFYFYYF

SEQ ID NO: 125670 - protein, 41 aa, Heterodera glycines
  Coding regions on vcDNA: vcDNA=SeqID_52093; Strand=-; Position=1-442
IFYKFLNVWIFFWLTKTSSNLALSILIQIAPNFFYSLTRPY

SEQ ID NO: 125671 - protein, 72 aa, Heterodera glycines
  Coding regions on vcDNA: vcDNA=SeqID_52094; Strand=+; Position=1 -72,269-415
MEIQNNIDVSGLVALIKFHDLNTVLLALLSVADLCSCLGILALGLMRKALYERIVETSQVPLEVKGHHYLLK

SEQ ID NO: 125672 - protein, 124 aa, Heterodera glycines
  Coding regions on vcDNA: vcDNA=SeqID_52095; Strand=+; Position=1 -171,290-493
MLLISLFSTLTVTVPNVLFLSNILFCKWMHSDLTDPSNWMITAKCAANFFVFLLFKEEFRVRIYEILGCISRDPSNERQYEVSALGIAMTSRRRKISVAVVEQQRNDQQQVTIGGTNQIHLETK

SEQ ID NO: 125673 - protein, 68 aa, Heterodera glycines
  Coding regions on vcDNA: vcDNA=SeqID_52096; Strand=-; Position=1 -100,514-620
MTTREFAKRQKFAMEENKRKIRGFGKAIDTAIFGTLIDDFCKTNKSAQDELLHRILQEIGVAAQRPFR

SEQ ID NO: 125674 - protein, 44 aa, Heterodera glycines
  Coding regions on vcDNA: vcDNA=SeqID_52097; Strand=-; Position=1-262
SVHFLWDSVVPVLRWHWFEFIPCFLDLAHQKLSNDTKFVRIWAF

SEQ ID NO: 125675 - protein, 140 aa, Heterodera glycines
  Coding regions on vcDNA: vcDNA=SeqID_52098; Strand=-; Position=1 -69,199-302,1174-1423
MSKRTVDQQRQQQNMQKKHNELEQFRSKLDQIENELMEVSDQLKDQLARNDQFRKGKGFMTTEEAAMGWHIVQGHPQYAAQLLQKQLERDAQQRQGTNGTETTAQKRKRKATEEQEKPTKLFRDLWESSKDEEETEQMNS

SEQ ID NO: 125676 - protein, 18 aa, Heterodera glycines
  Coding regions on vcDNA: vcDNA=SeqID_52099; Strand=+; Position=1-54
NSIVIDFKFFVKELLPIV

SEQ ID NO: 125677 - protein, 56 aa, Heterodera glycines
  Coding regions on vcDNA: vcDNA=SeqID_52100; Strand=+; Position=1 -55,125-240
MIIRIAAILPIIFVYGMERYPDTTNKRDNLAMKKKQQGNLSYLYSIGEDEKVLIDY

SEQ ID NO: 125678 - protein, 41 aa, Heterodera glycines
  Coding regions on vcDNA: vcDNA=SeqID_52101; Strand=+; Position=1-123
MTLKQFVPTEHRTVGVTICASPTTAVRSVRSDICCRPFMTT

SEQ ID NO: 125679 - protein, 155 aa, Heterodera glycines
  Coding regions on vcDNA: vcDNA=SeqID_52102; Strand=+; Position=1 -79,218-584,992-1013
MSSQFHHFFFITLLYLLISLLCQPYSVHAEPPLRVTDGADVPAQSPIASPPGAEDGGAQPSLSNSNNNDNDVLLEPYGPSAFPAGDQQQQQQQQPNGPKKKKQKQFPQLIGWVDRPGERIGEQCDPRMKPACTVPNSECVGGVCECLAIFKKVFS

SEQ ID NO: 125680 - protein, 28 aa, Heterodera glycines
  Coding regions on vcDNA: vcDNA=SeqID_52103; Strand=+; Position=1 -77,512-521
MGLNNKYSKWFELEVVYDCIKKHLMRLY

SEQ ID NO: 125681 - protein, 220 aa, Heterodera glycines
  misc_feature (183)..(183): Xaa can be any naturally occurring amino acid
  misc_feature (203)..(203): Xaa can be any naturally occurring amino acid
  Coding regions on vcDNA: vcDNA=SeqID_52104; Strand=+; Position=1 -167,295-396,512-633,678-739,792-886
  Homolog annotation: Hit_ID=CAE63792.1; Match level="QueryCoverage =81%, HitCoverage=25%, E-value=4e-42, Identity=50%"; Hit description =Hypothetical protein CBG08333 [Caenorhabditis briggsae]
KPFVMNANNQELLDMILLAFGMTGEMIYSVAGLLGLTGSARTEERNWEQMTLILLFKYNLMDLKVGLQSCLIYIAVILHFLISDKSIQKGKQAITFLLLANISMFLMNLLEAEKAGVSDTVVNFYGKRNWVFLVRSFSPLTIFYRFHSVFLVRSFSPLTIFYRFHSSVCLAEIWKSTYSWKEXTKPIGRLAEIWKSTYSWKEXTKPIGRKEQHIFVTVQS

SEQ ID NO: 125682 - protein, 237 aa, Heterodera glycines
  misc_feature (30)..(30): Xaa can be any naturally occurring amino acid
  Coding regions on vcDNA: vcDNA=SeqID_52105; Strand=+; Position=1 -62,489-1139
  Homolog annotation: Hit_ID=DAA04499.1; Match level="QueryCoverage =97%, HitCoverage=16%, E-value=5e-47, Identity=40%"; Hit description =TPA: pol polyprotein [Schistosoma mansoni]
CTKEVQVALHIAQAPIGFDLFVSIDKILIXILEKGTFPDSEKQNLLELLSQFKNIFAVSDSQLTQTTLEHEIETGIATPVRSKMRPVPYAYREKVAEMLKDYLERDLIRPSYSPWASPIVIVPKRDGSLRFCVDYRAVNSVTRKDSFPLPNIDNTLLLLGGKKFFTTLYFMSGYWQIRMKAESIEKTAFVTEFGLHVFVVMPFGLSNAVATFQRFMNRLFEGMISKFLFVYIDDVFN

SEQ ID NO: 125683 - protein, 125 aa, Heterodera glycines
  Coding regions on vcDNA: vcDNA=SeqID_52106; Strand=-; Position=1 -84,818-1108
MKLEGNGTRGNGKMGNCTEAEANKWEKGDTESDAAGDGSGIGPPFEDGDRPAVPSDAERAPLLSTTPTTIAYTTVPPPAKTQNVLVTQMRPKAWPPSEADGRWDGGAQLTPGPKGEKGDPGVPGT

SEQ ID NO: 125684 - protein, 37 aa, Heterodera glycines
  Coding regions on vcDNA: vcDNA=SeqID_52107; Strand=+; Position=1 -68,128-173
MEPNSHNLLAKAERLLIVIFVIRRKSYGTLKPKFEFK

SEQ ID NO: 125685 - protein, 28 aa, Heterodera glycines
  Coding regions on vcDNA: vcDNA=SeqID_52108; Strand=+; Position=1-84
MNWIKQQTIPIPGTRPGRSGYPGTKSAL

SEQ ID NO: 125686 - protein, 58 aa, Heterodera glycines
  Coding regions on vcDNA: vcDNA=SeqID_52109; Strand=+; Position=1-219
FGPRGRLGPNPKIEKCAFLKIKILKTKPEGSLATWHKLGLINIRSFFTILLIPNLIIF

SEQ ID NO: 125687 - protein, 111 aa, Heterodera glycines
  Coding regions on vcDNA: vcDNA=SeqID_52110; Strand=-; Position=1 -213,1052-1174
MLLPQLRSCQVISSISEFVYLILLIVFASQGRIDVDSAPIGCLRPFSREEFGPTAAATKWPKRGTNALRRWIANPGTRGKFGTTFVEHGIGQFFGSFNYYQILLLTMSDRP

SEQ ID NO: 125688 - protein, 53 aa, Heterodera glycines
  Coding regions on vcDNA: vcDNA=SeqID_52111; Strand=-; Position=1-161
MFRSPALFAMFLLLLIVFQLFGVEIVQGSKRSKGRARTRESEGISNRGKDRQR

SEQ ID NO: 125689 - protein, 184 aa, Heterodera glycines
  misc_feature (4)..(4): Xaa can be any naturally occurring amino acid
  Coding regions on vcDNA: vcDNA=SeqID_52112; Strand=-; Position=1 -137,1105-1213,1283-1348,1450-1553,1610-1693
  Homolog annotation: Hit_ID=NP_508168.1; Match level="QueryCoverage =95%, HitCoverage=81%, E-value=1e-31, Identity=45%"; Hit description =cysteine dioxygenase (21.9 kD) (XB482) [Caenorhabditis elegans] gb|AAB36852.2| Hypothetical protein F56F1
HIIXFPGSTKNAFIKLNIFKSKKQYKRNCFSVLIKKIKLNLFTALTPTIFSIHDHSAAQCFVKVLDGQLLETRFAWPKKEEGPMRATGTALFKTEGPMRATGTALFKTNGVSYISDKIGIHRMENPSHVDPTVTLHLYIPPYSQCYSFDQRTGRKQRTGRKQQNTVSFHSKYGRKVDYGSGNRK

SEQ ID NO: 125690 - protein, 245 aa, Heterodera glycines
  Coding regions on vcDNA: vcDNA=SeqID_52113; Strand=-; Position=1 -574,619-782
MNLLCLIFITIFFIFVIDSDKIRPNFDEIFGNGWDKKESEQTVKIEQNERNENSQSAAVDQMGEEMGNDRNDQMKNDHKKREIILKFEAIKEKLKQKGKYKRKDYGKIERKIAKLLGTNRKKIYKWKKEMNLNKKMEKSFYEDKKKEFIERFDEFKDLYAHGKQKEFVKELGISKQTFRKWKKELAPKYNKTPPKYSNEDKLMKMKQYYEIKEANPKVTDKIIAKKFGIGYATMRKWKKRMLSSI

SEQ ID NO: 125691 - protein, 92 aa, Heterodera glycines
  Coding regions on vcDNA: vcDNA=SeqID_52114; Strand=+; Position=1 -164,226-340
MNERTNETLTLDKEENDDGCIVWVLKRCQIGGTVLWEDKNLDNLNNVDFLLFEFGPLSPPKAGQMNAKSRLKMNTGPNGRKKLMKYVLGNDR

SEQ ID NO: 125692 - protein, 70 aa, Heterodera glycines
  Coding regions on vcDNA: vcDNA=SeqID_52115; Strand=-; Position=1-213
MQPTDLPACLKQPARVMVRGGIHPQIRSDENEVYHLYNSNLMKKVGYISMFYHVRIGDCVWLSIDLVLYY

SEQ ID NO: 125693 - protein, 21 aa, Heterodera glycines
  Coding regions on vcDNA: vcDNA=SeqID_52116; Strand=+; Position=1-63
MAKDLCRYSKKSLLMHPEEIE

SEQ ID NO: 125694 - protein, 129 aa, Heterodera glycines
  Coding regions on vcDNA: vcDNA=SeqID_52117; Strand=-; Position=1-390
MRFGHGTRPPPLASSAAATAETSAGPWGAADGRVQRHGLRKCSEWTARERRRTAPTDDGGAAWRRQRSPLAAAAAAEATVAAEAGKHRLDGFLGTARKNGVTVISRGKTEGDKQNCDQSEADHQACPDL

SEQ ID NO: 125695 - protein, 161 aa, Heterodera glycines
  Coding regions on vcDNA: vcDNA=SeqID_52118; Strand=-; Position=1 -19,205-671
MGQDMDGLFPYLLLALGLALLAFFIILYAILNALLQRKDAQQNGEGEEEDEEERRRKRRNRNRRRRRRERVRQKHRTARDTEEDEEWMGTEEDDEGMESEADSWDAEEPRAERRERRDQARNRAFTGLEEDEVQTGCQLMAYTNMALAPSCADVVPELRDS

SEQ ID NO: 125696 - protein, 73 aa, Heterodera glycines
  Coding regions on vcDNA: vcDNA=SeqID_52119; Strand=+; Position=1 -67,133-287
METPSRVSAALVNMCTQIAKAKENKNGDEHSELIRQWTRHLLNFLKESDLFRQALKTYDVEIALMVASIDQSC

SEQ ID NO: 125697 - protein, 82 aa, Heterodera glycines
  Coding regions on vcDNA: vcDNA=SeqID_52120; Strand=+; Position=1 -117,184-315
MFKQMNLFVLFFIFSSYSFGTVEGSAFTDFFTDLGNKAWEGLKEAGEAILDGINEATKALVIPGWECGPNDPKYLDGPSHVH

SEQ ID NO: 125698 - protein, 95 aa, Heterodera glycines
  Coding regions on vcDNA: vcDNA=SeqID_52121; Strand=+; Position=1 -67,195-415
MKITTIPVLKLNLNNQYCSDMKVKPRTFPVLKLNLNNQNYSDMKGKPKLFCNENQNYSGCYFAPQCRNILRHQNKPLIPEDCNGRFELRGWAGLS

SEQ ID NO: 125699 - protein, 122 aa, Heterodera glycines
  Coding regions on vcDNA: vcDNA=SeqID_52122; Strand=-; Position=1 -201,262-429
MYSGGGRRSSMVHKDGNNGDDFGGGRRLFMSNKGGSCGEDDARLCAIIGRSHVLGTEPNAKTAALTESNAFDIETTKTPHKFPNVQADGSGVFPADFTCRFMLDVGALAQLLVSKFLQLTFT

SEQ ID NO: 125700 - protein, 87 aa, Heterodera glycines
  Coding regions on vcDNA: vcDNA=SeqID_52123; Strand=-; Position=1 -4,388-647
MSFYIDSLKMYSGDGRRLFMANKDGNNGDDDMRLCAFVGLSHVLGAEANAKAAAVTEVSRNVTKVGTGNRGIFQGIKKTPTAIWHFY

SEQ ID NO: 125701 - protein, 265 aa, Heterodera glycines
  Coding regions on vcDNA: vcDNA=SeqID_52124; Strand=-; Position=1 -109,761-947,1247-1471,1766-1941,2082-2181
ANERSFVIVQCVENGPPGSPLTPKSSNNGHCRSGLAKGSLTNNNQRHSSLNNNKLGATVAKSPQKTARQQRKHEAEECNNINDKEGDENKTMPEGANDASAILVPITGTFGGANVGLVNDGDNVGGALPPHPSAAQLCLINNNNTTNNISEQYSNAIVNQQQHQQQTVPIRPMVGSHPFPTNPSSTMMASSSSASSTSSACFNNLFAEISTEQQQLQQQQQMPRMETNFNVTNEALKQFNGLLKDANKLSPLSYNMIVSFLNGNK

SEQ ID NO: 125702 - protein, 188 aa, Heterodera glycines
  Coding regions on vcDNA: vcDNA=SeqID_52125; Strand=+; Position=1 -331,939-1174
  Homolog annotation: Hit_ID=S70430; Match level="QueryCoverage=57%, HitCoverage=9%, E-value=8e-13, Identity=35%"; Hit description =hypothetical protein 4 - fruit fly (Drosophila melanogaster) retrotransposon mgd1
MHQDIAIWTKACVNCQLRNNPTPAYRAEMSITPANTLFAKVGLDLAGPFPLTIRGNKYLLNIVCWFTKYVISVPLPDAKARTIARAFLTNCYLKFGGCTELVTDQATSFTRPACTKPTLTEDEHQAPDRAEAEELTNMPGYYHRPQANATEQKETSEKAQSEVDDTNQETMDNNKNEETTEKSRRLRD

SEQ ID NO: 125703 - protein, 175 aa, Heterodera glycines
  Coding regions on vcDNA: vcDNA=SeqID_52126; Strand=-; Position=1 -106,564-824,1060-1192,1264-1291
  Homolog annotation: Hit_ID=NP_493415.1; Match level="QueryCoverage =77%, HitCoverage=48%, E-value=7e-19, Identity=37%"; Hit description =putative cytoplasmic protein family member of ancient origin (1O390) [Caenorhabditis elegans]
MEEMGHGKMPNAGEEDTVDEDSLGEKGEVSRDLFGGSDEPRHPRPPHIKYRVGQVVRHRIHNYRGVIIAWDEKAKAPEWWIKKVHGDVPVDEPNYTLLIDTRGKAEEYAILKLRILVPFFQKDRLIPQIAYVVERNIVLLSSGAIVHPLVKHYFESFDGTCYKSRPWHKKVYPND

SEQ ID NO: 125704 - protein, 218 aa, Heterodera glycines
  Coding regions on vcDNA: vcDNA=SeqID_52127; Strand=-; Position=1 -96,590-1150
  Homolog annotation: Hit_ID=NP_763435.1; Match level="QueryCoverage =73%, HitCoverage=25%, E-value=2e-15, Identity=27%"; Hit description =TPR repeat containing protein [Vibrio vulnificus CMCP6] gb|AAO08425.1| TPR repeat containing protein [Vib
MIDFMRHKKDSTTTPTPTTTAKMEDGGGSRGRAKAKHSTGSSGGGPSVPAPNNRKKTPNQQQQKGNNELGGEGRENGGKREEKGGEKGAAAEAEEKEKKVAVEHHQKQQQQKQEVQAVQQQQQKQEVQAVQQQQQKQEVQAVQQQQQKQILVGMEMKMDNSKNGETREEVEKEGNSIGEGGETEEKERKRKNSKQGGGERGENEAEKKREEQQQIDTF

SEQ ID NO: 125705 - protein, 93 aa, Heterodera glycines
  Coding regions on vcDNA: vcDNA=SeqID_52128; Strand=+; Position=1 -131,764-850,892-955
MKSNDQEEEEEKEEEEDDGEEAQDEAEEEEAVVVVGELITTRKRALFGRGRLHQLKAEFGAEHDDDSEKFIKMALPDYNSVLENEDTPDELFK

SEQ ID NO: 125706 - protein, 39 aa, Heterodera glycines
  Coding regions on vcDNA: vcDNA=SeqID_52129; Strand=+; Position=1 -87,691-723
MNKMIDYLKMKKANPSLSDKEIAGLLKISKGINDTVLGR

SEQ ID NO: 125707 - protein, 380 aa, Heterodera glycines
  misc_feature (2)..(2): Xaa can be any naturally occurring amino acid
  misc_feature (157)..(157): Xaa can be any naturally occurring amino acid
  Coding regions on vcDNA: vcDNA=SeqID_52130; Strand=+; Position=1 -135,190-434,577-753,801-929,973-1192,1252-1341
  Homolog annotation: Hit_ID=NP_741917.1; Match level="QueryCoverage =93%, HitCoverage=77%, E-value=4e-58, Identity=36%"; Hit description =UNCoordinated locomotion UNC-9, OPUS protein, innexin family member (45.2 kD) (unc-9) [Caenorhabditis ele
LXKVSQSLPKFKEASILGTYFLPIDESIDNSYIQRENIFVGYYQWVPIVLAAQALLFYLPSFIVPIVLAAQALLFYLPSFIWKSCNFSTGNESVANSPICPSLSVARLRQREKCAEQCGTRQKEVRQGHAKCPSGKSSQPFDGPALENATAFSLSVXYLFTKLLYVANVFLQFVILNAFLGPQYTFWGIGILSDIWNGREWSESGHFPRVTMCDFNVSGHFPRVTMCDFNVRVLGNIHRWTVQCVLMINMFNEKIFLFFWFWFIFVGLLSLLSLFYWFWFIFVGLLSLLSLFYWAFATLVPAFQKAYVCKYLRCVGIIAHFTTQALNRLFFYFLRTDGVFLLRMIQTNGGTNGGDLLVGEIVAALFSRYQTKIERHSDPT

SEQ ID NO: 125708 - protein, 43 aa, Heterodera glycines
  Coding regions on vcDNA: vcDNA=SeqID_52131; Strand=+; Position=1-203
INFLVCFNLNVYQYSTLLVWKWPKCLSRGLAVGNRPVGNWPVG

SEQ ID NO: 125709 - protein, 135 aa, Heterodera glycines
  Coding regions on vcDNA: vcDNA=SeqID_52132; Strand=-; Position=1 -34,150-523
MSAHLYPNILTVFVAVHAQQIEQQLAHALEFRAHFDATKQLKREAKYERPNGDDFSFRHAEAVSAGARDGTLWERNARADGGRAFAKHKTEDERTRVVGGNGSAAGESGQTKTPGGRTLRHARTGTRTPPAHGGL

SEQ ID NO: 125710 - protein, 328 aa, Heterodera glycines
  Coding regions on vcDNA: vcDNA=SeqID_52133; Strand=+; Position=1 -185,254-398,591-835,866-1047,1098-1199,1789-1853
  Homolog annotation: Hit_ID=NP_509807.1; Match level="QueryCoverage =93%, HitCoverage=25%, E-value=7e-89, Identity=59%"; Hit description =putative protein, with at least 2 transmembrane domains (XL442) [Caenorhabditis elegans] emb|CAA90607.1|
SAPLVAAAVTSKGGSGGFAGMSSTSMGHPRVGDIRRPSSPPVLPGLPLIEIRRPSALSQFEFGYFVNSPEIVSASRGGSGAGSTDDCAPLLLSGGSTGSRKSSDESSMCGWSSRASSRMSQRSSSGGLRLSTFSGGTSIASDNSGPFIFSFVLRKRASTIGTRIPLPKRAISRSSGDSLRVPEREVSFQLLCGIEMSPSFQLLCGIEMSPEFQCMRQLLLNLLCMYSNKDSNFVNTLRTCSDVLCQALNTPQHPTVKNWCADILNVINGQLETECADILNVINGQLETEAECKLESEERSNDEYLDVSNEAQAQCIPLVRSDRRTIKL

SEQ ID NO: 125711 - protein, 101 aa, Heterodera glycines
  Coding regions on vcDNA: vcDNA=SeqID_52134; Strand=+; Position=1 -132,403-576
  Homolog annotation: Hit_ID=CAE64682.1; Match level="QueryCoverage =97%, HitCoverage=19%, E-value=6e-21, Identity=46%"; Hit description =Hypothetical protein CBG09460 [Caenorhabditis briggsae]
MKVGEILRLATNGDNSDPATRTSNINALCVHLQKVLKFHHRLYQKHISPHSFFRLLNMKYSAYYVTVVYLFTKCLFFVNVAVQLNVLNRLVLIWPSIFIYF

SEQ ID NO: 125712 - protein, 131 aa, Heterodera glycines
  Coding regions on vcDNA: vcDNA=SeqID_52135; Strand=-; Position=1 -77,119-290,342-488
MLDEGTSYKRIRTRFKKLKSDEEISRIRHYIQKGGTKYEKFEKIEQHVLAVFAEARSRHEAIHDQDLVTIALLKAREIDFEFKASAKWVLNFKKRNRIVSRRVTKIVPATYAADEEVLNKRASECSLVNLI

SEQ ID NO: 125713 - protein, 64 aa, Heterodera glycines
  Coding regions on vcDNA: vcDNA=SeqID_52136; Strand=+; Position=1 -66,232-360
MMPLAVDAFVGGDLNVKPQLELIILVNEKDCDLDQLLWTDTRKNLDGLSATLKCCGRFRCNSAR

SEQ ID NO: 125714 - protein, 127 aa, Heterodera glycines
  Coding regions on vcDNA: vcDNA=SeqID_52137; Strand=-; Position=1-820
KILKPENWSTICNVGKDHEKKVTNEPDYSLKKDFVTLKEILLRQFDQGNSLKLERYIGVLLMEYKTQKQMVATDPCEEAKLKVIKLMKDVQKSLDKKEKDGVTKTDKGGQNELIKMEETEVENRYTQ

SEQ ID NO: 125715 - protein, 90 aa, Heterodera glycines
  Coding regions on vcDNA: vcDNA=SeqID_52138; Strand=+; Position=1 -164,1088-1196
MVATDPCEEAKLKVIKLMKDVQKSLDKKEKDGVTKTDKGGQNELIKMEETEVENRYIFHFLMHTRKLKKIFVNEDKQFYYCYIVELLGNR

SEQ ID NO: 125716 - protein, 346 aa, Heterodera glycines
  Coding regions on vcDNA: vcDNA=SeqID_52139; Strand=-; Position=1 -385,637-753,1079-1615
MAESQVYAPALLQEMNLYAENAHDDGFTAKKVEMAKEFFYQLLIETKMPDIEESIRNAFCVLYHFFECMVLEKQLIVKVMMAHCEREVNVKMAIAMQRDRMRGRTMQFVVNSLASPELLMVQRIRRTQGGRTRIWKLLYNYDQKIEQNEKEMANLWETLELSDDIIIDYEDNQQLISHYENVLLNDDRNEFIRMEGKMKAEICLFISWINGQFLLTKSFSAKVLENVQIYLPLSVKMLDSFYDRLFDHQQIEELEQDEQELVDLIMAIRSQIEQIVVGHQPMKSETELIKEWRRRNFAGVKRSKKPQQIAKAKHCAEYGAWMRQMHGQTLIKLIKTDEQFAQKLKN

SEQ ID NO: 125717 - protein, 52 aa, Heterodera glycines
  Coding regions on vcDNA: vcDNA=SeqID_52140; Strand=+; Position=1 -88,692-762
MPKTEKDDGLGRHEMCEERKAIGRVASANRFSRVTDQKRVYISLNLSSWAPN

SEQ ID NO: 125718 - protein, 253 aa, Heterodera glycines
  Coding regions on vcDNA: vcDNA=SeqID_52141; Strand=+; Position=1 -217,260-801
  Homolog annotation: Hit_ID=NP_502797.1; Match level="QueryCoverage =86%, HitCoverage=62%, E-value=3e-35, Identity=36%"; Hit description =HASI (4P602) [Caenorhabditis elegans] emb|CAB16520.1| Hypothetical protein Y57G11C.19 [Caenorhabditis ele
MDKKINKIYTDPANPGGYAGASALYAAVKKKHPKLKRTEFEDFLKRNTTYTLFKPKREKFRRLRTVPTGFMTDVQADLADFQALSRKNSGYRYLLLAVDVLSRRMFGAPVKSKRPVDMKRAFEELFEQMPRVPDTMYTDRGLEFVAKPLKEFYAEKGIQKFETSSKKKAAVAERAIRTLKTRLYKYFSANNTSVWVDVLPKFLSAINNSVSRATGLRPQRNQRHQCEGGLGRGVYGEGLAQLEQTPKIKAGET

SEQ ID NO: 125719 - protein, 139 aa, Heterodera glycines
  Coding regions on vcDNA: vcDNA=SeqID_52142; Strand=+; Position=1 -232,363-552
  Homolog annotation: Hit_ID=NP_508515.1; Match level="QueryCoverage =79%, HitCoverage=36%, E-value=8e-18, Identity=40%"; Hit description =MIP family (XD645) [Caenorhabditis elegans] pir||T16635 hypothetical protein M02F4.8 - Caenorhabditis ele
FVDEIVGTALLLFFVNALIDPRNQVPKWVHPIGFGLAIFLITSSFGMVRLTLARSFSHSSIGIFRLTECRLSDQSGTWHSYYFWIPIIAPFVGALIGTWLYQCMIGLHVPDDEAAQSVPTKTGEKSNDFEFDPLNGPSD

SEQ ID NO: 125720 - protein, 407 aa, Heterodera glycines
  Coding regions on vcDNA: vcDNA=SeqID_52143; Strand=-; Position=1-1223
  Homolog annotation: Hit_ID=NP_498959.1; Match level="QueryCoverage =94%, HitCoverage=17%, E-value=6e-46, Identity=30%"; Hit description =zn-finger, CCHC type and RNA-directed DNA polymerase  and Integrase, catalytic domain containing protein
MMPTRVFTDHRALIPMFKSKKETGNSRVDKWLMEMNAKFLLQVEYHPGKKNVIADVLSRSQALKCPEAPKESDKIVAFQIRQNEDGQKQHGIENHREWATKTRESELGFLYEFLTEKTLPIEPKDRQKLMSILNNFTVLDDLLYKCEKDGKSRLFVPSVYREKLINERHSGICSGHMSGKKIFLQLAEKYFWPNMYSDCVRAALRCRICAHTRNPRSNEPPMKIVATSEPFELVCLDILSIGPAHSSCKYILVAVDHFSKYLVATPIPNKNADTIAREFVKNFVLIFGTPKKIHSDRGKEFVNETLNEITKILQMEKTLTSGYDPQANGVTERVNQTILGMLKRSTASNWEWDDRLPFVVFSYNTTPSETTNISPYHLLFGKPANFPSNISLPVNPLYTIDVNGYIQ

SEQ ID NO: 125721 - protein, 200 aa, Heterodera glycines
  Coding regions on vcDNA: vcDNA=SeqID_52144; Strand=-; Position=1 -21,204-359,555-805,959-1092,2111-2148
  Homolog annotation: Hit_ID=NP_500405.1; Match level="QueryCoverage =91%, HitCoverage=18%, E-value=9e-27, Identity=35%"; Hit description =helicase, C-terminal and Helicase-associated region (4E499) [Caenorhabditis elegans]
PLSSSVSHLEFSLGTGGKGMERELASHRLDDNVATELKLVLAAGLYPQFGVVDPTNNFREGHDQFAHTPSKPFGGLHPNSALGQRPEVLRSDDLDSEGHSAQHQLIYFGLLLETTKPYLCNSCRIPASFLLVIARNVRPFSRWSVLCCDGFVEFHFVKARHCDDSLAFACRVRSLFLQSLEHKLRSDVFGTGRPKLKRCV

SEQ ID NO: 125722 - protein, 205 aa, Heterodera glycines
  Coding regions on vcDNA: vcDNA=SeqID_52145; Strand=-; Position=1 -232,587-781,833-1020
MTHVFFDPESVDWSSFFTSQHGRGQKQYFVGSKYQRGFGLLGNVARFLTHIARNIASSAGQEGLAAGQRVLSDIAQGHNQFCDLNKTFLYLSTSIERKDKSNWIPITTDSEADQHVGVIQNFGHSFVKTLKVSISGVESYDSEDVKKGLCEASCYYVDDVDQNDYTNSGFKNRASRFADGAKCETMMKLNFDLARQPNLLLNNSD

SEQ ID NO: 125723 - protein, 268 aa, Heterodera glycines
  Coding regions on vcDNA: vcDNA=SeqID_52146; Strand=-; Position=1-809
  Homolog annotation: Hit_ID=NP_502797.1; Match level="QueryCoverage =97%, HitCoverage=72%, E-value=2e-47, Identity=40%"; Hit description =HASI (4P602) [Caenorhabditis elegans] emb|CAB16520.1| Hypothetical protein Y57G11C.19 [Caenorhabditis ele
KQRTYTIHKPIRKKFPRLKTVPSGFHTDWQCDLCIFDQLKKHNDGYKYLLVCIDVLSRMIFSAPAKSKKSEDMIEAFDRVFEKSKIIPMKIYSDSGLEFQAGKMKKYFEEKFIIKNVMYSPDLHAGVVERANRTIKERLYRYFTKMDTLRWVDVIDKIIININNSVNRTLGAKPVSVTFENARPLWEKLYKAKEFKISKKNKFKIGDIVRITKEKGKFAKGYLPNFTEELFKIVIVNPTTPDSYRIEDLEGNLIKGIFYNQELVKTDG

SEQ ID NO: 125724 - protein, 38 aa, Heterodera glycines
  Coding regions on vcDNA: vcDNA=SeqID_52147; Strand=+; Position=1 -91,279-304
MGVRSCRFNVPTIETLGYKNYAYVPIMGAPADGSIRFL

SEQ ID NO: 125725 - protein, 252 aa, Heterodera glycines
  Coding regions on vcDNA: vcDNA=SeqID_52148; Strand=-; Position=1 -304,588-796,3695-3937
MTHVFFDPESVDWSSFITPQHGRGQKQYFVGSKYQRGFGFLGNVARFLTPIARNIASSAGHEGLAAGQRVLSDIAHGRDLRDAVREHSRQGLTNLTDKLQQYNQFCDLNKTFLYLSTSIERKDKSNWIPITTDSEADQHVGVIQNFGHSFVKTLKVSISGVESYDSGIYYADGDHLNKLRYHTSPTLLTDLDQLNSIDSGYLFPDENAPNSTAGQALAKWLRTPTKNGQPKELRCSHFAFMKINNWFHNHKQ

SEQ ID NO: 125726 - protein, 113 aa, Heterodera glycines; identical to SEQ ID NO: 124938
  Coding regions on vcDNA: vcDNA=SeqID_52149; Strand=+; Position=1 -359,468-640
  Homolog annotation: Hit_ID=S52407; Match level="QueryCoverage=82%, HitCoverage=39%, E-value=8e-11, Identity=35%"; Hit description=TATA box-binding protein - Entamoeba histolytica

SEQ ID NO: 125727 - protein, 1330 aa, Heterodera glycines
  Coding regions on vcDNA: vcDNA=SeqID_52150; Strand=-; Position=1-3991
  Homolog annotation: Hit_ID=NP_507780.1; Match level="QueryCoverage =76%, HitCoverage=62%, E-value=1e-82, Identity=26%"; Hit description =predicted CDS, DNA polymerase type B, organellar and viral family member (5T899) [Caenorhabditis elegans]
MSNRSNNEPSPPKRRRMPNILKSGSNNNNNNNNGKRRNFRHYVRALNTDVAFNKKFRLMNAKSTFMIQTLPSNPESLLRVIFGHCIQSSLDEAQRRGIEPSRLGATITSQLLDPDIWIPIRQITPNTVDTILNRFLDVAQSKSREGSLWGAPFSVIVTTLDTVNLPQRDTITGRGSEHRTLKGAHHIIKEKNLLRIRNNNNSYCLFYALEISRIYHCMVMPKQTFSNYINKMHSQQQQDAERLMLDAGIPLNQERYDAEVWVPRVVDHWNAVYPELKFKVFIFGTTGQYRPKYKYGPEEFLTPISLYYNNDHFDGIRCGVGTAIFGRDYYCFACELPFKNADTHKSSCILNCKECGRIGAGRPCRDDGFKCECVGCDKTFMNVDCYHHHLSSNFCHKSHKCKKCGVIWNVRNNKGKGRAGHVCDERFCRTCGAFHNRERGCFIRQLKPRRPKTYRLVVYDCETTQNCHVIGAPEAQQRRVHIVNFVSAFVTCTKCIQIGAWRNSLLNVVPSCEICGPYRTLTFSHRPFTGTEVDFQHVCDDPMSAFTDWLLLGSHNNRNNNTINNNNESNSKIKPHIKYPINVFAHFGGRFDNVILFRQFFNRGLCPKMIRRGNKLYEMKVLRAKDNPEIKVRDSWNLMPVPLGALPGAFGLRVQDKEFFPHLANVEDNYDRVLPSLPPREQYLYGGMIPERQRRFDEWYAAHQHEPFNLCEQLASYCVNDSRILIEALVAFRTEFLMVTNPDEQHRLTEDEGEVEEEEEEDAGGIELGDDGNGGIDITWDALTIASASMKHFRLNHLRSDQLAIVPESGYDTANNQSLLALKFMEWYAEENGLQIQTAHSSGGEHRIGRYTVDGYIHETDSVIEVNGCCWHAHDHQRHRFKADTVMPSGKTAARIREDDARRMAFIRSQIRGTVSIFWECDIEERLRREPDMRQAFSSYRNSGPINLRDCYHGGRVGPQRLHYQVPEGWRMRYFDVRSLYPYTNAITEYPTGHPRCVDIMEGANRAVDWRHPEQIPVRGILKVFVVPPRQVDVPVLPVKFDQRLLFPLCGTCARLHPEGGVSASYRCTHSDEQRGWVSTVTSIELAEALRNGYRCTAYYRSIEWTQEQWSERVFRGYVAEFMTMKTHASGFPEEVGNGEEEREKFITECEERFGMVIDPARMQHNKAKRTIAKLCNNSLWGRFSLRNGLSKTVVTDSPSELRAYLDNPQLEVSSVDPLNEQCVLITYTAKKEWTDEHDCSNIVLSLWTTSAARLHLLKLMQRVVRAENTELIYTDTDSVCFAHREEDGCPLDIGPHLGDLSDEWPDNELLEFVSGGCKQYALRMRHRQT

SEQ ID NO: 125728 - protein, 172 aa, Heterodera glycines
  Coding regions on vcDNA: vcDNA=SeqID_52151; Strand=+; Position=1 -49,326-444,817-1029,1320-1454
  Homolog annotation: Hit_ID=CAE58554.1; Match level="QueryCoverage =46%, HitCoverage=37%, E-value=5e-18, Identity=51%"; Hit description =Hypothetical protein CBG01713 [Caenorhabditis briggsae]
MPDPVQNGMANRQQQYKSKPIRSARGGLASVQQSFDKSASPNGRQQTGPLGAIQLAPHKQRRLPPVPSAAPQQQAVIVPQQQQHNNNNSNIMHIIIHEYSSADCVLRPGDRVVVVDNGDPDWKHGFKFNDCLEHLLTFPSSCVAAYHMEEQPMKLLQSCNLVEQKIRLYRDQ

SEQ ID NO: 125729 - protein, 561 aa, Heterodera glycines
  Coding regions on vcDNA: vcDNA=SeqID_52152; Strand=-; Position=1 -475,786-1996
  Homolog annotation: Hit_ID=NP_502799.1; Match level="QueryCoverage =84%, HitCoverage=73%, E-value=3e-17, Identity=19%"; Hit description =putative nuclear protein, with 2 coiled coil-4 domains (4P607) [Caenorhabditis elegans] emb|CAB16521.1| H
MADDSNNNYFFVVLPSNVTDYVDNTTSKYRVHLPKPVQFRGSWVCGLYSIQYPHSWASTIGTVEDQWIDIHYIDGRLLRLHLPKSSQQNTEGLQRHLNGTLTTALSRKSTEDGQTPSIKRSKRSVDQGKQQSREETEKESKTGTMEINDEGERVPQDNQITPPSNPSAQRQQQHDEPRAQALTRGEQLGQRLRKTENEVQSQQKSPVNESLEAQTQFSDAKDQSKTHADVLKDRLSTIHGDVSIQAPLQKSSSNDGQTSIEPTIRPKEQSDREPQSARTHGEQLRSRVEVVQDERMQNERQLHEAKTHGDLLREELKKIRQEGEKREQELSVTKTKGDTLRAQIEKIREESGQKDKQLKVEKTHGDALAKLLEESRKKMEETEKRLTEARTHGKVLTDRIKEIQNERTALSAPADVHFNYRTDIDRFHLMISDPEIDYLSMSSQIAYVLGFPNKERVVQGETAKYGVDLRGGFTSFAVYATGLTRSVILGNSLSSLLRIVSTEGEYGQVVERIYDNPMFIPVHPREINELQVELRMMNGQLVQFDYGTVLVTLVFKKVINF

SEQ ID NO: 125730 - protein, 955 aa, Heterodera glycines
  Coding regions on vcDNA: vcDNA=SeqID_52153; Strand=-; Position=1-2865
  Homolog annotation: Hit_ID=NP_500013.1; Match level="QueryCoverage =29%, HitCoverage=20%, E-value=4e-16, Identity=23%"; Hit description =predicted CDS, polyprotein family member (4B673) [Caenorhabditis elegans] gb|AAC02594.1| Hypothetical pro
MSGEGSDFNPAFFTVEENAQYQTILERLRSFEAAVCSQFRKLESSLNGSERATKDQLSRLESSLQNLDENEEMDEFETKEKIFKLEEKLEETHNKFEVLKANVSENLKECFEKIDTQVKESKCLVDLINEKIESVEKEMKFSIDVVETRVEFLELEKMGDSSLDEYWQDNGHHDLQKQFAQGNNSSENGEKRDADNGRESHEIGNDENKDENNEGQEKEKTLMGETEDLEVMMADPFLMNVIPPGVYDGNPSSSFSRWSERFMDLLSLYPQLTEEQKLSRLRISLSGQARGEMEGMSPAPTTLQDAFNFLKNKFENENTKSIARQTLSICKQAPGEKVYEFANRLSEALRTAMAGENEGTIKKRLLEEFMERLTPDLQFEVKAGRPSNYSNAYEMAQHFELLLASRKQSQVSVAELSSRVEALTIQTQRNIGKRADERRVCYYCNRPGHIVRDCRVRKEGRQSGNRQSYYRGDRAAEGTWRRDYRNEPSESNRWGRQNHRDENWERPNWRNDRSPERPNWRYGRSPERPNWRYDRSPTPDQRKPWTGRNYQRKPHRSPSSDGDESNRSHSPGKRVHFKRGKVAAVRVASPLFLAIIAFLALFGSNGASEVKAKPMICLPDAPTSIWSLPVDPICPNWVPTQVPVPFALNIYRPNTVQYKTEATACSCILTRISRRRGFFGGTYEEISAFHSVVPTAICRKMAVDKDSPAGELYVNDETLMATNNSLEIGWGKWPSNLFWRTEEIDNYYVYKTIVFTRHGMEGLNTPIGECSNCFYKSGECQCVKISLIWTPDKTQLCSFVWLSKWSGEYASLIWTTESGDFALSFENTSSHSQPGCYAESGQLIVSDQAFAVPVSDFQEMVEKAKGSGTRKTRETTEIGPVYSSQLAAQLTALSTKMAITTQRLFTETIRKICTSMQIMADQALTLSIANPSLLARFFLGNPFLSARLITEKLME

SEQ ID NO: 125731 - protein, 187 aa, Heterodera glycines
  Coding regions on vcDNA: vcDNA=SeqID_52154; Strand=-; Position=1 -119,278-710,895-906
MALLSDRFDVLVDAHFDRKSELTIWRSVVIRKDKGPKAKLYIDHSVIKFLRSNKPIWDRNGTKLKVFVYAFDTDVQPIWDVFIREIWPIFATNIRHLGFDDGDHLDNLRRRTSPTILTDLDQLNSIDSGALFSDGIADDGPNATAGQALVKWLHTPTKNGQPKRLHRNNLLGPLNLEWVNNFKELIF

SEQ ID NO: 125732 - protein, 80 aa, Heterodera glycines
  Coding regions on vcDNA: vcDNA=SeqID_52155; Strand=-; Position=1-442
TDARLANMCLRLFIISRVILRSSSSLFLCWFLNLRLFSIRVASSDLPVIWMLLDVVLGKISTQQQLDHLIAGPVLQLQGI

SEQ ID NO: 125733 - protein, 559 aa, Heterodera glycines
  Coding regions on vcDNA: vcDNA=SeqID_52156; Strand=-; Position=1 -1487,1518-1681
  Homolog annotation: Hit_ID=XP_318550.1; Match level="QueryCoverage =98%, HitCoverage=56%, E-value=1e-130, Identity=44%"; Hit description= ENSANGP00000020240 [Anopheles gambiae]
EKEWDWNENCQKAFKIEKNFGIDLLLTIVVAADASDYGIGAVISHKFADGSIKAIAHASKSLSPAEKNYSQIEKEALALIFAVKKFHKMIYGRHFTLQTDHKPLLSIFGSKKGVKQCSANRLLRWSLILLAYDFSIEYVRTNDFGNADALSRLIAKGIECEEEKVIAALDVESDLTSIFNLNLEKLPIKFADLATASKIDGSIQKAIKFIRSNWPNNDLLKQESETVQLFSRRKDELSILKDCLMYGDRIVIPKFCQKKIMEQLHKGHPGIKRMKQLSGQYVYWPKLDAEIEEVQNCQPCQAAAKAPVKTDLHSWPKAEHPWQRIHVDYAGPFYGKEFLIVVDAFSKYPEVFEMPTKSTAATVDKLRYLFTRHGIPEILVSDNGTQFASNDFAKFTAANGISHLFSAPYNPMSNGQVERFVDTFKRAFRKLKGEGVPGKDVIETFLVTYRTTPTPDKSPAEMLLGRKPRTTLDLLKPPLSQPSERDAEMGQRIFQMKDTVYARHRQRIFQMKDTVYARHRLSQNWRAGIICDCKGVIYTVKFSDGSINRYHANQLRERR

SEQ ID NO: 125734 - protein, 259 aa, Heterodera glycines
  Coding regions on vcDNA: vcDNA=SeqID_52157; Strand=+; Position=1 -191,239-317,365-472,521-663,1576-1681
  Homolog annotation: Hit_ID=XP_319106.1; Match level="QueryCoverage =91%, HitCoverage=14%, E-value=2e-41, Identity=42%"; Hit description =ENSANGP00000022340 [Anopheles gambiae]
EKPGFPVTIDRLIFLIKECLPNLLPALYEETKVKQELVREVEMGPFKHIVDDGLDLRKAAFECMYTLADQSLDRVNINMYTLADQSLDRVNINEYLTYVENGLKDQHDIKLLTYLMLDQHDIKLLTYLMLVRLVHKCPIQMAQRLDAFCEHIKPQLLLRPKQNAVKQENDKQDEHIKPQLLLRPKQNAVKQENDKQDELKRSAVRSVIALRKVPNSDRSQKMTDIRILFRQSNNNNITLATVQKVSHSSTHHTSLPLSP

SEQ ID NO: 125735 - protein, 201 aa, Heterodera glycines
  Coding regions on vcDNA: vcDNA=SeqID_52158; Strand=+; Position=1-606
MDDRQRNRRRAFAHLDEWLRLDQWKSKEKEHKTARALTLGALPNGVIGLTEEWFMDKLRLLVSYWTTACCIYVTFIFGRDVLIPLVWVYLMGPVIVTIRNLVTGNQWTQRNRATRGTRRAPAISRIEAIELVSPPMPQEMRANETASSQQEDPEPSPLVMELKRQMVAFRSKRRFQSRGNVATERQPRMSVERTNEENGEE

SEQ ID NO: 125736 - protein, 57 aa, Heterodera glycines
  Coding regions on vcDNA: vcDNA=SeqID_52159; Strand=-; Position=1 -18,466-621
  Homolog annotation: Hit_ID=NP_982285.1; Match level="QueryCoverage =70%, HitCoverage=10%, E-value=2e-12, Identity=85%"; Hit description =alcohol dehydrogenase 8b [Danio rerio] gb|AAP74382.1| mixed alcohol dehydrogenase Adh8b [Danio rerio] gb|
MDTAGKTIKCRAAVAWEPKKPLVIEQIEVAPPKEGEVRIKASEEAIELDWIIRKMLR

SEQ ID NO: 125737 - protein, 134 aa, Heterodera glycines
  Coding regions on vcDNA: vcDNA=SeqID_52160; Strand=+; Position=1 -119,273-372,433-506,786-897
MLDKLAIVRAGTGGMEMLAHTEMPVNKPRHKMGRTLYEAWKLFGDPNAVLLFVNQPDLFPFCHFEQLQFTTFEVEKLAKRDGNVVQVIRMTFKECAERCHLDESDFSLYVDGKRVALVHMAYGYIGEHYPTEVN

SEQ ID NO: 125738 - protein, 54 aa, Heterodera glycines
  Coding regions on vcDNA: vcDNA=SeqID_52161; Strand=+; Position=1 -23,54-195
MAVLIKKMDKIFVLEAIRPSENHGPGPLDAKLMILYSLNDLSNNKLKMLIPWLL

SEQ ID NO: 125739 - protein, 269 aa, Heterodera glycines
  Coding regions on vcDNA: vcDNA=SeqID_52162; Strand=-; Position=1 -157,209-241,311-442,488-975
MIIDPPNGNSSSPLWSSSTNETNEHSFQNDFEKHSESQENDQIEKNNNGIFGSEKIRKNGKKKETIRWVVHLTKNWLDSKNSLKKVQNLLAIIFVCIELTVSPIPIIGRAIGEQKTLPNCLMSPTVMAHFALSLLTIPPFYTKFGPVLKAQKKPGKYLTAVKFVEEIFKIILKNEGEIGEMDEKMRNLQFYSLFYEFLCAFFKGNKKTIADFPSEKHMKSWERAKQFVQIYEQMFKHQLEKIETIGLGGTMAELGKIKRGDKVIEEGPK

SEQ ID NO: 125740 - protein, 236 aa, Heterodera glycines
  Coding regions on vcDNA: vcDNA=SeqID_52163; Strand=+; Position=1 -72,122-343,390-806
  Homolog annotation: Hit_ID=XP_422434.1; Match level="QueryCoverage =64%, HitCoverage=24%, E-value=2e-14, Identity=25%"; Hit description =PREDICTED: similar to TOE1 homolog [Gallus gallus]
MIIIPSIVPLGDSKYMAEHQQTKNFSCSYLDYVFRKAQRENQRLFQNNKPHLVIKFSKLRSKARKATKFSHLKCGLKESFVNGKLADIRQEMLCQSYTRFGHCRNRTDCVKEHDVDLLLDLEDKRAQLKREKERKRRSKKETEKQKEESDGEENQREREEHENERGKEGGTKRKWEVSKVKGNKWKFHNIISSLPSPRRKVSRFLPYRTTALEKRRRNQKKITKMEKELGTLSWIH

SEQ ID NO: 125741 - protein, 167 aa, Heterodera glycines
  misc_feature (30)..(30): Xaa can be any naturally occurring amino acid
  Coding regions on vcDNA: vcDNA=SeqID_52164; Strand=-; Position=1 -336,387-499
  Homolog annotation: Hit_ID=NP_493334.1; Match level="QueryCoverage =90%, HitCoverage=38%, E-value=1e-23, Identity=40%"; Hit description =GTP-binding protein like (39.4 kD) (1N870) [Caenorhabditis elegans] emb|CAB07637.1| Hypothetical protein
VQYGDFFQLAGVVTLAWHSASVLLTSLTKXSVADIPGLVQGAHRNEGLGFSFLRHIVRCECVLFVLDFTQGNLREQYELLQHEMTLYDDELSKKEAAIVINKTDLLDGEMASIVSMFPEQSVFFVSGRHRIVSMFPEQSVFFVSGRHRLGIEPLLMFLREKHERFLK

SEQ ID NO: 125742 - protein, 60 aa, Heterodera glycines
  Coding regions on vcDNA: vcDNA=SeqID_52165; Strand=+; Position=1-181
QPFSPKFSHFFTSLIYSKIVGPKTTGQQQKTAFPFINNSDLDKNLCPSNKRRATGDVYPL

SEQ ID NO: 125743 - protein, 146 aa, Heterodera glycines
  Coding regions on vcDNA: vcDNA=SeqID_52166; Strand=-; Position=1 -205,726-850,893-1089
  Homolog annotation: Hit_ID=XP_419642.1; Match level="QueryCoverage =89%, HitCoverage=38%, E-value=1e-14, Identity=35%"; Hit description =PREDICTED: similar to hypothetical protein FLJ38968 [Gallus gallus]
GTSAALHRELRNLSFRNPGYRCTLPEPSRAKRTVVISAQQPKTSAEPSADRRSMRKRTAKKDGSNSDVQTRSAKSKLRYNNKGRLVLPSRTEVDLCDCLDQKCNGCQYQCKKCGGNKCSYACRVNRTTFIEHIDTLGGGRTNNPFL

SEQ ID NO: 125744 - protein, 293 aa, Heterodera glycines
  misc_feature (267)..(267): Xaa can be any naturally occurring amino acid
  Coding regions on vcDNA: vcDNA=SeqID_52167; Strand=-; Position=1 -109,167-263,306-411,457-489,533-816,937-983
  Homolog annotation: Hit_ID=CAE56617.1; Match level="QueryCoverage =96%, HitCoverage=54%, E-value=4e-27, Identity=33%"; Hit description =Hypothetical protein CBG24373 [Caenorhabditis briggsae]
RESIRPILLKYVSLLVLVLQNACHVLVTRYAMTRVGPEILFQVEILFQVAILFNELVKLCVSLILFFISTNDLCKFFKILYHHFGPNCLDTLKVGTNDLCKFFKILYHHFGPNCLDTLKVGVPAVIYLVQNLLIFLAIENLETGTYAIENLETGTYMVTYQLKILTTAFFAVLILKRKLSIIMVTYQLKILTTAFFAVLILKRKLSIIQWGALLILVAGVALVQYVSWHRLEGGGGESTRNGSVKNSLCSGLLFSAPGRMLVSSVFXRQTIRLQQRRQQNPVLGLVYVLIACS

SEQ ID NO: 125745 - protein, 165 aa, Heterodera glycines
  Coding regions on vcDNA: vcDNA=SeqID_52168; Strand=+; Position=1 -182,765-913,1298-1461
MTIKIGSEIIQKDNNGQKAAKKGKNKKKKKAKNEGPLQSAEICPPTNMATKPEPIPDDKSGRAKMAVNCAPIRSDKIPPTNKSKSAKCANNVSRSKAKSGRKWTKAVASNANESGTELGELVEKVNKNAIKFRRVVARTVQNPHVLHLLYALEKRQSSMEKLTKE

SEQ ID NO: 125746 - protein, 156 aa, Heterodera glycines
  Coding regions on vcDNA: vcDNA=SeqID_52169; Strand=-; Position=1 -76,160-331,575-730,773-837
PSPTNHLVALVTPTTSGFRQILQTKSIEFTLPFKTTEFVELGREDCPKDFLTNIGDESIGMDHDEWLRDLGISPRSKFKLKQSPSELDVSSASLLSNESKNDSSGLTNCKSSEDNSRGLSAVSSVESSKSAVLICGAKNVEAFCRLLIGQPTLCST

SEQ ID NO: 125747 - protein, 451 aa, Heterodera glycines
  misc_feature (403)..(403): Xaa can be any naturally occurring amino acid
  Coding regions on vcDNA: vcDNA=SeqID_52170; Strand=+; Position=1-1383
  Homolog annotation: Hit_ID=NP_506644.1; Match level="QueryCoverage =92%, HitCoverage=50%, E-value=6e-58, Identity=34%"; Hit description =predicted CDS, RNA-directed DNA polymerase family member (5P241) [Caenorhabditis elegans] emb|CAB60585.1|
VWRRRNGNHPIDSKSFINLSVNSPAQHDRSEVKDFWALESIGITDCPEMNDDEKAVQKFDQSIKTDQEGRYEVSLPWKTEGERPPENFKFAFSRLAALVRKLKDAPQLFKGCDDIIQDYVAKGIKKWTRTTEQQYFLPHHTVMGKKLRIVFDASSEKGARSLNDTLFSGPNLYPDLAGKLIQFRATKFPIWADIEKAFLMISLRESDREFSKFLWVKDIKAPLSGNIIVFRFKRITFGIVSCPFLLAATLKYHLDTHPSSLAREIVEKSLLYVDNLLKPRLRMLGMKWVINEDNLSLSFPPVPGPEGLTRRVVLKTIASFFDPLGLCSPCLVGPKMFFQKLWNESQGCDDLIPISECTELMKIQKHWDSEILSIPRHRRVGSNSLQLHAFSDASPEAFACAVXIRAEMQNKNVVSMVYSRSRIRPKKNGLTIPRLELLGILIGTRAIKFVN

SEQ ID NO: 125748 - protein, 41 aa, Heterodera glycines
  Coding regions on vcDNA: vcDNA=SeqID_52171; Strand=+; Position=1 -72,566-619
MSGSHLFLLIWINYWFFFGSRPLKSRVTGIFSLEHIYIDIF

SEQ ID NO: 125749 - protein, 71 aa, Heterodera glycines
  Coding regions on vcDNA: vcDNA=SeqID_52172; Strand=+; Position=1-216
MSKFKQFTFTALTFHLFFHSFPWAALPLSYRGTSALSFMDLINPRFPRFNRPASFFLTAPSSSGPVPRSIS

SEQ ID NO: 125750 - protein, 50 aa, Heterodera glycines
  Coding regions on vcDNA: vcDNA=SeqID_52173; Strand=-; Position=1 -38,79-193
MTEIKFFSQSSAGKNVKYLGIFSTAGLIVTDLRKRLLPENVDKLIFASQS

SEQ ID NO: 125751 - protein, 29 aa, Heterodera glycines
  Coding regions on vcDNA: vcDNA=SeqID_52174; Strand=-; Position=1 -10,155-234
MPRKMIKYYETKISIDSMIIVVESLSSRP

SEQ ID NO: 125752 - protein, 222 aa, Heterodera glycines
  Coding regions on vcDNA: vcDNA=SeqID_52175; Strand=+; Position=1 -102,160-249,308-388,445-525,580-660,717-950
  Homolog annotation: Hit_ID=AAG15241.1; Match level="QueryCoverage =67%, HitCoverage=61%, E-value=2e-12, Identity=31%"; Hit description =ENOD2 [Cladrastis kentukea]
MFPNDDGYESEDDEILLPPPPIPPQLGHPPPNVPAVRVQPIHVGQQQLPLRDLPQFEDHPQNVPAVRVQPIQQPLPLRDLPQIFHPPPNVPAIRVQPMQQPVPMRAVPQFPQPPPNVSAVRVQPVQQPIPLRDVPLFVNPPPNVPVIRVQPMPQPLPLRDMPQIHHPPRNGLQFGSNCGCFFSVSGCFFREFMFDKFNGNTPYRNMPIRRQTCRIINQKTFR

SEQ ID NO: 125753 - protein, 19 aa, Heterodera glycines
  Coding regions on vcDNA: vcDNA=SeqID_52176; Strand=-; Position=1-60
EPVNSCIGCKCRRCCTPNS

SEQ ID NO: 125754 - protein, 25 aa, Heterodera glycines
  Coding regions on vcDNA: vcDNA=SeqID_52177; Strand=+; Position=1 -19,187-245
MGGGREAHFFFAPYPSFYMKADPTF

SEQ ID NO: 125755 - protein, 298 aa, Heterodera glycines
  Coding regions on vcDNA: vcDNA=SeqID_52178; Strand=+; Position=1 -342,397-537,626-716,1221-1375,1462-1629
MKTGMFKVPSAAVVVISDFSDIAESVQSNIAALLAAESAQSTEASHSSVADASQPPTIADEQVTVVRQFQLDQHQNSAIDENGVSPMDVTQCLAASLSTLPPAFDMEQQKLQTEEVCANMPNRTDPALLAKQDEHFLRVNGFHPIGILCERIDLVWQRDKKAVEREKLRRERERRAEAAEQRRKERRDGSEDKVRSEAVAPQKRNFNRIVQCSYCELIVRHDRFGGRESAYCSAECISRRVDMCVKESERILMIDLKGNIYNASVNPTIETLEAFLNQNPSYNPIIDDARLGQSYFQD

SEQ ID NO: 125756 - protein, 62 aa, Heterodera glycines
  Coding regions on vcDNA: vcDNA=SeqID_52179; Strand=+; Position=1 -127,523-689
QGWAEVSLFAFRLSHYSHFLAFRISLFAFRFLARNATFTPLRIGLNSHKIFQNFTYKLANFQ

SEQ ID NO: 125757 - protein, 293 aa, Heterodera glycines
  Coding regions on vcDNA: vcDNA=SeqID_52180; Strand=+; Position=1 -79,790-1037,1117-1671
  Homolog annotation: Hit_ID=EAL22360.1; Match level="QueryCoverage =49%, HitCoverage=11%, E-value=5e-10, Identity=32%"; Hit description =hypothetical protein CNBB5330 [Cryptococcus neoformans var. neoformans B-3501A]
MDRRGETDSRRTAAKHATVPNGKCKKAQQQRQQQHQLEYEQQRLVEQQQQLQTLLQQLATVQRQRQLQQQQMLMNSQRQSGQAVQGRNERLASRASSSSSSSSRAANIEKFPPPFASPSFFGPANNPFQPPPPISPPSSSSALFPGKFLPSSASAFRLPGGLPSPTAPIFGGVQPSDSKFAVQPSPISAPFRPISSSVDSAADLSALLQKLSWNNPTNQNSGNSATVVVPIPTVLSNAANRGGAAQFVVPKPQQERPLVVKLVAAGKSEQQSQQQNPNNNNNNGNDNSWDYYI

SEQ ID NO: 125758 - protein, 15 aa, Heterodera glycines
  Coding regions on vcDNA: vcDNA=SeqID_52181; Strand=-; Position=1 -27,183-203
MGLPNETFRGWGIEL

SEQ ID NO: 125759 - protein, 50 aa, Heterodera glycines
  Coding regions on vcDNA: vcDNA=SeqID_52182; Strand=-; Position=1-449
FIVLSVLITYASSFFHKFFLSLSTNFRPFSFHMAKQKLKRKAKQCNIKKI

SEQ ID NO: 125760 - protein, 294 aa, Heterodera glycines
  Coding regions on vcDNA: vcDNA=SeqID_52183; Strand=+; Position=1 -25,194-607,657-1102
MVTWVPLLSPTQQQSLADSNLLRGLLQAFSNLLTPQATASGGVSPSSSAFVPPTVGQQQQQVPNIGGTNNFGKSQFVGVPQPQQQQVQAVQQQSQPQQIGQPNSAVQFVAVYEPWRMAQQQQQINGANFITAATSGDGAVPAQSAAVLPQEVGAVGQLQQQFIGSSQPVLPQLPQQQQQQVGAVSVLGWLPTRAGETNAFSADGLFWPQQQQQLQQNNFGSNNDNGNDILVQRRTAQRRREDGQQTNGEEAAEEEAEDGGGAAERGEAEEEEGEERRREGDEGLEDTGKWGNDV

SEQ ID NO: 125761 - protein, 224 aa, Heterodera glycines
  Coding regions on vcDNA: vcDNA=SeqID_52184; Strand=+; Position=1 -87,129-322,378-582,668-780
  Homolog annotation: Hit_ID=A59287; Match level="QueryCoverage=91%, HitCoverage=8%, E-value=2e-36, Identity=42%"; Hit description=myosin heavy chain - fluke (Schistosoma mansoni) (strain Brazilian LE) gb|AAA29905.1| myosin heavy chain
CHDLCQLSELNDASVLAALRQRYSLRLVHTYSALFCVVVNPWSLATYSALFCVVVNPWSLAPLYSAQMRSLYANANGATLPPHIFAIAQSAFEGLSDGTSRLNQSILITGESGAGKTENTKRGESGAGKTENTKRIIEYLMDIAERNAKVSDDQQKAATVEKALISAGTALEAFANAQTVHNNNSSRMGKFVRIDFDREGKLQSAQIVVSLFFIFNSITLFPFF

SEQ ID NO: 125762 - protein, 135 aa, Heterodera glycines
  Coding regions on vcDNA: vcDNA=SeqID_52185; Strand=-; Position=1 -141,587-853
MLREGMSNVLLHAFMKMCHHLVTTMSWAAALNWRHAKFFTRKTDGDWSLPFCLSPLCPSICSHVFRCVAQKWKRILALMISFTKIQMSFRKGRVMNENGGRTTKMNDLYRILYICRLSKLNSPINQLSCSRDCEI

SEQ ID NO: 125763 - protein, 124 aa, Heterodera glycines
  Coding regions on vcDNA: vcDNA=SeqID_52186; Strand=-; Position=1 -36,137-374,693-772,1001-1021
MGDIPSKQHQKMRTNVGRRIVTNGNLKLGGDGLVPPTENLGGDGLAQILPPKEVIDQQQHNYGQQQHEATTDQSDQQKQYVDEATNGGGEIVNQITLPSNPLGMGTVVEGEEHQKQATEIWGLC

SEQ ID NO: 125764 - protein, 56 aa, Heterodera glycines
  Coding regions on vcDNA: vcDNA=SeqID_52187; Strand=-; Position=1 -86,277-361
MVGGLSSTKVAKSRKNLNKLLALGRRRCSENRQFLGQFNQNKSTNFSKTANHHLKN

SEQ ID NO: 125765 - protein, 305 aa, Heterodera glycines
  misc_feature (4)..(4): Xaa can be any naturally occurring amino acid
  Coding regions on vcDNA: vcDNA=SeqID_52188; Strand=-; Position=1 -33,1341-1486,1841-2227,4466-4817
  Homolog annotation: Hit_ID=CAB62280.1; Match level="QueryCoverage =98%, HitCoverage=90%, E-value=2e-48, Identity=34%"; Hit description =hydroxyproline-rich glycoprotein DZ-HRGP [Volvox carteri f. nagariensis]
RAVXLFPGPPPPRRPPAPPPPPPPPGRPPRRPPPSPPGGPGAPSPPTSPPPRPQRPPRPPPPLPRAKVKVEQPRPPTPRPRPNVKREQQQKPKSEFKPPSTSKKTGRPTPAKRVPEFVDLDPRPSTSRQAGYNPPPPTPKIKHEPTTKRPMPYRIPKREPKVEEAPQQQQPLPAAAVVVEEMPVVPPPPKSPSPIATPPVPAVKPLTTTTTTTPTPPAVKPVTTTTPAPQSSAKPSAQQQKPTPVPPKPSAPQTSEPKIATTTTTPAPTTKPATPPPPKPKTTVALQPKQTTPTPPQQPITTPTP

SEQ ID NO: 125766 - protein, 149 aa, Heterodera glycines
  Coding regions on vcDNA: vcDNA=SeqID_52189; Strand=-; Position=1 -61,108-254,312-357,412-534,738-808
MIGQLFASVLPLVLFANLINVGEMVRGGSNSLSMTNGGGPPIQQQNPSINLVTNVAHSLNNLRLNPSAEENQHQPTPVNAAQPKIRQNPNKKGVKVGSKMKLQQKLKSGVKSKDLGEKKSKLGMAMFYVFMLISLFVPHTPHVPINVML

SEQ ID NO: 125767 - protein, 120 aa, Heterodera glycines
  Coding regions on vcDNA: vcDNA=SeqID_52190; Strand=-; Position=1 -72,115-188,263-479
MNSNDTIDDGLFTSHLKDQNASKMPSSISDEAGPSSSSTKTTDFTEQPEFTEFRPELIVWRNKFYEVDQEEDEEFAWDDFLKSPERRPFELDEQSTSGQSKTVNVRVGETKVVLKGNFRF

SEQ ID NO: 125768 - protein, 344 aa, Heterodera glycines
  Coding regions on vcDNA: vcDNA=SeqID_52191; Strand=-; Position=1 -448,535-668,706-940,1154-1369
MHRIPFIQLFILLINMIGIANSKDGIKNLFVGKKNNNDYDKCSDQFHYEVIEDGTTEEEDMKKAIQIGKTFFWREMIAKWECENEDLYNNPQKIGKKSIKKLKRICENWKMKALSADAFVKSLKCKKKQKYFMVTLLIKIDEGGQPLNELKCLCVKPRFLVEEGELQLSSAMEATKAVYRDLFKWGNGKGLKIAIKFENERAWDLVDRWLKAFKGLRIEQNDEVNQMLKKAQSNQILFKAENALKFDPYFEKFENSEFSKTFLNAPPRFRKERTLASINEMTYNDKKKNRYYLNEFINVAEDYKEQWDFLQQKNLNDYEKFEVLKQIKQESSVQLWHISQQLGL

SEQ ID NO: 125769 - protein, 71 aa, Heterodera glycines
  Coding regions on vcDNA: vcDNA=SeqID_52192; Strand=-; Position=1-215
MRSNETVNRKVLFSLMTIFLVETFGWVSNWSLRLLLIQFGATESTKWFVMSYAGYVMQISLALNGPILYVL

SEQ ID NO: 125770 - protein, 34 aa, Heterodera glycines
  Coding regions on vcDNA: vcDNA=SeqID_52193; Strand=+; Position=1-119
IKINQRLNIHRRLKYSVNVAQKISYSELIAFSKP

SEQ ID NO: 125771 - protein, 733 aa, Heterodera glycines
  Coding regions on vcDNA: vcDNA=SeqID_52194; Strand=+; Position=1-2202
  Homolog annotation: Hit_ID=CAA82797.1; Match level="QueryCoverage =25%, HitCoverage=29%, E-value=6e-11, Identity=29%"; Hit description =gag protein [Ascaris lumbricoides]
MQRLEFEDGSESNMDPANEGHRNGAQHDENVQDGDGPVASTNEEQQKVARVNEATRGSNMATGLGTNQQGMLPFPSRNLRSVSIPVRTARDRIERASGTLAARIAEAREVIDQDLTEGEAGYQAARLLAMERGLKEATQIFQGHFEIGMAAAGAEPAGRQDFFYDILTAPLPAATKELQLRNHPTPAELLQIADEHIGDLRTMRLALEDEEEAIARSRLSGSFGTNNSHPVGDDPPPPENRNMEEWERSFQVAAKRWQNDGQGVQQHNRRPMGRVATPVMSNLDGIFQRRAKVPSVASMRVTNTAREWINRNRDEMGAFPPATAHRPALMQPKIEKQQAHVNDDYRERQTYPIRRHARDEGEHDRKHGRDESTGMTTFETVRLQPPTFSGKPEDWTTFWAYFKRAVDDKPIPGFEKQLHLLRCLKEGSPARRAVEVYPPSDGNYPVVVQFLKERFGDTDDLQRAIRARLLHLAPAKDNVNSLTTMIDEFERCVCQLEQLGANVDDDSFGPLLEAKLPVRVLTELRIRESMMGSKWSVREFRRAVTAQVRCMRSAESALAAMKDPEVRTDHRTERDHTGRGGKAGREPFQRAFMVRDSQQTRAQPNGTRKEEQCGTSARFTGRTVARGNENGHTGGNGPRFAQNGLPPSFGRGNCSFCLESGHRPSECRAYPTPQARRKRLIEQKRCLRCLGSDHTFEQCQRTVRCDACRKDDHHWLMCWKNQPGNQSRPSGEP

SEQ ID NO: 125772 - protein, 77 aa, Heterodera glycines
  Coding regions on vcDNA: vcDNA=SeqID_52195; Strand=+; Position=1 -72,738-899
MNNRKKQTQSQTDLGFVELEDPEKTFLACCSPLMLHDLFKEFCTNFKESRSGFPDLVVWNENVAEMAVTYSLAFVMH

SEQ ID NO: 125773 - protein, 108 aa, Heterodera glycines
  Coding regions on vcDNA: vcDNA=SeqID_52196; Strand=-; Position=1 -60,122-388
MTLLIDNSKMVTQFNTQLWSVKIHSLGIVVNRHINQIRSFIPKIPISKDFVEEQRPNSPTKTPTTKNNQPHGSHDEQPSVLARPQRERRPPKRLNIGPNAGARYEIEG

SEQ ID NO: 125774 - protein, 157 aa, Heterodera glycines
  Coding regions on vcDNA: vcDNA=SeqID_52197; Strand=-; Position=1 -288,674-859
MPSSATGNTTSTSTSASSTASLSSSSSSTTLAASAAAAAATAPPTQPANSSQPTAGASTTAPKPASYTSVMVEDFENRAFDKDQFRFNKLLDIQHNDIYDEVLDKLPEVSSDEGSPSDHNFINVLSLDGGGIRGLVIIQVTECEKCTADPIRHFSKV

SEQ ID NO: 125775 - protein, 159 aa, Heterodera glycines
  Coding regions on vcDNA: vcDNA=SeqID_52198; Strand=-; Position=1 -166,247-560
MPLKIDNAKRMQQIVPKVKASENVPGYLENKNEEKQQRISFKNYFNEVNAYFNYYVPKHIIGLIALKLINAIQRHLKLNNGQLAHVLTPDHLVAIRVGDQFSKSELLGNAHLEIDAEIQRVEDPRQRALPSADQTKIIWLKDFPYMSPQQIKVILISDN

SEQ ID NO: 125776 - protein, 176 aa, Heterodera glycines
  Coding regions on vcDNA: vcDNA=SeqID_52199; Strand=+; Position=1 -171,223-399,512-641,829-881
MSMLLFVFSIGILTWTYDYIVGNAHINLSLINAEEIFQIQQFLGGNIGDFVLYCGRNDYFLGKITMGLYFVENIICYAVIVICGYKMVRFVYKNLDKSSARRQQINRQITINLILQAFIPLAMNLINLIISVEMVIFEFQLSPSFVYSNVHHSSLSLVAHPKGSTYQFPRKSTITQ

SEQ ID NO: 125777 - protein, 149 aa, Heterodera glycines
  Coding regions on vcDNA: vcDNA=SeqID_52200; Strand=+; Position=1 -280,331-502
TIDALAYEAAKVLQRQPFLLSAAGGGGENGSVILENGGRTAAEGGGTLTPHAASAPGGSTDHQQHNNLQVLAQSRVLVIEWGFPLETFVENVPRLALHWAAVAPPRWVAVPPLILRAENATPTRPPSADCRPAPVDGWSGTNSPTLSTD

SEQ ID NO: 125778 - protein, 87 aa, Heterodera glycines
  Coding regions on vcDNA: vcDNA=SeqID_52201; Strand=-; Position=1 -61,166-368
MPSHMVGKDGLTISAENALNVLLICYFLYAVEFVIFSANNKANLQNLSVNALRMLLSKELSVKLGTSVIYEEFKSNFKHYEMKDDDL

SEQ ID NO: 125779 - protein, 31 aa, Heterodera glycines
  Coding regions on vcDNA: vcDNA=SeqID_52202; Strand=-; Position=1-113
SPALNPSTGFLVNSFNCFCSKSLDCSEDIIN

SEQ ID NO: 125780 - protein, 80 aa, Heterodera glycines
  Coding regions on vcDNA: vcDNA=SeqID_52203; Strand=-; Position=1 -13,459-571,681-797
MNAIGLGIDENCIVNGQQNGAGQVTPSAALLKIVEKNLAENNNELAEKVEKICGFGANGSSFPGGTAIRMEMAELPRNSQ

SEQ ID NO: 125781 - protein, 164 aa, Heterodera glycines
  Coding regions on vcDNA: vcDNA=SeqID_52204; Strand=+; Position=1 -36,861-1319
MKLHDNYNKNSQNANITAIFNGPSDFLSTLALNPLANLFSIANGPLEIDNFKRNQAQNSIKHGKLLLQIMGKDLTGLILLEHFMDVTGLSVEHFFEIGADGLEEKTAVQQIRNKLEIVLRKPEISVDRKSSAQAIIKLIKVISNVSNMLAHKDFDILQHISVKL

SEQ ID NO: 125782 - protein, 161 aa, Heterodera glycines
  Coding regions on vcDNA: vcDNA=SeqID_52205; Strand=+; Position=1 -128,398-466,847-1135
MPKVDFDYLDMFSPILVCFVGIYHFHFLFFLFRWHLFLRSSFFSSPSRASIGTVSRTRMTLRCSKRFLETSCSRKIRLLKMAPGFLGLDPGKTQALVKMALIFQFGTRLNLRLGPHSMAVIKRGGYASTYAREEAKRSECTGPQQQQLNTLGDGKCQISHA

SEQ ID NO: 125783 - protein, 643 aa, Heterodera glycines
  Coding regions on vcDNA: vcDNA=SeqID_52206; Strand=+; Position=1 -520,761-2171
  Homolog annotation: Hit_ID=NP_346206.1; Match level="QueryCoverage =84%, HitCoverage=93%, E-value=7e-42, Identity=27%"; Hit description =cell wall surface anchor family protein [Streptococcus pneumoniae TIGR4] gb|AAK75846.1| cell wall surface
MAFYSAADSDRQPQGQPAPQQPPQQEELVPAASPPAEESVAPNNQPVVPMMPASAGPEPQNELGTQHQTSPPPLPARAPPQLHFQIRNLGPNPEGIPGFGANEYKPNRKPLPSAAKEQSPAGSAAAFSPAPAPPVVPLAVGGSANPCGTVAVPPPAVAVPSSAAGAESTYGGGAEPSAAASAVGAAAPATAPPAGGDGGSAETNVPTTAGGVTASSAVTTAAAVSSPITAAAPQASSGAPCPSSAAPLLPAGGPAEQQHVPVGVEVKPAPATAQIGPGIAADYGEETNNGAASPSGAEPQPATVVSPAPGQQATTVCAGISAAPAVAAPSAAYGAEEAVSGDGPASSSDTVPPSTPTSPSAEGGAASSSAPLTGTASAVPPLSATTSCPSPAAVGSVSPPALHIGGSEADGPASAAVGAPAVAPSSGATASASSGYSEESAASGSASPAPSLGGISSAAPFSGSGASAAPGHEQTESEFASGSVSSVVGVSSAAPSPGSAASGSPGYVEEGAASVSASGPGETGGPPPVSAPSAAPSYGSVSAAPRAGNAASVSPEHGEEVAVSQSVSETTSSGISSAPTYGSGASASSAAGISPAAPSSGSAASISPEYGEEIDFSESASESASSASAAAGISPTAPSSGSA

SEQ ID NO: 125784 - protein, 103 aa, Heterodera glycines
  Coding regions on vcDNA: vcDNA=SeqID_52207; Strand=+; Position=1 -190,453-574
  Homolog annotation: Hit_ID=NP_510201.2; Match level="QueryCoverage =61%, HitCoverage=14%, E-value=3e-16, Identity=61%"; Hit description =nuclear Hormone Receptor (nhr-32) [Caenorhabditis elegans] emb|CAA94154.2| Hypothetical protein K08H2.8 [
MHSSSIDLHSHGAVGICAVCGDRADGHHYGVLSCRGCNAFFRRAVTFNLQFHCRRDGHCDISKIPTNSADFLLLSPPQADGPPFPTNLQVLGSGKTLDLVKIK

SEQ ID NO: 125785 - protein, 232 aa, Heterodera glycines
  Coding regions on vcDNA: vcDNA=SeqID_52208; Strand=+; Position=1 -212,488-600,677-905,1145-1289
MHFPTYSSGGWFPCKNTKTNHWRSNVVYIFFFALRFLHPFHFLPDLSTGSATICQTLSIVGHGVIGLNVSRNLGVVPINQSCQFPMEICFSNTKKGSSFFFGLLLAHDSQHPAFTKAEQFRGLIMNKADDQEILSALRMPSDEPGGGGGGEFSTDFSIDAVAIFFSVLLKLSSRTMTHSFAALTRYINIALMTLTMRKCIDILRHCEKIENFYGRLIQFPGMNNGFANSLII

SEQ ID NO: 125786 - protein, 22 aa, Heterodera glycines
  Coding regions on vcDNA: vcDNA=SeqID_52209; Strand=+; Position=1-68
CCCLLISTMVMVDKLHIFEEHV

SEQ ID NO: 125787 - protein, 303 aa, Heterodera glycines
  Coding regions on vcDNA: vcDNA=SeqID_52210; Strand=-; Position=1-909
MSELIRQRLTAEVRTLSDLVKRLRQRVGRLTEFTRMAPEEIPLAEETKLAKGVRTDRQLLQRSIDRVNGMLQECFDHIQRLGDPFLKQAEEDLLAALPTFDDEQADPNVEEWPIITLLSKAQLILDGLQVYIEARFDTTDAISSRSSSRVSDHGADDENRIHRQRQSTDPPAQAQQANARQPSNSARADQNLFNQRTPAFPLNLTFPRASNRPTHRSEPHHGHFRQSTNDDDALRVSRIEIPRFSGSAEEWITFWAAFDFAVHSRQYPAFQKHLLLLQYLEKGSPPRRMIEGYPPSDANYSTV

SEQ ID NO: 125788 - protein, 61 aa, Heterodera glycines
  Coding regions on vcDNA: vcDNA=SeqID_52211; Strand=-; Position=1-234
APGNSTLRCPTTILGLRHSSLNSSRQPPFRLPTNPHRVVSRPFQAFDHSSLFSQPPAALSG

SEQ ID NO: 125789 - protein, 115 aa, Heterodera glycines
  Coding regions on vcDNA: vcDNA=SeqID_52212; Strand=-; Position=1 -233,282-396
  Homolog annotation: Hit_ID=NP_509753.1; Match level="QueryCoverage =67%, HitCoverage=17%, E-value=3e-23, Identity=61%"; Hit description =neurotransmitter-gated ion-channel subunit family member (XL75) [Caenorhabditis elegans] pir||T19840 hypo
MNGWKFFVAFTSNHWAILRRRKWQILALINASIKLIPSNSQSFDADLYLYLSWQDPSLAHSDSDFVLLNDPKIRHYIWLPDLYFANSRTSRFHEVIAPNLNLFIDRNGTIAYSTR

SEQ ID NO: 125790 - protein, 25 aa, Heterodera glycines
  Coding regions on vcDNA: vcDNA=SeqID_52213; Strand=+; Position=1 -59,259-277
MSLLAFLTYLVFIVTKIDKISLQSF

SEQ ID NO: 125791 - protein, 297 aa, Heterodera glycines
  Coding regions on vcDNA: vcDNA=SeqID_52214; Strand=-; Position=1 -745,825-973
MARRMGMNFDSFVALAVRAEEVQKATKSAESGNKHRPKFQQKPTFQPQKIFAPKTNRIVCYNCNKTGHISRHCRLPFARKQSNCARKPPQQNFATKSADFRKNSEAEKKLIDLRLSNQPPAQPTNVEAGPKRKASNRQRNSSSSCSVKATKMEEKSAEIPKWFLNAIFAALVVFAGVFSKEKSKCGQIWKSKGSMSRTDEVKGRKAFGKLGTIFSPKAGEELADVAAANLENLLKIGKSMNFPIADRKYLTLQRDFVPNRSTADTLAAPFNAECTTDEPKALRTSLLRGRGCDIIVI

SEQ ID NO: 125792 - protein, 36 aa, Heterodera glycines
  Coding regions on vcDNA: vcDNA=SeqID_52215; Strand=-; Position=1 -14,74-170
MEPFVNLYDFWLGIIPFSDSIRHFFHFVYDALEANF

SEQ ID NO: 125793 - protein, 112 aa, Heterodera glycines
  Coding regions on vcDNA: vcDNA=SeqID_52216; Strand=+; Position=1 -126,512-724
MTSKNDVTFLQKSPSMSDMKPLRLRRPSIVSTSRSGLGNLGVPLTRHLSIEPPANLADALGMHNPNWAFYHYSSPNYRSAWPWRMFRDRFDVRSNWQKCKTKLNAFFDKKSS

SEQ ID NO: 125794 - protein, 42 aa, Heterodera glycines
  Coding regions on vcDNA: vcDNA=SeqID_52217; Strand=+; Position=1 -71,113-170
MYNKHFSVQPIYRNVPLNVPSHRTNFSNHQRAGYWSFDYDYM

SEQ ID NO: 125795 - protein, 111 aa, Heterodera glycines
  Coding regions on vcDNA: vcDNA=SeqID_52218; Strand=+; Position=1 -138,398-595
MYKQHAQALFSVLSSFLCSVGTKGTEKSDCKTTHLDNARQMYKQMGVTDEQKIKSDMLLARRTVFNTIIAYNDAKTGEAVHAAIVAVRAVISGGGDAANAAVSSSELTNEY

SEQ ID NO: 125796 - protein, 154 aa, Heterodera glycines
  Coding regions on vcDNA: vcDNA=SeqID_52219; Strand=-; Position=1 -102,149-221,311-468,1280-1411
  Homolog annotation: Hit_ID=CAE59437.1; Match level="QueryCoverage =54%, HitCoverage=25%, E-value=3e-11, Identity=41%"; Hit description =Hypothetical protein CBG02810 [Caenorhabditis briggsae]
MPSTNANDGITSADDATRLRMVDPVDRYSALIVRAIHLGADSWNGCAWIRTFHSKFKIAFNHVKQIPQDYYQKGIIMKGIVRDLESNGIIKVEHRPAIRIPRLFGTKKSKVVAERRGLGLWERATWVERVQSYPSTAVQIFKHSVPAKLAVYIN

SEQ ID NO: 125797 - protein, 168 aa, Heterodera glycines
  Coding regions on vcDNA: vcDNA=SeqID_52220; Strand=-; Position=1 -108,532-690,772-1011
MYPPKDSDSNFFPNRMLSVDRSRSSSSHLVGLNAALRVSFSKDIKLHRMLRYLRACFVRDIREHNRGFNNGTQQTTKCQPEMIDQTNGVLNKRSWLEQNAYFAENNCFYPFYGQAVFYASFGQHSEGRVVCCSDGRIDEEESFKENCKKMTDHIYAAKAGWRKGKDAQ

SEQ ID NO: 125798 - protein, 23 aa, Heterodera glycines
  Coding regions on vcDNA: vcDNA=SeqID_52221; Strand=-; Position=1 -31,448-488
MAGIYCLFFSAKNHKISHLLDVM

SEQ ID NO: 125799 - protein, 148 aa, Heterodera glycines
  Coding regions on vcDNA: vcDNA=SeqID_52222; Strand=+; Position=1 -75,129-288,650-861
MMIYAYAISFVIHHFLLSFSNAVPSVDDSALIAFMKSDQKGSQTNDYKYSIQKYEAHLGILHFMVKNWHCDKMGDQFEGPTVQNFSRARLSRTRKTRPYIFWDGLDQTEVTQLGNLETLNGQNATNIANFWTFCTNICTENILTDCQQ

SEQ ID NO: 125800 - protein, 63 aa, Heterodera glycines
  Coding regions on vcDNA: vcDNA=SeqID_52223; Strand=+; Position=1-190
MKVPKLEEDKKKVPRWEEDKMKMPKDDDKMKVPKLDGDKMKMPINERILQLAIDVANHDQTNE

SEQ ID NO: 125801 - protein, 32 aa, Heterodera glycines
  Coding regions on vcDNA: vcDNA=SeqID_52224; Strand=+; Position=1 -44,453-507
MNILTVKLLENKGINSAPCSSAFCCSYFEPPP

SEQ ID NO: 125802 - protein, 379 aa, Heterodera glycines
  Coding regions on vcDNA: vcDNA=SeqID_52225; Strand=-; Position=1 -94,240-280,356-449,581-706,763-842,886-982,1313-1425,1531-1646,1691 -1751,2025-2167
  Homolog annotation: Hit_ID=CAE64944.1; Match level="QueryCoverage =100%, HitCoverage=39%, E-value=1e-111, Identity=54%"; Hit description=Hypothetical protein CBG09775 [Caenorhabditis briggsae]
FMDEYAKRHEEEDGEVYEYDEDGNIIWTWKKIIDPLPPIDHANIEYKPFNKNFYYKPFNKNFYVEHGEIKALSPKDVFELRIALDIRVYGNDPPKPVVSFAHFQFDKVLMSSICKASFEKPTQIQAQAVPAALAGRDVLGLAVPAALAGRDVLGLAKTGSGKTLAYIWPVICHILEQPELCPVICHILEQPELCPNDGPIALVVVPTRELAIQVYNEARKFCVPYNISVVCAYGGGSKYEQQKALEQGAELCICTPGRIIDLVKIEATNLLRTTFLVFDEVDRMFDLGFEPQVKSISEHIRPDRQCLVFSFEPQVKSISEHIRPDRQCLVFSATMKSKIEKLVFHALFNPVKIVCGDVGEANTDGEGSVLVVQDTQAKF

SEQ ID NO: 125803 - protein, 27 aa, Heterodera glycines
  Coding regions on vcDNA: vcDNA=SeqID_52226; Strand=+; Position=1 -63,133-153
MEKRLRKIHPNQWKKIPRLAQKVWKSA

SEQ ID NO: 125804 - protein, 27 aa, Heterodera glycines
  Coding regions on vcDNA: vcDNA=SeqID_52227; Strand=+; Position=1 -63,133-153
MEKRLRKIHPNQWKKIPRLAQKVWKSA

SEQ ID NO: 125805 - protein, 43 aa, Heterodera glycines
  Coding regions on vcDNA: vcDNA=SeqID_52228; Strand=+; Position=1 -63,133-200
MEKRLRKIHPNQWKKIPRLAQKVWKSAYGKFIQISGKRFLGSL

SEQ ID NO: 125806 - protein, 459 aa, Heterodera glycines
  misc_feature (313)..(313): Xaa can be any naturally occurring amino acid
  Coding regions on vcDNA: vcDNA=SeqID_52229; Strand=+; Position=1-1387
  Homolog annotation: Hit_ID=NP_499726.1; Match level="QueryCoverage =98%, HitCoverage=19%, E-value=3e-63, Identity=34%"; Hit description =predicted CDS, RNase H integrase-like protein family member (3O318) [Caenorhabditis elegans] pir||T26836
QLWGKKLRIVFDASSHEKGARSLNDTLFSGPNLYPDLAGKLIQFRATKFPIWADIEKAFLMISLRESDREFSKFLWVKDIKAPLSGKNIIVFRFKRITFGIVSCPLLLAATLKYHLDTHPSSLAREIVAKSLLYVDNLLLLADTHEEARSKAIEAQTIFAAAKMRLCEFIAAVPISLVGIPEKDRLETETPNVLGMKWVINEDNLSLSFPVPGPEGLTRRVVLKTIASFFDPLGLCSPCLVGPKMFFQKLWNESQGCDDLIPIAECTELMKIQKHWDSEILSIPRHTRRVGSNSLQLHAFSDASPEAFACAVXIRAEMQNKNVVSMVYSRSRIRPKKMATSQSDGLTIPRLELLGILIGTRAIKFCEKTNYDIKKCFLWSDSRIALSWLASTDKMPIFVANRVREIRSNRLVFSYVRSADNPADLATRQTTPAELKNAILWWNGPEWLSKSNEFWPKEC

SEQ ID NO: 125807 - protein, 197 aa, Heterodera glycines
  Coding regions on vcDNA: vcDNA=SeqID_52230; Strand=-; Position=1-594
MENLERTLNHTRLTRQRAQNEGILLDRDGNVFFRENPPNRTLGVMNQNVVVADPNLENSEQLDSMEMRRRLLNPNNDSALGQLRQNERASLDENEEEETKQGFMRNRTDWTQNLGERAGPTQQIFRNFGFGHTQNEDDFFDHPNIRRTSTPVNENRCVGVGPQNLNEIGLLAEQIGRVIVGQLNSAHQNPNTNPAPN

SEQ ID NO: 125808 - protein, 51 aa, Heterodera glycines
  Coding regions on vcDNA: vcDNA=SeqID_52231; Strand=-; Position=1 -75,1160-1240
MLGVGTSIGPVVGADRPRPCPVQSQAHKCRLLAIMGQQRAKCIIHELNCYS

SEQ ID NO: 125809 - protein, 27 aa, Heterodera glycines
  Coding regions on vcDNA: vcDNA=SeqID_52232; Strand=+; Position=1 -21,86-148
MDINLRKLDRELFGLPNDNRFIQFGRL

SEQ ID NO: 125810 - protein, 61 aa, Heterodera glycines
  Coding regions on vcDNA: vcDNA=SeqID_52233; Strand=-; Position=1 -21,72-187,265-313
MHPSVTEKHSLNGFINNNHNNNNNNNLSPTNLVFCQTDGPQSRSNNHLLTAPENSHQLLRR

SEQ ID NO: 125811 - protein, 46 aa, Heterodera glycines
  Coding regions on vcDNA: vcDNA=SeqID_52234; Strand=-; Position=1 -53,85-172
MSSNEEEESGGSNDDQFSEMSKLLEFTKVWCPMSERTKLAMAQFFG

SEQ ID NO: 125812 - protein, 24 aa, Heterodera glycines
  Coding regions on vcDNA: vcDNA=SeqID_52235; Strand=+; Position=1-73
MFAGAKEKGGQKLLQQKDGLFDAF

SEQ ID NO: 125813 - protein, 86 aa, Heterodera glycines
  misc_feature (78)..(78): Xaa can be any naturally occurring amino acid
  Coding regions on vcDNA: vcDNA=SeqID_52236; Strand=+; Position=1 -108,157-356
CPIKTNFSQIRPSLKNPCQFIARLFPFSVFLSVSWAVFGHVFLDFLGKSIFVGLPLLRRLGIERVVKSMRSVNNWSRXRMTSRMRR

SEQ ID NO: 125814 - protein, 139 aa, Heterodera glycines
  Coding regions on vcDNA: vcDNA=SeqID_52237; Strand=-; Position=1 -136,413-521,738-874,919-955
VVRRQIRAQIGIIKIAEKYFCVLSVELFDECLFGFVPMAAVDNVQKGPIQHTLELKGGVKLFVGNWQQNRRRNRQMVKSRKGMLKETRLNTVVERIRHTTSKRLPPTAMEQSRTAKAKAGGWTTIGNFDVGTLQLAGGK

SEQ ID NO: 125815 - protein, 128 aa, Heterodera glycines
  Coding regions on vcDNA: vcDNA=SeqID_52238; Strand=-; Position=1 -69,474-655,720-852
MNKKVIRRAKPLTLTTVQIICRRKTEMEQHSKQEEKVMDDEQLERLSQTLELLFSAGYFRAKIMGLGNFDKVGTERLGSRFQNRDRPGPESRPGFFLDPGLGPGHFSAAWIFPGPGFSWIFVQEIKVQ

SEQ ID NO: 125816 - protein, 285 aa, Heterodera glycines
  Coding regions on vcDNA: vcDNA=SeqID_52239; Strand=+; Position=1-858
  Homolog annotation: Hit_ID=AAG23159.1; Match level="QueryCoverage =51%, HitCoverage=65%, E-value=3e-69, Identity=88%"; Hit description =polyprotein [Heterodera glycines]
MATKSAAATIERLRYLFTRHGIPETLVTDNGTQFAASEFTKFTEANGIAHLFSAPYNPMSNGQAERFVDTFKRAFRKIKGEGVPNKEIINTFLVTYRTTPNDSLPDEKTPAEMLLGRKPRTTIDLLMPPLPQPTERDTKMEHHFNRRFGARPQKFVSNKPVWARHRLSQNWRAGTICDCSGVIYTVKFPDGSTNRFHANQLRNRENTENGHEPLAILNEAFHLPITAPNVGIVGQDLEPRPDPINDEHQDEIEPEQARRSPTPQQQQVPRRSGRNRRAPDRYSPG

SEQ ID NO: 125817 - protein, 135 aa, Heterodera glycines
  Coding regions on vcDNA: vcDNA=SeqID_52240; Strand=+; Position=1 -142,437-587,636-750
MPTLMRTSSCKETLKLYAVQLDHGETLRTQNWHNETKWWGGVTENRQDLLQRLSRADFAAPSVAFAPHGLFPRCPWRCHCAGPLCRQCVAGGADRQQNGAPPFFRRLYVLLFFAVVVSTDRNLQVGRHVASVGSD

SEQ ID NO: 125818 - protein, 94 aa, Heterodera glycines
  Coding regions on vcDNA: vcDNA=SeqID_52241; Strand=-; Position=1-3,73- 233,1102-1222
  Homolog annotation: Hit_ID=NP_000684.1; Match level="QueryCoverage =58%, HitCoverage=10%, E-value=1e-15, Identity=70%"; Hit description =aldehyde dehydrogenase 1A3 [Homo sapiens] pir||A55684 aldehyde dehydrogenase (NAD) (EC 1.2.1.3) 6 precurs
MAGFPPGVVNVVPGFGPTAGRAIVQHPQVDKVAFTGSSEVGLEVSREASGKNLKRVNCYDVFDPAAPFGGYKMSGIGRELGEYGLSAYSEARKI

SEQ ID NO: 125819 - protein, 77 aa, Heterodera glycines
  Coding regions on vcDNA: vcDNA=SeqID_52242; Strand=-; Position=1 -104,494-622
MTLTLLRLLKVLQNKTIIASNRPVNLWSRCTHKTLFCSSNLTVCNFCVFRRDQGLLQGTGFLASEAPTHEGLSGRAR

SEQ ID NO: 125820 - protein, 95 aa, Heterodera glycines
  Coding regions on vcDNA: vcDNA=SeqID_52243; Strand=+; Position=1-288
MTSSAVLTEQQQSTQQQQQLQNFAGVVANILPSAVPQNTQQQQMAAVSPAQVMWTQQAQQSQAHQQQQQQQMLRHQKKVHVPQQMASSSMGPSFF

SEQ ID NO: 125821 - protein, 22 aa, Heterodera glycines
  Coding regions on vcDNA: vcDNA=SeqID_52244; Strand=+; Position=1-67
SPAEEAGLKVHDKILQVNGVDY

SEQ ID NO: 125822 - protein, 27 aa, Heterodera glycines
  Coding regions on vcDNA: vcDNA=SeqID_52245; Strand=-; Position=1-81
MRSARVNQRQQIEELAQNSALLQDMTI

SEQ ID NO: 125823 - protein, 373 aa, Heterodera glycines
  Coding regions on vcDNA: vcDNA=SeqID_52246; Strand=-; Position=1-1121
  Homolog annotation: Hit_ID=NP_504187.1; Match level="QueryCoverage =94%, HitCoverage=27%, E-value=2e-58, Identity=37%"; Hit description =predicted CDS, integrase, catalytic domain containing protein family member (5E782) [Caenorhabditis elega
MDADIIELTGRDNDEHFLPHHAVINPKKLRIVIDASAHAKGTPSLNDCLHRGPVLLPDLCGILLRFRSATIPVLADVQGAFHAIEVEPEDRRFCKMLWLKNPARPVSGDNLLIYRYKRLVFGATCSPFILAAVLLQHFDKHEHPFAQALAANMYVDNLLIECETEEEAIDKSSIAKQILKDADMNLREFLSHSPNVMGRIPEDDRLDKTPAKVLGLTWDTPSDCITFSLPKDTDITATRRSVLSIIASTFDPLGLVGPCLLPAKRLFQRLWGEGTAWDTPLPETEAETWNQTLSLWQHQTLVVPRHSILGKHSRLQLHVFCDASEHTFAAAVYIRSETSDSSQANLIFAKNRLRSRIASQRFTIPGLEIFSRC

SEQ ID NO: 125824 - protein, 60 aa, Heterodera glycines
  Coding regions on vcDNA: vcDNA=SeqID_52247; Strand=-; Position=1-365
SFWPRYEAFPFCLFNIILKECKANVSVGGLVVVPSILFSSSKVQFPNPVNNYFVFFSYPN

SEQ ID NO: 125825 - protein, 592 aa, Heterodera glycines
  Coding regions on vcDNA: vcDNA=SeqID_52248; Strand=-; Position=1 -106,163-1279,1353-1908
  Homolog annotation: Hit_ID=NP_001004509.1; Match level="QueryCoverage= 51%, HitCoverage=20%, E-value=2e-46, Identity=36%"; Hit description =si:busm1-180o5.3 [Danio rerio] emb|CAD60788.1| novel protein similar to DNA polymerases [Danio rerio]
MKTRPFPIGTPRVWTGEQLWQQQPQTAGGHPHTDCAKPSPPALRPPALPWCRPEDNPFRGFLFCRVLPPSADELGNREPLLPYRTQADGRLTFGLCARCAELRQQRTCRHTERERAWTAAYTHVELNRALLLGYRVLQVHEVWHYEQWASPESGNGLFNDYVNTFLRLKAEASGWPAGCDDEPARAEHVRQFAEQEGVHLRRDNIGHNPGLRQLAKDLLNSLWGKMAERPERDEVVYTDSARAFHELLMDARQEVVSFTHINEQLDRCVVRKREPFARAPEHNNLAVACFVTSHARLYLYEWLEEVRRVGGRALYCDTDSVLYVRRQGAAGVREGNALGDMKRELPGRRIIDFFAAGPKNYGFQHVDARTGQDLRAERKVRSFELTYAADQQLQYGRMRQLVINHFVRPEQRANHGGGGGGDIAEAATEQRTIAVPCQRFVRTRQADIFTRRSTRVYRPVYTKGRVLRPPPTAGGEAAAAEEEAEAVTPTPLSIRTRPFGWCSAEAQQMETDDEEEEGEEEADANSDDAGGESDGLEQPVRKRARAEPVQEMLVEVEEAAPAPVDPDLEEEPVAGCSTWNQQRRLNEHIFRN

SEQ ID NO: 125826 - protein, 42 aa, Heterodera glycines
  Coding regions on vcDNA: vcDNA=SeqID_52249; Strand=-; Position=1-127
MDLQDANKENKEPTKKQEEEAEDPSWISLIDEEMKREPLAPI

SEQ ID NO: 125827 - protein, 1109 aa, Heterodera glycines
  Coding regions on vcDNA: vcDNA=SeqID_52250; Strand=+; Position=1 -393,711-986,1041-1426,1504-1670,1739-2823,3072-3920,4162-4335
  Homolog annotation: Hit_ID=AAA93301.1; Match level="QueryCoverage =30%, HitCoverage=90%, E-value=3e-53, Identity=38%"; Hit description =HASI
MDAFQQFKREDGQFRHPFTMIVSGSTGSGKSEWIMRLLRNVDKMISTPVERVIYSYGELNRNVMNLQRAGKIGNVPVTVHSGVPRAEQVRECAKKEKTLLVLDDLVVGMSQQYLDALFTRGSHNWGVSVILTLCNAKKANALIRDASDEQLLCLVEICLNILKCRVPLRPRHLNKLKAHAQVLRRLARTRCSRSAKKVLLQHGDGLPAIVGLIASIALPLIADHTKRYLLVPEEIYQSLAAPPPADGTSIGLVRNRIKQIKNDDGINEAERAIKYEQELKRLNKLTKDEDERPVGVKLENLSDVVDAMPKPVNVTRPIVVSTRRHLKIGRARKENVEQLEDTDDDDDYQNPRGVGEGQVLRAGGRPFITSSVDDIVSHLLNKDKRGQNKEPTAFKEFVERAKQNPLLTIIMDLKKLRLLEFLYKDLSSPVTFTSVEPLLREARKSQPKINRNDVQNYLTSQRTYTLHRQSKRRYRRLPTLAPGLHTEWQADLAIFDRLGKQNRGFKYLLVCIDTLSRQVFVEPVKTKTSTNMIIAFDRIFKRSKYIPWKVLTDQGKEFTARAVQQFFRTKDVEHFCMLTSPQFHAGMAERANRSIKERLYRYFTERNTYKWIDVVQDIVCAINHSTNSSIGMRPVDVNFKNAEALRQKLHDAAENVVRRKQKYRVGDRVRIEKYKHVFQKGYLPRFTNELFTVAEVHSERSPVVYRLRDDNNEIISGWFYANDLCKTLEDKQQKMYEIEKILKKKRQNGVDYAYVKWKGYCTRFNSWIPIEWQTGNTVRIEVPPSNVTNPHELSKNLYRLLGEGSDPLAKKVRSTQNSFMLLINKARRWAREEYIKRKTKEKRSVRDEELLLQAMLTDTGTLVDLNSVAQGFLTREKSAATSNVPLRMPADDTNSYQEKLYEYFSKLSDKNLNIFDELGMTKLNAEIKNLTEEERVILEATKEMGTEAWIQAYREIRLVCQFNYDVHRNRFVLNIDPRYVKKVKVSLQLAYILGFNNTEFIQSENEARFMPDMSGGVSSFHVYTPDLIEPMMIGDVTAPVLRIVTIRGNPDQQIKYPPVQLSNFPTVWWLILTPAHHMVLIGWAYIALLLCIWSIMTHWGCGHRPVFTL

SEQ ID NO: 125828 - protein, 89 aa, Heterodera glycines
  Coding regions on vcDNA: vcDNA=SeqID_52251; Strand=+; Position=1 -156,204-317
MSPNECSDRPFQQPDNVQQPHQQPDEDAELRAQIEDAEEDLLLNWWREDPTIIRFLFGHGRAPAIEAALLQRAEREAEILRQYAENQQQ

SEQ ID NO: 125829 - protein, 433 aa, Heterodera glycines
  Coding regions on vcDNA: vcDNA=SeqID_52252; Strand=+; Position=1 -131,177-423,470-543,618-907,954-1115,1162-1557
  Homolog annotation: Hit_ID=NP_001004509.1; Match level="QueryCoverage= 96%, HitCoverage=28%, E-value=1e-34, Identity=28%"; Hit description =si:busm1-180o5.3 [Danio rerio] emb|CAD60788.1| novel protein similar to DNA polymerases [Danio rerio]
MRDNGWTLRHVESPGGEYKHGNFLLDGMLERIGEDMNLAIEVNGCYWHACPHCFPEDDAIVGGGETAGAIRARDEKRIRQIARDFEVEIVWECQLGRMLEVDPPMKAFSTTRPTPARLTSMTPFSEVGLAPSGSEHPSSRTKKDRLGGPLKNMFTNYPVGHPKVIQMDKDVNWTAKEHIVDDDGVKMEGIIKCFVVPPRHCLYDIPVIPMRRNNRTLFPLCRKCAEMYPKGLVDPEYNCPHFEDAERGFSTTIPHIELEAALRSGYRVTHVYRAYVWPLYCDWSNGLFHSYLNKFLRIKFEASGFPADCAVDDIDEEERERRKQQYIDNPWKGCTVRLDANNIKPNPGMRYLSKLCLNSLWGRFALRNRLTKTEIIDCHADLAKLLNDVKIDISSIDQLTEKFWMVCYKAKDEHVVEHDTSNVAIALWTTAAA

SEQ ID NO: 125830 - protein, 227 aa, Heterodera glycines
  Coding regions on vcDNA: vcDNA=SeqID_52253; Strand=-; Position=1 -409,456-730
  Homolog annotation: Hit_ID=CAE56395.1; Match level="QueryCoverage =96%, HitCoverage=28%, E-value=4e-34, Identity=37%"; Hit description =Hypothetical protein CBG24082 [Caenorhabditis briggsae]
MPKLPETLYTDRGLEFVAKPMKEFFAENGIKKYETSSKKKAAVAERAIRTLKTRLYKYFSAKNTSAWVDVLPKFLSAINNSVCRATGLRPNEISDVNAREVWKRVYGEGLVPAEKRPKIKAGETVRIPEPKHIFEKGYIPNYSDHVYTVDAARATKPQHYLLKDYYGTKMNRKFYLPELTKVQVDENTMYRIEKKYKERMRDGKKEILVKFIGFPEKYWVTDEDFEK

SEQ ID NO: 125831 - protein, 327 aa, Heterodera glycines
  Coding regions on vcDNA: vcDNA=SeqID_52254; Strand=-; Position=1 -65,222-342,421-582,638-823,873-955,1008-1096,1467-1619,1706-1827
MNTNALIASSSVVPLVIEEFQRQNLCDECKAATKCPDNRRLLQYGVFLLHDSFALVSRPERKLLVALCELVVRSMRSSAMSVSFASLFLSTEFVHVASRTISALLSRIFDHIGHTDLSKVVDGRAVASFIAVLDLFSGCSTDKWVLLRDNAPVASILETLCVKMSTPCATRAHILTLQKVLFAGLKGVRQPLSDQSIDELFRVIVRFMRIANFDAGEACATFVQLLKAPSLTMAFIFAIGEGVEFVRRLHFVSFVGQKSVGTARIGHLRNFAFGGEFNPFGKCGQRNDHSETVGVGPPREHFAPKMHPKGRKPSAQQLLAPSFVGMD

SEQ ID NO: 125832 - protein, 59 aa, Heterodera glycines
  Coding regions on vcDNA: vcDNA=SeqID_52255; Strand=+; Position=1-178
FVVKCLLLEISSFMSLGLFPSSTAVYSSNSDNENDQNNKFRGSTVLRASSENSATSNNS

SEQ ID NO: 125833 - protein, 76 aa, Heterodera glycines
  Coding regions on vcDNA: vcDNA=SeqID_52256; Strand=+; Position=1 -153,454-531
MDGIAQSNQKDHFLLNFFVGKVTEGAVVAAQSPQRNSHHLNEFEKQLMRENVKTIRISIKRRDLPLKSNQQQQKFC

SEQ ID NO: 125834 - protein, 287 aa, Heterodera glycines
  misc_feature (251)..(251): Xaa can be any naturally occurring amino acid
  misc_feature (257)..(257): Xaa can be any naturally occurring amino acid
  misc_feature (265)..(265): Xaa can be any naturally occurring amino acid
  Coding regions on vcDNA: vcDNA=SeqID_52257; Strand=-; Position=1 -171,278-347,409-468,511-557,663-700,762-888,974-1100,1282-1336,1524 -1642
  Homolog annotation: Hit_ID=CAE67719.1; Match level="QueryCoverage =94%, HitCoverage=32%, E-value=1e-57, Identity=48%"; Hit description =Hypothetical protein CBG13294 [Caenorhabditis briggsae]
TRKNAGQGGAAGMAEPAEQKFPGKVVQKLYEFIEKSEVIREDEIKREAHKLYKQYEQSLVFAHKLYKQYEQSLVFAVNYEGYDEKYDDSHPTFQWTYDEKYDDSHPTFQWTFSGALLYSITVFTTIGYGHICPKTALARGTIGYGHICPKTALARGLTIVYATFGIPLMLLCLANIAESLAQVFTFVYVFTFVYFKVCCAYCRWQAKKRQEKRSALKLRYHPNAPVNVRRVHSGRSAQRYNSLLRRHASQXKSETIXNEKKICIXMEYYIKTNLKTIINPFKTLEVP

SEQ ID NO: 125835 - protein, 61 aa, Heterodera glycines
  Coding regions on vcDNA: vcDNA=SeqID_52258; Strand=-; Position=1 -55,254-384
MSTSTNLSSSSIFTPAEREASCYDGSLIGQKLDNPRSFSDQQQIEVDERNRNNKNGNKFYY

SEQ ID NO: 125836 - protein, 500 aa, Heterodera glycines
  Coding regions on vcDNA: vcDNA=SeqID_52259; Strand=-; Position=1 -372,487-1162,1327-1402,1487-1545,1745-2062
  Homolog annotation: Hit_ID=NP_509552.1; Match level="QueryCoverage =47%, HitCoverage=12%, E-value=6e-36, Identity=38%"; Hit description =reverse transcriptase RNase H-like protein family member (XJ813) [Caenorhabditis elegans] gb|AAA85753.1|
MTPANSEDSENPLPCSVKPRIMIGVRDFWRFILDWDEIRPGIYRIRTVFGVIFGGEDCGVPEKTSNPSLCCPVLNTPHPIESDVAKLWALETIGVSDSPILKDDEMALEKFNKTIKKDKEGRYEGCNEIIEDYLARGIIENSSRTCDPQHFLPHHTVMGKKLRIVFDASSHEKNVPSLNDTLYAGPNLYPDLAGKLIQFRATAHPIWADIEKAFLMVSLREADREFSKFLWVKDVNAPLSGNNLLVYRFRRITFGIVSCPFLLAATLQHHLDTSPSDLAREIRHKSLLYVDNLLLLADCPAEAEQKAIEAQEIFSEAKMRLREFVAAKPELLTTIPKEDCLSEDEPSVLELMGPVPRLGPAHRKFRKKCMGFDQKCFTQCFCDGGISESGNRGPSWISSTEKQPVFVSNRIREIRTNRSVNFHYVRSAENPADLATHPTSPNELRSANIWWKGPEWLEKPANLWPDELTAILPPEESSAPDPVVVAVVKIGPDIFEFDRF

SEQ ID NO: 125837 - protein, 365 aa, Heterodera glycines
  Coding regions on vcDNA: vcDNA=SeqID_52260; Strand=+; Position=1 -537,650-806,1048-1451
  Homolog annotation: Hit_ID=CAE59732.1; Match level="QueryCoverage =51%, HitCoverage=5%, E-value=6e-10, Identity=28%"; Hit description =Hypothetical protein CBG03168 [Caenorhabditis briggsae]
MGKLGHGEFKQWTEILSKKNLKSRNNALKGKAPPEESGAVSAPCQSCAQSHGWAETPALLSACLVSTEPEPHLRVMASTSPGALGDSAGGTGTTNAAGGGTGAGGGMKPSGGGTSGGGGGANTISSASSATSSKPAMGSAGAGRQSALGANVGAQQQWWSQTAVACPDDRSVTHIMVFQTILNVSLGHHQGEDMLQSAFDDDGDLTNVLGGFNFVEQNQEELDLDNLEIDKDEETQINNQPMAIGYTVSTAPLPPGMPSSFWHRCPAARRRAGASGIAHLKSSLHINTSNLNEEYGGGAAQQRERDSGGGGTTASSAGGGAANAKATGAEQQQLPHAQHPLDAVATDDVLRWYLRLNEKIKPYQE

SEQ ID NO: 125838 - protein, 27 aa, Heterodera glycines
  Coding regions on vcDNA: vcDNA=SeqID_52261; Strand=-; Position=1 -67,807-823
MAINSKISEKECNFLGSDKPFLNLHIV

SEQ ID NO: 125839 - protein, 141 aa, Heterodera glycines
  Coding regions on vcDNA: vcDNA=SeqID_52262; Strand=+; Position=1-426
  Homolog annotation: Hit_ID=CAG82020.1; Match level="QueryCoverage =100%, HitCoverage=17%, E-value=7e-09, Identity=29%"; Hit description= unnamed protein product [Yarrowia lipolytica CLIB99] ref|XP_501710.1| hypothetical protein [Yarrowia lipo
MPLANPIKSHQLPMPLANPIKSHCYWPIPSNPIAIGQSHQMPLPLANPIKCHCYWPIPSNAIAIGQSHQMPLLLANPIKSHQLTMPLANPIKSHQLPMPLANPIKSHCYWPIPSNPIAIGQSHQMPMPLANPIKSHQLPMA

SEQ ID NO: 125840 - protein, 64 aa, Heterodera glycines
  Coding regions on vcDNA: vcDNA=SeqID_52263; Strand=-; Position=1 -135,1122-1181
MLRHEPVFRDEVKRLVESMVAPNLLKPKMLNGRPMTVRKFVECVRVYVTLKPTVKACLGMEKDN

SEQ ID NO: 125841 - protein, 319 aa, Heterodera glycines
  Coding regions on vcDNA: vcDNA=SeqID_52264; Strand=+; Position=1 -26,72-260,337-453,499-615,661-849,926-1114,1191-1323
  Homolog annotation: Hit_ID=AAF34780.1; Match level="QueryCoverage =99%, HitCoverage=68%, E-value=3e-15, Identity=23%"; Hit description =srpA [Streptococcus cristatus]
MASAMTFTETKTAASPASASKGSNNKPKQQKNSASASMTSVMKRTQLASKYFGNYLVVFQDHNRSISSAGIWTKTAASPASASKGSNNKPKQQKNSASASASMTSVMTLTQTKTAASPASASKGSNNKPKQQKNSASASASMTSVMTLTQTKTAASPASASKGSNNKPKQQKNSASASMTSVMKRTQLASKYFGNYLVVFQDHNRSISSAGIWTKTAASPASASKGSNNKPKQQKNSASASMTSVMKRTQLASKYFGNYLVVFQDHNRSISSAGIWTKTAASPASASKGSNNKSKQQKNSASASATMTSTMTLTELTIT

SEQ ID NO: 125842 - protein, 120 aa, Heterodera glycines
  Coding regions on vcDNA: vcDNA=SeqID_52265; Strand=-; Position=1-360
  Homolog annotation: Hit_ID=CAI04701.1; Match level="QueryCoverage =87%, HitCoverage=81%, E-value=1e-17, Identity=53%"; Hit description =conserved hypothetical protein [Plasmodium berghei]
KSRVRVQVFKPGTGGPESGRGTESGRESGRGTESGRGTESGRESGRGTESGTEIETESGRGTERGTEIETESGRGTERGTEIETENVRGTESGRGTERGTEIETESGRGTERGTEIETEN

SEQ ID NO: 125843 - protein, 58 aa, Heterodera glycines
  Coding regions on vcDNA: vcDNA=SeqID_52266; Strand=-; Position=1-174
MSIPALPPPFVSVLARPLLLLPRLITTVRRRRMSPSFIRPPIQPPMQWHHRRQQSTNT

SEQ ID NO: 125844 - protein, 70 aa, Heterodera glycines
  Coding regions on vcDNA: vcDNA=SeqID_52267; Strand=-; Position=1-213
DFRAPKCANSKPCDCQPWPTEFGWPWKDRRTGWHRTSICEGTEKEIYILGGKFIVKKTILFAYSEENLFW

SEQ ID NO: 125845 - protein, 141 aa, Heterodera glycines
  Coding regions on vcDNA: vcDNA=SeqID_52268; Strand=-; Position=1-424
YIDHNVIAFLRRFCPIFAAFPINLAIKTDSDLISEFILRNIWPMLGRNICGLFLFANVFHRLRKFVPSILNDCPSLRVVNLCDADLFIEFPADDSAAASDGQAVAKWLFTPLQNNVPKVFMCWWDNNDDGNLASELEAFKA

SEQ ID NO: 125846 - protein, 78 aa, Heterodera glycines
  Coding regions on vcDNA: vcDNA=SeqID_52269; Strand=-; Position=1 -47,287-476
MSDNRKEAEEKMAKAIFISADCWLKVFDLLSPRQLGLGIAMISHRFDFYVDEHFKIRKWTFGTVQFGDKMHENCSKFN

SEQ ID NO: 125847 - protein, 289 aa, Heterodera glycines
  Coding regions on vcDNA: vcDNA=SeqID_52270; Strand=-; Position=1 -406,457-720,2777-2974
YLLVRKATFVCKITKNIIYYKCSSIKETAFVVRNPFTNHGLRLSVTVFHRLRQFAPSILNDLPLLCIGKFHAHDDDVDDLFAEFPCNDSAAASDGQAVAKWLFTPLQSNVPKVFKCGLDMDYVKNWSSNIEQFKTAFANASSPVNFIVFICIPLPFADSVLAFDFTNELTREQLTLKRTDFHYCFLLVRCPIARDESKWTKWEKEAIGWRTDDPWNRIIIHIRALASPLSLSTTNSVMRTIGQQHDVPSNGTVTVTLIVTQSSSTESKWKQMAPSDLLANVTVTPHAMV

SEQ ID NO: 125848 - protein, 159 aa, Heterodera glycines
  Coding regions on vcDNA: vcDNA=SeqID_52271; Strand=-; Position=1 -75,165-263,566-871
MDEYKNVEEGISNGIRIQLNKEQGNREFIFSTVAGHFKVLQRVKLFWQNCLEAEKQKKLALARQSASATVRRLNRKIVREPLYAHYPHRSVPTPTANTTVGTTLAGTADADAVGPVQSRTARRWEKLFHDYGHNYSMFRTIELHRLLLDGAVVVQQIAK

SEQ ID NO: 125849 - protein, 124 aa, Heterodera glycines
  Coding regions on vcDNA: vcDNA=SeqID_52272; Strand=-; Position=1 -175,438-615,1409-1428
  Homolog annotation: Hit_ID=CAE70359.1; Match level="QueryCoverage =94%, HitCoverage=6%, E-value=2e-38, Identity=69%"; Hit description =Hypothetical protein CBG16916 [Caenorhabditis briggsae]
SPPIYGWGMPNGIVQFLKKIKELCNREFEYLSITRDTTEVDIKQRREIRAGSAYYTDLCAVRAALCGRILFIDGVEKAERNVLPILNNLLENREMQLDDGRFLLSAEKFDRLLRVSELCLLLFL

SEQ ID NO: 125850 - protein, 138 aa, Heterodera glycines
  Coding regions on vcDNA: vcDNA=SeqID_52273; Strand=+; Position=1 -80,384-721
PPYHPQSNGVAERYVDYFKRQLKKCSGLIFEIRSPQLGNRIITRHANQMRTTMAQSGDETCSVPDDIIFAREEHGTGNETTTGNETTDDQQTNTQPQQQAAQQEEQRQNQQPTLRRSERTRKSVRFLSPTHTGQSYDH

SEQ ID NO: 125851 - protein, 107 aa, Heterodera glycines
  Coding regions on vcDNA: vcDNA=SeqID_52274; Strand=+; Position=1 -133,723-913
MQMVHKNYGPLLAFGGQRTKKKRGTKERRNGEEKKWKQEKEWRRGRYENCRGKVHFAKRQRQREEKHLEKKHFWESHGDFIHLRFVWLVDGLGTEVDKESEGAEANF

SEQ ID NO: 125852 - protein, 38 aa, Heterodera glycines
  Coding regions on vcDNA: vcDNA=SeqID_52275; Strand=+; Position=1 -75,208-249
MTPFCAFVGLTQLAVTVIGKGVEVRQNKRPLIEKLEKG

SEQ ID NO: 125853 - protein, 51 aa, Heterodera glycines
  Coding regions on vcDNA: vcDNA=SeqID_52276; Strand=+; Position=1-154
MDNTNNKFILLKNGAKLFYASEECVRQEAKNFVGGIVGLNGPSDLEEGIYE

SEQ ID NO: 125854 - protein, 26 aa, Heterodera glycines
  Coding regions on vcDNA: vcDNA=SeqID_52277; Strand=+; Position=1-79
SSRADEFNECQNTSADAEIMRFGSQK

SEQ ID NO: 125855 - protein, 45 aa, Heterodera glycines
  Coding regions on vcDNA: vcDNA=SeqID_52278; Strand=+; Position=1 -113,424-448
MSLIIKLNYLQRNGQFRSSPVCAADWCSNCSISTQFANFIIKVFP

SEQ ID NO: 125856 - protein, 972 aa, Heterodera glycines
  Coding regions on vcDNA: vcDNA=SeqID_52279; Strand=+; Position=1-2917
  Homolog annotation: Hit_ID=NP_941979.1; Match level="QueryCoverage =41%, HitCoverage=41%, E-value=8e-21, Identity=22%"; Hit description =membrane glycoprotein polyprotein [Uukuniemi virus] sp|P09613|VGLM _UUK M polyprotein precursor [Contains:
MPDDSPFMYQIIRSKLPSTVLSELIKMERAAGIPWGTPQLRAGLAEVLGVREEVERCLRETNADRQTRFRHEARPNRPQRPERHENARVFSVAQSVRNSDDKRVPSCLFCPGQHWASECNKVTDAETRKRCLLQQNRCLNCLRKGHQLRECRSKQVCRVCKERHHSAICPSAKGTSSARSKQQKPSPRNKQSFGNERNSRPLVSSAVANEADSIPEPKTVNTIMAIVSPSVPHLVMLMALRAPVFSESAPNKRRDALFFFDPGAQVTMVKTPLIRQLSLPKLQDDQLEVNPFHTRQPIKMKAPQHVLCVQREDGGYETLVAHRTDWIVPSVRRATFLQGMLVPVDEEPDILVGMADFWKFFNGVQRVSPQLFKVQTSIGSTVCGRDEIPSRPTADHPLSVMPVTVHVPANEDEMPNTAVSGIQRNESISDLDSLRQFWDLQNIGIRDDPLENDDETAQQIFDQTTTRLANGRYSVGWPWKNFPPDLPSNFAITRSKTKALASVLSILMCLFLIGASQTNASSTTKPKRGKGLPIRCRGCELTCTKTGVDISIPNGIVKFLLCCAGGTQCITQSGVRKSFHRLPKEHLLFDYDCEAMYWTKRGNKRIGSVQCPGRDACELIDCWVCLERLANPDCRPDVTFGLIGGASFFTFLFLFWILPLMCHVTMFWILQHLFTLLVRLLCCFWPSQNAPQREESPLLAFQSLPTPRRRQMGRSRFRPFPKLQTTLLLLTICAFTSCARAQVVSITASAEKCQRSDFGSVCHLESSTTVTLLPSGLPVRLLLRHPDERVLGTLEISMRSLTLHCLPKSEQWLRSYHIETVSVKRCPSRGNCTREFCDDVNNGRKTEVQELSEWTKHPGFNRCSASCSFWWCGCLNAGASCIFYRPHAIANSPIVYEQISCPTWEYRLRTSLKLSVNANFTKEPSVSLTPGITFRWKDLSITPIASSVPPAPIMANKFLSDGNNVAISDEIQ

SEQ ID NO: 125857 - protein, 22 aa, Heterodera glycines
  Coding regions on vcDNA: vcDNA=SeqID_52280; Strand=-; Position=1-68
MAKFEGRSGGKFFHGHPTLYLP

SEQ ID NO: 125858 - protein, 755 aa, Heterodera glycines
  Coding regions on vcDNA: vcDNA=SeqID_52281; Strand=+; Position=1-2268
MSKGLFGCYSCHTGAHLHLQCHTDFGSALGYVRGSDGTEFTALCHKTPKVLNVSLSFNRAEVDINCTIECSGGRNPFVINGHLRYVPKHFQAPNEGSSFASKAKPSNSCLIWCPDWNFDFSDVFWYFFGLQNALRTVGIITLALFIVYVLLRCNPALRSWRAISRVVLLFLALWPTTDSSAAGGLSHLLSIQNSAPKLQFEGHSSVSRRVTETLDIFDAQIGTIHLAKNQKSPMDFAIKAVSVPVHSPFLQIPESAFHIQTQAQFPPFPMATLLSFLANTMNIDVDRFGLAVTTSMSRWNEAQAIVEGLHARGYELKTRHLYPRERNVRLHGSELSRSGASRLGAYNGSARGPTVSELYRSRHGITLRHPSAPCLMEPGGNEHHDFFPIEMIRVVAPDQVSTPRGLSTRPLPRPRPSHFELWDRTDHPPRSRELVINVMPHGDSTSRGAAEEYRIGVGRELTISGPLVLRIYAGALLLALFSVALVDGQSSIAGLCPAHSFALCSSRLHKFSCHCPSLFGPSAFDFVQIVNKFAPLAYSPSSGSEHFVKSHVKSADSPFSPLFGRVHHLPLFKPLVAKLGHHSLPSDSSISVALVAMPSTHCSSTLAPVASHVQSGTASLFDPSSPRVCTADFVRAPESCPPTIGLCTTDRMPTISPIADNQMATGVTSRWMSIQQREKYERRLLRLNGFRPTLVICEPMSSAIRRERLRLKRLHMATPQEPRKPGAVSEEEGTAVAGPSSAGSVAKATEKMEEN

SEQ ID NO: 125859 - protein, 80 aa, Heterodera glycines
  Coding regions on vcDNA: vcDNA=SeqID_52282; Strand=-; Position=1-243
MTSKDRAQRMTAKGVVDYLEGKCKPRQNGKSPEANCVRKSPKRIKLFGTMLTDETPGQSVSGQSVSGQSVSVQSVGVKNI

SEQ ID NO: 125860 - protein, 229 aa, Heterodera glycines
  Coding regions on vcDNA: vcDNA=SeqID_52283; Strand=-; Position=1-690
MKRSNTTKDTPPQPKRSMAPPLDLDPNTVALAEQERQRTLVFIGIPESNAVRPSERVKEDREATTKILDHLEVEAEPTAVFRLGRFDPQRTTPRPLKVVMPTPAHQHMALGGWKRERARLRSQQNLARLFVRPALSKEQLKEEYEARVRKRQQNTAPVAPAMQPPQTNVPAPAKENGPKPKEASEDTSKSSQVEKTITQNQIPNSLPKIDNFLLQLQSFQKQFPQCFDK

SEQ ID NO: 125861 - protein, 18 aa, Heterodera glycines
  Coding regions on vcDNA: vcDNA=SeqID_52284; Strand=+; Position=1 -20,731-767
MYVKYVRPLNGDYFDTKK

SEQ ID NO: 125862 - protein, 69 aa, Heterodera glycines
  Coding regions on vcDNA: vcDNA=SeqID_52285; Strand=+; Position=1-209
MLIAVMKGRPKIQISQYSVQKYEAHLGIVYFMKNNWQCDKIVDVFDEFERAECQKYRKYLDILYEYLFR

SEQ ID NO: 125863 - protein, 140 aa, Heterodera glycines
  Coding regions on vcDNA: vcDNA=SeqID_52286; Strand=-; Position=1 -209,253-569
KFQWFGEQMFVFCYFNYSLIVPLTPQLKLNAKRGDHCKVPTNCASFRGPFFRRSKCHLAVRRAVALSVFLPNCARLQKSVVPFFDLFSRRRVHSKFGPKSSCCLGVRIGLFKPTDQFGPFQNAKNARRFRRSGHIGNKSE

SEQ ID NO: 125864 - protein, 111 aa, Heterodera glycines
  Coding regions on vcDNA: vcDNA=SeqID_52287; Strand=-; Position=1 -90,138-230,925-1077
MFFLPFAFMLFSPTFATLSVGNPGVKRRKQHPIRTSREDELFDETRGAEMLSKCKASNMDLTVRKAIEDIKYRGGSTLTSKAVELALQDMRRGMRLDARQVIMSPVKKPIN

SEQ ID NO: 125865 - protein, 205 aa, Heterodera glycines
  Coding regions on vcDNA: vcDNA=SeqID_52288; Strand=+; Position=1 -291,567-773,818-937
  Homolog annotation: Hit_ID=NP_917837.1; Match level="QueryCoverage =38%, HitCoverage=3%, E-value=3e-12, Identity=48%"; Hit description =B1158C05.18 [Oryza sativa (japonica cultivar-group)]
MCRQIGLGETGEHFWIPPQFLVKSKEELIDYVYPNFQQLLGNDKELLNRLILAPHIDTCDEVNEIMMANVPGQVREYLSTDKPLDDRPLDIDEIESEFPIKPAFAMTIQKGQGQTIRTVGIDLEREVFSHGQLYTAFSRATDGNNVRVHAPNREIDAQGRAKVLNISSWYMVFGEMPKHSIPICTMLGAKMVRSLDPGHGPVSPL

SEQ ID NO: 125866 - protein, 231 aa, Heterodera glycines
  Coding regions on vcDNA: vcDNA=SeqID_52289; Strand=-; Position=1-696
MKFCILLFLFLIALIIPIESEKKKLQQKSFGEIFGEKWEEKEEEKRNELKKREIIAKFYKIKEKIKQKGRKYSTKEWGKIEIKIAKKLGTNRMKIYKWIKEFGLQKYKSKSDAEKIEIVQEFIEMTNEYKQKSKYSRKEWKQNYDEICKKIGVNRETLRKWKKQFGISKKRITEEEKMEKMKIYWEIKSENPKMSDNEIAKILKIHQNSIIRWKKLFGEEMFKKRAEEEEC

SEQ ID NO: 125867 - protein, 65 aa, Heterodera glycines
  Coding regions on vcDNA: vcDNA=SeqID_52290; Strand=-; Position=1 -57,800-940
MPSKLSQKYAGHLPNSLTTLASFPIKNSEKGIIATNQIKIDIVQIVDTCLVVLLTYIFLNVMNSA

SEQ ID NO: 125868 - protein, 25 aa, Heterodera glycines
  Coding regions on vcDNA: vcDNA=SeqID_52291; Strand=+; Position=1-79
KERTPSDIPIFPFHNWPKATVLIDT

SEQ ID NO: 125869 - protein, 65 aa, Heterodera glycines
  Coding regions on vcDNA: vcDNA=SeqID_52292; Strand=+; Position=1 -88,460-569
MVTVRTKRIKLSESEFMGKRIFEKWTREGRVTGSENTIQISISTQFRTPDEQKSKIQIFIFAFLV

SEQ ID NO: 125870 - protein, 44 aa, Heterodera glycines
  Coding regions on vcDNA: vcDNA=SeqID_52293; Strand=-; Position=1-133
MSSCLDVFKLTDDDAMKFLVCESHIGTKKMDYQMEHYVWKRRSD

SEQ ID NO: 125871 - protein, 18 aa, Heterodera glycines
  Coding regions on vcDNA: vcDNA=SeqID_52294; Strand=+; Position=1-55
MRNSKNLKFRLFVRNLVH

SEQ ID NO: 125872 - protein, 135 aa, Heterodera glycines
  Coding regions on vcDNA: vcDNA=SeqID_52295; Strand=-; Position=1-407
MKRQFNDKNGAKPITFQNGEPVFIWNLKGNKANWLPATIIERVGNSPTYRVDVPTLRCAVHRLVNQIRRRFPVEMETPQLGQENGNDLAGDQTNQTPIKEIEKAKSPIGRSQNAPRTSARAKRAPQRLDMDPSKP

SEQ ID NO: 125873 - protein, 509 aa, Heterodera glycines
  Coding regions on vcDNA: vcDNA=SeqID_52296; Strand=-; Position=1-1530
  Homolog annotation: Hit_ID=EAL44122.1; Match level="QueryCoverage =58%, HitCoverage=51%, E-value=2e-14, Identity=22%"; Hit description =conserved hypothetical protein [Entamoeba histolytica HM-1:IMSS]
MDDSVSLAGSDDESQQPRPKKKFKIPKRRSALLRPIGQQQSPLQGQHKRRKQLQDSGLRKLFQAISDQQGSSKATTKAIEESRKVQKAPRHEKIEHEQRMVKKSQQEANRHLQPEKRQQKEIQEVPHSTTEEQQRETKRQQIERQQNDEQRAINQQTRSKAWQELARQFDYDLMDQPDPTEKQPEETDQPTKSKQQSTKDKEDKELERHRIGRKKTIDMQEKRQRSRDEWPEENETLLSYVQRIYGPENWTSAWQRGRVLRELHELEDQGRWMIHHKSDRLQLSVSRMYGGKRPFAEFRFVEGRYYSHMVPEDVIFLQAVPTEEQPEIITIDDTTTPATNTEQTKHPTKPQRPQSPKLEEYRMADSKPNTHSQFNLFQPCDNTHTTCAKTATYGSTAGNRFQMEEFQNFRANNFFEALLFNWLTRNMNLPAEEIWAAHEGYIQADTTVEEVAQMFYQQQVADSGRQIARDQHLAEVINVWRNSCDRFGELYNQPAHKQVKFRPITTESE

SEQ ID NO: 125874 - protein, 1189 aa, Heterodera glycines
  Coding regions on vcDNA: vcDNA=SeqID_52297; Strand=-; Position=1 -1798,1842-3353,3426-3595,3647-3733
  Homolog annotation: Hit_ID=NP_508324.1; Match level="QueryCoverage =87%, HitCoverage=41%, E-value=1e-126, Identity=30%"; Hit description= predicted CDS, peptidase family A16 and RNA-directed DNA polymerase and Integrase, catalytic domain and
MASYRADWIVKSIRRAEWKTGNVEITDEEPDLLIGMAEFWRFFQRREQINRNLFRIYTSVGPIVCGKDIPQEIGETRQICAVMSAKADCEFAETGIDTAKNFWDLQLIGIKDDPKENDDDTAMEIFEKKAKRLADGRYSSGWPWKEFPPDLPSNYNMAYRRLVNLLEKLRKTPELLDKYHESISREFNLGFFELGERREGFPEHFLPHHGVLTHKLRIVFDASAHPRGEKSLNECMFRGPVMIPDLVGILLRFRLPIIALWADLEKAFNAISLDNEDREFVKFLWVKDPKKKLSTDNLQIFRWARIPFGVISSPFILAAVVQKHLKEKASPLALEFAGNAFVDNLMTSCKDAGEVLKKYREGKALFAEAQMNLREFICNSMKAMEQIPEEDRLNKPGTKVLGIPWDIQKDELSIGFPPTNEAGKISKRIVLKTLASIFDPLGMVAPCLLQAKLFLQRLWDRTLGWDEILPADETAEWFAVIREWKTEPFKFPRRSVLQDEMVQLHAFVDASKDAYAAALFIRSQKGEETNVQLLYAKSRLKPRKAEVTIPRMELLAMLIGARMLNIKRMHSRRAEIPSSLVEWTNMAPRTNEKLADRLRELDNVVAVPATTSEDNPWIDPCRFSSWTKLRRTVVWFLRAINKMRKTRIFEISEGVPMSSEDYQYAEILLVKMAQKCWPMWKKQSQELVKTSRKDGLVRLSTRLAMSNASEDMVNPIILPENCPITRLIAQSVHESLAHSGVESTLTEFMGKYWTPRARLPIKKVIRACGRCRRIQCPAYKLPTMSPLPEDRVRRTAPFESIGIDYLGPTNTKINGELQKAWIALFTCLSTRAIYLEPVLDLSAEAFLQVFRRFTSRRGTPKRIITDNGTQFVLAAKVAAALEAGKTPTCPLEEHLANEGIKWRFNPSLRPWSNGFLERQVAGVKAAFKRVLGRRILPYDQLRTFVAEVEATINQRPITYVDEGPNAVQPLRPVDFIMPKAILSLDVRRNEQSSDTEFENEPKNLQKQLQMRWEGTLATLDEFWTRWKKEYLLMLRNRLQWEHKGPRSCLADQPKIGEVVIIEEEKTPRNCWPLGRIVELQGSDNIVRSAKLKIPKANGERISWLPGTNVATPSFGAKVTSGDLRTALLSNKVGEEDASSVDPIDRSYAKHLINQANSGITIELGRPFILNNIKLHLMDRDQRTYSYFVE

SEQ ID NO: 125875 - protein, 63 aa, Heterodera glycines
  Coding regions on vcDNA: vcDNA=SeqID_52298; Strand=+; Position=1 -108,169-397
FLADLKPSIACRFSAQQSTNRVFDSLQKNNSLPKSFLQQFISNLISCRLKAINCLPVLGTAKH

SEQ ID NO: 125876 - protein, 27 aa, Heterodera glycines
  Coding regions on vcDNA: vcDNA=SeqID_52299; Strand=+; Position=1 -69,157-171
MNTDFVSTQRPENEHLYKKKNVWKMGN

SEQ ID NO: 125877 - protein, 28 aa, Heterodera glycines
  Coding regions on vcDNA: vcDNA=SeqID_52300; Strand=+; Position=1-85
MANFFNIPRRQTIQLLLIIILFKMTLQQ

SEQ ID NO: 125878 - protein, 242 aa, Heterodera glycines
  Coding regions on vcDNA: vcDNA=SeqID_52301; Strand=-; Position=1-729
  Homolog annotation: Hit_ID=AAG23159.1; Match level="QueryCoverage =32%, HitCoverage=33%, E-value=5e-27, Identity=79%"; Hit description =polyprotein [Heterodera glycines]
MSNGQAERFVDTFKRAFRKLTGEGMSSVKEIIETFLVTHRTTPNDSLPDLKSPAEMLLGRKPRTTLDLLKPPPIQPIERDQAMEKKFNRRFGTRPQIFASKDAVWARHRLSQSWKAGTICGCTGVIYNVKFEDGSSGRYHANQLRFRKATQIVEDPLNILNGEFNLPIQMAPMVNGHQNGQDIENRPDPINAQNEVEEQPIEEEQQDVIQAAQSPTPAVRSPTPQRRYPYRRRQPPARYSPR

SEQ ID NO: 125879 - protein, 109 aa, Heterodera glycines
  Coding regions on vcDNA: vcDNA=SeqID_52302; Strand=+; Position=1 -67,149-226,629-768,1525-1569
MTGTCQELSIYIVAIPGAITLAGLHLKQWAPVRLNVEVNGMVSKFCLIEKFVALLHHWTLCLLMKSVKNVNSMESILNLFLPQYYRKAIILIPFQSRLCCNRIRSSSNN

SEQ ID NO: 125880 - protein, 45 aa, Heterodera glycines
  Coding regions on vcDNA: vcDNA=SeqID_52303; Strand=-; Position=1-137
MSNIRIRPSLSQEELKARRVLQEECSRKRKEDGGEWVVYADKVML

SEQ ID NO: 125881 - protein, 131 aa, Heterodera glycines
  Coding regions on vcDNA: vcDNA=SeqID_52304; Strand=+; Position=1 -25,271-509,893-1023
MQRIIGKKKKAYDRADEMLAPPASPTSASPIERPLNSNNANLMVRGWARISGRKRHRRKVPNLESNNNSSNNFGVTRRESGTMPYNIQNGRRESGFSVESTWPMIRANSNLSRVAHLSENTGRTEDETERK

SEQ ID NO: 125882 - protein, 354 aa, Heterodera glycines
  Coding regions on vcDNA: vcDNA=SeqID_52305; Strand=+; Position=1 -157,288-1192
  Homolog annotation: Hit_ID=XP_318550.1; Match level="QueryCoverage =100%, HitCoverage=39%, E-value=3e-91, Identity=44%"; Hit description= ENSANGP00000020240 [Anopheles gambiae]
MPAPHDKTTLRSFLGALNYYGRFVKPMRETRAPLDQLLRKDESWSWEMTNSPHKKEKVIEHASTVLTNAQQNYSQIEKEALALVFAVQKFHRMLFGRKFTLFTDHKPLLAIFGSKKGIPIYAASRLQRWALIMANYDFEIRYINTASFGQADVLSRLIANYPRPEEDILIANICTETECYISTILQTKTEQLPVTADEIAEVTPKDEILKKILAFTQSNWPKKCSDPDIAPYFPKRENILEIEGCLLYQNRVVVPQSLRNRMLKSLHMAHPGIVRMKALARQHVYWPGMDSEIERIVRQCEECQKAQKAPIKAPLAPWTPTDKVFQRVHIDFAGPCQDGHVYFILVDSFSKWPE

SEQ ID NO: 125883 - protein, 768 aa, Heterodera glycines
  Coding regions on vcDNA: vcDNA=SeqID_52306; Strand=-; Position=1-2305
  Homolog annotation: Hit_ID=CAE56862.1; Match level="QueryCoverage =46%, HitCoverage=56%, E-value=3e-10, Identity=21%"; Hit description =Hypothetical protein CBG24692 [Caenorhabditis briggsae]
MVNPLENLPYEDIVAIDRRLFSGRNPSVQAKVSDLENVLSQVSGFEDASNRNLRYLNRRINATNEAIFKLSEELNTGLATMATRIDSLTDPNPFHFPFPIPKQNKQNRSKSQTPSRQFPLNVDLNAQSSNSITPNLAQNSDIRNRGLTDSSTPPPLNQVIVEEEQQDDSHVWADESSDRINGLTFENQSSGGLNSFTGESSQTFESWSRKFMDYIEATGRRMEEGDKIGRLKMMLEGTPRDIFEDLPADRKATLQAAIHALKTVLDTPFKSQLAKQSLASCRQKEGEMVETFVERLIPLVNAAYQELDPKFRKDMLKSAFLEKLRDEISFHVRLGSSASQTFEETRIKALEVENLLATRKPRVDPDWINVMSSSSSARSPPNLLQGNFTTWQPPPPQQKRVSFGPSQSANPNPNNYTNQFRPPSPPRFQNRNWQQTPNQTPTCYYCKKPGHVISECRILAYKNQNRNSQNWTSQPPMFTHSNPNSIPISRPPPYNSGRGNQPHQRGTWRNQQSFHHDQRGAWRNQQPFHHDNRNWNRYPNPNQPYGRGRQINSLNTYDSLPPDSFQNLSMSDNGPHPSFNTLTFSDQVQQPVTASPSQIKEQLVCSGSADKQPNLTDALKSEPKPVSPTPIVTNWESHPRSSNFSIAPFLTRFNFILCIITLSLSASLVSSSHSQSSLKVLPMVCQTHVEGTIWSLPIWLPCPKLKHTPSDTPIKQPIRLFQPNPFEQKSKAWVCRKVKKSLIEYTNPWNDLIIKQLPSENLPVLLDE

SEQ ID NO: 125884 - protein, 339 aa, Heterodera glycines
  Coding regions on vcDNA: vcDNA=SeqID_52307; Strand=-; Position=1 -247,294-505,550-1111
  Homolog annotation: Hit_ID=EAL41644.1; Match level="QueryCoverage =75%, HitCoverage=16%, E-value=5e-23, Identity=32%"; Hit description =ENSANGP00000027773 [Anopheles gambiae str. PEST]
GLPHVHFALILDWDRVRSGGIIMTPEDYMVQYISAEIPENPSGRSPEVILRRQLYNTITTKNIHTCSIRRCIVDGKCTKRFPKPFSYDDVYSETAYPRYKRRPPALTEKEASKNPDNYGRFIQYKDKSGKIVRVDNRQVVPFNAFLSAKYKSHINTEFVAGEGCTKYLCKYVMKGADMAFIEVKGGPEKQQKVDYDEFHQIRLARYITSMEAYLSLTGAKLVRRSHEVAILEQLKCNINYDKVDELDVHGPSGHRIAVEFGLKDEEEDLNAVCEAAQAEEDRRARGEERVTQLTAYFAFNKDNAPLGLTYAKCNKKLWYDIAKKQWKPYVGRVFRSSAD

SEQ ID NO: 125885 - protein, 329 aa, Heterodera glycines
  Coding regions on vcDNA: vcDNA=SeqID_52308; Strand=-; Position=1 -135,181-465,524-683,730-1139
MISYVLWDYNPPEGNMPHLHGQLFTIPPAEARTRITDISTENSLDDSVMDALHRILREHHLLAVVYESAAETYRQLPAEERVQLRMLLVDTDKTGAERTVESDVAQAPANLHADDRANVKQIHPGRLGTETAAGSRLVAQFYLDTGANVIPVSEYDIILMGRDETKVRSMKWWNRNIDPALFPLLFPFGQFGYEYGIKLVLLKNERFDSTYRQIRDKDNMLLDADEDLGEEEEFLGAEQEQQFHRRDQVSRSQWFRYMAHIRGLNYNWRDGHWLWDWRTLAQLYTISYNNRMEAQKVQFMKQHQERRRLILPSSIINWLKALRDKKGKK

SEQ ID NO: 125886 - protein, 89 aa, Heterodera glycines
  Coding regions on vcDNA: vcDNA=SeqID_52309; Strand=-; Position=1 -253,645-661
MPLSNQNRNTIIKHVAIWCKGKQDQRLEVEQRRQQLEGEVAALVKACGRLKRNAQKKDIAFKLKSLEMVKWPPAKAFDNPYIKQGIQIH

SEQ ID NO: 125887 - protein, 25 aa, Heterodera glycines
  Coding regions on vcDNA: vcDNA=SeqID_52310; Strand=-; Position=1-76
REKKILFFSGTLYLLVHISFFETVC

SEQ ID NO: 125888 - protein, 25 aa, Heterodera glycines
  Coding regions on vcDNA: vcDNA=SeqID_52311; Strand=+; Position=1-75
QFIYKGQGGNTNNFPSKKLCDQVCK

SEQ ID NO: 125889 - protein, 129 aa, Heterodera glycines
  Coding regions on vcDNA: vcDNA=SeqID_52312; Strand=+; Position=1 -76,307-489,608-738
MNMTIDELKHKLTQFLYRPINRLQNSVNFFCKIFANEVIHQKVLASLRPKDVGRMESVSVSLKNILLSGSVDNAFWKVHYERLFGKVQDDRQIPYRERFGEKMRWQANAARMLMAIPLREPKTVDVPDE

SEQ ID NO: 125890 - protein, 44 aa, Heterodera glycines
  Coding regions on vcDNA: vcDNA=SeqID_52313; Strand=+; Position=1-132
MEEFEEMVAVLQLDGVLDFDAVRRAVSSGAIRVRECDAETPMVQ

SEQ ID NO: 125891 - protein, 79 aa, Heterodera glycines
  Coding regions on vcDNA: vcDNA=SeqID_52314; Strand=-; Position=1-239
FEYPKRTLEKIDFFVFGAVPPNRCAQIYGETESFRNSFPIACTLILRWIFAPHDLFEYPKRTLEKIDSFVFGAVPPNRC

SEQ ID NO: 125892 - protein, 136 aa, Heterodera glycines
  Coding regions on vcDNA: vcDNA=SeqID_52315; Strand=-; Position=1-410
TKARTLAQNAIRRRLQHPRLHRTPPPPPPPPVAVPTARPAPSPVRKATEGRRKVERHKLVGCYGMKTSEKQPNRRRKSEDWTKEKGEGRDTAEEKGKNGEEKANGRGKHPSDGEKAAYQRELLRERNRGNEKLGNC

SEQ ID NO: 125893 - protein, 60 aa, Heterodera glycines
  Coding regions on vcDNA: vcDNA=SeqID_52316; Strand=+; Position=1 -93,163-252
MPDADQILQQLEHHFVNNWLLDTGKIDEMKQRQSDQREEHDEFDQTEEETDEISLINVID

SEQ ID NO: 125894 - protein, 183 aa, Heterodera glycines
  Coding regions on vcDNA: vcDNA=SeqID_52317; Strand=-; Position=1 -186,424-623,1659-1824
MEMPTNRELAQRKRRAEEAEFLHSIDEGEQLDELTPGRICLHEVGHLKFLWDDVDCVDEFRKITAAADPRDGSAGAVHFQPPAQHKYTRAQLKAKLQLSLGGRAAEEVYFTRCVGDGFDSLEWPELAPRLMGHPEASKQFAAEARANAANAMEWDQMSNSNASGMEEDEEEATYEMITPGLIR

SEQ ID NO: 125895 - protein, 23 aa, Heterodera glycines
  Coding regions on vcDNA: vcDNA=SeqID_52318; Strand=+; Position=1-70
SKNAQFNRTRTKEQQRTNSWLRF

SEQ ID NO: 125896 - protein, 35 aa, Heterodera glycines
  Coding regions on vcDNA: vcDNA=SeqID_52319; Strand=+; Position=1 -81,958-984
MPGPGPGPGFHVGPGPGFPGQKSRKIQFGISNQSL

SEQ ID NO: 125897 - protein, 27 aa, Heterodera glycines
  Coding regions on vcDNA: vcDNA=SeqID_52320; Strand=+; Position=1 -64,227-246
MALIIRGSADCFLPPPGRCWEKKGTKM

SEQ ID NO: 125898 - protein, 88 aa, Heterodera glycines
  Coding regions on vcDNA: vcDNA=SeqID_52321; Strand=-; Position=1 -34,951-1183
MECHLRANAKSAPKVLPRGLRPVVLRPLHANVRMAPPPGSAVLRRLVGPTTKIRWAIRRSIATEQKQRGKGHEEADNASNADWDDDSD

SEQ ID NO: 125899 - protein, 340 aa, Heterodera glycines
  Coding regions on vcDNA: vcDNA=SeqID_52322; Strand=-; Position=1 -21,131-517,562-991,1038-1201
  Homolog annotation: Hit_ID=NP_921821.1; Match level="QueryCoverage =98%, HitCoverage=21%, E-value=2e-45, Identity=33%"; Hit description =putative helicase [Oryza sativa (japonica cultivar-group)] gb|AAP54108.1| putative helicase [Oryza sativa
TRMFLNLVVLIGGDWKQLTPVIPGGTDRHQLEASVKNSSLFVNFTTVRLRANHRLLPGQHHYRAFLKRVGTGTINDSQGRVKLPSLMVQPSRDELINEIFPADLPNPTNNWKQLAERAILCPLNRDTLTLNEIIMERLNTAEERLNTAERVYHAVTLPLVDETGENELDADADHENLSRMTPPGIPEHILRVRVGAVMMIIRNISLEEGLCNGTRVQVTELFDNIIRCRILTGTHVGNEHDLPLLVVTKAPHEGPFKCERIQFPLRPGSVMTINKSQGQTLARVGVQTLARVGVLLDSAQCFSHGQLYVALSRVRDANSIRVCTTRNDRRVKNVVMRELL

SEQ ID NO: 125900 - protein, 44 aa, Heterodera glycines
  Coding regions on vcDNA: vcDNA=SeqID_52323; Strand=-; Position=1-132
MAHCASLVQMDEDVYEEMKLWMKGLVAMWRDEKGEDGMDCVFVE

SEQ ID NO: 125901 - protein, 1576 aa, Heterodera glycines
  Coding regions on vcDNA: vcDNA=SeqID_52324; Strand=-; Position=1 -1314,2214-2346,2542-2869,2991-3234,4084-4209,4576-4792,5743-8108
  Homolog annotation: Hit_ID=XP_308624.1; Match level="QueryCoverage =27%, HitCoverage=47%, E-value=2e-51, Identity=32%"; Hit description =ENSANGP00000024486 [Anopheles gambiae]
TIKTFIDRNGLIRMDTRIKKCEMEFSFKFPIVFPKRAPIIELLIWRAHKKAKHGKVDSTLNEFLSEFWAPNVRATVKKIIKMCSSCKKLNGPSFALPIMPQHPEERVKISNPFESIALDYLGPSLVKNDGKTVKFWIVLITCLITRAVYLEPVLDLSTYSFLQVLRRFASRRGTPKRIISDNAQTFRLAAKVAGAYEARGGKTRDELENYLVKNKIIWRFIPALAPWANSLAERLVKICKDAFKASLGKMVLQLDELRTFTTEVEWTMNNRPITHVSIEPEGERALRPIDFINPGLNLGLTMPNTEKEEENNDDDDDDYNPEPEKLADHLKRQWQKTNKVLQWFWERWHKEYLLVLRDRTQWFHKGPNSQEKREPKIDEIVLIEDEFHPRNTWKMGKIIKLNGEKGAIRSVQIKMTTKGKEMTGRIIERPINKIYSLESTSEDCERQLNGSVCRVSGTTELTILLAGQKVSLALKDDKGKIMGNNFCKKGDAIWGHKCALPSSECFFYRTYAEPTSNTIWELIRCTGWDYELKMSLTLTIGNETKSKDLTMFPGLTVKWSKFSFTPEGLTPPISPIFKITIHNRKIKYSKRSGCYNCGTGGTLNYVCQTEFGQAEAEIKCQNGPIFLAKCSENGHEQKDILPFEMADINMNCIVECPGGQTNFKLKGTLRYVPQLENEVKILEERGARIYSTKNGKRKPHINNKNWVLSMDKPDDEERNVHGKDIVKRGDGLLNLKVKGSQPQVRKMSLKGIIKWTILAIFILFGHVKGMDNTKKLDESIIDELSDDVNEADDGSDTLSVELGAQGNQQKINQNENEQRIGNRERVETPPVYYPKLPWPNFYGDTMSWPVFWQAFQANMGDKPIPEAQKCTYLLLSLKGKAARAMRGYQPTAENYNLVINALKRLYGNEKVIKEALQNELLNLPQANEAAISLRICLEDVERVVRQLNNLGFAGDKDYVMMTIKNKFPRNIILEALKAEKDSGREWNVEDLIKGLEEIISMREEAARCTRMNKTAGTQRENWNNNQKQFRQFGNQNNKWQNNQPRNNRNDERNPQRVFFTQDSNNKQNSRPPIINPKCFLCGGAHWPSKCRQIIGQENRLKIINEQSRCHRCLKKGHEKINCTGKMCFNCNGDHNKLICMREFQGTGANRTEIRLPFNRTNQKQNPRSNLAATAIKNTLEEKEVLLMSKRINSYDGLDRKKKSVLVFFDNGSQIAMATDELIDKLKPPKISEGELELLSVRKSKPTHLNSPKYLIKLETTEGGMEEIIVNRVDLITTKIKRANIISGKIELIEEKPDILIGMREFWRFFKKVEPFKEDLFKVHTVFGPIICGEINGNDKLCALTSMGLECIENESEKIWDLETIGIKDNPMEKDDEVALKMFKDTIYRKDGRYVVSWPWKGPKEELPTNFTLAYRRMISIIEKLKKSEEHLKQYDEIFKEQLKEGIVEESEIKGYDEHFLPHHCVLVAGKKPRVVYDASSKIRGKKCLNDLLFRGPIYMPELPGLLMRSRLSKIALWGDIQRAFWTLELQENDRDTVKYLWLKDVNKPITKANLCAFRFKRVPFGVISSPFLLGAT

SEQ ID NO: 125902 - protein, 243 aa, Heterodera glycines
  Coding regions on vcDNA: vcDNA=SeqID_52325; Strand=-; Position=1 -418,484-749,967-1015
YIDQNVITFLGGFRRLFPVSSINLDIVTENLRILEFVLFTIWPMLGNSICLLKLNKIVLHGLRQLAPSILCDSPALLYTTVDRVMPFVFPLGDNANASDDQALTKWLLTPRPDGVPKLLDCNVNSVGENWFAAMDELQNAFRIASSPVSFRVFLGFPKRQIDIAVPFELNNEVTGEELTLRQIVPRHFVLTRCPIGWDHRNWQIVSALINARPNPIDIVIKDGEFDERLLNTASPAPGGQQQQ

SEQ ID NO: 125903 - protein, 70 aa, Heterodera glycines
  Coding regions on vcDNA: vcDNA=SeqID_52326; Strand=-; Position=1 -58,118-270
LKNPIAFTASARPICLMEYGTNDQSTFVVAGWGRTSPYCSNDSKPGPSKQLMYGKMKISAPENCQSASIK

SEQ ID NO: 125904 - protein, 35 aa, Heterodera glycines
  misc_feature (24)..(24): Xaa can be any naturally occurring amino acid
  Coding regions on vcDNA: vcDNA=SeqID_52327; Strand=+; Position=1-105
PGLKCPAQAKNFFYFREKIEIFPXKYQSIELEKLC

SEQ ID NO: 125905 - protein, 115 aa, Heterodera glycines
  Coding regions on vcDNA: vcDNA=SeqID_52328; Strand=+; Position=1 -130,490-565,1265-1405
  Homolog annotation: Hit_ID=CAF89757.1; Match level="QueryCoverage =84%, HitCoverage=22%, E-value=1e-24, Identity=53%"; Hit description =unnamed protein product [Tetraodon nigroviridis]
QQKVTLGVERFALPELLIRPGDVEVQQMGIPEALCAVIERLPKEMQLLIARNIVLTGGNALFPGYRKRIEQELRSMMPEQFTLGVQQPSDPICHAWECARDAIQQQQHDGAEMHK

SEQ ID NO: 125906 - protein, 130 aa, Heterodera glycines
  Coding regions on vcDNA: vcDNA=SeqID_52329; Strand=+; Position=1 -41,115-305,444-604
MRQIVLIASKKNKIWFCTDFLMDIFPFFDHAELGLKLALISPHFDVLVDKHFDGKSELTLWRSITIRKDIVAKVPKLYTLIIPSSLFSVPITKFGTKEASICESYGTPCGCISRLAVITDHGNHGVSEMP

SEQ ID NO: 125907 - protein, 128 aa, Heterodera glycines
  Coding regions on vcDNA: vcDNA=SeqID_52330; Strand=+; Position=1 -99,849-1136
METGILFFNLLRRGYIIGGRQINGDWHIKRVYTKGLCHHPALSDFIYEVSRSIDKQVDAARSARNFIHKRHKRYVLQNAVIIRILADATYDNDAEIHDVMTALGLQVKGYAGKLKDYENFDDSTTHVP

SEQ ID NO: 125908 - protein, 42 aa, Heterodera glycines
  Coding regions on vcDNA: vcDNA=SeqID_52331; Strand=-; Position=1-269
FLEGDILTHFGLGDIMTQGHYDAGTFRRWDIMTQGHYDAGTL

SEQ ID NO: 125909 - protein, 165 aa, Heterodera glycines
  Coding regions on vcDNA: vcDNA=SeqID_52332; Strand=-; Position=1 -222,355-630
MAHIKRVELLLRRAICGGGRKSEKGKAKGKGRGTEEERKNPFISQRSSGDNAKQRMPKGGGGNGNLSEESISKELTSSDCETHSAALSRLFDLFSSDILSLLGKEDIGRMKRILAEIEIQMPKERGESEQTQKKLRCVIERLEMATEEKEEEEEQEEKKEEEGEE

SEQ ID NO: 125910 - protein, 382 aa, Heterodera glycines
  Coding regions on vcDNA: vcDNA=SeqID_52333; Strand=-; Position=1 -228,335-1089,1582-1744
CASANSIPREVNRRAVDGVNEVIKALLQLEWPSDQPRMTVFGWNSFLFSAFSQIAGSDSLCVSETFLQVGQVLLSFQLIRRNVKESPNCPLVALILDIFEKFLAISKPFVLLIAFSGFVDALSLFLSLSIDDNSSIFEQLVSLLERSECVLIDFLFTAPIELPLAFIEMINRKWEDKRKITMANGQRNTEEADADGYVNQLTDLRTLLSDQREGMAEGCPIMSKWLDEGEGGAKVGSGQRKSEGGPKANGPIIERKMTALSDSTWPSNLPICHLSPTSPCKVVALHSFNLLQQLLKAMLNNRNDSFNVTNQSRLTLNFGNFLGELSTNHYTLFPVRLLISQFFVHSTDFSSDLGKMRVSYRLGLNPAEVEECVDKVNKLANQ

SEQ ID NO: 125911 - protein, 81 aa, Heterodera glycines
  Coding regions on vcDNA: vcDNA=SeqID_52334; Strand=-; Position=1-245
LLCTFIDTLRSFSMHRMIMEGLKQRENEKARNSKGQRNAILNGRWSEITFPIGGQTRSEGGRAVTVVMSDIAGLAVEIPRD

SEQ ID NO: 125912 - protein, 309 aa, Heterodera glycines
  Coding regions on vcDNA: vcDNA=SeqID_52335; Strand=-; Position=1 -216,265-446,556-757,801-997
  Homolog annotation: Hit_ID=CAE72295.1; Match level="QueryCoverage =95%, HitCoverage=72%, E-value=9e-46, Identity=36%"; Hit description =Hypothetical protein CBG19425 [Caenorhabditis briggsae]
RKSKENFSLFPVGHQFRRITELRTTDPLEFTQPFTTPTLLGIFNNVLSILNFSFSDFAESMHSVARLPFQTKLSSAGLIYAHYGKSLIANTKLSSAGLIYAHYGKSLIANILNLAEDDADMDRLYEHVYRKFVEGVDAIDNGIKQYDGTPRYQMYQMSSTLDSRVRNCNPAWNDQKPDPEKGFHNAMAIVGAEFEERIRYLHSAWIPARNIVIEAIERRNEAHPSGRIILFPKSGAPWKEHRRNEAHPSGRIILFPKSGAPWKEHFFQLENELGLENVGICLVVFADNSNNTWRVQAIPVSDVSSFDNR

SEQ ID NO: 125913 - protein, 90 aa, Heterodera glycines
  Coding regions on vcDNA: vcDNA=SeqID_52336; Strand=+; Position=1-270
MDHRYKAIIIGKSDQHLSDMCLKLWLIGEWKCVDIKFGRYGGYNLLDPVDVGDFVELYDGGGPIRRLPPGPALPKTRILDGSNGTRSCLK

SEQ ID NO: 125914 - protein, 56 aa, Heterodera glycines
  Coding regions on vcDNA: vcDNA=SeqID_52337; Strand=-; Position=1 -54,138-254
MGRTFIFWLGKATKKKRVLIPAHKTILASASDVFEAMFRFDAGNTGRKSVHKQTIT

SEQ ID NO: 125915 - protein, 134 aa, Heterodera glycines
  Coding regions on vcDNA: vcDNA=SeqID_52338; Strand=-; Position=1 -83,956-1277
MGGKDSSKKVCFLFVKVFAAAANKLILLKLKLIQYSRENLLKKDFLENFRFLGSKRPIWLMGAVLIEVFLEKSQNMDKNAKIWKNMEIWIWNSILEASNQAKNMFFVHFRPPTVQEKNMDFHIITNPTHKLFKT

SEQ ID NO: 125916 - protein, 41 aa, Heterodera glycines
  Coding regions on vcDNA: vcDNA=SeqID_52339; Strand=-; Position=1 -42,180-263
MTANINPTTAMNRKRKDCTACKCEAISHGRRSNKKSDSTCQ

SEQ ID NO: 125917 - protein, 47 aa, Heterodera glycines
  Coding regions on vcDNA: vcDNA=SeqID_52340; Strand=+; Position=1 -146,204-236,684-731
  Homolog annotation: Hit_ID=AAP30776.1; Match level="QueryCoverage =100%, HitCoverage=19%, E-value=1e-13, Identity=80%"; Hit description= putative gland protein G34B08 [Heterodera glycines]
MRTFLFIAVVGLMLAVILENVNATGKNSPSKGKQSLDSPNHKKDPKN

SEQ ID NO: 125918 - protein, 186 aa, Heterodera glycines
  Coding regions on vcDNA: vcDNA=SeqID_52341; Strand=-; Position=1 -111,527-644,860-1020,1059-1229
MPGGENNISHSLHTFVSSARIETGIRPWKEQLELYKKKKCLVVKTIFHISLHNFVSSARIETGIRPLERAARALQEVKKLFEFLQFCFHNFRKLFGIIMPKQNEIVLKYSFLDLTWFLDIEAVFYAISKTKKCLVVKTIFHISLHNFVSSARIETGIRPLERAARALQEGMERKNSYFWDFFRNQN

SEQ ID NO: 125919 - protein, 31 aa, Heterodera glycines
  Coding regions on vcDNA: vcDNA=SeqID_52342; Strand=-; Position=1-94
MTFPFLLLPVHLLLMLVSAVVFIIFSQCCGC

SEQ ID NO: 125920 - protein, 312 aa, Heterodera glycines
  Coding regions on vcDNA: vcDNA=SeqID_52343; Strand=-; Position=1 -565,615-693,754-807,866-1106
  Homolog annotation: Hit_ID=NP_851896.1; Match level="QueryCoverage =99%, HitCoverage=81%, E-value=4e-24, Identity=31%"; Hit description =very large tegument protein [Cercopithecine herpesvirus 1] gb|AAP41454.1| very large tegument protein [Ce
MSDEPPPPATPETPKEPPTQASEVPSPAAPETTKEPPTPASEVPSPAAPETTKEPPTPASEVPPPAAPETTMEPPTQASEVPSPAAPETTMEPPTQASEVPSPAAPETTMEPPTQASEVPPPAAPETTMEPPTQASEVPPASADTSSATLSAHQQLQGCAPGAAGDARPVAPSDHRHCGATDRDGPRAAVLRRGRPVDVLPAVWLLQHLREQCARQMLPGLPERDDHPIAKQNGRHPMARLLVRVRPLLAGRPLHRAVRAVSAAEDGRARLHAPPADVRCAQLLRQLCAADDGAICGAPCPTPCSLMRPPAS

SEQ ID NO: 125921 - protein, 16 aa, Heterodera glycines
  Coding regions on vcDNA: vcDNA=SeqID_52344; Strand=+; Position=1-48
MARRRRKKEPRKVSYK

SEQ ID NO: 125922 - protein, 93 aa, Heterodera glycines
  Coding regions on vcDNA: vcDNA=SeqID_52345; Strand=+; Position=1 -26,91-346
  Homolog annotation: Hit_ID=NP_001002724.1; Match level="QueryCoverage= 74%, HitCoverage=58%, E-value=5e-14, Identity=52%"; Hit description =zgc:92591 [Danio rerio] gb|AAH76088.1| Zgc:92591 [Danio rerio]
MRALNIMNSFVIDALDRIATEATRMAHYDRRKTVTLRDMEFSCRLCLPDTMAKHANQKAQKTVTKFYAAKVRDRMRRTEMRRGEFAMMQMGAL

SEQ ID NO: 125923 - protein, 250 aa, Heterodera glycines
  Coding regions on vcDNA: vcDNA=SeqID_52346; Strand=-; Position=1 -307,352-520,1370-1553,1693-1784
SESNQDTISTKNGETVTVTTQKPTKNGVGRPRKRKRVEDEKRKKEVSLEKKKKEEEPLESEESAKKCLSDTQQKAKRTPFYKHNVSNSTKEAESVINSSLSHPIYHSNKSFSKSLPLSSADYPTSSSQLQHCHNLPIGPNNEAKCDFIKEEQASNFDHADHAYEKASSSLPIENNVTNANVSSAVPAVIGNCAAPITVQAENGLVVSNGTCDNGTPSNHLTTLTTLDLLRTKEFIANQSISMDEGQILNE

SEQ ID NO: 125924 - protein, 224 aa, Heterodera glycines
  Coding regions on vcDNA: vcDNA=SeqID_52347; Strand=-; Position=1 -60,102-253,297-426,817-1149
  Homolog annotation: Hit_ID=NP_507845.1; Match level="QueryCoverage =37%, HitCoverage=12%, E-value=4e-19, Identity=51%"; Hit description =transposase family member (5U321) [Caenorhabditis elegans] emb|CAB81975.1| Hypothetical protein Y116F11B.
MVFSRAQQISDNYKNLENFSASSHGWLEKFMSRHNFSLRKPTTLAQKPPDDYAEAIVNFIVYVQKLWHEKNYTAVFACDETAVWLDPTGGNCVSETGAKSVTVLTTGHEKARVTPPDVCWNAPFKNKIRQIYDEWMVKGEKETTSSGNMKAPPMETYLQWIVTAWNLLSKELIAKSFLSCGITDEIDGRNDEMINVFKVAYLEYFVYFSSVLRRTEPYQMGFIF

SEQ ID NO: 125925 - protein, 99 aa, Heterodera glycines
  Coding regions on vcDNA: vcDNA=SeqID_52348; Strand=-; Position=1 -147,256-428
PIKATALLWESGPLICLGTKSLIDCDNAIKKFIEIIKGSGCPGASYTGLNFKRGKSITALIFWTGKVVITGTKNNSEIEEMYHHILPYLKMAQKKLGRR

SEQ ID NO: 125926 - protein, 246 aa, Heterodera glycines
  Coding regions on vcDNA: vcDNA=SeqID_52349; Strand=-; Position=1 -525,1482-1697
MQKNNFMKIFLIIILLTILFIIITEGIDEDLWKDLKSSTSRNLKKQKITKNFSINEEIAVKNEIYQQQNANKIIIKSENCDEHETENIKPKVSQKIKTESLDGYNNKLKIKIKLPKIESDQWNGEALENENDEQQQAGLCNCSADQSNSSADQSNSSVNHSNCSKEQEELDYTETQKMGQIKKKKRETAETKMELIRTFDQMRKEKIYGFKYEAKKKFQIEREIAGSLGVKRDEIYQLKNEFGKIS

SEQ ID NO: 125927 - protein, 154 aa, Heterodera glycines
  Coding regions on vcDNA: vcDNA=SeqID_52350; Strand=+; Position=1 -49,133-273,737-991,1204-1223
MKLILQLNVLFACFWSAKLLICRVGLFGSVDKPFVRKELNYSTIDCPAKAKFCVKEVCFQDGKAENYVNIYACTDVIKDCNTDGTSLMAYRECRLKNKGIKNACKNEKEKNEAAFVKKYGSNYRCEQCQYGNENEDKGNENFAPYRPDADLIII

SEQ ID NO: 125928 - protein, 105 aa, Heterodera glycines
  Coding regions on vcDNA: vcDNA=SeqID_52351; Strand=-; Position=1-330
PGLKCPAQAKIFFNFREKIENFPKKLPIDRARKTMFWKWSSFFWENSLKNPKIQKPENRFLGLARKILKIFEILKFGKIGLLKLYNKSAGHPALSSKPNELFAWY

SEQ ID NO: 125929 - protein, 51 aa, Heterodera glycines
  Coding regions on vcDNA: vcDNA=SeqID_52352; Strand=+; Position=1-153
MVNTKNGHGISHMVVFFCLVLTIGCWPSNGGWTPFGFVHLGGLGLKNADLL

SEQ ID NO: 125930 - protein, 321 aa, Heterodera glycines
  Coding regions on vcDNA: vcDNA=SeqID_52353; Strand=-; Position=1-966
MEGQIRNDKRARDESQSKEPVRSQRRLKARDPLDEQLKRRKKGQQAEENPGRIKLAPASPGYRRTINYSLFTRCEPGVKRHEGCQRNCTMGSLSHGRLTKIPQAESKAVCLAQAFAFDWLGRMHAKKFNENWCALLGSGSEIEDSLKNWWTKVLQNNEKTIPQKQLECVLTAWDNSCQVFGQEWKGKIYGPVGLEDVPMKTNVISAEEQFENWLRNLTERFGQTLTKLRAKEYWKDCHLQSKRVLVVSNQEAAELVAKEFVEEGSSWFVHFGDKPLREKMFPANWNIKIIFNRDDNADHVIDHTVATNGDQRTSHSAGTKR

SEQ ID NO: 125931 - protein, 67 aa, Heterodera glycines
  Coding regions on vcDNA: vcDNA=SeqID_52354; Strand=+; Position=1-350
ETGNFKFADPVAGLEFKIFYRTGSGRINPANPAILQILHLKSAGSCAGLRILGNFKKFCINKKSFKV

SEQ ID NO: 125932 - protein, 116 aa, Heterodera glycines
  Coding regions on vcDNA: vcDNA=SeqID_52355; Strand=+; Position=1 -153,372-569
MAIKYGQQIAKYGHKIAKISKYGHKFFQIDGIICQYFFKFVKYICSKIFKMVKKANLSVGGRSVRGFLEKCQNMGIKYGHKCQNMEKYGNMDINCQIWRNMENMDIEIRPRGFKLS

SEQ ID NO: 125933 - protein, 182 aa, Heterodera glycines
  Coding regions on vcDNA: vcDNA=SeqID_52356; Strand=-; Position=1 -530,805-823
MDYFPTEVVDLCYFEGETEIPQQINRPLRQDDTDPGGDRNLREFSEPPVARGQTQLTTDQNWTEQRETPNSQNSDFGLSQNEGSGSLSSIPTIYIIFSIFLVQNVMAIADSLECPFTHSKKEKGEITSRVFNKITKSSSSSTEGELSDASFSQMTRFSFVKGESKEIRWIWWTRYGRIFHCF

SEQ ID NO: 125934 - protein, 204 aa, Heterodera glycines
  Coding regions on vcDNA: vcDNA=SeqID_52357; Strand=-; Position=1 -354,483-743
  Homolog annotation: Hit_ID=EAA16908.1; Match level="QueryCoverage =100%, HitCoverage=22%, E-value=5e-17, Identity=24%"; Hit description= Drosophila melanogaster CG8797 gene product-related [Plasmodium yoelii yoelii]
MRTFQGEQQQQQKQKLEQGNSRTFQGEQQQKLEQDSMRTFQGEQQQKMEQDSMRTFQGEQQHQQKEQHEIQQFEQQENKQQEPSLALERARLEELRIKERARVAKLEAERQARLVEIQARERQAKLEAEMRVRNVENRVRQAKLEAEARANQAILEAKVRQAERRARLGHGGGFADASEELQKDEQQAQQRQQQQLLEQPVDVV

SEQ ID NO: 125935 - protein, 107 aa, Heterodera glycines
  Coding regions on vcDNA: vcDNA=SeqID_52358; Strand=+; Position=1-324
MPDAEQRVPVPCTRFVRTKRAEVFTRRGTKLYQPVYTKGLVVALDEREAGGGAGNAYFTRPFGWYDDDDDADRDDAEEEEAEDGELLDESDTDDDDDDDDVDFLVLG

SEQ ID NO: 125936 - protein, 240 aa, Heterodera glycines
  Coding regions on vcDNA: vcDNA=SeqID_52359; Strand=-; Position=1 -468,523-777
MDSFGNVAWILRPTAQTTGTAVGSMEYEEEENGTAKLVHSDTATVTTPTTAEFRLEKEAPSSEKDGAEEGSGGHGALLFIESDDGEEEEEEDEDIEDTPVATDSPSAATATVVDDSSDTVKGVEQRSSEHSDMTNGTGGGGGSEGAKLLGGGEEEEPVRMPLLNYLCAFNDCSMKELQLLFHSVHARQRMVSHLQQHCRLHTAYLKPAERNIALHCHDLSVQNANRTFACGGYLELTVSR

SEQ ID NO: 125937 - protein, 373 aa, Heterodera glycines
  Coding regions on vcDNA: vcDNA=SeqID_52360; Strand=+; Position=1 -666,785-1240
MFKHPFTMCVAGCTGSGKSQWVDRLLSHIDLMVSEGPITGVLYCYGEVNDNVLRLQRMENTATTSSDSNTTEGKHSIRMCHGAPEERDVEREARATGGRLLLVLDDLMSGGLRCSFLDTVFTRGSHNWGVSVVLITQHLFTRELRIARNNCHYMVLMRNPAGALQIRNLGAQLFPGGALRYFLEAYEDATAEPFGYLLVDMHPTTEQQLRLKTHIYPGEMCVKRTEGSGEERRPSSRKLAPSRPPVLSEHVRRHIDFFRQLKAARSSPTRCQALVAGASSEQLLCLVESALNILRARVPIQRRHLDRLRQRASDVRTLSRVRSTRSARRLLLNAHAPSTAQTGRGIPPLVGLLASVLVPVLVQRVFETTSSSS

SEQ ID NO: 125938 - protein, 745 aa, Heterodera glycines
  Coding regions on vcDNA: vcDNA=SeqID_52361; Strand=+; Position=1 -1000,1060-2297
  Homolog annotation: Hit_ID=NP_502797.1; Match level="QueryCoverage =53%, HitCoverage=99%, E-value=8e-45, Identity=31%"; Hit description =HASI (4P602) [Caenorhabditis elegans] emb|CAB16520.1| Hypothetical protein Y57G11C.19 [Caenorhabditis ele
MTLKHTVRMLLIPEDVYRRLMDNPSAAAATSSTTCMNKLPTPATPIEHTARKMVAASSKHTNDDERLIHYQQEFKRYQKLLEDEAERPLNVQLSQRTTNALRDTVLQKASPATATPPPARPQRTTPLSRRRGLQHQNQAPSASSSSSTRPAKSSSSNEQQQPLPQQTAAPQKIGDLPKQAEPRIHAAMAYAQQNPGLLGVGGEDGQQILHLAQGAYRPIRGSNLDTLLRYHFVGRHQQQQPRSSTTTPTASVAKAPPGYKTFVNNARDDLQMWRLLFPDERAAAAGSDSASTVGGQPRRHQPLRGQKKTGAGRFSLSRLLQPNHHHAHKSVQKTSIMVIGSNAVRSLTVESLLDPIYKDERSPACFTSVEPLLREAKRRHPDARLTRAEISRYLASQRVYTLHRQVRRRFRRLPTLASGLHTDWQADLADFQRLRAQNRGYAYLLVCIDTLSRQVYVKPVKSKRSDDMIAALKRTFARCGYTPWRLLTDKGREFTASAVQRYLRDEAEVRHHCMETSPLWHAGMAERANRSIKERLYRYFTHRGTQCWTRVIQRIVSSLNASPNSSIFGMRPNEVCFDNAESLRQRIADRAEAERGGRASQHARFRPGDHVRIERARGAFRKGYLPRFTDEVFTVDRVCTGRRPITYKLRDMDGEPITGLFYANDMCLVLVPPSLDDSSIRSRGSIDKRKTRKRLPGGIDNNNKVYAIERILERRYRKDGTECCLVKWKGYSTRHNSWIPAHTII

SEQ ID NO: 125939 - protein, 161 aa, Heterodera glycines
  Coding regions on vcDNA: vcDNA=SeqID_52362; Strand=-; Position=1 -118,166-533
  Homolog annotation: Hit_ID=CAE62990.1; Match level="QueryCoverage =98%, HitCoverage=21%, E-value=4e-45, Identity=61%"; Hit description =Hypothetical protein CBG07219 [Caenorhabditis briggsae]
MVVCVINGMTSILAGFAIFSVLGHLSESAKKPIAEIVKPGVGLAFLAYPEVASNLPFKQIWAFLFFLMITILGLDSQAFKNHFCNLFFRNLQVCMVEGLFTALEDTFPTLLLKHKKVKVFKVFFYVFIKLSLLVACIIFFIIGIPMVTYAGAHWLTLVNYN

SEQ ID NO: 125940 - protein, 325 aa, Heterodera glycines
  misc_feature (11)..(12): Xaa can be any naturally occurring amino acid
  misc_feature (323)..(324): Xaa can be any naturally occurring amino acid
  Coding regions on vcDNA: vcDNA=SeqID_52363; Strand=-; Position=1 -52,2844-2891,2945-2989,3047-3139,3188-3226,3302-3412,3470-3605,3861 -3993,4829-4983
  Homolog annotation: Hit_ID=CAE62990.1; Match level="QueryCoverage =97%, HitCoverage=44%, E-value=3e-96, Identity=57%"; Hit description =Hypothetical protein CBG07219 [Caenorhabditis briggsae]
SEEIVAKSQKXXHNFQPRFDFLMSMIAYAVGLGNVWRFPYLCNVWRFPYLCYKNGGGSFLVVYALFFTFGAVSFLVVYALFFTFGAVPIFIMEVTIGQYLQKGAMEMWKMCAMEMWKMCPIFKGVGIGNVVISFVGIGNVVISFMCIAYFCVIVSWAVFYMISSFNSPFPWETCNNWWNNGQCVSETCNNWWNNGQCVSGKENETDIQQLSSNLSVYGLTIESSVEQFWERRVLKQTASIDDIGGIQWELLGLMFLAWVVVYFALWKGITQARKFVYFCALFPYFLILVLLIRGLTLEGAGKGIIFYLKPNITKVTDTTGPYXXL

SEQ ID NO: 125941 - protein, 46 aa, Heterodera glycines
  Coding regions on vcDNA: vcDNA=SeqID_52364; Strand=+; Position=1 -91,1088-1137
MNEGRAKCEGHGHYLYTPPVVREKRNVIEKSNYFGFFGLKNPSPTH

SEQ ID NO: 125942 - protein, 46 aa, Heterodera glycines
  Coding regions on vcDNA: vcDNA=SeqID_52365; Strand=-; Position=1-140
MSGIYLIPFLSRGIKKKDIHFHVKAFIAIGVSDTHRLKVEELVNNP

SEQ ID NO: 125943 - protein, 220 aa, Heterodera glycines
  Coding regions on vcDNA: vcDNA=SeqID_52366; Strand=-; Position=1 -85,403-604,649-732,1116-1389
  Homolog annotation: Hit_ID=NP_503148.1; Match level="QueryCoverage =91%, HitCoverage=56%, E-value=7e-71, Identity=63%"; Hit description =PRP38 family (5A653) [Caenorhabditis elegans] gb|AAK72068.1| Hypothetical protein Y108G3AL.2 [Caenorhabdi
ISFFQVKHLEPWERGTRRTTGMTGMCGGVRGVGAGGVISTAFCLLYKLFTLRVTRKQLVAMINSRQSIYLRGIGFMYIRYTQKPADLWAWMEPYLDDDAEIDPRSDDDAEIDPRSGGGDTMQMGQLVRMMLTKLDFYGTLFPRIPVPIQKDIESKFGERAKLYGYEDERYGGGTRRRAESRKKGSKEKEREQRRSRSREKRGKSRRDRNRRSRDRNRWAN

SEQ ID NO: 125944 - protein, 202 aa, Heterodera glycines
  Coding regions on vcDNA: vcDNA=SeqID_52367; Strand=+; Position=1 -491,585-699
MKFAKKMLIIPEAEYLALRSAMNSGDYLQNEKASLDAKISQNLQDPGISEDLKAKRHDWLYKERRTVKGILENRPQKVVIENHVPGPNVAPYLGLNNQSKPQETDEPRKIIIPRKRLKEQTPDLESDNDTLEELSPEPQTTSTLKTPIPIKTIIHPTLLNGLFRDVLLYLAGKKDETPRGAKFLKDRLLKDPTVKDMVDKSK

SEQ ID NO: 125945 - protein, 113 aa, Heterodera glycines
  Coding regions on vcDNA: vcDNA=SeqID_52368; Strand=+; Position=1 -159,587-769
MDPSAVSSSSSTDQQQNAEEAQKGDLTLAQQIAEDKQKMFERSQQYQQEIEDEELAGVYSDIRRIRGDGNCFYRAVLTAQLERCFEDAEELKRLEMADNSSRTSLVLFKKHLF

SEQ ID NO: 125946 - protein, 125 aa, Heterodera glycines
  Coding regions on vcDNA: vcDNA=SeqID_52369; Strand=-; Position=1 -230,310-372,422-505
  Homolog annotation: Hit_ID=1UUX; Match level="QueryCoverage=95%, HitCoverage=73%, E-value=3e-20, Identity=46%"; Hit description=Chain A, Structure Of A Molybdopterin-Bound Cnx1g Domain Links Molybdenum And Copper Metabolism
MDFAVLVVSDSSDKDHKMDKSGPLLVELLQNSLLIRRGQKVTVANYTIVPDEKSKIVEYLREYSTKVDCILTSGGTGFSKRDVTPEATKEVIERECPGIAVALLKKGLDITPFAALTRLTAGGLK

SEQ ID NO: 125947 - protein, 20 aa, Heterodera glycines
  Coding regions on vcDNA: vcDNA=SeqID_52370; Strand=-; Position=1-61
DYFSKHLLDWGIIGDCGINR

SEQ ID NO: 125948 - protein, 120 aa, Heterodera glycines
  Coding regions on vcDNA: vcDNA=SeqID_52371; Strand=-; Position=1 -43,548-699,1183-1267,1311-1393
  Homolog annotation: Hit_ID=NP_501890.1; Match level="QueryCoverage =77%, HitCoverage=9%, E-value=2e-33, Identity=53%"; Hit description =predicted CDS, AMOP domain containing protein family member (4L60) [Caenorhabditis elegans] emb|CAA94300.1
MVSLTIINLKNTFCNINNAQISVNGYLGFATVLDQGPTINVGPDSTDWPRVQDPAMIAPYLCKQQACPSTAGSYVRCDANSDYFLDEMMRWLQEGVAGASAFRADAAMVFIFCIFFYCFH

SEQ ID NO: 125949 - protein, 19 aa, Heterodera glycines
  Coding regions on vcDNA: vcDNA=SeqID_52372; Strand=+; Position=1 -55,166-170
MSIIFLSNRKYLELRKISK

SEQ ID NO: 125950 - protein, 445 aa, Heterodera glycines
  Coding regions on vcDNA: vcDNA=SeqID_52373; Strand=+; Position=1-1335
  Homolog annotation: Hit_ID=NP_494149.1; Match level="QueryCoverage =98%, HitCoverage=28%, E-value=6e-94, Identity=42%"; Hit description =predicted CDS, putative protein of ancient origin (2C297) [Caenorhabditis elegans] gb|AAF39854.1| Hypothe
MNLALNPENGDEPAYGQIFIVDAEQAMRSMRQGNVDVDPQLLITVYEVIRNMNVFAEAYMMMKDEEEEEAERARNEMREPTEIKLLFDTGRQLDRRLGYNVPRANEVAAVYVPGADGEVPNAKIVIRERGKELKILKSTDSMVTPMTYPLFYPRGTLGWNPEMKHRNSNRRVTRLQYVCYTLAIREREFNPILYGGKLFQQYCVDEYVKIEGDRMNWIKCNQKKILADAYKNVDNMLMRRAQERGLPLGRKVILPPSMTNSPRYVEKHFQDAMAVVRRFGKPDMFLTMTCNPQWEEISENLFHEQKSSDRPDLVVRVFNLKVKAIMNEIVKKKVFGEVIAWMYPVENQGRGLPHIHLLLTLAEQDKLINGEDVEKKGISARIPDKEHEYGLFDLVKRFMIHGPCGNLNPNCPCMEEFVDKNGIKGRKCSKGYPKAFQEETVVLKM

SEQ ID NO: 125951 - protein, 49 aa, Heterodera glycines
  Coding regions on vcDNA: vcDNA=SeqID_52374; Strand=+; Position=1 -54,690-785
MFFRRFFRLDKYANGRPFQILKNLFPYFAILVHILWPYFAILYPYFWTP

SEQ ID NO: 125952 - protein, 39 aa, Heterodera glycines
  Coding regions on vcDNA: vcDNA=SeqID_52375; Strand=+; Position=1-118
LRVTRAEPLVLEAEIELGSKHLNEGGTMHGGFVATLVDI

SEQ ID NO: 125953 - protein, 42 aa, Heterodera glycines
  Coding regions on vcDNA: vcDNA=SeqID_52376; Strand=+; Position=1-127
MARKDFRFHIFGVGIPTSEIFDEKSEIFLIFFFKKLASFVQF

SEQ ID NO: 125954 - protein, 52 aa, Heterodera glycines
  Coding regions on vcDNA: vcDNA=SeqID_52377; Strand=-; Position=1 -148,791-801
MLRHHLVVPSVPTDWARDGEEAEAEEHLKSSPTDQEGLRWAKRGSYPYKSAH

SEQ ID NO: 125955 - protein, 154 aa, Heterodera glycines
  Coding regions on vcDNA: vcDNA=SeqID_52378; Strand=+; Position=1 -127,171-242,325-444,1263-1331
  Homolog annotation: Hit_ID=CAE65910.1; Match level="QueryCoverage =85%, HitCoverage=17%, E-value=8e-32, Identity=55%"; Hit description =Hypothetical protein CBG11077 [Caenorhabditis briggsae]
VILAPSVLSPWVLSPAAPVPYILSPYVFGPFILSPMAMAPFILTPYVLSPNVLNPFALSPLTPYVLSPNVLNPFALSPLILSPTVLSPDILVLSPDILSPQILGGGILSPTVGSPAVLTESALMASVLSPSFQPNTQIISRMSETREFLQMDEC

SEQ ID NO: 125956 - protein, 469 aa, Heterodera glycines
  misc_feature (457)..(457): Xaa can be any naturally occurring amino acid
  Coding regions on vcDNA: vcDNA=SeqID_52379; Strand=+; Position=1 -248,441-537,603-782,870-990,1049-1170,1342-1466,1521-1727,1852-2146
  Homolog annotation: Hit_ID=AAH86735.1; Match level="QueryCoverage =91%, HitCoverage=52%, E-value=7e-73, Identity=36%"; Hit description =Zgc:101763 [Danio rerio] ref|NP_001008625.1| zgc:101763 [Danio rerio]
MRLRLRLSPWSFRGAVPGVVWVGADEVFSVSDDHSLCRWTVSKTEANFLSNALKECVLPPFPKSLFFHFRCHFQLHFPHFSQGKIHLITPAGKIERTIEAHQGAAILARWSTSEQNVGTGGEQNVGTGGEDGLLKMWSRNGMLRSMLAQLGKPIYAMDWNGNGTKLVYSAGEECFIKQMKAQNAPTKWRAHTGLVLCLSWSAVTDLIASGGEDCRYRLWDGQGRPLWSSASHGHPLCSVSWSRPLWSSASHGHPLCSVSWSPSGETFAIGSYNLLRLCDKSGWSHSLERPASGTIYSLNWSADGVQLIGGCANGQILHAHVVERRVRVVWAPLAAVQARVVLRGLSSVVARRLVPRVGVVRFVFGFSLVVAALSLCVFGSLPAFGSFFSFRGGFSVPSRCFLLVGGSAVRVFCFVGRFLGSLFPPSAAGGLAVSVASSALLVLRPSSLKDLFAGAPXGKTHNVSGGAGA

SEQ ID NO: 125957 - protein, 238 aa, Heterodera glycines
  Coding regions on vcDNA: vcDNA=SeqID_52380; Strand=+; Position=1 -204,512-556,603-692,797-969,1009-1213
  Homolog annotation: Hit_ID=NP_508106.1; Match level="QueryCoverage =70%, HitCoverage=22%, E-value=8e-37, Identity=43%"; Hit description =abnormal CHEmotaxis CHE-2, WD40 protein required for sensory cilia formation and chemotaxis (84.9 kD) (ch
MCGTFAERRVAFVDQKGDCFLALVSCYGSAQRTAKIGSLISCLSANNLTNMLAALQENQRLLVWTLPTLAQWEQAVRICRTTNEEFLWATLAGLACIEKNYQIAEMCYGQLEEMEKVLFLSELRSQNVPQLRDAKVAQFSGQRREADMLLVNAGRTFEALMLNLGTFRFDRALELATKMGRHLDTVLGYRQRYLELTGRKETDQRYLKHLSEVEIDWTHIFEKIQEDEAKANQQNKSP

SEQ ID NO: 125958 - protein, 258 aa, Heterodera glycines
  misc_feature (7)..(7): Xaa can be any naturally occurring amino acid
  Coding regions on vcDNA: vcDNA=SeqID_52381; Strand=-; Position=1 -44,193-341,398-502,750-892,954-1043,1735-1895
  Homolog annotation: Hit_ID=NP_508515.1; Match level="QueryCoverage =98%, HitCoverage=75%, E-value=7e-42, Identity=40%"; Hit description =MIP family (XD645) [Caenorhabditis elegans] pir||T16635 hypothetical protein M02F4.8 - Caenorhabditis ele
TVNGLLXVFPISTYAPSKGGHLNPAVSLAFVSLGKLPFAHFLLYSLVQTVGAFFGSALCFHVYRESFEKFDAGIRTVGGPSSFEKFDAGIRTVGGPSGTGAIFCSFPDEHIGHYTAFVDEIVGTALLLFFVNALIDPRNQVPKWVHPIGFGLAIFLITSSFGMNVGSPINPARDFNVGSPINPARDFGPRLFLLFAGYGWEAIASYYFRIFLRMFNFKCHFSSFSRRFVVGWPLPRPLGSSQKCVSSQFPPPKDASNI

SEQ ID NO: 125959 - protein, 107 aa, Heterodera glycines
  Coding regions on vcDNA: vcDNA=SeqID_52382; Strand=+; Position=1 -116,322-431,594-648,706-748
MDREPDPAWEIAHEKLNKKLFLTGPVRVPDQALLVPRKCWICTDIWLDTLPFTPTTTPTTTTTSVKQYLFGIDIGSKKFEKPCEKNCFLASELIAKVVEAIDSEEKK

SEQ ID NO: 125960 - protein, 150 aa, Heterodera glycines
  Coding regions on vcDNA: vcDNA=SeqID_52383; Strand=-; Position=1-453
MCKNEVHNKYNSGKFSSAKTQFKKKTANVVTENCKVVSVAQADCNLVSVPPQMIALQVHKKTANFELDTGADVTLLSYEDWENIGHPKLDNYKCPTVLMAFGGIPIKGVIGSFKVCVAYKKQKMEATIYVFKGTRRNLCGRDLIKGLQID

SEQ ID NO: 125961 - protein, 179 aa, Heterodera glycines
  Coding regions on vcDNA: vcDNA=SeqID_52384; Strand=-; Position=1-540
FLTDWHKWLNNATSGGKSRKRPWCLFPRDEMSWYTWEERFEFFIKLRGITDESTKKLLLFTEIGAIYEELRMMAQPDDVRTLPFSEIVKLMKERFGESKTLAAKRHELFSATQSSGMSIRDFAIQLRSLIAKAEWDRNSIEMCLCALFINGISSDMVRTELIKGKAMAFKDAVETAVLL

SEQ ID NO: 125962 - protein, 170 aa, Heterodera glycines
  Coding regions on vcDNA: vcDNA=SeqID_52385; Strand=-; Position=1-513
MTGSSARVVPADKLKADPISVPIERMIRVPPGIPNNSILPKGKAKFKNLIGLICVSEEIKNGEINFENETDKEVVYSLGTMNFSGADGKEAAKCDEYCLGDGTCFWTTICSGEGHEHCTQLVVADFDAVLNRKIGIGAKEVTTPLQALFCAFLLKKFGSTTASRRLVDRP

SEQ ID NO: 125963 - protein, 222 aa, Heterodera glycines
  Coding regions on vcDNA: vcDNA=SeqID_52386; Strand=-; Position=1 -432,895-1131
  Homolog annotation: Hit_ID=CAG07457.1; Match level="QueryCoverage =31%, HitCoverage=33%, E-value=4e-17, Identity=59%"; Hit description =unnamed protein product [Tetraodon nigroviridis]
MTIFSSQHSFVNWTFKTDDGSDAMDSDDEDQSDEDANRRADALTREQEKQFWSIVPVEQLKTEDGNSQSSDKPSTSYAASQAGLPPSQKKNQASSSSMRHPNVCLDDSSMPCSICLSDMREECDDDVVVQLSLCSHLFHKECIKDGHIRPGQPYSSTTRIAYLPNNAEGTLVLKMLQLAFTRRLIFTIGDSVTTGRKNVPVWNNIHHKTNKKGGPQKCAFVI

SEQ ID NO: 125964 - protein, 169 aa, Heterodera glycines
  Coding regions on vcDNA: vcDNA=SeqID_52387; Strand=-; Position=1-510
  Homolog annotation: Hit_ID=AAG37039.1; Match level="QueryCoverage =91%, HitCoverage=11%, E-value=9e-12, Identity=28%"; Hit description =polyprotein [Dictyostelium discoideum]
MEALKAKISLKEILEEQRKVKELSKIFNILKTGKFPEGEPKWRKIIENYGLINDAIYYKKGKTNSENPKLIIPYPLRERIFRIFHNEGHFGFEKTWPEIKNRFYWDGIKEDIKLLNETCEFCQKRKIFPGQVKAAPSVPIKSTEGPFQRIHCDLMGPLKKPKKEISTFS

SEQ ID NO: 125965 - protein, 210 aa, Heterodera glycines
  Coding regions on vcDNA: vcDNA=SeqID_52388; Strand=+; Position=1 -372,835-1095
MDLYLDFDDVYDNNGIVQSIWSVFAREFWPIFAPNIRHLTVPIGHQLDDLRHHISPRIFTDCNQLDSIDSDSRLLDAIGDDGPNATVGQALSKWLRIPTTNGQPKQFRDDESSETNEWVNNFKKEFLRANTSSASYIIQFKTYTTSVAQFELVNERTNEMLTLKAEDDVVYTHINCELKRCQIGQTIQWEDKKTDNLNNVDISLHGNCIG

SEQ ID NO: 125966 - protein, 340 aa, Heterodera glycines
  Coding regions on vcDNA: vcDNA=SeqID_52389; Strand=-; Position=1 -734,1103-1391
  Homolog annotation: Hit_ID=CAA33463.1; Match level="QueryCoverage =100%, HitCoverage=77%, E-value=1e-108, Identity=36%"; Hit description=twitchin [Caenorhabditis elegans]
RAGETITFTLPYSSGGLKPNVDVLNNGKTIFEDDRTTIEVEDDKIVFTTRDSKRNDAGPYKVVAQNRHGKDSAKLNVNVLDVPGKPSGPILFSELAADACTLHWSPPKDDGGSPLTNYVVERKSARGGDWERVGAPAGLSLRVRGLTSGERYEFRVCAENQFGVGEPLDAEDPLLAKAPFDVPGPPGAPEPLHTAYDSITLQWARPLRDGGAPITGYVLEKREHGTNAPWEKAAFGNVPDTRCKVTGVKPQHTYEFRVAAVNAAGQGEWSENSVPIVAAPSACKPLITMGMLARDMTVLVGEPAKLLVPYAASPRPEITWSKNGVPVEVRADPRAEVESS

SEQ ID NO: 125967 - protein, 62 aa, Heterodera glycines
  Coding regions on vcDNA: vcDNA=SeqID_52390; Strand=-; Position=1-186
MENPDANSSTIHQLNGVGLGGQNGRHRSSDWRYKIRNQMAEREGRDGVNSSVGFSAARRHIR

SEQ ID NO: 125968 - protein, 62 aa, Heterodera glycines
  Coding regions on vcDNA: vcDNA=SeqID_52391; Strand=+; Position=1 -40,764-912
MTFPNSYKIGPSANCDAKIKVCPHSQAINVFRSVTINPAVENIPRYLPFLLNNKKLDYIGEN

SEQ ID NO: 125969 - protein, 30 aa, Heterodera glycines
  Coding regions on vcDNA: vcDNA=SeqID_52392; Strand=-; Position=1 -22,64-133
QRCAEPDKIRFRLNRRFRLWPKIRLIAIPI

SEQ ID NO: 125970 - protein, 51 aa, Heterodera glycines
  Coding regions on vcDNA: vcDNA=SeqID_52393; Strand=+; Position=1-155
LQIYWFKLHMRYISKFFDSVRRFDKDGFRFAISRSTFGNWSRIFSAITCNH

SEQ ID NO: 125971 - protein, 79 aa, Heterodera glycines
  Coding regions on vcDNA: vcDNA=SeqID_52394; Strand=+; Position=1 -131,373-481
MNPTFVFICICIRDRHFEKSLDLDLDSMLDLDLDFLDKNPGKSRFFPVLPGPGPGFFFTFDLDLDFLDKNPGKIQVAEK

SEQ ID NO: 125972 - protein, 68 aa, Heterodera glycines
  Coding regions on vcDNA: vcDNA=SeqID_52395; Strand=+; Position=1-207
MNPTFVFICICIRDRHFEKPGPGPGPGFHVGPGPGFPGQKSRKIQVQEKSRLLETWIQAWTWIFLNSF

SEQ ID NO: 125973 - protein, 58 aa, Heterodera glycines
  Coding regions on vcDNA: vcDNA=SeqID_52396; Strand=+; Position=1 -44,480-569,1229-1271
MTWTWIQEKSRPGSSFVRLADPQNVQATKCPSLEFEFFIIRMGLRLENLSAFCKANRA

SEQ ID NO: 125974 - protein, 51 aa, Heterodera glycines
  Coding regions on vcDNA: vcDNA=SeqID_52397; Strand=+; Position=1-157
LHVIAEKIRDQFPNVDRLIAKRKPSLSKRLTESKNFGNVSHMQFQPINLKE

SEQ ID NO: 125975 - protein, 282 aa, Heterodera glycines
  Coding regions on vcDNA: vcDNA=SeqID_52398; Strand=-; Position=1 -236,349-473,846-1194,1319-1457
MDFVKTLQNIVSVDQRLKLQEFEQRQNSFWKEKNIAFSELLFSLAIRLCVQIEQQNDQIIGNYLKAFTFAYRTGFKIHRNGIPRHQKISEVEIPTPKMLEVGTRNSVPSLLCTGHSKLHLGNYEFLLILTKPAYSPTVYEVIKMVQILDQMDSDGEYILEELDYLKIFNHVLNFLLTNERISKSPNQIRNKFAFLAYFVEDLLQEIETTNYLLNNEAIKMLIKRFREKQRQLCAKSTFYCSLNPNFVLIYENKKDAYMKYFGENYVNFVKAIKIDFNSDKGC

SEQ ID NO: 125976 - protein, 149 aa, Heterodera glycines
  Coding regions on vcDNA: vcDNA=SeqID_52399; Strand=-; Position=1 -305,599-743
  Homolog annotation: Hit_ID=CAG03377.1; Match level="QueryCoverage =91%, HitCoverage=8%, E-value=9e-09, Identity=33%"; Hit description =unnamed protein product [Tetraodon nigroviridis]
FEPSLPPPTAQQQQPSVFTAATAATAKTDHHHHQQQQQLQHLDILLQQQHIGTARGGGGTPAMRGGVGGAVQPSPPHQQQQQYMQQQQLLLMRAAAAEQQAMLQQQQQQRKHEQQKMAPPLTTVSAAAVALTPAALAIDDFRLIAVLGR

SEQ ID NO: 125977 - protein, 94 aa, Heterodera glycines
  Coding regions on vcDNA: vcDNA=SeqID_52400; Strand=-; Position=1 -157,486-560,640-692
MASSFSISVFISMIGLCCLFNESIGGDEYEYYNGLSEIHNVQPYSDYYPTSYDHRNWDHSSEIAYGQLPPAALGQSNGFIKYEGNRKLENKMIT

SEQ ID NO: 125978 - protein, 38 aa, Heterodera glycines
  Coding regions on vcDNA: vcDNA=SeqID_52401; Strand=+; Position=1 -39,179-256
MNNNIIAVAFVMNANRENFWLANDTKIVKLADKGKGYI

SEQ ID NO: 125979 - protein, 80 aa, Heterodera glycines
  Coding regions on vcDNA: vcDNA=SeqID_52402; Strand=+; Position=1 -170,224-296
MLLLLCRLLVLLLCWLLLLVVVLVVTKTKMQPPGVGYFMKNSAIGESFLLTTTFNWLSNSQFPPSSCRSGLQTLNWPKFG

SEQ ID NO: 125980 - protein, 53 aa, Heterodera glycines
  Coding regions on vcDNA: vcDNA=SeqID_52403; Strand=-; Position=1-159
MKGPFDWYIVSKMQKPIIVNIIALANLGTGIKLNSLTITECEFKYNPRKFNAA

SEQ ID NO: 125981 - protein, 84 aa, Heterodera glycines
  Coding regions on vcDNA: vcDNA=SeqID_52404; Strand=-; Position=1-252
MSSSTIAPISSADGTAGSAAAVASAGPSSVEPMPPVEQLMEGIEEKCPPSLDQRLNAMDEVDMRIDDLLTVVAEVMAGLDKDKP

SEQ ID NO: 125982 - protein, 87 aa, Heterodera glycines
  Coding regions on vcDNA: vcDNA=SeqID_52405; Strand=-; Position=1 -64,203-430
AYLFLSFAFINYMLFNTIFMIINHHPIRSVLILRPLFQHMGRSVVGTVRAPCATGQQHSAASPPPGRSSDALDVSKSYRCVRPAPGP

SEQ ID NO: 125983 - protein, 240 aa, Heterodera glycines
  Coding regions on vcDNA: vcDNA=SeqID_52406; Strand=-; Position=1 -579,711-854
MSAHSHVKERLFPAAAQPAPAIVQPAAAAVVPPAPVVVLPAAAEAPPADVEIELDIDGEQLTNFPAQQHPQQLFPAQQHPQQLFPAQQQQPQQLFPAQHQQQLLLPPRPMISQIVDNAVSVLQMHFHNMSPLRPAFPPFFINSPFPRLQGALELPSLQFGQQHAFAPPPAPALQIVPLDDAPAPQPLCDVLQTRRQFCLETAGREPRSARCPPALPLLHPPLPLPRPLFRSTPNETKESA

SEQ ID NO: 125984 - protein, 108 aa, Heterodera glycines
  Coding regions on vcDNA: vcDNA=SeqID_52407; Strand=-; Position=1 -258,307-375
MATSFLMSLIFCLLVPAPSPRHGLRDIAEEDDGSEEFEISAIMLYDHCACMLCGRIRFFYLIDYATPHVVTKWGGSYLKDENVLTHAGFCLGRLLTFVNTSPHGWQPA

SEQ ID NO: 125985 - protein, 141 aa, Heterodera glycines
  Coding regions on vcDNA: vcDNA=SeqID_52408; Strand=+; Position=1 -282,664-807
MQWIKFNCTLCPIGLQCFYPRKYAKPVLCAHPSVRNITDFLSTGQLGEAATTTTTTFPTTAETAAATECAPPPAHLTAWIAVCTALVALLVIAEAAGQRRADGAIEEGEEPVYDEVPLDSDIVVEMRDEENGEEEDEDSDF

SEQ ID NO: 125986 - protein, 105 aa, Heterodera glycines
  Coding regions on vcDNA: vcDNA=SeqID_52409; Strand=-; Position=1 -58,115-158,219-345
  Homolog annotation: Hit_ID=NP_997912.1; Match level="QueryCoverage =100%, HitCoverage=18%, E-value=3e-28, Identity=61%"; Hit description= Unknown (protein for MGC:77310) [Danio rerio] gb|AAH65339.1| Unknown (protein for MGC:77310) [Danio reri
LARIQYIHSKDFIHRDIKPDNFLMGLGKRGNNFLMGLGKRGNLVYIIDFGLAKRYRDQRTKQIIDFGLAKRYRDQRTKQHIPYRDHKNLTGTARYASINTHLGVD

SEQ ID NO: 125987 - protein, 80 aa, Heterodera glycines
  Coding regions on vcDNA: vcDNA=SeqID_52410; Strand=-; Position=1 -142,669-769
MMFWRNELCAVNPHIYWRLINEWPSDAILRPSSPGGKKTKKKKGRDDYFQPNGHPEFSFSCICLPEGYPKFSLIFILMGI

SEQ ID NO: 125988 - protein, 48 aa, Heterodera glycines
  Coding regions on vcDNA: vcDNA=SeqID_52411; Strand=+; Position=1 -3,368-511
MVLALCFALEFVVVKDLSSVWILDLEFDATAFEHFDLLWPRVGQITDY

SEQ ID NO: 125989 - protein, 543 aa, Heterodera glycines
  Coding regions on vcDNA: vcDNA=SeqID_52412; Strand=+; Position=1-1632
MDYNDLNVCDKKLMDGKILTNQAKLSDVGKVHDEVILLEDGVNRNLRTINRKVTNVSNRVVEIASDVNVGFNTVAKRVDTLGEIVTELDGKFSTWKNEIDTREQLEFDEMNKTQEAHGTVPFPFRRPPGSPRLNIPATPPANLALILQIQAPNRGNVNALTEVGTSGPQPGLFNGEIASAFDEWEIKFRDYIDVFGTNWNESEKLNRLKLHLGTQTRNIFENLLQNERNTLANALKNIRAKLDSPHFRELAYRKLAACYQKEGESVSDFIKRLVPLVNTTSAQIPPEAREEMMCRCLIEKVRPEFQRSLQLVGPLIGRKDFQKLTAYIQELEVSIERDVRNESFGIHALNTNPSQVPQGKFNTWGPSNPNNIQLGHKTFRNENRDQSDRRPNQFSQNNRYNQQRRDWGPQNDRRWNNRPVCHYCKRTGHVQYNCRIRQNDFNGQSDNRNQTRWQHRPQNSNRDNWSTNESKQLKDMVEDLAVQVHEMKMNNNYASARQQNIKALQMIHTNEEIQKIEPRKILNPKVFQVGRISKGNPKHFQAF

SEQ ID NO: 125990 - protein, 431 aa, Heterodera glycines
  Coding regions on vcDNA: vcDNA=SeqID_52413; Strand=+; Position=1 -421,912-1786
  Homolog annotation: Hit_ID=CAE73289.1; Match level="QueryCoverage =31%, HitCoverage=16%, E-value=5e-20, Identity=34%"; Hit description =Hypothetical protein CBG20708 [Caenorhabditis briggsae]
MEEKSEPENFDVSLDECRQMIKHKSCSFGNLKGITNFWQTENKIDLTPRFWLLGSFGWKNVSSENCFLLETRIDSHFGANSIVTPLRLSETHDCPYSKGYCILSDKTVLIWQIDTERKCNFIPIGNKNGKMMDKIWLSDDEIDQIEGKITSVSPNKLIHHEIKFGLNNLLPQIEAHAFHKLVLLNLTDIKDHAFVSNMVKLSQMTYQIHEKDTKITATISQEWEEVESQMIKAVIGDYRKMWLIIMSLIITILSIDLAIRLTIGLSEIYAGNGRLGNLLFGTTIQKAGKRVRKLRETKIQEEREIYEEPINQISWPPRIRRAGNSLRKSFTRPFKRNRHGPNPTQMSTHFELNSLMGQLGSLNNNTMTGTTFVSLNNFQMKCLVDTGSSTSVAPKALADYLGIKTFTSEAHLMSASGHPVHVKEAARVTLK

SEQ ID NO: 125991 - protein, 664 aa, Heterodera glycines
  Coding regions on vcDNA: vcDNA=SeqID_52414; Strand=+; Position=1 -36,261-2216
MSFAFSQSLRTFTLNREHFAFIDPTSMIVSPSSRKGTCEEFRKIIIQIEGQILEIDQIEGKITSVSPNKLNHHEVKFGFNNLLPQIEAHAFHKLVVLNLTDIKDHAFVSNMVKLSQMTYQIHEKDTKITTSISQEWEEVESQMVKAVIGDYRKIWLIIMSLILTILSIDLAIRLTIGLSEIYAGNGRLGNLLFGTTIQKAGKRVRKLRETKIQQEGEIYEEPINQISWPPRIRRAGNSLRKSFTRPFKRNRHGPNPTQMSTHFELNSLMGQLGSLNNNTMTGTTLVSLNNFQMKCLVDTGSSTSVAPKALADYLGIRTFKSEAHLMSASGHPVHVKEAARVTLKIGNEYVDIIIRLFDDELSWTMKDYNFILGCDALASLPPITFDFQNKCVIITNPTSTVKRIFKGTCLGNSNEVLKTENSTIFTEIEKEDSEYEFNALIEKEIKIAIVTAANLPLAKLVQELNDVFGSDEMEESGSVAFFSGYAKEKYKEMLEKLKRHLLISKISNEEIISKFETQDDVKEIETYCKNFEVRPRLTKERKVANLYSEVADLRIVFTTVSMAENLIHTALDGTTVLIFDEATQGSWVCLAHLVARMPKLEKVLVTGDQLQLGVHLQKLPPLLQSGFGLESMVDQLILSPTVVQTRLTTCYRMHPTLVKAVASA

SEQ ID NO: 125992 - protein, 140 aa, Heterodera glycines
  Coding regions on vcDNA: vcDNA=SeqID_52415; Strand=-; Position=1-420
MPKSSQKRCRMSPVLEDNDDIGIRLNRLEKLVSSLNPSINATIVERLDRLELLVQKLVNDNTKERSAGDSMSFSNSSPSVLWGQPPPHIGMVTQLVNNAVLDSEEIIAKSKRAVLEKVPEQIDAVKLVRKVATECGLMDE

SEQ ID NO: 125993 - protein, 48 aa, Heterodera glycines
  Coding regions on vcDNA: vcDNA=SeqID_52416; Strand=+; Position=1-239
VSNHRIGVKLKTIDINETNHTSQWGKYALLLNYFFCNFSEFFGVIYFH

SEQ ID NO: 125994 - protein, 50 aa, Heterodera glycines
  Coding regions on vcDNA: vcDNA=SeqID_52417; Strand=-; Position=1-253
MCAIAANCGRKQFLRCKSDFFLPKSMSTLVTQETCLYDFLIWIPTNVIQW

SEQ ID NO: 125995 - protein, 56 aa, Heterodera glycines
  Coding regions on vcDNA: vcDNA=SeqID_52418; Strand=-; Position=1-168
MVLEGTADEAGGNAAEEEEQREDGEEMDEEEEEAEEKVIIPTNGRDEERKRVTEKK

SEQ ID NO: 125996 - protein, 81 aa, Heterodera glycines
  Coding regions on vcDNA: vcDNA=SeqID_52419; Strand=-; Position=1-367
MLCRVIVFPLSFASFAFIKCQFPLPFPFLTFLCFLCCSFSFHFFRSFVSNHSFFDSMIDQMSFKSIETFLPILNLNCSNYK

SEQ ID NO: 125997 - protein, 39 aa, Heterodera glycines
  Coding regions on vcDNA: vcDNA=SeqID_52420; Strand=+; Position=1 -85,557-591
MAKKRSGRMKRKRKKGKKEQNQREEKGGDGYYSFVIGTI

SEQ ID NO: 125998 - protein, 19 aa, Heterodera glycines
  Coding regions on vcDNA: vcDNA=SeqID_52421; Strand=-; Position=1-59
TFAFSSLALPNTHTIFEML

SEQ ID NO: 125999 - protein, 19 aa, Heterodera glycines
  Coding regions on vcDNA: vcDNA=SeqID_52422; Strand=-; Position=1-59
TFSFSSLALPNTHTIFEML

SEQ ID NO: 126000 - protein, 19 aa, Heterodera glycines
  Coding regions on vcDNA: vcDNA=SeqID_52423; Strand=-; Position=1-59
TFAFSSLALPNTHTIFEML

SEQ ID NO: 126001 - protein, 19 aa, Heterodera glycines
  Coding regions on vcDNA: vcDNA=SeqID_52424; Strand=-; Position=1-59
TFSFSSLALPNTHTIFEML

SEQ ID NO: 126002 - protein, 19 aa, Heterodera glycines
  Coding regions on vcDNA: vcDNA=SeqID_52425; Strand=-; Position=1-59
TFAFSSLALPNTHTIFEML

SEQ ID NO: 126003 - protein, 19 aa, Heterodera glycines
  Coding regions on vcDNA: vcDNA=SeqID_52426; Strand=-; Position=1-59
TFAFSSLALPNTHTIFEML

SEQ ID NO: 126004 - protein, 173 aa, Heterodera glycines
  Coding regions on vcDNA: vcDNA=SeqID_52427; Strand=+; Position=1-522
QRVAKELEELAGICETIAETKGKRESAKTEKEEKKRDEKSTKARKVEETQSNLKMVKRTTFEWQEVKIIKPIWMRRHSELEKSDDSFTNKMPPTAGAFQIQNLAFSSGTMKNLREGKKIGSSETGKKNGLMRIWRFDKYSVKVAGQIIVESAKWLKTWIFIKIPDKILLDYHI

SEQ ID NO: 126005 - protein, 92 aa, Heterodera glycines
  Coding regions on vcDNA: vcDNA=SeqID_52428; Strand=+; Position=1 -11,82-349
MNRRWICTDVWMDIFPSFDRPKLGLQMALLSFRFDVLVDKHFGGKSELTIWRPIVINKGIGPKAMLLVDWKPVALPDRPLPNKIRFKELWIL

SEQ ID NO: 126006 - protein, 487 aa, Heterodera glycines
  Coding regions on vcDNA: vcDNA=SeqID_52429; Strand=-; Position=1-1464
MAAPPIANTAKTDQQQQQQTTHTPQHFYHQNYFGRQISAQVGDNSVTSQAPALFIPMTKPNSSSSTTTAPQVQAVQQQTTTKQPEFVVFELFGQQKQQLNSSHRQLFNVHQQQQQQKFATKWTPFSPLMSLNSREAPSLSNNIKTETNVEESSAVAPTSSNGICFATVHLWPNHPSLGNNNSSSSNINIVSRHSKTPQQQRTNRLLFDNPMFRRLPNWHFFGDDRRLVPIPPLIPLLPVMPIERTLLYIAPNESSSRQLLLLAMLDMKRKKEIAGGMPAIGDGEADSESAETAAVAELLQQDDELLPVEQECPSSTSGVESMSSAEESGSALTERSSRSTTPTNKGGRSTPGEQQTEPKYQQNNAHAYEGDERQDGNEMEEYDEEDEMLRLGQQHNHLLRRQSPISSATESCTSSTPNSPPTFDRRIVRMSRGTRDAVRRLSRRFEEDREEEEAEEESGNCAAEDESDEHEFGKANGRKDEESVCAN

SEQ ID NO: 126007 - protein, 83 aa, Heterodera glycines
  misc_feature (52)..(52): Xaa can be any naturally occurring amino acid
  Coding regions on vcDNA: vcDNA=SeqID_52430; Strand=+; Position=1 -120,179-361,442-516
  Homolog annotation: Hit_ID=NP_509684.1; Match level="QueryCoverage =95%, HitCoverage=12%, E-value=2e-12, Identity=41%"; Hit description =predicted CDS, sorl mouse sortilin-related receptor like (XK654) [Caenorhabditis elegans] emb|CAA96700.1|
MADELLPPYNFTANILSPGKVRLEWRTPPLPSPSSVPFYIVNVRQLSANTGXSLPSPTLRVDGTHFLLGNLVAGENFEFTIRT

SEQ ID NO: 126008 - protein, 84 aa, Heterodera glycines
  Coding regions on vcDNA: vcDNA=SeqID_52431; Strand=-; Position=1 -162,664-756
MVIRRGTTVIRRGTTVIRRGTTVIRRGTTVIRRGTTVIRRGTTVIRRGAKLLKENPQSHRDSKVLTMSEVKSDHAFVISNPNNA

SEQ ID NO: 126009 - protein, 52 aa, Heterodera glycines
  Coding regions on vcDNA: vcDNA=SeqID_52432; Strand=+; Position=1-162
EGNSNVHAVAESLAVTRTEEFLFRFVEYIPLSCYLFVMEMKSFLSIIKEKNC

SEQ ID NO: 126010 - protein, 15 aa, Heterodera glycines
  Coding regions on vcDNA: vcDNA=SeqID_52433; Strand=-; Position=1 -37,125-135
MNIVVVIKTEGNGSP

SEQ ID NO: 126011 - protein, 53 aa, Heterodera glycines
  Coding regions on vcDNA: vcDNA=SeqID_52434; Strand=-; Position=1 -84,138-215
MIVSFLTQLKTYLRKHTISEFIEQKLKKKSLFFKNRTKDEGLDMKQGGSIGRN

SEQ ID NO: 126012 - protein, 150 aa, Heterodera glycines
  Coding regions on vcDNA: vcDNA=SeqID_52435; Strand=-; Position=1 -156,388-544,909-1040,1178-1185
MMERLRGGVPEATTAKFVPPSAPAALQQQQQHFADNNTHNNNGTVVLAQQQQVPLNFGSLSNLSSSSSSSSSAPPSSSAPPQQQIKTELIKKSSSENATADECEAQQTQFVPTPSTTADELIGHALAHLVEQMDTDGTDATDDGHFQEAT

SEQ ID NO: 126013 - protein, 55 aa, Heterodera glycines
  Coding regions on vcDNA: vcDNA=SeqID_52436; Strand=-; Position=1 -54,184-297
MHKSLILTTVQNKSIVDEKIGVGVLFLPKSRTIYQKLKLKKLDVSEARSRSFVHP

SEQ ID NO: 126014 - protein, 32 aa, Heterodera glycines
  Coding regions on vcDNA: vcDNA=SeqID_52437; Strand=+; Position=1 -47,653-704
MGICLSLQLYIVHEQHKFMGIGTAPWIAFLQN

SEQ ID NO: 126015 - protein, 52 aa, Heterodera glycines
  Coding regions on vcDNA: vcDNA=SeqID_52438; Strand=+; Position=1 -94,147-214
LTSVRSVGMFKFVHFFCSLATFPLLISAISSNCFYLPHIVLNGGTYDEFNAS

SEQ ID NO: 126016 - protein, 165 aa, Heterodera glycines
  Coding regions on vcDNA: vcDNA=SeqID_52439; Strand=+; Position=1 -88,779-973,1134-1348
MVQYDPINKPVKNIITEKFNIFFNLLRFFGVNIDDFLALSAPPFIDGISFACPTFCRPFQSCGDGVAALAFRPIFGCRGLCATTQVNLLPMGINYCSRRQIGMLMCEVLFSLFDFPSPPQFDYAETDPMLREFRAALQNHPYQNSTESNDEDVLLENTFCNVLTI

SEQ ID NO: 126017 - protein, 42 aa, Heterodera glycines
  Coding regions on vcDNA: vcDNA=SeqID_52440; Strand=+; Position=1 -51,620-697
MTFNKAIALTVYNLLPPQSYLNHGLYGLLKALILNINLKRII

SEQ ID NO: 126018 - protein, 168 aa, Heterodera glycines
  Coding regions on vcDNA: vcDNA=SeqID_52441; Strand=-; Position=1 -396,445-554
  Homolog annotation: Hit_ID=NP_500013.1; Match level="QueryCoverage =70%, HitCoverage=9%, E-value=1e-17, Identity=33%"; Hit description =predicted CDS, polyprotein family member (4B673) [Caenorhabditis elegans] gb|AAC02594.1| Hypothetical prot
RRVVRHDNGRNTLRQLPLFLDLQTGALIRKTDGKVFACEMAKEREKAKTTEQDPNLELCLQKHKDVFSTHDYDLGECLIKCPPILTNSNVPERVKPYPVPEKYEKELKLHIGKMLEAGVIKESCTPWAHNVVPLNKITIPDPYPIPRMDKTILRVSGQKYYSTLDLLS

SEQ ID NO: 126019 - protein, 231 aa, Heterodera glycines
  Coding regions on vcDNA: vcDNA=SeqID_52442; Strand=-; Position=1 -88,240-367,439-918
MNIILHLLILNSAVDLLNSNNLEQTKILIGKLKNLFLKRDAKYSKMTNKPTTQANSAKLMQILKNYAFLKMNQFLAKLKKEEGQIQNFLSEKNDNKRKILKAIVNFFDEISKILTEFSSKNGKFAEKDYRMLSQLIETLLDKLSTINKNGWNNVEKNSKNLFKQFETPKIFAKAHQKRRVRRRDNEGIMPIGVIEVFLLLTTYCAITVLPLITAILLLIRLFFMFRNEKMN

SEQ ID NO: 126020 - protein, 435 aa, Heterodera glycines
  Coding regions on vcDNA: vcDNA=SeqID_52443; Strand=+; Position=1-1308
  Homolog annotation: Hit_ID=NP_912739.1; Match level="QueryCoverage =66%, HitCoverage=23%, E-value=2e-40, Identity=34%"; Hit description =unnamed protein product [Oryza sativa (japonica cultivar-group)]
MVYGQPSNAIELWNKYKDQMYNPQGIITPAQHKAAELEALADLDWRLHSCFNLSCVHFGLPDPPNSIAKNTDAAIEEFFFGDDDLNLPPGQPNLRPQPKAPPPLNSDQQKVFDAVLLAIQSNPRDPTVPRRFFIYGDGGTGKTFLFGQIIRRLRKAPYTYKVLATASTGCAAILLPYGKTAHSTFRLGREVSLDKLPSIPLESFFARRIREAQLIIIDEITMLHNTVIEVIDRVCKEMAIRQHKDLLFGGKTVIFSGDFKQSLPVVPHEGLTAQVTACFQTSPLFGQFTTMKLTINQRLGKGQQAYLQMCRQIGLGETGEHFWIPRQFLVKSKEELIDYVYPNFQQLLGNDKELLNRLILAPHIDTCDEVNDIMMANVPSHMREYLSTDKPLDDRPLDIDEIESEVAALNPRTDSGMPHTVSGLSRMRRRPLIIK

SEQ ID NO: 126021 - protein, 190 aa, Heterodera glycines
  Coding regions on vcDNA: vcDNA=SeqID_52444; Strand=+; Position=1 -3,221-511,658-792,961-1104
MPSGPPLLNYVCKSNGNSERRHISFLNQFDLQIVPTIPKDDDSIYYVETQCHNKGNEHQTFKSVTSGSIKIVLHKFACKSYDIMARKVPKNWTQQIELYKYAIRQIKDATELNVNIDNGYVYIFDYETLVRTNRRWRNAGPSSNVNLFDLNVEDYVASDYDKMEEEDRKETELNKARMDETDDDCFYYFN

SEQ ID NO: 126022 - protein, 27 aa, Heterodera glycines
  Coding regions on vcDNA: vcDNA=SeqID_52445; Strand=-; Position=1-83
IISLSTPNGHLKLSIFLFHKYFFRKCS

SEQ ID NO: 126023 - protein, 124 aa, Heterodera glycines
  Coding regions on vcDNA: vcDNA=SeqID_52446; Strand=+; Position=1 -151,193-413
MENSNQEIKTKRNKQKLEHEGALYVLHQLSDDGLRKYWRCEFFGPNDKCKGRLHTDIHGNVLKIIGSHTCDMSAAQVECQRRVTQLKRRAVETCEAPATIRAQVLHNTATPVLAAFPTKAATKK

SEQ ID NO: 126024 - protein, 1377 aa, Heterodera glycines
  Coding regions on vcDNA: vcDNA=SeqID_52447; Strand=+; Position=1-4133
  Homolog annotation: Hit_ID=NP_491240.1; Match level="QueryCoverage =74%, HitCoverage=78%, E-value=0.0, Identity=40%"; Hit description=zn- finger, CCHC type and RNA-directed DNA polymerase  and Integrase, catalytic domain containing protein fa
MANQNATIQQLIDTLTQQQQLVQQLLTHQTQNLAGQAIAPTTIPALPDIMAFEQNDDKSRVSEWISRFKFALDCAAPNAADGIKVKALMNKLSEAAFSEYSRSVLPSAVTDFNFDATVQRMEKLFARPQSVFIDRYECLKAVRSEGEDFRSFINRHRKLLADFKFSELNKEQFNCLMLLTALKSHSDSALRQRILAKLSADGTNITYDGVVEDLINFQATIVEAKAIEAPTNWRNVNAVNRPVKQNNAPKMQVAKVPENRQANKNCWRCGATDHWGSECRFIGAKCRKCKFTGHIERQCESVQQWRLKNKGKRFGNKRIGQLQIGMVNPKNDTDSLKTKIRFNKKPIQFALDTGSDVNVIDVDSHVEAGSPPIEKCTEIGRAFDGTPIRFIGKGFGTFEFGGILIENEPFYVAKRGSLNLLSRQTMGKFGFLDGIKQRISEHGINSCRATNQFEKHISELRKEFPTVFEDALGHYIKEKAHLELKGGAAPIYRKARPVPHHSKDVIERELDRLEGLGIIRKVEHLDWAAPILVVKKADGSARLCIDYSTGLNDALIDYQHPLPIPEDIFATLNGGQFFSQIDLKDAYFQVELDEDSKKLCGLSTHKGNFAMERLPFGVKSAPSIFQSIMDKMLAGLNFATAYLDDIIVASRSFSDHIQHLKDVFNRLQSYGFRVKMTKCSFFQEEIKYLGFVIDKNGRRPDASKIKAITEMPAPTNLSTLRSFLGMVNHYQQFVQNMRFVRKPLDDLLKKDAEWIWAENCRKAFDKLKEILTSNLLLTHYDPNLEIIVSADASEHGIGAVIAHRFPDGAIKAIAHASKSLNAAEKNYAQIEKEGLALIFAVQKFHKMIYGRKFVLQTDHKPLLAIFGNKKGIRQCSANRLIRWSLILLAYDFEIEYLNTKDFGHADALSRLIAKGSDDEDERVIASVTEESEMEDLLKLATKNLPIKFHDLVLATKNDALLKKVVQFVQKGWPNDKDLSKEEEIVRLFHRRMADLSILKDCLMYGERVVIPKIFQSKILHLFHKGHPGMKRMKQLARQYVFWPKMDQNIEQFVQNCEPCQAAAKAPVKSNLHSWPKSTEPWQRIHIDYAGPFYGKMFLIVVDSFSKYPEVFEMTTSSATATIDKLRYLFTRHGIPETIVSDNGTQFSSSEFAKFTAANGITHLFSAPYNPMSNGQAERFVDTFKRAFRKLKGEGMPNQEIIETFLITYRTTPNDSLPNSVSPAEMLLGRKPRTTFDLLKPPPFRPLIRDLAMEERFNKRFGTKSRKFEIGDKIFARHRSSEDWRPGVIKGCSGVIFEVKFMDGSKSRFHANQLRNRQNMNNGDEALAILNDAFALPLPPAQANEVPAADPPADDHEGNGLEDQGIVRSPLIADRNQR

SEQ ID NO: 126025 - protein, 33 aa, Heterodera glycines
  Coding regions on vcDNA: vcDNA=SeqID_52448; Strand=+; Position=1-100
LSPPPSSDIFICYFNLSSINIYLFVHSTFRGPN

SEQ ID NO: 126026 - protein, 21 aa, Heterodera glycines
  Coding regions on vcDNA: vcDNA=SeqID_52449; Strand=+; Position=1-63
FGPRGHLGPNPKIEKCAFLKI

SEQ ID NO: 126027 - protein, 194 aa, Heterodera glycines
  Coding regions on vcDNA: vcDNA=SeqID_52450; Strand=-; Position=1 -73,155-271,559-703,1222-1352,1845-1961
  Homolog annotation: Hit_ID=CAE72546.1; Match level="QueryCoverage =99%, HitCoverage=10%, E-value=5e-40, Identity=38%"; Hit description =Hypothetical protein CBG19730 [Caenorhabditis briggsae]
LIQELQATKSRLQTEASDQERQSEELESQLNQMGKRKAQALAQLEDAKRILEEEHQERMEVRPVSANVKALEHDIEQIREAIDEEVQGKEELLKQLSKAKAEAAQWRGKFEGEGLVAVDELEEERRRRMNRKLEISDHLAELNSKIAAVEKTNSKWQKKQETHERVLDDWRRQCDDLSAQIERTQEDCRRSTAD

SEQ ID NO: 126028 - protein, 74 aa, Heterodera glycines
  Coding regions on vcDNA: vcDNA=SeqID_52451; Strand=-; Position=1 -92,176-308
MTIKTEKQSNSIQKAKRICPGSDWMSSKQGKQMPKISAHLILTDKHGKRIFRLVSDVYDDFYNAYFCLFRGFCA

SEQ ID NO: 126029 - protein, 37 aa, Heterodera glycines
  Coding regions on vcDNA: vcDNA=SeqID_52452; Strand=-; Position=1-116
KGRARNYHHPFVICASYLIIYFALIIRFALLILFKWP

SEQ ID NO: 126030 - protein, 113 aa, Heterodera glycines
  Coding regions on vcDNA: vcDNA=SeqID_52453; Strand=-; Position=1 -218,279-402
MQMVPFEFLNEWTKEKLTMTKANENELDNSWIMKRCKIIGEKKEKQQQKKDDNWDNNCNNVSIWFFNANDCIGPLSPPPFAEESGQSITKGPSSADKMSDVQNNKINDQMQKK

SEQ ID NO: 126031 - protein, 28 aa, Heterodera glycines
  Coding regions on vcDNA: vcDNA=SeqID_52454; Strand=+; Position=1 -83,720-723
MIVDKKSFKSNILCRILLLEVTVQNVPL

SEQ ID NO: 126032 - protein, 54 aa, Heterodera glycines
  misc_feature (43)..(43): Xaa can be any naturally occurring amino acid
  Coding regions on vcDNA: vcDNA=SeqID_52455; Strand=-; Position=1 -92,142-211
  Homolog annotation: Hit_ID=NP_492072.1; Match level="QueryCoverage =96%, HitCoverage=14%, E-value=6e-14, Identity=67%"; Hit description =EATing: abnormal pharyngeal pumping EAT-11, G Protein, Beta subunit (eat-11) [Caenorhabditis elegans] emb
LCDQIDALAREAEELRQKLEQERHKLNDIPIQQAAERLELLSXIAIKQRRVLKG

SEQ ID NO: 126033 - protein, 221 aa, Heterodera glycines
  Coding regions on vcDNA: vcDNA=SeqID_52456; Strand=-; Position=1 -39,1071-1155,1202-1433,1573-1861
  Homolog annotation: Hit_ID=NP_871809.1; Match level="QueryCoverage =98%, HitCoverage=35%, E-value=3e-37, Identity=42%"; Hit description =carboxypeptidase activation peptide and zinc carboxypeptidase A metalloprotease  and metridin-like ShK to
PLESLPPQICTKSRPLSLRAVQALKRLYSTKYQVGSGADLLYEASGASEASGASHDFAKGSLNIPYSFLIELRPQNTLHSTGFLLPEAEIMDTAEETWEAVKVVADEVLQRFGQFGEERKAWNGRKEKKTMKRVPFSVSTAKPTQTVSSTTTTTTEATTTETTTTKATTITTTTTEEATKGTTKRKTTKIRGKGGEKKGKKSLAHKHTFKPNTTNNRTTAA

SEQ ID NO: 126034 - protein, 147 aa, Heterodera glycines
  Coding regions on vcDNA: vcDNA=SeqID_52457; Strand=+; Position=1-441
  Homolog annotation: Hit_ID=CAE59388.1; Match level="QueryCoverage =62%, HitCoverage=33%, E-value=1e-16, Identity=43%"; Hit description =Hypothetical protein CBG02745 [Caenorhabditis briggsae]
MKVYTATFLASSVSGISLLASLVLIANIYSDVQQIWQELDQQIAGFRAETDDLWVDMMKLGKKLRVRARRDAGYAGAESAPKANAPVGVAPSARKNESLHFQIVSLLFKLFLALVPVEMPLAFPQAALHPQAFRRAFKQTDREVPDA

SEQ ID NO: 126035 - protein, 125 aa, Heterodera glycines
  Coding regions on vcDNA: vcDNA=SeqID_52458; Strand=-; Position=1 -143,189-261,421-542,1130-1152
  Homolog annotation: Hit_ID=NP_871809.1; Match level="QueryCoverage =91%, HitCoverage=17%, E-value=7e-44, Identity=66%"; Hit description =carboxypeptidase activation peptide and zinc carboxypeptidase A metalloprotease  and metridin-like ShK to
WPSISPSFKNRMWRKNRRPAFCRQQYFNRICCSGVDLNRNFDWFWSTTGSSADTGSSADPCHETYHGPSAFSEPEARSVRDFLEDHSVKAFFTLHSYSQLWLIPYGHKRRNYPEDYTTLVRPPTI

SEQ ID NO: 126036 - protein, 179 aa, Heterodera glycines
  Coding regions on vcDNA: vcDNA=SeqID_52459; Strand=-; Position=1-540
MDTFLGMAFPTIRSELTPIDCTLINWLLATHCAHLQGVRQLSCLHRVGSSIGAELFMGRQKDDKRKTNERRNGKNGGRRKTELGKYIWSDQSTKSHCHVHFDLNKSGQKEEAIGGGKALAMIAEEETEMGRTEMGRTEKGRTDIPTPKSSLGSASSTSSSAAEGKEKDKTNDGVKRRKE

SEQ ID NO: 126037 - protein, 68 aa, Heterodera glycines
  Coding regions on vcDNA: vcDNA=SeqID_52460; Strand=+; Position=1 -80,362-488
MDFQMEPFQRSKRRKKPRKVEEETDKELIEHNQKERTSEWMISASKKNGEKAKHKQMEEEEEERRNII

SEQ ID NO: 126038 - protein, 179 aa, Heterodera glycines
  Coding regions on vcDNA: vcDNA=SeqID_52461; Strand=-; Position=1 -179,290-338,411-496,580-751
  Homolog annotation: Hit_ID=NP_493632.1; Match level="QueryCoverage =98%, HitCoverage=26%, E-value=4e-48, Identity=51%"; Hit description =putative membrane protein, family 8 (71.0 kD) (2A305) [Caenorhabditis elegans] gb|AAB70976.1| Hypothetica
MTITYSLSVSSSTFLGFFRLLLRWKGSIWKSIWPEFVCWLCTYYALSFSYRKLMRKNQQILFEDICMFFHAYSDYIPITFMLGPITFMLGFYVSAVFNRWNEMFTNLGWIDSPALLIATILRPALLIATILRGKSEEARIIRRNIVRYLVLVQAMVYRDISAPVKKRFPTMVSKGILKY

SEQ ID NO: 126039 - protein, 43 aa, Heterodera glycines
  Coding regions on vcDNA: vcDNA=SeqID_52462; Strand=-; Position=1 -87,364-408
MIKANRKKCRWKFDKVRRQKEGRTKEGRSRFFVRAEPAGRAET

SEQ ID NO: 126040 - protein, 79 aa, Heterodera glycines
  Coding regions on vcDNA: vcDNA=SeqID_52463; Strand=+; Position=1 -94,206-351
MVRICANFAILCLTFIVCPAEESKIPKVVLNACFAFWLLCSFTKRPLPREKRHTFTEWFMAVQKRRKRPNDSSNHAPYF

SEQ ID NO: 126041 - protein, 247 aa, Heterodera glycines
  Coding regions on vcDNA: vcDNA=SeqID_52464; Strand=+; Position=1 -273,346-532,658-901,1037-1078
  Homolog annotation: Hit_ID=CAE69959.1; Match level="QueryCoverage =59%, HitCoverage=18%, E-value=3e-31, Identity=47%"; Hit description =Hypothetical protein CBG16350 [Caenorhabditis briggsae]
STNYFLFSLALADLLVCAVVMPFSILVELGNGLAALLHKCLKFRIAFPPGVLPWTFRWDFFSCLVYTYADVFLCSCSIVHMTVISFDRYLGVSQPLKRHNKRKRIVLMKIFVAWVLSTIISSPLAILSFVEQQNILMVRLIPKFIRYPSNCIRVFLSHPFGHYGNYHQPNGPFTAASGSSVELRQFLRRIAPNYGTAAQNGRTGADDVHRQLQRGVCQQQHGEEQQYYDDDEQQWQQKPATPKADEL

SEQ ID NO: 126042 - protein, 59 aa, Heterodera glycines
  Coding regions on vcDNA: vcDNA=SeqID_52465; Strand=-; Position=1-179
MSFYTVHRDQLPLRALFNQHGLSFQQRWHSPHYKYSEVLGGTYHIPHSRYPPHDVYKTP

SEQ ID NO: 126043 - protein, 67 aa, Heterodera glycines
  Coding regions on vcDNA: vcDNA=SeqID_52466; Strand=+; Position=1 -97,204-310
MRPRSKSLSNINFEITQTPICRFYLRFMDALYEAKHDRIFLKRKKNNRWVKIRRVYPVFILALILFK

SEQ ID NO: 126044 - protein, 51 aa, Heterodera glycines
  Coding regions on vcDNA: vcDNA=SeqID_52467; Strand=-; Position=1 -114,415-456
MKKTMDETNGQLCNSTFINSDALTVFLNLYAKVTSFVKGGGSQNRKVPGYE

SEQ ID NO: 126045 - protein, 309 aa, Heterodera glycines
  Coding regions on vcDNA: vcDNA=SeqID_52468; Strand=-; Position=1 -35,160-679,1002-1373
MIKNIGTRVDFRETLTTVYSLLEIESQLVKVDEKSAKTIQRLNTDLMTNFSNGKISENEGLKELDNELDKTFKTMKNKEDTAAKVGIGGMDGLAQIFPKANEQGKSVRLQIYGQAMEVLKLIHERIEQSTEKEAIGKVTGKSTVANNGSTVMPSQLVGLMMGLWTHFLQRVRKSDQDKATQTNPEEKQSSPKLRTKLNTPMAQKTKAPTKAAKNQAIPKNQKHTASSDRQKKVTEKKAVSLGNDKFSRRRRAITPIDSSTIHALLIALAILCITVLAFSSDLNPWAIVAIVFLTLNSQQANNRPNQIAK

SEQ ID NO: 126046 - protein, 174 aa, Heterodera glycines
  Coding regions on vcDNA: vcDNA=SeqID_52469; Strand=-; Position=1 -25,116-285,388-717
MGQISKNNDISHLEESFKEMLKFKNSQSPRKWETPNSTPSSPAPSNSAPCSREPSSFTPSSSSPQILKNWRRRIGERPSNTDQTKYVRGNHSKSNNLEESFKEMLKFKNSQASRKLETPNSTPSSPAPSNSAQSSWAPYSLELSSLAPSSPASRVIIFFIREQNFIKIGVTRKR

SEQ ID NO: 126047 - protein, 35 aa, Heterodera glycines
  Coding regions on vcDNA: vcDNA=SeqID_52470; Strand=+; Position=1 -104,1055-1058
MDGFNTGMNQMTNVLDASQPWVELMSLDDKEFDAG

SEQ ID NO: 126048 - protein, 210 aa, Heterodera glycines
  Coding regions on vcDNA: vcDNA=SeqID_52471; Strand=+; Position=1 -63,113-166,220-298,368-450,521-874
  Homolog annotation: Hit_ID=XP_310308.1; Match level="QueryCoverage =61%, HitCoverage=11%, E-value=8e-27, Identity=45%"; Hit description =ENSANGP00000015236 [Anopheles gambiae]
MRYQNIFFQPMVTALADKYPEVRQAAAYGCGIMGLKGGQNYAKHCAQMLQPLINAIEKNGSRSTEEDTRATENAISAVAKILKYNATEVNFNEVVPRFVGWLPIWNDEEEVPYVFDFFCDLVESQHDAVREDPSRVFHVIFHYLLITLIKKRLAFGFVGVPLECRSFKWQNAFLPFLQIILNAFSHGAFEDDSAEEMRLVKSRMVRFQLK

SEQ ID NO: 126049 - protein, 507 aa, Heterodera glycines
  Coding regions on vcDNA: vcDNA=SeqID_52472; Strand=-; Position=1 -500,724-1026,1075-1325,1762-2019,2349-2560
  Homolog annotation: Hit_ID=XP_393173.1; Match level="QueryCoverage =99%, HitCoverage=14%, E-value=1e-38, Identity=31%"; Hit description =similar to Hypothetical protein CBG09037 [Apis mellifera]
MIKLEVAESETVDKVKMLIHQTEGIPPDQQMLFIQLEDGRRLSDYNVQSSSTIGMVLRPSSAKENPNMHEVSTLSMANTCAVSPFGMPVLPSPAAADASMRDVPTFGMPGTSEANLHDTSPLGIALRPVSVSSDANMRAVTTSIAVHPTPVIIAEVPHSFAALMRKRPFSANEMPSEATTSSFTQHEISVFVSSLNNIMLKFAMKRSDNVQDIMEKIWELKGIPIGEQRLFFRGIQLNKAELQIFLHNGGHENEFVFYLVPRPALPRSEEMPILVKDLTNKKMIRLRVKSTDTLLNIEWMIKAKVGIPRDQLRLCLNGNGYSLKQELAKYIEGANWPEITLEIKPQLHVSDEINIKMPNGKVIQMRVHRWYTILYIMRKVQELENIPLIDQTLLYKGKRLRSDVTLANYGIENYTNTEYEIKTLDLLVSQALPIITYEIFIGELVLLKLDVHDWNTVQQLKKKIEEKKGIAMNKQKLKHGEIELINELTMSDYEIRKFSILSLIIIW

SEQ ID NO: 126050 - protein, 98 aa, Heterodera glycines
  Coding regions on vcDNA: vcDNA=SeqID_52473; Strand=+; Position=1 -79,181-398
MTTTTPQKYLNCHNLHAFSNGNGCRNGVSCSSTREKRKKCWDYSDAMAFHQQQRQPQHQHSKRNGGEPTTITTTTMHVGDGGGGEIGGTTTPKKLGAI

SEQ ID NO: 126051 - protein, 180 aa, Heterodera glycines
  Coding regions on vcDNA: vcDNA=SeqID_52474; Strand=-; Position=1 -169,252-625
MKNAVKMALIVQQRIAVKCLARHCSKFAFRFCQTWNLRGKLVKNKSKFQTRSLMRCLPFGVLSKDEVIAVYQFKSLPNCHGISDGLFPMPFSTNGRISDRKKGTLLLDIEKVSEFAREEVGSSRYSEKVYINGLPWKIVAQIKTKNGGTDNEKWLGIFICCDTSKKGAKLLIVNIYINNN

SEQ ID NO: 126052 - protein, 68 aa, Heterodera glycines
  Coding regions on vcDNA: vcDNA=SeqID_52475; Strand=-; Position=1-208
ESHTEPNHRTARKVGKVGGAARGGRESIWTSDLVTPSTPPPLRLPPPQTAIFNGVNRRLLLAPAQCRG

SEQ ID NO: 126053 - protein, 41 aa, Heterodera glycines
  Coding regions on vcDNA: vcDNA=SeqID_52476; Strand=-; Position=1 -70,821-874
SRDRDQVFRPGPRKNPGPGFLFFQKPGPGSGPGPENPGISR

SEQ ID NO: 126054 - protein, 114 aa, Heterodera glycines
  Coding regions on vcDNA: vcDNA=SeqID_52477; Strand=-; Position=1 -86,151-409
MPVQCSMFVARAPFLPTIVLPAKLVPYYKFRKKSSPHSLKKEMIRGNSKRFRKTPPHSTRKFDLPGAEFALVLLPTRAAHFPSPLSWITLILFSYYFWLALYAGKKKLTMKVHI

SEQ ID NO: 126055 - protein, 251 aa, Heterodera glycines
  Coding regions on vcDNA: vcDNA=SeqID_52478; Strand=-; Position=1 -123,179-257,318-376,442-580,628-778,842-956,1022-1108
  Homolog annotation: Hit_ID=CAE74145.1; Match level="QueryCoverage =84%, HitCoverage=86%, E-value=1e-15, Identity=24%"; Hit description =Hypothetical protein CBG21816 [Caenorhabditis briggsae]
MLLLASLRGPCRRPRVLKTLRSLKVPHFSTMNRDYVIETVNFTSERDSVFKFLQEVFLVNEPITRVIGCTPSDTSPIFDDICEKCSKFDLSFAAKNNDGKILGVLLNAPFKLENIHESYRDIGRMPNKKEFGEEIRNGPFPSQNANRIHAILTFVNSHIALLPPEEDIKLVELQAMAVGPGHARTGLGSGMLRALIQTASAKGYSHLFTCATAIASQTGLKKFGFDEIKTVPFNSFLEDGVPIFSGVHDNG

SEQ ID NO: 126056 - protein, 221 aa, Heterodera glycines
  misc_feature (24)..(24): Xaa can be any naturally occurring amino acid
  Coding regions on vcDNA: vcDNA=SeqID_52479; Strand=+; Position=1 -28,1982-2618
  Homolog annotation: Hit_ID=NP_493834.1; Match level="QueryCoverage =97%, HitCoverage=15%, E-value=8e-41, Identity=39%"; Hit description =putative endoplasmic reticulum protein of ancient origin (2B142) [Caenorhabditis elegans] gb|AAF60594.1|
LLPNPNPTLFYIDGPGGTGKSFVXSAIFHLSRGFLKKVTNMAFSGIAATLLKNGRTVHNRFKLPLENINSSSSIENNSKEAKEIRETDIIIFDEAPMAPKFVIEIIDKKLREIHKNNIIFGGKIMILSGDFRQCLPIKNKASKTEILDLTLQKSELWVNFKIFHLRKNMRTENESQNFANQILEIGNGKGNDENGICLPKICDIEDNDLVDEIFGEIIKTT

SEQ ID NO: 126057 - protein, 103 aa, Heterodera glycines
  Coding regions on vcDNA: vcDNA=SeqID_52480; Strand=-; Position=1-312
LNNFIEELFLFIETVLESEEFEIRNDVMNKFWSAWTVTLKRIAQMDNLAQRFCTLHKFTIMNISLFWTNATEQQREELWQMLREKTVVGYEGFCGPIYRISLH

SEQ ID NO: 126058 - protein, 132 aa, Heterodera glycines
  Coding regions on vcDNA: vcDNA=SeqID_52481; Strand=-; Position=1-398
MGGKDLDFGNGIGEEWHSTNTIFNENPVIFGESPEISSMNNDDDNNNNYHPYYYYNNYGYGNDSNFPGNNNWYNANAYTDNWYSVNDGDDDTSGYGSTTSGNYGFETNSYSSSTLGGNYDYGNSSESSAPAY

SEQ ID NO: 126059 - protein, 109 aa, Heterodera glycines
  Coding regions on vcDNA: vcDNA=SeqID_52482; Strand=-; Position=1 -152,206-380
MLSRPLLFIAALLFLFGCCRADGNVVHLSSLNCATKDGGIDGFKAVDDGLILDSSSVTADTSDLPLIGFQKNGKEDLIFKLFVRNGGCVSKANFFTNGQPCTLGESEDV

SEQ ID NO: 126060 - protein, 38 aa, Heterodera glycines
  Coding regions on vcDNA: vcDNA=SeqID_52483; Strand=+; Position=1-114
MLTNPILSPYLGTVARREIRRYQSTTELLLRKLPFQRL

SEQ ID NO: 126061 - protein, 205 aa, Heterodera glycines
  Coding regions on vcDNA: vcDNA=SeqID_52484; Strand=-; Position=1-618
MKLFPLLLLIILFLIDKIGSERKKLQQKSFGEIFGEKWQEKEEEKRNELKKREIIGKFYKIKEKIKQKGRKYSTKEWDKINSKIAKKLGTNRQYIQKWIKEFGLQKKKCYKSKTDEEKLEIVQKFIKMKNEFKQKRKYSVKEWNKNYVEICKKIGVGYVTIKKWKKQFGIRCKRITEEQKIEKMKIYWEIKKENPKMSDTEIGKF

SEQ ID NO: 126062 - protein, 230 aa, Heterodera glycines
  Coding regions on vcDNA: vcDNA=SeqID_52485; Strand=+; Position=1 -652,739-779
MSTNDGDELEQMSANSGQISDHFSSEIDKKKREIVEKFDKIKEKVKQIGKKYSTKEWEKIERKIAKKLGANKMKIYKWKSELGMMTKKNYSVEEKRIMLKQFDQIYSKLKIKLNEKLEGKREKCKKIIAKHLGTNISSIYHWKKQSGKTKKNQQIDDEKREIVEKYFKTKNEFMQIGKHSRKEWKEFHAKIKQIFGLSYMTIELWAKKIKNQSNASKERNFIQMPKKWKL

SEQ ID NO: 126063 - protein, 34 aa, Heterodera glycines
  Coding regions on vcDNA: vcDNA=SeqID_52486; Strand=+; Position=1-103
MHTDEDLSDDGTESYTFRSLIYYEKKQCSKCKKL

SEQ ID NO: 126064 - protein, 217 aa, Heterodera glycines
  Coding regions on vcDNA: vcDNA=SeqID_52487; Strand=-; Position=1-654
MDNKSLTSQLLPTVNFLVTTQGVTVHSDRLDTPRVVFFNDDGTICRQCRYNMDLDYLISKDGVYIHSSRLKGTEKFVPFDRVYDLPRFCAFRVRSRRIFKVPYIFSDSPLEKAMSSTVTSTTENPLIDNVERKKARFDSDLRDITTKNGEDEKAELTNRTDELNVGEKATDGMIRTDKMDLSQVQLMDEANTMENTPKFRTNKFISNLDTIKEEKDV

SEQ ID NO: 126065 - protein, 147 aa, Heterodera glycines
  Coding regions on vcDNA: vcDNA=SeqID_52488; Strand=-; Position=1 -102,440-699,1056-1137
MPRTDGRPKKLRCLTSTLYRQQPANLEWITNFKEKFVRATTSVSYQMNFAMKGSTPIVLFGLVNERTNEKLTLEKVPRHPGNWVMKRCPIGETAVQWEDGTLDANFNSVHFIMDIDKQCIGPLSPPAAEEAGQSNEKVFSTDDSRAN

SEQ ID NO: 126066 - protein, 64 aa, Heterodera glycines
  Coding regions on vcDNA: vcDNA=SeqID_52489; Strand=-; Position=1 -94,185-241,595-638
MHAFCARAIYHRACQSKAKQQRCCFERIKGIESVHRLLEKYICNLSTILRKSVKRILEYIFGIY

SEQ ID NO: 126067 - protein, 77 aa, Heterodera glycines
  Coding regions on vcDNA: vcDNA=SeqID_52490; Strand=-; Position=1 -94,185-324
MHAFCARAIYHRACQSKEKQQRCCFERIKGIESVHRLLEKYICNLSTILRSELEMINFTIQPIFVALINRDKNIQIN

SEQ ID NO: 126068 - protein, 363 aa, Heterodera glycines
  Coding regions on vcDNA: vcDNA=SeqID_52491; Strand=+; Position=1 -175,808-929,1013-1115,1538-1789,2193-2353,2416-2517,2740-2916
  Homolog annotation: Hit_ID=NP_491599.2; Match level="QueryCoverage =76%, HitCoverage=26%, E-value=1e-36, Identity=35%"; Hit description =doublecortin and IQ calmodulin-binding region and Lipoxygenase, LH2 domain containing protein (1G2) [Caen
MIRLLCVQLDSSSEREESTHGTDLMLERNKERLSWETAEALDQPAAAGDKQALKNPRGEFLYTVTVITGNRWAADTEANLYIDMHGTDSDSERLWLKQELASQWTSGTTFSAKPIRFLYLSSPVTAGHHQQAYCAGVFIDRILVTEDEVDEADEETGAEAPEGQMPPFVEHCGDCRQFLFLCNRWFDSGQVDGKLERNVRLSAFYMISSIPVDGRVTRGRWEFVLHGGTTDGRGSTSSQLAITGYGTAGQSTTNGLYDSRMANAPSDALMQLDFGNIGELLKVRVELDGGDGTSPDYFLNFVEFKDLDTDENFVVMCGKWLRWRSAKKGDQPFRELIAFHIGVEPLPCNMTGWEWGIYIILSA

SEQ ID NO: 126069 - protein, 40 aa, Heterodera glycines
  Coding regions on vcDNA: vcDNA=SeqID_52492; Strand=+; Position=1 -59,223-286
MVITDFRGRSAPFYAFKFASPFSVQCRAQIANVLPFTDAL

SEQ ID NO: 126070 - protein, 28 aa, Heterodera glycines
  Coding regions on vcDNA: vcDNA=SeqID_52493; Strand=+; Position=1 -57,470-499
MKLGALHREFFGLSNDIKIIMNHNLAQT

SEQ ID NO: 126071 - protein, 54 aa, Heterodera glycines
  Coding regions on vcDNA: vcDNA=SeqID_52494; Strand=-; Position=1 -10,265-419
MFLSLELRPAPAAVCASGAARNTTRCQCDHSALCRATERLGPSQGAVTIFENGC

SEQ ID NO: 126072 - protein, 144 aa, Heterodera glycines
  Coding regions on vcDNA: vcDNA=SeqID_52495; Strand=-; Position=1 -88,600-864,1147-1228
MQSAKFHIALVQSESMLSSLLKIVKVWAKTSEILAENPQNWERIFKEINYEEKFEHFALIVCSQSVGFDFDSYSSNCAYQKSRLRQNLLGWVNSVQAQLDNYHQIPKFEQKTICYILKIDQLKHLLNESEEFDENVQNEMLLNA

SEQ ID NO: 126073 - protein, 123 aa, Heterodera glycines
  Coding regions on vcDNA: vcDNA=SeqID_52496; Strand=+; Position=1 -137,664-770,1239-1363
  Homolog annotation: Hit_ID=NP_505582.2; Match level="QueryCoverage =65%, HitCoverage=23%, E-value=1e-22, Identity=63%"; Hit description =yip1 interacting factor homolog (39.1 kD) (5K530) [Caenorhabditis elegans] emb|CAA94831.2| Hypothetical p
DWANKCEGDAPVLPCQDVNAPDLYIPLMAFITYVLVSGFVFGVQKRFSPEKLGMLTTNALFYLFLENGIVFVMKYALNISQIAQSEDVYPGHGLEPAQRAQAEAVPVVVHHRVPVADHVVVDQ

SEQ ID NO: 126074 - protein, 154 aa, Heterodera glycines
  Coding regions on vcDNA: vcDNA=SeqID_52497; Strand=+; Position=1 -148,212-315,547-759
  Homolog annotation: Hit_ID=CAE62006.1; Match level="QueryCoverage =80%, HitCoverage=16%, E-value=6e-38, Identity=64%"; Hit description =Hypothetical protein CBG06014 [Caenorhabditis briggsae]
MERIMKSQAYAKARDPSQEFYAKMKKTFEVNPRHPVVRELLRRVQEDAEDPIAVSTAHLLFETATLRSGYSLDDQVGFAERIEGILRKTMDLSETAEVEEEIEPLEEEEPEKKEEEGKEEDGGEEDQQKEEEDEEKKIVVEGEEEEEAAARDEL

SEQ ID NO: 126075 - protein, 31 aa, Heterodera glycines
  Coding regions on vcDNA: vcDNA=SeqID_52498; Strand=+; Position=1-117
LNFVSFCFNFFCWSILYNLNSLNLVYKLIKL

SEQ ID NO: 126076 - protein, 35 aa, Heterodera glycines
  Coding regions on vcDNA: vcDNA=SeqID_52499; Strand=-; Position=1-106
KYNVSYEFFFICNHAKTATRKRTSRENGHAKTSWP

SEQ ID NO: 126077 - protein, 148 aa, Heterodera glycines
  Coding regions on vcDNA: vcDNA=SeqID_52500; Strand=-; Position=1 -135,213-524
MNSLKRFQLPEQGTRQQEELDSVEPKHISDVVNFNSAGVFYVLGKACPFRSKGLICRRKLSDDNMCEACGQKAIAPIHTVFVRLLLQDVEQADIAQRVTMFSSVAEEFLGMKAAELLAKEKEPESLAKHLDDLIAVKLIAKVNIKVFC

SEQ ID NO: 126078 - protein, 40 aa, Heterodera glycines
  Coding regions on vcDNA: vcDNA=SeqID_52501; Strand=+; Position=1-120
MAKLINGNEIAQQFLDEVAQGISRIREQNSDFNVGLAIVQ

SEQ ID NO: 126079 - protein, 73 aa, Heterodera glycines
  Coding regions on vcDNA: vcDNA=SeqID_52502; Strand=-; Position=1 -108,942-1052
MDFDRFRQYLTSGCGVGRNDCKDVRIECRTNSIQQLYLSAPVEDALEAAATAIIQIHVEKQYGDILVFVEGEE

SEQ ID NO: 126080 - protein, 39 aa, Heterodera glycines
  Coding regions on vcDNA: vcDNA=SeqID_52503; Strand=+; Position=1 -36,337-420
MKRKRVCREGKCHKYTSQITYKNGQFKQISWDRDYAFLT

SEQ ID NO: 126081 - protein, 124 aa, Heterodera glycines
  Coding regions on vcDNA: vcDNA=SeqID_52504; Strand=-; Position=1 -97,303-580
MRKRRKSRSNEKSLEMVKWPPAKAFYNAYIKQAYGRGTDHQFQKAATIAGRFRANFLGSSTARLASAAWYATRGVYYPIEDCPPIPDDQDGYVPPEQPGLNADDQPVTLAKALQDVSNFLRLQF

SEQ ID NO: 126082 - protein, 216 aa, Heterodera glycines
  Coding regions on vcDNA: vcDNA=SeqID_52505; Strand=-; Position=1 -247,535-663,1074-1219,1325-1453
MYSRLISNSPLPPHPLPRRHLRQQQSASASAAQYRWLGQQEERKVAANARRQQRKELEAGPMYCSFCHLFGTHVVSNCPGDKGENLAAIASAGKELTFKWGKRRFDARGYAEKMCIPLASAWDVLDGKIVRRRQQEEEAKAKLRQQEAAAKLHQQEAEDKLRQQEEREHLRSLGRMPAALLTLATGHPVDHLDAKNSIVRMLMQLAEEEEAEKTPH

SEQ ID NO: 126083 - protein, 65 aa, Heterodera glycines
  Coding regions on vcDNA: vcDNA=SeqID_52506; Strand=-; Position=1 -30,290-457
MSSATVLVTKVRTLPQLRQPAGKELTFKWGKRRFDVRGYAEKMCIPLTSAWDVLAKDNYQFFDIL

SEQ ID NO: 126084 - protein, 91 aa, Heterodera glycines
  Coding regions on vcDNA: vcDNA=SeqID_52507; Strand=+; Position=1 -96,386-565
LQGRRGAEQLKKRREEEKRRRRGRDKADGPRKAQILSPNDLDGLERSTDDFKVFLAEQDRMSAFLSKKPRPYSTLPLCAICTTTSIHWPFG

SEQ ID NO: 126085 - protein, 26 aa, Heterodera glycines
  Coding regions on vcDNA: vcDNA=SeqID_52508; Strand=-; Position=1-79
REKKIMFFSGTLYLLVHISFFETVCV

SEQ ID NO: 126086 - protein, 69 aa, Heterodera glycines
  Coding regions on vcDNA: vcDNA=SeqID_52509; Strand=+; Position=1 -93,140-217,303-341
MPDAEQILQQLEHHFVNNWLLDTGRIDELKRNYEEREGEDDTDKEAAEEIDDECQIDNIYLSFYKSYFA

SEQ ID NO: 126087 - protein, 145 aa, Heterodera glycines
  Coding regions on vcDNA: vcDNA=SeqID_52510; Strand=+; Position=1 -46,102-199,453-542,809-980
  Homolog annotation: Hit_ID=CAE60587.1; Match level="QueryCoverage =100%, HitCoverage=23%, E-value=1e-67, Identity=65%"; Hit description= Hypothetical protein CBG04223 [Caenorhabditis briggsae]
MALLKKFESKSARVKGISFHPTRPWISFHPTRPWVLASLHSGVIQLWDYRLCVLIDKFDEHDGPVRGCDFHSQQPIFVSGGDDYKIKVWNYRQRKCIFTLLGHLDYIRTTFFHKQHPWIISASDDQTVRIWNWQSRNSIAILTGY

SEQ ID NO: 126088 - protein, 36 aa, Heterodera glycines
  Coding regions on vcDNA: vcDNA=SeqID_52511; Strand=-; Position=1 -20,543-633
MYVELLRRRHPTRKWAAANGSHSPGQVHHVRQTECE

SEQ ID NO: 126089 - protein, 43 aa, Heterodera glycines
  Coding regions on vcDNA: vcDNA=SeqID_52512; Strand=+; Position=1 -91,789-829
MCNFSKKSANKQAKFYIIPGCVLSLDTNSQVEKIPLLIKKAFN

SEQ ID NO: 126090 - protein, 190 aa, Heterodera glycines
  Coding regions on vcDNA: vcDNA=SeqID_52513; Strand=+; Position=1 -23,254-357,410-855
MDKWAALVLLIALINALDSAVVRQQRAANADASKPEPNNEKPGNVDWDKGNSDKSQGAGTEGKNPDEPTESQKVEEDGPNPKNPKESQEVEEDEPNPKKPKESQEVEEDGPNPEEPKKPGTREAEGTWRKKGQGGGGKKTGGKGGKNAKKRGKRAPDEPAPKSPKMPDKFDLKLPSMHKTLIVLGSDPIF

SEQ ID NO: 126091 - protein, 154 aa, Heterodera glycines
  Coding regions on vcDNA: vcDNA=SeqID_52514; Strand=-; Position=1 -227,270-508
  Homolog annotation: Hit_ID=NP_501429.1; Match level="QueryCoverage =100%, HitCoverage=23%, E-value=3e-30, Identity=45%"; Hit description= tc5 transposase and CENP-B protein and Tc5 transposase, C-terminal family member (mut-x) [Caenorhabditis
VLNADQSGFELELHQKRSLAPIGTKLVECVVQSVSSTTHSYTIMPIITADGMLLSPLYIVIAERQGKFPQKGIFQAKNVFAVPNTSHIMTKNLMIDWVHNVLVPVLRPGEQSLLLVDSWNGWNDFRLPDNVKLKVKQIPKHATGICQPLDVYIF

SEQ ID NO: 126092 - protein, 57 aa, Heterodera glycines
  Coding regions on vcDNA: vcDNA=SeqID_52515; Strand=-; Position=1-173
ANIYLIYCDKKSLARHNSALRLISQKIKTLFLRTHGCSIHPPNFIWKSHGHLGTFLC

SEQ ID NO: 126093 - protein, 37 aa, Heterodera glycines
  Coding regions on vcDNA: vcDNA=SeqID_52516; Strand=+; Position=1 -103,231-241
MNTFSAFLRPCGTRISSRPITTTADIGVTDFGGKLVF

SEQ ID NO: 126094 - protein, 72 aa, Heterodera glycines
  Coding regions on vcDNA: vcDNA=SeqID_52517; Strand=+; Position=1 -96,316-438
MGKCSSKLVKFLFCFLRLILIGSLEHYLIQLNVVSFNFMMRIIFRNSQLLDSLITLWSIDTDKHLCPSMAIH

SEQ ID NO: 126095 - protein, 134 aa, Heterodera glycines
  Coding regions on vcDNA: vcDNA=SeqID_52518; Strand=+; Position=1-405
MSLFLLRALPLFFLFSLCFAASPFNFRANHSLGAETTQQIVPTVATETTDGPKPTENVPLMLENDNVTEVAKVEGRNASDSEIEMREDQGLQKECKKWVFIFNGFGMDFLRFLIWDGFNRLFQSVIRFKYVSFV

SEQ ID NO: 126096 - protein, 38 aa, Heterodera glycines
  Coding regions on vcDNA: vcDNA=SeqID_52519; Strand=-; Position=1-116
SEITSEQLVVLAKVNVNEAGCFYIHFRRAVKIQKSHPY

SEQ ID NO: 126097 - protein, 118 aa, Heterodera glycines
  Coding regions on vcDNA: vcDNA=SeqID_52520; Strand=-; Position=1 -196,239-399
MNLNKIEFKRMKDSFYNEKKKEFFERFDDFKRLCKGKQKEFTKELGISEKAFRRWKKELVPKYYKTCKRHSDEEKLKKLKQYFNQRKKSKVSDGIIAKQLKIGYETLRKWKKKFASVS

SEQ ID NO: 126098 - protein, 61 aa, Heterodera glycines
  Coding regions on vcDNA: vcDNA=SeqID_52521; Strand=+; Position=1-188
NLNKFWQNVPLFLFLLSIVALVLLLAASPAASFAFYPVPWPLTTTPSAEDDEAFYDNYDDE

SEQ ID NO: 126099 - protein, 147 aa, Heterodera glycines
  Coding regions on vcDNA: vcDNA=SeqID_52522; Strand=+; Position=1 -247,545-739
MEEKTFVAVERQKPVPKPRRHHTIGILASAEGQLKNEHPDKEEAEKADKSKGKNGAERRKSVEEKHETQQKYGTDEQQRNGVNNSLIAAANKRPFQTTKVGNKDKKLTFYHTKTKRNAQRNIGRPKVEGKRLPMVGKWQDKANEDKE

SEQ ID NO: 126100 - protein, 96 aa, Heterodera glycines
  Coding regions on vcDNA: vcDNA=SeqID_52523; Strand=+; Position=1 -109,359-540
MAAFCADYFLRRRSENTRRRTERRQAAEEGQWQGMKSIGLPINNAYFLRAKLKNNRKAANPFSPDLRDSSGQIPLFLWAQNATTPMAYASMTAAAL

SEQ ID NO: 126101 - protein, 387 aa, Heterodera glycines
  Coding regions on vcDNA: vcDNA=SeqID_52524; Strand=+; Position=1 -74,372-714,1120-1342,1588-2035,2496-2571
MAERQRGDEKECKTPAEETAQQKQNFAIPSAEEICSTSSLHRRADNSFSMNRNKSDLPHISLPINRLLQQKGTTMDAFPISGQHLSTTSNRLRQSNAMEGFERRLGDENLGWKKANDEHRNSTSTTNSSRRTSKTAIAAVRPQLKQMQLNGISTKLRKAPDVPTKAHSSDYSLLGEMFPHRKSSDQRNSGEIANSQLATDGNVDETARHGLIMENDSLAVMEKAAKMVNCLRTQIPHFTTGEHRRSLMRVHGTNSMMDISGIGSNKLSYPISTEAANEPMRANGLNFGQNSIGKQQQQIRHHRPVPACSSSVDELNAYNQPNKVTSICPSLVPVFLSSRLRNLAHEHPGEEDPAKVIQRYVEDQIEGPFVPSDDFGEHQQRRAEKAV

SEQ ID NO: 126102 - protein, 127 aa, Heterodera glycines
  Coding regions on vcDNA: vcDNA=SeqID_52525; Strand=-; Position=1-384
MPYYVLMLCLMFHTVFMEFILPKFSIFYKTEMNQIVPILKNEIKKMFRNKDWDYATFDCMHTIEWNLLRIDLAKMGQTQKWKQMEKLLKEWRILYNNWVLNKSEMNRPNFAKIMQKIVQNLEMMSIK

SEQ ID NO: 126103 - protein, 40 aa, Heterodera glycines
  Coding regions on vcDNA: vcDNA=SeqID_52526; Strand=-; Position=1 -21,175-276
MPGQSRRLKNWPPKVLKHPIDVTDTCKFIPKCFYGVEPNE

SEQ ID NO: 126104 - protein, 66 aa, Heterodera glycines
  Coding regions on vcDNA: vcDNA=SeqID_52527; Strand=-; Position=1 -169,265-296
MENGDYTEAKFGMFKYDVIKNNCIHFVRTFAAKLIGEERLAKASDGFISDIKSGKILPDSLTSLYK

SEQ ID NO: 126105 - protein, 209 aa, Heterodera glycines
  Coding regions on vcDNA: vcDNA=SeqID_52528; Strand=+; Position=1 -82,140-198,253-319,762-794,879-914,954-1022,1130-1201,1516-1566,1640- 1742
  Homolog annotation: Hit_ID=NP_492055.1; Match level="QueryCoverage =95%, HitCoverage=22%, E-value=3e-51, Identity=53%"; Hit description =tyrosinase family member (1H852) [Caenorhabditis elegans] emb|CAA95805.1| Hypothetical protein F21C3.2 [C
FLNLVYGQNDEQGNLVYGDFANWRTIEGNGNPNIRRGVGRDGKGFTEDEINWFINWFLSQQQIDQILAFSAPQPGCPIRIEFRWMEVTHGNVHLFVGGDMSEQTRAANDDMSEQTRAANDPIFFNLHSFVDYIWEMWRQSRQTRESRERDYPMDNSQCSSPQHFGSAPMRPFQPWPWQNRDGLNNKYTDNMYEYAPRPSCQMPNCGSKF

SEQ ID NO: 126106 - protein, 118 aa, Heterodera glycines
  Coding regions on vcDNA: vcDNA=SeqID_52529; Strand=+; Position=1 -44,79-166,230-334,472-499,784-875
  Homolog annotation: Hit_ID=NP_491709.1; Match level="QueryCoverage =56%, HitCoverage=9%, E-value=2e-15, Identity=48%"; Hit description =tyrosinase family member (82.2 kD) (1G477) [Caenorhabditis elegans] gb|AAB52481.1| Hypothetical protein C3
MASAKITDVFRRLTLFYYYLFQSSTPWPMPPTDVTTPNPIRPVQSCYNEHECCSVWSQKGECQRNPGFMNSWCKASCQQCQPDYDLYQGRKLSSIMWKMPRFTSTGVQRRARQSAKSG

SEQ ID NO: 126107 - protein, 17 aa, Heterodera glycines
  Coding regions on vcDNA: vcDNA=SeqID_52530; Strand=-; Position=1 -22,712-743
MIFDQFGTIVKCLETLA

SEQ ID NO: 126108 - protein, 132 aa, Heterodera glycines
  Coding regions on vcDNA: vcDNA=SeqID_52531; Strand=+; Position=1 -78,139-256,314-387,437-565
MRNELGANRVITKPQEFYKLVLDHKVEIYAIIPLSDDVIRVSYRTKKNFVDEHSSSNIMLSLWTTSRARLKLLDSMQQVHETEGAELLYTDTDSVIVKHRRDVSPLQTGEFLGQMSEEYAGYAIQCFVCGGK

SEQ ID NO: 126109 - protein, 379 aa, Heterodera glycines
  Coding regions on vcDNA: vcDNA=SeqID_52532; Strand=-; Position=32-1171
MSSFFYFLLIAFIFFNVLHLSSGEWINVELSVDPPNFFDRSFRTISKTSPAQHWFGYNRDTACHVELERNINRLYTNPDTWNIALTDVDNLMSLGRTTIEIPSTALPWACFGHGGHSFVIFNLQNDAGEVTVLRGHQQKIARQLSAYGRILFDHIAARLYIVDKSERRINELLIADLERWWTLNNTDDALNTTSAHVLRSNFVGFLPEQKTDYFIAADHVYMIWRRRVYKFRIGHYFNDPSSQLQFLTNSSDIRFNFLLFEAGAEKLGEDGDRRNSRSAIVVPAVSSNGIERLLLALTYLFDLVVILLAICAFRHFRRLGTDGGSARNGHHAMELNEYDLFHSLSFQNNNNGGGAYGVPAAYNPTNTTLSHQLRSCATI

SEQ ID NO: 126110 - protein, 140 aa, Heterodera glycines
  Coding regions on vcDNA: vcDNA=SeqID_52533; Strand=-; Position=1 -97,200-353,468-638
MSSETGAEDPTEQNAFDEMTQDRAIELDISIKGLSKQKRKKGQFETNDLCFFAPKCKNNVLEEMGYAIIDCGHKCHWEGEYAKWASDGHYKRCHNQRCKKNAFIKCKSCKKKIGYGLYECGCYCTKNAHDMDIHADTLEK

SEQ ID NO: 126111 - protein, 40 aa, Heterodera glycines
  Coding regions on vcDNA: vcDNA=SeqID_52534; Strand=+; Position=1 -54,161-229
MSNSIARSCVISSNAFCSYKSSEAMEHRFAMIRPIEDLGF

SEQ ID NO: 126112 - protein, 85 aa, Heterodera glycines
  Coding regions on vcDNA: vcDNA=SeqID_52535; Strand=-; Position=1-259
NQPRGEVVELQSIANNSKLIINDESLYLYFLHKYEANPNDKASAMIATKKQYGITVADRFKLNIWWLNLVRGSSMMQCCRKCWNN

SEQ ID NO: 126113 - protein, 114 aa, Heterodera glycines
  Coding regions on vcDNA: vcDNA=SeqID_52536; Strand=-; Position=1 -36,89-191,247-449
  Homolog annotation: Hit_ID=CAB40412.1; Match level="QueryCoverage =87%, HitCoverage=20%, E-value=9e-22, Identity=52%"; Hit description =hexokinase [Haemonchus contortus]
MATTHQHNPTPEVKELCKCLALDDNQLRDIMAKIEMDYQKGLDPVTAPTACVKMLPTYIRAIAVGEEKGEFLALDLGGTNFRVLRITLEGGCRSTMHNKIYSMPDSVQQGTGTE

SEQ ID NO: 126114 - protein, 209 aa, Heterodera glycines
  misc_feature (188)..(188): Xaa can be any naturally occurring amino acid
  Coding regions on vcDNA: vcDNA=SeqID_52537; Strand=-; Position=1 -52,242-291,380-537,611-931
  Homolog annotation: Hit_ID=NP_509805.2; Match level="QueryCoverage =85%, HitCoverage=9%, E-value=7e-30, Identity=41%"; Hit description =phospholipase C, putative effector of Ras (212.9 kD) (plc-1) [Caenorhabditis elegans] emb|CAB60298.3| Hypo
IKCQSLLPPPTTQPHSIKSQSSSQLHGRSIDVVALGHASFFPQGMHPRAKSMGETFLVCVHNISDNHPYAILRTSINNTARDIIKQIFAKTQCYEVDLDEYAIFAKTQCYEVDLDEYALVEEIVVGQQRTEPNRTEKGTGGAMKPQQQANFRVLEPEENIWKVQSRWSGASGRFLLERRDQQVTMNEXMTNDWTGERPSPFRSQANGRR

SEQ ID NO: 126115 - protein, 51 aa, Heterodera glycines
  Coding regions on vcDNA: vcDNA=SeqID_52538; Strand=-; Position=1 -151,347-351
MNFLKNIFLFLLFLLICVISVENSCFNFLCPPKEQRPKSKESPKERKNLSA

SEQ ID NO: 126116 - protein, 191 aa, Heterodera glycines
  Coding regions on vcDNA: vcDNA=SeqID_52539; Strand=-; Position=1 -155,472-575,641-781,1176-1351
MNVYMANPANNNTMNNNTGTFYAQQQLHNSSNSWNSQTPQYYIEPLHSYFSDSSYFGQPSSMLGGSASLDSLNAYGHFGPLFAGQQEIEYSANFSTAFSAFITGGIEAAAPMQYHQQHHHHMVGHHHQSAALGGGGDFLMGSLVVHPLPSQQLAAAATAADRECISCGGRLYEAESVRVDARGYSNQSINQ

SEQ ID NO: 126117 - protein, 157 aa, Heterodera glycines
  Coding regions on vcDNA: vcDNA=SeqID_52540; Strand=+; Position=1 -236,714-869,913-992
  Homolog annotation: Hit_ID=CAE72553.1; Match level="QueryCoverage =73%, HitCoverage=7%, E-value=6e-22, Identity=43%"; Hit description =Hypothetical protein CBG19737 [Caenorhabditis briggsae]
GHDSFRAFRSAYVNSEVRFETNSWEQLNRQCPQILLYANTFKCLDFLMRTLMTVNRPVKRGPLFKSTQAKRYQLSRHFRNVQLMASMPRFLISYWMSFSSSHGFRVISDSLQFACDFLLQIHPDQSNVRRGTASSAGSGQRGKFCTRRPSWTMPKFT

SEQ ID NO: 126118 - protein, 131 aa, Heterodera glycines
  Coding regions on vcDNA: vcDNA=SeqID_52541; Strand=-; Position=1-393
MLLLLSLSVFLLASPSVCSASAQFPMSAGIGDSPPSLQYVASSSSFSASSSSSEEFARKNQMGEEKADDWEEEEDTKLKQDQNQLKKNPHRMVVKRQMKRAAEAMEVAEDEKLVEEEQEEQQQSCTVRVQV

SEQ ID NO: 126119 - protein, 62 aa, Heterodera glycines
  Coding regions on vcDNA: vcDNA=SeqID_52542; Strand=-; Position=1-288
QGWAEVSLFAFRLSHYSHFLAFRISLFAFRFLARKATFTPLRIGLNSHKIFQNFTYKLANFQ

SEQ ID NO: 126120 - protein, 627 aa, Heterodera glycines
  Coding regions on vcDNA: vcDNA=SeqID_52543; Strand=+; Position=1-1882
  Homolog annotation: Hit_ID=YP_024435.1; Match level="QueryCoverage =25%, HitCoverage=90%, E-value=3e-11, Identity=26%"; Hit description =hypothetical protein KgORF4 [Staphylococcus phage K] gb|AAO47450.1| ORF4 [Staphylococcus phage K]
MRKKEMKAMVFRPRKWDKNTIGTEIEIGTITQCIVIWRETMDAELLAVLTKVEEICYELLCIWVVPKGVPIHVMKKRFPAIVRVPEEENIDNLLTKLEQIGMPIEKKGEQRWHETASTNAPRVNWNQLGDGHRVQAAGSHSYNSFVAPHFSSYLPTTTTKMFFPTPEMPKKGENFGKIQSEKFDPFVVLGVKRKSQSPESNYEEEDIFEGPLCTKRTKFWVNSKCETTNTEPLGVKTFFKNENKEIYQPHWKPIVLSSPSGKKGAFFFGKNFVFSNFHPSSFMMDGFKWDNVEQKYCFEKASYFGYFNLAKMIKFKNGITEPSEFKKFTDKDMDQYKSLEENPKSFDQYEWNRVREGVIRPILWAKFTQNEKFGQMLWETGKFPLYEASVNLSWGIGIDIRERQLIFSNMDQGFKGKNMCGRLLEDIRQKLNPMGTVNQKRPTNQINEKDLDQILKKIENDRKISVFKTENILRQCTRIKEVVKENWDMNVFIQGSIYNGLGRKESDLDLVMINSKGIPNDWTKNDSCQFFDKLRKKLRESGMALTRTLIIPSRNVSILEITINSDDQEINAQISCNNLIGLINSKWLACCVQLDVRFKTLYFAILEWADFFEIHQSANGGGTLNSY

SEQ ID NO: 126121 - protein, 17 aa, Heterodera glycines
  Coding regions on vcDNA: vcDNA=SeqID_52544; Strand=+; Position=1 -36,605-622
MVIQIRNSMKRWRFQLG

SEQ ID NO: 126122 - protein, 206 aa, Heterodera glycines
  Coding regions on vcDNA: vcDNA=SeqID_52545; Strand=-; Position=1 -126,292-524,568-829
MDDPKTYNFSFPELAAKNALHFAFRKHTKIERILKRIDVELQKDGTESGVRQLLFHGIGDGCERCVSCVEVLKSRLASQGKNVFQWNALSNKKTSSTTTENSSKCDEMEALKISENSPKFNGGTTKPSKKDENRPQPVLAILISLDPFSTTDGDDSQHSLRCGGHRIQIEIRVFKMFQKLGDFDQAKMTKFGIPRPKSRKSVLEWY

SEQ ID NO: 126123 - protein, 79 aa, Heterodera glycines
  Coding regions on vcDNA: vcDNA=SeqID_52546; Strand=+; Position=1-255
QKDGTESGVRQLLFHGIGDGCERCVSCVEVLKSRLASQGKNVFQWNALSNKKTSSTTTENSSKCDEMEALKISENSPKL

SEQ ID NO: 126124 - protein, 175 aa, Heterodera glycines
  Coding regions on vcDNA: vcDNA=SeqID_52547; Strand=+; Position=1-8,90- 609
MKKKFGLINGAIGALLNRSVSESKALNQQHQNGGGHYGKLKAHQQFPFSQSFPVKENSKKQQQAPIAQSEPSDTDFDDSLSATSAVETGSTPMGSGATRTPIGQGSAEGDTSQHEKRPFVAMYNQTQKHQTNYEATTMANSSIRGSVFAVKTKAVQNFELKTPKVLIVTLVFNLM

SEQ ID NO: 126125 - protein, 142 aa, Heterodera glycines
  Coding regions on vcDNA: vcDNA=SeqID_52548; Strand=-; Position=1 -132,390-686
  Homolog annotation: Hit_ID=CAE64315.1; Match level="QueryCoverage =64%, HitCoverage=40%, E-value=5e-22, Identity=57%"; Hit description =Hypothetical protein CBG08993 [Caenorhabditis briggsae]
MKAFFAKNIKLTRKAHQDEAGHLTLPPLEKQFLISPPSSPPVGWIQHAEMAPVVCDFDLMARLASLTVDEKFELFEGDEHQRRPSIVITPCEKGGGGGLLAKDGGQMANSADESEAEKQRQAELRSKVPLPHTPRPPTLKEE

SEQ ID NO: 126126 - protein, 113 aa, Heterodera glycines
  Coding regions on vcDNA: vcDNA=SeqID_52549; Strand=-; Position=1-342
MTFQSLGLNPPAFQSLRLNSQAFQSLGLNPPAFQSVGLKSPAFQTRGLNPPAFQSVGLKSPAFQSLGLNPPAFQSLRLNSQAFKSSVLSVAVALTHFLQIFDYYFYFSSVLSA

SEQ ID NO: 126127 - protein, 109 aa, Heterodera glycines
  Coding regions on vcDNA: vcDNA=SeqID_52550; Strand=-; Position=1 -102,574-672,752-978
EMSFPVPSDDDFYDETTDYLYLTNDNANPTNCEQTLANEHSAVALSSAIPGNDENSSSPAVPSERSLELLKKYFGYSRFRPLQYEVIEAALSKRDQLGRYVHRSFHRSF

SEQ ID NO: 126128 - protein, 80 aa, Heterodera glycines
  Coding regions on vcDNA: vcDNA=SeqID_52551; Strand=+; Position=1 -71,306-386,460-505,918-959
  Homolog annotation: Hit_ID=CAE73644.1; Match level="QueryCoverage =83%, HitCoverage=21%, E-value=2e-17, Identity=44%"; Hit description =Hypothetical protein CBG21144 [Caenorhabditis briggsae]
MSEEVDRHIVERYKIQKRLGKDEEEIMFLQEFGRHPNIIKLFNILRADNDKDIYLVFEYMQADLHNMDDYLDGTNVPELT

SEQ ID NO: 126129 - protein, 143 aa, Heterodera glycines
  Coding regions on vcDNA: vcDNA=SeqID_52552; Strand=-; Position=1 -66,702-769,1000-1111,1192-1290,1402-1485
  Homolog annotation: Hit_ID=CAE59601.1; Match level="QueryCoverage =60%, HitCoverage=22%, E-value=2e-22, Identity=56%"; Hit description =Hypothetical protein CBG03009 [Caenorhabditis briggsae]
MRSPPMSVSRKLLVRLNFSSPTACKDFNLTCVLFCAKISGKLKPSRFCFSTEAFEKAQKDMKQLKDEPDNDTKLELYALFKQANEGDVRGDRPKMLEFVARAKFDAWEKVKGMPKADAQHKYAEIVNSLLKNAGINNANTSET

SEQ ID NO: 126130 - protein, 32 aa, Heterodera glycines
  Coding regions on vcDNA: vcDNA=SeqID_52553; Strand=-; Position=1-98
MSSIPILSSFSRALQMRQHPLLFGMIHVPALP

SEQ ID NO: 126131 - protein, 191 aa, Heterodera glycines
  Coding regions on vcDNA: vcDNA=SeqID_52554; Strand=+; Position=1 -113,215-355,544-657,723-927
  Homolog annotation: Hit_ID=XP_309488.1; Match level="QueryCoverage =100%, HitCoverage=28%, E-value=3e-68, Identity=64%"; Hit description= ENSANGP00000021969 [Anopheles gambiae]
MSAPPQYKMGEKVATRQAYGNALLKLAEANKRVIALDGDISNSTFSNLVQKKLPEQFVQCYIAEQNMVGVGVGMACRGRVLPHVSTFAAFFTRAGDQIRMGAVSFTNVKFTGSHCGVSIGEDGPSQMALEDLALFSALPASVVLYPSDAVSAERATELAANYTGITYTRVSRPATPVLYTSDEKFELGKCK

SEQ ID NO: 126132 - protein, 58 aa, Heterodera glycines
  Coding regions on vcDNA: vcDNA=SeqID_52555; Strand=+; Position=1 -63,302-415
MIDIFYNFTIGKCTTSRPLMLEVNAFKTEKELAEFMMNHGEKLVDRVRLLSKIPTIFV

SEQ ID NO: 126133 - protein, 101 aa, Heterodera glycines
  Coding regions on vcDNA: vcDNA=SeqID_52556; Strand=-; Position=1 -114,207-398
TAVNKILEAKAKNDAELESEVKTKTATLSEDSKKASAELTLIIEDKKTTLDEKVKRTEELTAKMSDNTKKELNLNNSADVVAFVKSYSAVAVPAVATEGKA

SEQ ID NO: 126134 - protein, 158 aa, Heterodera glycines
  Coding regions on vcDNA: vcDNA=SeqID_52557; Strand=+; Position=1-477
MNEGSKHFKKTLISRGRTAGHRHSPQNDDGDDDQQQRQQQNQFDAYLNPQQMDNFEMGAEKEEEEEGEEEEEEEDFYALLQRFGGHGREGGKTAEECGCGRRRNGIGTAGKSAADGPGREYDAPRHSLGQFFNSEQRLRDRGPSRLLLLIGNAERHNN

SEQ ID NO: 126135 - protein, 18 aa, Heterodera glycines
  Coding regions on vcDNA: vcDNA=SeqID_52558; Strand=+; Position=1 -44,291-303
MTNFDSKNNKIKQNHFYL

SEQ ID NO: 126136 - protein, 164 aa, Heterodera glycines
  Coding regions on vcDNA: vcDNA=SeqID_52559; Strand=-; Position=1 -378,612-725
  Homolog annotation: Hit_ID=NP_502196.1; Match level="QueryCoverage =86%, HitCoverage=17%, E-value=2e-13, Identity=33%"; Hit description =methionyl tRNA Synthetase (101.7 kD) (mrs-1) [Caenorhabditis elegans] emb|CAA97803.1| Hypothetical protei
MPSKRVSEHCFPFYKFFRFFGEKSVDFGRLDVRVGRVVAVRKHPNADSLYVAHVELGELQPRTVIAGLVKFVGLEEVPNIGQSQDIEMVHNICFINGCTASKPARRLPLQFETVEKTWHRFACDDFDMLVSGTGECVFKGTPLRVDAEDGASSLVTAPTLRNVP

SEQ ID NO: 126137 - protein, 182 aa, Heterodera glycines
  Coding regions on vcDNA: vcDNA=SeqID_52560; Strand=+; Position=1 -12,248-358,630-1055
MKSKIPLLIYPLIFPLRMANPSAAIIFALFSAFWSIIFEATCNDSFSDTFATFIISRTEAVDDNAAPMENPSFEQQQNLVALDLGRVRELQQMIGQNAIDHIVVEDGIFSGVYSCQSNIEFQFDGLSLGDGKMHRMLFSFGAILSAEIDGPKQTASENSNYLRSLLKAYECVGGSLKQDEGR

SEQ ID NO: 126138 - protein, 125 aa, Heterodera glycines
  Coding regions on vcDNA: vcDNA=SeqID_52561; Strand=-; Position=1 -115,627-889
MAQPDSTRCGRPATAAERGTVSASSAATISGGLFDWIGEPNRRMDGQSIGKSNENGFIFSFNLIFITINGQNCWRCQKEWPAKSVMKNNGGQNEERSNGRKKDGTVKKKRTNAQRKGRRGKGKLK

SEQ ID NO: 126139 - protein, 57 aa, Heterodera glycines
  Coding regions on vcDNA: vcDNA=SeqID_52562; Strand=-; Position=1 -126,224-271
MAPRDDSSNNTNGQPVIQFDQQIRQDPGLNAVFDFVREQGARQMAQHRLNERRAGNN

SEQ ID NO: 126140 - protein, 120 aa, Heterodera glycines
  Coding regions on vcDNA: vcDNA=SeqID_52563; Strand=-; Position=1 -76,139-425
MAFPEPEKPKEPTPPPAEPEKPKRASDFGGRRRRRRRRRRIRGDVTAKGEENGERVDAAQRANGTEGVRVGGQMERGGGTAQRQTGERKRSGEKAKGRKSHEKGKWGGKAMRGKDKTITN

SEQ ID NO: 126141 - protein, 119 aa, Heterodera glycines
  Coding regions on vcDNA: vcDNA=SeqID_52564; Strand=-; Position=1 -122,272-408,484-583
  Homolog annotation: Hit_ID=NP_491214.1; Match level="QueryCoverage =94%, HitCoverage=14%, E-value=1e-31, Identity=56%"; Hit description =degenerin mec-4 family member (1E341) [Caenorhabditis elegans] gb|AAB93309.1| Hypothetical protein ZK770.
GVYDPIAIRSKAVENLVFAVSQMSEYEQSQMGYSKREFITKCSFNGRECSVEEDFSLYVDPTYGNCFTFNAHPDKNVLSERAGPNYALRFQVFVNVSDYLPTTEAAAVNIAVHESMRPV

SEQ ID NO: 126142 - protein, 353 aa, Heterodera glycines
  Coding regions on vcDNA: vcDNA=SeqID_52565; Strand=-; Position=1 -651,837-1235,1277-1288
MAANLVPYPHIHAWGKPIHTIEMVFNRRIALPAHRAIGFCKQLSKGTDQFGLKGNSEKQLDEMPKIRGIILGLREEFNTFVIEIMLTRIENEKGANENGANKSLEKMNEILKFLKEKNGSAFCDQSIIESAQGKAEAQMKKMGEKKEKQQMMENIAKAFVVKAKLSILTEEMRNKKDALSDWKELDALIPIAFFCQFGTALENIRQYCKITDEAGMEEKLNNLAEMARPLTDQVKWLVSHHLSELITDVSHVLVLLYFNESKINKFVHSIDAICHTVLIAVQTIGIEYLDIVSKITDIKALIKEMENVHKDKVTKTIDQTDKDKVTKTTNELLQLLETKQDAFLENFQLLYFA

SEQ ID NO: 126143 - protein, 84 aa, Heterodera glycines
  Coding regions on vcDNA: vcDNA=SeqID_52566; Strand=-; Position=1 -145,824-933
MKKFIPSFLFVFIQFFICFDLSVSVEFHRWVKNCEEVISNIETKPIVTQNSSTVDVGELINLEKELANFEQNILQFYKLGNYIN

SEQ ID NO: 126144 - protein, 70 aa, Heterodera glycines
  Coding regions on vcDNA: vcDNA=SeqID_52567; Strand=-; Position=1 -99,145-258
  Homolog annotation: Hit_ID=CAE60571.1; Match level="QueryCoverage =94%, HitCoverage=7%, E-value=6e-16, Identity=56%"; Hit description =Hypothetical protein CBG04200 [Caenorhabditis briggsae]
MKAKLSQDGLRARTFYQHPHLSPFLHGLIRDGKAAWGNLESHVPTESRPGHVAMMAGFYEDVSAVTRGWK

SEQ ID NO: 126145 - protein, 170 aa, Heterodera glycines
  Coding regions on vcDNA: vcDNA=SeqID_52568; Strand=-; Position=1 -116,160-287,347-446,566-645
  Homolog annotation: Hit_ID=CAA74204.1; Match level="QueryCoverage =99%, HitCoverage=51%, E-value=9e-71, Identity=80%"; Hit description =serine proteinase [Heterodera glycines]
AEDSIDFSDNATHPITLSRRSNFTKTDLAFIAGWGRITDWSSPVTLQGANVLIWPWSSPVTLQGANVLIWPKDEARCDGIMESEVCAFGEDGANVCFGDSGGPLLVKSYDGGDSGGPLLVKSYDGQRWEQIGVTSRGNFVCESNGFSCVYIYCEWLAKITEGEVQCLNNE

SEQ ID NO: 126146 - protein, 105 aa, Heterodera glycines
  Coding regions on vcDNA: vcDNA=SeqID_52569; Strand=-; Position=1-315
  Homolog annotation: Hit_ID=NP_625403.1; Match level="QueryCoverage =95%, HitCoverage=37%, E-value=2e-17, Identity=44%"; Hit description =putative secreted lyase [Streptomyces coelicolor A3(2)] emb|CAC13062.1| putative secreted lyase [Streptom
MHSFLVLTILFANLATNAFGQQWPKATSEETVKATIKVSGGVKDFGFKRLTASSALGTGDQSEGQKALIRAEKNAVIKNLIIGQNGADGIHCYDGCTLHNVWWEQ

SEQ ID NO: 126147 - protein, 26 aa, Heterodera glycines
  Coding regions on vcDNA: vcDNA=SeqID_52570; Strand=+; Position=1-79
PWVLYPPTKFHLEIPRTPGDLPLSAR

SEQ ID NO: 126148 - protein, 293 aa, Heterodera glycines
  Coding regions on vcDNA: vcDNA=SeqID_52571; Strand=+; Position=1 -195,247-360,411-562,607-680,731-866,1037-1246
RILTVVLKVIDGLAFRFGFLLFNRSFFPKAQKLSCSFGVLVKLFYEKFPHPMLVDYSNRNIFVSSGANTRDHKLFSKEDSRSFTAILEFHEKTLKQGIELPKIFKDRVSGPSEAPKVLVELAKKYNVKGGHWIMFFNKLATHKWEKVFDELLSEALKHWGILNRFNARISSDNLIICFGNEKTLAASDPTILDSSDQLQRNNVKNDPGPYTVLRIIDEIYKPNTPVASNGTISFGQQVKFGRIPQINSWSNPRIRSPFSVYQANYGEYSQRFVPSNLPLSRGGALEGMPMPTG

SEQ ID NO: 126149 - protein, 549 aa, Heterodera glycines
  Coding regions on vcDNA: vcDNA=SeqID_52572; Strand=-; Position=1 -623,728-894,975-1235,1287-1423,1520-1700,1741-2021
  Homolog annotation: Hit_ID=NP_494149.1; Match level="QueryCoverage =80%, HitCoverage=26%, E-value=1e-36, Identity=29%"; Hit description =predicted CDS, putative protein of ancient origin (2C297) [Caenorhabditis elegans] gb|AAF39854.1| Hypothe
MIKILKNAHHEMQQQEEPDLDQISDDELGDEVPIDDIVGTQQNDEEIDEMPELELALDNDVVEEQEDPEMDAVGTSTAQPNPGRNENEDVIFDHEVETRGGRTNISERQFYRYRMALRGSGKNTFHWLWFARRLAEYFTISVLNRIERNELNHLKAIQVKKNYRQLLAREYIAAMEKGVRQQGPNAKLGRVFLMPQTFAGSRQYYQGKFVTFTGNPKWPEIDEALRVRQNYAHRPDIVCRIFMDKAAEFIRDVTERGVLGKVAGMPHIHMLLILERGVRIETAQQVDEYVSARIPTLPPSSDQSPEGHQQRRLWHYVTSMMLHDCNAACLEGSRCRKHFPKPYSDRTELSEVRYTNYVRIPPDESDTFFGRAGGQDNQHDDDHHDPAADPERDWAEGEQGQTHYKKKRGVRSAILMDDSRVIPYNPFLLLKYGCHINVEYVFGQKACKYIFKYLLKEHSGFEKAYVRVAQPRRSAQQGRSNETAGADEVYDYDEIAATFKVRYMTAMEAYLRLNSYKIVGMSHQIYTLSVHDELGQTIVVEEGHEEEGR

SEQ ID NO: 126150 - protein, 95 aa, Heterodera glycines; identical to SEQ ID NO: 125597
  Coding regions on vcDNA: vcDNA=SeqID_52573; Strand=+; Position=1 -748,915-1262

SEQ ID NO: 126151 - protein, 39 aa, Heterodera glycines
  Coding regions on vcDNA: vcDNA=SeqID_52574; Strand=-; Position=1 -76,838-881
MGLKRPGPGWMDQQVVELIAGGGMLAPFTAHEPINLKRK

SEQ ID NO: 126152 - protein, 27 aa, Heterodera glycines
  Coding regions on vcDNA: vcDNA=SeqID_52575; Strand=-; Position=1 -37,345-391
MSWRRLNFSISQRPVNEMLVEILLKST

SEQ ID NO: 126153 - protein, 46 aa, Heterodera glycines
  Coding regions on vcDNA: vcDNA=SeqID_52576; Strand=-; Position=1-150
DTFVEAFIYHLIILLLLRVLLRHRPANNWPHFRGGHQQQFVALCQK

SEQ ID NO: 126154 - protein, 46 aa, Heterodera glycines
  Coding regions on vcDNA: vcDNA=SeqID_52577; Strand=-; Position=1 -77,180-243
MAKYGPKYGLNTAKIYVLNPQKFQKSFTIANQIRLKIFVIISFCCQ

SEQ ID NO: 126155 - protein, 51 aa, Heterodera glycines
  Coding regions on vcDNA: vcDNA=SeqID_52578; Strand=+; Position=1-155
MSQSPQMATFSGLTANIYHEKQKRQLCLLHTLNNLFQREEFVRDELDEICE

SEQ ID NO: 126156 - protein, 64 aa, Heterodera glycines
  Coding regions on vcDNA: vcDNA=SeqID_52579; Strand=-; Position=1 -66,126-254
MAELLRPKATSIATRKILIAEYSEVRAVIDPLISLKFAKLKSEQSDRSCKFFAKFRHVTQNRQC

SEQ ID NO: 126157 - protein, 99 aa, Heterodera glycines
  Coding regions on vcDNA: vcDNA=SeqID_52580; Strand=-; Position=1-829
GTARNQKNRFFKCPFGYSNIYGSKIQRRIKVQAIGSYPEGFGLPINLGASVRGDCPENKKIDFFKCPFGVLKQLWGAKIQRRIKVQAIGKLFPKDSVSP

SEQ ID NO: 126158 - protein, 429 aa, Heterodera glycines
  Coding regions on vcDNA: vcDNA=SeqID_52581; Strand=-; Position=1 -260,302-1331
  Homolog annotation: Hit_ID=AAH57473.1; Match level="QueryCoverage =93%, HitCoverage=65%, E-value=2e-14, Identity=22%"; Hit description =LOC402866 protein [Danio rerio]
MKMFFDGNILLFVILALCPNRISSASTRSVASTDDEVERKMKLDLATHQMKKKLGKYVDAIENPFQATSSSEVQQTPPVTDSKRNETIKTRTNASNSTSKCVNTNVARTLSQNNGEDKQLTIGTKFPWENVRRNLAEEKPDREREKKVREPKQQQPRESTSSKIVPLEEKQQKQSMDKSAYEEPEQYEQQPARKSNSMSEMLALEKYEARSKSRQIREESSGQRNHRRSSARRSNFDEQMKYEKPRKSRYSKEESLREHRPRKSHAKEKQKQREAPRKSNYVEDESKDSHAARTSSSTAIESLRKLRRQKSSRRSGGMIEAQELSRLLTMTSDTRQSSGRRSFSKSRTMMTDRELSKWRDGGAIGEELATRSSRPIVAMPVAQKRKENSIADMQNLQDEMRAIRLRELALNASNKKREEAVALFRNQIE

SEQ ID NO: 126159 - protein, 29 aa, Heterodera glycines
  Coding regions on vcDNA: vcDNA=SeqID_52582; Strand=-; Position=1-87
SRLKTGASRPFLNLLALDGRFAPVIQILL

SEQ ID NO: 126160 - protein, 197 aa, Heterodera glycines
  Coding regions on vcDNA: vcDNA=SeqID_52583; Strand=-; Position=243 -253,317-899
MNRRWICNDVWMDIFPSFDRAQLGLKMALLSPRFNALVDKHFDGKSELTIWRSIEIRRKDKGPEPKLSVRIDDKFVPFPLPDRPLPSKIRFKHLRIEYLKIRAIAIKAFIPFLGTSITPSSLFFVQITKFSTKEAPIYICGFLLHIPRMANKFGTFLFVKFGQFFLKTFATWAFTMVIIWTICFVALRQQFSPISTN

SEQ ID NO: 126161 - protein, 187 aa, Heterodera glycines
  Coding regions on vcDNA: vcDNA=SeqID_52584; Strand=-; Position=1 -59,140-224,304-385,436-632,959-1058,1101-1140
  Homolog annotation: Hit_ID=CAE68261.1; Match level="QueryCoverage =57%, HitCoverage=52%, E-value=5e-12, Identity=34%"; Hit description =Hypothetical protein CBG13938 [Caenorhabditis briggsae]
MDHTPWRVVLYVIDDFRIHLNRRFDHLEQWQIVLYTLSFVLFVQWVRKWNDSLLSFSTYKHKWEENKENAYKELEDRMHRADRLREFYKYLPDRGLPPDDIIREATAYKTMSDILFERGRLCGSLYAVEDEDSNYQRMIKQLIGTLPTKMAFEDRKLLCPSTPMSDFLKQRNYWECVWSASAPTAKA

SEQ ID NO: 126162 - protein, 73 aa, Heterodera glycines
  Coding regions on vcDNA: vcDNA=SeqID_52585; Strand=-; Position=1 -6,165-380
MNGVVVEIEYAASNILHQCKALLEEIVEFFFGQSKVPEPEVFKRHSEQLDNYMAIDTLSQYLDIFTAIRKRSS

SEQ ID NO: 126163 - protein, 332 aa, Heterodera glycines
  Coding regions on vcDNA: vcDNA=SeqID_52586; Strand=-; Position=1 -219,266-1044
  Homolog annotation: Hit_ID=NP_508324.1; Match level="QueryCoverage =69%, HitCoverage=8%, E-value=1e-31, Identity=40%"; Hit description =predicted CDS, peptidase family A16 and RNA-directed DNA polymerase and Integrase, catalytic domain and Zn
VYGEPDLIIGNDYYNRLNISVLEELQSGLYINDSNIGQFLSGQGKVQFFKSLNGSQSDISSSVIHHTVNQKCVEWELNSDQLSRNYFNKMIMDWNGLEHVGMSDLNSDKQNVRQRMIDKISFNGDRYQTELLWDEELAAQLPTNYDMAFRQLMSNLGRLRKTPDLLRQIHEIIMEQVETGFIEECEPLPIEERYLVGSKVHYLPHHPVVKETSEHTKVRIVYNASARCRGGLTLNQVLEKGENDYNDLAGILIRSRIKPILLTCDIAKAFHQILIHPKDRNAMRFLWVRDPYVDDSPLVEYRFTRVTFGVICSPAHLSLTIKLHLSKYTDKK

SEQ ID NO: 126164 - protein, 443 aa, Heterodera glycines
  misc_feature (440)..(440): Xaa can be any naturally occurring amino acid
  Coding regions on vcDNA: vcDNA=SeqID_52587; Strand=+; Position=1 -111,198-263,689-782,1445-1594,1831-1904,1959-2001,2235-2271,2372 -2467,2653-2788,2848-2909,3305-3404,4028-4181,5211-5286,6519-6575
  Homolog annotation: Hit_ID=CAE58586.1; Match level="QueryCoverage =93%, HitCoverage=35%, E-value=1e-90, Identity=42%"; Hit description =Hypothetical protein CBG01752 [Caenorhabditis briggsae]
VLSFTLSQWKISKSTILQPTHNHQHLLVAGNELAPDCIYMFHIIYMFHIASQLLVRTFSSSDQKQDTVQQHNQHHFFVSTSADGAVRVWSFTQVEKLKTLHACSARILCSVLSSDDQWIAVGSADSCARVLLLDSGQVTRTFKEHTGPVVGLQLSSDNTLLVTGSGEFVVMVWDIEKGEIVVRLQGVWDIEKGEIVVRLQGLMAPVTCLALTSNNDAFLAVACEDETLRVFSLVSAQELHELTGHESRINALVASGDDCKLFAGTRGRVIVYDIHNGQLLEVLQCAQRQPVSSVSSVRISDDDSFVLVACGDRIHMWALDSIERDVAAVQQHKMAAVTVAPPESPSSSAGCGTADGIVAFWDLDVCQCMWTSNAQRNGAVSALCFSSDSFLLLSGSEQGRVLSCDSSDNAYLWSLASLDESSGGESFGVSLPCFGRPRAXIFI

SEQ ID NO: 126165 - protein, 75 aa, Heterodera glycines
  Coding regions on vcDNA: vcDNA=SeqID_52588; Strand=+; Position=1-228
ICLHNTPANLHSTSASRYERVTMPSPSSSSKNQPEAQARAPPARGGAGGGSFALELSATTTGAASEQIGEEREKQ

SEQ ID NO: 126166 - protein, 69 aa, Heterodera glycines
  Coding regions on vcDNA: vcDNA=SeqID_52589; Strand=+; Position=1 -57,288-440
MGDRIPPANGADKEPVTSRATNSAIAAPAERDAATASATAAQSPDAAASTAQQSQKERRTRRSKLCTIM

SEQ ID NO: 126167 - protein, 232 aa, Heterodera glycines
  Coding regions on vcDNA: vcDNA=SeqID_52590; Strand=+; Position=1 -474,568-690,736-837
MTNELASTETQTEPEEKPKTFAFGLQTDQTGLIDSEMQTVSEEKPKTVTFAMQTVQTDLVNSEMQTLSEEEPKITNKLITTEAQTEPEEKPKTFAFGLQTDQTGLIDSEMQTVSEEKPKTVTFAMQTVQTDLVNSEMQILSEEKPKMTNDEVLELNVSKLPMDADSSFLSNQGRSSPLLDESLRRKYNEKCEEMAELRYAYEFQQSIISNQLDEIARLKQQQQLRNGVQKNG

SEQ ID NO: 126168 - protein, 64 aa, Heterodera glycines
  Coding regions on vcDNA: vcDNA=SeqID_52591; Strand=-; Position=1-223
AVAKNGVSKNRNYAQKALQTILALPIPSTIAFIHPIMSAKIIRVPKIACDLSLAKNGVSKNRNY

SEQ ID NO: 126169 - protein, 61 aa, Heterodera glycines
  Coding regions on vcDNA: vcDNA=SeqID_52592; Strand=+; Position=1-185
VKSGSSLLISFYHRPDHHRCRFSVAADRIAVLYRARTGGRNPWRIFPFRAFVGRFVLSTDA

SEQ ID NO: 126170 - protein, 91 aa, Heterodera glycines
  Coding regions on vcDNA: vcDNA=SeqID_52593; Strand=-; Position=1 -87,130-317
MAVRRRVAHHEAGHIMANHLNKDGAECLASDIVEDQFNDGHTWVSLREKYTLAQVTATLQYFLGWFFKLNPKFVLHIKEVRHRRKQYLVFT

SEQ ID NO: 126171 - protein, 27 aa, Heterodera glycines
  Coding regions on vcDNA: vcDNA=SeqID_52594; Strand=-; Position=1 -48,122-157
MTCIIYIFDSPLFYINRKQPDSKNNLN

SEQ ID NO: 126172 - protein, 670 aa, Heterodera glycines
  Coding regions on vcDNA: vcDNA=SeqID_52595; Strand=+; Position=1 -498,592-2106
  Homolog annotation: Hit_ID=XP_320889.1; Match level="QueryCoverage =71%, HitCoverage=58%, E-value=9e-77, Identity=34%"; Hit description =ENSANGP00000012033 [Anopheles gambiae] ref|XP_313651.1| ENSANGP00000013044 [Anopheles gambiae] ref|XP_314
MAEPKAKAGKGPGPYTAEMAWKIWEERFEFFIKLRAVTDADTKKLLFFTEIGPIYEELRQMALPDDVRDMPLDKIKALMRDQYGETKTVAAKRHELFAAKQTQGQTIRDYAIKLRTLIANAEWHRDSVDMCLTALFINGLADDSIRAELIKKGDNALKFKDAIETAKKAGGNSTPGKCHRCGRNGHWASECPSKNTECRKCGRIGHWAVACKAKQSTVSNAAKGRQGSSYYKGKPVHQISAQKRDSSADVASVVKSKQVKSLTAPPAFVQLQLQKEEADFELDSGADVSLVSEDDWIANGEPKFSTCSGLHAYGGKPINVLGFFESKVKYLGRETTTDLYVVKDNVKNLCGRDLIKKLQIDLNKAFGIGMVQQIRDTKFGSKLDEVLQNYAEVFSEGLGRCTRHIALKFKTDVQPKRCKPRPVPFALRSEVEKVINQWEKEGVLEPVATSEWATPLVIVPKPGNKIRLCCDYKVTVNPCLDIHQYPLPRPEELFSALNNGDKFSKLDLKEAYLQLPLDDQAKECLTICTHKGLYRFSRMPYGVASAPAIFQQVMEEILCGIDGVAVYLDDIVVTATNNAEHLKRLDAVLQRLQKAGLRVKKEKCSFMQESIVYLGHIIDHQGIRTSPEKVEAIRKMPAPENLKELQSFSRDGWLLRENHPFIGDGLGTFE

SEQ ID NO: 126173 - protein, 73 aa, Heterodera glycines
  Coding regions on vcDNA: vcDNA=SeqID_52596; Strand=-; Position=1-220
MDFHIIGLSSYSTNCSMLSYDIFSSIPICFHSAQFVAASSCFSVQRTDCTSKITISGRSAPFTEMPAEANDLP

SEQ ID NO: 126174 - protein, 32 aa, Heterodera glycines
  Coding regions on vcDNA: vcDNA=SeqID_52597; Strand=-; Position=1-101
ENRHFKRSIFSLSGIKPLIPVCPSKAGWDPWA

SEQ ID NO: 126175 - protein, 157 aa, Heterodera glycines
  Coding regions on vcDNA: vcDNA=SeqID_52598; Strand=-; Position=1-471
MKLCLFLFLFMFLIVEIAKVGSEEKKLQQKSFDEIFGEKWQEKEEKQRNEQKKREIIRTFNKIKEKIKEKGRKYPRKEWNKIDQKIAKKLETNPMKIYKCIKELGLNQKNSYKSKTDEQKIEIVQKFIEMTNEYKQKRKYSSKEWEQNYEEIGKKIG

SEQ ID NO: 126176 - protein, 30 aa, Heterodera glycines
  Coding regions on vcDNA: vcDNA=SeqID_52599; Strand=+; Position=1 -17,440-515
MPNSALQSIITRMKLCQIMELSLIAKYGKL

SEQ ID NO: 126177 - protein, 43 aa, Heterodera glycines
  Coding regions on vcDNA: vcDNA=SeqID_52600; Strand=-; Position=1 -42,740-829
MIRRGTTVIGRGTTSFNSLKLTVIRRGTKLLEEVQKCLEEVQL

SEQ ID NO: 126178 - protein, 36 aa, Heterodera glycines
  Coding regions on vcDNA: vcDNA=SeqID_52601; Strand=+; Position=1-109
MAQQRQNVGGQKPAVGTAHVDDGRAVERAGGGEGAA

SEQ ID NO: 126179 - protein, 33 aa, Heterodera glycines
  Coding regions on vcDNA: vcDNA=SeqID_52602; Strand=+; Position=1-100
MAQSLDPKVRRRRPMGPMKVPAIGSRIGRWPTK

SEQ ID NO: 126180 - protein, 78 aa, Heterodera glycines
  Coding regions on vcDNA: vcDNA=SeqID_52603; Strand=-; Position=1 -82,181-335
MDQIEHFSVCEETPPKEPSVVDITYDPAIVSVSKPPVAADASAPQQPVQQPSVAEQLQRIADDKSKEIGTRHFEKDWK

SEQ ID NO: 126181 - protein, 331 aa, Heterodera glycines
  Coding regions on vcDNA: vcDNA=SeqID_52604; Strand=+; Position=1 -315,540-679,1122-1434,1603-1751,1807-1887
  Homolog annotation: Hit_ID=XP_316911.1; Match level="QueryCoverage =44%, HitCoverage=13%, E-value=6e-11, Identity=28%"; Hit description =ENSANGP00000006552 [Anopheles gambiae]
PTGVLTIEEVNSVYQHYSHQNLSDATGLFPLKFPTHRRNKNKGTIEMEIEKVSEFVLEPVGSGRFSDAMDIGGFPWKIMAQIRTKNESNEKWLGFCLSNDGLENENWSCKSSATLRIVSQKNGTEDLIGTFNDRIFNKEWSIYGKYFISFAELLDPGKGFYDKSEDKVKLAIDVIVDEPKTEKSISDPNKSNGTLSTEIEKLSEFAREIEGSERKSETAVYIKGMPWKILAYIKMKNESTEKWLGFLLLCDASKKGGNWSRKCSTTLRIVSQKNGVEDFKRESSEKRIFNNAKPSWGWNYFISFAELMDPSKGLYNKDEDSVTLAIDFTCE

SEQ ID NO: 126182 - protein, 49 aa, Heterodera glycines
  Coding regions on vcDNA: vcDNA=SeqID_52605; Strand=-; Position=1-167
SSGRTIPEKVDEAVQGSIPVRSAKTLDDFSPQRPMPEFKIGQLHSTLTF

SEQ ID NO: 126183 - protein, 176 aa, Heterodera glycines
  Coding regions on vcDNA: vcDNA=SeqID_52606; Strand=-; Position=1 -232,439-737
MPPGISRENIKKRKTSTSEGSDEEDSGQEEQQAPELNIASRQRRTAAMKSHKVWDVLKPGAKMHAEGETEPNEAPTTAPKVGRPSLKRKTPSSSFTSPLEDNAKMETEFPTEIVKEQMDEKTDDHLPTQRGIQRIIVNRKMAATSLSTTNLWPQPQPAKDKGQLQLIEANRRKNKS

SEQ ID NO: 126184 - protein, 472 aa, Heterodera glycines
  Coding regions on vcDNA: vcDNA=SeqID_52607; Strand=-; Position=1 -269,470-577,619-710,754-1486,1537-1750
  Homolog annotation: Hit_ID=NP_742119.1; Match level="QueryCoverage =25%, HitCoverage=12%, E-value=5e-09, Identity=30%"; Hit description =zinc finger CCCH type domain containing 3 [Mus musculus] gb|AAH60682.1| Zinc finger CCCH type domain cont
MFNNHANHFMPNFCIPPPPPPQLPQPLNSAVNSFGVDFCDPCSLASFLSAGSSSPSSGLLPSTSTCTSSYEPSVLQFKRSASSNYAKYQHKTFHTGHANGFTSKGNGAPLSRSRKRFLEQITNEEGTSGELRIELDTAPRNRPLSGQSSTEVDQEAADESPNSKESGCSENSQESLRLVPTDNDSDGEHPEMGRNWRILMLFNGLVRDEDLAPNCERPQAEDGRTYPDIQKKVFTQNGVEQKEQHEQHKLLKLMSLKLPLDTNHEVVPASSSSRLGYGMRTSNVWVSTDLMAKMIQQQQTVSFTTKSSAASDNSIPPPPIVHDKNNLQPNTRETVDARHPGTRKRLHHNRSLIILKTGQRVYQGSKDCFQFLETGNCLNGVFCEYEHEESTEHSAKKVCPFLMRGQCRNIDDNCSHGPHSTLKAHQMPVCDYYLRMCCSKGKDQCAYLHVKHTDGMEPCEEFNRGCCQQGVM

SEQ ID NO: 126185 - protein, 184 aa, Heterodera glycines
  Coding regions on vcDNA: vcDNA=SeqID_52608; Strand=+; Position=1 -89,310-384,447-632,694-793
  Homolog annotation: Hit_ID=XP_312464.1; Match level="QueryCoverage =99%, HitCoverage=19%, E-value=2e-33, Identity=43%"; Hit description =ENSANGP00000021939 [Anopheles gambiae]
VFMCQNAKICVFVFISRSKTKIVRRKCYFEMTSIIKLEALSGVQDDGPLCYLLQVDQVYFLLDCGWDEQFDLAVDQVYFLLDCGWDEQFDLAYIEAIKMRIPQINAVLLSYGDVPHIGALPYLFKNGLNCPVYATVPVYKMGQLFLYDWINVPVYKMGQLFLYDWINGHMTGKDFSLFNFDDID

SEQ ID NO: 126186 - protein, 60 aa, Heterodera glycines
  Coding regions on vcDNA: vcDNA=SeqID_52609; Strand=+; Position=1 -54,189-317
MYLTEKFEILLAVKSYLKELEGQICLSPTHLTHSIRNRSKSSGTKIWCPNFSPQFGTGAT

SEQ ID NO: 126187 - protein, 100 aa, Heterodera glycines
  Coding regions on vcDNA: vcDNA=SeqID_52610; Strand=+; Position=1 -72,606-711,914-1038
MIVLLSTAKGADAHFLVGKSDKKELVHAHKGILMISSNVFEAMFQKEAENSNNRTTDGKVVKDGPLLISDADAEAFKVMLRFIYSDDLSELNGQNAVEII

SEQ ID NO: 126188 - protein, 448 aa, Heterodera glycines
  Coding regions on vcDNA: vcDNA=SeqID_52611; Strand=+; Position=1-1345
  Homolog annotation: Hit_ID=BAA12105.1; Match level="QueryCoverage =41%, HitCoverage=11%, E-value=2e-10, Identity=26%"; Hit description =The KIAA0191 gene is expressed ubiquitously.~The KIAA0191 protein retains the C2H2 zinc-finger at its N-te
MAQHTATWLEYEDGFCSLALAKGGKGKVLVMPFAESDVSDQGFLTESGVSKTVDELERILRGKKEEASSSLDIRLQRFVEARTHQADEVNTNMLDVDTSKPMVVLAACTSAAQHPIEHQEEVHIAMPQAEEVPWTWGTKHYFVNDVKISATKMRELDEALEALILSQVPPPEERELKQLTFEAVKRILRRDTWEDFEMRIAGSTRANTALRNGDLDIILMPKSGEPLSHERKLRELKFLVREFRLMKRQYPYRHCVAITKTKAPLIKIRTSEDVDIDITMDNTEALRNSNWLAEQTNDSKLWRLYMTVKIFAKHNGIGDASCGGLNSLAWAVLTTHFAASRGQERCETPLLDFLQMAEYFSEFPFEGYTITTTGWRERKSSSVPIYVEDPHNREDNCARNRQAQDVCRVKNKLTQAWSQFIRKKDKCRLADLGFPCPRDEDVGWPSAR

SEQ ID NO: 126189 - protein, 95 aa, Heterodera glycines
  Coding regions on vcDNA: vcDNA=SeqID_52612; Strand=+; Position=1 -24,84-346
  Homolog annotation: Hit_ID=CAE72291.1; Match level="QueryCoverage =100%, HitCoverage=5%, E-value=6e-35, Identity=71%"; Hit description =Hypothetical protein CBG19421 [Caenorhabditis briggsae]
QIHCYDEYEASVDKEGNVSNQRARVRLFCLAFLSGTSFLEIGLNDRRREGKEVVRRKDILPMYTERWIRFEAPELHETVDKVVWEEDQVLRINPP

SEQ ID NO: 126190 - protein, 231 aa, Heterodera glycines
  Coding regions on vcDNA: vcDNA=SeqID_52613; Strand=-; Position=1 -388,572-828,888-912
  Homolog annotation: Hit_ID=CAE72291.1; Match level="QueryCoverage =90%, HitCoverage=13%, E-value=3e-79, Identity=66%"; Hit description =Hypothetical protein CBG19421 [Caenorhabditis briggsae]
LIGFTTNEFNAMFVHRSLPLCQIQANYSLSDIVLQPYDVFTKIHTVKLQHILYKERIGIRPGQISRLVEGHLTKYGLPLEHAAQCTVLAKFGSLNERTIASFTDALENVLFHCPAKRETAPTYKQDEVQIHCYDEYEASVDKEGNVSNQRARVRLFCLAFLSGTSFLEIGLNDRRREGKEVVRRKDILPMYTERWIRFEAPELHETVDKVVWEEEQVLRINPPQVLRINPP

SEQ ID NO: 126191 - protein, 320 aa, Heterodera glycines
  misc_feature (161)..(161): Xaa can be any naturally occurring amino acid
  misc_feature (186)..(186): Xaa can be any naturally occurring amino acid
  misc_feature (202)..(202): Xaa can be any naturally occurring amino acid
  misc_feature (227)..(227): Xaa can be any naturally occurring amino acid
  misc_feature (231)..(231): Xaa can be any naturally occurring amino acid
  Coding regions on vcDNA: vcDNA=SeqID_52614; Strand=-; Position=1 -815,1793-1956
  Homolog annotation: Hit_ID=T02995; Match level="QueryCoverage=99%, HitCoverage=59%, E-value=4e-65, Identity=48%"; Hit description =unspecific monooxygenase (EC 1.14.14.1) - common tobacco dbj|BAA10929.1| cytochrome P450 like_TBP [Nicotiana t
MYRPSQTPRLTLSSARVGVARLNTKMDTLSGALPFYRLSKESMKVVVFHWRLAAPTYATPLMILHKVRLESSSTGSSFPAKFAKPVPLAVVSLDSRRDSGNLVDPFVRVGKPTRHLATLRESCYSPVYPRLIKFPWLNIQSTGQKSDTVNVHKDHPSPLFXLDSRIPRVRASSKLVVQRQPKCIPXRAYTQLKRSTSSSHHXSTHHPRKNSTQPRAKAACFTQQPGXPDLXSQFFSRSYESNLPTSLTYIILSTRGCSPWRPAADIDGSISLSPLYPSQTIDLHVRIASDFHQSFLWLHPAQEVTIFRVSAHTLCLAPSH

SEQ ID NO: 126192 - protein, 611 aa, Heterodera glycines
  Coding regions on vcDNA: vcDNA=SeqID_52615; Strand=+; Position=1 -239,338-738,781-1123,1170-1609,1653-1844,1891-1986,2031-2155
  Homolog annotation: Hit_ID=NP_001004509.1; Match level="QueryCoverage= 97%, HitCoverage=45%, E-value=1e-65, Identity=29%"; Hit description =si:busm1-180o5.3 [Danio rerio] emb|CAD60788.1| novel protein similar to DNA polymerases [Danio rerio]
MKVRKQKRRNPNVVFRDSFNLMPCSLAALIPSYGLDVEDKPFFPHLANRPENYGRAIHPTPEDYLANGMMPGKRRQFDMCYCTNDVEILMAALVAFRREFFEITRRQEYVEGIDDRENHDGIDALRECMTIAGACMRHFRTNHLPAEHLAIVPERGYDNAQNQSLLALRFFYWYSEEYDVEVQTAHSAGGEKRIGPYSLDGWIEAEGRAIEVNGCTWHGCKKCYPNDNMVLPSGKTAGQIRERDGKRMEYLSARVNRIDVFWECKIDEMLARSKAMRKCFANYVDDGPLVIRDAFMGGRTGPMKLYHKAARGEKISYYDFTSLYPYVNFTTRYPIGHPKVHVFNQQVVWTKEYPTGGVDDDYHCQHNDQQRGWVSTCTSIELNAALDEGYRVTRLFRVLEYEDSDDQLFRPYIAEFMAQKIQASGFDNEIKGNAAMEEQFVRECAEMFGINVDPTKMAINKGKRSIAKLRLNNLWGRFSLRNFGLCQTLITDSPVVLAEYLDNKSVEVASIDQLDEKHILISYQHKKDWVDEHACSNIVISLWTTSTARLVLLKAMQKVVRSERCELLYTDTDSLVLVHPEGRCPLKTGPHLGQFTDEYPDHDIVEYCSGG

SEQ ID NO: 126193 - protein, 136 aa, Heterodera glycines
  Coding regions on vcDNA: vcDNA=SeqID_52616; Strand=-; Position=1-411
MAFLCHFQRFFGTNLSIDTKNGQISDFTIRNAWPMIKDNVCTVRWFSSKHSKDLGQFVPTDLNECKSLRYLYSDGNFIELPVHDGTGALSIGQAVAKWLFTPRPGGVPKNVSLLLSKSMAVRLKKFIQWHFVQKSV

SEQ ID NO: 126194 - protein, 69 aa, Heterodera glycines
  Coding regions on vcDNA: vcDNA=SeqID_52617; Strand=+; Position=1-422
GRGKQINENQLNKLLKQHLFGPLNLCFNLPKNQCVNGTLYKCKFVQLAAFRTKAFQINLKKANLFLAFF

SEQ ID NO: 126195 - protein, 25 aa, Heterodera glycines
  Coding regions on vcDNA: vcDNA=SeqID_52618; Strand=-; Position=1 -47,79-109
MSDNGKEANKQIEKETIKPKLKPKA

SEQ ID NO: 126196 - protein, 84 aa, Heterodera glycines
  Coding regions on vcDNA: vcDNA=SeqID_52619; Strand=-; Position=1 -102,282-434
  Homolog annotation: Hit_ID=AAH57950.1; Match level="QueryCoverage =92%, HitCoverage=21%, E-value=3e-09, Identity=45%"; Hit description =Serpinb6a protein [Mus musculus] ref|NP_033280.1| serine (or cysteine) proteinase inhibitor, clade B, memb
MGMPTAFTNSANFEGISGKKTLLLSEVVQKAVIEVNEEGTVAAAVTEEEVECCSSKEYRFVADRPFCAFLIRDDTVLFSVIFRK

SEQ ID NO: 126197 - protein, 40 aa, Heterodera glycines
  Coding regions on vcDNA: vcDNA=SeqID_52620; Strand=+; Position=1 -57,314-379
MDNILLEIFICCFCITTYSRAIVTNYPPREEAKDFHLQIH

SEQ ID NO: 126198 - protein, 1421 aa, Heterodera glycines
  Coding regions on vcDNA: vcDNA=SeqID_52621; Strand=-; Position=1-4266
  Homolog annotation: Hit_ID=NP_491240.1; Match level="QueryCoverage =81%, HitCoverage=84%, E-value=0.0, Identity=36%"; Hit description=zn- finger, CCHC type and RNA-directed DNA polymerase  and Integrase, catalytic domain containing protein fa
MDAQQLQQILDAALKKSAEVFAAALNIQNQNPNPGSSTTASLAASINVRLEKFNYNPEVGQTYDAWLNRYGKIVQQDGASLPEQSKVQLLVGKLDEEEYKRYIDSIAPKATEQFNWLETVANLKKIFGETRSLFLRRFDCFQIRQCQNQDLSSLLAQINSSCENAELDLKKEELKCMILIISLRDEFSDLKQRCLQRMEEARTNGKSITLQELGEECKKYQILKESTLALSTKQYNANAIRAKPQQVKDKADATKQYAKPKAVPKPYESKHKLPNRPCQSCGSTNHWRSDCGHRDAKCPKCGKIGHLGKVCRSNSSIRHIQTVNTTERHAQINTVIIDLNCMEIKADHPKWWKIPIKVNGSDYPMHVDSGAQITLFTIQTWIQMGKPPLTSANIRVKNCNDQTFAINGQFMCKVQYMDRPPMKLLAYVSPEISHNLLGMPWIEALEVIPKEIMHPNLHPKINTISTKTNEIKDTETLISALKSTHSDVFSPELGHCTKFKANLILKNGAKPIYCKARPVPHGALDDVNAEIDRLLKMEAIKPIEFSHWAAPILAVKKRNGRTRVCIDFSTGLNDALELHRHPLPRPEDIYNAIAGSKYFSRLDLRDAYLQLELSDESKKLCTINTHRGLFQCQRLPFGVKSAPAIFQSLMDKIITPINGAFVYLDDVIIANTTLDQHVKTITKVFDKIKQFGFQIQQEKCSFLQKETIFLGHIISENGIRPDPSRAEAIRKMPAPHDKSTLRSFLGALTYYGKFIKQMREIRSPLDELLKKDVPWNWETDQQKSFEKAKEIMLSDLLLTHFDPKLPIIVAADASKGGIGATISHQFPDKSERVIEHASCTFTAAQQNYSQIEKEALGLVFAVQKFHRMLYGRKFILLTDHKPLLAIFGSTKGIPIYSASRLQRWALILSNYEFDIKYVNTKAFGNADVLSRLIANYPRPSEDILIANICNDTDCCVNFVFEAKIEQLPITAKIIADETAKDEILQQISAFTKQGWPQKFDNIKLSPFLPKKAQISEIEGCLAYGERIIIPSTLRNNILKSLHFAHPGIVRMKAIARNHVYWPGIDSEIERLVKQCEECHSAAKNPTKANLQPWKAANGVFERIHIDFAGPCADGQTYLVLVDAYSKWPEVWQMERTSSQLTISMLKSFVHRLGIPKEIVSDNGSQFRSAEFAQFCKEFDIKHTFTPPFHPMSNGAAERFVDIFKRSMKKCRQEGKDWLQKVLLAYRTTPNTALNGHSPDELFLGRRMRTRMTLVHPEKQKLQPTNLENFQQFQGQYIKKMENQFNKKHGAKSTIFQNEEPIYFWNLKNNKAIWLPGKIIEKFGTSPTYRILAPTLGRAIHRHANQIRRRFPIELEDNDQVVENDQTQAQNPQQSPIAHKPQTNRQQSPAQPVLLRRSGRAKQAPQRLVLDPTKPKYGLIRS

SEQ ID NO: 126199 - protein, 337 aa, Heterodera glycines
  Coding regions on vcDNA: vcDNA=SeqID_52622; Strand=-; Position=1-1014
  Homolog annotation: Hit_ID=XP_320889.1; Match level="QueryCoverage =98%, HitCoverage=40%, E-value=2e-79, Identity=44%"; Hit description =ENSANGP00000012033 [Anopheles gambiae] ref|XP_313651.1| ENSANGP00000013044 [Anopheles gambiae] ref|XP_314
MGRPPKKLLAYVSPEITHNLLGMPWIEALEVIPKEIMHPNLHPKINTISTKINEIKDTETLISALKTTHSDVFSPELGHCTKFKANLILKNGAKPIYCKARPVPHGALDDVNAEIDRLLKMEAIKPIEFSHWAAPILAVKKRNGRTRVCIDFSTGLNDALELHRHPLPRPEDIYNAIAGSKYFSRLDLRDAYLQLELSDESKKLCTINTHRGLFQCQRLPFGVKSAPAIFQSLMDKIITPINGAFVYLDDVIIANTTLDQHVKTITKVFDKIKQFGLRIQLEKCSFLQKETVFLGHIISENGIRPDPSRAEAIRKMPAPHDKSTLRSFLGALTYYGK

SEQ ID NO: 126200 - protein, 35 aa, Heterodera glycines
  Coding regions on vcDNA: vcDNA=SeqID_52623; Strand=+; Position=1 -14,79-172
MNLKRKINLFIFKSETECPKKTKMMMNVPEKHFGK

SEQ ID NO: 126201 - protein, 49 aa, Heterodera glycines
  Coding regions on vcDNA: vcDNA=SeqID_52624; Strand=+; Position=1 -143,1002-1008
MQTYYYFLICLSCFLANKIERNNSDDEEDYWPNETVESYIDDTDSVVKL

SEQ ID NO: 126202 - protein, 69 aa, Heterodera glycines
  Coding regions on vcDNA: vcDNA=SeqID_52625; Strand=+; Position=1 -14,79-274
MNLKRKRNLFIFKSETECPKKTKMMMNVPEKHFGTKGIGCGTDERHKCEKCDGRRKEQQNGNGRWTRHF

SEQ ID NO: 126203 - protein, 120 aa, Heterodera glycines
  Coding regions on vcDNA: vcDNA=SeqID_52626; Strand=+; Position=1 -143,832-906,1339-1483
MQTYYYFLICLSCFLANKIERNNSDDEEDYWPNETVESYIDDTDSVVNLPPNVKEKLRDFNFIPMTPAPPPMGRIFFTVGVMVAISILFGIIIFLIYKKRNTNGTHTEAPADEFEMETLV

SEQ ID NO: 126204 - protein, 87 aa, Heterodera glycines
  Coding regions on vcDNA: vcDNA=SeqID_52627; Strand=+; Position=1 -148,703-818
MQEVALANDSAQFAEKSMSMAATKSNGWVLLMKVVIILEQNKFVSFNNETRSPTRVFCPHYAQLLRASADQGTLSAESLRWCCALRK

SEQ ID NO: 126205 - protein, 36 aa, Heterodera glycines
  Coding regions on vcDNA: vcDNA=SeqID_52628; Strand=+; Position=1 -81,462-491
MPGPGPGPGFHVGPGPGFPGQKSRKIQSHNSAFMLI

SEQ ID NO: 126206 - protein, 37 aa, Heterodera glycines
  Coding regions on vcDNA: vcDNA=SeqID_52629; Strand=-; Position=1-112
MDVLQTKRIAFIEFARNGEAENAISKMDGRTIDGFVL

SEQ ID NO: 126207 - protein, 215 aa, Heterodera glycines
  Coding regions on vcDNA: vcDNA=SeqID_52630; Strand=-; Position=1 -111,154-322,366-730
GGLSEAKLISQMALLELGNYDTIPETLSKLMQKKLANVVGPGRWIVPTSEGLQRLEATFQSVLNKHGLLIKSFRQDGVDTDGNTEQVSDDVLEERDEDDGSDVREVKQHSDRRARKRVRFDLTVPTSALLRSRSMGPMRSLDFNTGGVHLGGIGLMAIQLLDRSPPIRRHRRAPSPEISRKNFNDFSPTDRSHHPTLRTSFSRHSMQEIGKQQQR

SEQ ID NO: 126208 - protein, 217 aa, Heterodera glycines
  Coding regions on vcDNA: vcDNA=SeqID_52631; Strand=+; Position=1 -32,88-139,173-266,326-488,539-643
  Homolog annotation: Hit_ID=NP_509693.1; Match level="QueryCoverage =100%, HitCoverage=6%, E-value=8e-49, Identity=52%"; Hit description =glutamate synthase (XK721) [Caenorhabditis elegans] emb|CAA90070.1| Hypothetical protein W07E11.1 [Caenor
YLDQIRKDDVLNHGAITNEYLNHGAITNEYLIKRQLKHAGKEHGKLRDTHLDSDRRLPLLIKRQLKHAGKEHGKLRDTHLDSDRRLPLFSYTPDTFSLILVPMIMERKILVPMIMERKEALGSMGNDAALACLSDYSPILFSYFQQLFAQVTNPPIDPFREQVVMSLRCPIGPESNLLEPEIVVMSLRCPIGPESNLLEPEIQLEGRILLDHPVLSL

SEQ ID NO: 126209 - protein, 217 aa, Heterodera glycines
  Coding regions on vcDNA: vcDNA=SeqID_52632; Strand=+; Position=1 -42,102-269,362-411,567-688,747-976,1036-1075
  Homolog annotation: Hit_ID=NP_509693.1; Match level="QueryCoverage =100%, HitCoverage=10%, E-value=1e-81, Identity=64%"; Hit description= glutamate synthase (XK721) [Caenorhabditis elegans] emb|CAA90070.1| Hypothetical protein W07E11.1 [Caeno
MRVALIVESGEVKQVHDFCVLLGYGADAVCPYMVYETRYRLRSMGLIDKSLTDDDVFQGYKAGIERGIYKGAQIFEIVGLAQEVVDKCFTNSVSRLGGADFETLAMEACRRHRIGYPNVLNSDLYLYGDSKVLVSPGVYHWRDGGEKHVNEPVNIAKLQAAARLNDAKSYQEFSRASNLAQRLCTLRGQLEIKTNVKLQIPLEEVEPAAEIVKRFVT

SEQ ID NO: 126210 - protein, 133 aa, Heterodera glycines
  Coding regions on vcDNA: vcDNA=SeqID_52633; Strand=+; Position=1-402
MPFNPGLRLIAKTLANSLWYFIFLRYIKKMIGRGKLAQRVGHTEIQYTRTPAEFHKLLDDPTYDKLDFVHVSDHMDRVVVRKRPEFAKAPLTNCLPVAIFVTSYARLHLYGYMEQVLTLNNAELLYCGLSFTV

SEQ ID NO: 126211 - protein, 188 aa, Heterodera glycines
  Coding regions on vcDNA: vcDNA=SeqID_52634; Strand=-; Position=1 -360,439-645
MHRLSAELPFSQVLSPSGKLMSANANAFPLLHNNNNNLQIFSSPTKSGILAADSPSASPGKQSEDDELAKQKIRSTELNGRMKQLEKANEQLNDQLNMAQEEYNNLEVKFEEMRVVNIKLQETIRNLNGRLKEAQDESELRRYEFEQLKREQRNANERNTKASGKMDKHAKEVEEKERELQLLHKRWI

SEQ ID NO: 126212 - protein, 174 aa, Heterodera glycines
  Coding regions on vcDNA: vcDNA=SeqID_52635; Strand=-; Position=1 -225,269-568
MTGSGPIQFGLHSPQPSTPTIPLSEESSLQLIPRWEQDIVCPPRFPISFWNVYTRAQMAIERTNNGMEAAHGQFARELNHHPSLSDFIAAFTKDINKQLDIGRAEQLQKSTKRRQRYVIKEQNVVRILDEADFESEEGLTNALHLLGIVMQGFAEGLHVRGNSESGEETEADEN

SEQ ID NO: 126213 - protein, 161 aa, Heterodera glycines
  Coding regions on vcDNA: vcDNA=SeqID_52636; Strand=-; Position=1 -175,280-590
MPTVREILESLQKPIKRPRIPTNEDSVLNAERTDAEQQMEDTSTRNDLDVAASDDEENCFRFLKIRKDGSWFRCEQRNCPATAKLEDNGLVTGILGPKEHHHGCAPSRFDAETKRNQMKRLIKEKPKTKPCQLRAQIRTDIDDEVLELLGTNEALDQMTNR

SEQ ID NO: 126214 - protein, 81 aa, Heterodera glycines
  Coding regions on vcDNA: vcDNA=SeqID_52637; Strand=-; Position=1 -25,244-464
MAKNVGVRVTKSLVTKGVPTFRQLDISPTDISPTDILPTQPKTFISPTQPKTFISPTQPKTFISPTKPKSDISPTDISPNS

SEQ ID NO: 126215 - protein, 67 aa, Heterodera glycines
  Coding regions on vcDNA: vcDNA=SeqID_52638; Strand=+; Position=1-204
MAATVAEVAAEAAEPPVGEQDADDEADDAFAAPAAGVAALAANDDSVPPFSTMPPMPLLTDEAGTRS

SEQ ID NO: 126216 - protein, 179 aa, Heterodera glycines
  Coding regions on vcDNA: vcDNA=SeqID_52639; Strand=-; Position=1 -229,250-455,783-977
AFLSHSHSLSSLFLNQKYYYRTISSKFYFFHYYFFQNAIFFFFFGMAPNLALSVLTLLLHFLSFIPFPFVYHWSVVCFCSVIVCQLSLLPPSVALFHKSLLFSPFLFLMLPIKFSLRYDNIIYVHLCFPSFYLVPIPPKSPFFFHVCHHGNHYFLILLIINNSFFCFFKFVNISPSLCP

SEQ ID NO: 126217 - protein, 276 aa, Heterodera glycines
  Coding regions on vcDNA: vcDNA=SeqID_52640; Strand=+; Position=1-828
  Homolog annotation: Hit_ID=NP_504187.1; Match level="QueryCoverage =88%, HitCoverage=19%, E-value=7e-46, Identity=41%"; Hit description =predicted CDS, integrase, catalytic domain containing protein family member (5E782) [Caenorhabditis elega
MAYRRLTTMLQRLQKTPEVLKLYTTVITDQLNAAIIEETTIGAGKHEHFIPHQAVITPKKLRVVYDASAHTRGAPSLNDCLLRGPVWLPDLAGMLIRFRACRVPVIADVEKAFLMVGIEEDDRDVCKFLWVRDPFRPVTTDNLVTYRFRRLAFGLTPSPFCLAAVVRHHLRKYDSNFAEELIRDTYVDNVLIPADTAEEAAIKGREAKRMFADARMNLREFLSNDETLNSSFSDAEFLGKTTAKVLGLEWNAETDKIRMKYPGSEPGTPISTTRRT

SEQ ID NO: 126218 - protein, 83 aa, Heterodera glycines
  Coding regions on vcDNA: vcDNA=SeqID_52641; Strand=+; Position=1-251
  Homolog annotation: Hit_ID=NP_495249.1; Match level="QueryCoverage =93%, HitCoverage=8%, E-value=6e-16, Identity=52%"; Hit description =regulated protein precursor (104.2 kD) (2G539) [Caenorhabditis elegans] gb|AAA68352.1| Hypothetical protei
VLSANAEAFAQVECVFEDRDFRVKVTRDELEAMFRDFEQRHMEPINVALTMAQLTLDKLDRVVLMGAGTRMPRLQTVLDIFLQ

SEQ ID NO: 126219 - protein, 90 aa, Heterodera glycines
  Coding regions on vcDNA: vcDNA=SeqID_52642; Strand=-; Position=1 -11,74-335
MNRRWLCSDVWMDILPSFDRPQLGLKMALLSDRFDVLVDKHFDGKSELAIWRMIRIDKDKGPKAEIICADRRHFCGISVPRPSAAQQNPI

SEQ ID NO: 126220 - protein, 25 aa, Heterodera glycines
  Coding regions on vcDNA: vcDNA=SeqID_52643; Strand=+; Position=1-79
KERTPSDIPIFPFHNWPKATVLIDT

SEQ ID NO: 126221 - protein, 79 aa, Heterodera glycines
  Coding regions on vcDNA: vcDNA=SeqID_52644; Strand=+; Position=1-379
IVKNIRKLFSVLIMQYNAFKPRREAGQFQNFVPHFTVESPSTLLDNYVSMSTVAFGQLWNGKMGISDGVRSFLKIPLFV

SEQ ID NO: 126222 - protein, 224 aa, Heterodera glycines
  Coding regions on vcDNA: vcDNA=SeqID_52645; Strand=-; Position=1-673
MAPPPIRQSSTSSSVELDDERDELPPPPPPMVQQKLRNGMQREEREEAHRHSQPLPLPSLPPTTAQLPHHQQQQQSLPPLRSHLPLPSRVHPLRPPPPPPPSVPPVSKPSVTPLWGRNERLVNYLHGYGTLLGKNMEEKENIIVGPRRDAKLEEEERRRADEWAVHPIMLKEQRGRPEERVIPIQRRTTAQETTPWRGSPLLRSPRRISTEWTSGPTQNGHRRN

SEQ ID NO: 126223 - protein, 235 aa, Heterodera glycines
  Coding regions on vcDNA: vcDNA=SeqID_52646; Strand=+; Position=1-708
  Homolog annotation: Hit_ID=CAE70527.1; Match level="QueryCoverage =88%, HitCoverage=59%, E-value=1e-10, Identity=23%"; Hit description =Hypothetical protein CBG17156 [Caenorhabditis briggsae]
MKQDELLANFLSSPLPPLPPRKNSSTNTRKSTSVNDQHETNFHKQFGQNIFNSKDGSTESEKRSNQQTKKNPISIYGREGQEVSGNQSDQNTKKTSSDKQRNEKNKDISFAKKVVKYLSGHSSDTQKDQKPKNGKNEAGSTGKNTNQSNDVPSINNQRDQISQKATNDLYGQPSETPSYQKKANRMNGAGPSEKKSDQNDKSELNEGTPSENQIDKTKTNRLLKAKEILPFQQKE

SEQ ID NO: 126224 - protein, 134 aa, Heterodera glycines
  Coding regions on vcDNA: vcDNA=SeqID_52647; Strand=-; Position=1 -142,197-461
  Homolog annotation: Hit_ID=CAE68084.1; Match level="QueryCoverage =94%, HitCoverage=75%, E-value=8e-53, Identity=74%"; Hit description =Hypothetical protein CBG13717 [Caenorhabditis briggsae] emb|CAE57116.1| Hypothetical protein CBG25025 [Cae
TVHTLKMLSGDFEYEDPKSEEEVVNITYVTRDGTEKKIRGKVGDNAMYNIEIEGACEASLACCTCHVYVDEKYYDKLPAAVEDEEDMLDMAPLLKPNSRLSCQIILNKDLEGIRVTLPKITRNFYVDGHVPEPH

SEQ ID NO: 126225 - protein, 129 aa, Heterodera glycines
  Coding regions on vcDNA: vcDNA=SeqID_52648; Strand=-; Position=1 -66,261-416,778-945
MQLLADPLVKQIANKTAFVPTEKFAILFKNIRMNCSMEIGNKCASGTKLIMLAMSGRDSFERRTGARETWMKEAAPGEIQRFFIADPSGGEAADVKQKLKEEQKKHGDIVFLHGFVDKYKHLHLKVISK

SEQ ID NO: 126226 - protein, 121 aa, Heterodera glycines
  Coding regions on vcDNA: vcDNA=SeqID_52649; Strand=-; Position=1 -73,133-203,256-477
MISIKALTDANFKSILVELLNAKSDGSTQTEVSFKIGTDSDFEVAFPGSKSMPGKGVRLPPGSYLLNLDIVLNEHCSIMLKLNGTQFGEFICPTDVKMPLGAISWIKVKPMGENSFLGVED

SEQ ID NO: 126227 - protein, 327 aa, Heterodera glycines
  Coding regions on vcDNA: vcDNA=SeqID_52650; Strand=+; Position=1 -13,144-622,671-791,841-1211
  Homolog annotation: Hit_ID=NP_507780.1; Match level="QueryCoverage =92%, HitCoverage=17%, E-value=3e-20, Identity=31%"; Hit description =predicted CDS, DNA polymerase type B, organellar and viral family member (5T899) [Caenorhabditis elegans]
MSTVPSGFPADCAADDIDEEERERRKQQYINNPWKGCTVRLDANNIKPNPGMRYLSKLCLNSLWGRFALRNRLTKTEIIDCHADLAKLLNDVKIDISSIDQLTEKFWMVCYKAKDEHVVEHDTSNVAIALWTTAAARVHLLNSLQLVYRQENLVQRYDTRILYMDTDSIFYDFKTALGDPLKGGNKLGELADEYHSHTIVEFICAGPKAYALWLRNNATGEDEYKLKLRGITLDSNACTRINFEKMKEMVLEKWGTPGNHVRFDYPTKNFRITKQGDILTVPITKQFNPTVNKGVLRDRGLKVVPFGYSSWEYCKAHNPYDCLCKRE

SEQ ID NO: 126228 - protein, 190 aa, Heterodera glycines
  Coding regions on vcDNA: vcDNA=SeqID_52651; Strand=-; Position=1-573
  Homolog annotation: Hit_ID=NP_502797.1; Match level="QueryCoverage =71%, HitCoverage=38%, E-value=4e-22, Identity=39%"; Hit description =HASI (4P602) [Caenorhabditis elegans] emb|CAB16520.1| Hypothetical protein Y57G11C.19 [Caenorhabditis ele
ADLADFQALSRKNSGYRYLLLAVDVLSRRMFGSPVKSKRPADVKRAFEEVLGQMPRLPETLYTDRGLEFVAKPMKEFFAENGIKKYETSSKKKAAVAERAIRTVKTRLYKYFSAKNTSAWVDVLPKFLSAINNSVCRADLGQTKSVTSMRERCGRGSMAKDLYQRRRDQRSKREKLSESQSSNTYSRRVQ

SEQ ID NO: 126229 - protein, 201 aa, Heterodera glycines
  Coding regions on vcDNA: vcDNA=SeqID_52652; Strand=-; Position=1 -459,948-1094
MEMGVEEQQTDNNPQQQQKHVPSLTSNPVDNAVGGVETATTAHFDGHGERAATASPASSFEEALPAETTRSNSGSGGEDEHDGARHGNVDGDEHDGHGRQHSRHYQQQQEQQQRPQRQQKRCSRHFFSQEPPKLCSIIYAEFDNDIGRVIRYQVPDEIFDKQRFDTISSAIIPSEEMRDRMIKINMYDYKITGHPVGISEH

SEQ ID NO: 126230 - protein, 34 aa, Heterodera glycines
  Coding regions on vcDNA: vcDNA=SeqID_52653; Strand=+; Position=1-105
GPFGGLKQLWGAKIQRRIKVQAIGKLFPKDSVSP

SEQ ID NO: 126231 - protein, 135 aa, Heterodera glycines
  Coding regions on vcDNA: vcDNA=SeqID_52654; Strand=-; Position=1-664
VFGAVPLNRCAQIYGETESFRNSFTIACTLILRWIFAPHNCLSTPNGHLKKSIFFVFGAVPPNRCAQIYGETESFGNSFPIACTLILRWIFAPHNCLSTPNGHLKKSIFLFSGQSPRTDAPRFMGRPNPSGIASL

SEQ ID NO: 126232 - protein, 145 aa, Heterodera glycines
  Coding regions on vcDNA: vcDNA=SeqID_52655; Strand=-; Position=1 -151,673-959
MRVAIGRRKLFGQSIWCPDGTPTVAFADAEERKVHVDRKAEKGTRDCTETAKANKDDKSSNIGGIETKAPPGKETNIQKNLEPKDSHISLKFSCSGDSGPRASVVCSERIALPTDCVRRAVVRPLPGTSAFAVRTHRSVPKGQRS

SEQ ID NO: 126233 - protein, 688 aa, Heterodera glycines
  Coding regions on vcDNA: vcDNA=SeqID_52656; Strand=+; Position=1-2064
  Homolog annotation: Hit_ID=NP_701342.1; Match level="QueryCoverage =79%, HitCoverage=29%, E-value=1e-19, Identity=23%"; Hit description =MAEBL, putative [Plasmodium falciparum 3D7] gb|AAL10509.1| erythrocyte binding protein 1 [Plasmodium falc
MSNLFYVLLPSDSPGYDNKPNKFRVHLPRTLTFGGQWLCGLHSIIYTNSWPAIGTTENQWIKVHLKNGDKIKIDIPAGSYQNEQELENAINESIKNGIKQPATRMKRQTENGVDLFFHYNPDDYWDKIEEERQRYNELLKLIETKSSERDNEMDTHRKRKIQEEKITPLQNQSLTKKARIEALEEAARQRDDGKEEKEERTGQEFLKMYPVNYREKLNEVRLELIRDLFNIQDHMKKYQGVTDGRTIQELNEIAIKMRTAMKHRRKNLNAFNKAVLKNDLQISAEEYERTSYEQNKDYVEPFFDSHPTDYWEHIHKKYEGLQDDYKKIRELREQQQFLTDEQKKQSIQDEIDQLRRLVDYRKKRFAALEYEAKKRDALQQQPMALALTHGEALKERIGKIEGTTTTADGEETKTHGKSLVELIEQVQKERDDSKAKTEGKTRGEILGDKLKAKIDEQDSSADGATHGEALKNKPETTIGEKVMTRGEILGEKLKSKDEEKKEERITHGEALKNRIEQIPEEEKTKGKIRGEILKEKIGASKPIEEEKKEGKTRGEILKEKIGASKPIEEEKKEGKTRGELLKEKIGVDKPIRQEEIEGVKTRGESLKDIIVSKQIEAVLFKYLNERRKFSIYFNDRRIEFIELSAQLGYILGFEDTTKIKNGDIAKYYCDLKGGIDSLCVYINGITEN

SEQ ID NO: 126234 - protein, 22 aa, Heterodera glycines
  Coding regions on vcDNA: vcDNA=SeqID_52657; Strand=-; Position=1 -32,772-808
MQKWIFKSANLFYKIMKIFDTY

SEQ ID NO: 126235 - protein, 55 aa, Heterodera glycines
  Coding regions on vcDNA: vcDNA=SeqID_52658; Strand=+; Position=1 -85,146-228
MAKECTSRKRPNCKDGHNNLIEGRTDRSIYRRSSCNHQIPSGHCVQVGQYAVLLP

SEQ ID NO: 126236 - protein, 21 aa, Heterodera glycines
  Coding regions on vcDNA: vcDNA=SeqID_52659; Strand=-; Position=1-63
MKEEKGWGEYEYDGQYGEKER

SEQ ID NO: 126237 - protein, 22 aa, Heterodera glycines
  Coding regions on vcDNA: vcDNA=SeqID_52660; Strand=+; Position=1 -6,487-549
MALIEDSCGYRKIPRMLNLDSV

SEQ ID NO: 126238 - protein, 46 aa, Heterodera glycines
  Coding regions on vcDNA: vcDNA=SeqID_52661; Strand=+; Position=1 -9,232-363
MNSTGFRMIPILKKSTDEQKSYGHSHSNCTKRHCTNCLDPSFLHCF

SEQ ID NO: 126239 - protein, 284 aa, Heterodera glycines
  Coding regions on vcDNA: vcDNA=SeqID_52662; Strand=-; Position=1 -139,317-493,860-1098,2326-2625
  Homolog annotation: Hit_ID=CAE05089.2; Match level="QueryCoverage =39%, HitCoverage=8%, E-value=1e-10, Identity=30%"; Hit description =OSJNBa0009K15.9 [Oryza sativa (japonica cultivar-group)]
MVNLPFGLRNATSAFARCMAHVLTGLDDCVIAYVDDILVYTRDDNFDPKTIREVKHVVGMASFFRKHVPNFSTIVEPLTRLTKKESNFEWGTEQAAAFNEVKRILTGKQNLLADGLSRYPHERTQEIAIRDLAELEDIANFPVCLALNMKPRMVHEHSLLTITARDIEGKTFAIDVRKEQNDDSEYSGPPCTTKNLQKDEEQALKELESREQTNVPGYSHDSYQNISDNTVLIENAPALTPNPSPSSQSNNQVKEKELNRNLCSKHNLRENPRKKKHFGNFSED

SEQ ID NO: 126240 - protein, 75 aa, Heterodera glycines; identical to SEQ ID NO: 124542
  Coding regions on vcDNA: vcDNA=SeqID_52663; Strand=-; Position=1-225

SEQ ID NO: 126241 - protein, 162 aa, Heterodera glycines
  Coding regions on vcDNA: vcDNA=SeqID_52664; Strand=+; Position=1-487
  Homolog annotation: Hit_ID=NP_500013.1; Match level="QueryCoverage =94%, HitCoverage=10%, E-value=1e-30, Identity=43%"; Hit description =predicted CDS, polyprotein family member (4B673) [Caenorhabditis elegans] gb|AAC02594.1| Hypothetical pro
FKHCYLKFGGCTSLLTDNATAFTSDFFKSFCSLLYINKCYAIPHWSQGNAVVERSFRTFHNILAKYISSEEPDFDEFLECANFCYNTSIHSSTKETPFFLVFGRDPIFCIEQILNPNTEPENITEVDNVKQKLVKSLRKAWESAAAVIKEAQLRSKVQYDKL

SEQ ID NO: 126242 - protein, 87 aa, Heterodera glycines
  Coding regions on vcDNA: vcDNA=SeqID_52665; Strand=-; Position=1 -57,205-373,771-808
MPLSPAPSVHFLRTEVEEREARSNLATDEEGEGLEEHRRMKEENRRGRQERMEANRLPPAEPEAEEEPVEVIPWQDVAWNFKFEHIR

SEQ ID NO: 126243 - protein, 74 aa, Heterodera glycines
  Coding regions on vcDNA: vcDNA=SeqID_52666; Strand=-; Position=1-228
KGHYANRCTKGILAFLSNTATASDQQREQPRDNQQKKYAGGEGGRKRKMTDRKISIDILFCKFICCYFPLSEKN

SEQ ID NO: 126244 - protein, 261 aa, Heterodera glycines
  Coding regions on vcDNA: vcDNA=SeqID_52667; Strand=-; Position=1 -549,925-1159
MPTDVVVRKTVEEREPRTGAKIRESVIKAASGSVNEMGENVLKFGFFQINFFHEGNLKNLMNNRHEFAKLVNKRDNDQHGKGAETVSKLIAYLKEKRDPVINEIIAEVLEESAIFGDNSQKGQKHILLFTYIRLYRKLANALRWALISDSGDNETFVQETNTLLKWLNEMGDTLLNALSKSPITARWVKNLCRMEAAVELTNFGIFLILPSHTWQSVGAERPTAVNDLFETIGTTEILEQINDPCDTNCIDQMVKQKLELM

SEQ ID NO: 126245 - protein, 251 aa, Heterodera glycines
  Coding regions on vcDNA: vcDNA=SeqID_52668; Strand=-; Position=1 -61,112-147,190-264,319-372,422-478,521-553,1064-1267,1421-1656
  Homolog annotation: Hit_ID=AAP30775.1; Match level="QueryCoverage =41%, HitCoverage=51%, E-value=1e-25, Identity=66%"; Hit description =putative gland protein G32E03 [Heterodera glycines]
MRAVLFLAMVCLVMAVILETANSKAVKKDGKKGAVASPAKGKASPKGASPAKGKAAKGGKKDAKKAGKKDGKVKKEKKEKPAKKAGKGKDAAKKDKTKDKKVPAAVSVTAPDQPANMSYLPMFFHRQLPFISFICVLNLPYNIPNVIMLGSHITVIFTLATIVIYIVMGIILKAQLITIAGAINAPILYICMRCGNGKAIKTLKIFFIRSEYLEIIKSEFAWIKFVLCLNNNNIDVISVVVGPKILNSSGV

SEQ ID NO: 126246 - protein, 58 aa, Heterodera glycines
  Coding regions on vcDNA: vcDNA=SeqID_52669; Strand=-; Position=1 -71,174-279
MWEKLKNMCTSPNWTNDISFDASRFLAMSNTDFKCLIVKAIKKLKNFSINPMTVCSGY

SEQ ID NO: 126247 - protein, 66 aa, Heterodera glycines
  Coding regions on vcDNA: vcDNA=SeqID_52670; Strand=-; Position=1 -89,240-351
MLISPQYWQNSNGYRAEDEALTVAFDVSTPFFFAYQQKIVANQKFKWNFMVKEISFIFCCCAKFAN

SEQ ID NO: 126248 - protein, 120 aa, Heterodera glycines
  Coding regions on vcDNA: vcDNA=SeqID_52671; Strand=+; Position=1 -180,491-673
  Homolog annotation: Hit_ID=CAE70875.1; Match level="QueryCoverage =72%, HitCoverage=16%, E-value=3e-11, Identity=34%"; Hit description =Hypothetical protein CBG17665 [Caenorhabditis briggsae]
MDHKYFNDSEKMRLNNFYDRFRHNLSIDQFFNEFFDNFGLSCKQFFQFCQLGDTVLDCCKIFEPIYLIRRGRCFRSIKLYQSNFDELGKLRVQLRQPYKMDPQMKDQEVIKMLKCLSNNK

SEQ ID NO: 126249 - protein, 100 aa, Heterodera glycines
  Coding regions on vcDNA: vcDNA=SeqID_52672; Strand=+; Position=1 -123,207-343,576-618
  Homolog annotation: Hit_ID=NP_509617.1; Match level="QueryCoverage =89%, HitCoverage=21%, E-value=7e-09, Identity=35%"; Hit description =na+ channel, amiloride-sensitive (XK207) [Caenorhabditis elegans] emb|CAB02660.1| Hypothetical protein C1
MAFIAEYKPQLAPFPRHYLQQGTWTKMRLNAKHISLFPAEEVCSQTNDQLGKDTCYVENWLQTHVEGPLNCTFPYVQEITKDRQLESVCWLVTVGSTWFP

SEQ ID NO: 126250 - protein, 107 aa, Heterodera glycines
  Coding regions on vcDNA: vcDNA=SeqID_52673; Strand=+; Position=1-326
PSEVLSEDEVIDIYQFHALPNCHGISDGFFPMQFSTNERFMNTGTLLLDIEKVSEFGQEEDSSRCSKKMYINGLSWKILAQIGTRIESDERRIYIYLLCDAPNEGAN

SEQ ID NO: 126251 - protein, 253 aa, Heterodera glycines
  Coding regions on vcDNA: vcDNA=SeqID_52674; Strand=-; Position=1 -30,851-897,959-1011,1260-1300,1371-1497,1813-1900,2117-2159,2206 -2254,2334-2399,2468-2540,2668-2744
  Homolog annotation: Hit_ID=NP_503121.1; Match level="QueryCoverage =76%, HitCoverage=67%, E-value=3e-60, Identity=61%"; Hit description =predicted CDS, hatching enzyme EHE13 family member (4S430) [Caenorhabditis elegans]
SVHRHHSSSGKFQGDIDGVDEHLLRLQNPLQNPAIQFNALRNRQLIWPKGVVPYELDVAFSLSEARLLSEARLLQRVFRTYRRRTFGCIRFRPRRSGETDYLSIVKGNGCYSQVGRTGGKQELSLGRGCLFNETITHELMHSLGFWHEHSRADRDEHIVIRDEHIVIRWENILPGMDSQFDDSQFDIVSSAIQDTLGEPYDYRSIMHYGSSAFSRNGRNTLEAVVDQFTNVIGTAMELSEMDVAKVNEGGGTK

SEQ ID NO: 126252 - protein, 637 aa, Heterodera glycines
  Coding regions on vcDNA: vcDNA=SeqID_52675; Strand=-; Position=1-1911
  Homolog annotation: Hit_ID=NP_508324.1; Match level="QueryCoverage =77%, HitCoverage=19%, E-value=3e-24, Identity=23%"; Hit description =predicted CDS, peptidase family A16 and RNA-directed DNA polymerase and Integrase, catalytic domain and Z
MATKPISVMVRSEDCSRSAEGLKCAGTAATVLALLPSDQTNSFVIRTQQDELLGAVRLRLASITMMCVPKTESWLRSYSISTTAVKRCPSAGSCRGNTCSAIRNRETIPELIALNHRPGHSFCMRSTSFWQNSCGLPSASCLFYRWAAVPTTTTVFEEFTCLEWDMQISAWVELETNNGQIDSQRLTLHPGVSEPWGNMTISVIPTSLPPMPALSAHFVTDGRAVAMGRPMPSDLHCPDEETARGFDKCQLSIGACQKCAPDHDNGTVHCHCRDLDIGRVLNNPEQRLPLDVARLHLHNHGSSIRAEFQYSPVQVHIQLNGLELISEYSNTKCWVSSPTLSGCYRCTSGATFNATCRTDHGTALAKVKCADGTLFALHCGGNDSTREAIPFDRAEIFTECKVKCPAGTTTFRLKGELIFLPKEQQFGFHRRDSSGGKIEPGITFNFPDWQIDPFPLLNLLSSWQWMLMAAGAAAIGFVALFLFIKFNPHFRLYRALMATILLVILIGKTEAKDSRGEISPATFDRWTNGEKISVTTGTDFVALGPQRLTETPQTTAKGDPNNFSEGAFSLIICAIYLYFTIISLFCRLLWTPRHRISPLFAPPPLTVVILGAICAANSLTGAREPKWREGDNFPTSL

SEQ ID NO: 126253 - protein, 1164 aa, Heterodera glycines
  Coding regions on vcDNA: vcDNA=SeqID_52676; Strand=-; Position=1-3492
  Homolog annotation: Hit_ID=NP_508324.1; Match level="QueryCoverage =59%, HitCoverage=27%, E-value=1e-81, Identity=30%"; Hit description =predicted CDS, peptidase family A16 and RNA-directed DNA polymerase and Integrase, catalytic domain and Z
MAALIQRRSNTPSVASVRVNNPVREWMARNRGGENEPPAQQQPQAQQPLQAEQQRFERLTLNDQGQAFPRASHHARIRREEHPSRERLRTQGAAPSHHHRSETRADTLTTFETVRLQPPTFSGKPEDWTTFWAYFQRAVDDKPIPGFEKQLHLLRCLKEGSPARRAVEVYPPSDGNYPVVVQLLKERFGDTNDLQRAIRAQLLHLPPAKDNVASLTAMIDEFERGVCQLEQLGANVDDESFGPLLEAKLPVSILTELRIRESMMGAKWTVREFRKAVAAQVKCMRAAQSALAAMKEPERRHEQRSEADRGGRNARTGQGFNRAFMIRENPPERHGTVGAGNHGSVHTPPRSGFLPPGSNSRQTESRRMGQGGSGCSLCGQAGHQPSRCIKYGSAQAKRRRLIEQRRCLKCLGSDHTASQCTRAHPCRKCQRPDHHWLICWEGGKKDEPQIQAKAEEPRANRTMVIQRMEPTEERTFAANSGMEGRGESPSPHQEPRTFTTVGQQLPAYLMICQVVVAADDEKGECQTTLLLDPASHGDYVDTELIRQLGLEKSESETLTIQVFGGKKVKVPSGRYKAKIKRTDGEWESIELSEVPTICTPIKTEFVLPGVAPEQIRTTTDTVQPQLLIGIRRFWDFVRAFRKTDEGTYLIDTVFGTVICGEQFQVSTGVPPDSSVFAIPPCGEDERDQMPSVKAIEQFWSVEAIGIRDDPTQDADSAAIIQFEQSVRQQDDGRYNIRLPWREEHPELPNNYAVAYRRLIGLLQRLQRTPEILKQYQQVIEEQSRMGVIEEATIGTGKCEYFIPHQAVITPKKLRVVYDASAHAKGVPSLNDCLLRGPVWLPDLAGMLIRFRACQVPVIADVEKAFLMVGIEEADREVCKFLWVRDPLGPLTTANLVPYRFRRLAFGLTPSPFCLAAVVRHHLRKYGSDFAEQLIRDTYVDNVLIPADTVEEASQKAREAKRMFTEAKMNLREFLTNDQNLNSSFSEADALGKTTAKMLGLEWDAEKDSIRMVFPGVTPAGAGGHSSRRAVLKTIARLFDPLGLLAPATLPAKQFFQRLWESTHSWDAPLDADDAREWNRIMASWDGEFITIPRVARADGAESCQLHVFTDASENAYAAAAYLRSEGVDGSILSRLIMAKSRLKPKKASGTFTIPRMELMGLVLS

SEQ ID NO: 126254 - protein, 22 aa, Heterodera glycines
  Coding regions on vcDNA: vcDNA=SeqID_52677; Strand=+; Position=1-66
APTHHGKTKHARVGDIVQGCLG

SEQ ID NO: 126255 - protein, 188 aa, Heterodera glycines
  misc_feature (49)..(49): Xaa can be any naturally occurring amino acid
  misc_feature (66)..(66): Xaa can be any naturally occurring amino acid
  Coding regions on vcDNA: vcDNA=SeqID_52678; Strand=+; Position=1-565
PRCRLICFDREMLCSLSSSQNVCLIACRSRKRLSANWSSRQELDAPAVXDTSSKAGKGAATKSYKXSCRSSGAAPAFCYSLIEMPFKNPSDLSKSPFHCHQPRGVLGRFAPREIRVHQLPRFCDSRRECVSRSLNPISGRPHRHCSAAQILRCRGCNTRLACPQALRVHPFLCFGLLRRIRSFPVLSV

SEQ ID NO: 126256 - protein, 102 aa, Heterodera glycines
  Coding regions on vcDNA: vcDNA=SeqID_52679; Strand=+; Position=1 -19,266-350,423-628
KFYANRKNKKREQIASELGVTIHQIKNWTRKFGLGNQKWLTDRQRKMLIKKFDKIKEKRTQNGLPAGEIRELEEKIAEEIGINIRTIYKWRKKFGISGSWQK

SEQ ID NO: 126257 - protein, 50 aa, Heterodera glycines
  Coding regions on vcDNA: vcDNA=SeqID_52680; Strand=-; Position=1 -26,277-403
MFNSAKLKRKKHFLGNNKNKSQVNLSHLSKNADNNKRINKIDRICNTNPT

SEQ ID NO: 126258 - protein, 152 aa, Heterodera glycines
  Coding regions on vcDNA: vcDNA=SeqID_52681; Strand=-; Position=1 -120,498-836
MFQFEPLNNVASTSSTTNIGTHFLGGLRGNLIYLFIKWALQLDSDKSQRSTYSQKSTSTQKQTQQHVRRAYSRLGIERPEERETARQAITASTSAASSSASSQGSKRERGETTKADKMKKEVVRKLKGKCEDDCDICSNFLKKYLQKCFVLG

SEQ ID NO: 126259 - protein, 46 aa, Heterodera glycines
  Coding regions on vcDNA: vcDNA=SeqID_52682; Strand=-; Position=1 -19,398-519
MINRRDKFKNENSIRRIRPKKISKCWQHLCMTSKNVPSVGKSANVI

SEQ ID NO: 126260 - protein, 190 aa, Heterodera glycines
  misc_feature (36)..(36): Xaa can be any naturally occurring amino acid
  misc_feature (48)..(48): Xaa can be any naturally occurring amino acid
  misc_feature (58)..(59): Xaa can be any naturally occurring amino acid
  misc_feature (135)..(135): Xaa can be any naturally occurring amino acid
  misc_feature (151)..(151): Xaa can be any naturally occurring amino acid
  Coding regions on vcDNA: vcDNA=SeqID_52683; Strand=+; Position=1-576
  Homolog annotation: Hit_ID=BAB33421.1; Match level="QueryCoverage =94%, HitCoverage=63%, E-value=2e-69, Identity=75%"; Hit description =putative senescence-associated protein [Pisum sativum]
SKNIAILPRRDSDLEAFSHNPSDGSFAPLVYRPSTXTKCLNLRFLSYXAGLLLATGLXXGKTNLSHDGLNPAHVPYWWVNNPTLGEFCFAMIGRADIEGSKSDVAMDAWPPQASYPCGNFSDTSCWKLYTLKDRXATLSRSVFVLKIRIKXAFAFLLYERFPSSLSALGHLRYALTDVPPQSNSPPDTVI

SEQ ID NO: 126261 - protein, 660 aa, Heterodera glycines
  Coding regions on vcDNA: vcDNA=SeqID_52684; Strand=+; Position=1 -204,253-1846,1887-2070
  Homolog annotation: Hit_ID=NP_507780.1; Match level="QueryCoverage =98%, HitCoverage=40%, E-value=6e-47, Identity=24%"; Hit description =predicted CDS, DNA polymerase type B, organellar and viral family member (5T899) [Caenorhabditis elegans]
MAAKFNLCLLLERGHFNYIGRVEQLFDVQRYCIDCERRAHLRYHFSGCKVVCRLCLRFGPEYPCQAQQLPNGASTARRCAACQFIFPNDDCYDYHLIEHAPAPMDARGQRQRQPICQWRRVCRDCGRIAYQGKHQCPCQHPDGNRNCKRCDGPHTTDEPCFIQPICDASARQRASIAVDNDDDNSDDNDEDNDEDKDDVLPLRLCFFDAETSQDSPLQLNNRLVQKHVPLLIVAEVICERCIQAGISVNDGLGRRAPDCVCLCRMVRGQQLRQWSSPPFANAPGDNTAVPVEAPTFNQRRFYFHSFDNDGNDPVDQFLDFLTHHGPKKAHTVCVAHNGGKYDFHLILEALHRRNMPPKRLCTTGLKIYSMRLSGRNQRRVTFKDSINYFFCELDALVKSFELPEHQAMVKPFFPYLYIQRQHLSQRLNGLPAQEFYSPDTMKADKRAKFLRWHANNNGNRFQLREQLIMYCANDVAILRESVIRFRQLIADNTQGLDPFLNASTAAGLALATLRRCFLAPNRLVHSPEGGYLRGRRASAESQRYIRFFELENPGAQVQCASWSVGEAHIEDTGYRVDGLWRRDAPLRPLAIEWLGCYYHGCPKCFPDRQQRLAAGRTAEDLYERTERRLFELEHDYGCEIHKVWACQWSERMRHDPELKR

SEQ ID NO: 126262 - protein, 107 aa, Heterodera glycines
  Coding regions on vcDNA: vcDNA=SeqID_52685; Strand=-; Position=1 -120,599-742,1182-1238
MMAPPHLGGQNAQPQKETEMAFSDEAPPCPQPTWKEAMEKALSRAVRGTFIVACSPADRREAFQKKMRLSATGDNFCHVIKDGVWCQAGHSGLAPFQKFRLSFEDSQ

SEQ ID NO: 126263 - protein, 57 aa, Heterodera glycines
  Coding regions on vcDNA: vcDNA=SeqID_52686; Strand=-; Position=1 -147,859-885
MGKLKKFEDADKRPKYENKTVGRFVKHALFELNSSSDCVNTTSEQTECEKFLGPTDV

SEQ ID NO: 126264 - protein, 223 aa, Heterodera glycines
  Coding regions on vcDNA: vcDNA=SeqID_52687; Strand=+; Position=1 -378,750-1043
MGTTKLEVFVDAIDTDVQPIWDVFIRQIWPIFAKSIRHLSFEDGNHLDNLRRRISPTLLTDLDQLISIDSGYLCPDGIADDGPNGIAGQALTKWLHTPTKNGQPKQLHRYNCFGPQNLEWVNNFKETFRRATTSVSYHIQLFFLVEPMPIEPFELVNERTNEKLTLKQEIDEFDLNAYNWLLQRCPIGETATAPAIKWKDSVNPSANLNNVTFDLWSFDKSIG

SEQ ID NO: 126265 - protein, 105 aa, Heterodera glycines
  Coding regions on vcDNA: vcDNA=SeqID_52688; Strand=+; Position=1-318
MSLIILVFIGTMCDNKPSYCLIIKRRIDYTVLAFLRSNKPIWDRMGTKLELWPYRTEKDQSIWDVFVREIWKELPMPPLLSLKQEKPRKFGCHFEQYPIYFLGRQ

SEQ ID NO: 126266 - protein, 182 aa, Heterodera glycines
  Coding regions on vcDNA: vcDNA=SeqID_52689; Strand=-; Position=1 -246,1113-1415
CALGFTSGDALDNLRRRTSPTILTDLDQLYSIDFALMCSGTIDNQILSKWLHTPSKDGQPKRLRFRAYVGPPNLEWLNNFRETFHRATSSASYTVRIIFRVKPMPIAPFELMNEVTNEKLTLIKGGTFRWLLKRCPIVGETAAVVQKQQKKDEKLDRLNGVYFCLYDAIFSTPGHIDQRKKK

SEQ ID NO: 126267 - protein, 88 aa, Heterodera glycines; identical to SEQ ID NO: 124691
  Coding regions on vcDNA: vcDNA=SeqID_52690; Strand=-; Position=1 -96,135-305

SEQ ID NO: 126268 - protein, 212 aa, Heterodera glycines
  Coding regions on vcDNA: vcDNA=SeqID_52691; Strand=+; Position=1 -57,116-382,434-603,646-722,776-845
NRSVQSNGDEGMEMVEMTEIRYEQKQQVAAGGLCCCCIPCGFFNESSNEEPPKIFKFFMTKKKTPQPPPAAEVVQPQNSVPSPKALPVENYTLNATFRKEEARGYAKMTFKKSKKRAAQTKQPKLVRISIFFAFPCKISTSFRFRPPVSPAKLRCWVRLPHLQQQASEPLSQWEAMSVRRKANTKWILPPIRLQRAAHTFKKEGPSHFNCER

SEQ ID NO: 126269 - protein, 17 aa, Heterodera glycines
  Coding regions on vcDNA: vcDNA=SeqID_52692; Strand=+; Position=1-68
HKHLFDLFYHIHNLIKI

SEQ ID NO: 126270 - protein, 80 aa, Heterodera glycines
  Coding regions on vcDNA: vcDNA=SeqID_52693; Strand=-; Position=1-240
MARQFDQHQGSKSVEFLPKDPVLLLNFNRGKRFWLNGKIIERLEKSPTYRVHVPALGRNVHRHANQLRRRYPLEEDGNDT

SEQ ID NO: 126271 - protein, 97 aa, Heterodera glycines
  Coding regions on vcDNA: vcDNA=SeqID_52694; Strand=-; Position=1 -41,215-467
MLRPLFDCILRLLRQFYRKIWLVGIELEDNIFTEEHSSAEGKKHNQQTNWTEWSQRLNSMLSSLFDADIVRAYRIKKNLMDAASLNIQLSSNYEKRG

SEQ ID NO: 126272 - protein, 33 aa, Heterodera glycines
  Coding regions on vcDNA: vcDNA=SeqID_52695; Strand=-; Position=1-101
ILRHMPFFLRTSFDILSIKNAFSTWFEASTLTF

SEQ ID NO: 126273 - protein, 56 aa, Heterodera glycines
  Coding regions on vcDNA: vcDNA=SeqID_52696; Strand=+; Position=1 -86,497-580
GERILQYSKKDGKQSKDSFFVGMAMTFVNTLFARFIFPLLNFDAFAIGFFVIQLVE

SEQ ID NO: 126274 - protein, 69 aa, Heterodera glycines
  Coding regions on vcDNA: vcDNA=SeqID_52697; Strand=-; Position=1 -64,667-812
MFRLVIMQLYVPPTMMFTYGQGPGLDPDLKEPGFFLDLDFPGFCPGNQGPAPTWNPGPGFFQNVDLYYF

SEQ ID NO: 126275 - protein, 55 aa, Heterodera glycines
  Coding regions on vcDNA: vcDNA=SeqID_52698; Strand=+; Position=1 -51,303-419
MAKKKNINLDFIWSIKTTLEKITLSKLLNEPFVLDINIICIRSIIICVKKRMKSF

SEQ ID NO: 126276 - protein, 21 aa, Heterodera glycines
  Coding regions on vcDNA: vcDNA=SeqID_52699; Strand=-; Position=1-64
MFRLVIMQLYVPPTMMFTYGQ

SEQ ID NO: 126277 - protein, 55 aa, Heterodera glycines; identical to SEQ ID NO: 126275
  Coding regions on vcDNA: vcDNA=SeqID_52700; Strand=+; Position=1 -51,290-406

SEQ ID NO: 126278 - protein, 295 aa, Heterodera glycines
  Coding regions on vcDNA: vcDNA=SeqID_52701; Strand=+; Position=1 -36,1843-1926,1957-2090,2133-2228,2272-2399,2522-2757,2902-2937
  Homolog annotation: Hit_ID=NP_492109.1; Match level="QueryCoverage =95%, HitCoverage=36%, E-value=4e-38, Identity=35%"; Hit description =metalloprotease III family member (1I107) [Caenorhabditis elegans] emb|CAA96596.1| Hypothetical protein C
IKILTLFAFGVLGHELMHAIGFHHEQSRSDVRNYVILREDIIFHVLILKQSEIDPYTKIIFHVLILKQSEIDPYTKNFDFPYDFGSVMHYQSGAIMNSKKKLVITLPRFYQQTIGQSERISITLPRFYQQTIGQSERISFKDAAIINRIYCEDSCKGHEDKCQNGSCKGHEDKCQNGGYLNPNDCTKCHCPDGYGGKYCKELEESEQAKCGGNGPCRCHWRIKAINNIFEFLVFLINANFNCFQPEAGKKVRIQFIEQFFECTYNCSSAYVEVKYRDDKRAQGNHFCAPFNKMDH

SEQ ID NO: 126279 - protein, 170 aa, Heterodera glycines
  Coding regions on vcDNA: vcDNA=SeqID_52702; Strand=-; Position=1 -61,106-141,189-245,312-371,424-468,614-867
  Homolog annotation: Hit_ID=AAP30775.1; Match level="QueryCoverage =100%, HitCoverage=100%, E-value=9e-82, Identity=84%"; Hit description=putative gland protein G32E03 [Heterodera glycines]
MRAVLFLAMVCLVMAVILETANSKAVKKDNKKGAITTPAKGKAAPKGAAKGGIKKDAKSKGKGKKDAKGKKDKKAKPAKGKGVPKNAKPMAAVKAVPKAAENAQKGPSSAEVVAEENNLDTEAVDDLGAEESDFDQLAEDELLEDDAMDGEADEWEGMGEETEMDSQMAL

SEQ ID NO: 126280 - protein, 125 aa, Heterodera glycines
  Coding regions on vcDNA: vcDNA=SeqID_52703; Strand=+; Position=1 -141,195-431
MIKTPSTYNFTYKFKVNGIQIQGKRQTVFTDPNNEKYNWTKIDVDCYKAEGGTVNFWGYSKPETNEIIRVDEIHCLMDDAVAEVPKQSKSLQTDEQPPMKLSPSPFLANNVSSLIHVFVPFVGNP

SEQ ID NO: 126281 - protein, 222 aa, Heterodera glycines
  Coding regions on vcDNA: vcDNA=SeqID_52704; Strand=-; Position=1 -66,166-768
MLDGGSQISLISVKFFLEIMDKRGPLETKIRVFVAQSTFGYDLLFGTNAMDQLGFKMLDAVNCRIVDFSPASKPENSPLITFKAFVCHGNTSTNREGQKKGNKHRSDPKNDTGTKKGKVVEKKSNRNAVDNKRRPLFNKTFVPQLKTKEIPIKNSESFGESAANKQRLNSVQVKVGVPNEKPMKCVWKRKNLGQIQLGTTEKLGRGKVNPTTCNKTKNKQKI

SEQ ID NO: 126282 - protein, 273 aa, Heterodera glycines
  Coding regions on vcDNA: vcDNA=SeqID_52705; Strand=-; Position=1-822
MPVLRSPPLTRTRALNQGIIVDRDGNAFRAENFGVLGGRPISPLANNENQRLDDNHENVLAETEIRRRLLYGGMDQSAPDEQLEYDEMENGDEQNVNGMVQQNLENGVEAGDRGSFGNDALDAHGLRAFSTPLNEQNLSALQRDRMQLPENLSVIQNQIRVMNFMQNQMPNPVAHNFPALNHPQAVNPIACRPNGQLYENAGGNFERQREQQIRLTQQPVVEDQQSHVRRILPHMPIHKDTAGPKTKDLSFTKDSNTQISKKPTYEERSTRSS

SEQ ID NO: 126283 - protein, 31 aa, Heterodera glycines
  Coding regions on vcDNA: vcDNA=SeqID_52706; Strand=-; Position=1-94
MDKRTEKEPNRPTDGRTETKTEDKMPRIYVI

SEQ ID NO: 126284 - protein, 190 aa, Heterodera glycines
  Coding regions on vcDNA: vcDNA=SeqID_52707; Strand=+; Position=1 -109,340-440,763-862,1401-1555,1655-1759
MIINSAKDMFHQEMDQQILESFSNSADHNLTEHSTNDGMTDEEIQLMFEYKDNWTKQYEQMLSRLTPEKQEMVINYVITQENDIELLKRFLKTDRYELLRGLKNNRLKKKLIEEMLGKMELEEFKIQIAQAIAINESNNPPTDLRKESKTKPKIRELKIDAHQSSQNLATNLRDKGKAKLEDGHKSPNIR

SEQ ID NO: 126285 - protein, 467 aa, Heterodera glycines
  Coding regions on vcDNA: vcDNA=SeqID_52708; Strand=+; Position=1 -36,90-192,248-450,510-665,711-879,938-1009,1067-1227,1278-1399,1445 -1506,1561-1787,1850-1942
  Homolog annotation: Hit_ID=CAB40412.1; Match level="QueryCoverage =96%, HitCoverage=92%, E-value=1e-142, Identity=57%"; Hit description= hexokinase [Haemonchus contortus]
MATTHQHNPTPEVKELCKCLALDDNQLRDIMAKFEMEYKKGLDPVTAPTACVKMLPTYIRAIAVGEEKGEFLALDLGGTNFRVLRITLEGGCRSTMHNKIYSMPDSVQQGTGTELFDHIAACLADYMREQNLTSHSKMPLGFTFSFPCQQNGLTNAVLTNWTKGFTASGVVGENVVHMLHDAFKRRGDVDIDVVAVLNDTTGTMLACSFIEQHCYVGVIVGTGCNAAYMERLENVPKLKGIVNSAEDGLPAEMCVNTEWGGFGDDGALDQFLTIYDQQLDQQSLNPGRQRFEKTISGMYMGEIVRLALEDLARRGLLFSGDSTRISERGCISTKMVSDIEGFMHSTDGNPFAKVGEMLRAIGISNSSAADCANVAYISSLIGTRAAHLCACGLAAILNRMQRPRVTIGVDGSVFRFHPTFKFNLDQKIKALLAVKCEFFMVLSEDGSGRGAAVAAAVALRMNRLVGA

SEQ ID NO: 126286 - protein, 43 aa, Heterodera glycines
  Coding regions on vcDNA: vcDNA=SeqID_52709; Strand=+; Position=1 -16,538-653
MKISSTTNIDYILLFIFSVSTLLSPRFNALVDKHFNGKSGLKS

SEQ ID NO: 126287 - protein, 51 aa, Heterodera glycines
  Coding regions on vcDNA: vcDNA=SeqID_52710; Strand=-; Position=1-152
SVASGWVGWRKTGATHGRRRTRTKSADARSAPATASGSYGGHPSLRCSSAS

SEQ ID NO: 126288 - protein, 152 aa, Heterodera glycines
  Coding regions on vcDNA: vcDNA=SeqID_52711; Strand=-; Position=1 -67,124-251,293-403,955-1107
  Homolog annotation: Hit_ID=XP_395515.1; Match level="QueryCoverage =61%, HitCoverage=18%, E-value=2e-43, Identity=79%"; Hit description =similar to CG7698-PA [Apis mellifera]
MVFCPTFRYWEQHPELHDIPVYYASSLAKKCMAVYQTFVSGMNQNIKRQISINNPFVFKHVSNLKSIDHFDDVGPCVVLASPGMLQNGLSRELFETWCTDSKVRLFHTPKLRGLLKSALPELTNEIVGLQHMKFFVFDDSVLITGFVFLCYK

SEQ ID NO: 126289 - protein, 416 aa, Heterodera glycines
  Coding regions on vcDNA: vcDNA=SeqID_52712; Strand=-; Position=1 -297,835-1084,1224-1382,1649-1941,2090-2314,2456-2499
  Homolog annotation: Hit_ID=NP_502196.1; Match level="QueryCoverage =91%, HitCoverage=42%, E-value=5e-95, Identity=49%"; Hit description =methionyl tRNA Synthetase (101.7 kD) (mrs-1) [Caenorhabditis elegans] emb|CAA97803.1| Hypothetical protei
PKNGQFGDDGICAIPLREGTEFDKSRRIWRVLVSFLRKRAETIVGVSANLSVLLSVLLYPFMPNISAQIQQQCNLPKNIVMPEHFVLFLKAGHKHNKPFALFTKIEPAKVAEWKELFGSGKQQQNQPKKTAMSSSSSKKAPNTTEKQQQKKKKENMAKSGAKGQIYAEVMAKFEKAKALFVTNESEKLDTEIAALKEQITEQKARLGFTGALFSPPMPKATPAIVVPPAGTVSSPQTPPKLTAASNASKEQTQQKQQPKQKKPQQQQATAPADDTVDVGCLDLRVGRIIEAQKHPDADALYVEQIDLGEEKPRTVVSGLVRFVPLEQLKNRLVVCLCNLKPAKMRGVESQAMVMCASTPEKVEVLEVSPDSVPGDLVVCEPFVRRPPQQLNPKKKIWETVAPDLSVSETGECIYKG

SEQ ID NO: 126290 - protein, 289 aa, Heterodera glycines
  Coding regions on vcDNA: vcDNA=SeqID_52713; Strand=+; Position=1 -372,638-1135
MMMALDAAGGATAAAADSAQLISTDSLDMEQLRVRCECTKHNANYKLTFDEDSGQWTTSGIGGSFTTTATASPPAAQQQKQQHQRRLKQHQQLKQLLAMNTTATAMNNNNNSHEEEDRDGHGDEHQQQQQQLYTAIMDNNGALGLQLLEQLNNADDDDQDNDTSAYSGGVFNATAEKRSGVRRRPATSVGHGTTTTATDGWRKNSFMDALLNNNPNHNANTSSSASSTFHGNNFRGDAATKKGDGGGMGMMTTWGRLHQQSDDMGGGQQPPFNSEKVHRSVFRKARGRG

SEQ ID NO: 126291 - protein, 89 aa, Heterodera glycines
  Coding regions on vcDNA: vcDNA=SeqID_52714; Strand=+; Position=1 -244,698-723
MATYQQQQPQQHRHVQPVHGSVSSSSSSAGLRRPTSSSLLDNFIATQRQQQQQWNGGPQMVDYAYSETYLGNGRYIDMNENESPPFIID

SEQ ID NO: 126292 - protein, 191 aa, Heterodera glycines
  Coding regions on vcDNA: vcDNA=SeqID_52715; Strand=+; Position=1 -261,615-843,1003-1088
MTETAPLGHKLGNDNQLQHNANANQQRQQQQQRRQSHHQMGATKTKAAATMAMPTTATMPQQQRRTFADLSASRTVPDLKFIALAHNVPTICPPSSVSLDNLLCRVRNSATAADGNGGIGGANAAAIDELIDCCASSMRILSEPDGGGASDGPDSGLGSSHSDGPSHIEDWSSLSVLLPRLDSFLFFNFEC

SEQ ID NO: 126293 - protein, 284 aa, Heterodera glycines
  Coding regions on vcDNA: vcDNA=SeqID_52716; Strand=+; Position=1 -223,402-591,707-1148
MATRTMMAWCGGSAARLPKDSRVPKSSSMPTKLVAAAASSTKLSTDCIEEEEQEVEVVHCQQDKQQHHNSIKLEDVKWVEVQQREQEEDKTAENERPNSMADNDNVVQSRNTDAVGGAADTVVHAGLRPSSSRIPILRTRSRSSIMHSDGGSPIAAQQRHSPTTLSRRSSSARPTPSLSPVYICPVREAITGEHTDQQSASLPHGSAAGGGTLLYPLRKGERVRVLAIRGEYTRCSRLPAAEHRQQQLQQQRLALQNGLVPTRTLQFGANNGTTALNDERMTEL

SEQ ID NO: 126294 - protein, 106 aa, Heterodera glycines
  Coding regions on vcDNA: vcDNA=SeqID_52717; Strand=-; Position=1-319
EGKIIYRSLCKSIKIKRSMSMDHSVDRQSVRLHFRRPFLLLLLLLLLLVHGRLLLHFNGNGSSAFVSRFHSADEQATAVQLALDALLLDALRDEHTARELTVDRFA

SEQ ID NO: 126295 - protein, 74 aa, Heterodera glycines
  Coding regions on vcDNA: vcDNA=SeqID_52718; Strand=-; Position=1-370
NFALTNVKSSNVRPFFDSPLFLLMLLLLCLLLSVFFIAFYSTLPRPLPPPPPGVPFLPKHHSHTNSFSSNFPKC

SEQ ID NO: 126296 - protein, 58 aa, Heterodera glycines
  Coding regions on vcDNA: vcDNA=SeqID_52719; Strand=+; Position=1 -127,239-288
MPYIGETNDFKFEQKDVEQSLVLMDDDGATDVAKSSFDVEDKIEIIMTSQNLKIGKLK

SEQ ID NO: 126297 - protein, 20 aa, Heterodera glycines
  Coding regions on vcDNA: vcDNA=SeqID_52720; Strand=+; Position=1-61
MKCAQRRALQVIGTDFHYIH

SEQ ID NO: 126298 - protein, 112 aa, Heterodera glycines
  Coding regions on vcDNA: vcDNA=SeqID_52721; Strand=-; Position=1 -194,251-395
MVIDGLRDCLLQVLRDYALRVGLLEHSNSVASSDTFALFQRRLRPEPFVAGTHGMVTELRCEICFDPLVSPSASAPVGDVRLLVNGSAVHEKCHGQKQMPNAKALYEERRNE

SEQ ID NO: 126299 - protein, 360 aa, Heterodera glycines
  Coding regions on vcDNA: vcDNA=SeqID_52722; Strand=-; Position=1 -57,107-266,313-500,544-631,676-737,783-920,968-1239,1286-1403
  Homolog annotation: Hit_ID=AAO49799.1; Match level="QueryCoverage =100%, HitCoverage=100%, E-value=0.0, Identity=99%"; Hit description =arginine kinase [Heterodera glycines]
MAVPQEVIDKIEAGYKKLQAAADCKSLLKKYLTKDVVDACKDKRTKLGATFLDVIQSGVANLDSGVGVYAPDAEAYTLFKPLFDPIINDYHGGFGPSSKQPATDLGEGKTQLLTDLDPEGKFINSTRVRCGRSLQGYPFNPCLTKENYVEMESKVKAVFEQLKSDAELGGTYYPLQGMTKDVQNQLIADHFLFKEGDRFLQEANACRYWPTGRGIFHNAKKTFLVWVNEEDHLRIISMQNGGNVGQVLERLIKGVKAIESKVPFSRDDRLGWLTFCPTNLGTTVRASVHIRLPKISAKPDFKSICDGLKLQIRGIHGEHSESAGGVYDISNKARLGLTEFEAVKQMYDGVKHLIELEKKA

SEQ ID NO: 126300 - protein, 92 aa, Heterodera glycines
  Coding regions on vcDNA: vcDNA=SeqID_52723; Strand=-; Position=1 -39,607-667,729-907
MSRSFSKRTITERVDIVRLLLTHGANVEQMDFEGFHFALKSAAIGGSLEVCRLLVEEWAADVNQQTIQERYTPVICAASIGHLAIGGKKIGF

SEQ ID NO: 126301 - protein, 263 aa, Heterodera glycines
  Coding regions on vcDNA: vcDNA=SeqID_52724; Strand=+; Position=1-789
MAVLSFLSWSWSRALDQGLRAPTSGASERRVACAYLRRKLAESCVRLPQARASKELRTPISSASERRVACAYVKRKRAESCVRLPQAQASKELRTPISSASERRVACAYLKRKRGESCVRLPQAQASGELRAPTSGASEQRVAYAYLKRKRAESCVRLRQAQASGELRAPTSGASERRVACAYLRRKRAKSCVRLPQAQASGELRAPTSGASEQRVAYAYLKRKRAESCVRLPQARASGELRAPTSGASEQRVAYAYLKRKRA

SEQ ID NO: 126302 - protein, 69 aa, Heterodera glycines
  Coding regions on vcDNA: vcDNA=SeqID_52725; Strand=-; Position=1 -109,638-738
MSSLRKGWRQNNANDGEELEVGGGTETRCEKQIDVKAPPLRPPLKPGCVLRQNTRMAQIRKNTEMTATI

SEQ ID NO: 126303 - protein, 224 aa, Heterodera glycines
  Coding regions on vcDNA: vcDNA=SeqID_52726; Strand=+; Position=1 -87,299-460,912-1186,1406-1556
  Homolog annotation: Hit_ID=AAC23503.1; Match level="QueryCoverage =94%, HitCoverage=49%, E-value=1e-45, Identity=41%"; Hit description =Shaw potassium channel Kv3.1a [Aplysia californica]
MTFTQHRDTQEVLQTLDKLELDDEAMRNEGRRDGRTDQPIQEELYKRFGFEEQYKNKELNCWQRTKPKLWRMFDEPSSSTGAKIIETICNVWFTIEIIIRWGWVGIDSRLNRYSWALANRSFCHFCPSFSLRFVACPSKVDYFKAPVNIIDLVATLTFYIDLLLTTRFGATADLEASAKELMLLVFFLLLGIVVFASLIYYAERMEDNPENQVKKHNNRIDHVG

SEQ ID NO: 126304 - protein, 264 aa, Heterodera glycines
  Coding regions on vcDNA: vcDNA=SeqID_52727; Strand=+; Position=1 -119,187-281,322-398,450-536,581-719,797-922,992-1027,1085-1200
  Homolog annotation: Hit_ID=CAE56473.1; Match level="QueryCoverage =99%, HitCoverage=39%, E-value=1e-113, Identity=74%"; Hit description= Hypothetical protein CBG24187 [Caenorhabditis briggsae]
YLGLYTEENYNRETVRLLASAADTAKDGLISYEEFSAFEASLCAPDALYLTAFEIFDNNASESITADEFEKVIRHTTPLVELDFDFNSEFIKKYFGAKKQRSIGYHAFCQLLHDFYEEQGLQAFKKFDTQNDGSITATDFFQLMTTVKGHLLTDFSRNNLIAVAGGTSSAHKVRFPFYQAFNSLLAKMELIKRVYQSIARGNIDLKVTREEFLQATQSYAQITPYEVEILFHLAELNHPGHRTVDLTDLDKIDPERLKRVSHMI

SEQ ID NO: 126305 - protein, 79 aa, Heterodera glycines
  Coding regions on vcDNA: vcDNA=SeqID_52728; Strand=-; Position=1 -38,295-496
MSVFSSSDGSCKSINSEAVFETAEDLGEALNLDAGVVEWLKEAPRSDEDPILVLDYTDLFHALPGTLNYNKTWVANLLV

SEQ ID NO: 126306 - protein, 56 aa, Heterodera glycines
  Coding regions on vcDNA: vcDNA=SeqID_52729; Strand=+; Position=1 -64,132-238
MVDYFFAQMHFMSPIDFYEPKAKPIFLVSFESTKCNEAKIYKIAAFMQLPKKLWIE

SEQ ID NO: 126307 - protein, 108 aa, Heterodera glycines
  Coding regions on vcDNA: vcDNA=SeqID_52730; Strand=-; Position=1 -96,543-590,641-823
  Homolog annotation: Hit_ID=NP_495799.1; Match level="QueryCoverage =92%, HitCoverage=20%, E-value=4e-21, Identity=47%"; Hit description =splicing factor SF3a60 (57.5 kD) (2I814) [Caenorhabditis elegans] emb|CAA91420.2| Hypothetical protein T1
MESLLEVQRNCHEERERCIDLMVKEFMMDKKSQRERINSDQRIKRLIERNQLATEKLINAYKDEHGERSKEVQSIGGPNEFAEFYSRLKTFEGCSSKKPERHCSNTDN

SEQ ID NO: 126308 - protein, 44 aa, Heterodera glycines
  Coding regions on vcDNA: vcDNA=SeqID_52731; Strand=+; Position=1 -22,98-210
MYIWAYFKNPEVAALPWECTCEIGEKYESFAVSAPSLLLNDYYF

SEQ ID NO: 126309 - protein, 326 aa, Heterodera glycines
  Coding regions on vcDNA: vcDNA=SeqID_52732; Strand=+; Position=1 -477,539-608,862-1295
  Homolog annotation: Hit_ID=AAC95573.1; Match level="QueryCoverage =49%, HitCoverage=41%, E-value=3e-18, Identity=28%"; Hit description =orf 48 [Ateline herpesvirus 3] pir||T42963 hypothetical protein 48 - ateline herpesvirus 3 (strain 73) ref
MSNSKSLADFCNDEEEEEEEEEYGGGETKESSEEEEEKEEEKEEEEEEEEEDRKKGNKEGKEKLREKGKEKESMGKSDQNQAEDDNVDHDHDQQQMDDDPFDQTQKQADQTDGQAKSEQCEADQTDSEQTEEETMLSDLNEDDGNGGEENPNSLGFGYTSAECPPKEMPLKMLQEIDRKNVIDPEQHHLMGNYLQLFWHDNENFLPLSPQNSVIMKVTQILATIAFYRNCAMELFALPDLYTENGTFSAKIGDYRQKWAVTQMTESETMGENICKIYQFIYEMVNDEELKAAGAVWEQYLARNVVKIGQMEAKEQLKKVEILNWKI

SEQ ID NO: 126310 - protein, 18 aa, Heterodera glycines
  Coding regions on vcDNA: vcDNA=SeqID_52733; Strand=+; Position=1-56
YREAIPEGFGLPINLGAS

SEQ ID NO: 126311 - protein, 74 aa, Heterodera glycines
  Coding regions on vcDNA: vcDNA=SeqID_52734; Strand=+; Position=1-223
MGAETIAKPTAPPQKMNTHFLNSSTTPQQTHHRNNSKQPPQPQQQPQTARRNSAARRHTTPDMAASAAYGMGKR

SEQ ID NO: 126312 - protein, 119 aa, Heterodera glycines
  Coding regions on vcDNA: vcDNA=SeqID_52735; Strand=-; Position=1 -265,450-542
KMALFRFNETKTNRGRSLISCHNFDYCFERDARIAEGFEYWRCPRRPPYCPGRATVQSAWQIDPDGNRFKMGRVTAPHNHPPIFGQHNIREANERVREEARSDFPTTSRNIVRDVRSEM

SEQ ID NO: 126313 - protein, 106 aa, Heterodera glycines
  Coding regions on vcDNA: vcDNA=SeqID_52736; Strand=-; Position=1-321
MSVIIDHSAVPVVYGLMPNKELGSYTSFFETIRNRIGNNWFPTRIMSDFELAAMNAAGIVFPNSVRTGCLFHFGQALYRRVQRLPNLHTQYLQNRDLQTSIRSLQV

SEQ ID NO: 126314 - protein, 80 aa, Heterodera glycines
  Coding regions on vcDNA: vcDNA=SeqID_52737; Strand=+; Position=1 -109,404-537
MAKRKQHFFRVELSAGVMRRRKHTEGIGRELKGEREVFHNSPQNPLLSTAIPTKGHWQNQKPRHTVLASRRAEVVLPVRP

SEQ ID NO: 126315 - protein, 91 aa, Heterodera glycines
  Coding regions on vcDNA: vcDNA=SeqID_52738; Strand=-; Position=1 -51,648-872
MFITELEEILDVIDPIEALKLFMEENQKLFDLCVQNFNKQKEQEQLKQQNNRRRWELLEKAAMENARAIRQQQTDGEAEPYSIGEGEKKPK

SEQ ID NO: 126316 - protein, 130 aa, Heterodera glycines
  Coding regions on vcDNA: vcDNA=SeqID_52739; Strand=-; Position=1 -227,685-848
MDFIECRHFKASKIEAVLETARINLDVDNSDCQIPNMQHLFSNFFLQTILALMHHYFSMAFQMRLVQPYEFHYIYWAETLMCQAMCSMNLDLIISQRMAVPPGEGLRYTKRVELFSSIPPLLFYSYEEYL

SEQ ID NO: 126317 - protein, 41 aa, Heterodera glycines
  Coding regions on vcDNA: vcDNA=SeqID_52740; Strand=+; Position=1 -21,91-195
MSKAMKKLVEMDAKLDEEELNLLFTGYRKAIKILQNQLLKK

SEQ ID NO: 126318 - protein, 41 aa, Heterodera glycines
  Coding regions on vcDNA: vcDNA=SeqID_52741; Strand=+; Position=1 -6,275-394
MTAHDDGNADLLAETTCDSFEVSMEILEKINAKLNEWARKQ

SEQ ID NO: 126319 - protein, 188 aa, Heterodera glycines
  Coding regions on vcDNA: vcDNA=SeqID_52742; Strand=-; Position=1 -93,366-428,482-608,664-824,879-1001
  Homolog annotation: Hit_ID=AAB02100.1; Match level="QueryCoverage =78%, HitCoverage=71%, E-value=5e-26, Identity=44%"; Hit description =isoform 2 sp|Q26537|1432_SCHMA 14-3-3 PROTEIN HOMOLOG 2 (14-3-3-2)
MAAETKEELLFLINLCDTSECFNEMVDAVKKVIETYREELESELLVNCRGVLEFLDSTLIPNATTNLEAKVFYLKMKGDYNRYISEIALGEDRTTAIEEAKQSYNQAAEHAAQLTPSDPTRLAVALNMSVFYHQLLKDVDQAIQMTERALKSAKAIPATHIDSKNIIIQMKKNLELWKPVNPKHAETK

SEQ ID NO: 126320 - protein, 27 aa, Heterodera glycines
  Coding regions on vcDNA: vcDNA=SeqID_52743; Strand=+; Position=1-142
IWQHGKSYSELIAFSKPLNSFALLICT

SEQ ID NO: 126321 - protein, 66 aa, Heterodera glycines
  Coding regions on vcDNA: vcDNA=SeqID_52744; Strand=-; Position=1 -165,611-646
MYIIPSCILPSSYIIKTYKVIMHFCNQLQHAEVLFALLNHSKSSAISMRRAAGVQINCFVSCQSVE

SEQ ID NO: 126322 - protein, 38 aa, Heterodera glycines
  Coding regions on vcDNA: vcDNA=SeqID_52745; Strand=+; Position=1-115
MNQQQVIKTKRNNDKLVHDGALYVFHKFSNDGLKKFWR

SEQ ID NO: 126323 - protein, 147 aa, Heterodera glycines
  Coding regions on vcDNA: vcDNA=SeqID_52746; Strand=-; Position=1 -190,1031-1284
MPKKKWLCPEGIRGDHAHNETVHKCRILKFANKALRNYLRFHALRVFNEETNGMEKLAFIQKEDLLENLALKPSFLSSSNDNISEIKIILLKAYKHFNITPEEENLNEFEKITQNFANKENYEKVQKLVKAFKMSRVLERNFILKIF

SEQ ID NO: 126324 - protein, 84 aa, Heterodera glycines
  Coding regions on vcDNA: vcDNA=SeqID_52747; Strand=-; Position=1 -242,383-395
  Homolog annotation: Hit_ID=NP_608540.1; Match level="QueryCoverage =94%, HitCoverage=13%, E-value=8e-10, Identity=43%"; Hit description =CG2839-PA [Drosophila melanogaster] gb|AAF51469.2| CG2839-PA [Drosophila melanogaster]
MRGKRRKRRRKEEEMRRRKRKSEKMKRKGGEAENDEEERKEEEEKKEEGRERGRMGGKRTNWGRKKRAVERGRDEEEEEENYPF

SEQ ID NO: 126325 - protein, 113 aa, Heterodera glycines
  Coding regions on vcDNA: vcDNA=SeqID_52748; Strand=-; Position=1 -106,761-996
MTHFPPNFLPTIFTRLLLIIFIIIIIIDETLLSKGEVEAEKNDTYYTFPFSLKNDQKISTNEGAECKDYKDKEDKELEKLLLALMDRKRNYENAKNELEKKQTAQDSVSKNEK

SEQ ID NO: 126326 - protein, 95 aa, Heterodera glycines; identical to SEQ ID NO: 125597
  Coding regions on vcDNA: vcDNA=SeqID_52749; Strand=-; Position=1-534

SEQ ID NO: 126327 - protein, 57 aa, Heterodera glycines
  Coding regions on vcDNA: vcDNA=SeqID_52750; Strand=+; Position=1 -32,95-236
MAILCILLMHITKDYGGGGREGEVSAGNHANKEAGGRKKRKKGTRKEKKMPELFKKI

SEQ ID NO: 126328 - protein, 259 aa, Heterodera glycines
  Coding regions on vcDNA: vcDNA=SeqID_52751; Strand=+; Position=1 -105,151-255,302-481,536-839,1087-1172
MSANFATKKLNQISELWQHMAFGEDRFNELDIYNLKNEIAKGNNYLIFDVNQKAMVENIIREMDELLKNWSSKINCHFSDEWLFRPKEEAKLSAICIMPFEFDISSFLGTYFSSNSSVFHDQSLFCRLSKKENLLALQRIQKDYFNSVPQIHFTYQTLPVTIMAILVPNLGQEVPNGPLDDQKIKTIAQKFGDEIEKLIRADHLFDEGQFRISQRVNDQTMEQLANSIVHADFTTHAKISLVFIGQIGHNTKRSSQHCA

SEQ ID NO: 126329 - protein, 167 aa, Heterodera glycines
  Coding regions on vcDNA: vcDNA=SeqID_52752; Strand=+; Position=1 -90,129-346,410-605
MIILALKTLRNESEKNALIGPLINKTFSQMYEHFIVVICAAPNYQIETFANFVGIRIGHELPEIIENPLERWIKFCHLFARPISLGECNNNNNNAPSPKSSSTYCKKIWLVGIEVNEKQKELSKFQDKMREKLKKKLAKKIISNFEGSFVEIETDYVNEREQLQKLW

SEQ ID NO: 126330 - protein, 150 aa, Heterodera glycines
  Coding regions on vcDNA: vcDNA=SeqID_52753; Strand=+; Position=1 -287,328-493
MASHSDEYEIDEFWLDNIAYDDGEPRPKSKKCEIIAGIDLQSHRQRREWAESRIFRQYYDIILDGNGNLTNYVICKSCVPPAKPVTFNYAGFHNLRRHLKNWHGIKFGTNDKYDKMELALVEFCVADGRPFSIIKGEGFKHFMDAYAELM

SEQ ID NO: 126331 - protein, 52 aa, Heterodera glycines
  Coding regions on vcDNA: vcDNA=SeqID_52754; Strand=+; Position=1 -32,542-668
MAYKCIDMGIRGNSKKIIYNWKMAMKLIINSFKTLKNCIKFYQGYLDNRRLF

SEQ ID NO: 126332 - protein, 210 aa, Heterodera glycines
  misc_feature (3)..(3): Xaa can be any naturally occurring amino acid
  Coding regions on vcDNA: vcDNA=SeqID_52755; Strand=-; Position=1 -219,269-380,516-656,704-824
  Homolog annotation: Hit_ID=AAK26377.1; Match level="QueryCoverage =98%, HitCoverage=62%, E-value=6e-96, Identity=87%"; Hit description =putative alpha/beta hydrolase [Heterodera glycines]
PVXSINSVYCGTFALLQLFQTLKLTPFVVLGWSEGGRTSIHVAGQGKGLVSHMVLLSSGSQVDMRGDLAFKGMRNTDQWMPMRNTDQWMPAAKAPYLEHYSNEFLKEQWAGLCDVVAKVYKDLGGSFPCDRVLNTLKIPVLIVNGNMDRFVLDPSLMSKKLENARIEIHAIEIHAQGGHDLHIKYPRWFALKVTSFVKESAKSDVKANRK

SEQ ID NO: 126333 - protein, 172 aa, Heterodera glycines
  Coding regions on vcDNA: vcDNA=SeqID_52756; Strand=+; Position=1 -230,282-420,482-631
MGAEFVKRHGEKANNRTLHELQRLAMLLNPGPENKQCTPIQRCSDVAVSARPQFPSKCPLDRLATRLMDSFPTITLKNNEPLTLTDATFSMAKRALLAAQERHSLGVNNTRGDSLASEAPIELNPLRSISDQTMCFFRASEDEAANYSDDQNGEISMDESPTADIYVRNTTH

SEQ ID NO: 126334 - protein, 87 aa, Heterodera glycines
  Coding regions on vcDNA: vcDNA=SeqID_52757; Strand=+; Position=1 -82,299-480
MIFSNNSSSNSKCLFCISSLFVLFAVLQLKRHAINRARKLAKLDKLPPIPEVKVKRVIRNAKGEYNPCSVVDNLCLNGGTCYSDNEE

SEQ ID NO: 126335 - protein, 113 aa, Heterodera glycines
  Coding regions on vcDNA: vcDNA=SeqID_52758; Strand=+; Position=1 -245,929-1026
  Homolog annotation: Hit_ID=CAE74688.1; Match level="QueryCoverage =96%, HitCoverage=38%, E-value=4e-28, Identity=61%"; Hit description =Hypothetical protein CBG22500 [Caenorhabditis briggsae]
KRVFGSMIFDIFFYFLKYCSLIPRIPFKILRVFKSPVLFAPFCSYVEYSLAQFLYYAMKEGATSEQASRMTAMDGASKNAGEMIDKLTLQFNRTRQAVITRELIEIISGAAAV

SEQ ID NO: 126336 - protein, 69 aa, Heterodera glycines
  Coding regions on vcDNA: vcDNA=SeqID_52759; Strand=-; Position=1 -42,362-529
MLKGCLYIILVLIANFYVQLKIQLDRFMGSGQTPKKQGVLILMQNSVQIKYVTRKANDQSNHYFFRQFK

SEQ ID NO: 126337 - protein, 172 aa, Heterodera glycines
  Coding regions on vcDNA: vcDNA=SeqID_52760; Strand=-; Position=1 -100,221-291,359-478,596-823
  Homolog annotation: Hit_ID=CAA06097.1; Match level="QueryCoverage =43%, HitCoverage=2%, E-value=9e-13, Identity=53%"; Hit description =very large virion protein (tegument) [Bovine herpesvirus type 1.1 (strain Cooper)] emb|CAB01605.1| UL36 [Bo
MSQKLTDQGAEKRKSSGPQNLLKGEAQDYEEILMDGFFWLYETCYFDGTSSSSSAASAALLPIAPQVAPPIDPPVALPIAPPIAPPMAPPIALSIGPAALLPIAPQVAPPIALPIDPPQPPNNAERIDELIKLASQMRRMDRRIRRLERIASIAIGALLTTALGTVLSLFRK

SEQ ID NO: 126338 - protein, 41 aa, Heterodera glycines
  Coding regions on vcDNA: vcDNA=SeqID_52761; Strand=+; Position=1 -92,347-380
MAHPPLNHYVMPTPIPLFGGRRFAPRANFPRETQRKFEHKC

SEQ ID NO: 126339 - protein, 29 aa, Heterodera glycines
  Coding regions on vcDNA: vcDNA=SeqID_52762; Strand=+; Position=1-90
LCTHTSPGTGRLSFPGSSPPGRINPPADR

SEQ ID NO: 126340 - protein, 26 aa, Heterodera glycines
  Coding regions on vcDNA: vcDNA=SeqID_52763; Strand=+; Position=1-78
RSAHCDGPNWHGNGRNCKCGHRGEDK

SEQ ID NO: 126341 - protein, 270 aa, Heterodera glycines
  Coding regions on vcDNA: vcDNA=SeqID_52764; Strand=+; Position=1 -325,373-515,567-911
MGELLGIYQFNSHPYNLRGDPGLYSLKFPSHGRIFDWNIAKDNRRGTLALQIEEVSEFAGESVWSRRLSDAVEIKGLALKIRALIREKSEGTDEKKCLGFYLWCDPKEGGPRNSVFSATFRIVSEKIKVENSIGKLYDNVIDPVYQFGFGNFITFLELMDPRNGFYDREEDKVILAIDVILKDEQMEKFISDPNKSNGTILMDIEKVSEFAREIIGSERKSEAVHIKGFPWKIRAEVEKKNDNEKWLGFYLLCAAPKKGAKLKLIDNNSN

SEQ ID NO: 126342 - protein, 132 aa, Heterodera glycines
  Coding regions on vcDNA: vcDNA=SeqID_52765; Strand=+; Position=1 -72,569-895
MANQFSLFFLLIIFNGIMSYVFVPRRCYQFYTTDDDEIVGEEQKWSRTDCQYQVGFTFVQLKSKCYFMNCSNGIFSNKILTIIMYLFIIYSNILNLNQGDTNQKTYGCATDFDSSYNDKCFPYEKDGNACWI

SEQ ID NO: 126343 - protein, 123 aa, Heterodera glycines
  Coding regions on vcDNA: vcDNA=SeqID_52766; Strand=+; Position=1 -275,909-1005
MCRTLRSERIRTPSEMENSLMLLHSYNLVKVLLKKGDNYAGGRLLCRVVADIGQFPARPWEGSECQSQKVGPFRCRADSDQCRDHVHKRFLLYLNSSCPMCYETITEQIMPSKFEQFIKDNSF

SEQ ID NO: 126344 - protein, 19 aa, Heterodera glycines
  Coding regions on vcDNA: vcDNA=SeqID_52767; Strand=-; Position=1-58
FGREILFFETKLKTYITYI

SEQ ID NO: 126345 - protein, 201 aa, Heterodera glycines
  Coding regions on vcDNA: vcDNA=SeqID_52768; Strand=-; Position=1 -15,538-750,856-1072,1292-1452
  Homolog annotation: Hit_ID=NP_496524.1; Match level="QueryCoverage =97%, HitCoverage=35%, E-value=3e-13, Identity=29%"; Hit description =poly polymerase   family member (2M106) [Caenorhabditis elegans] emb|CAA90398.2| Hypothetical protein F43
MKSLKSNGTARLVVSGSHFLGTRSSDSDIDTICVVPQKGSIGEEKAKFSGTFTCVLAIPLEQRICEDNSLYCRLCKHPKIRHLSKFPSAYLHLIQLKLFGVEFDLSLVSVPDMEFLPDEPLEPIDVELMMEVLANQRMPSEVMIKSLAGSHIYGNIFGFFNGTILCILAAKVILWYPNGSVQFLFQKFMLIYATWWLYPFI

SEQ ID NO: 126346 - protein, 126 aa, Heterodera glycines
  Coding regions on vcDNA: vcDNA=SeqID_52769; Strand=-; Position=1-381
MYLEQKTGSEQHIITGTRLALPMLLIFVKCQTKQMPQSVGTNQKTLQQSLKEKLKQIRAQIYPKMGQAHHRIWALCILQQFINFIREIKNEEVIKMKEYKIQRWDGEEKCADVNEQMRAFNVRMNE

SEQ ID NO: 126347 - protein, 68 aa, Heterodera glycines
  Coding regions on vcDNA: vcDNA=SeqID_52770; Strand=-; Position=1 -108,428-526
MTSERINRKIISLILFLFIILISSNFVLSGKNKRAKRKIDGMFAFAGELGEKMNEKEFLEEMEKQKSE

SEQ ID NO: 126348 - protein, 183 aa, Heterodera glycines
  Coding regions on vcDNA: vcDNA=SeqID_52771; Strand=+; Position=1 -164,1004-1078,1591-1702,1779-1955,1998-2021
MTVPGKRIRPSGTPQQLGAHVWAPACFWLTLLVSFLNFFLIINLLQKPKILFYFFKPQGNIIFKNGPVPNHGIVEIWKKRKVTILRDFHTGRSRECAFIRFDSEDFAKKAMKIRYVYLIVNSYDAKLAKRKAEEQNLKKGAKRTNDVWQSPPNFVQVDDISSTVEMAGNEDKVPEKKFFYSYI

SEQ ID NO: 126349 - protein, 85 aa, Heterodera glycines
  misc_feature (47)..(47): Xaa can be any naturally occurring amino acid
  Coding regions on vcDNA: vcDNA=SeqID_52772; Strand=+; Position=1-504
  Homolog annotation: Hit_ID=NP_741716.1; Match level="QueryCoverage =95%, HitCoverage=10%, E-value=5e-13, Identity=44%"; Hit description =putative protein, with at least 10 transmembrane domains, of ancient origin (68.2 kD) (XB658) [Caenorhabd
TNRQLVAIVMLAISNLCSTVVVSCIGPIYPGEAKRRGSLLNSHAKSXQLRGFRMSEAQIGLVFGLFQLVMFISAPLLGKYVNIFF

SEQ ID NO: 126350 - protein, 50 aa, Heterodera glycines
  Coding regions on vcDNA: vcDNA=SeqID_52773; Strand=+; Position=1 -67,176-261
MIPKFSNCCQFLKTFTRAHFRDVTKSLVTKGFSDETSAGSLTSWHSTSYV

SEQ ID NO: 126351 - protein, 45 aa, Heterodera glycines
  Coding regions on vcDNA: vcDNA=SeqID_52774; Strand=-; Position=1-137
FKILPINWLIFSEKLFINDQNFQFFPRRRLSAPPRPQNSYFFLEN

SEQ ID NO: 126352 - protein, 116 aa, Heterodera glycines
  Coding regions on vcDNA: vcDNA=SeqID_52775; Strand=+; Position=1 -298,465-517
  Homolog annotation: Hit_ID=XP_523024.1; Match level="QueryCoverage =84%, HitCoverage=11%, E-value=3e-10, Identity=39%"; Hit description =PREDICTED: MAGE-like protein 2 [Pan troglodytes]
MSPAVIRRGTTVIRRGTTVIRRGTTVIRRGTTVIKRGTTVIRRGTTVIRRGTTVIRRGVTVIRRGTTVIRRGTTVIRRGTPVIRRGTTVIRRGTPVIRREYLLKLKGINFSKIQIK

SEQ ID NO: 126353 - protein, 37 aa, Heterodera glycines
  Coding regions on vcDNA: vcDNA=SeqID_52776; Strand=+; Position=1 -70,660-703
MAMVGVLKRILFCVMFCLLGQCYVGVVSDFPRAINIP

SEQ ID NO: 126354 - protein, 332 aa, Heterodera glycines
  Coding regions on vcDNA: vcDNA=SeqID_52777; Strand=-; Position=1-999
  Homolog annotation: Hit_ID=XP_526755.1; Match level="QueryCoverage =92%, HitCoverage=69%, E-value=2e-52, Identity=35%"; Hit description =PREDICTED: hypothetical protein XP_526755 [Pan troglodytes]
MSDIFGVGIPVSDIFGVGIPMSDIFGVGIPMSDIFGVGIPVSDIFGVGIPMSDIFGVGIPMSDIFGVGIPMSDIFGVGIPMSDIFGVGIPMSDIFGVGIPMSDIFGVGIPMSDIFGVGIPMSDIFGVGIPMSDIFGVGIPMSDIFGVGIQMSDIFGVGIPMSDIFGVGIPMSDIFGVGIQMSDIFGVGIPMSDIFGVGIQMSDIFGVGIPMSDIFGVGIPMSDIFGVGIPMSDIFGVGIQMSDIFGVGIPMSDIFGVGIPMSDIFGVGIPMSDIFGVGISMSDIFGVGIPMSDDVGDSIPILQLLGFSMCGLVPSLEHNYYKNGIKSKNPTK

SEQ ID NO: 126355 - protein, 292 aa, Heterodera glycines
  Coding regions on vcDNA: vcDNA=SeqID_52778; Strand=+; Position=1-878
  Homolog annotation: Hit_ID=CAH97176.1; Match level="QueryCoverage =100%, HitCoverage=100%, E-value=4e-45, Identity=29%"; Hit description=erythrocyte membrane protein 3, putative [Plasmodium berghei]
NSDSKNVGHRNSDSKNVGHRNSDSKNVGHRNSDSKNVGHRNSDSKNVGHLNSDSKNVGHRNSDSKNVGHRNSDSKNVGHRNSDSKNVGHLNSDSKNVGHRNSDSKNVGHLNSDSKNVGHRNSDSKNVGHRNSDSKNVGHLNSDSKNVGHRNSDSKNVGHWNSDSKNVGHRNSDSKNVGHRNSDSKNVGHRNSDSKNVGHRNSDSKNVGHRNSDSKNVGHRNSDSKNVGHRNSDSKNVGHRNSDSKNVGNRNSDSKNVGHRNSDSKNVGHRNSDSKNVGNRNSDSKNVGHRNS

SEQ ID NO: 126356 - protein, 83 aa, Heterodera glycines
  Coding regions on vcDNA: vcDNA=SeqID_52779; Strand=+; Position=1 -231,556-576
MKEQQQAMNNKLNNGFNIVTRNQHKLYKKMAKIEKNQHQLKKNQHQLKKQQQEMNNKLDVLMSINQQQQQEQPQQNVYNRHLQ

SEQ ID NO: 126357 - protein, 56 aa, Heterodera glycines
  Coding regions on vcDNA: vcDNA=SeqID_52780; Strand=-; Position=1 -76,127-221
MSSKVRRPSWSINQQHNQGAAAAERGSKWSAQSDQNAGQIARRRGQSGRIGRCHDR

SEQ ID NO: 126358 - protein, 346 aa, Heterodera glycines
  Coding regions on vcDNA: vcDNA=SeqID_52781; Strand=-; Position=1 -237,288-554,605-871,922-1188
  Homolog annotation: Hit_ID=EAA16908.1; Match level="QueryCoverage =99%, HitCoverage=22%, E-value=2e-19, Identity=22%"; Hit description =Drosophila melanogaster CG8797 gene product-related [Plasmodium yoelii yoelii]
MQDKWHVDVDNQDESDGAMRIQGKLDVVNRNQHKLYKKMAKIEKNQHQLKKQQQEMNNKLDVLMSINQQQQQEQPQQNVGPNGARNQIKMQDKLHVDVDNQDESDGAMRIQGKLDVVNRNQHKLYKKMAKIEKNQHQLKKQQQEMNNKLDVLMSINQQQQQEQPQQNVGPNGARNQIKMQDKLHVDVDNQDESDGAMRIQGKLDVVNRNQHKLYKKMAKIEKNQHQLKKQQQEMNNKLDVLMSINQQQQQEQPQQNVGPNGARNQIKMQDKLHVDVDNQDESDGAMRIQGKLDVVNRNQHKLYKKMAKIEKNQHQLKKQQQEMNNKLDVLMSINQQQQQEQPQQNV

SEQ ID NO: 126359 - protein, 253 aa, Heterodera glycines
  misc_feature (135)..(135): Xaa can be any naturally occurring amino acid
  Coding regions on vcDNA: vcDNA=SeqID_52782; Strand=-; Position=1-761
  Homolog annotation: Hit_ID=XP_550305.1; Match level="QueryCoverage =85%, HitCoverage=14%, E-value=3e-28, Identity=36%"; Hit description =helicase-like protein [Oryza sativa (japonica cultivar-group)] dbj|BAD68127.1| helicase-like protein [Ory
KSREELINFVYPNFQQLLGNDKELLNRLILAQHIDTCDEINEMMMANVTGQVREYLSTDKPLDDRPLDIDEIESEVAALNRRTDSGMPPHCLQLKVGSVVVLLINKSDREVLINGTRIVLEELGDDRLVGRVINXSNAIGGQVRFFLERSHNIFEDKTPGGLKYARLQFPIKPAFAMTIQKGQGQTIRTVGIDLEREVFTHGQLYTAFSRATDGNNVRVHAPKREIDAQGQAKVLYIVAKKMLKLQQKSNPSH

SEQ ID NO: 126360 - protein, 255 aa, Heterodera glycines
  Coding regions on vcDNA: vcDNA=SeqID_52783; Strand=+; Position=1 -24,659-1407
  Homolog annotation: Hit_ID=XP_550305.1; Match level="QueryCoverage =84%, HitCoverage=14%, E-value=2e-30, Identity=36%"; Hit description =helicase-like protein [Oryza sativa (japonica cultivar-group)] dbj|BAD68127.1| helicase-like protein [Ory
FLDHFLGVEELINFVYPNFQQLLGNDKELLNRLILAQHIDTCDEINEMMMANVTGQVREYLSTDKPLDDRPLDIDEIESEVAALNRRTDSGMPPHCLQLKVGSVVVLLINKSDREVLINGTRIVLEELGDDRLVGRVINNSNAIGGQVRFFLKDLTISSRTKRLVLKYARLQFPIKPAFAMTIQKGQGQTIRTVGIDLEREVFTHGQLYTAFSRATDGNNVRVHAPKRENAQGQAKVLYIVAKKMLKLQQKSNPS

SEQ ID NO: 126361 - protein, 263 aa, Heterodera glycines
  Coding regions on vcDNA: vcDNA=SeqID_52784; Strand=-; Position=1 -66,121-239,295-509,575-966
MSLWKNISDDDDLLQCEWKAFIDDVVVLLNKAESGAELLVEQCWQKGGILNTKDLLFYALLGGGLIILAAVLTIVIVLVVRRQRKSASHTVGGDDDMDDKRTKKMGRPAATRIVVHNCRMEQPAGNQSQMSHEGYSARASEFGVEVPESLLSDREDGGRGPFIRKAMIAPKFGVEVPESLRSDASRDVTMPHKFGVEVPESLRSNGSDDGSGRLLLVTATARPKSAPKKPMPTDDMYAPPKKSARYGTGKLQQKEIYAPLPPI

SEQ ID NO: 126362 - protein, 42 aa, Heterodera glycines
  Coding regions on vcDNA: vcDNA=SeqID_52785; Strand=-; Position=1-138
RRRKRTESFTAEGSSIGEGDRWTLIRDIRQRNVSTIIKPNKY

SEQ ID NO: 126363 - protein, 16 aa, Heterodera glycines
  Coding regions on vcDNA: vcDNA=SeqID_52786; Strand=+; Position=1 -3,305-352
MCLKVGNYGHVRFKDF

SEQ ID NO: 126364 - protein, 57 aa, Heterodera glycines
  Coding regions on vcDNA: vcDNA=SeqID_52787; Strand=-; Position=1 -3,622-706,1323-1407
MSFSPTLLREILISLIISQFSSITDYLFYVLFAYPVKRNLNFTNNFSIVFYNRLSLL

SEQ ID NO: 126365 - protein, 56 aa, Heterodera glycines
  Coding regions on vcDNA: vcDNA=SeqID_52788; Strand=-; Position=1-597
RQNAHLKLRKYKLIFAIRTDYLVNRKQINHKIRTKIDFILECTLKMHNKLIYSNLF

SEQ ID NO: 126366 - protein, 266 aa, Heterodera glycines
  Coding regions on vcDNA: vcDNA=SeqID_52789; Strand=+; Position=1 -217,474-1057
MAITFWLFYRKFSEFFDVYQLPKESNFAFQLRILHINNAKVKLTQIKKEMKQLLDGKHWTILEFEALTYLAPELLDEQSLAMKYLPIISMGHNEIFTVVEAGVRIYFGRIWKIFLAFKRQEKDSVQRSDWAAISKKLENKLKIFFGEQVKKHSLSFSHKIWLDLAKMYNETFALNENEKMAIKNFDFSNLELIEQEIVEDHCQNMEQLIGGKNEFSEVIKGASNLAKFRVKQFITARLNRENLDEENELMAKFPALGQMLQFGILT

SEQ ID NO: 126367 - protein, 91 aa, Heterodera glycines
  Coding regions on vcDNA: vcDNA=SeqID_52790; Strand=+; Position=1-274
MLETALSGADLDTFNTNVLYYVFRQMLIEKVDARQLVKLGAQNAQLGRKVAELMHANADGRLEGEAEKRKQICHLERFMKWYVKNNEKQDE

SEQ ID NO: 126368 - protein, 333 aa, Heterodera glycines
  Coding regions on vcDNA: vcDNA=SeqID_52791; Strand=+; Position=1 -260,330-598,777-1046,1148-1348
MIFSPYNDDNQMYAEIMLALRYAMIRIYGLKDQIKGSHSEDLERETIRILIVLRIIELFDDRMPNVRMLCVAMSFLKMIIDKRKTKRLSWDPSAVVAQCLETEAEPIFAEQRFYMVPYHQEYFKQFLALCKRDDALTTIIREGLCKLSLLSRLIGDDSLFRLFNFTLIREKLIDRNFFNNKKFLLSQNYLGLLIGRTDEERQTNRVLADLIVLTTNYFEVDKFGHSEAIRKIVDFQWLHCRFLYESVVENVEESRKISFFVGIFIPANKMLANNSKKFTNALQVTEREAVAEMDTQWFNSKNEYAKPSEIVQKMHFDQLMMLRNDENFTEIYK

SEQ ID NO: 126369 - protein, 82 aa, Heterodera glycines
  Coding regions on vcDNA: vcDNA=SeqID_52792; Strand=+; Position=1-249
MNVYEDLRKEGLRKMYYGLQKVKSTPKADKRIHSNTKPNLKRKKRRKMWKRKKKMKIEKMERRKMMKMLMKMMKMLMKQGNF

SEQ ID NO: 126370 - protein, 342 aa, Heterodera glycines
  Coding regions on vcDNA: vcDNA=SeqID_52793; Strand=+; Position=1 -496,539-633,916-1128,1285-1509
MNMLTLGGFINEIEDRFKMVENISKMENLSDFMCKEKAQNLLEKWEEFKNEMDQFKKVNKKEFENLEEKLYEKLRNLLLFIDGEGQLSGLNVKNNFAKANLKVQIHLKNILWALISDKKMGKNWQKFDNETKKMKLFKLLQTQMEQFKIEQSMEKMEKMMEQNEIDNELFEKSAIKEDEQQKYLLTIFPLHSQQITISNKHARLLISGSLLLDVHTIGSDVNLFCVAPGERLKLSDFMGSDKNGKCMENKCKSEEADDAKSLFCQICEDKSTANLIKIESASILLIRFAFDGIEFDISFVVVPKVKTLAHKMDDNELKSLLEHFDWSVNEQKHMLRSLSSKK

SEQ ID NO: 126371 - protein, 188 aa, Heterodera glycines
  Coding regions on vcDNA: vcDNA=SeqID_52794; Strand=+; Position=1 -60,179-262,329-534,612-828
MLLDSSHIQMQKSSVAKCLMPLNQISSMKNKQFELDALLKNSIPFSQKFGNFIVINCVAEDKEEADAFCDFVEWRMRLQIIFDIDKKGGGGIETHLYPNVYQENCILTQKLVKFSFRANHCKIWLLGIYGKNAISERITAMAQSFDTTIKRHYFLKKVENGNIRKIDDFFNTTKIELKSIMAKKEELI

SEQ ID NO: 126372 - protein, 20 aa, Heterodera glycines
  Coding regions on vcDNA: vcDNA=SeqID_52795; Strand=-; Position=1 -47,693-708
MRHFHIKISDRLVHGKQFNP

SEQ ID NO: 126373 - protein, 66 aa, Heterodera glycines
  Coding regions on vcDNA: vcDNA=SeqID_52796; Strand=+; Position=1-198
MQWVDYEKVRPKQTVPEQPQDEDGTFGGRRTMETQTEPPEQKAAQRGEKAEEKPRGQWQEDNRPHA

SEQ ID NO: 126374 - protein, 65 aa, Heterodera glycines
  Coding regions on vcDNA: vcDNA=SeqID_52797; Strand=+; Position=1 -30,82-249
MDFTTIEVNYKSPFFALPFYHSEPGVKKESWATFHVEFFDPPENEFNISLLHDSPEHSEKGKTKL

SEQ ID NO: 126375 - protein, 172 aa, Heterodera glycines
  Coding regions on vcDNA: vcDNA=SeqID_52798; Strand=+; Position=1 -60,114-308,715-768,827-1036
MGMNVKPKDKRVDVIFWNCFKKLPGNKDSCDETETKSYKNENLGKAAEFHIEVLNDSFSVIINGDQKKPLEYNSTLPVWATNFFRVEGNVRLLGRPLWKEWEVYGDEKGYFHNFSIPLKTLLNYGDQIILRTLIIGSETEFPQPFNITLLHEAAEWNEKSQSMAQKWTKEWH

SEQ ID NO: 126376 - protein, 71 aa, Heterodera glycines
  Coding regions on vcDNA: vcDNA=SeqID_52799; Strand=+; Position=1 -191,719-743
MGRLDKNTQPIEQIWPRVHDEDHGQHGIGLTLRLKLWPLWRKSNANIRFWTMCKFHRGQLTTFGLMAMSSE

SEQ ID NO: 126377 - protein, 172 aa, Heterodera glycines
  misc_feature (9)..(9): Xaa can be any naturally occurring amino acid
  Coding regions on vcDNA: vcDNA=SeqID_52800; Strand=+; Position=1 -54,138-251,345-415,459-515,562-654
  Homolog annotation: Hit_ID=CAE64443.1; Match level="QueryCoverage =99%, HitCoverage=83%, E-value=3e-29, Identity=40%"; Hit description =Hypothetical protein CBG09150 [Caenorhabditis briggsae]
VVIVKNGKXLPRGNNGALFSNDPTAHAEVFSNDPTAHAEVTALRGASKVLDSFDLSGCIPYTSCYPCPPMCLGAVLWSRISNVFYAAAPTDAASVGFDDQNFHEFVSNPKTDAASVGFDDQNFHEFVSNPKYEKLMALEHLYEKLMALEHLPVEGHMKVFKMWEQRDEKRMY

SEQ ID NO: 126378 - protein, 80 aa, Heterodera glycines
  Coding regions on vcDNA: vcDNA=SeqID_52801; Strand=-; Position=1-244
IAMVRIGRLKRELENAQQSGDDQLLFRCCDALMDRMPDQLQLDSDECTVAFDLDKFDEGAVQTLEQLLLIDPLTPLNGNS

SEQ ID NO: 126379 - protein, 287 aa, Heterodera glycines
  Coding regions on vcDNA: vcDNA=SeqID_52802; Strand=+; Position=1 -522,955-1293
  Homolog annotation: Hit_ID=EAK87047.1; Match level="QueryCoverage =96%, HitCoverage=96%, E-value=4e-14, Identity=32%"; Hit description =hypothetical protein UM06209.1 [Ustilago maydis 521] ref|XP _403824.1| hypothetical protein UM06209.1 [Usti
QATTVQKTFTQQQQQQQQPSQLQQQQQFKFAQQQRHMDLMAQQQQGRQLHAAIALQQHPVAAQVVTDGCVFVGGQQLANAATVAASASDSRPTTMLPVSTAAAFAQQQFIGANGLQHQQQLQQDFQAATVYQHHQQQYQQQQMKYHSQHAEAVQQQQQQHQYGREGAVAAQAAPYSNHSRMGKFLCSPPPYPAAAGGGVVLPLHAYGGAPYSMLHHANAAGGAAESGGKELLFLQNSPAMAPPLPITVKLEEDGGGDGQQQKQQQNDEKVPQKKQQQQIGKCQPPKR

SEQ ID NO: 126380 - protein, 572 aa, Heterodera glycines
  Coding regions on vcDNA: vcDNA=SeqID_52803; Strand=-; Position=1-1719
MDTLSTRLDQVVEKVESLESQVENWDDPNADKLSQNGNATVVLRGRVGLLEEEDDEDEFLNVLTTVDPFASQLPACRDENLTSFDNWAQKFRDLLDYAGTTWSEKEKLGRLKFSLEGQIRKLFDKLPDNKKDTVDKALNAIRDKLDSPERREMSKRALVTCKQRETETVREFLSRLSPLVTTVCAGQSEAQIQSRLRDEFLERVKPNLTFLIRLTGVTKNQDFEAVFSQAQELELLLTNTNENNVLDPLKFTVQAITQSPVNQSGYRTNQFSSSNVNSWAPAGQRYTNNRQVNQQTQNNQPNGSGRGYFRGNHGESNRPQFQRNRANQYRSNRGRGDRNWTGRPKCHHCGRLGHVAYNCRDRRSQFQMNGPNNNSNRPTYYTPVNMVQPNYPFQANDVVPQTSSNPQNVTVDLSALADQLIQRMNVRDGLPPDQPISSNMQHNACNALMPEEHLNDQSSTSEWASNEVDSSVPPLKVSNWGFPTTGPQLSRILMLTLTLIASMLISTNADQLLVPEHPLICQTAFHAATWGLPKFNGCSSIAVNLSHTPKSQRKRIYTPIFFESELKNGHVR

SEQ ID NO: 126381 - protein, 170 aa, Heterodera glycines
  Coding regions on vcDNA: vcDNA=SeqID_52804; Strand=-; Position=1 -195,453-601,910-1080
QLLELFKVFVVGTNETSAASADFLCPCTSNPELIVPLDRRVYSDLLVGTVDAAQGKEFDYVIVSVGRNNTSTLGFLADSYHPTLRMWKNGRVNVMFSLHRKALIVLCDAASFLANPLLTTNTAPEGTEAVEFESGIEAGRFMPYTKQSFMVFLKEARREGLIFDAKDLEL

SEQ ID NO: 126382 - protein, 330 aa, Heterodera glycines
  Coding regions on vcDNA: vcDNA=SeqID_52805; Strand=+; Position=1 -282,488-676,832-993,1363-1644,2087-2164
MCLNIVKTPLMRVCKFDRPTTPNGHQISPIPEENDELDQLVSALVDNHNQQQKQGTAATTAYDQRAVKSLVTQLRDVIAQWDWAQARHRHVAKIYFERQNDELNAKWEQLNAEVAKFNETKADEWAQIAKVRTALRAEREKRLGKKEADRIIQLEKELADFKAKDARASRLASELRTQNRELQGVVRVREQSYTDNMMRLKRLESQLVSAEQENSRLRTRLKLIRQEPAATKVPQHPNHHQQQKQSQQQLPQQQHRHHSEQQRGVTFSTAAPAVFPPSSSSSSTTTATTVSAGRQQQQQHVRHQQFPALGGRLSPKRSVAMAARGTFKMR

SEQ ID NO: 126383 - protein, 54 aa, Heterodera glycines
  Coding regions on vcDNA: vcDNA=SeqID_52806; Strand=+; Position=1-164
MDEEQSNKERNANFGQMELVPKKAALQQQKEPIEAMIIKHRTMADEEEAGTGMD

SEQ ID NO: 126384 - protein, 153 aa, Heterodera glycines
  Coding regions on vcDNA: vcDNA=SeqID_52807; Strand=-; Position=1 -100,152-427,507-590
TIYVNDALFDEFIELFSRHCIRSPATVKEATESVYMWLLADYLQYLLPVDEQKLNLLKNSTWISAPFSSLPTSAVTSPRRLLRPEVLAQCAPLEHVSLRSGAFKTLYPRLLQFVGTMLSHVASLSNWPSVAQFQVLRIILDHYLTFLFSETED

SEQ ID NO: 126385 - protein, 68 aa, Heterodera glycines
  Coding regions on vcDNA: vcDNA=SeqID_52808; Strand=+; Position=1 -38,95-217,998-1043
MTRRCTTSMARARNSGVVYSEMQARDSEMDSMLDKKRKELFYPAGSSYRAMTGRLKNAIWTLKMPQDE

SEQ ID NO: 126386 - protein, 32 aa, Heterodera glycines
  Coding regions on vcDNA: vcDNA=SeqID_52809; Strand=+; Position=1-96
MANAMYAARARAAKAEKRQAQLRKAARARAGN

SEQ ID NO: 126387 - protein, 57 aa, Heterodera glycines
  Coding regions on vcDNA: vcDNA=SeqID_52810; Strand=-; Position=1 -95,347-416,538-633
IAFCLSTFIPFIHSIHLIIRPPPPPRQIATSRALFNLPGPTEPNHAYHDGLPPSAAP

SEQ ID NO: 126388 - protein, 75 aa, Heterodera glycines
  Coding regions on vcDNA: vcDNA=SeqID_52811; Strand=+; Position=1-264
CSSIKKEDGEKIFPYILVISFCFWWGAWNSGIMRTRPIWQVKQRLLTSQKVRCRDETNQHCLPRGTRHGPPKEWI

SEQ ID NO: 126389 - protein, 172 aa, Heterodera glycines
  Coding regions on vcDNA: vcDNA=SeqID_52812; Strand=-; Position=1 -258,405-663
MSLTAQNSSVPSSTSVAERRERRRQKILQNAEDRISKILTAHGGERRQAPTIDGMYGEERADSGGETAPVELTSNEGSSVMDDGDVQCRLVNCRERFDCHRLSAAASFGVLLRLLVHFDLVRSVPLTFLPAFIACQFFLRFRFSNGVTLNAQDSLMTNFLLVCGLNERSVRL

SEQ ID NO: 126390 - protein, 173 aa, Heterodera glycines
  Coding regions on vcDNA: vcDNA=SeqID_52813; Strand=-; Position=1-522
MLKAKPHVLFVQCRFLRMMKSIPKDSKFTAKFGDTSMVGFSTVFFQWSMVGIVVRFWRGSDESAEEGASAGREVQAVVPDGPRRTDPIGLQPIPTGRPKVSVVRAGHPIGLQKRTAAPTVRLQLQRARVRPARDRAVQKTVPDSVGHHRDQSQGWLHAGAGEGRQIFARPETV

SEQ ID NO: 126391 - protein, 29 aa, Heterodera glycines
  Coding regions on vcDNA: vcDNA=SeqID_52814; Strand=+; Position=1-89
MRKAKCETPKNANNAKGEMRKAKPRPIPG

SEQ ID NO: 126392 - protein, 114 aa, Heterodera glycines
  Coding regions on vcDNA: vcDNA=SeqID_52815; Strand=+; Position=1 -64,111-218,274-446
MKFVLLPLSLFCCFAFPCICYGIHCKVGMYDTLGNAAIVISECWMDQHFCSAIGCAIGTDQITVVWACEQQNDPKVLVKRTSFKNYTCFAKIGQKGANMSNEEFAFPELAELVK

SEQ ID NO: 126393 - protein, 50 aa, Heterodera glycines
  Coding regions on vcDNA: vcDNA=SeqID_52816; Strand=-; Position=1-151
CPPTVAEMFRRKKSCIRTHSSSQRSRCMLCRSRARSIRVVSRGSPGAFCV

SEQ ID NO: 126394 - protein, 124 aa, Heterodera glycines
  Coding regions on vcDNA: vcDNA=SeqID_52817; Strand=+; Position=1 -119,221-311,527-691
  Homolog annotation: Hit_ID=CAE69450.1; Match level="QueryCoverage =83%, HitCoverage=22%, E-value=8e-16, Identity=40%"; Hit description =Hypothetical protein CBG15641 [Caenorhabditis briggsae]
MVLLVSALYAVCWLPQNLLMNIFVTYDPSILSHPYILYIWWGSHSLAMFHSAVNPFVYYVTNRRIHAAVKHLLRWMPCFRNARNLALAEFDVKKRLASSFRYTSADHQQQRRTTLYKTVSNSLH

SEQ ID NO: 126395 - protein, 275 aa, Heterodera glycines
  Coding regions on vcDNA: vcDNA=SeqID_52818; Strand=-; Position=1 -243,299-883
MTTALLPRSLSSLSVLTTATSAAANANNNRHGDDGGGGANNGRAGGDDSAAASAAIAAAELLAPPSPLAPPTVASEKDDEKNINGKTADFVVPPPSTNDGREDDGATATMPPFKPSPVAEGAVTVAASSPATSVDSGVASPGAAADYLLLNGSSSSLRAKESTAADKSEQYNNTNNSANSPCWATVPRTRRRIFNFGTIIAGDTNSTGSNESPLIDALTLSSTMSSSSSICTTTTGASTKPQKTGQHSSTSSMAPMPSLTLQRPPLKKVGDVGFS

SEQ ID NO: 126396 - protein, 102 aa, Heterodera glycines
  Coding regions on vcDNA: vcDNA=SeqID_52819; Strand=+; Position=1-309
MHNGDRLAVALFNDAAAAAIFSDRSNSARNSSTRWMRSTMAPPPMALWEEDDEEVVDEEDMIILRISQRLYGGMNMCCTSNLYANLKMEKTLKMAFFGKLGK

SEQ ID NO: 126397 - protein, 439 aa, Heterodera glycines
  Coding regions on vcDNA: vcDNA=SeqID_52820; Strand=+; Position=1-1320
  Homolog annotation: Hit_ID=XP_479365.1; Match level="QueryCoverage =45%, HitCoverage=13%, E-value=4e-14, Identity=28%"; Hit description =helicase-like protein [Oryza sativa (japonica cultivar-group)] dbj|BAD32013.1| helicase-like protein [Ory
MNNRTFVLPDLSINYEKKRILWHINELYGSDNVPYHPREGVPTPCPIVYRHTDEAQSTSKAAELMEVDEHDDIMIIEPQTSGQAVGAILTQAQVAGENQADTLGLVSESCIPQEPIAQADDVIFIRPKTPPRRSLRVQKRLSASVSRSPSPAPKRPPPANSLGMATPITRRCSAFHKGWQCAAAAAKHFPEYCDSGKLGDKKCADCGAHLFSHEDSNICCRKGRVVLPMLNPHPDELKELIVGNKQSREGKEFVRHMSRYNNLFQFASVSAGNKPSPAGGPMAVILNGEFHRRISSMQAGTTQIPGFGQLYILDPVEAMEQRRNNPRFTGEKITNEDEFVQGHQLNEQTLEILEKMIQVHHPAVQAYKQAREQLTELLQQQNQEELRFFRMTLLDSRRAPAGLTDPKLHPHQIITPSTGEGMFAIHADPTGAPPPQEFA

SEQ ID NO: 126398 - protein, 367 aa, Heterodera glycines
  Coding regions on vcDNA: vcDNA=SeqID_52821; Strand=+; Position=1 -196,248-574,712-888,933-1062,1164-1437
FPPPSPFSALPSAPPPTVGGQSQFHRTTNAKQSVPKRRRKVILRRKLLRKGATAGDLQQKKKSGNAKSGAVRRVVWRVVPLQRLPPSEDGAGQMAEGGSAEERQSNPWNTFPFENEFGVPSTGGTEKGATMRTKTGTVVVRGTDRGEGVQLGRRMARRRTTAPNDGQKPTHDVDATASSADDSLSVVDFLAPNPIAFRRLPPFNRSSAVPPPSLAHQLVALFSVGLCLCRAVFDCWALLQCFCCALFLLGLCLRRRPLSLLPLAFDVLSVLLALFFCLSLVVLLLVLSLLAPSVPPPPLSLFRCFLFIASLCFAVILFTFCTFCEQSAVAEMTKKRKRRKTEDKREEEEEEEEEEKEEEKDRRERRV

SEQ ID NO: 126399 - protein, 116 aa, Heterodera glycines
  Coding regions on vcDNA: vcDNA=SeqID_52822; Strand=+; Position=1-351
MPKALSARVPPPFSFVEPPAEVVDRRWGAGDSSSEDMRQGNGTEEAEPVPPLVPFCCVVWKWDDKGWNMGLEGSAEAECRCRNASVPFLLSGGGNKSWFLVRMPTNKWQLALFMDF

SEQ ID NO: 126400 - protein, 184 aa, Heterodera glycines
  Coding regions on vcDNA: vcDNA=SeqID_52823; Strand=-; Position=1 -134,801-925,1857-2152
  Homolog annotation: Hit_ID=CAE60209.1; Match level="QueryCoverage =36%, HitCoverage=24%, E-value=1e-19, Identity=64%"; Hit description =Hypothetical protein CBG03773 [Caenorhabditis briggsae]
MAKHWWHFQLIPQALTASEFASKTRHSPDWTITLTKRRTKSNQSSLMKHERMSLRQAYHYVKSARPIIRPNLGFWQQLVEYERKLRGHNTVTMVPAEGSALPFPDVYSSDLRGHILSNPGPPQHDPQIVALQRRQREREQQRETNAANARATATLIPVQLVGGGGSRQMGGQQQHQQDNHHHAR

SEQ ID NO: 126401 - protein, 52 aa, Heterodera glycines
  Coding regions on vcDNA: vcDNA=SeqID_52824; Strand=+; Position=1 -109,161-210
MARKFIGLLLVLKLVHAQWDGGMNGGAPMGGGMGGGVPLFFLLNWSFQSLCF

SEQ ID NO: 126402 - protein, 70 aa, Heterodera glycines
  Coding regions on vcDNA: vcDNA=SeqID_52825; Strand=-; Position=1 -121,496-587
MSSLITFIRKLSNKAKGAFGHCLGNFIRNGFNVLAKPLEEVVTLFGSAAVQLNSLTISEFSKNGFGSKEN

SEQ ID NO: 126403 - protein, 141 aa, Heterodera glycines
  Coding regions on vcDNA: vcDNA=SeqID_52826; Strand=+; Position=1 -55,99-140,202-321,632-697,768-911
  Homolog annotation: Hit_ID=NP_650438.2; Match level="QueryCoverage =97%, HitCoverage=63%, E-value=2e-35, Identity=47%"; Hit description =CG4299-PA [Drosophila melanogaster] gb|AAF55155.1| CG4299-PA [Drosophila melanogaster] gb|AAM50782.1| LD2
NILEEEEEECLHYLTKVEIEENEDIKAGYKLKFSFDPNPFFENSEIVKEFNWTAAEPNSVTTEIKWKQGKNKLANGTGSEEQTFFKWLCQNIEPVIKDDIWPNPLQYFLAPDVEALDDEENEEEDDGGDEEEEEEKEGEGQ

SEQ ID NO: 126404 - protein, 99 aa, Heterodera glycines
  Coding regions on vcDNA: vcDNA=SeqID_52827; Strand=-; Position=1 -179,286-406
MLAYLSPITPLLVFILPNFRPSLFQCFVIQSVPLVANFYIYSLILVIGLDRLLSAFCPIWICRINPAGSCPVKNFEFQSCNRTRKFDLCRIQQDPALIF

SEQ ID NO: 126405 - protein, 61 aa, Heterodera glycines
  Coding regions on vcDNA: vcDNA=SeqID_52828; Strand=-; Position=1-339
ATQFGKSVFLNALKKIQSIAWSVSKKLINFSSSSFFGLKIYLNTFFTLKDFFINTEFFEIS

SEQ ID NO: 126406 - protein, 151 aa, Heterodera glycines
  Coding regions on vcDNA: vcDNA=SeqID_52829; Strand=+; Position=1 -150,464-604,656-817
MPSTAIPTATILFFQDEIDKEPKNRDFSRVKDDAFWAFLRGYHPLDSLRKRRLEQIIDLIQEYGVSRPRDVGKSILLNTLNECYRRIYHINLFNGKMLTAIFGTQTGNKDLDVFNFIRKWCGAIFRAEQQSGHSIISYVLEDYPGEAKDIF

SEQ ID NO: 126407 - protein, 338 aa, Heterodera glycines
  misc_feature (5)..(5): Xaa can be any naturally occurring amino acid
  misc_feature (322)..(322): Xaa can be any naturally occurring amino acid
  Coding regions on vcDNA: vcDNA=SeqID_52830; Strand=+; Position=1 -180,245-302,388-596,651-764,806-847,952-1134,1177-1215
  Homolog annotation: Hit_ID=CAE57999.1; Match level="QueryCoverage =89%, HitCoverage=90%, E-value=4e-70, Identity=49%"; Hit description =Hypothetical protein CBG01062 [Caenorhabditis briggsae]
SRVKXIGNKMPKQKNGARHFTQYEINPWMKRGTVVDERKAMDQWTQLKRAIEGEGVEVLTLDQVNGLPDMVLTLDQVNGLPDMVFACNSGLFYRNLFYRNKLYLSHFRHAQRIGEQRHFADFYKGLGLELYGADCAEVFEGGGDAFFSDERTLWAGWGGPRTNRAYEHIRKMGDFETVPCELAYEHIRKMGDFETVPCELVDPRFYHLDTCLCPVGIDSALWFPPAFSENTKKELWFPPAFSENTKKEVLRRLPRAIAVSEKEAMTFVCNAITIRRRVISPKGISEETHAKLASIGYAVKELEMGEFMKSGGACQCLVMKLXEFMKSGGACQCLVMKL

SEQ ID NO: 126408 - protein, 69 aa, Heterodera glycines
  Coding regions on vcDNA: vcDNA=SeqID_52831; Strand=-; Position=1 -99,143-254
WQIVTLAPALPTPVRQAKELAKRGRANFGELKRTPQYIPRAENQQIDYQQLNRRLCYNGHIFADTRFNA

SEQ ID NO: 126409 - protein, 100 aa, Heterodera glycines
  Coding regions on vcDNA: vcDNA=SeqID_52832; Strand=-; Position=1-3,64- 363
MNVLQLKPDKRLSAKGIVQYLNGECELEEFLSLEGNDARKIVIFNDLKMQNLEQLISNLCGEESNLFRELKNVIEKQQKELLAGNEKLEKCDTKGTNFDE

SEQ ID NO: 126410 - protein, 224 aa, Heterodera glycines
  Coding regions on vcDNA: vcDNA=SeqID_52833; Strand=+; Position=1 -195,240-719
  Homolog annotation: Hit_ID=NP_741567.1; Match level="QueryCoverage =94%, HitCoverage=17%, E-value=1e-48, Identity=49%"; Hit description =IMportin Beta (123.9 kD) (imb-4) [Caenorhabditis elegans] gb|AAB04981.2| Importin beta family protein 4,
LKRILNDMLSVYQVISGNLNKAVNEQGEQALKWPLVKQMRIVKKEILTLLSTWISRAFEPRVAIPDPLFVPVQLVIENVIKPLFSTVLVDYEMNIPQAREPKVLSLLSITIVSLKVSHRHFEFAIVGFLKEDASAQVPAILDAVFTCTLEMINKDMEAFPEHRTNFFQLLKAINQHCFDVLITLPDEVFGLLIQAIVWAVKHTMRNVAENGKKFALMNECFNLR

SEQ ID NO: 126411 - protein, 87 aa, Heterodera glycines
  Coding regions on vcDNA: vcDNA=SeqID_52834; Strand=-; Position=1 -49,469-683
MLFLLVLLPLLPLSSQRYSNEPVYGRMFPGYGRTPGYGDENVPNAAGAYIQTEMPLGKLGKGVFGRAKGNVKGKSNGSRAGRTGLYF

SEQ ID NO: 126412 - protein, 78 aa, Heterodera glycines
  Coding regions on vcDNA: vcDNA=SeqID_52835; Strand=+; Position=1 -103,153-638
  Homolog annotation: Hit_ID=NP_741567.1; Match level="QueryCoverage =94%, HitCoverage=6%, E-value=5e-20, Identity=56%"; Hit description =IMportin Beta (123.9 kD) (imb-4) [Caenorhabditis elegans] gb|AAB04981.2| Importin beta family protein 4, i
LGPQIRVTVKGFFSFNRTVTKMREHIRDFLVQIREEAGDDTADLFLEEKEAEIQRIQSLKQAIPGVRNPNELLEEDMV

SEQ ID NO: 126413 - protein, 82 aa, Heterodera glycines
  Coding regions on vcDNA: vcDNA=SeqID_52836; Strand=-; Position=1-288
FEERRKPSEKGNDAKIGIWGGELRLVAIVISTKNVLDYYGILATICFCLLFWSPICPSIRQIIPFVSVPRQIPSHSASRRCF

SEQ ID NO: 126414 - protein, 175 aa, Heterodera glycines
  Coding regions on vcDNA: vcDNA=SeqID_52837; Strand=-; Position=1 -223,270-442,746-836
  Homolog annotation: Hit_ID=NP_507939.1; Match level="QueryCoverage =99%, HitCoverage=89%, E-value=5e-37, Identity=46%"; Hit description =putative nuclear protein (20.2 kD) (5U948) [Caenorhabditis elegans] emb|CAB03793.1| Hypothetical protein
LRTDEKFFTPSSAVVTQIILPTIAFCVGMVVAMLIGINKCKQWELDKVIEIRRTRRIIQRLTARLRERNFKAIQKARDVRKRAIAAKEARDVRKRAIAAKEARGEPTPPEPSAVPPPFYRQSPPTGNSPPPTYEDSLLHQFFMECSEAAQFVPFDSDPKKASRKAKGRNAIGRVH

SEQ ID NO: 126415 - protein, 74 aa, Heterodera glycines
  Coding regions on vcDNA: vcDNA=SeqID_52838; Strand=-; Position=1 -164,207-266
MNQQKSAKRATRGQRQIYEENKQTLLCYVLASICSSVLVFSLNYFLFLPQKGAWIGLASCVEQSSIFCDSYVYD

SEQ ID NO: 126416 - protein, 44 aa, Heterodera glycines
  Coding regions on vcDNA: vcDNA=SeqID_52839; Strand=+; Position=1-132
MAALHYAEFFSQSIAKFGATCMHRKKVIWREVNVVFYIIKNEEI

SEQ ID NO: 126417 - protein, 39 aa, Heterodera glycines
  Coding regions on vcDNA: vcDNA=SeqID_52840; Strand=-; Position=1 -61,896-954
MVSPKTMILDLTLGLGINLPKKSITSVIQGPRHLDKNCV

SEQ ID NO: 126418 - protein, 174 aa, Heterodera glycines
  Coding regions on vcDNA: vcDNA=SeqID_52841; Strand=-; Position=1 -158,219-288,406-530,579-702
  Homolog annotation: Hit_ID=XP_395536.1; Match level="QueryCoverage =92%, HitCoverage=47%, E-value=3e-29, Identity=44%"; Hit description =similar to CG1227-PA [Apis mellifera]
ICRDLKPANLMFSDPQTLQLIDFGSATECPLRILDARDSRRILDEAAELCTMPYRAPELFPYRAPELFTCEIGAMIGESVDIWSLGCVLFALCYFRSPFDGVHERGDSVALAVQSAKINFDTAVPVDRHIAELVDRHIAELIQSMVLIRPSERPHISQIKKRVDQMQTLDEVKD

SEQ ID NO: 126419 - protein, 56 aa, Heterodera glycines
  Coding regions on vcDNA: vcDNA=SeqID_52842; Strand=+; Position=1 -78,286-380
IVTSFLRLRSPRSYVGSLRAAPGIACACALRNMEEGTFERSAAAIKRHETKEVPGF

SEQ ID NO: 126420 - protein, 220 aa, Heterodera glycines
  misc_feature (217)..(217): Xaa can be any naturally occurring amino acid
  Coding regions on vcDNA: vcDNA=SeqID_52843; Strand=-; Position=1 -181,253-319,400-498,555-649,702-736,794-855
  Homolog annotation: Hit_ID=AAM98028.1; Match level="QueryCoverage =89%, HitCoverage=9%, E-value=2e-46, Identity=52%"; Hit description =Inositol triphosphate receptor protein 1, isoform g [Caenorhabditis elegans]
PLSLSLSLSLISLSFSVSFLVLLKRNNRSGRFLTYLADLCMCRGEANKKIQELICNTVLNERNRDIFMRTMMKPMGAKVDKETNCRTLVATNCRTLVACAESCREEDREMIDYYRHQLELLAQMCQDQQYLAIDPPPMCQDQQYLAIDPPPERKLWNISRELPADLVLQCMSDHCMSDHRLPFDIRASFTRVMVHIHMIRASFTRVMVHIHMIRWEXLFI

SEQ ID NO: 126421 - protein, 89 aa, Heterodera glycines
  Coding regions on vcDNA: vcDNA=SeqID_52844; Strand=+; Position=1 -174,231-272,999-1052
MANLGKCHLNEILSSFNCYLFIFQIKYLILSYIFILVYLNKYSHAGIHNANIRMNNAKLFYVIWFFIYHNEMIFVLFDLLIGDHRHLAH

SEQ ID NO: 126422 - protein, 46 aa, Heterodera glycines
  Coding regions on vcDNA: vcDNA=SeqID_52845; Strand=+; Position=1 -29,193-306
TEPPETISQLLSVESLNPFFDALLFAANITSSSSSIIKNNSKNRKN

SEQ ID NO: 126423 - protein, 270 aa, Heterodera glycines
  Coding regions on vcDNA: vcDNA=SeqID_52846; Strand=+; Position=1 -120,183-301,353-450,1375-1505,1590-1628,1798-1888,2002-2216
  Homolog annotation: Hit_ID=NP_491050.2; Match level="QueryCoverage =77%, HitCoverage=14%, E-value=1e-24, Identity=30%"; Hit description =InTeXin: intestinal neurexin-like ITX-1, InTeXin (intestinal neurexin) (itx-1) [Caenorhabditis elegans] g
MDTTNDNNKVFVHQQKRGIRREMSVSIASQRPLNDLFWHRVLVEVFRGEIRFSVDRLNAFQPLSFPFATSTKFSIGGDEKGNGFVGCIGNFQIDQMLHDWTQQLAQKDRDEDDINENSSATFRGGSSGFLRFFNLPISALHSDVIFSIRTDQRRALLLYEHDQADNFVQIHLADDYRIVLTMNNLSSIVSCSVFAPPIKTFNDMRWLQLILERSNEPGATAPQTVVLHVDDDQCQIGPVLLNDPDSTDHQNGLSLMDDEEKTVEEGKNVN

SEQ ID NO: 126424 - protein, 147 aa, Heterodera glycines
  Coding regions on vcDNA: vcDNA=SeqID_52847; Strand=+; Position=1 -181,1274-1444,2910-3000
MREILARRSANANEQNENGQQRHMDKIGTATVKVPNAKSTTASTEFLWPQQIVHFVGCISRNSFVHWLFLIFLLLILLAFCLFLISLICRRKIRQRIGRTYYVLQKSEPKNGGPTFEDEKQTSSGDEDSTTIGQAFEENAPELMDER

SEQ ID NO: 126425 - protein, 35 aa, Heterodera glycines
  Coding regions on vcDNA: vcDNA=SeqID_52848; Strand=+; Position=1-107
ELRAEGNEVLCLETPPNFSAVGLHYQRFDQTSDEE

SEQ ID NO: 126426 - protein, 20 aa, Heterodera glycines
  Coding regions on vcDNA: vcDNA=SeqID_52849; Strand=+; Position=1-60
GLLGSWVRVPPGELPFMFYK

SEQ ID NO: 126427 - protein, 152 aa, Heterodera glycines
  misc_feature (56)..(56): Xaa can be any naturally occurring amino acid
  Coding regions on vcDNA: vcDNA=SeqID_52850; Strand=-; Position=1 -188,939-1031,1525-1634,1926-1999
  Homolog annotation: Hit_ID=CAE57477.1; Match level="QueryCoverage =97%, HitCoverage=33%, E-value=3e-34, Identity=54%"; Hit description =Hypothetical protein CBG00445 [Caenorhabditis briggsae]
GHFGNVFRAQLSAFSGQIVPVAVKTLKAGDNMHTFEQFLREASIMRRLSHRNVINXLGERSPADDGAAAPSVVMPFMHFGDLRTFVGDSFRVITVMELAWFALQIATGMAYLADQGFVHRDLAARNCMLTERGIVKVADFGLAVDLNDATLW

SEQ ID NO: 126428 - protein, 80 aa, Heterodera glycines
  Coding regions on vcDNA: vcDNA=SeqID_52851; Strand=-; Position=1 -22,542-762
MACSESYWTIVVCEGGLASLHCPAQHGIVIHEANFGRFTLLECNPNRLTNITDQCANNRTKELMQARYTVESITTVIITE

SEQ ID NO: 126429 - protein, 64 aa, Heterodera glycines
  Coding regions on vcDNA: vcDNA=SeqID_52852; Strand=-; Position=1 -18,262-438
MAMISRVGKRNERMREKSDGGGEKAGKRERERESSREGKNKDKVDEEKNRKNPSRGESNKFFKI

SEQ ID NO: 126430 - protein, 83 aa, Heterodera glycines
  Coding regions on vcDNA: vcDNA=SeqID_52853; Strand=+; Position=1 -31,356-417,1274-1432
MPLSVTIIRYGKAQVAEECRRLEECVRNCDVVKQFYRTEGFEFLNRIFQSPAELEQITGLAELQRQADAFQSEVIEMDDSESI

SEQ ID NO: 126431 - protein, 29 aa, Heterodera glycines
  Coding regions on vcDNA: vcDNA=SeqID_52854; Strand=+; Position=1-90
RQSDQREEHDEFDQPEKETDEISLINVID

SEQ ID NO: 126432 - protein, 330 aa, Heterodera glycines
  Coding regions on vcDNA: vcDNA=SeqID_52855; Strand=+; Position=1 -146,234-296,349-417,475-567,618-670,719-810,860-1061,1196-1315
  Homolog annotation: Hit_ID=NP_995974.1; Match level="QueryCoverage =97%, HitCoverage=24%, E-value=5e-64, Identity=44%"; Hit description =CG16973-PB, isoform B [Drosophila melanogaster] gb|AAS64942.1| CG16973-PB, isoform B [Drosophila melanoga
PTILIYFTGQNVLLTDTAEVKLVDFGVSAQLDRTVGKRNTFIGTPYWMAPAPEVIACDENPESTYDSRSDLWSLGWSLGITALEMAEGHPPLCDMHPMRARALFLIPRNPPPRLRSKKWSKKFEAFIECVLEKDYTRRPFTECVLEKDYTRRPFTENLIKHTFIRDQISDRIVRNAIREHHTFIRDQISDRIVRNAIREHVERHRKVQKKEVDDYFSFSGSDEEVDDYFSFSGSDEEEVQINNNLDRLSDNKSNAKSERKSQSEGAGEGDTTTSSDKGRSSPSWDRQAQKDRRRRGGRDGNDQRGRRPAQRVPAHSGEQPKRIRKREANE

SEQ ID NO: 126433 - protein, 33 aa, Heterodera glycines
  Coding regions on vcDNA: vcDNA=SeqID_52856; Strand=-; Position=1-103
INFLIFLFLAASIFYNNWSVWSDVRQTEKIIKI

SEQ ID NO: 126434 - protein, 748 aa, Heterodera glycines
  Coding regions on vcDNA: vcDNA=SeqID_52857; Strand=-; Position=1 -643,1166-2769
  Homolog annotation: Hit_ID=NP_510671.1; Match level="QueryCoverage =71%, HitCoverage=54%, E-value=5e-85, Identity=35%"; Hit description =predicted CDS, endonuclease/exonuclease/phosphatase family and RNA -directed DNA polymerase (XR69) [Caenor
MRSLNNKLNEFTAIIALKDFELVFVTETWAKEKIPFQPFITNNYKIYEASRSGKNGGGVMILTKTSVNSFSVLSCSKFNCEIQIIQINGAKKLRIVLLYRPPNTSANFTKKILNLIGNYFEENFILMGDFNLNAKDITWTSGTPYAKSEKGNIFCEFFNKYGLFLMTNGPTRGSAWLDLILSSKPDFVNNVLIEDIFSSDHLSTNFSLSFPQNKNVPQISSCPSNPNGPSISDVEFNADEISKILKNLPNRESTSPDEISFRILRNCHLTLSPVISELFRISMDTGKIPEIWKKSIVIPLFKKGDRNDPHNYRPISLTCCLCRVMEKIIAKSIYNFLHLNNLISEHQFGFVKHRSTNTQLITVLEDWYDSIYGKKNIDCIYVDFRKAFDSLPINILINKLHNIGIRGKLLSWLSEFLKDRFYRVKINNKFSNLYPIQSGVPQGSVLGPLLFLIYINDLPQVIPPGVSIKLFADDVKIYVSYKTRDERSKLNVALDNIGKWANAFGLNISQNKTFILFLGKNNSKQQYKFCNNIINEVESISDLGILIDNKLRFSNHYTKIIKAAYLRIRNIAKILKTRSIRIWTKVFKTYIRPLLEYAPEIWNPTYKKDINKLERCQKYFTKIALFKCRLPYIPYEQRLDLFKLQTLEERRKTIDLVQAFKIINGLTHLKKDIFPQFSGHIPYNLRRKVVLKPQSSKTSNSFINRTALIWSKLNKDITDAPSVDSFKKRINKWIELNKNLVCKRAPWT

SEQ ID NO: 126435 - protein, 50 aa, Heterodera glycines
  Coding regions on vcDNA: vcDNA=SeqID_52858; Strand=-; Position=1-151
LCEEERRLHSVVVLNLPESEETVPSARVNSDFVDAQSMLDTCEIECRPCQ

SEQ ID NO: 126436 - protein, 126 aa, Heterodera glycines
  Coding regions on vcDNA: vcDNA=SeqID_52859; Strand=+; Position=1 -120,1502-1762
MFFVELVNSFRMIPRLLDLDNKEKSYSQKHAGVKLVGPTVQFLAVLFFLVLIIIVIIICAYDMGEKCRTESGNLKKNMGYKFQYKFEFLKTRENTSPAVYMIADHSGSDFYVLKNAEICAKKPKKC

SEQ ID NO: 126437 - protein, 239 aa, Heterodera glycines
  Coding regions on vcDNA: vcDNA=SeqID_52860; Strand=+; Position=1 -156,202-503,550-589,699-920
  Homolog annotation: Hit_ID=NP_495841.1; Match level="QueryCoverage =87%, HitCoverage=30%, E-value=6e-13, Identity=27%"; Hit description =initiation factor eIF-2Be (75.5 kD) (2I953) [Caenorhabditis elegans] emb|CAA91063.1| Hypothetical protein
MAENKKHNETDGCAFSVSPSKSLSNLLLDDSPSDESADERDDQTDFCGQRQQIGDTHSHSSFVAEVVDSLQGALEDGFLRENEKAKLSGDLLNKIKLEVNASKLAYNIPAEEVPGLLFTAFLSLPGVVDKFSEFTKVSITHNYLSCIYNYLSPTTFAQSQMLFAIEEKASDSDRFRRVLPKVLYFLSQEVKAMDDALIVDWYSNLEEKSQLKKEEKLAELVTWLQNAEESSETDDEGED

SEQ ID NO: 126438 - protein, 117 aa, Heterodera glycines
  Coding regions on vcDNA: vcDNA=SeqID_52861; Strand=+; Position=1-356
YDGSKACGSCWAISAAAVLTDRICIERLKKGIHSYTNHASSFASAQDILDSHLDNKCPSFNVALLKNKLITKVPVRPKVRQQLYGNGSPRRASSQAQITQWAWAASRTFIPQQKNCL

SEQ ID NO: 126439 - protein, 59 aa, Heterodera glycines
  Coding regions on vcDNA: vcDNA=SeqID_52862; Strand=+; Position=1 -14,440-605
MKNGKFPSASFSALVDEQCRNCRRICGRPARRLPPPPAPLSHIAKPFKNNRSNNCKNKN

SEQ ID NO: 126440 - protein, 173 aa, Heterodera glycines
  Coding regions on vcDNA: vcDNA=SeqID_52863; Strand=+; Position=1 -165,245-429,478-649
  Homolog annotation: Hit_ID=CAE63207.1; Match level="QueryCoverage =86%, HitCoverage=4%, E-value=1e-38, Identity=55%"; Hit description =Hypothetical protein CBG07562 [Caenorhabditis briggsae]
TVNDSRMYEFFREDFKLEKWRKGALKNAFVLMSKQRFQHAAAFFLLGGSLKDAIQTILSRIGDLQLALVVLRFYESDPERQFELLTELLCREILGCEPSQFHSLVKEGKVHFPSASRDPFKRSMAFWLINEYALSAATLLEEPSTAQNDGEDEQRRGSLVKARPFLFDCFCVE

SEQ ID NO: 126441 - protein, 78 aa, Heterodera glycines
  Coding regions on vcDNA: vcDNA=SeqID_52864; Strand=-; Position=1 -100,506-639
MSDSQQSDQRNERVTRRSLFGSGRPNDADEWLKSLENNAMEEKVRKWSFDFRIGCPLKKAGAESPSSSHVYEAIDERE

SEQ ID NO: 126442 - protein, 57 aa, Heterodera glycines
  Coding regions on vcDNA: vcDNA=SeqID_52865; Strand=-; Position=1-172
VAKLPQLSQSFAKELKPLSDADSVAFAPYGQLVADFVHHVEQSTEVQWPGVPEGEMS

SEQ ID NO: 126443 - protein, 122 aa, Heterodera glycines
  Coding regions on vcDNA: vcDNA=SeqID_52866; Strand=+; Position=1 -153,789-1004
MCRFTTCLLKFVLLSPLASESFQSIGTIYSFFIFERNTMAHVLIIERVLATISLGLFNAIGYKENGFSIVLTNFALLFSAGIELCVFSLLRWHNEKAYFRTLHSSNGHNLSERYQVGKRSQK

SEQ ID NO: 126444 - protein, 118 aa, Heterodera glycines
  Coding regions on vcDNA: vcDNA=SeqID_52867; Strand=+; Position=1-357
MDTHYADILFNDHLSLSDRSNLAYRIGGAIVHLNVERSLDLMGNMCHKTGLKIQNASLLIVGLMREQFGQMIEDFGKEQLQKDIFSLPLVPFVENGAEFGQHEKIADEQSKAGQTAGP

SEQ ID NO: 126445 - protein, 38 aa, Heterodera glycines
  Coding regions on vcDNA: vcDNA=SeqID_52868; Strand=-; Position=1 -22,181-275
MEMGQLSSFFYRYLGSYPIFVPISRLFVVPFKRHLPEI

SEQ ID NO: 126446 - protein, 472 aa, Heterodera glycines
  Coding regions on vcDNA: vcDNA=SeqID_52869; Strand=+; Position=1 -29,768-1126,1642-2166,3044-3549
MFNLVDFNKRDSINCDELENVLSQAQRKGNKIELPSWAKDFGNYFSDLHFYGLHLSLNAEGTEKGFKMSDWLGQNKLDGETTIAHSLRTMHLRGEMGRIKEIKRRMVRHLISHFQLERLEMIHPIRMAAGHVDEQTMSTYYEMMFCQNIRLTEELLEYAILCSQIFAYFLHQKGAKTEENDANWWQKFVHSTRQIILFTNDAGATEKLAKKEDVLGTLHELWHNIKDGDNFDEKALRKGSKMGRELVENLAKCLVEIYAGNEEFRKCFGEQRERRRKLEQMLRIAEKELGGRSAVPEQFWHIFEELFSYTLMKQYVELLLADRQSVDKELETIESKAIIFYYRERVRALFRKAIIAQPKMENEQFMAVINNYLTQWESLMDEWQQNAKGTANGWPQLVCKCYQFTYKLVTDKQLKELNAEWHKLVGMNVKEWNGTMLTELISENMMSWFGVGCLLICSDRVLFMGFQFVIKR

SEQ ID NO: 126447 - protein, 453 aa, Heterodera glycines
  Coding regions on vcDNA: vcDNA=SeqID_52870; Strand=+; Position=1 -30,84-543,1316-2187
MADFTKRPSTLDLFIFVRWIDSQVTALLILGNSFSAQRCAKFWVRCKVLILQLYDRYFDEQMEEMPSLQIFQYHFLSHLNLYFEKILDRKIGAKKSEKAMNDELRKIVQNSQKVYEEDKLMDSFVSEEREQYERFEMVLTELRIKTVNELANRNEVFKEALGHFLSKMKELPDFVGKDTIIETWRAIASEHFEELGKKLEEKYGKKTAETKPKKKKAKRTKNKNGKNNAKKEDGEKETEVAMDTVFTEEGNTVSGVGTNEEAKEDAEMSTVDVDTVGDKMESANTEEEAFKNENACEMNGAEKAINNGHNESLAPVGGEDQRNEEDKSQQENTDEGSESTAVADRATKLKEFADDDFLAQKYAEFVHTFMMEEQQNGDGIGQLIRMLTIGAFVNEISHRLDAIEWMGGDQWQNVKKKRTFLWWKSILADQQYSADLVDQLYDVLKEIWSEREK

SEQ ID NO: 126448 - protein, 466 aa, Heterodera glycines
  Coding regions on vcDNA: vcDNA=SeqID_52871; Strand=+; Position=1 -952,995-1167,1210-1296,1356-1541,1843-1845
MEVAMDTVFTEEGNTVSGVGTKEEAKEDAEMSTVDVDTVGDKMERANTEEEALKNENACEMNGAENAISNGHNESLAPVGGDDQRDEEDKSQQENTDEGSESTAVADRASKLKEFADDDFLAQKYAEFVHTFMMEEQQNGDGIGQLIRMLTIGAFVNEISHRLDAIEWMGGDQWQNMKKKRTFLWWKSILADQQYSADLVEQLYEFLREIWSEKEQIIGTNLEKLTGNKKEQMESDQRRGIELISRQIHSRKFGRAIIGGKVKNWAKMPKKQKEKALLSLFGSHEDGTKNAENGNNIVGNFERKLELLEKAFAQQKLDQMLFEQYKNNENLSLFIEMKDKINFNGKNAQIFPTENWQELKFTEEENDGKLKEIEKLKDALKLRDGEQKVAQKLMIKLNEIFNGWSAEAQFQPSALHFLMNSVAKLEPICILPDGFDQKLIFGQATECDQSKREQCSDQSLYCTLCK

SEQ ID NO: 126449 - protein, 97 aa, Heterodera glycines
  Coding regions on vcDNA: vcDNA=SeqID_52872; Strand=+; Position=1 -151,309-451
MRLKLLELLLPKTDYLSMFSNKQNKLDGQFAVGILDKFRTIFAFLERWAQNNFIYCEDLGYLNGEMLLIMLTKVFLLFPDSSVSFLVDKFFLIYSKW

SEQ ID NO: 126450 - protein, 146 aa, Heterodera glycines
  Coding regions on vcDNA: vcDNA=SeqID_52873; Strand=+; Position=1-441
MDRLGLSDSIRNGLKDKFRNEASKENGASQKKKKKFFRKDGRGKKKNFFAVGANVIASLGDEPWRAGRVISRKEGTYDVQFLDGTIPAKGVQPYKPDEDENLNFLLDGFGLKRASSGGSIGKHGSDGRRDQTKDDLREASDCGHKA

SEQ ID NO: 126451 - protein, 191 aa, Heterodera glycines
  Coding regions on vcDNA: vcDNA=SeqID_52874; Strand=-; Position=1 -192,312-460,789-1023
MSDDICTYLNITSARKFDSNNLTKKFSALDSSKNVTIFEWFFSSIIHQFVAAKCAFQYNLNKVVSDDYRDTILVLSDKFNCISQTAAWIVLPSLFTAISIVLNISLISVTIIKREHHKVCNWLIAYDALFQLFVVAPFALNLVDVIFQYSPIDYRICLATLMASTVASYGSILALYLISIERLLIVLFPLQ

SEQ ID NO: 126452 - protein, 76 aa, Heterodera glycines
  Coding regions on vcDNA: vcDNA=SeqID_52875; Strand=-; Position=1 -94,147-283
MLKYAHKNMNEMPKYAHKSRNMHKYAKYAYGSLPQFRKKYACAYNFTPYSSVSASHWSSFTNSNGTIDGVDTAELK

SEQ ID NO: 126453 - protein, 119 aa, Heterodera glycines
  Coding regions on vcDNA: vcDNA=SeqID_52876; Strand=+; Position=1 -242,671-757,844-874
MPGSKFKIWHTVKCRFGMCRTETINVCTLFYFSRYFNGTGCEISFISESFARKANLLGNIDRSNCQTIYVPVFGGGKLLGWVNDVEIRIDELKLKFGHRLGVMEDKHLPMYCQEKFDML

SEQ ID NO: 126454 - protein, 27 aa, Heterodera glycines
  Coding regions on vcDNA: vcDNA=SeqID_52877; Strand=-; Position=1 -49,436-470
MSFFNHLTNDTFTADQVLRLLITLKNF

SEQ ID NO: 126455 - protein, 97 aa, Heterodera glycines
  Coding regions on vcDNA: vcDNA=SeqID_52878; Strand=-; Position=1 -164,407-534
MASPAKNEKKLSSADHCLISSATIGENQQQSLGSSFETAFGEHQMKMEKRILRKIDVWMDIFPLFGRVELGLKLAMLSDRFDALVDAHFDGKSEWAI

SEQ ID NO: 126456 - protein, 260 aa, Heterodera glycines
  Coding regions on vcDNA: vcDNA=SeqID_52879; Strand=-; Position=1 -253,313-419,711-1130
  Homolog annotation: Hit_ID=AAO50779.1; Match level="QueryCoverage =93%, HitCoverage=20%, E-value=2e-18, Identity=30%"; Hit description =similar to Mus musculus (Mouse). Sex-determining region Y protein (Testis-determining factor) [Dictyosteli
MESTSSNNSSSSRPVSSHRPPPRRHNNTQAVPATARNGTARKRPPTATTAAGTTLDHHQQQQHQLQQLQTNRQQQAQHLFIDPGDRLVLSHHHQQSSSSAPLLAHHQQQPPIGPNSSPHSTDSYHNSPKGPHVVNSASTSGTNRSGTSASFRQHQMVGVGTPSSSSSSSLMMASAQQQPLPQYILSTATAAAAQHHSQQQQQQAVHQQQQHQLQQLQHHHQQQQQHHAQQQQQQQQQLYEVESEIIDLLVRHLGNLNDDE

SEQ ID NO: 126457 - protein, 144 aa, Heterodera glycines
  Coding regions on vcDNA: vcDNA=SeqID_52880; Strand=+; Position=1 -117,500-666,710-860
MCSPHGHGYECPANMQCMKLSLKANQIGFYGMFNDFGTINYFRQKLERDDDGEWRLREFDPKVNDLDTIDQCRVRRWLSALVRSTSFHTFMLCLVVFNALINASFVYRHNRSDARRKRIYHAIEVQLKCQANPSHHSLIASLIG

SEQ ID NO: 126458 - protein, 78 aa, Heterodera glycines
  Coding regions on vcDNA: vcDNA=SeqID_52881; Strand=-; Position=1-236
MFLIWSTLTKVMTFFCRKTVRVEAVRVEQYELEQYELEQYELEQYELEQYELEQYEVEQYELEQYEVEQYEVEQYELE

SEQ ID NO: 126459 - protein, 89 aa, Heterodera glycines
  Coding regions on vcDNA: vcDNA=SeqID_52882; Strand=-; Position=1 -194,254-329
MVPFEFLNEWTKEKLTLAKAKELGNRWIMKRCKIIGETAAVQQQKKDDNCNKVAIWLYICNDCIGPLSPPPFAEESGQSITKGPSSADK

SEQ ID NO: 126460 - protein, 66 aa, Heterodera glycines
  Coding regions on vcDNA: vcDNA=SeqID_52883; Strand=+; Position=1 -97,198-301
MLENIFKQKGIYLREGKHSRKEWQEFKAEINKESKILKLPKNEECEAILANEKEKGKNSDRKIAKF

SEQ ID NO: 126461 - protein, 44 aa, Heterodera glycines
  Coding regions on vcDNA: vcDNA=SeqID_52884; Strand=-; Position=1 -5,467-596
MNMEYRNAFQKVFKFLQPTNYNTTIIGTQQQQWAIRVATENVQN

SEQ ID NO: 126462 - protein, 121 aa, Heterodera glycines
  Coding regions on vcDNA: vcDNA=SeqID_52885; Strand=-; Position=1-366
  Homolog annotation: Hit_ID=EAA17202.1; Match level="QueryCoverage =84%, HitCoverage=31%, E-value=5e-10, Identity=37%"; Hit description =hypothetical protein [Plasmodium yoelii yoelii]
MAASISKQATVPPAVPRKPVPPTETKTAPKTMPNSTPKTMPNSQKMPKSETTPKEMPKSETAPKEMPKSETAPKEMPKNETAPKEMNEAIKSKTNKTTPPGTKKGNKSVAPPVFCLSFVAK

SEQ ID NO: 126463 - protein, 208 aa, Heterodera glycines
  Coding regions on vcDNA: vcDNA=SeqID_52886; Strand=-; Position=1 -137,421-525,1053-1437
MAKTQYYGQSLMDTGTAAFIFVNAIADHDGMARGQSPRQRAAKATMQLFAFRVPTLLALFLIGVGRSVFIRFSGYGQDVTEDKKLSPLNVAGELGFSLCCYCSQRVLEAHFGLSASRRLANLAYSFAMVRGGREKLFANNCHPSLGTVDPVQHHLCPVPAHSARRSVAAGCAPGWTCGSNQPKRTAPFSVCQSDDWLRQSVGNGIAAP

SEQ ID NO: 126464 - protein, 603 aa, Heterodera glycines
  misc_feature (288)..(288): Xaa can be any naturally occurring amino acid
  misc_feature (521)..(521): Xaa can be any naturally occurring amino acid
  Coding regions on vcDNA: vcDNA=SeqID_52887; Strand=+; Position=1 -272,549-708,953-1174,1631-1871,2290-2507,2763-2941,2984-3201,3402 -3697
  Homolog annotation: Hit_ID=CAE65904.1; Match level="QueryCoverage =95%, HitCoverage=95%, E-value=7e-78, Identity=31%"; Hit description =Hypothetical protein CBG11071 [Caenorhabditis briggsae]
PNACGPFVPCPPQNVHLAFSLPKSNSYIFAVEHNAIRRSVRRHCASPSCSATTFAAPAPPGAVAHPRQQRPPLSVEQIERYRNEEKWRYVRLTFYSVLWLGWLFSLMFALLLVHVHPKCAPSSSLSLEWWKGTLIYEALLKSIFDSDGNGVGDLAGIQLKLGHLRRIGVGAVFLRPILRTESTGMGVIDFTALSQQIDATMDQFDAFVDAAHRKGSADLPVLNWQNANVSSAVRAALSFWLGHGVDGFHLAGIDYLHRTADGRRPSWDEVLTKTTQIMKLMYISRKTXGIRGPSHLFLFTSHEHLSEALKVRLVDEVGLDAVVNTELRDLALGNRVCANKTAHAVPAMSVAECANEILADLLLFHQSFTNVWPLWSVGGSFARRLASRVDGKVYAELIMLLQLALPGTPIIYYGDELGLHDVLNLKAYFPQRGPMPWDSSFPQRGPMPWDSSSPFDNRTDGAGSIETNFDVINLYCRMQLADSRSFLHSVRAMARLRLRDAALRADSTVNNAILIGMPSYXIVRFPSFSRSQSVVVLVNFGPAPLTFSLSDLPPFHRRGVYRRGRIVARSANAASKFARLGIELDGRQVHIGAGQGIVFKAFE

SEQ ID NO: 126465 - protein, 65 aa, Heterodera glycines
  Coding regions on vcDNA: vcDNA=SeqID_52888; Strand=-; Position=1 -188,607-616
MFLGQTFWADHLALLLLVQLALCAVIFACCDSARACGVTPLRSMRPLRVDAARAQRDAHTMFRKI

SEQ ID NO: 126466 - protein, 36 aa, Heterodera glycines
  Coding regions on vcDNA: vcDNA=SeqID_52889; Strand=+; Position=1-109
MKCKNGRGSEEGMIEEREEEYFEVGKCGAVFCSADN

SEQ ID NO: 126467 - protein, 124 aa, Heterodera glycines
  misc_feature (121)..(121): Xaa can be any naturally occurring amino acid
  Coding regions on vcDNA: vcDNA=SeqID_52890; Strand=+; Position=1 -81,133-234,303-383,562-601
  Homolog annotation: Hit_ID=CAE60152.1; Match level="QueryCoverage =95%, HitCoverage=58%, E-value=1e-31, Identity=59%"; Hit description =Hypothetical protein CBG03702 [Caenorhabditis briggsae]
MRLEKCWFCSSTIYPGHGIQFVRNDATVFKFCRSKCNKLFKKKKNPRVFKFCRSKCNKLFKKKKNPRKLKWTKASRRIRGKELVELVNDVTQAMEIRRNEPTKYDRNLWETTSMSNKSSIXILI

SEQ ID NO: 126468 - protein, 42 aa, Heterodera glycines
  Coding regions on vcDNA: vcDNA=SeqID_52891; Strand=-; Position=1-467
GALFSRKRTTPMSFLKSGRYDSKHLKMNATPRESSLKRRPFC

SEQ ID NO: 126469 - protein, 157 aa, Heterodera glycines
  Coding regions on vcDNA: vcDNA=SeqID_52892; Strand=-; Position=1-558
LFCFISVIIFIKIHSLLKVAKKFCGTYCGTSLLDSCLIAPVIWFCNFQKSNKLRISNFIFENFAVDNCCYNHDVCYINKYQKRYDCDIKFCNCLNEYPNCFLTKVCSPTHILNILFFRIYYAGQFIFLENVLKKDKNNYFILPSIDMHMYFKFFIVM

SEQ ID NO: 126470 - protein, 118 aa, Heterodera glycines
  Coding regions on vcDNA: vcDNA=SeqID_52893; Strand=+; Position=1 -46,90-154,204-372,419-495
MEKNTESLSKLDPSETLGTDALLQLMELIKLRPKQKQGEVESEKREMEKPIADFHHRKTDQINPDSSELKKELREKGKLESYGRITDEKGEEKDSWGHALQKELDEKVRKFRELNRKK

SEQ ID NO: 126471 - protein, 144 aa, Heterodera glycines
  Coding regions on vcDNA: vcDNA=SeqID_52894; Strand=-; Position=1-437
  Homolog annotation: Hit_ID=NP_001001852.1; Match level="QueryCoverage= 98%, HitCoverage=44%, E-value=6e-39, Identity=56%"; Hit description =serine/threonine-protein kinase pim-3 [Homo sapiens] sp|Q86V86|PIM3 _HUMAN Serine/threonine-protein kin
YDLHFFERNYKLGPELGRGGFGVVYSGFRVADREPVAIKYVARRNVTDWAQLRGKDVPLEIALLEKCSACPGVILLLDWFERYDGFLIVMERPSPYCDLFDFITVRGALDESVTRFFFKQIVDTAIACAGRSVVHRDIKDENVS

SEQ ID NO: 126472 - protein, 109 aa, Heterodera glycines
  Coding regions on vcDNA: vcDNA=SeqID_52895; Strand=-; Position=1-330
MPTGSTASASSFASSPAAASPPFSSPSLLRGAVAEICSQIPLNPSALFPVPSQLSTSAARDNSAPIVPQQQQRRAETEEEDAEELACFGQSISRNGQNAPGKIPRGEGG

SEQ ID NO: 126473 - protein, 233 aa, Heterodera glycines
  misc_feature (6)..(6): Xaa can be any naturally occurring amino acid
  Coding regions on vcDNA: vcDNA=SeqID_52896; Strand=+; Position=1 -319,517-640,724-972
  Homolog annotation: Hit_ID=CAG07464.1; Match level="QueryCoverage =87%, HitCoverage=12%, E-value=2e-70, Identity=64%"; Hit description =unnamed protein product [Tetraodon nigroviridis]
INFHFXGDRQSEPFGQSKIQKYLKPEFASITPSVSFVCSDTHLGEIWVSSGHNASGFFSLFSEEAHLQTNHFNAKLKTGDTSTAFARTGYLGFLRQTQAITADGELHDAIFVVGALEEALMLRGMRFHPVDIELSVSRAHRRIDESCVFTWCVFTWTHLLVVVAETHAPEAEALDLVPAITSALLEDHHLIVGVVVVLDPGTIPINSRGEKQRMHLRELFLDQLDPIYVAYNM

SEQ ID NO: 126474 - protein, 90 aa, Heterodera glycines
  Coding regions on vcDNA: vcDNA=SeqID_52897; Strand=-; Position=1-273
MVIEVAEEMVKHEEEEVEEDERQDEERHGTTEGRSSGGGAQMAEPTPAEGQTDQREDITAGGGATNGGRENGGRDKKGGEGGTGAKGAGD

SEQ ID NO: 126475 - protein, 49 aa, Heterodera glycines
  Coding regions on vcDNA: vcDNA=SeqID_52898; Strand=+; Position=1 -47,887-989
MKNKTEWKSCIYTKRRPFGEFGVEAIISLEFERQHFGDKNHIVESVQTF

SEQ ID NO: 126476 - protein, 68 aa, Heterodera glycines
  Coding regions on vcDNA: vcDNA=SeqID_52899; Strand=+; Position=1 -166,219-440
KSCALSKCFKFLIKFFCAFLHQFFGLFTKRNWCCQDLGNGRNCTILTVIRILYHLSFDLFQRLTVLLS

SEQ ID NO: 126477 - protein, 58 aa, Heterodera glycines
  Coding regions on vcDNA: vcDNA=SeqID_52900; Strand=+; Position=1-315
FGPRGRLGPNTKIEKCAFLKIKILKTKPEGSLATWHKLGLINIRSFFTILLIPNPIIF

SEQ ID NO: 126478 - protein, 102 aa, Heterodera glycines
  Coding regions on vcDNA: vcDNA=SeqID_52901; Strand=+; Position=1 -60,638-689,737-930
MDESNLGLLFSSYVFPVQQQPTPNRNTKTPRRDEDDAEVAIVHSCSKRVATPNQNTTDLEVAKLAANIASMEEGSARSRLLNKMMTVQRQKMGIKKKKSILR

SEQ ID NO: 126479 - protein, 78 aa, Heterodera glycines
  Coding regions on vcDNA: vcDNA=SeqID_52902; Strand=+; Position=1 -67,112-225,271-328
  Homolog annotation: Hit_ID=NP_997905.1; Match level="QueryCoverage =85%, HitCoverage=15%, E-value=8e-23, Identity=61%"; Hit description =fucosidase, alpha-L- 1, tissue [Danio rerio] gb|AAH50158.1| Fucosidase, alpha-L- 1, tissue [Danio rerio]
MSFTVVPILFCFFLPALSIYKPNWDSIDSRPLPNWYDEAKFGIFSHWGVYSVPAFGSEWFWWYWKGQRDAKFERFFKN

SEQ ID NO: 126480 - protein, 23 aa, Heterodera glycines
  Coding regions on vcDNA: vcDNA=SeqID_52903; Strand=+; Position=1 -68,192-195
MHQIINFYLFILFFAPNFAEKLR

SEQ ID NO: 126481 - protein, 167 aa, Heterodera glycines
  Coding regions on vcDNA: vcDNA=SeqID_52904; Strand=-; Position=1 -257,377-620
MVSELPEQRHFVALHHCVLLLPTEHREALTQLLRFLGTVTRLSPRMTSLCMATCWMPTLFKMPGDNKMGKLMTPDNTKRSRNSKLTRRKTICTPVLDSLDAVKRLLMTMIDQWERLLYLPSALAKLVAEDKRWKVCHDLEMPIKNGQFDFSTELQYNFRQQLSRLKA

SEQ ID NO: 126482 - protein, 175 aa, Heterodera glycines
  Coding regions on vcDNA: vcDNA=SeqID_52905; Strand=+; Position=1 -35,162-381,686-727,766-827,1107-1275
CNGRLGYTLVEDDSSLLGGITFRSIVSGDKLPLLRDSPPESHVEPVAQLLRSPRDHMDNIFNPADNNIVDNTNGFALAPYTEQRRPCHDRPGFLSGNAGAPSGVLAQQTMQRFGNAYFMGNSNNSTNNTTTSSAYSLATIGTNTTTYSGGACNGSGGTLVTNATGTTGGRRKEVY

SEQ ID NO: 126483 - protein, 253 aa, Heterodera glycines
  Coding regions on vcDNA: vcDNA=SeqID_52906; Strand=+; Position=1 -126,789-1104,1149-1294,1344-1514
  Homolog annotation: Hit_ID=NP_001003918.1; Match level="QueryCoverage= 71%, HitCoverage=15%, E-value=5e-09, Identity=26%"; Hit description =ubiquitin specific protease 7 [Mus musculus] gb|AAQ12339.1| herpesvirus-associated ubiquitin-specific
ALRWADEKCLQNAIECSAENRRAALGPALFKIRFPLIPSDAFELMDPCKGLYDKGGDKVTLAIDNFVEEENEEKFDLNPNKSNGTIVMEIGKLSEFAREIIGSERSSETVFVKGIPCKILAIIEIDEKSNEKWLGFYLWCTASQSEEDRNWSCKCSATFRIVSLKSGTENSIGKFYDRVFNNERTIRGFENFIEFAELMDPCKGLYDKGGDKVTLAIDIFVEEENEEKFDLNPNKSNGTIVMEIGKLSEFARE

SEQ ID NO: 126484 - protein, 27 aa, Heterodera glycines
  Coding regions on vcDNA: vcDNA=SeqID_52907; Strand=-; Position=1 -67,206-222
MPSKNLRTQSFGLKKLILGLNNGLNSF

SEQ ID NO: 126485 - protein, 79 aa, Heterodera glycines
  Coding regions on vcDNA: vcDNA=SeqID_52908; Strand=-; Position=1 -45,283-477
MNGMVTLFWAGRETECTVEKSFTVEKSFTVEKSAVEKSFCRKVRCRKVLAPPVDLDFLDKTQEIQVHEKSSLDRRSNSN

SEQ ID NO: 126486 - protein, 87 aa, Heterodera glycines
  Coding regions on vcDNA: vcDNA=SeqID_52909; Strand=+; Position=1 -193,385-455
MSSGSSGPEEGEIGAELFANEAFEEAEEPAGLVQFFRPESKRGRELIRSGGFEYAFEADSGLQEELAKYFAKNWLGCRQIWHEWNSW

SEQ ID NO: 126487 - protein, 156 aa, Heterodera glycines
  Coding regions on vcDNA: vcDNA=SeqID_52910; Strand=-; Position=1 -194,476-752
VERELDQLDSIVVSAQQQADDVEENNHYASASAIDRRLSVDNVSSASYRNKLPASMVAAAQQLERQSKSLAALSLLDTSMTSLPSPPRCDGTSVVAELQHRNRHLPQQQGQPTAEGGNDVRSAEVQQNEQRRHQKQPPPAVPAKPAIRCETRDSLF

SEQ ID NO: 126488 - protein, 377 aa, Heterodera glycines
  Coding regions on vcDNA: vcDNA=SeqID_52911; Strand=+; Position=1 -47,107-424,485-902,950-1242,1293-1350
  Homolog annotation: Hit_ID=AAL78214.1; Match level="QueryCoverage =47%, HitCoverage=86%, E-value=5e-14, Identity=30%"; Hit description =putative esophageal gland cell protein Hgg-20 [Heterodera glycines]
MSDNPKEAEKEMEKAIFISADCWLEVFGLLPPSQLGLGIAMISHRFDYYVDEHFKTRKWTLGKMEIRSKIRRWRLGYLEIRGKIGENGAIEMEIVNSDGKELPIPQNPLPKKVIGFESISIDFIDQNVLTFIGHFHRLFSVCSAKLTIHASVRISEFVQFTIWPMFKDSIRLLYLSSFVLRQIRQLAPSFLCNWPSLQFVTLFCDFLPELPPDDSANTSEGQAVTKWLFSPHPDNLPKLFYVQIWEDMGQQWAAIVEQIKAEFSIASSPVSFNITVAFMPFHSLPVVVPFEMTNALTGEKLKLKTSIGTEDNEDIFELIRCSIGEGSEQQMEKALNELIDGRENNKIEISIKHGGVDDGLLDDLPSGPSGDQKQQKK

SEQ ID NO: 126489 - protein, 224 aa, Heterodera glycines
  Coding regions on vcDNA: vcDNA=SeqID_52912; Strand=-; Position=1 -57,356-637,815-906,1055-1298
MGNKSFINKIFMVFRVEIENTSTLFLLMENVFQNAKDLTLLNFDVKGVFSRQPKLVKIDQEQRLNDVVLKWYNYFGAEPPLVPKIVEPMFPEGILLDKKTHHNIAEQLKRDFEVLAKNNVNDWSIIFGVYFEQNGEHEKITESSDEIPFFKATCNQCRNHPNSATLLNSQKLRLYFGIVDIFTPFSEERKKRYIDGLKRHITVQEKDSANLMAYVKTGRRWVKS

SEQ ID NO: 126490 - protein, 162 aa, Heterodera glycines
  Coding regions on vcDNA: vcDNA=SeqID_52913; Strand=-; Position=1 -69,113-214,258-414,478-585,635-687
MLFLHIFQTILFVYLINGSPIKKKNDIFETDEHNEVKQLLEKIKIEAQKNLKKFSDEHFVKLSKQRPSPKDSDKDSILNLNHNLLDQLFEGDILLSVPQAKNILYQLEYANFGHKRTQRQANPAPDSFWSNLTIPYTFRSDYLNDSKLIDTVKNGLNHIEYV

SEQ ID NO: 126491 - protein, 133 aa, Heterodera glycines
  Coding regions on vcDNA: vcDNA=SeqID_52914; Strand=+; Position=1 -269,925-1056
PTWSFTGSTEIRSIYSGEAKVYDLKKFVFNAGTTELNYAIHLNEVCEQGWAKLGLALEAEAEGEAQFLFEAEVRSSKPKKPEVFEAEAEGCIFPETSGKIAEAEARSSKLKKPEVFEAEAVSPSPVPDPGSNL

SEQ ID NO: 126492 - protein, 81 aa, Heterodera glycines
  Coding regions on vcDNA: vcDNA=SeqID_52915; Strand=+; Position=1 -141,521-625
MDSYTTINNEPSVTGPTEEESVLSATATTAVQISSPPPLLISPNATSLCKTPFLGIFLVAIGHQFLPIPNPGPEFEQEVEN

SEQ ID NO: 126493 - protein, 94 aa, Heterodera glycines
  Coding regions on vcDNA: vcDNA=SeqID_52916; Strand=+; Position=1 -206,267-345
MVPFESVTKWQMEKLTLTKENENEWDTICIMKRSKIIGETAAVHWNDGNWDNNCNCVFFWLDSDTNCIGPLSPPPKEEDEAGQSSEKGASSADK

SEQ ID NO: 126494 - protein, 161 aa, Heterodera glycines
  Coding regions on vcDNA: vcDNA=SeqID_52917; Strand=-; Position=1 -183,236-376,1001-1162
  Homolog annotation: Hit_ID=CAE58730.1; Match level="QueryCoverage =53%, HitCoverage=5%, E-value=5e-14, Identity=39%"; Hit description =Hypothetical protein CBG01916 [Caenorhabditis briggsae]
PSCLFNGNSAFNASPPRPQAIIWLLVADAVFIFLLAIADVLIWELINPVDFLYPVFLCLSMLILRSLLHACRLHGRITSGPIFLSWFLFGICGLPELYDWVLTATHPNQYAVTDQRKEDQKTVDSQVMEVIRKHPEKKFLFGYLGSRFHLAKGMHPHKMVF

SEQ ID NO: 126495 - protein, 171 aa, Heterodera glycines
  Coding regions on vcDNA: vcDNA=SeqID_52918; Strand=+; Position=1 -46,192-418,468-710
MAPRKQNEQFLDEIQNIDDDVILVDSQSSHAEERPALKKRGRKSRWEKLLEDVNNAKKSNPAEVEVTDVDERKAANVFDYPTIFWKLARPKYGVFTFMCNECRNENFKRGDKRFILNTGSGQEKLEFTQTFCQDCAIDCTDLISSKAETALKLFESGVGTPNSSKAGLAKY

SEQ ID NO: 126496 - protein, 161 aa, Heterodera glycines
  Coding regions on vcDNA: vcDNA=SeqID_52919; Strand=+; Position=1-486
  Homolog annotation: Hit_ID=XP_309989.1; Match level="QueryCoverage =58%, HitCoverage=34%, E-value=6e-09, Identity=31%"; Hit description =ENSANGP00000015194 [Anopheles gambiae] ref|XP_319667.1| ENSANGP00000022407 [Anopheles gambiae]
MTQPAAVQPNLQQLIDVIAQQQTQINQLINVQRNNQPNPAIIQTIPSMPDVAIFEQCDEKHRITEWLERFTFAIDSCAPNAADDIKVKALMNKLSETAFSEYSKFVLPAKVTDFDFDETISKLEKLFAKPQSIFVDRFACLMATKDDGEDFHNLLTGTNDF

SEQ ID NO: 126497 - protein, 171 aa, Heterodera glycines
  Coding regions on vcDNA: vcDNA=SeqID_52920; Strand=-; Position=1 -117,377-571,671-874
MWSDSTHDGHRLPLYKDDERPDKPDNAQEGDFGNYRFNRKCRVAIEYNDIFVQQFLDKFPHISGIFRAHEPQPNGYRINEGQTHLTLHSSIRYAKPSDCASIAHISADCQKIVIITLKPKGGGGGQRQQQRTTTKEEQDEQQQGGSNGGTDGGGGGGNDVEVDFTELSKNT

SEQ ID NO: 126498 - protein, 55 aa, Heterodera glycines
  Coding regions on vcDNA: vcDNA=SeqID_52921; Strand=-; Position=1 -99,148-216
MKMMGKNEPFVIKTEANKIVFAEDNITKKQKEKAQNEIKDFLMSQKLQMEAVLYW

SEQ ID NO: 126499 - protein, 85 aa, Heterodera glycines
  Coding regions on vcDNA: vcDNA=SeqID_52922; Strand=-; Position=1 -177,233-313
MTTPKIPAEIARITVEKVLPTHFAKSRGPGRPVFELVPAKGGEILADYVLFEETMKKTKVSWLCFDKMTSQFLSFFFLHLISHPI

SEQ ID NO: 126500 - protein, 125 aa, Heterodera glycines
  Coding regions on vcDNA: vcDNA=SeqID_52923; Strand=-; Position=1 -109,673-813,863-904,956-1039
RLERGELSDDDKRGLEALKTQAEQMHINLSDLWREEAVEKLKTSYANARRSTFWEAVKTAASSARGARDPCLDQFLAALEDALGTGRPATYIVEERSERVGTGLTHTQGGSETSRTHTVSKTSAG

SEQ ID NO: 126501 - protein, 99 aa, Heterodera glycines
  Coding regions on vcDNA: vcDNA=SeqID_52924; Strand=+; Position=1 -53,864-951,1183-1341
MFSILIEKKLGYRVVPRIPEDIRAKVEHILNITIPFNEEQIRQLSENIRQKVYEAKEPEKILTETHANKTAASELQAKAEKASQRAASIHSKMMNIDKN

SEQ ID NO: 126502 - protein, 48 aa, Heterodera glycines
  Coding regions on vcDNA: vcDNA=SeqID_52925; Strand=+; Position=1-146
MPKNAFSTRAMPFFTKGSNTGRVVGAKPPILPHFWTNWVALGANTAGK

SEQ ID NO: 126503 - protein, 72 aa, Heterodera glycines
  Coding regions on vcDNA: vcDNA=SeqID_52926; Strand=+; Position=1 -130,431-519
MFGIDRDRDSVGIPTRDPSDPSCPVSSVHAVEVAKKGERMSARVPLLLCRFLGQCAKENPFFGRFFGNVSNC

SEQ ID NO: 126504 - protein, 92 aa, Heterodera glycines
  Coding regions on vcDNA: vcDNA=SeqID_52927; Strand=-; Position=1 -144,526-660
MDRRRPPNPSRFGPRLGCHGPGISVKTRDRDEPPNYSHFGSRVISALPGDAVVKKQKRRRKNIRNLWQKHQPGHFDQFMASDHFGHPQFLEP

SEQ ID NO: 126505 - protein, 49 aa, Heterodera glycines
  Coding regions on vcDNA: vcDNA=SeqID_52928; Strand=+; Position=1-257
FYANFIVPPINRNLIFSNFVANFHLLIDHFYLFNYTKGHSPSIIKTVHS

SEQ ID NO: 126506 - protein, 98 aa, Heterodera glycines
  Coding regions on vcDNA: vcDNA=SeqID_52929; Strand=-; Position=1 -164,464-520,1528-1605
SDFDCAVDRWLDDRHAEFFAFGTCHFRGDDGRECEQNNGGAWHLRWGEERGRMQLAGVGLFILFASNIWFIYKINDPSVHLATSLCLKKGHCLIIIHI

SEQ ID NO: 126507 - protein, 26 aa, Heterodera glycines
  Coding regions on vcDNA: vcDNA=SeqID_52930; Strand=+; Position=1-78
MTLNGTYLFNLSLYCSNSMREVRAVQ

SEQ ID NO: 126508 - protein, 121 aa, Heterodera glycines
  Coding regions on vcDNA: vcDNA=SeqID_52931; Strand=+; Position=1 -153,579-793
PKNIKSAILETDFVVTEFNNDSISELMNCLEKRGASKLLDNDDLKHRIERDFPKSLLKLPPDWLLLSLGQIRSQRQLKAFDYSARNFFATFDKKVIKLGKSTKKKCVTWRKKRIYAAYAKC

SEQ ID NO: 126509 - protein, 76 aa, Heterodera glycines
  Coding regions on vcDNA: vcDNA=SeqID_52932; Strand=+; Position=1 -106,457-581
MVEWYKKGEFTEEKLINYDYGLKYSREKQNSLDEVNNLQQLLTEMGYTVEEVPQNTVVISNGIKFNKDKLPKQYHN

SEQ ID NO: 126510 - protein, 298 aa, Heterodera glycines
  Coding regions on vcDNA: vcDNA=SeqID_52933; Strand=+; Position=1 -37,86-556,666-1054
MRMKCNEIQHQNDIIETGNNDLVNNLPNDLFAADNQSFDQQKFINEFLCRRENEIGKTISKLAKNILYEKAEKMRKDFCEELRKGKSIEKATQKVGKAAIKLAKELENDENIKENIQKALKNKNEKIKLDNANLNELKEELAKNYSEENMNKLKSLFYSKLHEFFASIKGSKIEFFEPHKINPSHFNGRRQKRANVRELFQGAFQRIRRHGTLIACVFYVFVASISLFIVIFLIARLVLVNPADYLAWLLMLWLFYVFLHYSNEFIKECADCLRNNNNQIHSIELAENGPAAGGANGQ

SEQ ID NO: 126511 - protein, 19 aa, Heterodera glycines
  Coding regions on vcDNA: vcDNA=SeqID_52934; Strand=+; Position=1-64
FGREILFFETKLKTYITYI

SEQ ID NO: 126512 - protein, 52 aa, Heterodera glycines
  Coding regions on vcDNA: vcDNA=SeqID_52935; Strand=+; Position=1 -46,90-202
MSLSNVHTNLVQNGKETNDPFAFSAADHPQNVGNNESSSSIEQKRVSKIVEK

SEQ ID NO: 126513 - protein, 37 aa, Heterodera glycines
  Coding regions on vcDNA: vcDNA=SeqID_52936; Strand=+; Position=1 -11,64-166
MNRRWICNDVWMDIFPSFDRAQLGLKLALLSPRFDEL

SEQ ID NO: 126514 - protein, 183 aa, Heterodera glycines
  Coding regions on vcDNA: vcDNA=SeqID_52937; Strand=+; Position=1 -18,340-426,786-900,985-1098,1221-1361,1406-1482
MMNSELQVCEKFIKMEMELKEAKHLQTIAKLEFENKALQEKLKQQEMMTDINALQAKVAKLEKEQQKEKEGKYVTVEQFNKILERISELEKQQKNEEKQRLTSKMAAENANAIVEKTDALFERVAEIEKQQQQNGITGEEQQKKLDNFIGILKDRFGNELLNAVHPKLRQNIAEVWKIKHIHN

SEQ ID NO: 126515 - protein, 42 aa, Heterodera glycines
  Coding regions on vcDNA: vcDNA=SeqID_52938; Strand=-; Position=1 -84,336-380
MQQFLLLFLLYLNGIGNLLGLVKNCAGFTQSNYTILVSYDSP

SEQ ID NO: 126516 - protein, 48 aa, Heterodera glycines
  Coding regions on vcDNA: vcDNA=SeqID_52939; Strand=+; Position=1 -55,944-1035
MGEWDSPLLLCVCVCCGGAQQILNYKIFLIQRVKFLLTVIRQIRVGTR

SEQ ID NO: 126517 - protein, 190 aa, Heterodera glycines
  Coding regions on vcDNA: vcDNA=SeqID_52940; Strand=-; Position=1 -180,370-585,636-812
  Homolog annotation: Hit_ID=EAK97409.1; Match level="QueryCoverage =70%, HitCoverage=12%, E-value=4e-15, Identity=44%"; Hit description =potential CCR4-NOT complex associated factor Caf120p [Candida albicans SC5314] gb|EAK97347.1| potential CC
MPTASGQVYANGQLGNFLPQPTEANGGPSPVYSLPLPQQQQQQQREGQAVLAEQPQQVPMFPQQQQQQVQPQQPQTVYVQQQPAQQQLQAVPAPLPPPQQQPQIVVQRPAQQSQQQQQFLLPNPQQQPQQNLVVVDAAAPAGGMPRAPLVQQPARVSSSSSSRGSYVMLRKNAIGGGNNIVGPKCRDYYP

SEQ ID NO: 126518 - protein, 119 aa, Heterodera glycines
  Coding regions on vcDNA: vcDNA=SeqID_52941; Strand=-; Position=1-360
MRTVQTARKSTGGMPPRKQTARKSAGGSGQRLQTARLPAAGGGEPILGTARRSAGGAAPRLQTARRSAGGSGQRLQTARRSAGGAAPRPQTARRSAGGSGQRLQTARKAAAGPSLRNGS

SEQ ID NO: 126519 - protein, 111 aa, Heterodera glycines
  Coding regions on vcDNA: vcDNA=SeqID_52942; Strand=-; Position=1 -96,1134-1373
MTTLNIFVKHSLIFLRPICIVRFWLSFHLQHVCIFDPTAWTEEQFGTEFMKIAFPVAKVSKFVLHIWATPYEIACHKYAKPMEMFEKDPPPSYEHRHFDGCMKVPTTKCHE

SEQ ID NO: 126520 - protein, 106 aa, Heterodera glycines
  Coding regions on vcDNA: vcDNA=SeqID_52943; Strand=-; Position=1 -199,411-532
MFARCVFRPFLKNSLAPSKTCRSFASFGVAQPSLNNNSSSNTFIDRELRFGAHNYKPLPVVLTKGKESYGNFLNICGHSCDNSMKFSETFLSNRAIQELSNDPKII

SEQ ID NO: 126521 - protein, 82 aa, Heterodera glycines
  Coding regions on vcDNA: vcDNA=SeqID_52944; Strand=-; Position=1-254
LFGLGFVCRRRMKQIEGSKAKPKLWTDLSPTRVLPKKAIFYPVIEFLYYFFDRMISRDTFIYFCPIYHPPKSIFIVSSLSLN

SEQ ID NO: 126522 - protein, 18 aa, Heterodera glycines
  Coding regions on vcDNA: vcDNA=SeqID_52945; Strand=-; Position=1 -43,145-158
MKYVLFQNSRPEICVFRQ

SEQ ID NO: 126523 - protein, 204 aa, Heterodera glycines
  Coding regions on vcDNA: vcDNA=SeqID_52946; Strand=-; Position=1 -73,130-299,464-703,784-915
SSAELALNDEKSWANYRRRLATFDVASRIAKPKEISPVVCARHGWKNVGEEFLQCDDCGKVLYIKLPGDEVSNRVLNHCIRHIQRKLVEAHTVICPWRISPGLNTSATYDITARYHQLVDSGQPELPLADNVLDEALADKFGVQSRFFLALAIFGWLPISKQATNDVEMNKPQPNFHCPLCGRHLCASVFSSDNPLDPREQHQH

SEQ ID NO: 126524 - protein, 460 aa, Heterodera glycines
  Coding regions on vcDNA: vcDNA=SeqID_52947; Strand=+; Position=1 -116,162-240,289-397,459-650,703-785,829-889,935-987,1197-1463,1764 -1868
  Homolog annotation: Hit_ID=CAE65034.1; Match level="QueryCoverage =95%, HitCoverage=56%, E-value=2e-89, Identity=42%"; Hit description =Hypothetical protein CBG09874 [Caenorhabditis briggsae]
PFIAFLFSTHSDDALPFLRISTFDNVPPTILFYTKGAKVKKPPPHFASRLTWCNNSLLALVAKVKKPPPHFASRLTWCNNSLLALVVRHSLAASHFKLVDESKKWIGYWGVRHSLAASHFKLVDESKKWIGYWGKHLKSPQYRTLKPFQKVNHFVNHFPGAFHLGRKDRLWLHIYEFMQRFEGDLFCIMPITYVLPRDARKLRLYLAGYTDRHVILKPPASARGTGISIVSRFDLVPPKAAPASARGTGISIVSRFDLVPPKAALVAQHYIERPFIINGAKFDLRIYVYLVAQHYIERPFIINGAKFDLRIYVYVTSYDVTSYDPLRVYVYDEGLVRFASVAYSSALSSYSNQFIHLTNYSINKHASDEPVPKWRLSEFWSFLEANGHNSTRLRNDINLVALKAIVSCETHIRSHGDHYSDFPFVSHELYGMDILVDANLRPWLIEMVCPIILHSFLFTS

SEQ ID NO: 126525 - protein, 173 aa, Heterodera glycines
  Coding regions on vcDNA: vcDNA=SeqID_52948; Strand=-; Position=1 -186,800-1135
MVAVRANVRLAADNCFECHQINVVAKSRGIVAIGLQKRPKFAETPFGDGLIGRMFVDGVIGENDMAIRIAGQIKSELSSVAREDISDGHNAEEVPFETLHKLVNVQPKAIFTAQMKGAGKMIDLEKRDVRNKPTKRTPLIIDRPFGTVSVSDIAVTSNASPNSQSISSIRPPI

SEQ ID NO: 126526 - protein, 94 aa, Heterodera glycines
  Coding regions on vcDNA: vcDNA=SeqID_52949; Strand=-; Position=1 -86,537-735
MDLSIECGKRRDLCLRNRKKLSYRMAPRRGGGFTKPKRPFKIAGRGVNSHLAIRRIGTVIRRKFGEIFWVEFPFCPMSNCAFGSVRQRNSQIVG

SEQ ID NO: 126527 - protein, 61 aa, Heterodera glycines
  Coding regions on vcDNA: vcDNA=SeqID_52950; Strand=-; Position=1 -29,81-242
CQLMNRLPTDFVSDLPMEVLPAFYPPPTFWMPQIEIPPLRKYEVSKKERSKMTYLSVHIRT

SEQ ID NO: 126528 - protein, 194 aa, Heterodera glycines
  Coding regions on vcDNA: vcDNA=SeqID_52951; Strand=-; Position=1 -284,334-493,538-597,643-721
  Homolog annotation: Hit_ID=CAE64771.1; Match level="QueryCoverage =92%, HitCoverage=56%, E-value=3e-32, Identity=38%"; Hit description =Hypothetical protein CBG09562 [Caenorhabditis briggsae]
MANVGMGAQVAETLVENVDIPESAVGLGKSLIFTEPRHKKDRIVRFEYFVLVIGRGGEQIQLIQQQSSCRVQMSSESNVSGFRQCTLQGARHNIDKAKQLIQEVLERSNRSAPGPQNGANAITIELSIPGPKCGLIIGKNGETIKGLQEQIGVKMMLVQESHQPTMGTKPLRVSGPPDKVENAKRIIEQLLAGE

SEQ ID NO: 126529 - protein, 90 aa, Heterodera glycines
  Coding regions on vcDNA: vcDNA=SeqID_52952; Strand=+; Position=1 -69,145-348
  Homolog annotation: Hit_ID=NP_500465.2; Match level="QueryCoverage =97%, HitCoverage=16%, E-value=1e-11, Identity=37%"; Hit description =putative nuclear protein of eukaryotic origin (4E811) [Caenorhabditis elegans]
MADPLTLLQEYTTGKRGLRELKHNGTLYYVFDDAAYPHDSKTNLSVYNKPDEFYSIESILNFWRMREMQHTAYVRDVSGKGIASITRVQR

SEQ ID NO: 126530 - protein, 133 aa, Heterodera glycines
  Coding regions on vcDNA: vcDNA=SeqID_52953; Strand=+; Position=1 -128,923-1049,1308-1454
MSTDGGDQPEVRGLSNELPAEKVAQLRTLVKKNLKNKPLDDESKRENELLLQIPKNGVTVPYRVVDNPTRLKDEEWDRVVAVFVQCACVEIVPYEKAFGPGGAAQILGNARQAHFEEQQKGMAQILAKSAHYI

SEQ ID NO: 126531 - protein, 120 aa, Heterodera glycines
  Coding regions on vcDNA: vcDNA=SeqID_52954; Strand=+; Position=1 -37,1283-1413,1457-1650
  Homolog annotation: Hit_ID=NP_505848.1; Match level="QueryCoverage =90%, HitCoverage=29%, E-value=2e-33, Identity=62%"; Hit description =putative protein, with a coiled coil domain (39.5 kD) (5L703) [Caenorhabditis elegans] emb|CAA98547.1| Hy
NRQSVLLLNNAKFATGAIKAILSTPADEQKCIREQISKAIGSEAETCLKKKVADFSGPLVIPDLEEGAFAIKEQVIDSISDYIWIHSRLAFCAERKPERAGSTSKCLKSPFLGYYQKHCQ

SEQ ID NO: 126532 - protein, 337 aa, Heterodera glycines
  Coding regions on vcDNA: vcDNA=SeqID_52955; Strand=-; Position=1 -123,170-330,395-609,660-1066,1608-1714
  Homolog annotation: Hit_ID=CAE58572.1; Match level="QueryCoverage =89%, HitCoverage=26%, E-value=1e-128, Identity=75%"; Hit description= Hypothetical protein CBG01737 [Caenorhabditis briggsae]
KIYCHHTGVEYMHLTNYEQQDWIRKHFEAPKVTELPPEQKKVLFKRLIRSTKFEDFLAKKWPSEKRFGLEGCEVLVPAIKQVIDRSSALGVDSIVLGMPHRGRLNVLSNVCRQPLSTILAQFSTLEPKDEGSGDVKYHLGVCIERLNRQSQRMIKIAVVANPSHLEAVDPVVQGKVRAEAFYSNDLHCDRHMVSLISGNCHLMCEISPKMNFCYPFPLPKKALVLHGDASFSGQGVVMETFNLNDLPHYSIYGAIHFVVNNQIGFTTDPRASRSSPYCTDVGRAMGIPIFHVNSDDPEAVMHEYVDEELKKYGAILENAHESAKQVTELRNRNWLDS

SEQ ID NO: 126533 - protein, 156 aa, Heterodera glycines
  Coding regions on vcDNA: vcDNA=SeqID_52956; Strand=+; Position=1 -259,660-800,851-918
  Homolog annotation: Hit_ID=CAE63849.1; Match level="QueryCoverage =77%, HitCoverage=68%, E-value=4e-45, Identity=56%"; Hit description =Hypothetical protein CBG08408 [Caenorhabditis briggsae]
MFEVGDKQRRIATAFEAVRNRTGGADASFASMPFPSLIAHLQNRRAKRQTEACESCCIPGHPGRAGTPGPPGQPGTPGAPGRPGAPGRPPMICEEIEIPPCNPCPPGPPGRQGPTGQPGTPGRSGPPGRPGTNGLPGPPGPPGPPGTPGPTGPDGE

SEQ ID NO: 126534 - protein, 69 aa, Heterodera glycines
  Coding regions on vcDNA: vcDNA=SeqID_52957; Strand=-; Position=1-207
GMARNAARLASLGLALGTSVLQVGDQRREWHGGKGCVGAACPVAHRFKRCGNATLLVPHLEHDVPSRTL

SEQ ID NO: 126535 - protein, 119 aa, Heterodera glycines
  Coding regions on vcDNA: vcDNA=SeqID_52958; Strand=+; Position=1 -187,368-540
MPSTLRDTNFLEPGLFLYRISGSHPLDPRQGQKGAGGSLTGEEESDYEYQQEQQDYEPGDQICVISENLAGSAYEKHSNGLHLGNVLPMLQKFFQTFLPTVRFVRCPWPLSPPLSALPT

SEQ ID NO: 126536 - protein, 89 aa, Heterodera glycines
  Coding regions on vcDNA: vcDNA=SeqID_52959; Strand=-; Position=1 -174,848-943
MSWIPISPKWKLCAPKAWSWPSPAKKPCGDCAEYQALDQSWTNFLQFIINATWRRVGSCYFALFGAVIASSSHNFRAGGADKSRREIFL

SEQ ID NO: 126537 - protein, 21 aa, Heterodera glycines
  Coding regions on vcDNA: vcDNA=SeqID_52960; Strand=+; Position=1-64
VDGVAGGRTTASAFLNFVGHL

SEQ ID NO: 126538 - protein, 29 aa, Heterodera glycines
  Coding regions on vcDNA: vcDNA=SeqID_52961; Strand=+; Position=1-87
MVEIHPFCNIGVLRKTDDKSLMNGQLALK

SEQ ID NO: 126539 - protein, 49 aa, Heterodera glycines
  Coding regions on vcDNA: vcDNA=SeqID_52962; Strand=-; Position=1 -73,131-206
VHVIQEEQATANLMCWSLILEGARNTLYDSEIFQLQFRFDDQYPFSSPE

SEQ ID NO: 126540 - protein, 47 aa, Heterodera glycines
  Coding regions on vcDNA: vcDNA=SeqID_52963; Strand=+; Position=1 -20,119-242
MTNIRENCSFITPKILLNLISLLTILIAVFLPHELRRTRPTRRSPSD

SEQ ID NO: 126541 - protein, 132 aa, Heterodera glycines
  Coding regions on vcDNA: vcDNA=SeqID_52964; Strand=+; Position=1 -148,441-691
MFVGHVLSVFRIPFSFIFICILTPVFEHRFTVFMVISMFVPQVPLNLVIKHNDQFLPIAPENLACREATNGSGFNCELSVNQMVVDDDCRDVSIWARMDNDTSTLQLLGEQVKKKKKLKQFRENWIRVTLEN

SEQ ID NO: 126542 - protein, 45 aa, Heterodera glycines; identical to SEQ ID NO: 124527
  Coding regions on vcDNA: vcDNA=SeqID_52965; Strand=+; Position=1-138

SEQ ID NO: 126543 - protein, 443 aa, Heterodera glycines
  Coding regions on vcDNA: vcDNA=SeqID_52966; Strand=-; Position=1 -100,398-531,561-722,774-1709
  Homolog annotation: Hit_ID=AAC95573.1; Match level="QueryCoverage =69%, HitCoverage=49%, E-value=3e-58, Identity=36%"; Hit description =orf 48 [Ateline herpesvirus 3] pir||T42963 hypothetical protein 48 - ateline herpesvirus 3 (strain 73) ref
MNDNVLSLLAFALVVFLFRQKSNSVLAFDLEEHENRRIVTRFQARKFISLLLRHISPTFSFYNLIPPDSVKSINWQFKALIQLAKDSGGIIVGPFLREMHSIKGQIGEALIAFLTKMSARSTKLFAENEGTKEERNSARNLIKVGIIFSMAKIIGEKLHDYEINWAKEILETQQKRGKMRGENYQNKEEDQKEEEEEEKEREKEDREKEKEEEKEEEEKEREKEDREKEKEEEKEEEEKEREKEDIEKEKEEEKEEEEKEREKEDREKEKEEEKEEEEKEREKEDREKEKEEEKEEEEKEREKEDREKEKEEEKEEEEKEREKEDIEKEKEEEKEEEEKEREKEDREKEKEEEKEEEEKEREKEDREKEKEEEKEEEEKEREKEDTQNEHEEQREQHQQQQQVGHGHGQAAESVETRHGQFEMSAEERECLSFFGMTFDFLTL

SEQ ID NO: 126544 - protein, 159 aa, Heterodera glycines
  Coding regions on vcDNA: vcDNA=SeqID_52967; Strand=-; Position=1 -21,137-310,345-469,727-886
  Homolog annotation: Hit_ID=XP_341944.1; Match level="QueryCoverage =95%, HitCoverage=63%, E-value=2e-14, Identity=35%"; Hit description =similar to BUB3 budding uninhibited by benzimidazoles 3 homolog; mitotic checkpoint component; BUB3 (budd
MGQHTDGLWDIRALMPVGAMECGDKVYALDVVDNRAVVGTKDRRVIVWDVRNMKAPLQTRESPLKAFSSKPVLSNVSPLAKRLFCLQLKAAWLLNTSTRTRKYRKERFPSSVVSLSFSPDGGMLAIASTYMYEEERDPNPIPESSLTIRRMTELEVRPK

SEQ ID NO: 126545 - protein, 302 aa, Heterodera glycines
  Coding regions on vcDNA: vcDNA=SeqID_52968; Strand=+; Position=1 -69,456-844,1034-1216,1340-1448,1497-1655
  Homolog annotation: Hit_ID=NP_492557.1; Match level="QueryCoverage =55%, HitCoverage=23%, E-value=5e-13, Identity=32%"; Hit description =complex locus; 3' and 5' of different mRNAs overlap; the locus encodes successively a product with simila
MEKIAASRNPQLAASLSTQPSNSPKLGLSGTTRKRRSDASTAAGGTTPRSTAPSAKKPRTATRRKRSKRGRRAASDEDDDDEEEIEVEEEEEAEKEDDVQQQGEQGDQSLRMEVDGEGSTSGRGRKRGTTPKAPADAGVPKTPERGSLRRTAGLDSSRKSEQKQKEELLYQVPELSPAEQLGVDCPRDAHLFMGVGARVLALWGNDYYSANICGREALGRYYVHFVEDNLNRMLPPTGVIPISALKPGTKISFIDIVNDEEIGKVCEVVEQPPTDDAGGWARGEFKLCELDEEGNRTDVIKT

SEQ ID NO: 126546 - protein, 40 aa, Heterodera glycines
  Coding regions on vcDNA: vcDNA=SeqID_52969; Strand=-; Position=1-181
FYRFLNVWIFFGLPKLHRTWFFLFSFKSPQIFFYSLTRPY

SEQ ID NO: 126547 - protein, 34 aa, Heterodera glycines
  Coding regions on vcDNA: vcDNA=SeqID_52970; Strand=-; Position=1 -33,247-318
MRQDICALQTKEKIAVLDNTMKLASVKIQDVVKK

SEQ ID NO: 126548 - protein, 202 aa, Heterodera glycines
  misc_feature (71)..(71): Xaa can be any naturally occurring amino acid
  Coding regions on vcDNA: vcDNA=SeqID_52971; Strand=-; Position=1 -62,117-296,702-885,1060-1192
  Homolog annotation: Hit_ID=AAH61207.1; Match level="QueryCoverage =99%, HitCoverage=50%, E-value=5e-43, Identity=50%"; Hit description =Gmppb-pending protein [Mus musculus] ref|NP_808578.1| GDP-mannose pyrophosphorylase B [Mus musculus] dbj|B
HLNPSVLQLIPRQPCSIEKEIFPKMCSVSNLYAFILVIFPKMCSVSNLYAFILVGFWMDVGQPKDFLRGTXFQSFFAIIFRTFFGVRLYLAHQQQQKVMIDPSASIGANCIIGPNVCIGAAVRLLDGVCIRDSTILSGTVIRRSTLIHSSIVGRKCVIGSHVHMVNTSVLGEDVVIKDELYLSGARVLPHKSIGESVPEPAI

SEQ ID NO: 126549 - protein, 138 aa, Heterodera glycines
  Coding regions on vcDNA: vcDNA=SeqID_52972; Strand=+; Position=1-417
  Homolog annotation: Hit_ID=NP_032158.1; Match level="QueryCoverage =89%, HitCoverage=76%, E-value=1e-41, Identity=69%"; Hit description =glutamine repeat protein 1 [Mus musculus] gb|AAC52934.1| glutamine repeat protein-1
MAVLKKVVNDPFYDKARAFWRSWNRRHQQQQHPQHQQQQHPQHQQQQHPQHQQQQHPQHQQQQHPQHQQQQHPQHQQQQHPQHQQQQHPQHQQQQHPQHQQQQHPQHQQQQHPQHQQQQHPQHQQQQHPQHQQQRQEQ

SEQ ID NO: 126550 - protein, 232 aa, Heterodera glycines
  Coding regions on vcDNA: vcDNA=SeqID_52973; Strand=+; Position=1 -229,1128-1439,1924-2081
MAQQRKPTLEPMAPTGTAHHSPIGTTLLDQPATWALMSGTIRPQCHPLGRHFTRAAADWRLVKGPTERRTKSAVSFSSATPVKPALLDEYKFLPTLRVDPPAFPAQAAPPTSVLASPTISAKPTTPAASAPTTSAKMITSTKPTTSAPSDSPSTSGKSSTSAAPKDMASSMSAPIIAEATALDRIICVMLLANWTVNLPFESVRCVQMKCDLSITFVYHVIAVLLFPLFLPP

SEQ ID NO: 126551 - protein, 160 aa, Heterodera glycines
  Coding regions on vcDNA: vcDNA=SeqID_52974; Strand=+; Position=1 -90,1982-2081,2541-2833
MPVPSKAAADECRPPSPENIPLPTQFRSFVVACSVDSEKLAFRGQATTAIGAAYWHPMFFKETRRSRSAVQAHLKCASCGKEVNKVYEGTDDAGGGSRSAFGHYTDTEKRTELSGLGGVAYADIERAFAVGGMRSGHRRNAEDLVRCLRDYAKEKEEAAL

SEQ ID NO: 126552 - protein, 26 aa, Heterodera glycines
  Coding regions on vcDNA: vcDNA=SeqID_52975; Strand=+; Position=1 -34,1919-1965
MFSDFDGTAVYVKQGLLCGNLQIFVP

SEQ ID NO: 126553 - protein, 161 aa, Heterodera glycines
  Coding regions on vcDNA: vcDNA=SeqID_52976; Strand=-; Position=1-486
MFVSNSVFLPVSRFCHCRALSAVNVVVHPFVARKCAFLSTPSLSFPFRRQYSSLASATTTGASNDKLNVDKLFEKINFEVRGHDFTVLKSYSLFVMVSEDNVYGKGSNALYESNQLTILGFYTITLFMFEQTLSFWYHSKAQNNEAKIYKIAAFRQLPKKI

SEQ ID NO: 126554 - protein, 96 aa, Heterodera glycines
  Coding regions on vcDNA: vcDNA=SeqID_52977; Strand=-; Position=1-288
MFVSNSVFLPVSRFCHCRALSAVNVVVHPFVARKCAFLSTPSLSFPFRRQYSSLASATTTGASNDKLNVDKLFEKINFEVRGHDFTVLKSYSLFVM

SEQ ID NO: 126555 - protein, 16 aa, Heterodera glycines
  Coding regions on vcDNA: vcDNA=SeqID_52978; Strand=-; Position=1-49
EAIPEGFGLPINLGAS

SEQ ID NO: 126556 - protein, 55 aa, Heterodera glycines
  Coding regions on vcDNA: vcDNA=SeqID_52979; Strand=+; Position=1-204
FEYPKRTLEKIDFFVFGAVPPNRCAQIYGETESFGNSFPIACTLILRWIFAPHNV

SEQ ID NO: 126557 - protein, 39 aa, Heterodera glycines
  Coding regions on vcDNA: vcDNA=SeqID_52980; Strand=-; Position=1-119
MRLPATDKQGHTIICAGAGYPSPTAACPSGYRCTMLAHM

SEQ ID NO: 126558 - protein, 216 aa, Heterodera glycines
  Coding regions on vcDNA: vcDNA=SeqID_52981; Strand=-; Position=1-651
MAPVLDLDPITAALAEQERQRTLVFIGLPESNAIRPSERVQDDREATTKILDHLEVEAGPTAIFRVGRFDSQRTTPRPLKVVMPTSAHQHIALGGWKRERVRLRSQKNLARLFVRPALTKEQLKEEYEARVRKRQQDPVPVAPPMQPAQTKDPTPVNENGPEPKEASHGRGPEPKEASEDTSKPSQVDKAIQNEIDRALLQIQSLQNELTHLVKRK

SEQ ID NO: 126559 - protein, 133 aa, Heterodera glycines
  Coding regions on vcDNA: vcDNA=SeqID_52982; Strand=-; Position=1 -33,128-264,313-457,512-597
MASINTSSNDPLYLAYRFAGPSADLIVPAVALYLVVLVGIVLNGTVLAVTVKSRQMPSLRGSANFLMALICLCELVHQIGHTFFVVVVILGTNFVSLLTADLIMTPMIFALNCGLMAMFCAAFDRLFAVVSPF

SEQ ID NO: 126560 - protein, 57 aa, Heterodera glycines
  Coding regions on vcDNA: vcDNA=SeqID_52983; Strand=-; Position=1 -70,196-299
MGGCCACLREILLEDEAADIRINVVEPTTVAKERDGTSNVAHGGQMYGTQLDVPKTD

SEQ ID NO: 126561 - protein, 71 aa, Heterodera glycines
  Coding regions on vcDNA: vcDNA=SeqID_52984; Strand=-; Position=1-216
MWRRARNNTVGALGTGKAEGGGKEAQHEDEGGTTANRQTFYWALEHFIHIFPLLKSYVIDSYFPISFTIFF

SEQ ID NO: 126562 - protein, 446 aa, Heterodera glycines
  Coding regions on vcDNA: vcDNA=SeqID_52985; Strand=+; Position=1 -143,324-380,444-471,523-903,950-1057,1188-1451,1501-1689,1970-2137
  Homolog annotation: Hit_ID=NP_497817.2; Match level="QueryCoverage =96%, HitCoverage=42%, E-value=1e-128, Identity=57%"; Hit description= UNCoordinated locomotion UNC-79, putative cytoplasmic protein of bilaterial origin (97.8 kD) (unc-79) [C
MPGQNASNSCQTQQNLAAEVSSSVLVMSRVKRVQNFASIKGAAQLVESFAKWLVEMLHRCPVELRDMLLVCTACNRGMIRERDKQIMTRAIVGELVAALKFKCELVEPNHLAIVRLVLQDFGEPLDSDWTASQCGQTVETTEGNGLKEEGRSTTDGAELIGGTGGGNGSGGDQFNTGAAEAIRPHVPELLEFIADLHVLAKMKKQTLSSSDRMGGDLKAGLAELIALEMSRPSVRDSRTVMRFIPWLYSPPSLSQALPGAFAESVANVRVLSWILLGTLHARGNGTVNAICSSVSGPNQCLPVPIACSGQMADYIHFVLAGFADQSKQSVVHMSALFHAFHLCQLWTIYCEQTAATCRSEETLQRTMQQILDFWARVTPAILQLLSHSKVLADMVNLHFVNTLQALQQVNSAVLCQLYPMWEPVLTAHHAHIPRQLRMKLDAVEAQ

SEQ ID NO: 126563 - protein, 148 aa, Heterodera glycines
  Coding regions on vcDNA: vcDNA=SeqID_52986; Strand=+; Position=1-447
MDNYTGRPWFNGGLTVPRFAPEEWSVHQRTLDGGDRTNNYAEAFHRKLQQAFDCTHPSVFHFINTIRCEQKSIDADISRCVAGELPPLKKPKYRAADARILRLLQGYNTINNNPANQNDHNYHANVNVNPDNINHLLVGVSRNYEMRP

SEQ ID NO: 126564 - protein, 306 aa, Heterodera glycines
  Coding regions on vcDNA: vcDNA=SeqID_52987; Strand=-; Position=1 -60,196-301,364-410,522-630,659-795,849-915,985-1035,1082-1205,1251 -1314
  Homolog annotation: Hit_ID=NP_497044.2; Match level="QueryCoverage =91%, HitCoverage=26%, E-value=3e-66, Identity=46%"; Hit description =perlecan, basement membrane heparan sulfate proteoglycan, UNCoordinated locomotion UNC-52 (unc-52) [Caeno
TTSETVQTTTSAPTPDPTTICDDGTCGTHGECEEVNGTHVMCECRDYYVGQRCEEFRPIEYAAKFRPIEYAAKFDGSAFVVFSSDEFPHLSSEQEEVVEFKVRTTATYGLIIWQGQQDDEWTGEDYLDDEWTGEDYLSIGLLDGHLSFSFELGGGAAQILSESPVDDGKTHSIRAIRRGRIRAIRRGRDGWLFVDDVAPTSGRSSSSGILAMLNVEGHVFVGGVPDLHEMTGVPDLHEMTFGLHTQNFVGCLAELKLNGQKMDMMANAIDGRNVRPCRSWQPNRMNVRPCRSWQPNRMRRRRKWMR

SEQ ID NO: 126565 - protein, 78 aa, Heterodera glycines
  Coding regions on vcDNA: vcDNA=SeqID_52988; Strand=-; Position=1 -106,484-614
MARGKFALPPFQRHNGDGSAIGESNASGRVESGASKTIKSRDKVPLNEPTTIRVQNDGQGKGGQIKRRAMGVAICFWH

SEQ ID NO: 126566 - protein, 420 aa, Heterodera glycines
  Coding regions on vcDNA: vcDNA=SeqID_52989; Strand=-; Position=1 -101,223-406,1169-1375,1633-1777,1834-1931,1981-2132,2186-2436,2976 -2998
  Homolog annotation: Hit_ID=CAE65897.1; Match level="QueryCoverage =100%, HitCoverage=49%, E-value=6e-92, Identity=35%"; Hit description= Hypothetical protein CBG11064 [Caenorhabditis briggsae]
VERVEWKRAGGDALPSDASDEEHRGVLRFDPFKADHAGEYECNAYRNEEVIATSKVEVHPEGDTRPDLLHVDISPPQVRMVNAGDSIVLDCVVHGSADEFTYSWSLARGGALIRELGRQSQLLVKSADPSNDYGIYRCEVESEDGETVGQAQAAVSVGFDSENNAVEAKFDGDSQAVLNCPVFVVPGSTVDWQRENGESLPENSNQSGDKLLIEKFDDSTAGIYRCIEKFDDSTAGIYRCTVHHGQSSVSGFVNAKIFVPDTIPDTIIKVLLNVSSESVQVGDQAWLDCVVIGDPSARVNFSKDGDALPANAQVTANRLLFTSISVEHTVTANRLLFTSISVEHTGRYRCQAQTKDGVLETSALLNVEGGKRRRRKSGGAASINRSSSKRRNRRRRMEHRRKKKRKRKRRGRTRLFGSWF

SEQ ID NO: 126567 - protein, 465 aa, Heterodera glycines
  Coding regions on vcDNA: vcDNA=SeqID_52990; Strand=-; Position=1 -454,515-762,867-1041,1485-1594,1908-2098,2165-2384
  Homolog annotation: Hit_ID=NP_497045.1; Match level="QueryCoverage =90%, HitCoverage=32%, E-value=6e-92, Identity=31%"; Hit description =basement membrane proteoglycan (2O938) [Caenorhabditis elegans] emb|CAB07707.1| Hypothetical protein ZC10
MPAIIFAQPMTRTTTRAKNGRSTRRQSGSVPNNYLSDLFLYDVAPQLDVRRPSPPPPARARNPPQVEPPYQRVDLGQPARFRCWVPGEPNAHLSWAPARGGSLPSGAVDRSGHLLFDAVAREHADSYICSSIDPETGQVLQSPPVRLDVNEPSKRPLVEPTEQTVQQGHPSRIHCWVPDEPRATLRWTARGGRPLPSGAVDDGRGNLNIAQTLPHHQGDYECIYEPREPSRGPQVSEPARIYVSPPPVGPLARKPGEPPRPVATPPQQTVPRGDPARFHCEPNSKTPAQIHWEEEPPTARVEPKVWNGQPGESKQFKCYVTGNPHPSIKTCTATNPLGEASDSGKVEIGPSIGINIIKEEKPAPARLKMIVGEPLEIKCEAEGEPDPDVEWLHDPGPERGDLPDDYVPITISEQFLRHPSIGLGNSGCYTCRASNDFASVTKGICIEGTDRVQLSFQITVIIARK

SEQ ID NO: 126568 - protein, 207 aa, Heterodera glycines
  Coding regions on vcDNA: vcDNA=SeqID_52991; Strand=+; Position=1 -475,1064-1212
MSINGSGLSAFQRIWHGFLSKKKKVSRAEVMSLAEQIASEVNDNELFDEITALNEILESISDEKFGEMNAEQKWMKVFEAELPNLVLLVSKILSISVSNACVERVFSLCSAQWTDVRNLLKVETVKSLAQIKSNYDLTCTEIYDLLISSPKLLKMIMGDFLHICHFLSNIFQFEYLLGKIFDYALKLNPNLNGCANGSTAGRGSVLI

SEQ ID NO: 126569 - protein, 70 aa, Heterodera glycines
  Coding regions on vcDNA: vcDNA=SeqID_52992; Strand=-; Position=1 -66,264-339,393-462
  Homolog annotation: Hit_ID=CAE72822.1; Match level="QueryCoverage =98%, HitCoverage=75%, E-value=1e-18, Identity=61%"; Hit description =Hypothetical protein CBG20103 [Caenorhabditis briggsae]
MVEELSNKVSQLKRVTIAIGDDDTKFDSTRGLLGSTMKKLGIVSKAGGKNVLCYLVLFSFFVFLIIYFLM

SEQ ID NO: 126570 - protein, 32 aa, Heterodera glycines; identical to SEQ ID NO: 125422
  Coding regions on vcDNA: vcDNA=SeqID_52993; Strand=+; Position=1-100

SEQ ID NO: 126571 - protein, 25 aa, Heterodera glycines
  Coding regions on vcDNA: vcDNA=SeqID_52994; Strand=-; Position=1-84
NDGSQNENPISAELIANQLIRLIST

SEQ ID NO: 126572 - protein, 72 aa, Heterodera glycines
  Coding regions on vcDNA: vcDNA=SeqID_52995; Strand=+; Position=1 -183,743-778
MAINPDDFGKTIGTDPESGSRPNPDQIPMILEKRSERIPSRDPDQMAINHIIILNFPLKKILIFQMVSFFFL

SEQ ID NO: 126573 - protein, 124 aa, Heterodera glycines
  misc_feature (5)..(5): Xaa can be any naturally occurring amino acid
  misc_feature (102)..(102): Xaa can be any naturally occurring amino acid
  Coding regions on vcDNA: vcDNA=SeqID_52996; Strand=+; Position=1 -42,401-483,584-638,690-891
  Homolog annotation: Hit_ID=NP_505989.1; Match level="QueryCoverage =75%, HitCoverage=12%, E-value=3e-27, Identity=61%"; Hit description =prestin family member (84.4 kD) (5M359) [Caenorhabditis elegans] emb|CAB04606.1| Hypothetical protein K12
FFFIXENPLSVISSSILFGHFIIDCSGFTFVDCMGVNALKEIFTEMREQRVLVYFAAAKAPVRPVRDLFEKCGFFRYVQKHNFYPTIRDAVAIARKRQINKXLKCEIMVKEGEGSLKIMKHSTN

SEQ ID NO: 126574 - protein, 23 aa, Heterodera glycines
  Coding regions on vcDNA: vcDNA=SeqID_52997; Strand=+; Position=1-69
MTSALPIHQWTIRKEANNYLMAK

SEQ ID NO: 126575 - protein, 38 aa, Heterodera glycines
  Coding regions on vcDNA: vcDNA=SeqID_52998; Strand=-; Position=1-114
MLDETMKVAELMCIKTALNEFIAYQRLAQMVANGTLNG

SEQ ID NO: 126576 - protein, 281 aa, Heterodera glycines
  Coding regions on vcDNA: vcDNA=SeqID_52999; Strand=-; Position=1 -81,546-634,688-730,1174-1276,1333-1859
  Homolog annotation: Hit_ID=CAE71158.1; Match level="QueryCoverage =60%, HitCoverage=72%, E-value=2e-19, Identity=33%"; Hit description =Hypothetical protein CBG18014 [Caenorhabditis briggsae]
MPVIKHDPELKSVDQTVAKFNTTAIQTGGEHVMREVMFLCEMIEQNGEGTPPDCYMKFGPLFYMYSRISETIDFEGEMLYQRQDDHKKIRLLMSSEEINQSIEYTGDPVNIIKFNNGKMVPPPAPRAQLMPNAPPPPVFSLSLAKTKGGKLPEGKTDDQINEQTMPMAKMAASISKQATVPPAVPRKPVAPTEDKTAPKTMPNSTPKTMPNSQKMPKSETTPKEMPKSETAPKEMPKSETAPKEMPKNETAPKEMNEAIKSKTNKTTPPGTKKGNKSVAPP

SEQ ID NO: 126577 - protein, 196 aa, Heterodera glycines
  Coding regions on vcDNA: vcDNA=SeqID_53000; Strand=-; Position=1 -253,304-606,653-687
  Homolog annotation: Hit_ID=CAE71397.1; Match level="QueryCoverage =96%, HitCoverage=15%, E-value=1e-60, Identity=68%"; Hit description =Hypothetical protein CBG18305 [Caenorhabditis briggsae]
IVEYLQSHGEITAMTGDGVNDAPALKKAEIGIAMGSGTAVAKSAAEMVLADDNFSTIVAAVEEGRAIYNNMKQLYGWEGKNLKLAFAISSRQTLVKSSPFSLSLRLVCHFHSLFCRVLTDCEHASGIPEALIPVQLLWVNLVTDGLPATALGFNPPDLDIMDRLPRSASESLISKWLFFRYMAIGTSVGVDYGYHL

SEQ ID NO: 126578 - protein, 138 aa, Heterodera glycines
  Coding regions on vcDNA: vcDNA=SeqID_53001; Strand=-; Position=1 -186,318-548
MSAPLPIIIFHTISVDIRSAPGPIITRLPSKALTAQNISTFLRILAPIVHKKTHADHIYDEKQSLDPKSLVQTNKTTTQTIRTLKEARAITLWGEKSQAGSVKVGWIKSIWVGLGIYDLPLDPDSSCVQGSGCIAQGR

SEQ ID NO: 126579 - protein, 307 aa, Heterodera glycines
  Coding regions on vcDNA: vcDNA=SeqID_53002; Strand=-; Position=1 -32,83-203,249-403,543-703,749-838,896-982,1118-1224
  Homolog annotation: Hit_ID=CAE66984.1; Match level="QueryCoverage =89%, HitCoverage=21%, E-value=6e-77, Identity=53%"; Hit description =Hypothetical protein CBG12380 [Caenorhabditis briggsae]
GLYTRLFDFLVASVNCALNVDANRNSFDISLAFLVASVNCALNVDANRNSFDISLAVLDIYGFEVFERNGFEQFCINFVNEINFVNEKLQQIFIELTLKAEQEEYQSEGLKWTPIEFFNNKIVCELIEAKRPQGIMFLLDDTSLQLHGQNEGADKKFLSDLKKQHEDHEHFRSGADSFVVRHYAGEVVYQIEGFCDRNMDILHVDVVYQIEGFCDRNMDILHVDLVQLMQNSEKCFMRQLFAADCFMRQLFAADCVSSNNKKPTSASTKIRSQANHLMDSLMRCVPHYVRCIKPNERKRALEFNEQR

SEQ ID NO: 126580 - protein, 135 aa, Heterodera glycines
  Coding regions on vcDNA: vcDNA=SeqID_53003; Strand=-; Position=1-408
MCDECRGENFRQGKSSFKLINQNGEQQQRLVFAQSFCQDCAKLNFDCTDLIMKHKKKDESATTTMAKSFRWTKDEENEPSWHTTYKDFFENFILVDQMTNFFFVILPSNTPGFVGNKTNKFKVHLTKKLVFDRAG

SEQ ID NO: 126581 - protein, 167 aa, Heterodera glycines
  Coding regions on vcDNA: vcDNA=SeqID_53004; Strand=+; Position=1 -388,440-555
MVLPLTAALSKLLSCKPENLAEYLNNPEAVNKANAYLCGKKLKTTYQGRDCKTKDVKFGTFSLKPAAETYAFEGFLGKFPKILFRSNTMRSDVKVQQYFYIKHRIRLLYPQLKCIVEYHNKGHCKYYPLELLAIEEGCESAPIEKPAAETDYLDYLNFRSGWQSALY

SEQ ID NO: 126582 - protein, 38 aa, Heterodera glycines
  Coding regions on vcDNA: vcDNA=SeqID_53005; Strand=+; Position=1 -34,131-213
MYGLWLSDNATGACICLYNPDLDMNLLSEEEHDPEIIP

SEQ ID NO: 126583 - protein, 29 aa, Heterodera glycines
  Coding regions on vcDNA: vcDNA=SeqID_53006; Strand=+; Position=1 -48,217-258
MFCYRKSRKIVMEFFWDMAFMYSILQIDA

SEQ ID NO: 126584 - protein, 114 aa, Heterodera glycines
  Coding regions on vcDNA: vcDNA=SeqID_53007; Strand=-; Position=1 -44,536-703,1035-1132,1463-1496
  Homolog annotation: Hit_ID=NP_494886.1; Match level="QueryCoverage =100%, HitCoverage=19%, E-value=8e-37, Identity=64%"; Hit description= phosphoglucomutase (61.8 kD) (2F181) [Caenorhabditis elegans] gb|AAA83163.1| Hypothetical protein R05F9.
TQIFRKTAKIGSFFKIRALLTGGMTDGRPFRLLVDSMHGVTGPYVSTIFVDRLGAPAQSCLRIVPKPDFGGGHPDPNLTYAKGLVDQMALGEHDIGAAFDGDGDRNMIIGRNAF

SEQ ID NO: 126585 - protein, 105 aa, Heterodera glycines
  Coding regions on vcDNA: vcDNA=SeqID_53008; Strand=+; Position=1 -45,313-461,530-653
  Homolog annotation: Hit_ID=NP_741442.1; Match level="QueryCoverage =91%, HitCoverage=5%, E-value=1e-40, Identity=77%"; Hit description =voltage-gated Calcium Channel Alpha subunit, putative L-type calcium channel alpha 1 subunit, EGg Laying d
MQVFGGRFNYNPMQQKPRANFDTFIQSLLTVFQVLTGEDWNTVMYNGIESYGGIGSLGMLVSVYFIVLFICGNYILLNVFLAICVDNLAEADQASDQSGNGLLNG

SEQ ID NO: 126586 - protein, 78 aa, Heterodera glycines
  Coding regions on vcDNA: vcDNA=SeqID_53009; Strand=+; Position=1 -177,285-344
MNAKPEEEEDEMEVEGEYEDDDKYDHGEEEDEADEGDADDDDEIEGEPEEVVVGARPRRMRITDWINASSIDKDHQSG

SEQ ID NO: 126587 - protein, 68 aa, Heterodera glycines
  Coding regions on vcDNA: vcDNA=SeqID_53010; Strand=-; Position=1 -55,444-595
MDFFEAHKAFQKLSNQLGTSENLFQQIASSPMGYVKDEEEEEEEEEDEERSNSGQNQAMGEPEDLSLK

SEQ ID NO: 126588 - protein, 188 aa, Heterodera glycines
  Coding regions on vcDNA: vcDNA=SeqID_53011; Strand=+; Position=1 -161,221-398,454-636,690-733
MSISYRQLLFIAAFLFIGCHAHAGVDHTHLASFTCATAKDGEINGFRAVDDGLLIGSDATNATGAMILFGFQTNKKEDLYFKVFVPTSSSCLSSVNNFVVSGRFCELGALETETESANCPDGGGAGNGCNSRSVTCQIKTVKEVAELPDGRVFKVNLGNLTQVTALCTKWKAYFTNVRQVMESGGGGE

SEQ ID NO: 126589 - protein, 67 aa, Heterodera glycines
  Coding regions on vcDNA: vcDNA=SeqID_53012; Strand=+; Position=1 -186,1022-1039
MANNPSVELLHELAFMDNSKLQFLLSLGTGVAPTVELATTESTFPTATIEGLGNTYRILMSQGKNYE

SEQ ID NO: 126590 - protein, 157 aa, Heterodera glycines
  misc_feature (7)..(7): Xaa can be any naturally occurring amino acid
  Coding regions on vcDNA: vcDNA=SeqID_53013; Strand=-; Position=1 -201,461-545,618-740,849-874
  Homolog annotation: Hit_ID=XP_313537.1; Match level="QueryCoverage =97%, HitCoverage=16%, E-value=9e-36, Identity=49%"; Hit description =ENSANGP00000018921 [Anopheles gambiae]
APFYLNXIWHKFGQVEPTRRRLMPTTLGIALVHGYQRVDPDLILPTMRANVERQLDLIAKGKADYQTIKNQTLEIFRQKFLNFVQNINLVDALFGDSFTSLADSGKPFSFTSLADSGKPFSKCGKCRRYMKLVETRPQRLYCPICDVNYNLWVQIIL

SEQ ID NO: 126591 - protein, 44 aa, Heterodera glycines
  Coding regions on vcDNA: vcDNA=SeqID_53014; Strand=+; Position=1 -45,128-217
MKKLSICQSLRCPGRLCNHTSPGTGRLSFPGSSPPGRINPPADR

SEQ ID NO: 126592 - protein, 178 aa, Heterodera glycines
  misc_feature (167)..(167): Xaa can be any naturally occurring amino acid
  Coding regions on vcDNA: vcDNA=SeqID_53015; Strand=-; Position=1 -92,906-1354
  Homolog annotation: Hit_ID=AAP92584.1; Match level="QueryCoverage =80%, HitCoverage=28%, E-value=1e-35, Identity=58%"; Hit description =Ab2-057 [Rattus norvegicus] gb|AAP85373.1| Aa1262 [Rattus norvegicus] gb|AAP85367.1| Aa1011 [Rattus norveg
GSTPEKGPEKWPLRLRMAAGAQITHSQREEAWPFLVRGAICLVYSDNERDSSLLNSWLIASGHNFLEGFSVFSRTKLSNNRSVMPLDVRGCTRATLAKSACLPSPKGVGKPVKICRDWDRTLQLLSVNEEFLVGASHQLALNTSLPFVHTARRCPGLSHFEKFGDGXCSGRSVCRLEP

SEQ ID NO: 126593 - protein, 219 aa, Heterodera glycines
  misc_feature (184)..(184): Xaa can be any naturally occurring amino acid
  misc_feature (206)..(206): Xaa can be any naturally occurring amino acid
  misc_feature (213)..(213): Xaa can be any naturally occurring amino acid
  Coding regions on vcDNA: vcDNA=SeqID_53016; Strand=+; Position=1 -192,970-1156,1644-1800,2084-2208
  Homolog annotation: Hit_ID=NP_491556.1; Match level="QueryCoverage =99%, HitCoverage=50%, E-value=5e-37, Identity=38%"; Hit description =human neuronal Ceroid LipofusciNosis related, Batten, Spielmeyer -Vogt disease related protein (48.0 kD) (
VSDVVSSWSSGTGGAGIFGALAFAVLTDRRLLALQPQNALLAMLVVPLLLMWTFWRLLHFPSSANTVHHSLPSSLLPFSTAVATDAFDDYGTANADAITEPLLNTTTTTNNSSSGNALTTTTVILPPLLKYMVPLCVVYFSEYFINQGLLELLVFDCAHSFALSPTSQYRWFQVLYQANRLLSXVFSRSVSLNSIKIKNYSLLVYXRGLYVVXIINDFF

SEQ ID NO: 126594 - protein, 178 aa, Heterodera glycines
  Coding regions on vcDNA: vcDNA=SeqID_53017; Strand=-; Position=1 -280,368-624
MAALAIKRGNEKILELRDTEKSDEKNPTEPINNMDCPSSSGIGLRCTDTLAWARVKPESDEYQKRQKRDKNSDDQLRMIIFQRMGECAMAVRLVPKVEKLEYFSSSNSELYSPNPNEESGTIYNIIKSVRNEIKAIDVDFNVYDDESDDNIYQRFFPHQIGPDVENLDLVDEACAQIQ

SEQ ID NO: 126595 - protein, 33 aa, Heterodera glycines
  Coding regions on vcDNA: vcDNA=SeqID_53018; Strand=-; Position=1 -81,173-193
MVAKQTGTCKNLIMVAKQTDKILKQINSSVKTS

SEQ ID NO: 126596 - protein, 23 aa, Heterodera glycines
  Coding regions on vcDNA: vcDNA=SeqID_53019; Strand=-; Position=1-97
KPKLFGLFKKELKIFKNFIHLPF

SEQ ID NO: 126597 - protein, 80 aa, Heterodera glycines
  Coding regions on vcDNA: vcDNA=SeqID_53020; Strand=-; Position=1 -55,690-877
MHRHSPIVWPSAVVVAAADFVDRQKAAFAPSEAEMSQDEDPYAVSSDSEDEKGPPPKIAIERETDISQIVRQQSNNYLIN

SEQ ID NO: 126598 - protein, 535 aa, Heterodera glycines
  misc_feature (1)..(1): Xaa can be any naturally occurring amino acid
  Coding regions on vcDNA: vcDNA=SeqID_53021; Strand=+; Position=1 -173,799-871,915-975,1018-1107,1158-1313,1583-1766,1975-2145,2205 -2404,2454-2732
  Homolog annotation: Hit_ID=NP_498374.1; Match level="QueryCoverage =95%, HitCoverage=78%, E-value=2e-76, Identity=33%"; Hit description =ankyrin and ubiquitin interacting motif (67.0 kD) (3H366) [Caenorhabditis elegans] gb|AAC47054.1| Hypothe
XSPKLKAELNSSLNDKNFVNLPDIHAWTPVMLATILGHFECAEVLLENGADANTQNKEMWSLSHEAIQWKDHNFLKKVLTFRDYQRAIQTINVLLELNKSDYQRAIQTINVLLELNKSLQDSSDFFVEMRWEFTSWLPFVKNMCLQDSSDFFVEMRWEFTSWLPFVKNMCPSDTYKIYKSGTNVRIDANILEIIYKSGTNVRIDANILEIGRGETPSNTRQQSFIFRFVNNTTAEVIFIDPNEQIATYVNVDNVGFERTTKSTGLFSWIGSNGKEEEVEGFTCRLMNASNVEIVTKTRLDHLSIADRAKVSDNKTLSLLMSLFEKKRVMNNSLPENTSNSSADDVYGGVSAIEYLSRRVGNCHIGKRSEEQIKRSEEQIKSNAFNASLWLSETFPLKLHEQIFPVIDLLAVRNTKFSRLKSFIQLQLPSGFPIRIKIPIFHLIIFHLINAQITFRNVNDPKEEAIERIAEHSEDDGPQMLRLRQSLFQIPDGFGCELSGSFSVNRAGEFERTQRGAADERCKLNHFFIYFDLNDF

SEQ ID NO: 126599 - protein, 227 aa, Heterodera glycines
  Coding regions on vcDNA: vcDNA=SeqID_53022; Strand=+; Position=1 -351,581-913
MTGTFPSEPTFAAASSNAVVDDGGESHQTERPTETEDTSAAFLPHNSSLRSVIERFGEENVLKEWTEEDCAGLLVQLLKSLDAFLCSLFALSNLRNFCDYEGAKRIVRCFRETSVDEINDCFNLCKELNKRAANERVRMGNCVSCAPLPQESLPTFPNWSSVLAQAKKSRGIPDDSSAVVAKMLSEISAKYNDDNFAPDSPNYKFIYEHLASLVRGYAMRDARRWGQ

SEQ ID NO: 126600 - protein, 199 aa, Heterodera glycines
  Coding regions on vcDNA: vcDNA=SeqID_53023; Strand=-; Position=1 -48,465-651,697-1061
  Homolog annotation: Hit_ID=CAG01063.1; Match level="QueryCoverage =71%, HitCoverage=44%, E-value=4e-37, Identity=53%"; Hit description =unnamed protein product [Tetraodon nigroviridis]
MAPLPGVIQLQGDITEIFRAKNVNLLYAQMKCFFKEVSCCKPKSSRLSSCEAFIVCKNYSPPEGYKPTLVNPILASDYNECLAQLEGPMNAALVPFMACGDLSGFDSDRTYPLNLEELSNEFKQFDYKYSHKDVLQPPTEPAYKKACEMKRNSELETNLDQQRQRTQSKKPAKNREAKEELQNDVIAELEEGCFERLLL

SEQ ID NO: 126601 - protein, 393 aa, Heterodera glycines
  Coding regions on vcDNA: vcDNA=SeqID_53024; Strand=-; Position=1 -113,178-305,381-505,552-912,1137-1399,1443-1634
  Homolog annotation: Hit_ID=NP_499083.1; Match level="QueryCoverage =65%, HitCoverage=40%, E-value=3e-24, Identity=28%"; Hit description =putative nuclear protein of bilaterial origin (3K554) [Caenorhabditis elegans] pir||S28283 hypothetical p
MDASSLSSLVGYQDSPLNKTVSSVHSRSQLNHLLENETCDSIIDPTDCSAYFSFNLPGPSHFYQPGTPQYLLTEEDTAFNGIRSFIDEHKLSKYSRRPDKRLFQHSRADDSPKVHLLSELKEVLETYGLREQDMEMYEVKLRIWLCNTILRPLVAKIDEVNAELCEKCPSSHLKVGTSSMEMLLTHKQHFSDTFLPFVLPYLRVHSNQQYVVSRLRTLCQNIALEEFKWDGGGEQTVRDESDSFDRFIGWGPQLPTDTELIWHLFCTYLDFHISPSSDGVSELSKPFSNVFFVNSSDGKFPLALMHATIQPTKQQIVPDELADEKYFIRLASARPPTFEIVVDGGETVILPCKNQPQNFWYVLILFLAHVTKMSHSRIGHIHLTSLSLNIFDA

SEQ ID NO: 126602 - protein, 86 aa, Heterodera glycines
  Coding regions on vcDNA: vcDNA=SeqID_53025; Strand=-; Position=1 -51,314-523
MKFAHTVPRGFAKFSHTHYMPKTLLQLTFVGLLSPNGDLFCNSSVPFSVLTKMSVFENSEIPALHAENIAPIDICRHFKPKWGLIL

SEQ ID NO: 126603 - protein, 172 aa, Heterodera glycines
  Coding regions on vcDNA: vcDNA=SeqID_53026; Strand=+; Position=1 -132,633-879,1300-1348,1485-1597
  Homolog annotation: Hit_ID=XP_512606.1; Match level="QueryCoverage =97%, HitCoverage=62%, E-value=6e-33, Identity=46%"; Hit description =PREDICTED: similar to hypothetical protein C130099A02 [Pan troglodytes]
WAKPGPGPFRVENPGIFGGKTGKKSGLVPVKTGTSVLSCTQLSVKSCPPLWSIHYVPDFVTEEEERQLLERVYGVPKPKWRELARRRLQNWGGTLVGGGGTVGTEEERQQAPVPVARRTVAGGAKPNHVLVNEYLPGQGIMHTDGPAFYPLISTISLGSHTVLDCYDPRAPF

SEQ ID NO: 126604 - protein, 63 aa, Heterodera glycines
  Coding regions on vcDNA: vcDNA=SeqID_53027; Strand=-; Position=1-190
DQIGHSDSVQQVFLLHKVSAAGQQLVGLVSAQVEPIVGGVRAGQLKGHQRLEPGGDVAQQSAA

SEQ ID NO: 126605 - protein, 202 aa, Heterodera glycines
  misc_feature (200)..(200): Xaa can be any naturally occurring amino acid
  Coding regions on vcDNA: vcDNA=SeqID_53028; Strand=-; Position=1-615
  Homolog annotation: Hit_ID=CAB91581.1; Match level="QueryCoverage =98%, HitCoverage=11%, E-value=1e-40, Identity=44%"; Hit description =putative protein [Arabidopsis thaliana] pir||T48965 hypothetical protein F4M19.60 - Arabidopsis thaliana r
CILAPYNEINIYNEQILKRFQGREYVFKSVDDASKGPPILPEVLNKLQTNSLPDHELKLKINCVTKLIRNLNVNMGLCNGTRLQILDIEKNVLRVMILTGDRTGEIDFIPRITLIEDKKLPYVLKRHQYPLKLAFCMTINGAQGQTFEKIGIDLTRDVFSHGQLYVALSRTRSWDKIKIKYSKENSEKKTQNIVWLEAFXCF

SEQ ID NO: 126606 - protein, 41 aa, Heterodera glycines
  Coding regions on vcDNA: vcDNA=SeqID_53029; Strand=+; Position=1-123
MSNNNDEGMANGGKGNYQQYVKLEKTVNQCRVKTFAVRTFA

SEQ ID NO: 126607 - protein, 30 aa, Heterodera glycines
  Coding regions on vcDNA: vcDNA=SeqID_53030; Strand=+; Position=1-91
DYFSKHLVDWGIIGDCGINRDWAIIRAYTV

SEQ ID NO: 126608 - protein, 97 aa, Heterodera glycines
  Coding regions on vcDNA: vcDNA=SeqID_53031; Strand=+; Position=1-294
MANTLKRKRRKAEEHSPKENIRSSVPLKHSVSFAVDSSGGSQLFIEDTDFGLVTLEDAQKAPFQSKAFEWNGEGMDKRQQRKVARGEGGQMTKIKAD

SEQ ID NO: 126609 - protein, 143 aa, Heterodera glycines
  Coding regions on vcDNA: vcDNA=SeqID_53032; Strand=+; Position=1 -79,123-189,233-306,441-553
  Homolog annotation: Hit_ID=CAE60876.1; Match level="QueryCoverage =99%, HitCoverage=24%, E-value=2e-41, Identity=59%"; Hit description =Hypothetical protein CBG04588 [Caenorhabditis briggsae]
PSAVVLQCGADSLNGDRLGPFNLTLKGHGKCVKFFRDCNLPLMLLGGGGTLKGHGKCVKFFRDCNLPLMLLGGGGYTPRNVYTPRNVARCWTYETSLAVDIDISDELPYNDYFEYFAPNYRLHIDASNETNHNTEEYLRTVQY

SEQ ID NO: 126610 - protein, 60 aa, Heterodera glycines
  Coding regions on vcDNA: vcDNA=SeqID_53033; Strand=+; Position=1 -58,660-784
MQIDESVEHDRANPDRRLPVEFSIINPLMVNLSSDSSVDYSEDPCPGEHLHHGIFYDGNA

SEQ ID NO: 126611 - protein, 89 aa, Heterodera glycines
  Coding regions on vcDNA: vcDNA=SeqID_53034; Strand=+; Position=1 -167,2008-2108
MENCVVVPRRISFVRSTLDQFWDCSALTVPMTNGQEFLVIYSNGEMEVYIQSENRGGLVVHLSFVDLDLEAAYSRSEQCLRDYIVVTII

SEQ ID NO: 126612 - protein, 182 aa, Heterodera glycines
  Coding regions on vcDNA: vcDNA=SeqID_53035; Strand=-; Position=1 -224,272-349,504-726,769-863
MSVHSELARSKILTCRNRLAVRRLALLEQYFELNKSVQCLLDDYRLNIMKAKSTSPGFVVGSVTALLSSQRELSPTIWVETAKSDCGSFLALNWPSKCAGEKGNDLRRRGGETFDGKGAEEAEGNGGHSTDFHPFGVLESQSVKAARKNIQKLLLILCDLANIQRQILSLGKEADETKLAEF

SEQ ID NO: 126613 - protein, 94 aa, Heterodera glycines
  Coding regions on vcDNA: vcDNA=SeqID_53036; Strand=+; Position=1 -164,1981-2099
MGGEKGGKCGRKEAEGTERKRDGKSRRNNEVAAKPHGGRNAFRNFTDSKNTPRNGELCFHYVEPIIVKKTLNGFVQLEVLFEQSQPTHRQTISA

SEQ ID NO: 126614 - protein, 103 aa, Heterodera glycines
  Coding regions on vcDNA: vcDNA=SeqID_53037; Strand=+; Position=1 -156,610-763
  Homolog annotation: Hit_ID=NP_700767.1; Match level="QueryCoverage =97%, HitCoverage=7%, E-value=9e-17, Identity=49%"; Hit description =RNA helicase, putative [Plasmodium falciparum 3D7] gb|AAN35491.1| RNA helicase, putative [Plasmodium falci
MFVLQSLITGTISKASAKQRAERAGRTQDGVCYRLYSELAFANQMLEHTPPEILWSDLTSMVLKMKSIPSISEHLGDLRFRDQPPKAAIVSALQNLYFLGAID

SEQ ID NO: 126615 - protein, 120 aa, Heterodera glycines
  Coding regions on vcDNA: vcDNA=SeqID_53038; Strand=+; Position=1 -78,495-588,782-970
  Homolog annotation: Hit_ID=AAV41376.1; Match level="QueryCoverage =66%, HitCoverage=4%, E-value=5e-14, Identity=42%"; Hit description =talin 1 [Danio rerio]
MVSELAQCSDQLRSNGASTAMSVEESKPDENLTYDEQILSSAKSITQAVQTLVKVIFGLVSAAKLVAAATNQLCEAANGLVQGHSTEEKLIAAAKQVKKTKEENQGIYHGNYWTNYRHKS

SEQ ID NO: 126616 - protein, 21 aa, Heterodera glycines
  Coding regions on vcDNA: vcDNA=SeqID_53039; Strand=+; Position=1 -54,580-591
MRTRPIWQVKQRLLTSQKKGF

SEQ ID NO: 126617 - protein, 79 aa, Heterodera glycines
  Coding regions on vcDNA: vcDNA=SeqID_53040; Strand=-; Position=1 -59,1163-1343
MGKLSAKSVNIIIHTFVYIRCVNDKIHETDSHTREKNLCMKFWPALYTNGFTLSPVEEGVASISLIEMTYFTESGQNNK

SEQ ID NO: 126618 - protein, 497 aa, Heterodera glycines
  Coding regions on vcDNA: vcDNA=SeqID_53041; Strand=-; Position=1 -223,276-544,597-813,858-1038,1078-1280,1331-1443,1749-2036
MIRNKLESLQKSRKKRYLSDILNTTEEAVNLGVELVEPNDVRTSDSVEQPNLKEAEVSTVLLSAEKPILGEIAYGFRFTHHSGNRWRCTNRSCSAYVNITNNGETGTSGTLGQKEYNHLPAPQKQQVCLNSTLREKVGEDIVLYDSRNVRQGEKDVVLIFGSVKTLDILRQCGTWHLDGTFKCAPAMWEQCFVIGASVHQRMCICLWCLLPGKQRRYYEEALNFLRGRISTEVPSKIMCDFEKAEIAAVRTAFPTAQIKCCMFHYGQSLFRNFKRLGLVHLYGEKTERGEAVRNTFRSVLSLPLLPPSVVRMAFSIIVASAPAGMHEFFLYFSRTYIGLTQRQLLDGANAFGATQISFLSSTDHSELVTTISTINSEHSYAATPIQFGIGSPAPSTLTWPTTKGLCHHPALSDFICGVNESIDRQVDAARSARHFIHKRQKRYILQDALIMRILADASYNNNGEIHDLMTALGLQIEGYAGKLKDFENFDDSIVHVP

SEQ ID NO: 126619 - protein, 87 aa, Heterodera glycines
  Coding regions on vcDNA: vcDNA=SeqID_53042; Strand=+; Position=1 -69,138-332
MATFTLRQGIDIAKKLEPTGENQFLLLGRQSAIKAAQNGTDWAKSVDAKLGTMVDEHILKRALEKVEKSAGSVPLYMDLAKVFKFIF

SEQ ID NO: 126620 - protein, 385 aa, Heterodera glycines
  misc_feature (15)..(15): Xaa can be any naturally occurring amino acid
  misc_feature (176)..(176): Xaa can be any naturally occurring amino acid
  misc_feature (235)..(235): Xaa can be any naturally occurring amino acid
  misc_feature (269)..(269): Xaa can be any naturally occurring amino acid
  misc_feature (312)..(312): Xaa can be any naturally occurring amino acid
  misc_feature (319)..(319): Xaa can be any naturally occurring amino acid
  Coding regions on vcDNA: vcDNA=SeqID_53043; Strand=+; Position=1 -1114,2016-2072
  Homolog annotation: Hit_ID=AAB97874.1; Match level="QueryCoverage =97%, HitCoverage=59%, E-value=2e-41, Identity=36%"; Hit description =surface antigen [Trypanosoma cruzi]
KLVPKSRVPKCRVPXVSGSKVSPQMSGSLSVGSPKVPKCRVPKCRVSKVSPQKSGSLSVGSPKSPQMSGSLSVGSPKLVPKCRVPSVGSPKLVPKSRVPSVGSPKLVPKCRVPKCRVPQVSGPQMSVPKSRVPKCRVSKSRVPKCRDPQKSGPQMSGSPKVGSPNVGIPKSRVPKXRVPKCRVPKSGSPNVGIPKSQVPKSRVPKCRDPKSRVPKSRVPKSRVPKCRVPKCRVPXVSGSKVSPQMSGSLSVGSPKLVPKSRVPKCRVPXVSGSKVSPQMSGSLSVGSPKSPQMSGSLSVGSPKLVPKSRVPXVSGLQSXSPNVGSPNVGIPKSRVPKSGSPKVGSTNGGRYHQQYYRLLCPPAAVASKVCGLLTSANSVPKLVMF

SEQ ID NO: 126621 - protein, 104 aa, Heterodera glycines
  Coding regions on vcDNA: vcDNA=SeqID_53044; Strand=-; Position=1 -118,420-472,1505-1569,1798-1876
MGLYFLNVLKLSSGQTTVLINVKKIIGAFFALLGSAVADGQFFMAPLFTELAKSFSACTHFHFFVADFTLKALPWPRFMYNKNPPKGNVFADVYDTVVVAFFDN

SEQ ID NO: 126622 - protein, 297 aa, Heterodera glycines
  Coding regions on vcDNA: vcDNA=SeqID_53045; Strand=+; Position=1 -444,587-1035
MTISPAVTRLRQHATTAENALDEDEMDQEALDTLRQEHQHITRILTRLEYDLNEWNEVIHRLQGPARDAEEAIFTAFIRDDRHFTEWMEDAREVLAHIEDELNGPPVAAQAHLAGGGQLPGASCNAHIPLPAANQQFQPVIAANAQGVSAVDRLPLEPVDKFNYLHVCLRGKAARAVTSYRGGENYAHAVAALKRLFGDPWKIAEALQSELMNLRPVDDDVRSLQDFLETFERVCRQLSNLEMPDDSPLMYQVVRSKLPATVLSELVKMERSAGVKLHTPQLRTGLAKVISIREEVE

SEQ ID NO: 126623 - protein, 60 aa, Heterodera glycines
  Coding regions on vcDNA: vcDNA=SeqID_53046; Strand=-; Position=1-208
CIYKLGWTVGYGVHAWLGNIWPSFVILKHTKHYQLSSVAVGKALRAQGRGFTASLEIDVI

SEQ ID NO: 126624 - protein, 277 aa, Heterodera glycines
  Coding regions on vcDNA: vcDNA=SeqID_53047; Strand=+; Position=1-835
  Homolog annotation: Hit_ID=XP_340503.1; Match level="QueryCoverage =99%, HitCoverage=59%, E-value=5e-13, Identity=26%"; Hit description =hypothetical protein Tb927.2.4050 [Trypanosoma brucei] gb|AAQ15862.1| hypothetical protein Tb927.2.4050 [
EKHDPEDIVESEEVHHEVEAVPAPIPTERHELDDTVETEEVVQEVEAVSAPIPSERRESDDIVESEEVRHEIEGVPASIPTEIHESDDIVESEEVRHEVEAVPASIPTERHEPEDIVESEEVRHEVEAVPAPIPTERHELDDTVETEEVVQEVEAVSAPETMASEEWARPAAAEEVIEFGDLSPKSDHFGDQKDEEEALVESEDVKPDEHRDKAVDDHFKTAQETDQQRPDSLMVRWAGDEQRDAEETRALYTVTEQQANQLVEEALERVLSDESSL

SEQ ID NO: 126625 - protein, 293 aa, Heterodera glycines
  misc_feature (33)..(33): Xaa can be any naturally occurring amino acid
  misc_feature (42)..(42): Xaa can be any naturally occurring amino acid
  misc_feature (67)..(67): Xaa can be any naturally occurring amino acid
  misc_feature (71)..(71): Xaa can be any naturally occurring amino acid
  misc_feature (76)..(76): Xaa can be any naturally occurring amino acid
  misc_feature (102)..(102): Xaa can be any naturally occurring amino acid
  misc_feature (106)..(106): Xaa can be any naturally occurring amino acid
  misc_feature (279)..(279): Xaa can be any naturally occurring amino acid
  Coding regions on vcDNA: vcDNA=SeqID_53048; Strand=-; Position=1 -29,292-1142
  Homolog annotation: Hit_ID=AAS38911.1; Match level="QueryCoverage =94%, HitCoverage=82%, E-value=1e-24, Identity=35%"; Hit description =similar to Leishmania major. Ppg3 [Dictyostelium discoideum]
LINLRIWHFLNLITYRNDDSSLSTRSSASSTSXFACCSVTVXSARVSSASRCSSPAQRTIKESGRCXSVSXAVLKXSSTALSRCSSGFTSSDSTNASSSSFXSPKXSLFGDKSPNSITSSAAAGRAHSSDAIVSGADTASTSCTTSSVSTVSSSSCLSVGIGAGTASTSWRTSSDSTISSGSCLSVGIDAGTASTSWRTSSDSTISSDSCISVGIDAGTPSISCRTSSDSTISSDSRLSDGIGADTASTSCTTSSVSTVSSSSCLSVGIGAGTASTSWXTSSDSTISSGSCFS

SEQ ID NO: 126626 - protein, 84 aa, Heterodera glycines
  Coding regions on vcDNA: vcDNA=SeqID_53049; Strand=-; Position=1 -107,801-948
MSEMITHNQHQLIKWVKKWGQTQMINKKEKSFENLKDRHFEKSLDLDSMLDLDLDFLDKNLGKSRSRKNPGSSRPGSRPGPGFF

SEQ ID NO: 126627 - protein, 215 aa, Heterodera glycines
  Coding regions on vcDNA: vcDNA=SeqID_53050; Strand=-; Position=1 -362,806-951,1007-1146
MHPSEPGPSSSNSEIHPTSLPPPSTTALNYQCNYNNIDDAQHRQLHRIWETSPEGELLILQNTTSIGSGETKNAVPSDHSTVIRPMFLDIYLPNGVLLPIQCPAQRALALLKQDVFIQARKLQLFETCREAERQRGTCSFGHYAFPENPLLMVHPVSMNGATVVSHGQFGPIEINETDLDYAQFPEQPGEVEQRAMEKLRRKVQFSDAYLEAWHH

SEQ ID NO: 126628 - protein, 82 aa, Heterodera glycines
  Coding regions on vcDNA: vcDNA=SeqID_53051; Strand=+; Position=1 -150,503-601
MPCSKCRTNHPHNQLTRHRMRECRAAAHSGPTASALVSEALEGRNAKSVQQIKLRIGLGSYQNFHRILLLTQLFFEKCTKIR

SEQ ID NO: 126629 - protein, 395 aa, Heterodera glycines
  Coding regions on vcDNA: vcDNA=SeqID_53052; Strand=-; Position=1-1188
  Homolog annotation: Hit_ID=NP_504188.1; Match level="QueryCoverage =66%, HitCoverage=71%, E-value=2e-19, Identity=26%"; Hit description =predicted CDS, gag protein like (5E786) [Caenorhabditis elegans] gb|AAB63928.1| Hypothetical protein ZC13
MSELLRITIAPIVKRLKLYIETAQENLTKDLTEEIKTDLLAERQNLCRAVSLLEKNNDKWEAVFHRVKGPALQEEEQNYKDYKPEGKAFMEWADQARGLVDTIDRALGLSEQGDDVVHHAQVQQPAQNIQPQVVVAPQRHEVMLPPISLPKFSGEPREWPLFWKLFETSVESLQIEDFKKHIYLLGCLPEKSVARRAIDLYPPSDENYPRVVEILKKRFGDEKSIVETLQSELLHLPKPSDSVQSLRQFSESIERICQQLSDFGENEQNKFMASTIKSKLPYHLLTQVVEKEMRSGGTFDCSDLHKANTSIVEVKEEVQRCTQVFRGEEKPRNFPPQMQRNNFQGRGTNFSPNQFRQGHWRPNNRNESVGMMSPQIHRSFNTVNPRVLCPTTVYI

SEQ ID NO: 126630 - protein, 231 aa, Heterodera glycines
  Coding regions on vcDNA: vcDNA=SeqID_53053; Strand=+; Position=1 -487,758-966
  Homolog annotation: Hit_ID=XP_230851.2; Match level="QueryCoverage =90%, HitCoverage=95%, E-value=4e-16, Identity=26%"; Hit description =similar to hypothetical protein [Rattus norvegicus]
MHSMNIYICMTEIIKHERHRNEIEQQRNASENHRNEIEQQRNASENHRNEIEQQRNASENHRNEIEQQRNASENLRNQIEQQRNASENHRNEIEQQRNASENHRNEIEQQRNASENLRNQIERNHKDEMTKLINELINRIAELEEQNGQLKQQVAEHERQQRDINFEAQPPNATDSAQPELTAPAMATNDGTNYDFAELSPTSAPTQSLARNDGTGGQLMSHSSSGLFNTF

SEQ ID NO: 126631 - protein, 280 aa, Heterodera glycines
  misc_feature (36)..(36): Xaa can be any naturally occurring amino acid
  misc_feature (48)..(48): Xaa can be any naturally occurring amino acid
  misc_feature (58)..(59): Xaa can be any naturally occurring amino acid
  misc_feature (135)..(135): Xaa can be any naturally occurring amino acid
  misc_feature (151)..(151): Xaa can be any naturally occurring amino acid
  misc_feature (217)..(217): Xaa can be any naturally occurring amino acid
  misc_feature (274)..(274): Xaa can be any naturally occurring amino acid
  Coding regions on vcDNA: vcDNA=SeqID_53054; Strand=+; Position=1-854
  Homolog annotation: Hit_ID=BAB33421.1; Match level="QueryCoverage =96%, HitCoverage=96%, E-value=1e-90, Identity=68%"; Hit description =putative senescence-associated protein [Pisum sativum]
SKNIAILPRRDSDLEAFSHNPSDGSFAPLVYRPSTXTKCLNLRFLSYXAGLLLATGLXXGKTNLSHDGLNPAHVPYWWVNNPTLGEFCFAMIGRADIEGSKSDVAMDAWPPQASYPCGNFSDTSCWKLYTLKDRXATLSRSVFVLKIRIKXAFAFLLYERFPSSLSALGHLRYALTDVPPQSNSPPDTVIGAGRRARVARLNTKMDTRRTPVLPIKXGIDESSGISLAPCGSHLCYTSHDSSQSQTRVKLNRVFFPAKFAKPVPLAVVSLDSRXGQWESR

SEQ ID NO: 126632 - protein, 75 aa, Heterodera glycines
  Coding regions on vcDNA: vcDNA=SeqID_53055; Strand=-; Position=1-226
MACGVLDKLPEIIGHRSVLSTWYRVGMAQLFAKRLLVQMPRCGPRDTPWLFCLLCRSSAERTALRAHLAMNGIET

SEQ ID NO: 126633 - protein, 71 aa, Heterodera glycines
  Coding regions on vcDNA: vcDNA=SeqID_53056; Strand=+; Position=1 -146,1012-1081
MTSKCINCKLLVYPWFAKLCRCEPTQESRASTNPPSPAWTIGKRIYLFCIWSHFCVLITFGNILIILHLIN

SEQ ID NO: 126634 - protein, 25 aa, Heterodera glycines
  Coding regions on vcDNA: vcDNA=SeqID_53057; Strand=+; Position=1-76
REKKIMFFSGTLYLLVHISFFETVC

SEQ ID NO: 126635 - protein, 201 aa, Heterodera glycines
  misc_feature (11)..(11): Xaa can be any naturally occurring amino acid
  misc_feature (167)..(167): Xaa can be any naturally occurring amino acid
  misc_feature (183)..(183): Xaa can be any naturally occurring amino acid
  misc_feature (199)..(199): Xaa can be any naturally occurring amino acid
  Coding regions on vcDNA: vcDNA=SeqID_53058; Strand=-; Position=1 -200,245-307,358-382,478-606,655-702
  Homolog annotation: Hit_ID=CAE73036.1; Match level="QueryCoverage =90%, HitCoverage=98%, E-value=6e-44, Identity=54%"; Hit description =Hypothetical protein CBG20405 [Caenorhabditis briggsae]
LSDRGNRPMVXGMAGAVLDKQKSKYNELEGQYLLEWINEKVKEDFHCRTRTNFWEQLKDGTLLCRFLNAVEPGIVKKVMKPISNFFLNAVEPGIVKKVMKPISNFNCMENINQFNCMENINQFVSEVSEARKMGVIDQETFQSVDLLEGRDLFSVCVTLQSLARKVXKKGIALPKQVPKDKIXREGIALPKQVPKDKIXRE

SEQ ID NO: 126636 - protein, 271 aa, Heterodera glycines
  misc_feature (218)..(218): Xaa can be any naturally occurring amino acid
  Coding regions on vcDNA: vcDNA=SeqID_53059; Strand=-; Position=1 -196,376-550,579-988
  Homolog annotation: Hit_ID=CAE68613.1; Match level="QueryCoverage =87%, HitCoverage=42%, E-value=4e-43, Identity=41%"; Hit description =Hypothetical protein CBG14494 [Caenorhabditis briggsae] emb|CAE68611.1| Hypothetical protein CBG14492 [Cae
GGGKHRINAKAIGRMNGIQMTRHLRSETLQIAACAGCNQMDAWGTIVTGVGAGLIYMALSGLMLRLRIDDPLDAFAHSGGGLWGLVSVCLVSTSGRGVVPSLATGDGLAIVRSLAVIECFSQLGWNILSSLAIIVQLGWNILSSLAIIVWSSAVVLPVFGLLKIIGKFRVAPEIEQKGIDIWKHGEEAYPLVAYGHGWDEAEKVKQKKRNELRAEEFXGSGRRIAWHPIATIYHDPNKYRETDGSRKVSERREMGQNERKAINWSYRGPME

SEQ ID NO: 126637 - protein, 67 aa, Heterodera glycines
  Coding regions on vcDNA: vcDNA=SeqID_53060; Strand=-; Position=1-203
DLYQVLMPLIGGGVGRDCIVHVDIDVDSEMRYPKGAARICFSRYDAFVTAIRKQFVNIPDGDGGVKR

SEQ ID NO: 126638 - protein, 110 aa, Heterodera glycines
  Coding regions on vcDNA: vcDNA=SeqID_53061; Strand=-; Position=1 -282,344-394
MPNLCIVKSNRRGRFVLISNSDESDKENCPSTSTAIPQNNEVVKWLVLADKKSTIRCSEYSRKTAWGPCDGADGPVEGCKENWKKWGRVQFLRAVRSKCSDYFGEKTNSV

SEQ ID NO: 126639 - protein, 47 aa, Heterodera glycines
  Coding regions on vcDNA: vcDNA=SeqID_53062; Strand=-; Position=1-142
MVKTTKLSHLKKSRKRLKPLTGQATSSLASSSSTISTTSAHKQPFDC

SEQ ID NO: 126640 - protein, 80 aa, Heterodera glycines
  Coding regions on vcDNA: vcDNA=SeqID_53063; Strand=+; Position=1 -80,1837-1997
MNKKAVFYNYSFYSRVIGAADHEYDIRFFAEHTEAEFAQAGAVASADISLPAGPMPAELHLHGAMEPQLRKLGMPTRLEN

SEQ ID NO: 126641 - protein, 29 aa, Heterodera glycines
  Coding regions on vcDNA: vcDNA=SeqID_53064; Strand=+; Position=1-88
MKGPFDWYIVSKMQKPIIVNIIALANLGT

SEQ ID NO: 126642 - protein, 109 aa, Heterodera glycines
  Coding regions on vcDNA: vcDNA=SeqID_53065; Strand=+; Position=1 -105,429-567,622-705
  Homolog annotation: Hit_ID=AAS47831.1; Match level="QueryCoverage =35%, HitCoverage=15%, E-value=3e-10, Identity=61%"; Hit description =metalloprotease IV [Ostertagia ostertagi]
MSVIACHELMHALGFHHEQSRSDARNYIILWEKDGKIIICSDSCKGHEDKCQNGGYLNPNDCTKCHCPDGYGGKYCKELEENLNCEDLSGIPRELVANHSAVLLKTKAK

SEQ ID NO: 126643 - protein, 213 aa, Heterodera glycines
  Coding regions on vcDNA: vcDNA=SeqID_53066; Strand=+; Position=1-642
  Homolog annotation: Hit_ID=CAC39142.1; Match level="QueryCoverage =97%, HitCoverage=31%, E-value=2e-32, Identity=25%"; Hit description =GD:RRBP1 [Homo sapiens]
MGQRKEVGKGREGKGREGKGKEGKGREGKGRERKGREWKGRERKGREGNGREGKGKERKGMEGKGRERKGREGKGMEGKGKERKGKKRKGMERKGKERKGKEGKGREGKGMERKGKERKGKGRERKGREKKEKEGKGMERKGKERKGREGKGKERKGKEGKGKEGKGRERKGRERKGTERKGKERKGREGKGRERKGREWKGREGASFKTTRL

SEQ ID NO: 126644 - protein, 138 aa, Heterodera glycines
  Coding regions on vcDNA: vcDNA=SeqID_53067; Strand=+; Position=1 -192,407-462,637-805
MKMEMEVAVCRNRQAQEEVALARTKAPDVSQAFVAAQTLLGRTVPAHANTFCKSAVIWLRCPTQPNHAPKRPRTVALYRTFAPMTLWPFVVVLTRAIVAITRLHIWHKEGARMCSNGINWHTDYSNGLKALALSFPIM

SEQ ID NO: 126645 - protein, 59 aa, Heterodera glycines
  Coding regions on vcDNA: vcDNA=SeqID_53068; Strand=-; Position=1 -78,603-704
MNIGPVFISTEVSFPLRDTTGTVMSGVYVLQFFIFANLALGHIFITFDGNAESFFCIKL

SEQ ID NO: 126646 - protein, 384 aa, Heterodera glycines
  Coding regions on vcDNA: vcDNA=SeqID_53069; Strand=-; Position=1 -490,535-716,755-890,936-1106,1146-1234,1415-1501
  Homolog annotation: Hit_ID=XP_473410.1; Match level="QueryCoverage =15%, HitCoverage=8%, E-value=3e-11, Identity=47%"; Hit description =OSJNBb0034G17.1 [Oryza sativa (japonica cultivar-group)] emb|CAD41609.2| OSJNBb0034G17.1 [Oryza sativa (ja
MSHIYSTLGLNKHSTSAEINSAYKRLALQNHPDKGGNPEQFKSIKDAFELLTDKKARDFLDTFGEASARAYLWSQTNIIEFSSDSDTESNIPGNSDYNTNFAGRTPPSRSENWSNSSSANCEAANQPEFDFPSPDNNDFLDQLISGIVHSDTEDYQQPHQQQQDGESNFTGNDGQHSQQQDQEEPTIRNLRPRKPQQQKEYKKTGVRARRQRKHHRRGTDKSVRIDANPRPKNVQADKNQKYCVKNILALFTTLDKHGHTRHAFYIDWKGHADRESWTLSEDLDALDTAMDFAANAHQNATVEALNGLSVPQFVLSRLTANPEFIKLCRRLNTKIAPPAPKNILFSSNSSVRQKNKAINQLDSFIVECMTNALWQGELDDSDDE

SEQ ID NO: 126647 - protein, 25 aa, Heterodera glycines
  Coding regions on vcDNA: vcDNA=SeqID_53070; Strand=+; Position=1 -9,407-475
MPALIRVRFSVKRFIMFFRPDSLLK

SEQ ID NO: 126648 - protein, 311 aa, Heterodera glycines
  Coding regions on vcDNA: vcDNA=SeqID_53071; Strand=-; Position=1 -64,559-944,1108-1413,1469-1603,1857-1901
MLASVSNNAWPATCGATKTETSPKKSVEAIEKKIIKPKINLENELGGQNATVSNIFQMPSQRIFARCCGLSRLLSQSAIENNRKNCTEFDFAVLTSQNWSIKKQQNSNEPIFDGILTFDHFSVIRQNEFEFDDEQLAGNLKIEFNEMVEKKHNIGERLGVIRRFAALPNVVQQQTSHGQLGAKAPFGHGIYGKMGFSKLNQFNGMYKTDDFVPGDFGIVPLKPKTRWIWMPESGRDETGEMALVEERIGMEQDYIVKLRSIVSEFLQNNQKMQFNYSRFAADEENNAPQKKLFDLTKNSVSFYFYEKQFIY

SEQ ID NO: 126649 - protein, 95 aa, Heterodera glycines; identical to SEQ ID NO: 125597
  Coding regions on vcDNA: vcDNA=SeqID_53072; Strand=-; Position=1-780

SEQ ID NO: 126650 - protein, 116 aa, Heterodera glycines
  Coding regions on vcDNA: vcDNA=SeqID_53073; Strand=+; Position=1-351
MGMALLIMLINLAGTISGQPPIRASGMDPNLPFREGPRVPCTKECAERVQHNEAQCQSENGFENPLLQLMDTRFGASTVKGRRGQCRQFFHWRREGGSIPAYCTNERDGTQSKQKE

SEQ ID NO: 126651 - protein, 505 aa, Heterodera glycines
  Coding regions on vcDNA: vcDNA=SeqID_53074; Strand=+; Position=1 -157,200-264,479-932,1305-1620,2058-2428,2903-3051,3086-3091
  Homolog annotation: Hit_ID=NP_705507.1; Match level="QueryCoverage =57%, HitCoverage=13%, E-value=6e-11, Identity=25%"; Hit description =hypothetical protein [Plasmodium falciparum 3D7] emb|CAD52744.1| MAL13P1.310 [Plasmodium falciparum 3D7]
QSIFTKLITCTVNKANKHHGTTNDDFLSKLHFDVLAQICEADDQMKENVLKNKIHLKDFLNANWYKKFLDLLEKEDEYFSVSESFNESDGSENEIFDDPSETIIEENENSKNLMEKHSIKNMNFEFGEKSAEKCENKNFKNNLTTTKMDEKNSDDEFLALNTENEEQWTKKKEQQNKKAKNINVRKNKNNNNSEKEMTEQKRKGKNGKNKLEENDENLNLNKKNYDLLDESIFKKIFQNFLEKHWEPQSMEKQCLEYLGTIALFARAIQAKMNFIEQMSKHWANKSVNGIAKKWEHFIFNEEIIFELQQQNQFVQIKLYFLHNQLDEYAFEQSINFLENFIQIIDENETDKIKNYGNYSPQSPNNHQTTQFGTYNSDEFNAIFATLEMHECSMLIAKGVINFEMIKQIKLAHYLNGETFSNAGNPPSKKCLCVDAKIEQQYVDKLKKMLNQKKLEPRLLVGGSLLMNGFVDGSDMDLLCVLPDEIKFDQLFNEEDNCLYKFLKKK

SEQ ID NO: 126652 - protein, 75 aa, Heterodera glycines
  Coding regions on vcDNA: vcDNA=SeqID_53075; Strand=+; Position=1 -18,682-891
MGQKGRTNCRWLQNGPALPTKCDNNFFYNDWGGKLHRQAICQHQKEGRQRHRNGAVPITSALVSDQIVQRRSAIV

SEQ ID NO: 126653 - protein, 269 aa, Heterodera glycines
  Coding regions on vcDNA: vcDNA=SeqID_53076; Strand=+; Position=1 -75,118-213,258-432,473-543,592-825,1028-1186
  Homolog annotation: Hit_ID=NP_508743.2; Match level="QueryCoverage =97%, HitCoverage=47%, E-value=7e-16, Identity=27%"; Hit description =STE20-like kinase MST family member (55.6 kD) (XE961) [Caenorhabditis elegans] gb|AAF75788.1| STE20-like
MFQEFIAICLVKNPDDRADADSLLKHLFIQSAKGPKVVREMIANAQDIAAQYLLQNAHYAKAAKGIDYYAQLNEAAEGQIERDAEERTISTKTGLMTYDGGTLIQHGEQSLKATAENCGVSVSQKAFHPSALSQPIDDNAEMTQTEAAKMNVLSAELSMVKLTVDQKIPNTLDSRHGDGTVEFWDQSPSATWETSGYNSAMDTAFRRAMNGQSDYSFLRDLSTEELVKRKEILEKEMETELNELQARYHAKRKAILDAIALKRNGTVQF

SEQ ID NO: 126654 - protein, 28 aa, Heterodera glycines
  Coding regions on vcDNA: vcDNA=SeqID_53077; Strand=-; Position=1-191
SISSDPTHLLISTRDVNEQDENKKHGLF

SEQ ID NO: 126655 - protein, 53 aa, Heterodera glycines
  Coding regions on vcDNA: vcDNA=SeqID_53078; Strand=-; Position=1-159
SSRISLEYLLLPPRSALVEAPAGPTPKAFNATTTTLLHVMARLRDKHVYKPMT

SEQ ID NO: 126656 - protein, 1324 aa, Heterodera glycines
  Coding regions on vcDNA: vcDNA=SeqID_53079; Strand=-; Position=1 -159,290-409,458-619,667-764,819-907,958-1094,1157-1275,1466 -1667,1717-1834,1880-2038,2127-2278,2535-2837,2876-3009,3059 -3098,3139-3257,3299-3659,3729-3878,...
  Coding regions on vcDNA: Position=...3926-4081,4405-4548,4601 -4723,4769-4928,4972-5069
  Homolog annotation: Hit_ID=NP_508280.1; Match level="QueryCoverage =97%, HitCoverage=99%, E-value=0.0, Identity=61%"; Hit description =atp citrate lyase (XC101) [Caenorhabditis elegans] gb|AAB00585.1| Hypothetical protein D1005.1 [Caenorhabdi
MSAKAVNEYSGKELLYRSLNHVQALVKPNAVQLDENTNFQDAIINCDWISKEGQGVLKPDQLIKRRGKHGLVKIGTSDELAKWFDEKKGQNVQIGKTTGRLSKFIGKTTGRLSKFILEPLCKHGAKDELYIAIYSKMNEDVILFYEEGGVEVGDVDAKARQLVVPVQLKDEEMALGEQSIDAKARQLVVPVQLKDEEMALGEQSIDQLIGSKVEETLVKQFVCELYELVKQFVCELYETYKKNHFTYLEINPLGMLNGKIFGKIFILDLAAKLDETAAFLCSENWKTRSGSEVEFPARFGRDLTTEEKYIADLDAKTGAEKYIADLDAKTGASLKLTILNRKGRVWTMVAGGGASVVFTDTVCDLGGASELANYGEYSGDPNETQTFEYAKTILTIMTEGEAHPKGKVLIIGGSIANFTNVSATFKGIIRALEGIIRALEMFAEKLRLHKVTIYVRRGGPNYQGGLRKFKEAATKLDLPIHVFGPTKLDLPIHVFGPETHMTSIVGAALGVRPLPEASLTPHTTGQFLLAPERGVSSVANGYPKSNGANGYPKSNGTTPEKKAKAETMEEQSKEAIRSLFERDTKAIIWGQQQRAIQGMLDFDYVCKRSAPSVVASTYPFTGDHKQKYYFGQKEMLIPAYKSMEKAFKSHPDASVMVTFASMRSVFQTVLEALEYPQIKVIAIIAEGVPENQTRKLIKVARQKGVTVIGPATVGGIKPVARQKGVTVIGPATVGGIKPGCFKIGNTGGMMDNILASKLYRSGSVAYVSRSGGMSNEVAYVSRSGGMSNELNNIISHNTDGVFLNNIISHNTDGVFEGVAIGGDRYPGSTYTDHILRYQDDPRVKMMVLLGEVGGEEEYKIVVKMMVLLGEVGGEEEYKIVQALKEKRINKPLISWCIGTCADHITSEVQFGHAGASANAVKETAAHKNAALKSAGAHVPDSFDDFGVMISKVYKQLVENGSIVPRAEEPPPPVPMDYAWAKELGLIRKPASFMTSICELGLIRKPASFMTSICDERGEELLYAGVPITRVLEDNVGVGGVLGLLWFQKRLPEYANRFKRLPEYANRFFEICLMLTADHGPAVSGAHNTIVCARAGKDLISSLVSGLLTIGDRFGGALDGAAKSFSEAMDTGLSAMQFVNEQKRLGKLIPGIGHRVKSINNPDINNPDKRVEILKEIAKNKTFFKQETPLFDYALKVEQITTSKKPNLILNVDKPNLILNVDGAIATIFVDILRHSGMFTPQEARETIEIGSLNGLFVLGRSLGFIGHYLDQRRLKQPLYRHPWDDISLGFIGHYLDQRRLKQPLYRHPWDDISYIMPEHEFAEQ

SEQ ID NO: 126657 - protein, 25 aa, Heterodera glycines
  Coding regions on vcDNA: vcDNA=SeqID_53080; Strand=-; Position=1-77
MSQNRDENSQPPVLDGPYRLAQERN

SEQ ID NO: 126658 - protein, 70 aa, Heterodera glycines
  Coding regions on vcDNA: vcDNA=SeqID_53081; Strand=+; Position=1-213
MARAHLAALKWLALSWPYTPPTPMGGYRNPVKWSPLTTRSYQMYKPDQSHRIIMGIRENDMSGDKKSDRL

SEQ ID NO: 126659 - protein, 48 aa, Heterodera glycines
  Coding regions on vcDNA: vcDNA=SeqID_53082; Strand=-; Position=1 -57,295-384
MPIYRCYHHHFAGSTSRATKSRITKKLARLLMLLFLNFTTDMSLMNHT

SEQ ID NO: 126660 - protein, 95 aa, Heterodera glycines
  Coding regions on vcDNA: vcDNA=SeqID_53083; Strand=+; Position=1 -149,490-628
MCQISAGRSQLNAAVWAPYKFEKRKLSWAVKMPTNLLDWVRPIEETKSCYRLIEPVKSFRMISRLFDSVNNFKSYIDSKLAQTELARRSWPVPAI

SEQ ID NO: 126661 - protein, 338 aa, Heterodera glycines
  Coding regions on vcDNA: vcDNA=SeqID_53084; Strand=+; Position=1-1015
  Homolog annotation: Hit_ID=CAA82797.1; Match level="QueryCoverage =83%, HitCoverage=43%, E-value=3e-21, Identity=28%"; Hit description =gag protein [Ascaris lumbricoides]
MASLIQKGITFTLKALDNARTTTALSLHPDADLSNWENAVKLEAQCTRVSREVQTIEAQLDNLRDLSNNWIDLLNRLEGSEKDKGEKEYVKFDTYEKIAERHDAATTKLRDLRDLEATLSADAKLYRGRAEREARADQQANPPPQIATPPMAAPTFTAPLYQFQPIQLDKFFGQKRKWPEFYESFKSAIGSQSISKAQKLNLLRNLLGGEARELIAGFRLEDQNYETVLQLLKDTYGAPEEHIRALHFELANLKTCRSLRDTKDFLLQLERLTRELNNAGEDIEGPQVFLMLEKKLTPAFLRNILNKKGEDPANWTTTKFRDVLNEAVRKEVQIQEVM

SEQ ID NO: 126662 - protein, 204 aa, Heterodera glycines
  Coding regions on vcDNA: vcDNA=SeqID_53085; Strand=-; Position=1 -27,87-269,1355-1465,1582-1875
MADDPSLHESAVLSVLWWTNSVSLPVSIQCKYLHLKSLSIPLGYRHCRPPLQRTQPFGFGYVGGSADAVLLVFTLRRIVRRDSSASAGTATTVAVAEERSGGVVVTNPAVPAVNPPSIFRVSIQRTNGEEHCPLASSFLLSHSLRHFPRLFLQIILEDGHAQQQQQRLNANAMLFAVVLLLFVCIGPQVPARLLYEWWDGMPNF

SEQ ID NO: 126663 - protein, 50 aa, Heterodera glycines
  Coding regions on vcDNA: vcDNA=SeqID_53086; Strand=+; Position=1-150
MEKELLATMKTKGREQLRKDIGAMFDQLQNVVGEEIAGLWAKIEPCLTEQ

SEQ ID NO: 126664 - protein, 393 aa, Heterodera glycines
  Coding regions on vcDNA: vcDNA=SeqID_53087; Strand=+; Position=1-1210
  Homolog annotation: Hit_ID=S08405; Match level="QueryCoverage=99%, HitCoverage=33%, E-value=1e-68, Identity=35%"; Hit description =hypothetical protein 2 - silkworm transposon mag
FIESSDKMGPSRVKDKEDVPFLLTIDEDQRIDKQMLEKETVVDPILAQVISKVKDNWAEPVNEDLNPFFRERANLFLEGNLIRTGMQIVIPHRMQNQILKLIHRAHFGIVRSKARARGIVWWPNLANEMENYVKSCEICQRNAPSAPRTDPEYKWPEARYPFERVHMDLAGPIWGTNFLILVDSYSKYPFVCQMQSTHSTSVINYLREIFGMFGSPKCLVTDNGRQFVSEEFESFMTNEGVRHLTTATYHPASNGEAERFVRTFKESMVKLLAEGMNIKVAQFTFLQEYRATPSAVNEGESPAHQFLGKELRTALDKIRMPRMELILENQSREQMQQQGNLKNFDPGDPIWYKEPNGKWVRAVLIQPLGERMWEIQTEGSTMTRRVHLDQIKG

SEQ ID NO: 126665 - protein, 1731 aa, Heterodera glycines
  Coding regions on vcDNA: vcDNA=SeqID_53088; Strand=-; Position=1 -586,828-970,1020-1262,1386-3594,3779-5790
  Homolog annotation: Hit_ID=NP_508324.1; Match level="QueryCoverage =60%, HitCoverage=40%, E-value=1e-139, Identity=32%"; Hit description= predicted CDS, peptidase family A16 and RNA-directed DNA polymerase and Integrase, catalytic domain and
PQVVVAPQRHEVMLPPISLPKFSGEPREWPLFWKLFETSVESLQIENFKKHIYLLGCLPEKSVARRAIDLYPPSNENYPRVVEILKKRFGDEKSIVETLQSELLHLSKPSDSVQSLRQFSESIERICQQLSDFGENEQNKFMASTIKSKLPYHLLTQVVEKEMRSGGTFDCSDLRKAITSIVEVKEEVQRCTQVFLTWDTHQASVQNIQHLEHAEGGLQINNDVFCLMQGHNSQQCTMQLIKEGDAPRGSTPKHTTKGGTVQKKQSSNIREPPRPTQNHFSTTNEPLRIREKPSEIAISDGTTNVLTNVVTKKSHAFLMTRRLRKRWKSTVSVVKGMDQYGSIHLSTPFKFNGVTISGRKSSSIEPSKFPLHSKWWSGTQMIITEEQDVFQALTLSEDEPEILISARHFWKFFQSKKEVLPGLFVIQTTLGPLVNGESDFGPKVQNPGLSMMTIDESNQKQMPATKEIEYFFNLESLGIKEDPNEDDDQTAIQLFDKSIRRENGGRYSVKWPWKEETPNLPSNYRMAFSRLMSTLNKLRHSPELLQQYNNTIHDQLSKGIIEEAREAPGTLEHYIPHQGVLAKGKKLRVVYDASAHTRETNSLNDCLYRGPVLLPDLIGMLLRFRCPAFPLLADIQAAFLQISLEPEDREVTKFLWLKDMEKPLSSDNLIIYRFCRVAFGVISSPFILAATLQYHLKNCRSILAKELAESLYVDNALMECETPEEALTKYKEAKAILKEGCFNLREFITNSKEVMEAIPPEDRLEKAKVKVLGLIWDIDQDEIVFEFPSVDSLKIVNRRLVLSFLASLFDPLGLMSPCIQPLKLFFQSLWEEKKGWDDALSEEDSTRWSAFQDSWKDKRIRVPRRTMVKGECSLQLHAFVDASIHTFATAIYLRVESSNKIQNWLIFSKNRLKPKSASKALTIPRMELMAILIGIRGLKFIQTQLRRAIEHSYLWSDSQIALNWVASKEVQPKFIERRIKEIRSITKCSFHFVRTAENPADLATRGATPEELSTNSSWWNGPNWLTKDQNCWPHELFFDIKEEELYDPPKEDEKVFLAHTSEDVLLAEYLIIRLDQLNDPDEFTKFPSLIDSEGILRLKTRLARSDQPYGFSHPILLGKNSEIRDLIILQCHQKRHHLGVDSTITEFLNIYWTPQSRTAVKRVIKNCRRCRRMKAYQFALPKMRPLPEERVCRQMPFKSMGIDFLGPTETRLAGEKVKAWIIIVTCLTTRAVYLEAMLDRTAESFLNVLRRFISRRGKPDFIWSDNATSFKLSQKTIEQLTTPKGVEQNKNEFLALNKIKWKFIAQISPWAGGVYERLVQLCKNCFKRTLGRKILNYDELNTFVAEVEATLNHRPITVVSEGAYGIQPLRPIDLLQPDLQINWETTTEETDPNDKQISSSEKLAALFKATREAHESFWNKWHNEYLLLLRERSKWDHKGTHLQDKGEPKEGMIVLIHEEFTPRNQWTLGKIIELNGKPGAIRSVQLEMPIHGIKSKRYGTMPRKVVITRPVNKIFPLEVGFENPTEDGKENLKVIKDETANSSTEKTILHLENKLPNEEEKNEDKNSHLVEPKANQNKHGMITRSKAKVMTVLNCLTIFCIFGLAGAYPTNQCNECKLICSNKGVLAKIPKEIRKVELCCSENCYIHENVHKLTYELPKEILLNDYQCQGHFWMDSKHMFKKDILCPAVDECVLIECYLCMEQLANPTCYPLVSSMLAGGLFLSLMSISFM

SEQ ID NO: 126666 - protein, 236 aa, Heterodera glycines
  Coding regions on vcDNA: vcDNA=SeqID_53089; Strand=-; Position=1 -460,530-777
MSELLRITIAPIVKRLKLYIETAQENLTKDLTEEIKTDLLAERQNLCRAVSLLEKNNDKWEAVFHRVKGHALQEEEQNYKDYKPEGKAFMEWADQARGLVDTIDGALGLSEQGDDVVHPAQVQQPAQNIQPQVVVAPQRHEVMLPPISLPKFSDFKKHIYLLGCLPEKSVARRAIDLYPPSDENYPRVVEILKKRFGDEKSIVETLQSELLHLPKPSDSVQSLRQFSESIERIVSS

SEQ ID NO: 126667 - protein, 33 aa, Heterodera glycines
  Coding regions on vcDNA: vcDNA=SeqID_53090; Strand=-; Position=1 -95,459-465
MPEIESQRLNCWWVESQRLESLRIESQRLKCCK

SEQ ID NO: 126668 - protein, 114 aa, Heterodera glycines
  Coding regions on vcDNA: vcDNA=SeqID_53091; Strand=+; Position=1-345
MGLKSPAFQTLGLKTPTFNDIPISGTQPTSISISELNSQAFQSLGLNPPAIQSLGLNLRHSKQWDSNLRHSKHWDSKHQLSMTFQSLGLNPPAFQSLGLKSPAFQTMGLKSPAF

SEQ ID NO: 126669 - protein, 320 aa, Heterodera glycines
  Coding regions on vcDNA: vcDNA=SeqID_53092; Strand=-; Position=1-962
  Homolog annotation: Hit_ID=EAL39955.1; Match level="QueryCoverage =70%, HitCoverage=76%, E-value=3e-11, Identity=23%"; Hit description =ENSANGP00000014227 [Anopheles gambiae str. PEST]
MGDAAIQRLTDILQQLLAAQQQNTPPAQNASQLPTLPDVECFDASQHSGCEIEDWLKRFMFVLDCATPNLQDELKVKLLFNCMVLLISLKSPKNATLRSRILAKLAADGDTVKYDGVVDDLKIYMSTIAEAKALEQPHISKLLLTAKLKGQKKRKNSDHSSNASIISTGTRRRNRSQRECWRCGWNHSSRKCRHQETVCRKCKKNGHLERMCAKHQAWLKKNGGKKEKAVNNVRVGKIFLVKGENQRKNGMIDVPIDVNGTKVEFIADFGTEGTVLHEDTVRKIGALKLSRCEERALYHDGTTRPFVGKGKAAFSFGEHS

SEQ ID NO: 126670 - protein, 59 aa, Heterodera glycines
  Coding regions on vcDNA: vcDNA=SeqID_53093; Strand=+; Position=1-442
IIFIQKKFFFGFRGSTLNRCAQIYGETESFGNTFPIACTLILRWIFAPHSCLSTPNGHL

SEQ ID NO: 126671 - protein, 50 aa, Heterodera glycines
  Coding regions on vcDNA: vcDNA=SeqID_53094; Strand=-; Position=1-153
TTPALFFFNYFFHFITQRSRLIRSSPNFAGKLLRTLQMLINFLRIFCLEE

SEQ ID NO: 126672 - protein, 73 aa, Heterodera glycines
  Coding regions on vcDNA: vcDNA=SeqID_53095; Strand=-; Position=1 -112,279-388
MGAGFAANKVLDTLRLLNFPTRGPRLRIPSRITGHLQYGTGPLSTKTELARRNWPKTEPAPDGTGETELARWN

SEQ ID NO: 126673 - protein, 31 aa, Heterodera glycines
  Coding regions on vcDNA: vcDNA=SeqID_53096; Strand=-; Position=1 -63,147-179
MAMKKVKNLGLRSGSADRRCKAMQGKKFGIF

SEQ ID NO: 126674 - protein, 39 aa, Heterodera glycines
  Coding regions on vcDNA: vcDNA=SeqID_53097; Strand=+; Position=1-120
  Homolog annotation: Hit_ID=AAK26376.1; Match level="QueryCoverage =100%, HitCoverage=9%, E-value=4e-15, Identity=100%"; Hit description= beta-transducin repeat-containing protein [Heterodera glycines]
AVQHHQAAPAAQPAAAAMPGGAGAAPAAAIIPLAPPPSP

SEQ ID NO: 126675 - protein, 15 aa, Heterodera glycines
  Coding regions on vcDNA: vcDNA=SeqID_53098; Strand=+; Position=1 -43,530-534
MRINSSTHNCFALVT

SEQ ID NO: 126676 - protein, 118 aa, Heterodera glycines
  Coding regions on vcDNA: vcDNA=SeqID_53099; Strand=+; Position=1 -143,179-257,489-623
  Homolog annotation: Hit_ID=NP_496397.1; Match level="QueryCoverage =96%, HitCoverage=39%, E-value=4e-14, Identity=34%"; Hit description =interferon gamma inducible protein 30 like precursor (2L479) [Caenorhabditis elegans] emb|CAB04345.1| Hyp
MNDPMPFVYCLETLLYENVKFDDATKLCFNLINPGKFVLDRITYYEIRQCFDGSEGILLQNLAADKTKTIWPNKHQFVPWILVNNVIIETMQFLRYSLPSLICEQRAEGEYMAECESW

SEQ ID NO: 126677 - protein, 63 aa, Heterodera glycines
  Coding regions on vcDNA: vcDNA=SeqID_53100; Strand=-; Position=1 -98,367-460
MARPRSAPQRPCSTAPAVPCDRRPPSGCALFSCYAQNKASKLNINVNALNALVQALNSTMRRG

SEQ ID NO: 126678 - protein, 389 aa, Heterodera glycines
  Coding regions on vcDNA: vcDNA=SeqID_53101; Strand=-; Position=1 -805,920-1031,1103-1355
  Homolog annotation: Hit_ID=NP_494149.1; Match level="QueryCoverage =99%, HitCoverage=29%, E-value=4e-79, Identity=38%"; Hit description =predicted CDS, putative protein of ancient origin (2C297) [Caenorhabditis elegans] gb|AAF39854.1| Hypothe
HLNSSVSFASMNPLRYRYPNNRGPYCFRIYGQIYHRMNLALNPEDGDDPAYGQIFIVDTEHAMRAMRHANVDIDPQLLRTAYEVIRNVNPFAEAYMMMKEEEDEEVERARNENREPAEIKLLFETGRQLDRRLGYNVPRANEVAAVYVPGADGEVPNAKIVVRERGKEFKILKSTDSMVTPMTYPLFYPRGTLGWHPEMKHRNSNRRVTRLQYVSYTVAIREREFNPILYGGKLFQQYCVDEYVKIEGDRMNWIKCNQKKILADAYKNDAMAVVRRFGKPDMFLTMTCNPHWDEISENLFHEQTSCKFFGEVIAWMYPVENQGRGLPHIHLLLTLTEQDKMINGEDVEKKGISARIPDKELETDLYALVKRFMIHGPCGDLNPNCPCME

SEQ ID NO: 126679 - protein, 49 aa, Heterodera glycines
  Coding regions on vcDNA: vcDNA=SeqID_53102; Strand=+; Position=1 -76,300-370
MVRRAGDLTDAFVVEVGPGPGGITRAILEQPCKRLDVVEIDKQFLMPLQ

SEQ ID NO: 126680 - protein, 111 aa, Heterodera glycines
  Coding regions on vcDNA: vcDNA=SeqID_53103; Strand=-; Position=1 -170,240-405
MLFLSFPSFVLRQIRPSFCRCFSFLLMLAMLFDLISIGRSLPLGSTNDRIYFSNALRDPKDIVLQLVTVPPPMFKFADFSNKFVRLEKRRRQFGPVQAKKYERNCKLLFFI

SEQ ID NO: 126681 - protein, 130 aa, Heterodera glycines
  Coding regions on vcDNA: vcDNA=SeqID_53104; Strand=+; Position=1 -143,543-595,1452-1525,1780-1902
MASNFGTFLITFASLLFVIYVISPTVYALIIAQSLLIPQSSIIPQSTRNRSLIGRRHRWMTAEIYILVLHSFSSGWDRLKVDSVPFGQHQVKRHETREVPGFYFLAGGRKEYSPDRLANKKREKDIEWLS

SEQ ID NO: 126682 - protein, 30 aa, Heterodera glycines
  Coding regions on vcDNA: vcDNA=SeqID_53105; Strand=-; Position=1-91
DYFSKHLVDWGIIEDCGINRDWAIIRAYTV

SEQ ID NO: 126683 - protein, 80 aa, Heterodera glycines
  Coding regions on vcDNA: vcDNA=SeqID_53106; Strand=-; Position=1 -47,103-298
MSDNRKEADEKMAKAIFISGDGWLSVFDLLAPSQLGLGIALISHRFDCYVDEQTQCQHIHQLINFFRRQTAEEKAHGNVN

SEQ ID NO: 126684 - protein, 46 aa, Heterodera glycines
  Coding regions on vcDNA: vcDNA=SeqID_53107; Strand=+; Position=1-139
VYESLECVHVFCARAHFVSAHHCVLVDTILRNAKAEELATIPFGGI

SEQ ID NO: 126685 - protein, 114 aa, Heterodera glycines
  Coding regions on vcDNA: vcDNA=SeqID_53108; Strand=-; Position=1-343
MDLLTALADKMKNEEQDEVGEEEEEDEFPHIANGTAAHLPTIIEDEAEDELNAMLAKARRLKQTETDKMHFVKSEQYNNDGTSSDDEETTPATLAGGHSTSVVFDSTSEKYKSI

SEQ ID NO: 126686 - protein, 100 aa, Heterodera glycines
  Coding regions on vcDNA: vcDNA=SeqID_53109; Strand=+; Position=1 -151,937-1085
  Homolog annotation: Hit_ID=CAE58454.1; Match level="QueryCoverage =95%, HitCoverage=10%, E-value=2e-38, Identity=77%"; Hit description =Hypothetical protein CBG01592 [Caenorhabditis briggsae]
NKFGGSVKPVLNVVHTAEPPPTYNRTNKFTSVFQGIVDSYGIASYLELNPAPYTIITFPFLFSIMFGDLGHGILMFFCGLFLVLREKNLEARQIKDEVKY

SEQ ID NO: 126687 - protein, 93 aa, Heterodera glycines
  Coding regions on vcDNA: vcDNA=SeqID_53110; Strand=+; Position=1 -11,74-344
MNRRWICNDVWMDIFPSFDRPQLGLKLALLSPRFNALVDKHFDGKSELTIWRTIEIRRKDKGPGPKLSVQMDDKSLPDRPLPSKIRFKWLRIE

SEQ ID NO: 126688 - protein, 44 aa, Heterodera glycines
  Coding regions on vcDNA: vcDNA=SeqID_53111; Strand=+; Position=1 -102,151-183
MSNEFCPSNWPILPTTVQPDSEQFKQNEAEMAESISESKMWSMR

SEQ ID NO: 126689 - protein, 210 aa, Heterodera glycines
  Coding regions on vcDNA: vcDNA=SeqID_53112; Strand=+; Position=1 -99,288-416,1093-1162,1217-1354,1402-1597
YLRGEDIREAQKGINCLDWNFNDSSRLCAAYERNRGTDHAVVVYDLNRTTRNVREVPMSIFEANFAEKVLSVCWFSQLDPSQRKGLDIDGHSYGVHFYSLPGMSSLTSFDWHPTISDRLALLPAQEKPIAFAHSVASTKRIAIIKLRDDVNSVIGPSGDFCISAGPQLNFENGEKLLAKPNCTSDIDTETLFKRRVLVGYGYGNSLNALA

SEQ ID NO: 126690 - protein, 18 aa, Heterodera glycines
  Coding regions on vcDNA: vcDNA=SeqID_53113; Strand=-; Position=1-54
MRTRPIWQVKQRLLTSQK

SEQ ID NO: 126691 - protein, 182 aa, Heterodera glycines
  Coding regions on vcDNA: vcDNA=SeqID_53114; Strand=-; Position=1 -59,117-196,352-484,627-754,801-878
  Homolog annotation: Hit_ID=CAE71491.1; Match level="QueryCoverage =100%, HitCoverage=33%, E-value=2e-41, Identity=47%"; Hit description= Hypothetical protein CBG18416 [Caenorhabditis briggsae]
VAYFTATVPYAIIVVLFLRGISLDGAQLGLDFYLFISLDGAQLGLDFYLFRPNFSVIFDPATWRAAATHVCFSLSVGFGGILSLSSFNSHSHNCFTDALIITAADGFMSVFGGTAVFSVLGFMAKQLDQPIDQVVQSGTGLAFVAYPEAMSRMPLSAMSRMPLSSLWSFLFFSMLFILGISS

SEQ ID NO: 126692 - protein, 25 aa, Heterodera glycines
  Coding regions on vcDNA: vcDNA=SeqID_53115; Strand=-; Position=1 -13,93-157
MPAKLTYYQGTDLFLMRSNFAIQID

SEQ ID NO: 126693 - protein, 147 aa, Heterodera glycines
  Coding regions on vcDNA: vcDNA=SeqID_53116; Strand=-; Position=1 -617,690-725
YIRECFRILIMNSLRRTIASFDQLKMIALIFIRSVRSQKTLDDFRRRSRPPFARNSVSSSPRPSDGSPLHQLRPMTPSLAHLADFRHPSSIDQHHNAQHSLGAAFSNFCAKISGGGKLKIRHNYGTSFRTSFAAGVDQYPPAFGTES

SEQ ID NO: 126694 - protein, 125 aa, Heterodera glycines
  Coding regions on vcDNA: vcDNA=SeqID_53117; Strand=+; Position=1 -175,812-1014
MKLIRGGLIESLMALESEFIFVPLLLQFWVDRQCTLNRTNSRTEAPNSVTAAQTVRSAKNAGRLPAPLAPSLRAEQCLLVAASVGRLTAAPTQAHDSVLGTFGGLSAPVQHRPAPQCAALTRSGV

SEQ ID NO: 126695 - protein, 70 aa, Heterodera glycines
  Coding regions on vcDNA: vcDNA=SeqID_53118; Strand=-; Position=1 -30,82-264
  Homolog annotation: Hit_ID=CAE58930.1; Match level="QueryCoverage =68%, HitCoverage=58%, E-value=8e-10, Identity=62%"; Hit description =Hypothetical protein CBG02195 [Caenorhabditis briggsae]
MLQYLCCLKVEKDGQNSECRDRAFGYFKCRMDNGLMDRDEWPKLGFKDLAEQQQQRKAEEKAVVATELQR

SEQ ID NO: 126696 - protein, 51 aa, Heterodera glycines
  Coding regions on vcDNA: vcDNA=SeqID_53119; Strand=+; Position=1-625
LVIRCLLSAPRDGRSPIGEIKWGGGKGKGHFRSRPYTSGPPKDRPWSLKFK

SEQ ID NO: 126697 - protein, 70 aa, Heterodera glycines
  Coding regions on vcDNA: vcDNA=SeqID_53120; Strand=-; Position=1-213
AMPLNTLNLNIQRFRQGIHPPKEYDFGQSSARLSDNEQHAKDDDEEEDEKELKLVDNDAQLNTKSQTASK

SEQ ID NO: 126698 - protein, 24 aa, Heterodera glycines
  Coding regions on vcDNA: vcDNA=SeqID_53121; Strand=+; Position=1 -19,812-867
MKTVCLTNYATYEVKQTIGDDSVY

SEQ ID NO: 126699 - protein, 54 aa, Heterodera glycines
  Coding regions on vcDNA: vcDNA=SeqID_53122; Strand=-; Position=1-405
PSTPSLKHYSRIDINIFFNDNKALRSEYNVNYSKKLVPYLIPNLMLSHFLSWKE

SEQ ID NO: 126700 - protein, 25 aa, Heterodera glycines
  Coding regions on vcDNA: vcDNA=SeqID_53123; Strand=-; Position=1 -52,151-176
MEKACKIWRDYIDFSALEKASESLI

SEQ ID NO: 126701 - protein, 80 aa, Heterodera glycines
  Coding regions on vcDNA: vcDNA=SeqID_53124; Strand=-; Position=1-310
VFGAVPLNRCAQIYGETESFGNSFPIACTLILRWIYAPHNCLSTPNGHLKKSIFLFSGQSPRPDAPQIYGETESFGRASL

SEQ ID NO: 126702 - protein, 366 aa, Heterodera glycines
  Coding regions on vcDNA: vcDNA=SeqID_53125; Strand=-; Position=1 -36,393-568,614-759,798-877,926-1044,1099-1222,1266-1475,1530-1555
  Homolog annotation: Hit_ID=NP_507684.2; Match level="QueryCoverage =99%, HitCoverage=26%, E-value=2e-68, Identity=41%"; Hit description =putative protein, with 2 coiled coil-4 domains, of ancient origin (5T342) [Caenorhabditis elegans]
KILIFLRKKAKTRRFFNALLRSSHAISHCLLSQFILSEHGSLFCELVTLLRFYVRFEIDDVNGQQLTAAEVTKRHYDSIVTKRHYDSISDLQKATFKFLKDKLGEFCLLPIASVDTSKFLREHLGTLRLEELQHIAKYLRLIPDKNHDEINGDENLEELQHIAKYLRLIPDKNHDEINGDENDPTFDPTFLREAIIFQCERHPSQLQKLNAEPLYPTEAILWDEKSVPYEHYSVPYEHYDGKNVLPLNKLNLQFLTLHDYLLRNFNLFRMESIYEIRQDIEDVLFEIRQDIEDVLFRMKPWRHEFNEQEVVWGGWARMALPVGECRVVHVGKPMVGEVSSATSEDDAEFNYYYRSALSALSENLGN

SEQ ID NO: 126703 - protein, 159 aa, Heterodera glycines
  Coding regions on vcDNA: vcDNA=SeqID_53126; Strand=+; Position=1 -83,230-321,489-793
MATNKTMSAQYVSVRLSRGQWSDRCRVRFMGGNITCPLCREKLQISQTAQTMTMANHLGVMAPPGGIVAPRVQVSGGTNEGQVRHGTVTADQHEVVIDIGTNANQNDGNTGGGTESQVPETPRHEATENTGGTMNHGTATPRHEATETRLNNGSENETK

SEQ ID NO: 126704 - protein, 144 aa, Heterodera glycines
  Coding regions on vcDNA: vcDNA=SeqID_53127; Strand=-; Position=1 -15,295-345,404-511,1103-1131,1179-1314,1358-1410,1599-1638
  Homolog annotation: Hit_ID=CAE72855.1; Match level="QueryCoverage =87%, HitCoverage=70%, E-value=2e-16, Identity=51%"; Hit description =Hypothetical protein CBG20154 [Caenorhabditis briggsae]
MKDGEEELQWRREHEEMHRKHRGHDAMHAEMFIIFIVSMVVAQIILMLWKRRHFRSYQYFTHDGLPKRVLESDMCAVCGNNLHKPSSNQNNFNSLDEANGGVMTEAVELPEEKTYALACNHVFHEFCIRGWQRKGGPQEDVQEP

SEQ ID NO: 126705 - protein, 245 aa, Heterodera glycines
  Coding regions on vcDNA: vcDNA=SeqID_53128; Strand=+; Position=1 -105,159-234,283-470,956-1071,1242-1382,2040-2151
  Homolog annotation: Hit_ID=NP_497129.1; Match level="QueryCoverage =47%, HitCoverage=25%, E-value=2e-36, Identity=67%"; Hit description =ring finger protein 130 (52.9 kD) (3A638) [Caenorhabditis elegans] gb|AAC26923.1| Hypothetical protein H1
MNVLMRNVCDLVPEQLTPDVVSSRLVITRCEECSKCPQKLPSIQRMLSQISLDASIQSLLVILVKDFESARGIARLAQQDPTVKFVFLEDDDLDSPTVCELTDSNDGSSLKDADSLKSFSKTSVLFVSISFIILMVISLAWLVFYYVQRFRYAHAKDRLQRRLFNAAKKALARIPTRPVKAGDKELNSDCPVCIDPYRQGDICRQLPCRCLDTAVEGVGVREREFEIDLSRVSDVFLRVTNYVNR

SEQ ID NO: 126706 - protein, 76 aa, Heterodera glycines
  Coding regions on vcDNA: vcDNA=SeqID_53129; Strand=+; Position=1-313
YQKGRWRKNFFKIFPYILVISFCFWWGAWNSGIMRTRPIWQVKQRLLTSQKVRCRDETNQHCLPRGTRHGPPKEWI

SEQ ID NO: 126707 - protein, 83 aa, Heterodera glycines
  Coding regions on vcDNA: vcDNA=SeqID_53130; Strand=-; Position=1 -50,224-389,625-660
  Homolog annotation: Hit_ID=XP_225434.2; Match level="QueryCoverage =93%, HitCoverage=26%, E-value=7e-25, Identity=69%"; Hit description =similar to HECT type E3 ubiquitin ligase [Rattus norvegicus]
GGGGGLRLLQFATGSSSVPYEGFRALRGSDGPKRFCIERWGEGESLPRAHTCFNRLDLPPYRDKSTLKSKLMAIYESSSYAIE

SEQ ID NO: 126708 - protein, 146 aa, Heterodera glycines
  Coding regions on vcDNA: vcDNA=SeqID_53131; Strand=+; Position=1 -101,245-442,831-972
MAARPIKKANDWHLHANCAPFIAVSLRHGHYSTESAPSWLALAVGYGLVNALNSLHEKGFIHRFVTPWNFMVPMPFTMDNITKKMIIMDLSLAKRWDPNSDLCNTSPADCPAIDNVKEAFESALKRRDGDDWSIKPMPDWLEMPTE

SEQ ID NO: 126709 - protein, 437 aa, Heterodera glycines
  Coding regions on vcDNA: vcDNA=SeqID_53132; Strand=+; Position=1 -412,459-519,568-695,739-853,908-1057,1132-1338,1385-1544,1599-1681
  Homolog annotation: Hit_ID=CAE56537.1; Match level="QueryCoverage =95%, HitCoverage=42%, E-value=1e-115, Identity=49%"; Hit description= Hypothetical protein CBG24264 [Caenorhabditis briggsae]
LIHANHGSSAIDYLSDQLSRASTSAVRHGACLGLGLAALGTRNERVYEHLRDVLYQNEAVSGEAAGTAMGLVMAGSMNQMVLIVFYLVFEIDFLHLKRQAFDEMYQYILDTHHDKIQRGLRTGISMLAYGVAERAEDWIRLLYNSPYAIIRQTGVCMIALAYAGTGSASVIKRLLERVASDPNDEVKRFATIAIGFVLSNNPQQCLDYVELLTEHFNGHIRYGAAIALAISCAGTGYKEAIALLEPLLQAKENYVRQGALVSLAFVLIQQTTSTCPKVADFRKTLIKMFGAVVAQGILDAGGRNVTLSLHNQNNQNDMPSVLGIFVFLQHWHWHSMTHFISLALRPTCVIGLNKDLKMPKMDFRCNAKQSMFAYPQPIEEKRKEGMEKVETAVLSTTKKKPNLEKKAEDADGKAEEKMEVDQKSEEKSNNNIIQLKI

SEQ ID NO: 126710 - protein, 123 aa, Heterodera glycines
  Coding regions on vcDNA: vcDNA=SeqID_53133; Strand=-; Position=1 -115,391-506,576-716
MALFHRIGVKTKLGTVAVPLYQTVVRPFGIPTLSSYVTSLFTPLNGGHKMNFVERFVNFINDLYDWLYLNNVMASYEEPVIAEAFGQNFPPLKQIMRNVSLLFTNSNEVGQNIMPKMIGKIHF

SEQ ID NO: 126711 - protein, 50 aa, Heterodera glycines
  Coding regions on vcDNA: vcDNA=SeqID_53134; Strand=-; Position=1 -135,399-416
MCKMDVENSNNSPNIVGVKEWSMCKESIKDLLGPNFTTYFILNFYDLNSE

SEQ ID NO: 126712 - protein, 186 aa, Heterodera glycines
  Coding regions on vcDNA: vcDNA=SeqID_53135; Strand=-; Position=1-561
  Homolog annotation: Hit_ID=NP_033302.1; Match level="QueryCoverage =66%, HitCoverage=98%, E-value=7e-12, Identity=34%"; Hit description =simple repeat sequence-containing transcript [Mus musculus] sp|Q06666|T2_MOUSE Octapeptide-repeat protein
MTSPFIGLYSFLFIRAESIHKKKRKGEEQKAKRKRRGRGGRERGRGTEEEEEQKAKRKRRGRGGRERGRGTEEEEEQKAKRKRRGRGGRERGRGTEEEEEQKANGNKRLRGREWRNGNRTERVEGEEKREDRDDQKEERMKDQNDDIPGDKSFNLTSYKYEPSICLTKLATINLIVVLRMDTKTLG

SEQ ID NO: 126713 - protein, 55 aa, Heterodera glycines
  Coding regions on vcDNA: vcDNA=SeqID_53136; Strand=+; Position=1-208
QLPPALLHSASVHSIGKVISDQRPFRMAFRCPFEFFAFSPFIFPFALVPPLSFCA

SEQ ID NO: 126714 - protein, 207 aa, Heterodera glycines
  misc_feature (185)..(185): Xaa can be any naturally occurring amino acid
  Coding regions on vcDNA: vcDNA=SeqID_53137; Strand=-; Position=1 -250,302-616
  Homolog annotation: Hit_ID=CAB78537.1; Match level="QueryCoverage =67%, HitCoverage=16%, E-value=2e-24, Identity=44%"; Hit description =hypothetical protein [Arabidopsis thaliana] emb|CAB46053.1| hypothetical protein [Arabidopsis thaliana] pi
PGLYSHLNTGITRINKTENGKEIGANCQCSADQLPLFTIDRLALHDGSDPSKPIYLAILGRVFDVEKGRRHYGIGGTYNFFAGRDATVSFVSGDFSPSGDCSDRDATVSFVSGDFSPSGDCSDANELSESELLSVFDWVAFYEREYRLVGLLDGEYFDAKGRPTEKMQRVEKTENGKLREWKPFXGERTHGKSEAEESGRTQRTVAA

SEQ ID NO: 126715 - protein, 165 aa, Heterodera glycines
  Coding regions on vcDNA: vcDNA=SeqID_53138; Strand=+; Position=1 -147,196-546
MLNHSLNELQEALSSAAFLDDFMPLVLAFEFGATFCTENGGTTKLFKEKCLSQSLVATKTKAPFVGPTKFHRTTTTFGIVPTTEQTFGFVPLVRHVDHFGTNCTNIFFPTEVDKFLLNITITPYDIGCKKYQRPLKMNDPEGPPSEKHRYFDACNKVPTEEKCGK

SEQ ID NO: 126716 - protein, 34 aa, Heterodera glycines
  Coding regions on vcDNA: vcDNA=SeqID_53139; Strand=+; Position=1 -59,649-694
MARKQSNRRNMPKTLGRNFGAMALAPCLMTMNRK

SEQ ID NO: 126717 - protein, 100 aa, Heterodera glycines
  Coding regions on vcDNA: vcDNA=SeqID_53140; Strand=+; Position=1 -116,329-429,740-825
  Homolog annotation: Hit_ID=CAE65930.1; Match level="QueryCoverage =99%, HitCoverage=97%, E-value=9e-33, Identity=67%"; Hit description =Hypothetical protein CBG11103 [Caenorhabditis briggsae]
MAKRKSKRKAPTKAKSIVALETQFNCPFCNHENVCEVKMKYVILHVYFNTQLMQFRDRERNVGFIQCRVCMEDFQSNITALSEPIDVYSDWIDACEAANQ

SEQ ID NO: 126718 - protein, 146 aa, Heterodera glycines
  Coding regions on vcDNA: vcDNA=SeqID_53141; Strand=-; Position=1 -225,285-479,935-955
MYGIFQGPHIYEADAPPGWLEAGGAAAATCRTESGSKAAATRDEQSACGTAQRMLLLACSAAAVCAAAHAALRNASADYLPLLPLLALVSSIGIVCSVIVWLCRLRVDYGSTATDCGQYYYSQQQIGRHPLEGKWLPIGAKNFLIH

SEQ ID NO: 126719 - protein, 192 aa, Heterodera glycines
  misc_feature (20)..(20): Xaa can be any naturally occurring amino acid
  misc_feature (191)..(191): Xaa can be any naturally occurring amino acid
  Coding regions on vcDNA: vcDNA=SeqID_53142; Strand=+; Position=1 -254,679-870,1013-1146
  Homolog annotation: Hit_ID=CAE66321.1; Match level="QueryCoverage =88%, HitCoverage=46%, E-value=1e-49, Identity=62%"; Hit description =Hypothetical protein CBG11572 [Caenorhabditis briggsae]
LVAILVLHRLFLVTPLPSAXLGVILVLHRLNRLELAITLETRPYNQGSRLTAFELQQSGVPFRLIADSAAASAMRHFGVDVVLVGDQVARNGDTANKIGTYALAVLAHYHRVPFFVVTPMASVNGRIASGCEIPIEERPAQELTQWHGVPICPSDCSVWNPAFDVTPAELITKILTEKGNFSPTELTDQFXS

SEQ ID NO: 126720 - protein, 160 aa, Heterodera glycines
  Coding regions on vcDNA: vcDNA=SeqID_53143; Strand=+; Position=1-480
MVVTSPLGVGAVSLPSENVGQTALLPPSDDDVPQQNGPPLIRPSSAVDRHRPLRLDHPPISVPSAPSLPFPSARAIEAFFRRGSAIGTAGSLPSPPTRNVPPPFNLGGLFMLNGGSSTGGSDGGTGEEEKKMAETEEEEAEGEEEEQRKDEEEKRREDDE

SEQ ID NO: 126721 - protein, 157 aa, Heterodera glycines
  Coding regions on vcDNA: vcDNA=SeqID_53144; Strand=-; Position=1 -27,470-553,615-776,1108-1286
  Homolog annotation: Hit_ID=NP_498265.1; Match level="QueryCoverage =100%, HitCoverage=31%, E-value=9e-39, Identity=53%"; Hit description= aspartyl aminopeptidase (51.2 kD) (3G952) [Caenorhabditis elegans] gb|AAC46643.1| Hypothetical protein F
VNNNRNCQILKAVAAAAGCKTEHILDMDMFLYDTQPATLSGLNTLSGLNEEFISGARLDNLVSTYTAIKGLVESLEDTDAFDTDPNVRMVACFDNEEVGSRSAQGAQSHCFEWLLRRVLSSVDHPTAFECSLGRSFMVSADQAHSVHPNYAHKHEVN

SEQ ID NO: 126722 - protein, 93 aa, Heterodera glycines
  Coding regions on vcDNA: vcDNA=SeqID_53145; Strand=-; Position=1 -88,189-291,382-471
  Homolog annotation: Hit_ID=NP_498265.1; Match level="QueryCoverage =100%, HitCoverage=20%, E-value=4e-14, Identity=43%"; Hit description= aspartyl aminopeptidase (51.2 kD) (3G952) [Caenorhabditis elegans] gb|AAC46643.1| Hypothetical protein F
MTTSSSPAAFRSSALAFLQFLNKSVTPFHAVESVEAILKSANFVQKSEYDKLQIQPKDRFYVKKSETSIFAFAAGGAFKPSEAGVSIVVAHTD

SEQ ID NO: 126723 - protein, 209 aa, Heterodera glycines
  Coding regions on vcDNA: vcDNA=SeqID_53146; Strand=+; Position=1 -293,399-732
MTTKEDLKNILEAQQKQFLDLISKILPQNTAPSASSSDLFSQINSQLPQFHYDPEADETFSLWWDRFGQFVEKDGKDLTGDMKVRLILGKLSATDYLRRFECFQLSCGPSQNVMEFGAMVNARCERADMTLSKEEVKCLIFITGLSDAHKELRQECLRQMEKARKSTPPRSMTLEALLEECRSIQSLQNSAAALSGPGQIHSVQVRPQR

SEQ ID NO: 126724 - protein, 325 aa, Heterodera glycines
  Coding regions on vcDNA: vcDNA=SeqID_53147; Strand=-; Position=1 -282,513-704,743-1675
  Homolog annotation: Hit_ID=AAC72366.2; Match level="QueryCoverage =98%, HitCoverage=26%, E-value=1e-161, Identity=88%"; Hit description= guanylyl cyclase [Heterodera glycines]
LAVNANFSYTWRMCGCFQPWAVGYATQLVLTENVDALIGPPCAIAAGYVASFYNIPLYLWGATVASEFYNTTVYPTLNNVNVNSDMLALALQSVLVQFNWTEVSFVYTPDNERMVCNSVKQSLTNVLNVTNVTIVFQHQMESNVDSMKATLRNLRNRSRIVLSCFDVEVDRRNFLLSIFDTGLAADNEFVFIMGSLRNQGMLQQVSSSEDGSVKYANIWVDKNSPSDGRDSDALAATKHVIMIDLENQSSDQIDEFNRNLTTKFGTYPFLCNGSCMGDAGEQSVAIYRIKIKITKHLIVIFYPSQYARALFDTTYAYFRALNRTM

SEQ ID NO: 126725 - protein, 360 aa, Heterodera glycines
  Coding regions on vcDNA: vcDNA=SeqID_53148; Strand=+; Position=1 -125,185-317,461-544,602-738,786-920,1016-1128,1427-1549,1607-1675
  Homolog annotation: Hit_ID=AAC72366.2; Match level="QueryCoverage =92%, HitCoverage=25%, E-value=1e-154, Identity=84%"; Hit description= guanylyl cyclase [Heterodera glycines]
LAVNANFSYTWRMCGCFQPWAVGYATQLVLTENVDALIGPPCAIAAGYVASFYNAIAAGYVASFYNIPLYLWGATVASEFYNTTVYPTLNNVNVNSDMLALALQSVLVQFNWTEVSFVYTPDNERMVCNSVKQSLTNVLVCNSVKQSLTNVLNVTNVTIVFQHQMESNVDSMKATLRNLRNRSRIVLSCFDVEVDRVLSCFDVEVDRRNFLLSIFDTGLAADNEFVFIMGSLRNQGMLQQVSSSEDGSVKYANIWVDKNSPSDGRDSDALAATKHVIMIDLENQSSDQIDEFNRNLTTKFGTYPFLCNGSCMGDAGEQSPSQYARALFDTTYAYFRAPSQYARALFDTTYAYFRALNRTM

SEQ ID NO: 126726 - protein, 193 aa, Heterodera glycines
  Coding regions on vcDNA: vcDNA=SeqID_53149; Strand=-; Position=1 -113,238-339,809-1173
MDSNRSSSLRANKSEQQMECRNWARKSPLEINNNGINDFDIRWINRTDSLNMLGAGAMGCFFYGAEEETEDSGGTLRIPCADGEENNSQENSRSASSLNLSASAVSTAPLAAATTPTATAAPGAGACIVEALVECHAEAGAEELSANADDNDGPSTQQQITLTALGAPTATKPDNGDDTSTEEEETAAPDDGK

SEQ ID NO: 126727 - protein, 263 aa, Heterodera glycines
  Coding regions on vcDNA: vcDNA=SeqID_53150; Strand=+; Position=1-789
  Homolog annotation: Hit_ID=AAH79708.1; Match level="QueryCoverage =62%, HitCoverage=21%, E-value=2e-17, Identity=35%"; Hit description =MGC81969 protein [Xenopus laevis]
TQLSDFPIAGTQPTSISLDSIHQHSNHWDSIHQHSNQRDSTHQHSNHWDSIHQHSIQRDSTHQHSIQRDSTHQHFNLWDSNLRHSKQWTQISGILNTGTQPTNFNGTQSTSISITGTQSTNIPINGTQSTSISITGTQSTNIPIIGTQPTSIPITGTQFSYISITGTQSTNIPITGTQFSYISITGTQSTNIPFNGTQPTSIPITGTQPTNIPITGTQSTNIPFNGTQPTNIPFNGTQPTNISISGTQPTNFNGTQSTSISIT

SEQ ID NO: 126728 - protein, 68 aa, Heterodera glycines
  Coding regions on vcDNA: vcDNA=SeqID_53151; Strand=-; Position=1-207
IRRGTTVIRRGTTVIRRDTTVIRRGTKVTKRGTTVIKRGTKVIRRGTSTKAIRKGTTVIKRGTKVIRR

SEQ ID NO: 126729 - protein, 76 aa, Heterodera glycines
  Coding regions on vcDNA: vcDNA=SeqID_53152; Strand=+; Position=1 -123,178-285
MTSCAILKIKDIGNASKPNEEPLAQIVHWYWDKNGAQQINDTHTLNKGSEINCACANASSIVIRILKKREKKPDEK

SEQ ID NO: 126730 - protein, 51 aa, Heterodera glycines
  Coding regions on vcDNA: vcDNA=SeqID_53153; Strand=+; Position=1 -30,391-516
MLLKLADYFQNYFLHFDVNKFRAFFNANHEQFLPVISKEFLYALSVRLSEQ

SEQ ID NO: 126731 - protein, 34 aa, Heterodera glycines
  Coding regions on vcDNA: vcDNA=SeqID_53154; Strand=-; Position=1 -50,483-537
MTLVANRHKTRPSIAKLKYLAISLFGTGMGLIEK

SEQ ID NO: 126732 - protein, 70 aa, Heterodera glycines
  Coding regions on vcDNA: vcDNA=SeqID_53155; Strand=-; Position=1-213
MTILKGQGQTISTVGIDLERDVFSHGQLYTAFSRATDGNNVRVYAPRRETDGQGGVKVLNIVATKMLKLQ

SEQ ID NO: 126733 - protein, 229 aa, Heterodera glycines
  Coding regions on vcDNA: vcDNA=SeqID_53156; Strand=-; Position=1 -23,1550-2226
  Homolog annotation: Hit_ID=NP_913627.1; Match level="QueryCoverage =92%, HitCoverage=14%, E-value=3e-31, Identity=37%"; Hit description =putative helicase [Oryza sativa (japonica cultivar-group)]
NLKLLAFLLNRLILAPHIDTCDEINEIMMANVPGQVREYLSSDKPLDERPLDIDEIESEVAALNRRTDSGMPPHRLRLKVGSVVVLLINKSDKEGLINGTRIVLEELGDDRLVGRVINSNAVGGQVKLNEHAMSTRTKRLAIKYERLQFPIKPAFAMTILKGQGQTISTVGIDLERDVFSHGQLYTAFSRATDGNNVRVRSQKGDRCTRQSQSAEYCCNENAQFAIKQT

SEQ ID NO: 126734 - protein, 255 aa, Heterodera glycines
  Coding regions on vcDNA: vcDNA=SeqID_53157; Strand=-; Position=1 -53,108-405,449-864
MQQNRRPSNSFWPRRSTGANNCPQCSIEGTKGTKKCANHCRSSPSYGNGHCVPLPTVIVLETVQHPSKMPSELHFMVWQQQGGALQKGLNTTMDTFTQKELDHGFVRFEIDEAKGVPDTKMGFHFLLNDGRHQLGPEFFLLQFDEILPSKKEDGTMPTQSTLSSTPTIHLPVPSVAIGPKIERNAKLGTAPGVPAVIGPNLLKATGGGKIPVEKVIFHLTKQPMHGRLVNGFPRTARDCCPLLFSCSTAPWGGWS

SEQ ID NO: 126735 - protein, 434 aa, Heterodera glycines
  Coding regions on vcDNA: vcDNA=SeqID_53158; Strand=+; Position=1-1305
MPSKQEKLRKKEQERYQRRTEKSVSRDNSPVPDGSADGNGEASASLQGTSTPSLSALQISTPASSIGSKKRGRPLRAGAKPILATQETVSAIDTPRAAFTQSDQGSPCKKIGKVAECDQPTFANEAIASTPVSTQSRRGRPVKQLGGHAGKGRGKTNESMSKCSEMDQSVENALSPAPSHIVFEKIDFSTVQINFATSRNFACKIWRWAAIGLYERDGETALGPRSGPRFIETCWNRPNEWLNDSFIVAYLAYIASISQRKTVVVDSLASRTDVSRFSNVKNYTFGYDPNAVPEVVLMPLHFPNHWTLIVYDVAHGAYFVDSLHMSSLSDERMALIQSIIAEIVPGSPSLAVEYVQQLTKQNDGNSCGYFVCLYAESWLMNNCTFVLPDLNINYEKKRILWHINELYGSDIVPFHPRGRVFHIFRSCVSSQWGM

SEQ ID NO: 126736 - protein, 104 aa, Heterodera glycines
  Coding regions on vcDNA: vcDNA=SeqID_53159; Strand=+; Position=1 -53,169-374,879-934
MIFGQTQTNWRSCESLSDRSDGGRFSMRGTHNQSTKGQPKASAAKAVVQQQSPEMVAWLRRKEYDPRKAAADQSQREAQQRQQQCVEFAPTDGGRIDAKVPQVD

SEQ ID NO: 126737 - protein, 132 aa, Heterodera glycines
  Coding regions on vcDNA: vcDNA=SeqID_53160; Strand=-; Position=1-540
RLLLSPSDAFPPKFCPFDRSFRPRFCPCDYKYNHSLFASDKTSSSNWLQWALFICPHRRRKRRRIRNYRRRGQRRTEPFFEGKPMTDEQSMGRKQTTVKMVSLYKIVKLKNRKSHESFKIFLLISKLCGEMV

SEQ ID NO: 126738 - protein, 188 aa, Heterodera glycines
  Coding regions on vcDNA: vcDNA=SeqID_53161; Strand=-; Position=1 -82,377-861
MFKSQFHHLALAFFCATVNGFELLCQKDLVSTQKVLLDSALSVNFSIEDKFFENWLHEYATEVFCCEKFGENFDDFDFDINHLLEDAQKLRNSFCLELNKSKHLEVAAKNVAHLTQKLTNELKKDQKIRQKIQNTVKNNGKEGDKKLELSEIRKMKKEFEDNFSSENMKKLTNGFYFSLNELFNSMES

SEQ ID NO: 126739 - protein, 37 aa, Heterodera glycines
  Coding regions on vcDNA: vcDNA=SeqID_53162; Strand=+; Position=1-111
CKAGTGNGLYPSPPPHFISPIGLLPSRGALKRQRITS

SEQ ID NO: 126740 - protein, 383 aa, Heterodera glycines
  Coding regions on vcDNA: vcDNA=SeqID_53163; Strand=+; Position=1 -164,681-868,1358-1623,2061-2315,2708-2986
  Homolog annotation: Hit_ID=NP_650644.1; Match level="QueryCoverage =78%, HitCoverage=39%, E-value=4e-12, Identity=26%"; Hit description =CG7643-PA [Drosophila melanogaster] gb|AAF55450.1| CG7643-PA [Drosophila melanogaster] gb|AAQ22555.1| LD0
MDGKPLIKCVAIKSVILEFDNATPEIIQGFEKEEHFLMMFRNNAKIKHIVHLHYMKKDYAKNRLIIILELGRHDLTKRIKLMRDQWKMYWGSTAVSIDRQIIKVLRQVLAAVNEMHGKTIHLDFKADNLLFVEEFNASGRKIGEVLKVIDFGGSEIIDPLAEKSNEASAVANVCRVRTSMWSDDRYSSPEQNVTCAEQSTDTIEYTVSTKSDIWSIGVMLVEFLLMTPHFPEIDPIAERGSDDANNIYNIVIGINHFHYSPADKTNAVNKQATDYMHKIQKLFPMLSSIIKACLVINPKQRPTAKGILQFLDGKCQFGEFENEKADHYQFDGKQYGQELERRKKRSVSSMLDGQKFSLFSHEILESPPEIKFCDIGNLNGTNN

SEQ ID NO: 126741 - protein, 252 aa, Heterodera glycines
  Coding regions on vcDNA: vcDNA=SeqID_53164; Strand=-; Position=1 -459,582-881
  Homolog annotation: Hit_ID=NP_827559.1; Match level="QueryCoverage =91%, HitCoverage=81%, E-value=2e-52, Identity=48%"; Hit description =putative secreted lyase [Streptomyces avermitilis MA-4680] dbj|BAC74094.1| putative secreted lyase [Strep
MHSFLVLTILFANLATNAFGQQWPKATSEETVKATIKVSGGVKDFGFKRLTASSALGSGDQSEGQKALIRAEKNAVIKNLIIGQNGADGIHCYDGCTLQNVWWEKVGEDAATFRSSSGCKEYSFTVTGGGVKNAKDKVFQMNGGGTLTIKNFVAEGIGKLARACGNCKTQCQKRKFVLENIKVTGLKTLLCGLNENYGDVATIKNVQITGSKKVCAEFQGNNQQKEPPMLRSFDVGSKGDGKNCIISGTTSG

SEQ ID NO: 126742 - protein, 70 aa, Heterodera glycines
  Coding regions on vcDNA: vcDNA=SeqID_53165; Strand=-; Position=1-214
ASALLIIVAASLVLPQCAAVGGMAELKALTGDAPYLGTGNQEQAPEFFGEALSRQYYQNPAYRYNDWYGT

SEQ ID NO: 126743 - protein, 76 aa, Heterodera glycines
  Coding regions on vcDNA: vcDNA=SeqID_53166; Strand=-; Position=1 -47,549-631,883-969,1803-1816
MEIPLPLEPRRRRLFEHFTSGKIALNDDQLNKLSQDSFGFSATQILATVNRAGAQAILDRVPLTFSYFDKALVKIC

SEQ ID NO: 126744 - protein, 99 aa, Heterodera glycines
  Coding regions on vcDNA: vcDNA=SeqID_53167; Strand=-; Position=1 -36,658-921
MAKSDKSRKMTEWKCNCSETIHQNEKGGNVRGLVSDCCCKIKTQNDGPAGHHTVKGQQLLAKQCWDTVTVTGREKPQNVLNMAYLKNYSIIFSIEFKTG

SEQ ID NO: 126745 - protein, 182 aa, Heterodera glycines
  Coding regions on vcDNA: vcDNA=SeqID_53168; Strand=-; Position=1 -226,283-361,512-755
  Homolog annotation: Hit_ID=AAF64254.1; Match level="QueryCoverage =55%, HitCoverage=23%, E-value=2e-15, Identity=44%"; Hit description =novel immunogenic protein NIP-2 [Onchocerca volvulus]
MANVICHCFGAALAQAQKLSTDSAFLDKEDKVLKKPIVVKGVQLVDGKMDFAIVQLNTANLANRKGVKNMVWIKPGLPFYKTKPMHENLKAIEGLNSETVRKKALIPLLQMWYERLPMIIAAVSIPAFCTSDYYPLHWYGTNGCKHHRVLKGHEQSALLIRDRELTGYEYNLMGIDSIPEED

SEQ ID NO: 126746 - protein, 74 aa, Heterodera glycines
  Coding regions on vcDNA: vcDNA=SeqID_53169; Strand=-; Position=1-222
MSIYHNNHHLTEDSQKYRFLIDKNGEIWTVLLLFMRIDPSLAGVFSFIASNELGYDENSIFMRIDEAANQNIAQ

SEQ ID NO: 126747 - protein, 136 aa, Heterodera glycines
  Coding regions on vcDNA: vcDNA=SeqID_53170; Strand=-; Position=1 -67,136-356,485-607
MDSLEFTKASMDMNCSHNRSPLGTQYLNVDIDIEAGQETSSTDGIIGLESIEYAESESSVALIEEDYMDVDVEIVDFEKEEDTGAILSTVVPPKYQNIVERVRIQPKMDAISRLLEDEVIAEAEEGGDMGNKHPIN

SEQ ID NO: 126748 - protein, 59 aa, Heterodera glycines
  Coding regions on vcDNA: vcDNA=SeqID_53171; Strand=+; Position=1 -132,772-819
MASDGQAMAKWLFTPLPDDVPKVFNCGLKEYDESWPLKIEAFKAINGNAKSTWQKFKHG

SEQ ID NO: 126749 - protein, 307 aa, Heterodera glycines
  Coding regions on vcDNA: vcDNA=SeqID_53172; Strand=+; Position=1 -153,264-390,435-553,1060-1202,1249-1388,1454-1568,1960-2086
  Homolog annotation: Hit_ID=NP_508085.2; Match level="QueryCoverage =78%, HitCoverage=32%, E-value=8e-50, Identity=42%"; Hit description =glutamate carboxypeptidase ii homolog family member (85.5 kD) (XA925) [Caenorhabditis elegans] gb|AAU0554
WSRWSGALPVPYRLTGSLLVRLDVWTRTEYRPIRNFVAVMRGREEPDRWVMGSIDPGTGTSTMMEMARVLSKYSAMTGWKPRRTIAFCQWDAEEFGLIGSTEWVEQNLHLIQKRAIAYVNVDNLNGNNSLVVKSVPLLYRLIAEAASKVEQPVKSELKSGRNTLLDSWQFHNPRPTLPGDRSVPHILPPHSGSDFQPFIAFAGVPVADLRMESAPQYSYMLYHTAYEVPWLNDNFVDPEGDASVAMGQLWLEIARNLADNMVKADQMIGIDSAMDVQIYNERIGFLNDSIRRFQEKAVKFQRLIHVL

SEQ ID NO: 126750 - protein, 125 aa, Heterodera glycines
  Coding regions on vcDNA: vcDNA=SeqID_53173; Strand=+; Position=1-378
  Homolog annotation: Hit_ID=NP_507834.1; Match level="QueryCoverage =92%, HitCoverage=29%, E-value=2e-11, Identity=28%"; Hit description =predicted CDS, putative protein family member, with at least 4 transmembrane domains (5U247) [Caenorhabdi
MEFFFFDPVKFVRFYNCSSYDVSMVQLDRRQKPLVGALTVALGTILTVFVPDLAVPTFPFKCLYLPCLFALSRPKLIRQSCYQLMFFLGLVNVTELCTTAICTGAFAIFGTVFCSQPTFMFWHDG

SEQ ID NO: 126751 - protein, 177 aa, Heterodera glycines
  Coding regions on vcDNA: vcDNA=SeqID_53174; Strand=-; Position=1 -81,142-201,596-656,718-802,1074-1255,1452-1495
  Homolog annotation: Hit_ID=BAA96354.1; Match level="QueryCoverage =99%, HitCoverage=99%, E-value=1e-62, Identity=66%"; Hit description =phosphatidyl-ethanolamine-binding protein [Dirofilaria immitis]
MSEIASKFSAAEIVPQILPEAPQQKLNVFDGIPVEPGKEFSVRNLKNAPRVTLNVDPESTFSLVMIDPDNLSRKNPDNLSRKNPSVAEWLHWLVVNIASNILEGINGGQHQQPYGSPAPQPRTGEHRYVIVLFEHQGKRLAVPKFNTRAKFSLKQFIEKHKLGAPLAGNYFIAKNDQ

SEQ ID NO: 126752 - protein, 21 aa, Heterodera glycines
  Coding regions on vcDNA: vcDNA=SeqID_53175; Strand=+; Position=1 -54,576-587
MRTRPIWQVKQRLLTSQKKGF

SEQ ID NO: 126753 - protein, 198 aa, Heterodera glycines
  Coding regions on vcDNA: vcDNA=SeqID_53176; Strand=+; Position=1 -169,262-483,527-732
MATIDLFSGFPFFTPELCHRLKEEVPKKVATVAVDIFSPTPTPTLALNSAIQQQQNTSALAPSPVRFVFTSAPSSVPSSSVPFPMVRPPLTLPNCLWPFMNCQAFGWTAEAEGQKQKSEEKKHWGEEEEKGQKVRGERKTDQSAGRTDRREEASETEPGTPDNPGEEIEVDVESVEKTSDETQREGAKEEQDSGVSWK

SEQ ID NO: 126754 - protein, 316 aa, Heterodera glycines
  Coding regions on vcDNA: vcDNA=SeqID_53177; Strand=+; Position=1-951
  Homolog annotation: Hit_ID=NP_921821.1; Match level="QueryCoverage =95%, HitCoverage=20%, E-value=2e-46, Identity=36%"; Hit description =putative helicase [Oryza sativa (japonica cultivar-group)] gb|AAP54108.1| putative helicase [Oryza sativa
MPIYCTFDNKNRKWKWPRKGPHKVIGRIYTINPKNKELYYLRYLLLNKHAKSFNDLKVVNGFKYNTYAEACLALGLTRDDLEWDKCLNEASQFKFPKGLRSLFANILINCEPKNPKLLWEKYKDELSYDLKKLYTQNDAYQMALLLIEQNLSNHEKSLKDFEGMPKINETIKNISEYQIINPKDELNLALNKFSLMNKEQKEIFENIKTIFEHPTENQTKCFYIDGPGGTGKSFVQTAIFHLARGFNKKVTNMAFSGIAATVLKNGRTVHNRFKLPLDLNGNSSSLIENNSKEANEIRETDVFILDEAPMAPKYVI

SEQ ID NO: 126755 - protein, 116 aa, Heterodera glycines
  Coding regions on vcDNA: vcDNA=SeqID_53178; Strand=-; Position=1 -67,141-424
MMYRNAKDCAFYTCYKSRNDRDKGYIKGVKGPFDWYIVSKMQKPIIVNIIALANLGTGIKLNSLTITECEFKYNPRKFNAAVIKCTRPIKATALLWGSGKMICLGTKSLIDCENAI

SEQ ID NO: 126756 - protein, 101 aa, Heterodera glycines
  Coding regions on vcDNA: vcDNA=SeqID_53179; Strand=+; Position=1-306
MAQPYGMGMPSTMACQNWAPIAYHQPDHYHQQQYYGEFWHHQQNPGICATNSNLSQLIWPTTAMAPTVPSASTTTFSGQMPMVKQCKRRATLASVSTSAVP

SEQ ID NO: 126757 - protein, 87 aa, Heterodera glycines
  Coding regions on vcDNA: vcDNA=SeqID_53180; Strand=-; Position=1 -189,224-298
MHQRRPPRKLNKCMLANNNLDEFRTEVMRRSAIVEEERDEFEQTLDQIMDTYSPAVRFIEPFTGCVTCRLPISNIFGLRAPIECQNF

SEQ ID NO: 126758 - protein, 221 aa, Heterodera glycines
  misc_feature (12)..(12): Xaa can be any naturally occurring amino acid
  misc_feature (220)..(220): Xaa can be any naturally occurring amino acid
  Coding regions on vcDNA: vcDNA=SeqID_53181; Strand=-; Position=1 -259,1013-1143,1453-1595,1767-1899
  Homolog annotation: Hit_ID=CAC83611.1; Match level="QueryCoverage =98%, HitCoverage=78%, E-value=2e-78, Identity=66%"; Hit description =EXPB1 protein [Globodera rostochiensis]
YSADSSFTNSNXTSISAKWGFDAVSGASNQYTLSNNADIAPGATNSNGGLNIQGTNPNGPPATPTLQLIEAKYYSNVIGGGHQSICMGCLASSGTSGPIDSYIGKSISNSVFTFYGGGGRGACGLDSGVPKMSAAGSGKLFKSDGQWKDACRADKQYMLDDPICKDICIKIDYNGKSLTVPINNKCPECDVNHVDLTIDAFNYLEPRGGEVGKATGQRIXC

SEQ ID NO: 126759 - protein, 391 aa, Heterodera glycines
  Coding regions on vcDNA: vcDNA=SeqID_53182; Strand=-; Position=1 -145,565-798,1206-1334,1415-1523,1882-2037,2581-2734,3299-3360,3439 -3520,3575-3679
MSKIVFACTLQIALFFVWTQKNGAPNPSRLSSSEDGLLVDGMHKLFKNDSSNAKQQNRDKHVNANDDDDDNDNDDDQHRPPIECIVCADSFTNDQLCFCDVAADHADASSSSSSSSSSTAACRQAQEKHAFCIECLHEYTKAAHEMVPFAPSGLGLKCMALECENPITWKKIKELLPNDNHRSIETLENHCDFMRMTIAGNCCKKYCPCCNCAIEMDNSVDKSRPFQCPKCGKDLCRKCNVPWNNKHKKATFCEIQNNCGEEKRIICEDNATKCQLCGKCTLYGNVKDPSSSTNMDIPSTSTKGRKGKEKAAEVISDDLAQKLKEMRLKMEESLSEVTLHQCACRNEYFIKEEGPTYVNCPACEKLYCFCCRKSKVTSFKDHFCGCKKILN

SEQ ID NO: 126760 - protein, 270 aa, Heterodera glycines
  misc_feature (259)..(259): Xaa can be any naturally occurring amino acid
  Coding regions on vcDNA: vcDNA=SeqID_53183; Strand=+; Position=1 -49,100-228,348-401,443-518,636-679,777-986,1197-1345,1431-1492
  Homolog annotation: Hit_ID=CAE68995.1; Match level="QueryCoverage =98%, HitCoverage=66%, E-value=4e-70, Identity=47%"; Hit description =Hypothetical protein CBG14982 [Caenorhabditis briggsae]
SGFVFNGFANWTTMDGRHSYQGRHSYQRMFGDQQDGEFLNGARIDWVLSQEQVDRVMAFTLPLHTCINYPLDERFLEYSHDYVHYFISGDMQVHYFISGDMQERFSSSNDPIFFMHHGFIDWIWEEWRQTKQNRLQRERDYPRDDADCMPEWHFSYAYMPLLQPLRNMDALSNNYTDHMYEYAPRPSCAKSGKSSECGNTELFCLVRPNSPGPPVCSSKVKPGGNCKGFEEWEICYKGKCVGGRCSKQRKRLTDGTKLXAFNPRILPFAS

SEQ ID NO: 126761 - protein, 31 aa, Heterodera glycines
  Coding regions on vcDNA: vcDNA=SeqID_53184; Strand=+; Position=1-93
MGSKNPTQNYSTDYREAIPEGFGLPINLGAS

SEQ ID NO: 126762 - protein, 41 aa, Heterodera glycines
  Coding regions on vcDNA: vcDNA=SeqID_53185; Strand=-; Position=1-125
MYNSPPPPIRWQMLIYACVLNQLDIALTVAASLSVQSPFTN

SEQ ID NO: 126763 - protein, 175 aa, Heterodera glycines
  Coding regions on vcDNA: vcDNA=SeqID_53186; Strand=-; Position=1 -72,124-174,619-803,1081-1184,1311-1427
  Homolog annotation: Hit_ID=NP_500405.1; Match level="QueryCoverage =77%, HitCoverage=16%, E-value=5e-34, Identity=48%"; Hit description =helicase, C-terminal and Helicase-associated region (4E499) [Caenorhabditis elegans]
TEAVPTRTAHLPKSDGNPRKIGRKPNHNHCGGHGLRQKHTALAQRVACELLKQFDSHIAYQTRFDKTKTSATRMLFLTEGVLLRQMVDDPGLQRYDVVILDELVLMSATINIDLFQGYFPEAPVISVPGRLYPIELRYMPPLIREVDTSKRAVRIDPGPFVNILQLIDKKYPSTE

SEQ ID NO: 126764 - protein, 575 aa, Heterodera glycines
  Coding regions on vcDNA: vcDNA=SeqID_53187; Strand=+; Position=1 -405,451-1159,1203-1545,1592-1859
  Homolog annotation: Hit_ID=NP_001004509.1; Match level="QueryCoverage= 82%, HitCoverage=31%, E-value=3e-53, Identity=30%"; Hit description =si:busm1-180o5.3 [Danio rerio] emb|CAD60788.1| novel protein similar to DNA polymerases [Danio rerio]
MESYRFVAFDLETMQHLPVDPRVPERRNHEPNFIAAKVICPMCIENGSWKQGTAGCWVCGPHRTVAFCQRPFNGTSVDKQVVTDNPMQAFVGWLINDLPKKANTYAYSHFGGRFDMVITFRELFRRGFNPEMIRRGNKMYEMKLKAQKNKNPNIIFRDSFNLMPCALGQLVPAYGLDVEEKPFFPHMANRPDNYGREIFPTPEDYLAQGMMPEKRRQFDQWYEQHRREPFLLDEALASYCTNDVEILMAALVAFRREFLEITKRQEYVDGVDNRENHDGIDVLKQCMTIASACMKHFRINHLPANHLAIVPERGYDNAQNQSLLALRFFKWYAEKHGVQLQTAHTAGGEKRVANYSLDGWIESEKRGIEVNGCVWHGCRKCFPEDNMLLPNGKSAGEVRERDAKRLEFLRNQVGRVDVYWECEIERMLTTDPEMRQAFAGYVDDGPLEIRAAFMGGRTGPLKLYHKAREGEKISYFDFTSLYPFINFTTRYPVGHPKVHVLNEDVEWKCAADNPYDLSLLKVWVVPPRRCDVPVLPVKVDERLCFPLCFKCAKDYPTGGVDNEYNCRHTDEQRGW

SEQ ID NO: 126765 - protein, 593 aa, Heterodera glycines
  Coding regions on vcDNA: vcDNA=SeqID_53188; Strand=+; Position=1-1782
  Homolog annotation: Hit_ID=NP_510671.1; Match level="QueryCoverage =95%, HitCoverage=57%, E-value=2e-80, Identity=32%"; Hit description =predicted CDS, endonuclease/exonuclease/phosphatase family and RNA -directed DNA polymerase (XR69) [Caenor
MKKQLKQFRNEKDSKIISRGQNSVNKFIRNKLSKFFEIPTLIDNAGNMFSSNVQKCKILAEIFQKSFLRKSIVNGPQTQSTQNKTKLFDIELNAGIIWNILRRLPRSNSTSPDNIPYILLKNCAEPITKILADIFRLILDSGQIPEIWRTSLVVPIFKKGEKTDPLNYRPVSLTSTVCRVFERILSSKILEFLNSTRFFDKEQFGFLKNRSTTTQILKTMDDIYNSLQKDQQIDIIYIDFVKAFDSVPIDLLLQKIKKIGIEGKIQNFLTNFLKNRRFKVKIGEELSESFRIFSGVPQGSVLGPLLFLIFINDLPSFITNEAASVGIKMYADDVKLYYAHENDDHSNQLDKEIEALEKWSKINGLEISTEKCFVLYLGKNNMKKEYFINSKKISESDNVRDLGIIIESKLNFSEHISKIIRNAYLRSFQILRVLKSREIKTLTAAYKTFVRPQLEYATEVWNPNLKKDIDKIERVQKFFTRKAFRKCGFVYKKYMERLKITSLHKLEERRKINDLTTAFKIIKGFTSLDTGKSFVFSERSRRPLLLRVKRHTAKTQNNFFHRIVRNWNNLPVLAVQINKAKEFRGLLKAMSSE

SEQ ID NO: 126766 - protein, 128 aa, Heterodera glycines
  Coding regions on vcDNA: vcDNA=SeqID_53189; Strand=+; Position=1-387
MICTLLRLYRNVLEFGPLYVNHAIPRMLSVWLDLAPKCAIAEAIASGTGTTVGGTARTSASKRGGKAAAAAAAAAAVATQPHDPNREMRDAFKRLDRAYFFSSYSQMISRITHSDAATYALLKVQRGK

SEQ ID NO: 126767 - protein, 136 aa, Heterodera glycines
  Coding regions on vcDNA: vcDNA=SeqID_53190; Strand=+; Position=1 -44,142-234,287-416,854-997
  Homolog annotation: Hit_ID=XP_516792.1; Match level="QueryCoverage =88%, HitCoverage=5%, E-value=2e-24, Identity=41%"; Hit description =PREDICTED: similar to ataxia telangiectasia and Rad3 related protein; Seckel syndrome; Rad3 related protei
MRKKGPLMTPTELQRLLGDQTSRGDRLKAFREVCARHPLAMAQWIRTTFLDACSWYNARLAFTRTAATMSMVGFLLGLGDRHGENMLLDIVPFRLTRNMVDGFGATGVEGTFRKSCEKALKVGTWMDGFIRQSLSN

SEQ ID NO: 126768 - protein, 102 aa, Heterodera glycines
  Coding regions on vcDNA: vcDNA=SeqID_53191; Strand=-; Position=1-598
  Homolog annotation: Hit_ID=AAR82784.1; Match level="QueryCoverage =79%, HitCoverage=7%, E-value=5e-22, Identity=54%"; Hit description =LD17186p [Drosophila melanogaster]
KPFQDLIHVDFNILFDKGEYLKVPEIVPFRLTRNMVDGFGATGVEGTFRKSCEKALKVMRAESRMLRTVLHAFAHDPLLEWTTTEARNQQYRQVRLVARAVY

SEQ ID NO: 126769 - protein, 151 aa, Heterodera glycines
  Coding regions on vcDNA: vcDNA=SeqID_53192; Strand=+; Position=1 -50,525-690,994-1233
MYQICIKTFHGNSVLKVQQRHADEMRSELQMEQNEPEADNGRAADTLSAFGDDEQHLEILNIVGTVEAFSVEHLNAIHAHIMEGHPSAGEIRTVDVNIIDRDGNVIYRPPPHSHVLQLMSDFCANLNEAMKSVKKRRMEALAVAGGPTTNW

SEQ ID NO: 126770 - protein, 32 aa, Heterodera glycines
  Coding regions on vcDNA: vcDNA=SeqID_53193; Strand=+; Position=1 -39,81-140
MPTFIFFKNGQKLQTIEGNNYESLRKTVENNK

SEQ ID NO: 126771 - protein, 128 aa, Heterodera glycines
  Coding regions on vcDNA: vcDNA=SeqID_53194; Strand=-; Position=1 -154,249-481
MAETANLRETTIFSRMVSMRMRRRKPREWTNQSKGRPMSERRPNNGSVSRRGHSLDGKPSKNGAECPLAADECAAEENGAATEEIRIRRKDLNFEEPLLLAVKEGGRWTSDKSIEPPTSITLMALISR

SEQ ID NO: 126772 - protein, 492 aa, Heterodera glycines
  Coding regions on vcDNA: vcDNA=SeqID_53195; Strand=-; Position=1 -162,207-374,485-610,664-816,858-1126,1176-1626
  Homolog annotation: Hit_ID=NP_510336.2; Match level="QueryCoverage =89%, HitCoverage=30%, E-value=7e-76, Identity=36%"; Hit description =tbc1 domain family member 2 (XO622) [Caenorhabditis elegans] emb|CAB01733.2| Hypothetical protein C31E10.
LWDCFLYEGPKVLFRFAIALLGFHEEELLAHSDTISVIKMLKAAVRLTFDVDGLIKFAFEQIKFAFEQLSPFPSKAYLRQRQSLYLRVLQEQLFKRQQLRQLLNITVNCVATINWVNVVVFSQFVPGRGYVCAGNQKRGKLSMIQLHQETASLDTLELEFDCRLISMVLFNSFDCRLISMVLFNSEMAFVSLLSGYVIALHLNESGEAEILWELKLNDVALKLVNCPQRLYSVNCPQRLYSCLANGTLAVLENAFERMPSALDLYHIPIAAAPITDALLDDDKLYLAVACKIVVLNRSTLSTVASVYVASASVGSQVPMFEKIRNLAPSPFGIWLLTAHSSLIQKIRNLAPSPFGIWLLTAHSSLIQLWRDGQCEMLFDIRYDHSHRSLRLALSADPTDFPFRKPSFDEDDDKLEQVELCSILFHLDELWVGTVDGRSFFPNSSVVFPPPVHPFRLFNALSRPCSRQTIANRPKRVLPSVDSTRKASLSSTW

SEQ ID NO: 126773 - protein, 16 aa, Heterodera glycines
  Coding regions on vcDNA: vcDNA=SeqID_53196; Strand=-; Position=1-49
EAIPEGFGLPINLGAS

SEQ ID NO: 126774 - protein, 371 aa, Heterodera glycines
  Coding regions on vcDNA: vcDNA=SeqID_53197; Strand=+; Position=1-1118
  Homolog annotation: Hit_ID=NP_036922.2; Match level="QueryCoverage =98%, HitCoverage=76%, E-value=1e-40, Identity=32%"; Hit description =dentin sialophosphoprotein [Rattus norvegicus] gb|AAL79813.1| sialoprotein-phosphophoryn DSP-PP523 [Rattu
LNPLHTDALDSSNVDDSSVTDDKSSDVDDSSVTDDKPSDVDNSSVTDDKSSNVDDCSVTDDKSSNVDDCSVTDDKSSNVDDSSVTDDKSSNVDDCSVTDDKSSNVDDCSVTDDKSSNVDDSSVTDDKSSNVDDSSVTDDKSSDVDDSSVTDDKSSNVDDCSVTDDKSSNVDDCSVTDDKPSDVDDSSVTDDKPSDVDNSSVTDDKSSNVDDCSVTDDKSSNVDDSSVTDDKSSNVDDCSVTDDKPSDVDDSSVTDDKPSDVDNSSVTDDKSSNVDDCSVTDDKSSNVDDCSVTDDKSSNVDDSSVTDDKSSNVDDCSVTDDKSSNVDDSSVTDDKSSNVDESSVTDDKSSNVDDCSVTDDKPFNVDRLLRE

SEQ ID NO: 126775 - protein, 263 aa, Heterodera glycines
  Coding regions on vcDNA: vcDNA=SeqID_53198; Strand=+; Position=1 -93,141-225,688-1049,1256-1376,1423-1550
  Homolog annotation: Hit_ID=NP_507780.1; Match level="QueryCoverage =71%, HitCoverage=12%, E-value=1e-13, Identity=30%"; Hit description =predicted CDS, DNA polymerase type B, organellar and viral family member (5T899) [Caenorhabditis elegans]
MACGDGDQPEEWRMEKPNNKSEGLQQPLPIPQHVHQVPGWPPNRGAIRQESGLALPGTYSSGYPAPCREVGIDEEERERRQQDYINKPWEGNKVCLDANNITPNPGLRYLSKLCLNSLWGRFALRNRLTKTEIVECHAELAKLLNNTKIEISSIDQLTEKFWMVCYKACDEDVVEHGTSNDTDSIFYDFKSELSDPLPGGQQLGELTDEYPNHTIMEFVCAGPKAYGLRNNATGEDEYKVKLRGITLDSDACERMTFEKMKDM

SEQ ID NO: 126776 - protein, 125 aa, Heterodera glycines
  Coding regions on vcDNA: vcDNA=SeqID_53199; Strand=-; Position=1-378
MPYYVLMLCLMFHTVFMEFILPKFSIFYKTEMNQIVPILKNEINKMFRNKDWDYATFDCMHTIEWNLLRIDLAKMGQTQKEMEKLLKEWRILYNNWVLNKSEMNRPNFAKIMQKIVQNLEMMSIK

SEQ ID NO: 126777 - protein, 230 aa, Heterodera glycines
  Coding regions on vcDNA: vcDNA=SeqID_53200; Strand=-; Position=1 -164,275-803
MPTKVNSQLFKLLFSLAIRLSAQMESERLAEKYVNLFISVNKCISISADDITDYCLLQTQIKINQKIIEIELPNWKDNLLFARSLGMLQREQIKSGKLILIFKSFLNKENFDFLCLLSDYSPTIYEIIQMLKIVGEANNAHFWVEPSAPQIFLRILNFSMSTEISDDKVKVPIRKSEFCVLVNFSNDLLERIMKNRKNQNILFNGVEPIEVTISKFELIKQELCSDTEHS

SEQ ID NO: 126778 - protein, 42 aa, Heterodera glycines
  Coding regions on vcDNA: vcDNA=SeqID_53201; Strand=+; Position=1 -37,563-654
MSWPDLVNNNLIAGCCARLWTSFRRRKVRKSAKFGVGQWAPT

SEQ ID NO: 126779 - protein, 74 aa, Heterodera glycines
  Coding regions on vcDNA: vcDNA=SeqID_53202; Strand=-; Position=1 -70,211-365
MHQSLPLFLPLFIFFVYTTDCLNGLNCQQGAEIKPNGQKFNNTDPKCPQKGAKYCVTSICTTGQPARPIKWGGE

SEQ ID NO: 126780 - protein, 107 aa, Heterodera glycines
  Coding regions on vcDNA: vcDNA=SeqID_53203; Strand=-; Position=1 -33,754-1044
MANPIATKKQKGAFNCRHPSIFHFIDVLRREQKTTDVKYASFIAGEEPPPKKRKFLATDERILNLVRLYVPMNAGNINHDHNYHNRNQFHIILEFLRGISRNYRMNP

SEQ ID NO: 126781 - protein, 119 aa, Heterodera glycines
  Coding regions on vcDNA: vcDNA=SeqID_53204; Strand=+; Position=1-377
PNCNQKTKSKIVLRRPPLHFAKMSSDGMTKFWRCEFKNSTDKCNGRIWTDLHDQFIRLATPHTCPADASRVDAQMVTTAIKRRAIATFEPPSVIRAEALQNVPSPSAILVSKQAAKDVK

SEQ ID NO: 126782 - protein, 125 aa, Heterodera glycines
  Coding regions on vcDNA: vcDNA=SeqID_53205; Strand=-; Position=1 -48,117-446
  Homolog annotation: Hit_ID=AAP30767.1; Match level="QueryCoverage =100%, HitCoverage=100%, E-value=9e-33, Identity=60%"; Hit description=putative gland protein G21E12 [Heterodera glycines]
MTSHFLVGAAAFGAGICFAKTYMEKPKSEDDKEAPKKEEATTGGDAEEKAKKKDKKGDGAAAADKKEEKRKDKHKSKEGKSDDSNRRSKKDKHGKKDKKDKKKDAAEPAANAGEQSTAETTQADE

SEQ ID NO: 126783 - protein, 23 aa, Heterodera glycines
  Coding regions on vcDNA: vcDNA=SeqID_53206; Strand=-; Position=1 -51,632-652
MGDLQSEKGGKTGKRQKKIIQIV

SEQ ID NO: 126784 - protein, 218 aa, Heterodera glycines
  Coding regions on vcDNA: vcDNA=SeqID_53207; Strand=+; Position=1-654
MREALATRIQLPESRIQVGMGLNQQIVSMFRSGSRTDVPNFGVPFPRNRIAIELFSANKKSEEIAHKIHQLASAKFPSGNANDSPPPAEPTVAKNESLKRAQMETAITLSTASGEQPASEAEEAKMAEPTADDFGTMFAPSALKLEPQTTHAIASASLPVSVDRTTMASTLWDGNGLAAVESTNHLTTGGANGTAMDWLAAAQWHKQQQQQNTQYQLS

SEQ ID NO: 126785 - protein, 172 aa, Heterodera glycines
  Coding regions on vcDNA: vcDNA=SeqID_53208; Strand=+; Position=1 -96,193-349,461-726
MPFDPDRYGCWRNVTKPCSCPCSKLRAIKFCRIECDFMDREAKEWGNAGRVAAGVGSLGLAFIPIVGPFLAVGAIAAQAKNWGEDMTHTALEVHFKCEQCGQIAYKTYEILRENITSNRWGRYTNTYGGEQICGIDTTAFDEIEQVFRGMPKAYNFAYNNCKDWTSEMTRRL

SEQ ID NO: 126786 - protein, 40 aa, Heterodera glycines
  Coding regions on vcDNA: vcDNA=SeqID_53209; Strand=-; Position=1 -38,672-756
MGRTDPLRLQKFGFLITKVDINLNQSLTELEQAENLILRT

SEQ ID NO: 126787 - protein, 543 aa, Heterodera glycines
  Coding regions on vcDNA: vcDNA=SeqID_53210; Strand=-; Position=1-1665
  Homolog annotation: Hit_ID=NP_510671.1; Match level="QueryCoverage =85%, HitCoverage=48%, E-value=2e-82, Identity=34%"; Hit description =predicted CDS, endonuclease/exonuclease/phosphatase family and RNA -directed DNA polymerase (XR69) [Caenor
NKKYSRKEIKLRDKTRLSYLRKYFKPLEDPPVIQYNTSFISDSISKAEIFAKFFSENYIVNNYSLDFDNSCSSSTINDVEFNIVSVGKVLRTLPNRNNTSPDGITFRLLKNCFLSFTPFVTEIFRLSLDTGKLPTIWKQSIIIPLHKQGDKSNPMNYRPIALTCSLCKIMEKFICWTISDFLLKKFLEHQFGFIRGRSTTTQLISTLENWYDGIYNNKNIDCVYIDFRKAFDVIPHNLLLYKVHKIGIRGKILNWISDFLSSRTFRVRVDSTLSSEYKMSSGVPQGSVLGPLLFLIYINDLPELIPKQISIKLYADDVKLYSDDRIVMHHALNILSDWYKKWYIKISINITFIIYFGKNNPREQYKNNDNAICEVETIRDLGILIDNKFTFSEYISKITRNAYYRMRLLFRVIKSKKIAIWKNIYDSYIRSLLEYTPESWNPQLKSHIIKIEKCQKYFTRIAFRKCCLPNIPYDQRLRFFKLATLEKRRKIFDLLTTYKILHGFTHLDHNLNTRNKSFFRLNVKLQSKKSNESFVNRSVKAWN

SEQ ID NO: 126788 - protein, 45 aa, Heterodera glycines
  Coding regions on vcDNA: vcDNA=SeqID_53211; Strand=-; Position=1 -95,165-207
  Homolog annotation: Hit_ID=NP_740853.1; Match level="QueryCoverage =95%, HitCoverage=3%, E-value=6e-10, Identity=62%"; Hit description=g- protein beta WD-40 repeat family member (1G129) [Caenorhabditis elegans]
NLGERGDRLNSTVDATEQLRNNAQAIQSRSAKLLEKYERRKWYQL

SEQ ID NO: 126789 - protein, 149 aa, Heterodera glycines
  Coding regions on vcDNA: vcDNA=SeqID_53212; Strand=-; Position=1 -39,147-305,402-501,747-898
MMQQIRDKPKLRHIVPPWASPPPATPSMPFPPMPALPPSTSSSSSRTTNFDNPLLVQLRNRIPLGPILENDAGRGEVGGTADEVAKGVNKRRVQMNYNEAGWVMIAMDITGKTRKICKDTYNVLIYNEICNGKCRTCIAKEEDISYHDH

SEQ ID NO: 126790 - protein, 142 aa, Heterodera glycines
  Coding regions on vcDNA: vcDNA=SeqID_53213; Strand=+; Position=1 -99,589-917
MPCLKDGRLFEFHRRWTPFEGCESDAIGKRRQNISEQCRRMGQLGHRWVAQFALFPEKAFSGVCQHTETETKVGEGMKEEEKEEEEGRLDDDQTDRTKWKKPNEVPNYGSPMANVMDYANTANGANFDEKLENNLRARTKRT

SEQ ID NO: 126791 - protein, 66 aa, Heterodera glycines
  Coding regions on vcDNA: vcDNA=SeqID_53214; Strand=+; Position=1 -34,82-248
MGNFFSTGIAEPDVEQPFGPDQRPSAPVVCVCRRVMTWAWNERVTMLLLFILLVLMCQFVFWNITI

SEQ ID NO: 126792 - protein, 71 aa, Heterodera glycines
  Coding regions on vcDNA: vcDNA=SeqID_53215; Strand=-; Position=1 -64,881-1031
MSASSSLFLVVVLACLAMSANNDNIRVIGMGCEPNSSVCDLAYFDNKFIKCENIQCCRDDFCNGVPDRVDP

SEQ ID NO: 126793 - protein, 342 aa, Heterodera glycines
  Coding regions on vcDNA: vcDNA=SeqID_53216; Strand=+; Position=1 -47,104-388,455-881,1057-1326
  Homolog annotation: Hit_ID=AAL78214.1; Match level="QueryCoverage =42%, HitCoverage=75%, E-value=8e-14, Identity=31%"; Hit description =putative esophageal gland cell protein Hgg-20 [Heterodera glycines]
MSDNPKEAEKQMEKAIFISADCWLKVFDLLPRSQLGCGIAMVSRRFDCFVDEHFKTRKWKLGDMIIEGKIGLNGAKGMKIVQIANLGGKELPIPQVPLPNKVIGFGRISINFIDQNVLTFLRRFDRFFASCTTIFDIYVENVRISEFVLRNIWPMLKDTVLYVQTEAIVFRQMRQLGLSTLNDYPSLRILSLTEIFPKFPPDDSANASDGQVVTKWLFSPRPDNLPKVFTCIVDSPEMASVGQWLATMEQIKTAFSIASSPVNFGFSVFLPPSDPPLTVQPFDLTNELTGEKLTLLEEDDDALVVLRCPTASDVLKWRKTAHHGMNDRQNQSVSMITGDVFD

SEQ ID NO: 126794 - protein, 38 aa, Heterodera glycines
  Coding regions on vcDNA: vcDNA=SeqID_53217; Strand=-; Position=1 -79,226-263
MAKDLAEQFDAFRSLCKMIRATGEIGGQLKQLFILMSQ

SEQ ID NO: 126795 - protein, 63 aa, Heterodera glycines
  Coding regions on vcDNA: vcDNA=SeqID_53218; Strand=+; Position=1 -55,159-262,559-591
MSSSSGSPDSFFRSEINQAEAEEVGKYEVLSWHGLWGDQLSAELFVTDQQLLKFLLVNWRHFW

SEQ ID NO: 126796 - protein, 87 aa, Heterodera glycines
  Coding regions on vcDNA: vcDNA=SeqID_53219; Strand=+; Position=1 -94,453-622
MSYVLRLIDLTRYIRVYCHLGPMSSGSQRLWYDTLFSLQLPSILCFHAFLCGLATKLRPILGQVSNLIWLLFEESRRNNGKGRLIIH

SEQ ID NO: 126797 - protein, 189 aa, Heterodera glycines
  Coding regions on vcDNA: vcDNA=SeqID_53220; Strand=-; Position=1 -123,826-894,1046-1098,1595-1919
  Homolog annotation: Hit_ID=DAA01153.1; Match level="QueryCoverage =52%, HitCoverage=9%, E-value=5e-16, Identity=36%"; Hit description =TPA: RTl1 [Mus musculus] ref|NP_908998.1| retrotransposon-like 1 [Mus musculus]
MNYSILKKIALIIGSTRDQVLLEARNEVQRLLEPLKNKMETIFLCSKKRDSKTGLTYTTRKWGVLIKKLFIKRTMDRTDVFGVMNTLPMSEKSGDKEGDDVLRYDADAEEDENDEEPDQQEDGQQGQQHEGQQQGQQMEEDEVEDEEYEDDDETDEEETEEGGDEDDDETDEEETKEGEAEEMEDDEVE

SEQ ID NO: 126798 - protein, 71 aa, Heterodera glycines
  Coding regions on vcDNA: vcDNA=SeqID_53221; Strand=+; Position=1 -50,1306-1471
MPNFNCLERPLSQLFYRIIDNIRIKLLNDIKLIQISTTLKEFYTKKESRVGATRNRKRNLTPCAYTILHRN

SEQ ID NO: 126799 - protein, 77 aa, Heterodera glycines
  Coding regions on vcDNA: vcDNA=SeqID_53222; Strand=-; Position=1-234
MKDEEEYQNNRVRLFEIDQTRGIADRPRLKKYIENDSAIRQLVIAYDAKEEKNDDDLIRHIHALQYRVGMKGFEGWD

SEQ ID NO: 126800 - protein, 34 aa, Heterodera glycines
  Coding regions on vcDNA: vcDNA=SeqID_53223; Strand=-; Position=1 -91,360-373
MPPRRDRSRERKGKARQGRHRSRSNSQTRLSKLL

SEQ ID NO: 126801 - protein, 201 aa, Heterodera glycines
  Coding regions on vcDNA: vcDNA=SeqID_53224; Strand=-; Position=1 -174,341-437,482-616,656-853
MKNPPKEIGKNDDTEIKQFVRDLLDHYNMVGKVLFVDQSQAIDYSVIEAILYKSDQTKINNLSKSNSNIEEIVNGIGKITLTKFDKKGKNDSSVKPTLMDKFEILKWIDQLDKPMADLIRKLHKSVNELSASINEDSLDQNAKIQNLISLIKEIAIGTANRLQISTNEIMPPADGQQIDQKSMLEELTKFWHKFRENGEQN

SEQ ID NO: 126802 - protein, 122 aa, Heterodera glycines
  Coding regions on vcDNA: vcDNA=SeqID_53225; Strand=-; Position=1 -187,280-460
MQPNFNFLIVLILFGVSICTASSYTWKSEPNLANNVQTFAKFMDDLYVEYKKTVKMGQFNAKYTILRNPSTILLTNYSDKQKRTVFNLTFVKCVGGIAYFQVLSQNDDSKDAYLILKWAFSM

SEQ ID NO: 126803 - protein, 49 aa, Heterodera glycines
  Coding regions on vcDNA: vcDNA=SeqID_53226; Strand=-; Position=1 -84,183-248
MCGSFPIIVGEMRGQRTSKMYRPFLIATVITAIVGIIATITFFTETGNV

SEQ ID NO: 126804 - protein, 238 aa, Heterodera glycines
  Coding regions on vcDNA: vcDNA=SeqID_53227; Strand=+; Position=1 -32,148-268,411-457,724-905,1045-1158,1218-1439
  Homolog annotation: Hit_ID=NP_490843.1; Match level="QueryCoverage =89%, HitCoverage=42%, E-value=4e-85, Identity=69%"; Hit description =peptidase D, Xaa-Pro dipeptidase (1B816) [Caenorhabditis elegans] gb|AAK18972.1| Hypothetical protein K12
VFFPVFPAKNSFSTDLASLYPTMAELRVIKTELELAVLRYASKIANEAHKEVMRHVRPEMYEYQLESLFRHISYYTGGCRHLGYTCIAASGENAAVLHYGHCAAPNDKVIRDGDICLFDMGPEYNCYISDVTCSFPANGKFTEKQKIVYNAVLRANRTVLGAAKPGVVRWTEMHLLAEKVILEDLLRAGILRGDVDEMLGKRMGAVFMPHGLGHFVGEYYKFLNKHKRNSKGWVGLSF

SEQ ID NO: 126805 - protein, 195 aa, Heterodera glycines
  Coding regions on vcDNA: vcDNA=SeqID_53228; Strand=-; Position=1 -57,654-745,969-1050,1446-1622,1996-2175
MFNRDWHDNPAPTIDFTGEFDQSGADEPVIPAEQHPPVPPVVADDKAERRGATHSPVRRPSIRTTIDFSAASPEPEEERTASSSGRRRRVGSTAADRSAQAAAAACAAGEEATDEVDNNEEERQNMAVVTKRMANLTAQSEDERRVRTASGGGRRRCDDSGAAADRSAAQAAAAACALKVQNIGNIFENTREAYL

SEQ ID NO: 126806 - protein, 45 aa, Heterodera glycines
  Coding regions on vcDNA: vcDNA=SeqID_53229; Strand=+; Position=1 -56,342-423
MCKIRRTSLTEEFGLELNWGVTKRIRTKNSFNKILYAYQKPLTAT

SEQ ID NO: 126807 - protein, 42 aa, Heterodera glycines
  Coding regions on vcDNA: vcDNA=SeqID_53230; Strand=+; Position=1-128
TVFSLIKAPGELFFNLFRKGDIIGDRAFNGDGGIIFQQIFND

SEQ ID NO: 126808 - protein, 88 aa, Heterodera glycines
  Coding regions on vcDNA: vcDNA=SeqID_53231; Strand=+; Position=1 -106,461-621
MEKLKKSPVHSRRIELSSYSMRRDYSTDYSIVIVGLPLDLLHFMSPSDFYESEVFYESNQIIIPGFYTATLFMFEQTLIFGIIRKNKV

SEQ ID NO: 126809 - protein, 189 aa, Heterodera glycines
  Coding regions on vcDNA: vcDNA=SeqID_53232; Strand=-; Position=1 -79,156-287,341-445,576-644,703-792,985-1079
MLASRPCQLLLLILASAHFLQAESKIDVQVNNDPQKTASSSGVDEDHRNVVVNVKHHHNNVERDEATTAKSEKVYNEKSTASSSSSASSEEKNGHKRHKFVLVQHEVNGRKKHVLLKVRGHRLMELYRERDGKHGLKKHLLLKVKTPHHHRKYVQDEYVKKDEKNDDDPKKKVSVRVHTSREGGIIDDN

SEQ ID NO: 126810 - protein, 356 aa, Heterodera glycines
  misc_feature (356)..(356): Xaa can be any naturally occurring amino acid
  Coding regions on vcDNA: vcDNA=SeqID_53233; Strand=-; Position=1 -115,184-249,301-342,384-431,474-577,628-717,765-835,880-994,1041-1219
  Homolog annotation: Hit_ID=NP_503730.1; Match level="QueryCoverage =93%, HitCoverage=57%, E-value=3e-68, Identity=45%"; Hit description =putative protein of ancient origin (5D168) [Caenorhabditis elegans] gb|AAF60576.2| Hypothetical protein Y
ILQNKIFLNFGRIMHRSAIRRLFDVAIVGGGIVGCAVARQLKIVKPNLSVVLLEKESRLASHQSGHNSGVLHAGSHQSGHNSGVLHAGIYYPGSLKAKIYYPGSLKAKLCVSGIDLAYKYLEDNEIAHKKCGKLLCVSGIDLAYKYLEDNEIAHKKCGKLIVALDEAEIRRLEALFDRAKQNQCALFDRAKQNQCKSIEMIGEDGIRQIEPHCRGRKAIGRKAIWSPYTGIVDWTMVTRKFAEDFQRMGDFQRMGGTVFCDWSLEGIGPSDDSAHPLRLIGAPNGAQIDSKFLITCAGLIDSKFLITCAGLFSDRVARLSGCPKLPKIVPFRGEYLKLKPERRFLIKTNIYPVSEX

SEQ ID NO: 126811 - protein, 161 aa, Heterodera glycines
  Coding regions on vcDNA: vcDNA=SeqID_53234; Strand=-; Position=1 -128,322-681
LKIFSLFVKANRACEELRMIPTMFDLADKEKSYSGKACWGQILSSFSLFHPFNSIRCQSMKLSGQFLCLRPISSLIRNSSGLRFTLLKKLLSTTNASKSSKDYSERITKLEKEKEKRKEKVTDLRKCRSEIRPAKNRKNEHFDESTEQIGGSFGGNWPFAF

SEQ ID NO: 126812 - protein, 174 aa, Heterodera glycines
  Coding regions on vcDNA: vcDNA=SeqID_53235; Strand=-; Position=1 -90,435-563,871-1052,1504-1627
  Homolog annotation: Hit_ID=CAE59824.1; Match level="QueryCoverage =76%, HitCoverage=9%, E-value=4e-24, Identity=47%"; Hit description =Hypothetical protein CBG03294 [Caenorhabditis briggsae]
MSVDDDDDDEEEIDGWSGDEEDELEPIEPNCVDRCLAVGQAPDETAFSDKWKREFSKRPTWFNADMALHQILRGRAIGFRWPLYSRILIQRSLFGIGCFVQRHAWLIIVLVLSLFTFFCCGLRYVYIETDIVKLGWSSERGAEFSVHSAAGEPPTSSKCDKTAQRRGRTDNRGI

SEQ ID NO: 126813 - protein, 173 aa, Heterodera glycines
  Coding regions on vcDNA: vcDNA=SeqID_53236; Strand=+; Position=1 -151,212-384,431-566,616-771
  Homolog annotation: Hit_ID=NP_501962.1; Match level="QueryCoverage =63%, HitCoverage=89%, E-value=9e-18, Identity=37%"; Hit description =transthyretin (4L369) [Caenorhabditis elegans] pir||T24096 hypothetical protein R09H10.3 - Caenorhabditis
MMERRNSTKNGGLSPTPQETTINLPVSSNRRASSASILFAQASFDTGLDVSRASQLSSQRNVLSTHVMDLGSGRPCSGIQCKAFKWDKSHSEWIQIGDTVTNAQGRIPLVHPGTSLSKGLYKLRFATKEYYARHQLKSLFPQVDVVIEVDDASEHCHVPVLLNHFGYSVYKGH

SEQ ID NO: 126814 - protein, 131 aa, Heterodera glycines
  Coding regions on vcDNA: vcDNA=SeqID_53237; Strand=+; Position=1 -41,452-806
MAIYQDSHSYFDAKFLAITFLKFNKIFRFWHANREYIRLSNALNSFTSDNYEKSYAPKTRLEPSWLQPSQPSPLKITRVVNYRGATFGDLQLGDPTFGELDIWGPDFWKSRHLGTRLLGIERLLGIRHLGN

SEQ ID NO: 126815 - protein, 52 aa, Heterodera glycines
  Coding regions on vcDNA: vcDNA=SeqID_53238; Strand=+; Position=1 -135,461-484
MASAFCCCTQLDSKVAFNFLNALDEFLFPLALGKGVLNKNWKGCTLLSVKDR

SEQ ID NO: 126816 - protein, 111 aa, Heterodera glycines
  Coding regions on vcDNA: vcDNA=SeqID_53239; Strand=+; Position=1 -42,206-273,1181-1406
MGLQTQAKMENKPLKYLFLGINYQRVLEGIKKNLTNPKIRAFAGSAVKQMVDDYICACKNSDTCLFRNKYVTYGQSVKCTARKGPINIGPLNLHIGGGGQFMSLVSRSAGT

SEQ ID NO: 126817 - protein, 55 aa, Heterodera glycines
  Coding regions on vcDNA: vcDNA=SeqID_53240; Strand=-; Position=1 -70,395-492
MVLLGFFKKMISSASIYTHQQIAGFGAGRRKPTTTTFYTVHKNDTHNNGMFNDNG

SEQ ID NO: 126818 - protein, 69 aa, Heterodera glycines
  Coding regions on vcDNA: vcDNA=SeqID_53241; Strand=+; Position=1 -55,560-616,1279-1376
MPTTPMSGNMTENATVATDASGHHHLTALAFILPFVIGNPAFHAEHGIRFMKNLTWTWIHEKSRPRSRS

SEQ ID NO: 126819 - protein, 50 aa, Heterodera glycines
  Coding regions on vcDNA: vcDNA=SeqID_53242; Strand=-; Position=1 -39,508-621
MEIEKVSEFALEELLMDPLKGFYNKNEDQLTLCIEIREISDSELVWQGQF

SEQ ID NO: 126820 - protein, 283 aa, Heterodera glycines
  Coding regions on vcDNA: vcDNA=SeqID_53243; Strand=+; Position=1 -203,395-455,512-791,840-873,929-1091,1198-1235,1417-1489
  Homolog annotation: Hit_ID=NP_497505.3; Match level="QueryCoverage =95%, HitCoverage=23%, E-value=3e-38, Identity=36%"; Hit description =actin-binding FH2 (123.9 kD) (3D239) [Caenorhabditis elegans] gb|AAK29921.3| Hypothetical protein Y48G9A.
GLKVAQNAAAQAKLAEQQRQTANSTQKTTPTTQTTPTVTAAKVGKEKVREQRDSSKQRTTQQTDKEMDSVDSASVNSAPRTNPSQQQAPPKKAVAPPPPPPPPPPPPPPLFVQPKKVVQNGPKAAGGMPPPPPPLGLFVSTAEAVPKKKIAKIGSKMPMINWTALNPNQVKGTVFNNMNDEKLAEELDLSKLEAMFSLDEKKPSSESQQQNVDANAAVKPRGQPSPNATVNCGKNTVLSTKRLQNIAIIRRKIGKSAMDIMTAVHRFDFSVLTSDQVDVLLHN

SEQ ID NO: 126821 - protein, 187 aa, Heterodera glycines
  Coding regions on vcDNA: vcDNA=SeqID_53244; Strand=-; Position=1 -117,165-438,493-665
  Homolog annotation: Hit_ID=XP_517745.1; Match level="QueryCoverage =48%, HitCoverage=49%, E-value=1e-13, Identity=44%"; Hit description =PREDICTED: similar to Kinesin-like protein KIF2 (Kinesin-2) (HK2) [Pan troglodytes]
MDKLRIGTEVQILRSDGRVHAALVTAINERGVSVEWMEEGETKGKQLDIEVIVRNNPSLFPSRVHKPEKSCADPKTASNGVVSNKNRHSIAASSSMQTVVGRQIDCGPSVGYISKSPPPPPPLQPIAPVKDIKRICAGMSVKIERSNGRVQTALVTTIFPEKNGAAVEWQEQVRVCLSQNSFVLLTP

SEQ ID NO: 126822 - protein, 141 aa, Heterodera glycines
  Coding regions on vcDNA: vcDNA=SeqID_53245; Strand=+; Position=1 -207,272-364,477-599
MDEGRAAHYFADLSRQCMLEVDVGEAVTEKVNRLKRAMLDDSLMILAALCKEMNVNGNLSEGQKNVAKIIASNETVLFIYHSILRMDTISMFKLQKTVLLTLNRITKSGALPAVLDNGPLLSEALLNFLFSSFDSSNVAKL

SEQ ID NO: 126823 - protein, 40 aa, Heterodera glycines
  Coding regions on vcDNA: vcDNA=SeqID_53246; Strand=-; Position=1 -110,788-800
MKCEMKNDHLNTIFENWIAKANFGERNWTLEKGSGRSHPN

SEQ ID NO: 126824 - protein, 197 aa, Heterodera glycines
  Coding regions on vcDNA: vcDNA=SeqID_53247; Strand=-; Position=1 -149,962-1406
MTVRHFVIIMPFQHRYNIDARGQRKFRRNIFFIFLNHSVIERIAWSSYICVLKSGNAFAIFEPGPANVLERRFARFRIRLALFDAVSLSQNEAVQFVGTKFVDDDNYGTFGRLKIGHFATNYAKDSAVVDDDTTNSKTITDFGPIAYAIQTSGSTGAKFLFFVPTDFCVKVPKFRFFRIFRHSEGRLGSVLCHFAKC

SEQ ID NO: 126825 - protein, 330 aa, Heterodera glycines
  misc_feature (305)..(305): Xaa can be any naturally occurring amino acid
  Coding regions on vcDNA: vcDNA=SeqID_53248; Strand=-; Position=1 -26,1360-2333
  Homolog annotation: Hit_ID=DAA04499.1; Match level="QueryCoverage =96%, HitCoverage=23%, E-value=6e-67, Identity=40%"; Hit description =TPA: pol polyprotein [Schistosoma mansoni]
RAMGNPELAHEWVDKKALEKKETDDILKLLMQYESIFAISDAESQTNLIKHQIDTGEAEPIRCKMRFVPYAYREKVAAMLQDYLQRDVIRPSHSPWSSPIVLVPKRDGTLRFCVDFRAINAVTRKDSFPLPNIDNTLLMLGGRKFFTTLDFMTGYWQIRMDENSIEKTAFSTEFGLHEFTVMPFGLCNAVATFQRFMTHLFDGYINNFVFVYIDDVLIASDSYEHHLKHLALVFERIQEAGLKLKLSKSHFCAKELPFLGHILTREGIKMDVDKVQPITNLPMPQTRKELHSILGFFTYYRKFIXNFGIAAPLFLLQKNVKFSIGEVEKE

SEQ ID NO: 126826 - protein, 164 aa, Heterodera glycines
  Coding regions on vcDNA: vcDNA=SeqID_53249; Strand=+; Position=1 -159,918-1075,2122-2299
KAREHAQPEHIYKNAAKHGNFSAKNPVLLSEIVSVIDLFRTMPHFPMLEPSDQAILLSFVAVPLIDVNARFYSSKINSQIVTVLPNNSFSPLYLYYNNPFYAGDKTSYRSVRCWSSHPAAFIRTLCRSVDAPFAHQPRQHGGRTSLCRIDPSDRVGVLHRETAP

SEQ ID NO: 126827 - protein, 39 aa, Heterodera glycines
  Coding regions on vcDNA: vcDNA=SeqID_53250; Strand=-; Position=1 -90,205-234
MRKMSSLGTLINGCANLYNSLNIICQETENINLFVMRLK

SEQ ID NO: 126828 - protein, 61 aa, Heterodera glycines
  Coding regions on vcDNA: vcDNA=SeqID_53251; Strand=+; Position=1 -60,157-282
MFSCGAKYVGTLQRLKRIIEEVHADYSECQKSMKQMDEDEQMAFGKGHGTERFAMIDELIN

SEQ ID NO: 126829 - protein, 55 aa, Heterodera glycines
  Coding regions on vcDNA: vcDNA=SeqID_53252; Strand=-; Position=1-168
VRLLFHANLQKVFEHFLKAKPKQAKCADAFSDEGKMMEKKGETTNKTKTNYGDEL

SEQ ID NO: 126830 - protein, 119 aa, Heterodera glycines
  Coding regions on vcDNA: vcDNA=SeqID_53253; Strand=-; Position=1 -119,1987-2225
MPSQVPKINKWTVSRVSVKCRKMQQKSQQKEKAISKRAEDSKIMRRGPTIAMVLQRQKQQKSEAEEMAPADVDDDENGAGGRGGGEGRGRHVPIEEEDDGAAESGQQIQCQFHANEELH

SEQ ID NO: 126831 - protein, 74 aa, Heterodera glycines
  Coding regions on vcDNA: vcDNA=SeqID_53254; Strand=-; Position=1 -166,1213-1271
MPSAAVADASSAFAQPTLAGTGHSRLFESVIALKYSVSFTFVRSEWHWTKNRRNRNRTLISLANKMLKLLLIFH

SEQ ID NO: 126832 - protein, 218 aa, Heterodera glycines
  Coding regions on vcDNA: vcDNA=SeqID_53255; Strand=+; Position=1 -378,535-813
MGTKLEFNVNTNETEDGQRIWDVLARQIWPIFATNIRHLCFYDSGNHLDKLRRRTSPTLLTDSNQLISIESCGLLPDAIGDDGPNATAGQALSKWLHTPTKDGQPKEFCSYLALMEINNWFDNHKQTFLHATTSVSYNVRIIFYKTTTPIEPFELVNERTKEKLTFMKKDGGGKLLNAWLLKRCPIIVGETAAAVQKDENLDHLNGVHFRLYDDYCIG

SEQ ID NO: 126833 - protein, 249 aa, Heterodera glycines
  Coding regions on vcDNA: vcDNA=SeqID_53256; Strand=-; Position=1 -44,235-712,746-970
  Homolog annotation: Hit_ID=NP_608540.1; Match level="QueryCoverage =95%, HitCoverage=59%, E-value=4e-30, Identity=36%"; Hit description =CG2839-PA [Drosophila melanogaster] gb|AAF51469.2| CG2839-PA [Drosophila melanogaster]
MIIVLYSIINPINSRIGISVLISIAHPQKVEEKVEEEQKVEEEQKVEEEEKVEEEQKWKRNRKWKRNRKWKRNRKWKRNRKWKRNRKRKRKWKRNRSGRGIESGRGTESGRGTESGRGTESGRGTESARESGRGRESGRGTERGRESGRGTESGSGTESGRGTERGRESGRGTEKVEEEQKVEEEQKVEEEQKVQEKVEEEEKVEEEQKEEEKVEEEQKVEVEKKVEEEQKVEEEQKVEEEQKVEEEQK

SEQ ID NO: 126834 - protein, 193 aa, Heterodera glycines
  Coding regions on vcDNA: vcDNA=SeqID_53257; Strand=-; Position=1 -126,521-587,704-778,841-879,1085-1110,1220-1452
  Homolog annotation: Hit_ID=NP_502437.1; Match level="QueryCoverage =78%, HitCoverage=11%, E-value=6e-51, Identity=65%"; Hit description =UNCoordinated locomotion UNC-31, EGg Laying defective EGL-22, Ca2+ -dependent activator protein for secret
AEDEEEEHKRSLQLYVFVAKCIAYHFNAKQPTDMARRQLKVNKHELSRTKERFNAFLKGDIQIPADEAFTKAIESYFEGFLKSERVAKVIQAGGFSIQAGGFSSNDFREVFRCNVERRIRSLPEIDGLSKDTVLASWMAKFDMIMKTEDRDPPATCQAKNNGIFKKKVFGILYFFKLKIVRVWQFKKKSRVSR

SEQ ID NO: 126835 - protein, 103 aa, Heterodera glycines
  Coding regions on vcDNA: vcDNA=SeqID_53258; Strand=-; Position=1-312
MTNVGIVLEKLGKLMALAMIKLKSIFLNCCHCDGKLGNELAFDGKIGNELAFDGKIGNELAFDGKIGNELAFDGKIGNELAFDGKIGNELAFDGKIGNELLPL

SEQ ID NO: 126836 - protein, 123 aa, Heterodera glycines
  Coding regions on vcDNA: vcDNA=SeqID_53259; Strand=-; Position=1 -192,727-906
MLAIMRCYNEQYGHRNQKKSKAKSLRDRLKDELHGDVERLALDLLEGNRNERTDFVPNCERAEEQAAELHNPGEGPLGKIRKATARVLLGQESTSLSVKYFIEFLANEHFRQLRLMFEMVKIV

SEQ ID NO: 126837 - protein, 72 aa, Heterodera glycines
  Coding regions on vcDNA: vcDNA=SeqID_53260; Strand=+; Position=1-220
  Homolog annotation: Hit_ID=AAF98156.1; Match level="QueryCoverage =90%, HitCoverage=13%, E-value=1e-09, Identity=52%"; Hit description =putative homoglutathione synthetase [Pisum sativum]
ISLDESGDFSLYLDGTKRVALVHIADGNVPHEYPTEHEWTARTTIERSNAILSPNIRFHLSSTKKIQQVQPN

SEQ ID NO: 126838 - protein, 265 aa, Heterodera glycines
  Coding regions on vcDNA: vcDNA=SeqID_53261; Strand=-; Position=1 -186,914-1027,1091-1418,1487-1656
  Homolog annotation: Hit_ID=CAE59095.1; Match level="QueryCoverage =95%, HitCoverage=37%, E-value=3e-64, Identity=59%"; Hit description =Hypothetical protein CBG02387 [Caenorhabditis briggsae]
MVESELDRLEHLNLVSRVVTELENHFGISERDVAEFIIELARTSSTFDKFKKSLEEHGLADGLEGFRRRTEGLVHISQIKNERVNAVADVLRRGQRVKVKVIKTVDSKVSLSMKEVDQQTGKDLNAAMPISAAAVAGSDNSFLTNPDAPWLNPSSEKMSTKLTQNSKPSRIRLSTPERWELRQMQGGGAITMMDLPDFDQELGVLKNYEEESDGEDIEIELVEDDPDFLKGYGKHVADLEPVKVVKNPDGSLAQAALMQVQWIEF

SEQ ID NO: 126839 - protein, 80 aa, Heterodera glycines
  Coding regions on vcDNA: vcDNA=SeqID_53262; Strand=-; Position=1 -107,381-514
MADVESEELLASQKLQNALDYVEDSVNRGINIVVHWPNPSFLRQLEVFQKLDYRCDLLTLRNSKLFKEFECISENPSEVS

SEQ ID NO: 126840 - protein, 19 aa, Heterodera glycines
  Coding regions on vcDNA: vcDNA=SeqID_53263; Strand=-; Position=1-60
SRYGASIPFEKAMRPEVII

SEQ ID NO: 126841 - protein, 33 aa, Heterodera glycines
  Coding regions on vcDNA: vcDNA=SeqID_53264; Strand=-; Position=1 -90,406-417
MILFVKTKEFDYRVWSAQMLSELEENNALTEYI

SEQ ID NO: 126842 - protein, 65 aa, Heterodera glycines
  Coding regions on vcDNA: vcDNA=SeqID_53265; Strand=-; Position=1 -181,647-663
MGGRNRSGTTFSNSAGTFFQIEGYALKLKDSKNVMIQCPCSVMNFIECLIKLFFSMCEAEAFISQ

SEQ ID NO: 126843 - protein, 45 aa, Heterodera glycines
  Coding regions on vcDNA: vcDNA=SeqID_53266; Strand=-; Position=1 -32,350-455
MTFERGKTNFGYTRDNNFDYQLGTSYAATPRVRHRHHQLLHGQPL

SEQ ID NO: 126844 - protein, 194 aa, Heterodera glycines
  Coding regions on vcDNA: vcDNA=SeqID_53267; Strand=+; Position=1-585
MVTKEGITLWCTRIEKAQFVPFDIVYELPGHCFFRVKNKARVFSVPYSELPSSDRCAQPLPPPPPPPPPMTTAKHQRTPDDEEEKNLRRKAKVALDLVEAGLAADAMMQDGTRWKKAKTAINVLANLLLAESLTDVSPTFDQQQQQQQLSSKEEEKREECTNNSSAAATTESAPDGDVMDDFVNSIQAATSNMQ

SEQ ID NO: 126845 - protein, 68 aa, Heterodera glycines
  Coding regions on vcDNA: vcDNA=SeqID_53268; Strand=+; Position=1-207
MERYKRQQQRQQQQQQQAKVTQLIKDNANWLCALSKAKCVKRCGRLIRKANTDQLLSLVEVCLNIVAS

SEQ ID NO: 126846 - protein, 126 aa, Heterodera glycines
  Coding regions on vcDNA: vcDNA=SeqID_53269; Strand=-; Position=1 -179,1058-1261
RGILGKIFPSKNKEAHAELDEVDEIIEEPFLLGSALASAADGGGGDDGDDDHLIVVGEDIRIWSVDQCTSIHTIAIHGKAVNDVSFHPTGDFVLCSSEDSHWSLIDLNAGRPLVKVGEQSENNIFY

SEQ ID NO: 126847 - protein, 90 aa, Heterodera glycines
  misc_feature (63)..(63): Xaa can be any naturally occurring amino acid
  Coding regions on vcDNA: vcDNA=SeqID_53270; Strand=+; Position=1 -167,212-352
  Homolog annotation: Hit_ID=XP_308965.1; Match level="QueryCoverage =65%, HitCoverage=13%, E-value=5e-15, Identity=62%"; Hit description =ENSANGP00000020214 [Anopheles gambiae]
MRCFFPRVVRSVFPSPLSFVRSSLSTFYPIDDQLFGLDEEQRQLRQLVFRLAQKELAPFADEXDRQNEFTKLRDFWRLLGQQAFCGSQCQ

SEQ ID NO: 126848 - protein, 180 aa, Heterodera glycines
  Coding regions on vcDNA: vcDNA=SeqID_53271; Strand=+; Position=1 -101,150-243,296-372,432-572
  Homolog annotation: Hit_ID=CAE72737.1; Match level="QueryCoverage =97%, HitCoverage=31%, E-value=8e-42, Identity=57%"; Hit description =Hypothetical protein CBG19978 [Caenorhabditis briggsae]
PPPPPGLMQAACDVAFEYAHSRIAFSSPIGTFQLMQGKLADMLMQGKLADMYVRLSASRAYLYAVAKNAADSDVIIKDSAGTILFLAENATQMIIKDSAGTILFLAENATQMALDAIQVLGGNGYINDYPTGRVLGGNGYINDYPTGRLLRDAKLYEIGAGTSEVRRLVIGRALNREYMK

SEQ ID NO: 126849 - protein, 90 aa, Heterodera glycines
  Coding regions on vcDNA: vcDNA=SeqID_53272; Strand=-; Position=1 -102,145-315
MFYQPWSFMKRTPSVAKANDFQKRPEGRQFLLRWPSADHFGKRSTVVPLMRFGRRPAERAAPLIRFGKRAYIRTDAAPLIRFGRSSEERK

SEQ ID NO: 126850 - protein, 94 aa, Heterodera glycines
  Coding regions on vcDNA: vcDNA=SeqID_53273; Strand=+; Position=1 -150,745-879
  Homolog annotation: Hit_ID=CAB53367.1; Match level="QueryCoverage =79%, HitCoverage=20%, E-value=1e-10, Identity=41%"; Hit description =necpain [Necator americanus]
MPLVTDITVWQGPNTEEKMMREIMTNGPVQVAYNIYEDFHRCCANGEIYQHGVNSTKTEFAHSVTAIGWGEANGTKYGLLANTWGTELNRATNY

SEQ ID NO: 126851 - protein, 51 aa, Heterodera glycines
  Coding regions on vcDNA: vcDNA=SeqID_53274; Strand=+; Position=1-3,86- 238
MILHWFTPKKARDVCQEVLEFAQERGMPCEKLTKWMKILNKICAPRLEESK

SEQ ID NO: 126852 - protein, 191 aa, Heterodera glycines
  Coding regions on vcDNA: vcDNA=SeqID_53275; Strand=+; Position=1-573
MSDKRSLVNQILAQSDITVTTSGITVSGPRLSTPRFIPFDECGRCRACKATEVEVDLMVTKEGITLWCSRISKAQFVPFDVVYDLPGHCFFRVKNKARVFNVPYGDLPSDTCTPTPTTTPTQGTQAGEQQQDLKRKAKVALDLVEAGLMADAMQDGTRWKKAKTAINVLGNLLLAESLDKKVTNSPVEEEK

SEQ ID NO: 126853 - protein, 191 aa, Heterodera glycines
  Coding regions on vcDNA: vcDNA=SeqID_53276; Strand=-; Position=1 -299,377-540,963-1075
MSSTERVMSEEEFNEWFGAGARVRGTCEKPTMFDNVRGLIIDLRHLFGMLSLFKVLGVESPSSGQGQITASESITTEGSSAVVRKYRRYALLCHPDKRMNQFPEEKKKDTERFQIIQNLFDCWKAAADYFVTGCWSHADTHAENKYNFWTDYINDCDAKIKVCPHSEAINVFSDLSQSTQRWRKAVRFQSM

SEQ ID NO: 126854 - protein, 31 aa, Heterodera glycines
  Coding regions on vcDNA: vcDNA=SeqID_53277; Strand=+; Position=1 -31,73-138
PVMCRARQNPIPIKSPIPIMAKNPINCDSDY

SEQ ID NO: 126855 - protein, 79 aa, Heterodera glycines
  Coding regions on vcDNA: vcDNA=SeqID_53278; Strand=+; Position=1 -132,392-499
MGMTIACGRPCPMAVARHSKNNELVAAHHTFATIQSHPLVSHFAIKKYNSISLTVNIVRPKIVLVSACVSAWDQQPVTK

SEQ ID NO: 126856 - protein, 71 aa, Heterodera glycines
  Coding regions on vcDNA: vcDNA=SeqID_53279; Strand=-; Position=1 -16,232-431
  Homolog annotation: Hit_ID=NP_872170.1; Match level="QueryCoverage =100%, HitCoverage=6%, E-value=4e-11, Identity=46%"; Hit description =ankyrin and patatin family member (5V188) [Caenorhabditis elegans] emb|CAD54162.1| Hypothetical protein W
MREDLGMVMCLLSYGAGLDEQADSGKMTALHFAVSNRSLQITRLLLCLGADPNVNNAHGETPRHLAAILNE

SEQ ID NO: 126857 - protein, 328 aa, Heterodera glycines
  Coding regions on vcDNA: vcDNA=SeqID_53280; Strand=+; Position=1 -399,425-1012
  Homolog annotation: Hit_ID=XP_447783.1; Match level="QueryCoverage =92%, HitCoverage=38%, E-value=1e-11, Identity=20%"; Hit description =unnamed protein product [Candida glabrata] emb|CAG60730.1| unnamed protein product [Candida glabrata CBS1
TLGLNPPTFNGIPISGTHPPSSISISENQPTSISISGTQHTSISISVTQISGIPDTGTQPTSISMSFQSLGLNPPAFQALRLNSQAFQSLGLNPPTFQSLGLKSPAFQTLGLNPPTFNGIPISGTQPTSISISTLGLNPPAFQSLRLNSQAFQSLGLNPPAFQCLGLKSPAFQTLGLNPPTFNGIPISGAQPTSISISETQPTSISISGTQHTSISISGTQISGIPDTGTQPTSILISFQSLGLNPPAFQTLRLNSQAFQSLELNPPTFQSLGLKSPAFQTLGLNPPTFNGLPISGTQPTNFQWPSNLWDSTHQHFNLWDSTHQHFNL

SEQ ID NO: 126858 - protein, 249 aa, Heterodera glycines
  Coding regions on vcDNA: vcDNA=SeqID_53281; Strand=-; Position=1 -107,152-358,399-579,622-876
  Homolog annotation: Hit_ID=EAL40771.1; Match level="QueryCoverage =71%, HitCoverage=60%, E-value=7e-16, Identity=30%"; Hit description =ENSANGP00000026779 [Anopheles gambiae str. PEST]
MADEIQQKIVQRIDQDFFSVTSDGWSQITKSPALLSVTLHHVNEYFERADFVLDVIPMTNHTGIYIAEEIANSLRTNGNPEKIICLVCDNAKNMIRASNISNLNSFQCVCHFLHLVMGDVLGLPELAGLISKIRSWVTFFRTSKGMSLLRGYQEKTNSKPKKLIMACPTRWNSTFEMMMAFREQKNVLLTIEGERRGFGVGPSKKSRLDIVAENLPNLEITDFDFLRELCPLLGVFHRETLKASEICKN

SEQ ID NO: 126859 - protein, 34 aa, Heterodera glycines
  Coding regions on vcDNA: vcDNA=SeqID_53282; Strand=-; Position=1 -47,91-148
MAKNMKNICKNLTSLRKTKGLPNSLAKKTQKKGG

SEQ ID NO: 126860 - protein, 115 aa, Heterodera glycines
  Coding regions on vcDNA: vcDNA=SeqID_53283; Strand=-; Position=1 -3,184-230,479-539,594-694,937-1046,1124-1149
MNTHRSGGGHGLSIMEKCYNKQIGQKSCDNQFCECMERATAGKKRCSIWEGPGFCRHYRLYGGSAYREAAPPFWSSCGTVLNSEKYLGCPCGTYKTWERCDFTCKSIGSKNCQNR

SEQ ID NO: 126861 - protein, 53 aa, Heterodera glycines
  Coding regions on vcDNA: vcDNA=SeqID_53284; Strand=+; Position=1 -24,494-631
MDAMECDEQFSVCINYSERPVKNGLNDIPIDSSQGAKHGKICLELRKCQKTGF

SEQ ID NO: 126862 - protein, 116 aa, Heterodera glycines
  Coding regions on vcDNA: vcDNA=SeqID_53285; Strand=+; Position=1 -156,203-287,339-448
MQIRFADLEMDCDSVVLSSSSSSLSKTMESETNEDEIDQEEQGNEHTQAEEDTSHHQQKCYVAKCLDSIAKLQRTFQLSNASADVLDRAADYMQLYLDRYANGKFGADVRLFSVSI

SEQ ID NO: 126863 - protein, 137 aa, Heterodera glycines
  Coding regions on vcDNA: vcDNA=SeqID_53286; Strand=+; Position=1-414
MVRQQHIREQLEEADQLHDQIVEAEQQNDENEDPALQQQQQQRQIMLQEQYERKVRLQLRESRRFSSGAASSLVVPPANLYWERECLICTDAPANFFNRSCGHVCLCSDCAVNCVLHKIPTCILCRAVVSGIYAFVR

SEQ ID NO: 126864 - protein, 21 aa, Heterodera glycines
  Coding regions on vcDNA: vcDNA=SeqID_53287; Strand=-; Position=1-65
MDILTVNSFGLKQTIGQRTLR

SEQ ID NO: 126865 - protein, 79 aa, Heterodera glycines
  Coding regions on vcDNA: vcDNA=SeqID_53288; Strand=-; Position=1-240
MLGERLKSCTGCECRRCCTLSSCCAMTENCLKNIQQKKGNKIRNTLSHITCRQTEGYMDERQVDYGTQLIFLGCELLNA

SEQ ID NO: 126866 - protein, 239 aa, Heterodera glycines
  misc_feature (3)..(3): Xaa can be any naturally occurring amino acid
  misc_feature (25)..(25): Xaa can be any naturally occurring amino acid
  misc_feature (55)..(55): Xaa can be any naturally occurring amino acid
  misc_feature (65)..(65): Xaa can be any naturally occurring amino acid
  misc_feature (105)..(105): Xaa can be any naturally occurring amino acid
  misc_feature (115)..(115): Xaa can be any naturally occurring amino acid
  misc_feature (125)..(125): Xaa can be any naturally occurring amino acid
  misc_feature (135)..(135): Xaa can be any naturally occurring amino acid
  misc_feature (145)..(145): Xaa can be any naturally occurring amino acid
  misc_feature (155)..(155): Xaa can be any naturally occurring amino acid
  misc_feature (185)..(185): Xaa can be any naturally occurring amino acid
  misc_feature (205)..(205): Xaa can be any naturally occurring amino acid
  misc_feature (215)..(215): Xaa can be any naturally occurring amino acid
  misc_feature (225)..(225): Xaa can be any naturally occurring amino acid
  Coding regions on vcDNA: vcDNA=SeqID_53289; Strand=+; Position=1 -71,538-1187
  Homolog annotation: Hit_ID=XP_521405.1; Match level="QueryCoverage =96%, HitCoverage=95%, E-value=5e-39, Identity=44%"; Hit description =PREDICTED: similar to putative N-myristoylated protein (4I499) [Pan troglodytes]
KKXKKKHLMDRKTNINATSHVLPVXNVGGLSPSDWNVGGLSHVDWNVGGLSPSDXNTGGLSVGDXNVGGLSPSDWNVGGLSPVDWNVGGLSPSDRNAGGLSVGDXNVGGLSPSDXNAGELSPGDXNAGDLNPSDXNAGGLSPSDXNAGGLSASDXNAGVLSPSDGNAGGLSPSDLNAGGLSPSDXNAVGLSPSDWNAGGLSPSDXNAGELSPGDXNAADLNPSDXNAGGLSPPVIEMLV

SEQ ID NO: 126867 - protein, 46 aa, Heterodera glycines; identical to SEQ ID NO: 124738
  Coding regions on vcDNA: vcDNA=SeqID_53290; Strand=+; Position=1 -62,478-556

SEQ ID NO: 126868 - protein, 233 aa, Heterodera glycines
  Coding regions on vcDNA: vcDNA=SeqID_53291; Strand=-; Position=1 -42,363-508,983-1065,1115-1305,1587-1769,2818-2871
MSPEIQFQVPNHQESKVAEECLEYQKKFDKKINQIASHWHGVRVSAPKAFGGIMIELSIAKEKYNLSDTQNFNIEFGNPKDLMTKITDETGREIRFSKDEAIRKAYLSNKIKRDAKLRNYTGLWMLGLDVLPMNNQDKMQLHVYRDCRCEMHAWEVDSHQFALPEPVGVGRAIRMRQRLNKNPEGIELRFGNENQKDLLMLRVDKPPYGIINISTIAGDVYPSSIEEPQVKER

SEQ ID NO: 126869 - protein, 44 aa, Heterodera glycines
  Coding regions on vcDNA: vcDNA=SeqID_53292; Strand=+; Position=1-234
SRGNSVGHRRFRCPIFGHIVFNSNLTFAILTWFLIGYSFLNINV

SEQ ID NO: 126870 - protein, 125 aa, Heterodera glycines
  Coding regions on vcDNA: vcDNA=SeqID_53293; Strand=-; Position=1 -145,952-1184
MSFFILTVRGGAVRGGRGAFIFIGALAVAAVLQGANADQAADSIQINVDISATISIRVELGLQALRPIVPLPDHRIWPLKRPEISSPRGRGLTLILSKFIKWAVFCGPLAHKLESRVNYSITNLV

SEQ ID NO: 126871 - protein, 68 aa, Heterodera glycines
  Coding regions on vcDNA: vcDNA=SeqID_53294; Strand=-; Position=1 -154,247-299
MVVTVTDTVTVAVVEDATDAVVENDSKAHQLYNVLLCFYFISQLHIKRAPAEIIFIYFNCIFWQWFHL

SEQ ID NO: 126872 - protein, 241 aa, Heterodera glycines
  Coding regions on vcDNA: vcDNA=SeqID_53295; Strand=-; Position=1 -414,918-1229
MVKMNLVIIITFFLYLIIVLIDGIEEDLFDDLWKNSLLSTSKNYEQQKAKKTIIKSENCFEIEIEDIKPKVQQKIKTEQLDDQTNFLMPKSIKVPKTEFVQFSEEGSFVNQIDEQTDQNDLHTIIHSNAVGDQGSSDTEAEKRKEMEILNKFSAMKKELRHKKVYKKLPFPKFEYEIAKKLGTSRDNIYQFKKQLGQTQKKRSNTMVKDIDKDTMIGLIRKFDQMRKEKIHGFKYDEKKRN

SEQ ID NO: 126873 - protein, 167 aa, Heterodera glycines
  Coding regions on vcDNA: vcDNA=SeqID_53296; Strand=-; Position=1 -88,157-365,408-614
MARATLNFVFNPLTEDEREELCQTWFYNYSASTIECLNIRKHIEISVSPAAGAHETEKWMNNLDLASTSKLFQLNIIVCERIQERIFRWQVYTPDLETSLTNLSQKETQHQYFCIIIRVPLDREFLPKPGPGPEKPGPGPRFFFGTGTARKTGNRDQPGNFKNSKKF

SEQ ID NO: 126874 - protein, 62 aa, Heterodera glycines
  Coding regions on vcDNA: vcDNA=SeqID_53297; Strand=+; Position=1 -85,532-635
MAFGAGHYSGAAVVSIIWLGILTALMVAAFIRMKNHRYREDRRSNPNADVLIDREINGQMLF

SEQ ID NO: 126875 - protein, 62 aa, Heterodera glycines
  Coding regions on vcDNA: vcDNA=SeqID_53298; Strand=-; Position=1 -61,812-939
MGEMQNYSSVKRLKCNKSGRAILAPQENVWSSPDPDPNVPSTSAAWEHNYVPISADYAATLM

SEQ ID NO: 126876 - protein, 428 aa, Heterodera glycines
  Coding regions on vcDNA: vcDNA=SeqID_53299; Strand=-; Position=1 -494,559-741,845-1001,1369-1820
  Homolog annotation: Hit_ID=NP_508964.2; Match level="QueryCoverage =26%, HitCoverage=14%, E-value=9e-35, Identity=60%"; Hit description =regulator of G-protein, possibly N-myristoylated (XG340) [Caenorhabditis elegans] gb|AAA85744.2| Hypothet
AQQHYLPTHLKTTTEEAEEVAASDKHISEQYPQHNPDDCSKVPAVAASSVASFALSRNSENKENRRPSPSAVISEKTKEQTQAEAARESPKRRIGRQIRHGQQQKQPKRQTDASPQALPIGHAQRQSPEASMPPAPGSPKQQQPDSSVDLEQVLKSEAARAPFHQFLQQQFCAENINFYLAVEEYKKIPENEFGRRTDFGRQIYDRHFAANCIEPVNIDNSTSNQIREAYKNNRFTSDVYDVVQYQIFHLLKYDCWPRYLRAGGQLAEELGGDAKSHAMFGGWCRQRQTFAAAPQVALPLSDESGKNRRLGQRVVQRGKRKQRGGRVLYMFRCGIPTTTPLGRAQRRHCACIAATTCALAFTKQARRLAAPCAAYLRGKDDRRCDECHCRTRGRTDAERVHHQLPRWSKETTRTNVQRRNKNFNVYIF

SEQ ID NO: 126877 - protein, 69 aa, Heterodera glycines
  Coding regions on vcDNA: vcDNA=SeqID_53300; Strand=+; Position=1-464
LFEYPKRTLEKIDFFVFGAVPPNRCAQIYGETKSFGNSFPIACILILRWIFAPHNCLSTPNGHLNKSIF

SEQ ID NO: 126878 - protein, 193 aa, Heterodera glycines
  Coding regions on vcDNA: vcDNA=SeqID_53301; Strand=-; Position=1 -76,133-257,725-1105
MPILDKSGCATPTTVTGRGTPNTNCGIVHPNGDDKTPIANPTEDMANKAKDGGGGEGGHIAEQDVQTEQPNPIAEKETASTVAASKSVKEDKEEAIAIAPGEPTDSVAPMAPPSAATSPAPPKTPASADDVSSSAPNSTGAAAAIILSSSAPSTNSTTTPPTNPSQSDTTDENGTKQRVAVPLASSGVTVRDF

SEQ ID NO: 126879 - protein, 39 aa, Heterodera glycines
  Coding regions on vcDNA: vcDNA=SeqID_53302; Strand=-; Position=1 -44,125-200
MSNQSAAQIADEYERGDGEVIKSNQGKRTKSEQVGSFVV

SEQ ID NO: 126880 - protein, 288 aa, Heterodera glycines
  Coding regions on vcDNA: vcDNA=SeqID_53303; Strand=-; Position=1 -42,107-195,459-564,616-703,965-1105,1636-1785,1859-1920,2472-2576
  Homolog annotation: Hit_ID=NP_509304.2; Match level="QueryCoverage =97%, HitCoverage=31%, E-value=6e-73, Identity=50%"; Hit description =unidentified Vitellogenin-linked Transcript (90.0 kD) (uvt-1) [Caenorhabditis elegans] gb|AAL08045.2| Sap
PTCVFRVQPNTLLSLWYTIGCTLLNSWLLWYTIGCTLLNSWLLYLAFVRYRLYTDMQWPAGAFPRVWLTAYISLLGTCIPILALFLVFGLMKTGNLAGNLAGDNDRLGARPKRTIELIKGGMGNTAGLCHCLRSAWLHAPPAPQCLHVLLALLQLFVQQTMLAQLYRWGFINSGDFLNTELDWLLQRARQLATNLPMGETRLQSFRISTEELSASPVAPNILPILMHTRLFGILMHTRLFGIPLEFVNFLIALVAFSTAYPSVFWRVSKSFALLFTAFLGVHSLCLVG

SEQ ID NO: 126881 - protein, 63 aa, Heterodera glycines
  Coding regions on vcDNA: vcDNA=SeqID_53304; Strand=+; Position=1 -60,188-319
MCKKYILIHKFVGSKLIIFEVKFDLNLKLTQSKNNFSDHYSLLTIACRCTVDTVQRPGTVTRS

SEQ ID NO: 126882 - protein, 130 aa, Heterodera glycines
  Coding regions on vcDNA: vcDNA=SeqID_53305; Strand=-; Position=1-393
ILLIVLQLVVCTVCAGEVTSASSDWYWKILASIGALLSIAAYIWAMVHLLVTSKIDVVLVKIDGMKTEMGLRIDLLKAELNEKMTEKVKSIKTELNEKMTEMNRNVESIKHEVTSIREDIKPKPKQGLFW

SEQ ID NO: 126883 - protein, 115 aa, Heterodera glycines
  Coding regions on vcDNA: vcDNA=SeqID_53306; Strand=-; Position=1 -103,438-682
MGPENDGKNGPIIRKENGGPQIENHEICKKEHEEGAEQRPFLFLNCQCLSANRIYFNFTTKSEKYEDWLEKGRGELFEQINSNYCLKSTEDAIFVSTLSHYQWSSACFHRPQFIS

SEQ ID NO: 126884 - protein, 171 aa, Heterodera glycines
  Coding regions on vcDNA: vcDNA=SeqID_53307; Strand=+; Position=1 -13,189-691
MELTQKIKQKGRKYPRKEWNKIEGKIAKKLGTNRQYIYEWIKELGLNQKTNKCYKSKTDEEKLDTVQKFIEMSNEFKQKRKYSSKEWDKNYEEICKKIGVSLKTITKWKNQFGISRKFITEKEKTEKMKIYWQIKREMPKMSDKEIGKTLKINRRTISNWKKQFGEEIMED

SEQ ID NO: 126885 - protein, 23 aa, Heterodera glycines
  Coding regions on vcDNA: vcDNA=SeqID_53308; Strand=-; Position=1 -64,418-425
MNKYFYKFIYLTKTMGHACPFDN

SEQ ID NO: 126886 - protein, 33 aa, Heterodera glycines
  Coding regions on vcDNA: vcDNA=SeqID_53309; Strand=-; Position=1 -33,909-977
MLKTSSFTKSRLFPNFNNLERTDDAKWVKKIIC

SEQ ID NO: 126887 - protein, 84 aa, Heterodera glycines
  Coding regions on vcDNA: vcDNA=SeqID_53310; Strand=-; Position=1 -43,664-805,1170-1237
MLKLLISLLILNVQSLKNFSFLIRLIEHVKSIRMIPRLLDLDNKEKSLSGKTSWRRNGSAETGGHKTEKNRDLIGALLAGVASI

SEQ ID NO: 126888 - protein, 102 aa, Heterodera glycines
  Coding regions on vcDNA: vcDNA=SeqID_53311; Strand=+; Position=1 -70,528-622,945-1085
LDESSGPDDVFAEAHPMQPVAADGTPTLPGGIPRNSQAQIDVVRKSTSARGKKNSVNAEGEADKAIVAKNKAGPGQPSDPSDMIMLPSTSDAPRRSRRIVAN

SEQ ID NO: 126889 - protein, 64 aa, Heterodera glycines
  Coding regions on vcDNA: vcDNA=SeqID_53312; Strand=-; Position=1 -169,391-416
MAMKINLLILFFLNFVQIFVSFSPYQWDPTNSVTNVHTFAKFIDNLFMTYTMNNKMGFLIRTRP

SEQ ID NO: 126890 - protein, 80 aa, Heterodera glycines
  Coding regions on vcDNA: vcDNA=SeqID_53313; Strand=+; Position=1 -57,925-1017,1137-1229
MASIPALINHLARNVDYSDPWDVAVLKLYAETMGNIWDPLFTYLDEVITSLEDRTNSPSPPTLNGTNLAFRQTQAQHLLW

SEQ ID NO: 126891 - protein, 162 aa, Heterodera glycines
  Coding regions on vcDNA: vcDNA=SeqID_53314; Strand=+; Position=1 -93,174-368,2193-2285,2405-2512
MLKSLLQPFDDDVEEDSEEDSHLAAIIDTAQKLADRQLSTEGEDPSVGTVDRAAKPAWKRLKSQLGRSIARRFERRCKYIYASSVESCHKRLQQSQPWDVAVLKLYAETMGNIWDPLFTYLDEVITSLENGDMPPYISESSPNNSANSLENLPSVEAPQSDD

SEQ ID NO: 126892 - protein, 218 aa, Heterodera glycines
  Coding regions on vcDNA: vcDNA=SeqID_53315; Strand=+; Position=1 -465,570-758
MASKNGLIMKHLKILFPHIISNSRLPKPAKIASPTQSESVFFYRSSSSSLLSLDSATSTTTSSSNSSGIGTSDAETPPLAFEGEQRQQQKPNSSSRSGTSKSQNLCGGTALKMAADGKKQQKVGHKTAPTAAAHCCPMEEEEQQQSMDKEQQQFEASSTAHCSPPSSSSGGQSGAAAASVLLVDLSNPMLQQFYVQQRLFFRQIYAQQFAALSARLGM

SEQ ID NO: 126893 - protein, 84 aa, Heterodera glycines
  Coding regions on vcDNA: vcDNA=SeqID_53316; Strand=-; Position=1 -105,276-425
MPKYAHIICTKCQNMQICIWKVILEASKQAKNMFFIGRARNEKIDFTIAEHQRISRYACRIVAERNAPANVYIYAAGFDQENNV

SEQ ID NO: 126894 - protein, 67 aa, Heterodera glycines
  Coding regions on vcDNA: vcDNA=SeqID_53317; Strand=+; Position=1-337
ILFYTLKDFLLIQNFLKFPKIRNPAQDPADFKCRICRINPAGSCPVKNFEFQSCNRIRKFEISGLYL

SEQ ID NO: 126895 - protein, 229 aa, Heterodera glycines
  Coding regions on vcDNA: vcDNA=SeqID_53318; Strand=+; Position=1 -172,216-383,431-524,581-717
  Homolog annotation: Hit_ID=NP_872104.1; Match level="QueryCoverage =94%, HitCoverage=28%, E-value=7e-38, Identity=43%"; Hit description =c2, putative phospholipid binding domain containing protein (69.8 kD) (4S226) [Caenorhabditis elegans] em
RPSSLHYVNSCQLYQYECAISAVLEICEHYNRSKLFEAYGFGAKIPPAFAVSHMFPLRLNNNERVVHGVAGVLEARLNNNERVVHGVAGVLEAYRYAVLNTHLFGPTNFAPTIREFIHKTSKLRDGSRYQVLLILTVLLILTDGVITDMQNTVRAIVDASHQPMSIIIIGIGSDEFAKMDALDAIGIGSDEFAKMDALDADDRTLSVDGHTAVRDIVQVGEETTISKLI

SEQ ID NO: 126896 - protein, 85 aa, Heterodera glycines
  Coding regions on vcDNA: vcDNA=SeqID_53319; Strand=+; Position=1 -90,165-332
MTLAQFGTAGTFPLSLKFFLTKPTANIVGKDPVRNRYPDSVEEFGPGTGFAQISGPMNRTQNGSTGASFFQIQQRNRFTGIMKIS

SEQ ID NO: 126897 - protein, 138 aa, Heterodera glycines
  Coding regions on vcDNA: vcDNA=SeqID_53320; Strand=-; Position=1 -221,397-592
MKNVKSSKPSAIPPISCILYNLGFQLNSLLSEPTQKFGEFFAKHKRGCGGELHKWISEVVDDTVLDDVYGLGYSIEQIDLELLKEPIKRYAKAIGFKETEKTEKPTEKPTKGKGKQKTDAKKVDQKLKGKKANQKKGQ

SEQ ID NO: 126898 - protein, 23 aa, Heterodera glycines
  Coding regions on vcDNA: vcDNA=SeqID_53321; Strand=+; Position=1-74
YTELTMLKESNLLREEISRCSDE

SEQ ID NO: 126899 - protein, 111 aa, Heterodera glycines
  Coding regions on vcDNA: vcDNA=SeqID_53322; Strand=-; Position=1 -103,150-192,242-327,369-558
VFSFYPSSPILQSCNFVSMALFRNGLPVPLFPKPIIGMVAGSNSVSLLPKPIIGMPVPLMNWSYSTSLRFPIFSKLSKNRSVDKLKGITAKHSLNSRKSGRVPSLNFIKAS

SEQ ID NO: 126900 - protein, 42 aa, Heterodera glycines
  Coding regions on vcDNA: vcDNA=SeqID_53323; Strand=-; Position=1-131
RQANTLVMSEENIAVCFLHLKVIEELKVQCDRSEAKSKTIHL

SEQ ID NO: 126901 - protein, 19 aa, Heterodera glycines
  Coding regions on vcDNA: vcDNA=SeqID_53324; Strand=+; Position=1 -16,292-335
MSIKKENTKIKQIPRKCEK

SEQ ID NO: 126902 - protein, 149 aa, Heterodera glycines
  Coding regions on vcDNA: vcDNA=SeqID_53325; Strand=+; Position=1 -187,524-786
MPSDSTDNSTNRGAKRSADAVKRSMDLEKLKDDKRKRRQHRHEEGIRRQKALLLLQSEFRTAPIAPVPLASVVVSTCPPPPVPPKLQSVAHSGPLTRTAAGSSKMHSKNKAQKKPYSSDDSTWSDGSEGPSEPKRRMIICSDDDEKMEG

SEQ ID NO: 126903 - protein, 633 aa, Heterodera glycines
  Coding regions on vcDNA: vcDNA=SeqID_53326; Strand=+; Position=1 -1042,1106-1422,1476-2018
MLVHFMNVFYAGIVLSCVPSRLQSELINVDFTVDNQNYFDSGKYRTFSKDATAAEHFGYSRNTACRIEKCERDSEWAVSLQNVYTLHSYQSVFFEMKSLVKMSPLACFEYNGHSFTFFEDSESGETTIFRGHQHKIVQRLSKHGRVVFDHLSGRLFLIDKYQRRISEIELEYLEHWWLRKNQSSAHTILKSNFVAFLPPDKSDFTLADNHVFVIRDQRIYKFHIGDYAKGNRALTFVTNSNDVRFNYLIYKPKDQNVSRGVFAHLRMSDAWMPISYLFNLLLIVLCTYILKQLRRVNRQSPLNVSDSADYYSSPFIDDAYSPQHQQLLNIPYETETSSDQSGGARSRKKLLSFYIIVTIYLPAYCMQRAIRYLIDSYGLSSVDDLYTCLKEEIKSGPEGGNCLYPNPLCAVDCVHVANADHPNQPVHIDGSLELIADVELYSTCYPKRKFEGIERTSVCGAERSEDLSGRLAAVSIAPFRTTEQQQQQHGPDSRRAGSIQLLERRRARKRDYNLVRVLCRFNNCGPYRLAKQLQKRRTENLTYLNRLDIETAHLRKNIKVIPDALCPNGANQVFAYRGFLGITVQQHLYSRHRVMLKYPGLPCIVQFGGGYHRDLFPIELLRVANAEMHSEIA

SEQ ID NO: 126904 - protein, 143 aa, Heterodera glycines
  Coding regions on vcDNA: vcDNA=SeqID_53327; Strand=-; Position=1 -65,170-536
MTKVATAERTTTMVARKIQGRRAEALDNIEKKYSKMEADIGGEESDEDTVDFFVDSVEEIMEKYVSKENLLRANSRFILIRIRRSEEKAKKWMDTRGRDEAKTVSVEFLSAQAQAVKKEDMDSSNSEKDLDEPTSTVYLDRKN

SEQ ID NO: 126905 - protein, 676 aa, Heterodera glycines
  Coding regions on vcDNA: vcDNA=SeqID_53328; Strand=-; Position=1 -1022,1069-1320,1370-1460,1505-1696,1745-1865,1916-2268
  Homolog annotation: Hit_ID=NP_001004509.1; Match level="QueryCoverage= 97%, HitCoverage=43%, E-value=4e-80, Identity=30%"; Hit description =si:busm1-180o5.3 [Danio rerio] emb|CAD60788.1| novel protein similar to DNA polymerases [Danio rerio]
MRNNEETKAVNCHSLFSVCMTIFKGQFLKENQLAIVPECGYERNDRASVFAIKYLDWRSKKDGTRIQHAGNGLEKRWQQFRLDGWIEEQNKCIEVLGCYWHGCERCFKPEDKLVDGKTCRELNELTHLRLLKLRGPPGDLHSRLEIEAVWECQIREQLKRDDEMRDFFADLGTDRGPIDPRQAYYGGRTGPLQLIAEPKEDEKISVFDIISLYPWVNYSADYPVGVPSVIHPTAEEMLVDWTRAEQLQYRGIYRVRVIPPRGLRIPVLPLKIDDRLLFCCCHHCATAFRKTNTRRTHKCIHTDEQRAFTGNYTHIELERALESGYRVDRFWRAWHYDEWYGSDEIFKDYVRLLIKLKVSDHIYVTEHRFWQIEASGFPDGVVCAEQRHQYAEEYRRTYGVNLDLGHVCKNPGLRFIAKLMLNSLWGKFSMRNELGVNKVITRPQEFFDIILDHAIEVTAIIPLSDRAVRVLYKHKRNFITEHSSSNIVLSLWTTSRARLKLLDFMTQIERTEGAKLLYTDTDSVVVLHKRDVAPIQTGEYLGQMSEEYLNYNIKTFVCGGAKQYGFRMKDKSTGAVEYVLKIRGITFDVNNSKALQFENFQQKVATYGRNVNIGNNDHHNDDSDNNGNAPSVFRYNKIMPTRDSRIITREMRKKYVPVCQKGIINEQYEVFPFGYE

SEQ ID NO: 126906 - protein, 408 aa, Heterodera glycines
  Coding regions on vcDNA: vcDNA=SeqID_53329; Strand=-; Position=1 -430,501-1297
MKRVEADTVKASALTDHRGGDEECMVKRPRRQSWDFKTMSHFDMDAATGENRPKSPPLFEQRHYYVHRVERFAMQRHVTEFLLNGQHDEPEEELQRTFKHIIERAIRNAEDPKQQTGSGARGDLSDSRRKRQVTRLGILLNGRGLSDPIVLPIRPPEQNTAEVLMAELDKLGQSDGDEDVHGGGISKRSLLLSEPIEIIVTCIAPPVGAAPRFHQYQHWGYDDRQMIRIMHMDDNYCLFHALIATRAYTDQEFLKLSSRRAAEAEEDGGPQGAVPAEIVRRVMTRPDFCAGYEALNRLVSNRERMKTAVAELMHTAGIPTDEDAYGMEHLVQIQQFWVNAISKISLFFNTKNRTKPTLVCTGLFCSKTIPRNCLARFGRALWDAASMCRFLCPKDTILASKRYTASSN

SEQ ID NO: 126907 - protein, 192 aa, Heterodera glycines
  Coding regions on vcDNA: vcDNA=SeqID_53330; Strand=-; Position=1 -165,224-424,587-799
MNCLKRFEIAASPKKRVSEEFPTVLKHLRDLKNFNAPGVFYANAKVTDLQFSLYKACPLKNRGMLCKKKLDDDSFCGICMHRANRPLRGLYMRLELHDCGDMEISQHATMFASVAESYLDMKAKGEHGLLDWVISALIEGEKMQMEEPTVTNNGQFGDGDGAEDGEIIALDSSDNAFAPSGGGPPKKRAKKN

SEQ ID NO: 126908 - protein, 1685 aa, Heterodera glycines
  Coding regions on vcDNA: vcDNA=SeqID_53331; Strand=-; Position=1 -1416,1965-5606
  Homolog annotation: Hit_ID=NP_498959.1; Match level="QueryCoverage =62%, HitCoverage=49%, E-value=1e-161, Identity=33%"; Hit description= zn-finger, CCHC type and RNA-directed DNA polymerase  and Integrase, catalytic domain containing protein
MITRSPPLTRQRALNLRMFGNVENRPAAAATQQNQEENRDNTNFTNNPISPNITHNLEEHNQNQSHFSEDEIMGDDEIRNALLRVSIEPSHARQQNVLGAEQQQQGNVTGIAEFRNIGIVIDRNNERGRDPDNFGTQNVAMNRQVAQFDSMVVLAQNIPQNNHRTSTPLPDNGLTHNIQRSSVGVFDQYNMGNRQLHQNHHLSHHPLAPFVPIEQNNARIRNVEERVQNRHAIPIQQLRQQIPVNADAFPAFQFQHGQGFEKGVQWQLPEQNPMFFERNNQVRVETLPNLPQNRGGAIVNQTQRPNPIFGHSKTDTTVPSNLELNLVLERIPDLTGKEGMDKVRKFFKKFDVYTEGWPEKTRISALQSKVYEKAERALEAALSTQPFRYECIRREMLQQMEETDSRNLNAFDELMMGVCRKPNEGIDDLANRISTLVRSAYPGLTSNLSDEYSIKFLIRAMDNPELALNLELDETVPAIGKVMAVKVQLFGQETEAMLDGGAQISLISAYFLYKLLKEEKVDLGTLKPSKSLARVLDVNGKHLSCLFSVKLPLCRRGLKFPTNIIAHVTKAPIGFDLLIGTNGLAKLGFKLYDNLNDEMVEFEKFEAKAKAQNFLTVIYRTVIEPRSTKIVEFEIDQNHNDSEILISSVQTDKLHIEPTIGKVKGGKVIAPITNLSMTTITLEGKQKIGQFESITEIGESDDILANPLIVSSLCKQLDSIELNPNLKIWDLWKEKTGMLSENELARLRTLSKDFTEIFAVVDNELTQTNLVEHRIETGDAAPIKLKMRPVPYAYREKIAEMIQDYLGRGVIQPSISPWASPIVIVPKRDGSLRFCVDYRSVNSVTRKDSFPLPNIDNTLLMLGGKKFFSTMDFMTGYWQIKMDKESVEKTAFTTEHGLFEFIVMPFGLTNAVATFQRFMTRLFEGVINDFVFIYIDDILVASETFEEHLQHLGIVFSRIKDAGLKLKLSKCRFCADELPFLGHILTREGIKMDIEKVKPVTDLPIPSNKKELHSLLGFLTYYRKFIHSFGTIAAPLFKMLSEKVKFEIGEKEKEIIEILKTKILEDVVLYFPDFEAAQNDPNRQFIIMTDASKAGISAILSQPDFDNNVRPIYFASRQCNEHEARYSATELEALAVRFGVKKFAQFVTMIPTRVITDHKALIWMFKRKNETGNARVDRWLLELNSRFHLKVEYQPGKKNIIADVLSRSFASPKTPEICQNDEEIAIIGQIREIEPNWDELAHNYQGWVEETKLSEMGALYDFLERRIIPKDPREQQSIFDKCHKYSVISGLLYLFESGSNMRLFVPKKFREELVKAHHEGNCAGHMSGKKLCKQLSEQYFWPNMLADCVKAHEKCRICAHTRNPRANEPPLNVVKSTEPLELICMDILDVGPSHSNKKYICVIVDHFTKYLVAEPIPDKSAGSVAKIFVEKFILVYGTPKKVHSDRGKEFLNSTMEEISKMLSIKRSFTAGYDPQANGLAERVNRILIGILKRSTASNWTWDERLAYATFSYNITPSNTTGFSPFALMFGRIARFPLDQNVPFSVNPAYTVDSDKYIQLFRENLLNMLEQANKNALEARKQNKLWFDSQPRVTANKFKVGDRVMVIFPGLHRRNPHKKLIWSNFGPFLILEIGESSAKVVPIDKQKDEPIKVPIERLVKVPKGIPDISTLPKGKKNAYKETKLMA

SEQ ID NO: 126909 - protein, 46 aa, Heterodera glycines
  Coding regions on vcDNA: vcDNA=SeqID_53332; Strand=+; Position=1 -61,133-212
MFYLDVKEKSYHGKRAGAETQNFCVLKVFKITNKYYKIVHKKRRRN

SEQ ID NO: 126910 - protein, 20 aa, Heterodera glycines
  Coding regions on vcDNA: vcDNA=SeqID_53333; Strand=-; Position=1-61
FGSWNSYPKNVGNRKSFRAI

SEQ ID NO: 126911 - protein, 169 aa, Heterodera glycines
  Coding regions on vcDNA: vcDNA=SeqID_53334; Strand=-; Position=1 -212,265-562
MKRELTDRRIVEFVAGGPKNYGIRHTARDGTDERANLKIRSFRLSYTAQQLLTFEAMKDLTLATYNIDGPIDDALDNDDLYVYGGGEHRAIRVNFPQIDRNVYADLYTHEAHKDYRPFYAKGRVRPGMQTRPFGYVEDDGQPNEGQRTHRRKRNFVEQDPTQPGHSGWF

SEQ ID NO: 126912 - protein, 655 aa, Heterodera glycines
  Coding regions on vcDNA: vcDNA=SeqID_53335; Strand=-; Position=1 -423,508-839,890-1060,1234-2275
  Homolog annotation: Hit_ID=NP_507780.1; Match level="QueryCoverage =21%, HitCoverage=9%, E-value=4e-10, Identity=32%"; Hit description =predicted CDS, DNA polymerase type B, organellar and viral family member (5T899) [Caenorhabditis elegans]
MLFKAGRQIGECFVIERSTAMRNVPRNTRGEICELRFLALEEAQQSDLLMEATSSNSSTVCWLVTRAHGWSDYSSTRRDLIVHMSSGFVRRSKTTQRHWRQLSSGSMSSRQPALISLPEQQSSKSWRSGPLTPFVLIPKGEQRAVTCPDSQPQRPALPCACRSLGEHDRETRMAGGGGKAAFNLFASRQDQHGPAAAQMLTRAGIAANRDMYTLDDVQRLQQWLNNQHGVGQIRLAVFEKEQEYRIVFKGDGLAAKFNLCLVLERGHFNYIGRVEQLFDVPNYCIDCERRADARYHAFGCKVVCRLCLRNHAPAPMDGRGQRQRRPICQWRRVCRACGRIAYVATHQCPHDQPADDGICRRCNGPHTVDEPCYIQPIDDGSVRQRASIAVDNDDFDDDEDDEELPLRLCFFDAETSQDMPLQLNNRTVQKHVPLLIVAEVICERCLQAGISVNDGLGRRAPGCVCMTGMVRGQLFRQWSSPPFANAPGDNSASPVGAPAFNQRRFFFHSFDNDGNDPVDQFLDFLLQHGPKKAHTVCIAHNGGKYDFHLVLEALHRRNRPPKHLCTTGLKIYSMRLSGRNQRRITFKDSINYFFCALDALVKSFQVPDHLATLKPFFPYLYIRRQHLSQRLNGLPAQEFYAPDTMKAEKRAQFLR

SEQ ID NO: 126913 - protein, 33 aa, Heterodera glycines
  Coding regions on vcDNA: vcDNA=SeqID_53336; Strand=-; Position=1-102
CSPPPSSDLFICYFNLSSINYLFVRPFDISGTE

SEQ ID NO: 126914 - protein, 166 aa, Heterodera glycines
  Coding regions on vcDNA: vcDNA=SeqID_53337; Strand=-; Position=1 -135,266-554,605-678
  Homolog annotation: Hit_ID=AAK85734.1; Match level="QueryCoverage =100%, HitCoverage=7%, E-value=4e-81, Identity=84%"; Hit description =beta-G spectrin [Brugia malayi]
MRIHCLENVDKGLQFLRDQHVHLENLGSQDIVDGAPRLTLGLIWTIQDITFEDVDNQETRSAKEALLLWCQMKTAGYRNVNVRNFTSSWRDGLAFNALIHKHRADLIEYEGLQKSNALHNLNNAFDVAEKQLQLAKLLDPEDVNVEQPDEKSIITYVVTYYHYFNK

SEQ ID NO: 126915 - protein, 338 aa, Heterodera glycines
  Coding regions on vcDNA: vcDNA=SeqID_53338; Strand=+; Position=1-1017
MALNMQDKKGLLHQILGEADITVTTSGITISGPRLSSPRFIPFDEAGRCRSCRGTEVELDTMVTKEGITIWCTRIDRVQFVPFDIIYDLPGHCFFRVKNKARVFNIPYGDLPAITFPNHQEQQQQLQQQQQQNDLRQKANTAMDLVESGLLADSLREEGVQRAELKRKAKVALDLIDAGLTGDALHEEGQRWKKAKTALSVLGNMLLADSLPEKKTAELPLPPAEKIETLPLPPLEKMKTPPLPPADKMPSPLPPSSKVESDEQQFYDSISAATTMMDSASMQQQAPLKRKQLTPKGKSNNGMKKAAEPQHHHNVGDMDKTLDEFFESVSAATTNLSI

SEQ ID NO: 126916 - protein, 171 aa, Heterodera glycines
  Coding regions on vcDNA: vcDNA=SeqID_53339; Strand=+; Position=1 -100,190-605
MPEWFNALGTDEQQMKQRIDTLIEMERQMHEDDQSIEENNIDTIELSLGELRSDFPNGFAVDWQKLFNAIVHDRNFTASSTVLLVAQKMNGRTERQTPLDVMAEYMRNFGPKNDTLNKWEQYVEWLLILQHAALSDNKMYTWGKTDWNYFCGYLLSDFIVFSAGTRGQPMP

SEQ ID NO: 126917 - protein, 191 aa, Heterodera glycines
  Coding regions on vcDNA: vcDNA=SeqID_53340; Strand=-; Position=1 -333,392-549,600-683
  Homolog annotation: Hit_ID=NP_871701.1; Match level="QueryCoverage =100%, HitCoverage=72%, E-value=5e-21, Identity=34%"; Hit description= RanBP1 domain containing protein, Nuclear Pore complex Protein NPP-9 (95.6 kD) (npp-9) [Caenorhabditis e
ATGDNFLFGIGASKTTAPMTATTTALTTSAGSPFAFGSSASTTASPVATTTTASATLPLLFGTQQKTTAPAAVPSSVPTFSFGTAKFPSFGSSAAGGTLFGSTTANTLTTISSADVSKAGKVTDKGGDSDDEAAEEFVPTGTFKPIVPLPSKVDVKSGEENEEVLFSARCKLFRYDPMDKKNKERGIGELK

SEQ ID NO: 126918 - protein, 84 aa, Heterodera glycines
  Coding regions on vcDNA: vcDNA=SeqID_53341; Strand=+; Position=1-333
RRARAVLSPLARPPRPPLPPSPPQPPPRPLSRFSLALSRKRRHPPLCLPPSPPSLSAPPNSLLLAPPPPVALSSVRPPPTPSRQ

SEQ ID NO: 126919 - protein, 386 aa, Heterodera glycines
  Coding regions on vcDNA: vcDNA=SeqID_53342; Strand=-; Position=1 -1049,1100-1208
  Homolog annotation: Hit_ID=NP_001004509.1; Match level="QueryCoverage= 91%, HitCoverage=24%, E-value=2e-42, Identity=31%"; Hit description =si:busm1-180o5.3 [Danio rerio] emb|CAD60788.1| novel protein similar to DNA polymerases [Danio rerio]
MYEMRIRRQKKRNPNIVFRDSFNLMPMSLASLVPSFGLDVEDKPFFPHMANHPDNYGKQIHPTPDDYLVNGMMPDKRQKFDDWYEQHRQEPFFLDEALASYCTNDVEILMAALVAFRHEFLDVTKRNEGIVAERAAFYEHHDGIDVLRECMTIAGACMKHFRTNHLPKKHLAIVPERGYDNAQNQSLLALRFFHWYAEEHGVVVQTAHSAGGEKKLGQYSVDGWVEAERRVIEVNGCVWHGCNECFPNDNMMMPNGKTAGEVRERDEKRLEFIESQVSRVDVYWECQIKRMLNRDPDMRESFGDYVDDGPLDIREAFMGGRTGPLKLYHKAGEGEKISYYDFTSLYPYVNFSTTYPIEHPKVLILNENVEWTTARDNPYKVSLLKG

SEQ ID NO: 126920 - protein, 70 aa, Heterodera glycines
  Coding regions on vcDNA: vcDNA=SeqID_53343; Strand=-; Position=1 -42,282-452
MTVTSNTEFRLIECVKGFLRQEDGTSQKVVNEYYEKYDGLNGFAEFIRNWAFTFFCLHAFDDDDDTSDED

SEQ ID NO: 126921 - protein, 125 aa, Heterodera glycines
  Coding regions on vcDNA: vcDNA=SeqID_53344; Strand=-; Position=1 -147,190-420
MNIFCFCLLQCCLAKRSMNFNNLTTPIDEQTMIETLSLDEPSNELRSVEKMDEELNKKEEPFTLAECCTAFDLVAFMFDCKIPVPYERSTSVTYSSTRTSRVSSTSPKMETRLSSRELSNSLDTS

SEQ ID NO: 126922 - protein, 23 aa, Heterodera glycines
  Coding regions on vcDNA: vcDNA=SeqID_53345; Strand=-; Position=1-69
MTARKGDMKFGHQKFWHREVWAP

SEQ ID NO: 126923 - protein, 69 aa, Heterodera glycines
  Coding regions on vcDNA: vcDNA=SeqID_53346; Strand=-; Position=1 -21,601-789
MPKIVRIDFLLPRDLMEKIFALESDSELDKMEVERLTDQLLKEVPRSVLDRLELPRFYSRLPFSSETIN

SEQ ID NO: 126924 - protein, 103 aa, Heterodera glycines
  Coding regions on vcDNA: vcDNA=SeqID_53347; Strand=+; Position=1 -93,415-633
MDVPRDLADVCAGTCGRVFGKIPLKSLHCIKWHHQCNAPQTEDPTPVNENGPEPKDATVKTFQNQRRLTRQTSKTKSQIHSPKLTILYPPTAIFSKTIHPLIQ

SEQ ID NO: 126925 - protein, 79 aa, Heterodera glycines
  Coding regions on vcDNA: vcDNA=SeqID_53348; Strand=-; Position=1 -114,363-488
MIDQMWQKVYELGDDCSMCQKMRKKWEPHQNETFFVVNTGTLISLAKKMLKLVIFYLFIFKNKITKLPLTLLMEIRSNG

SEQ ID NO: 126926 - protein, 90 aa, Heterodera glycines
  Coding regions on vcDNA: vcDNA=SeqID_53349; Strand=+; Position=1-273
MLALCRFLFPLDLGFLFLIIFPIVNAEQQQQNLWSGFYQNFALELPQEERSDDTLALFAEMDEVDTVLTDGIGAAIMAPPSPAHPAFQAI

SEQ ID NO: 126927 - protein, 50 aa, Heterodera glycines
  Coding regions on vcDNA: vcDNA=SeqID_53350; Strand=+; Position=1 -27,230-353
MEEGNYEQKTLAQLLKPLTIVTRSAQRGAAEEDAVPTKRQMGIRRGPLAN

SEQ ID NO: 126928 - protein, 135 aa, Heterodera glycines
  Coding regions on vcDNA: vcDNA=SeqID_53351; Strand=-; Position=1 -249,336-494
MIKRFPKLTSKLTFTNLVKLDEKEVYSPVKKISAPQKTKGNCQCGRTEKATMAKLTLTNLEDKKPIELRFKEDDVLGEGTYSKSIGTTMFNKCVALKMTRKDLESSDWQKHTKEWKIQKAFDQLKEQKHVIKLFA

SEQ ID NO: 126929 - protein, 137 aa, Heterodera glycines
  Coding regions on vcDNA: vcDNA=SeqID_53352; Strand=-; Position=1 -11,71-160,944-1253
MNRRWICNDVWMDILPSFDRPQLGIKMALLSDQGYIDYSVIEFVRSNKQIWDRMGTNLELSIDNDQLIWDVFCREIWPNFATNIRHLSFTNDNHLDNLRNGISLTILTDLNHLNSINSNFLLPDAIADDGPNASAGQ

SEQ ID NO: 126930 - protein, 171 aa, Heterodera glycines
  Coding regions on vcDNA: vcDNA=SeqID_53353; Strand=-; Position=1-516
MKRILLFSVIVLLIVQIEIGAEKKKTEQKTFDEIFGEKWEEKENEQKMKEIIEKYYQIKEKIKQRGRKYSAKEWSKIEWKIGKKLGTNRQYIYKWIKELNLQKNKCYKSKTDDQKIEIVQKFIAMKNEYKQKGRKYSAKEWKKNYAEICKKIGVCKRVIEKWKKQFGLSRQ

SEQ ID NO: 126931 - protein, 70 aa, Heterodera glycines
  Coding regions on vcDNA: vcDNA=SeqID_53354; Strand=+; Position=1 -24,484-672
MGYKRAYTSNVTVVETVIANAALSFHFYYFLYKYLNSLRRSAHLAGLIGDRYLIIGIVIMFKNLPDESII

SEQ ID NO: 126932 - protein, 192 aa, Heterodera glycines
  Coding regions on vcDNA: vcDNA=SeqID_53355; Strand=+; Position=1 -127,227-291,336-399,444-535,629-742,788-904
  Homolog annotation: Hit_ID=CAE61890.1; Match level="QueryCoverage =88%, HitCoverage=62%, E-value=9e-13, Identity=30%"; Hit description =Hypothetical protein CBG05881 [Caenorhabditis briggsae]
ALSSEGRISKLYVECFNEREKCLTVIGGGKMATALVHGLVSAGFIDKSEVNICSRSKETAFRWTTQGYQNAYTNDEFYSKVKKPRGIVIVAVKPQIFPGFLDELRKNGWLNFVGPELKLVGFNGHAARFMPNVNCLVSAGIVLVCADDCVPTEMVTLLLEMGSKLGYSVRIDESLFDAASALASCAPAYVRM

SEQ ID NO: 126933 - protein, 143 aa, Heterodera glycines
  Coding regions on vcDNA: vcDNA=SeqID_53356; Strand=-; Position=1 -96,135-252,468-685
MPKQNEIVLKYSFLDLTWFLDIEAVFYAISKTKKCLVVKTIFHISLHNFVSSARIETGIRPLERAARALQEVKKLFEFLQFCFHNFRKLFGIIMPKQNEIVLKYSFLDLTWFLDIEAVFYAISKTVIPNPRFLNPVFRKNALW

SEQ ID NO: 126934 - protein, 113 aa, Heterodera glycines
  Coding regions on vcDNA: vcDNA=SeqID_53357; Strand=+; Position=1 -60,563-844
MMEVSQIQLKMLRPLLIAIYDKIREKYTEDYNQYGFGTIELVKEFKTDEREPFVMRDDVELWHEDLDEYKTMEQCGIRKGSTVSVFYARRLDKEEYDQGFYIRPWPTPKKICF

SEQ ID NO: 126935 - protein, 21 aa, Heterodera glycines
  Coding regions on vcDNA: vcDNA=SeqID_53358; Strand=-; Position=1-65
MKLVGLDSYCLFRKTSKESLK

SEQ ID NO: 126936 - protein, 154 aa, Heterodera glycines
  Coding regions on vcDNA: vcDNA=SeqID_53359; Strand=+; Position=1 -201,943-1084,1478-1599
MSSSAAANAQMSHAAAANNNHHQFAPHAPPPVPVPPPTNLLANPGAPPPPAPPIQQQQQQNTTTTAQDKQVDDSSDGKAGQQQHPQSEGEDDEQHNFRHCAETYSDEETASANNVWWATTFGWTFSPFLTMLNWPQIGALFNALVGKHFDGKSE

SEQ ID NO: 126937 - protein, 126 aa, Heterodera glycines
  Coding regions on vcDNA: vcDNA=SeqID_53360; Strand=+; Position=1 -51,636-803,1157-1301,1547-1563
MALLSPCFELWWTNISMHISNNVWMEIFLFFDHAQLGLKLALLSPVSISWWTNILMKKQNDCGPQIERTNLNVLVFSDVWMGSFPLFDRPQLGLKLALISHRFDVLVDKHFDGQTRIFSNFESFSF

SEQ ID NO: 126938 - protein, 66 aa, Heterodera glycines
  Coding regions on vcDNA: vcDNA=SeqID_53361; Strand=-; Position=1 -58,113-193,306-367
MEEDDDEDLQEEAGTDVQSGPTQKAKKKTLAQVLAPPKNAGKDVQSDEMSMIVFQLHELEKGNMKD

SEQ ID NO: 126939 - protein, 86 aa, Heterodera glycines
  Coding regions on vcDNA: vcDNA=SeqID_53362; Strand=-; Position=1 -117,824-967
MPTGSRVPLIVERRSDETEEDTWTVYPTAGICIKFKEVTVDVLVNSEFFHKRISQSEFFRQLTLRIVCQAIEVKWLKMANIYFFIQ

SEQ ID NO: 126940 - protein, 156 aa, Heterodera glycines
  misc_feature (8)..(8): Xaa can be any naturally occurring amino acid
  Coding regions on vcDNA: vcDNA=SeqID_53363; Strand=-; Position=1 -40,1099-1232,1312-1394,1513-1731
  Homolog annotation: Hit_ID=NP_505775.2; Match level="QueryCoverage =95%, HitCoverage=27%, E-value=2e-50, Identity=66%"; Hit description =putative protein, with at least 3 transmembrane domains, of eukaryotic origin (5L370) [Caenorhabditis ele
VFGMPENXVPEIESKGFDSEFDDIANEPPLLEELGVNFQHIWLKTMAVLNPLGIASAEVIADQDLAGPLVFCLLFGASLLLHGKVSFGHIYGIGLCGCVGMYALLNLMASQHNSISFTCTASVLGYCLLPMSLLSLLGAVLSLKSVSFFPLSPKNH

SEQ ID NO: 126941 - protein, 139 aa, Heterodera glycines
  Coding regions on vcDNA: vcDNA=SeqID_53364; Strand=-; Position=1 -113,556-862
MERQRVGDVQQVEGGECASDHTARGGQTTARFSMICGNDTNQITMANLGISLSSIVHHHFAAALLVQNTVTTLPATDRVFGPDFVFLVAICAMRGKQMNTIKQIGQNPPPQMYVTVPSETVPMPPPVDALVGAVPPPND

SEQ ID NO: 126942 - protein, 79 aa, Heterodera glycines
  Coding regions on vcDNA: vcDNA=SeqID_53365; Strand=+; Position=1 -143,200-374
  Homolog annotation: Hit_ID=CAE74118.1; Match level="QueryCoverage =73%, HitCoverage=93%, E-value=2e-17, Identity=68%"; Hit description =Hypothetical protein CBG21781 [Caenorhabditis briggsae]
MDSAATTPHHQSFGGGTAPTRASTGGGIGTVSLGTVTYICGDCHKENEIRPKDPIRCRECGYRILYKKRSRKMMVYDAR

SEQ ID NO: 126943 - protein, 198 aa, Heterodera glycines
  Coding regions on vcDNA: vcDNA=SeqID_53366; Strand=+; Position=1 -130,667-792,1064-1193,1322-1369,1513-1681
  Homolog annotation: Hit_ID=NP_500396.1; Match level="QueryCoverage =93%, HitCoverage=46%, E-value=1e-78, Identity=75%"; Hit description =metallopeptidase family M24 (4E448) [Caenorhabditis elegans]
FQNGILIQAVVTVFHRGFHGDLNETFLVGDAVSEENLKLISVTYECLRQAIDIVRPGVKFRDIGNVIQKHANANGFSVVKRYCGHGIHRLFHTAPNVPHYAKNKNVGVMQAGNAFTIEPMINAGSYDDDQWPDGWTAVTKDGRASAQFEHTLLVTETGCDVLTERSVAGAPRPWFRDQLEQLGYNRKAAAVVPLRMRM

SEQ ID NO: 126944 - protein, 78 aa, Heterodera glycines
  Coding regions on vcDNA: vcDNA=SeqID_53367; Strand=+; Position=1 -166,1162-1232
MRRKRKRELDKQQSTGEGDSVSTSTDSEKKEDSDQTITKSPQSETSEKSEMVAEDGHKKPQNPDGIILDFVFDFRFGQ

SEQ ID NO: 126945 - protein, 25 aa, Heterodera glycines
  Coding regions on vcDNA: vcDNA=SeqID_53368; Strand=-; Position=1 -34,966-1009
MTTFLKQIKCIKIKDSIRISMVAGY

SEQ ID NO: 126946 - protein, 252 aa, Heterodera glycines
  Coding regions on vcDNA: vcDNA=SeqID_53369; Strand=+; Position=1 -66,167-443,504-639,739-927,1022-1109
  Homolog annotation: Hit_ID=CAF98539.1; Match level="QueryCoverage =97%, HitCoverage=19%, E-value=1e-31, Identity=32%"; Hit description =unnamed protein product [Tetraodon nigroviridis]
MPSEVGISKHLDLLRKEHVRLQRTLWGAPMEFEVLKMFPLQILSTPFCTLSPNFTTRICTGRSFLSRLWTLFFCGFSDITIHFDGHQLRGHRIVIAARTDFWGDLSTVERLELTEIPGKVAKVMMKWMYTNILDESIGDSVLLPLLEAALKYHFEDLKTRCEEILIVRIDVENCAKVYQFAELHSLDRIRDFCAEVVSDRWSEFTPEHFLDMPAQLLYRLLKRKSGANLLGSLIRLQREDVLFLFLIENDAR

SEQ ID NO: 126947 - protein, 21 aa, Heterodera glycines
  Coding regions on vcDNA: vcDNA=SeqID_53370; Strand=-; Position=1-65
MLPSNPDDKIDEVDKILSKLD

SEQ ID NO: 126948 - protein, 299 aa, Heterodera glycines
  Coding regions on vcDNA: vcDNA=SeqID_53371; Strand=+; Position=1 -142,203-338,438-626,717-804,921-1086,1161-1339
  Homolog annotation: Hit_ID=XP_415742.1; Match level="QueryCoverage =89%, HitCoverage=17%, E-value=1e-44, Identity=36%"; Hit description =PREDICTED: similar to KIAA1255 protein [Gallus gallus]
MDFVFSFGFSDITIHFDGHPLRGHRIVIAARTDFWGDLSTVERLELTEIPGKVVKVMMKWMYTNILDESIGDSVLLPLLEAALKYHFEDLKTRCEEILIARIDVENCAKVYQFAELHSLDRIRDFCAEVVSDRWSDFTPEHFLDMPAQLLYRLLKRKSGANLLGSLIRLQREDVLFLFLIENDARLKTILNDFDCDGQLPLGIAFELKQLKMAKCLLTHGADVNKLDERGNSLLWKAIEKGNADVCDFLIENGANLNYVHEESGETLLHVLAKSKAKSQWTPGELTNFDVNALNRNGRW

SEQ ID NO: 126949 - protein, 276 aa, Heterodera glycines
  Coding regions on vcDNA: vcDNA=SeqID_53372; Strand=+; Position=1 -121,193-293,518-850,960-1235
  Homolog annotation: Hit_ID=XP_307941.1; Match level="QueryCoverage =86%, HitCoverage=23%, E-value=1e-17, Identity=32%"; Hit description =ENSANGP00000006257 [Anopheles gambiae]
MHDNASRSALQIALLERHNLEIAEKLLAIDGLDLLCADKKTGQTLIHKTVAFSDQIAAQFLAANGVPVDVPDAKSGANPSSVDGVSGCTALHYAVSKPRAVLDALLPHCDSATIGTTDRDGRSPLWCALLASKFDTAALLIGAGADINEKSADGVPLLIKAIALKRDDISRFLLANKAIAAVTSPDGFTPLNLAVQNGLTSTVDQLCKLGANLNHPNPLNGLIPLWTALENGDFGTAEVLIAHGAVIVHSNARKFAVCAFSVGYRRIVRQRRTNDG

SEQ ID NO: 126950 - protein, 227 aa, Heterodera glycines
  Coding regions on vcDNA: vcDNA=SeqID_53373; Strand=+; Position=1 -206,622-714,1208-1592
  Homolog annotation: Hit_ID=XP_239269.2; Match level="QueryCoverage =85%, HitCoverage=14%, E-value=3e-11, Identity=27%"; Hit description =similar to ankyrin repeat hooked to a zinc finger motif long form [Rattus norvegicus]
MSCRIDAQDADGRTAAHIAVLEQDQHTLELLLAHPDPSPLGVRDRYGHTPLALAMRAKQNKMAEAICKRLTSTLQPKTRNGSRHCTFVVAWARNSFCAIWQQNILHLCAINIGHVSAEAFVEILRVHPNYPLEVADLYGNTSKTMAWQQQQPVSGLAISVFLLAFINGNSELCKLALKNGACMGTMNSQGQTVFNFSTPTQQLLIGLLGTDGLPFNGLFCHCKNKNW

SEQ ID NO: 126951 - protein, 33 aa, Heterodera glycines
  Coding regions on vcDNA: vcDNA=SeqID_53374; Strand=-; Position=1 -42,563-622
MALHRRTELRLLRHTRDQTLHLLLLGPSGHSFV

SEQ ID NO: 126952 - protein, 86 aa, Heterodera glycines
  Coding regions on vcDNA: vcDNA=SeqID_53375; Strand=+; Position=1 -142,248-343,393-415
MTGDKMKANYEVAKKAKREHQRQFTAEEERRAAKQNLVKAKPTKCQSASNQKAIQCYLDEMTEKANNSWARVGKRTEMPRHRLMLA

SEQ ID NO: 126953 - protein, 250 aa, Heterodera glycines
  Coding regions on vcDNA: vcDNA=SeqID_53376; Strand=-; Position=1 -11,71-346,400-826,1247-1285
  Homolog annotation: Hit_ID=AAL78214.1; Match level="QueryCoverage =62%, HitCoverage=78%, E-value=1e-10, Identity=30%"; Hit description =putative esophageal gland cell protein Hgg-20 [Heterodera glycines]
MNRRWICGDVWMDILPSFNYAQLGLKMALLSDRFDVLVDTHFDGKSELTIWKAIAIRKDKGPKAKLSEWIDGKRVEFPLPDRPLPTKIRFKSLWINYIDHSVLAFLRSNKPIWDRRGTKLELSIWSNKTEDDQRIWDVFTREIWPLFATNIRHLSFPNGDDLDNLLRLVSPTILTDLDQLNSIDSGYLSSSAIADDGGPNAISAWQALAKWLHTPSKDGQPKRLRCDDFSKSINYFKEAIVAASGRRRSG

SEQ ID NO: 126954 - protein, 56 aa, Heterodera glycines
  Coding regions on vcDNA: vcDNA=SeqID_53377; Strand=-; Position=1-173
RKVFKIAEKIDNMKQYYKMKKQNSELTDHEIATELGIPRSSLYKYNSKLMGDEKKF

SEQ ID NO: 126955 - protein, 495 aa, Heterodera glycines
  Coding regions on vcDNA: vcDNA=SeqID_53378; Strand=+; Position=1-1488
MLEQANKNALEARKQNKLWFDSQPRVTANKFKVGDRVMVIFPGLHRRNPHKKLIWSNFGPFLILEIGESSAKVVPIDKQKDEPIKVPIERLVKVPKGIPDISTLPKGKNPFKNELKLMALYAGINWKFKNAYKETKCCKNEAPLQLGTIAFDCLGVELGKPKLISARVNVEKGIMIGFGWSSTCAGDIPGHDLCEPITLGSLDPVLGLTKLGSMVAKTPLQALLGIFLLRSGVASSLTAAQTLVEVIVKAQPKLELCMYFGKRGDQISSGKYPTEEDQRKALEKWAGSCYVARQALAATGFNPLEMEEPEGVNSLPESEKLKWKEVFGQSAWALECVRATVVHKAGRFLAHQRVLLGDSSAAALSQYIPNSFCIGQEGSMADIIRQFQPTILSSRVKAMLIITGRDSLVAGETAESIAEQFEMVVELCRRFSHVKIYWCPPPYVHNKSAEYDQLIDKMRALINNGPIISICITEKGRSVLEIFRFGGARRSQFPS

SEQ ID NO: 126956 - protein, 176 aa, Heterodera glycines
  Coding regions on vcDNA: vcDNA=SeqID_53379; Strand=+; Position=1 -353,1019-1193
  Homolog annotation: Hit_ID=CAE63301.1; Match level="QueryCoverage =72%, HitCoverage=22%, E-value=4e-09, Identity=34%"; Hit description =Hypothetical protein CBG07688 [Caenorhabditis briggsae]
MREEANISPADHLALQSLRSSALARKTNTTTKLTRDCRKLFADLMTGEEDGEEKQKKSNEKKEKPKMKEADEKKKEQANCEKKEQKREEKGGENERERGSGAELMARGPIRVPPVVGRSPAAPRGGIANNENSPQFNTKGTAKAKEKPRPAKERLRAMIRSEDMDNAWAWTCKCIQ

SEQ ID NO: 126957 - protein, 115 aa, Heterodera glycines
  Coding regions on vcDNA: vcDNA=SeqID_53380; Strand=+; Position=1 -33,401-463,569-820
  Homolog annotation: Hit_ID=NP_510540.1; Match level="QueryCoverage =74%, HitCoverage=14%, E-value=4e-12, Identity=39%"; Hit description =ankyrin (66.5 kD) (XP981) [Caenorhabditis elegans] emb|CAB01860.2| Hypothetical protein C33A11.1 [Caenorh
MSGCETVYNEITQIVNILCAHSSISLNAQNGNGLTPLLNAFKNHAERSEESQSQINNFGTIEALLRFGADVSLADSASGKTVVHYAVEKMDLQLIEVVHFIHFITIHRTCTKKVK

SEQ ID NO: 126958 - protein, 70 aa, Heterodera glycines
  Coding regions on vcDNA: vcDNA=SeqID_53381; Strand=-; Position=1 -35,90-267
MEKGHNVWINEMGLSLLSASVCSASDQCQTHLFPLGFFHAVSHSAQIVHWCLTTKIFLINQLGHSMLTDI

SEQ ID NO: 126959 - protein, 105 aa, Heterodera glycines
  Coding regions on vcDNA: vcDNA=SeqID_53382; Strand=-; Position=1 -280,648-685
MNSLILNIGLFKKSKNGKIGICLVCKEQNRQKSEFSINDSSTKSLIVHLNSSLHKGSEYDKKFQQLETEWKSAKQKQQKEQPKITNVMNMTSSDFYQEISFPRAK

SEQ ID NO: 126960 - protein, 133 aa, Heterodera glycines
  misc_feature (36)..(36): Xaa can be any naturally occurring amino acid
  misc_feature (48)..(48): Xaa can be any naturally occurring amino acid
  misc_feature (58)..(59): Xaa can be any naturally occurring amino acid
  Coding regions on vcDNA: vcDNA=SeqID_53383; Strand=+; Position=1-403
  Homolog annotation: Hit_ID=BAB33421.1; Match level="QueryCoverage =91%, HitCoverage=43%, E-value=1e-47, Identity=75%"; Hit description =putative senescence-associated protein [Pisum sativum]
SKNIAILPRRDSDLEAFSHNPSDGSFAPLVYRPSTXTKCLNLRFLSYXAGLLLATGLXXGKTNLSHDGLNPAHVPYWWVNNPTLGEFCFAMIGRADIEGSKSDVAMDAWPPQASYPCGNFSDTSCWKLYTFKR

SEQ ID NO: 126961 - protein, 60 aa, Heterodera glycines
  Coding regions on vcDNA: vcDNA=SeqID_53384; Strand=+; Position=1-185
KPSSSSSRRSSPLPVQVGQDYVSTIELSKRGGGAAAGGGDQRGWPLKSPTTMTASTSSAC

SEQ ID NO: 126962 - protein, 68 aa, Heterodera glycines
  Coding regions on vcDNA: vcDNA=SeqID_53385; Strand=-; Position=1-207
MSAHPTAYCPLASSGNTLPTGGDGDGAAATGGGCCGSDGVVPFGGGGGDGDGVVLDGNNPIANKDMKI

SEQ ID NO: 126963 - protein, 52 aa, Heterodera glycines
  Coding regions on vcDNA: vcDNA=SeqID_53386; Strand=+; Position=1-158
MGLLPSKTTPSPSPPPPPNGTTPSLPQQPPPVAAAPSPSPPVGNVLPLLANG

SEQ ID NO: 126964 - protein, 36 aa, Heterodera glycines
  Coding regions on vcDNA: vcDNA=SeqID_53387; Strand=+; Position=1-110
HALATGLRVHGWGGKLPGREHVQDEPLPRLGRRRQK

SEQ ID NO: 126965 - protein, 18 aa, Heterodera glycines
  Coding regions on vcDNA: vcDNA=SeqID_53388; Strand=+; Position=1-56
YREAIPEGFGLPINLGAS

SEQ ID NO: 126966 - protein, 161 aa, Heterodera glycines
  Coding regions on vcDNA: vcDNA=SeqID_53389; Strand=+; Position=1 -58,377-804
MATAQMAAHMAAASAAGGFGFLDMLGQAGAFPKASPTAEEQSHAFQAVPALCAADSSPADHGTNGVNDLLTNGTGANGRRATAAATMRASAPPNDEAVVDGSGGGTNIGPPRAKRARAGSTPLIAGGAALQQTTTMALMGNNEGATTNGSGRTSRESGGGI

SEQ ID NO: 126967 - protein, 241 aa, Heterodera glycines
  Coding regions on vcDNA: vcDNA=SeqID_53390; Strand=+; Position=1 -231,307-358,423-512,601-714,843-1025
  Homolog annotation: Hit_ID=CAE59601.1; Match level="QueryCoverage =93%, HitCoverage=54%, E-value=3e-56, Identity=49%"; Hit description =Hypothetical protein CBG03009 [Caenorhabditis briggsae]
ECRELIESRTKFWSILAGVGSYFCAGNDLSNFTRGVKTSDDLRAMADRGERVLERYVRAFIEHEKPLIGLINGPAIGISVTVLPLFDLVIASDKATFHAPFSSLGQSPEGCSATFHAPFSSLGQSPEGCSSYTFPLIMGTSKASELLLFDKKMSAEEALERNLVSRVIPNNSFGTETERMVNSLASLPPESLRLNKSLLRDVHRDALLAVNTRECALLKSRWLSEECQNALRKFMTRKSGG

SEQ ID NO: 126968 - protein, 72 aa, Heterodera glycines
  Coding regions on vcDNA: vcDNA=SeqID_53391; Strand=+; Position=1-424
  Homolog annotation: Hit_ID=AAO51573.1; Match level="QueryCoverage =97%, HitCoverage=5%, E-value=6e-10, Identity=42%"; Hit description =similar to Dictyostelium discoideum (Slime mold). Adenylyl cyclase
AEQQQAAQAQTQKAKEQRQTQQPQKPREVEQQQTPQTQQQPKKAKEDEQQQQAAQSQQQPQKSKYVPPSMRK

SEQ ID NO: 126969 - protein, 25 aa, Heterodera glycines
  Coding regions on vcDNA: vcDNA=SeqID_53392; Strand=+; Position=1-76
CRAHPPHDPLEIRKCRNETRTWGWN

SEQ ID NO: 126970 - protein, 58 aa, Heterodera glycines
  Coding regions on vcDNA: vcDNA=SeqID_53393; Strand=-; Position=1 -123,217-270
MANLFGLNKDTIYLSVCLYATNNLQGEPQRNDGEELIMLGWTSVYVPGLVEDCSVCHL

SEQ ID NO: 126971 - protein, 44 aa, Heterodera glycines
  Coding regions on vcDNA: vcDNA=SeqID_53394; Strand=-; Position=1 -85,246-295
MPTNFGELRERICEEIGYGNDTMKLIHKGVKNFFDKKWKKAIDF

SEQ ID NO: 126972 - protein, 322 aa, Heterodera glycines
  Coding regions on vcDNA: vcDNA=SeqID_53395; Strand=-; Position=1 -223,285-415,527-794,841-1061,1114-1149
  Homolog annotation: Hit_ID=NP_509573.1; Match level="QueryCoverage =89%, HitCoverage=31%, E-value=1e-92, Identity=57%"; Hit description =meningioma expressed antigen 5 like (XJ962) [Caenorhabditis elegans]
IEFKRALFASSAINCFIFRFFTKKGFYGRPWTAEQRKHLFTLLRKFGMNTYLYAPKDDLKHRAEWRLLYTPEEAALLESLLESLIRAAKDNGITFVYALSPGIDIVYSSAKELKAIREKLTQVFSLGCTAFSLLFDDIEASMNEMDRKQFSSFALAQLTVSNSVFESLGCPLFFFCPTEYCESSASPSLSESDYLNLLGTKLHPDIHILWTGPRVVSRFLTADHLQRVSTVPRVVSRFLTADHLQRVSTVLRRKPLIWDNLHANDYDPKRVFMGPFLGRSVTIKNVTSGLLLNPNCKYEANYVPFFTLADWVFFTLADWVQS

SEQ ID NO: 126973 - protein, 133 aa, Heterodera glycines
  Coding regions on vcDNA: vcDNA=SeqID_53396; Strand=+; Position=1 -275,659-715,769-837
MSMPGESAYTKVIPLSLAALISDSNNAKQQKTIGSFICGASALAQPTRFLRRVQQPPLRPVLQVVLWRIQIRVHAELSQQCEQMLPLFSSPWRSQILERHPEVKEFFGIGRPKLQICRCFDGPFPIAHGLLSQ

SEQ ID NO: 126974 - protein, 116 aa, Heterodera glycines
  Coding regions on vcDNA: vcDNA=SeqID_53397; Strand=-; Position=1 -111,251-488
  Homolog annotation: Hit_ID=CAE67706.1; Match level="QueryCoverage =68%, HitCoverage=19%, E-value=2e-19, Identity=58%"; Hit description =Hypothetical protein CBG13278 [Caenorhabditis briggsae]
MDELIEQAGGISVNRCVQRAAFRHAFPRSGKALLYAPATESFDLLVPQVGELAGGGVREWEADKLSERLPPNSNLDWYVELRRRGHPRSAGFGLGIDRLMQALFGITNIRDTIAFP

SEQ ID NO: 126975 - protein, 22 aa, Heterodera glycines
  Coding regions on vcDNA: vcDNA=SeqID_53398; Strand=-; Position=1-66
MLCEILERDELQIREEISMWNA

SEQ ID NO: 126976 - protein, 31 aa, Heterodera glycines
  Coding regions on vcDNA: vcDNA=SeqID_53399; Strand=-; Position=1-93
FVAFQNFAQHFLVNLQKSIRFDQSVGIFVNV

SEQ ID NO: 126977 - protein, 237 aa, Heterodera glycines
  misc_feature (5)..(5): Xaa can be any naturally occurring amino acid
  misc_feature (12)..(12): Xaa can be any naturally occurring amino acid
  misc_feature (21)..(21): Xaa can be any naturally occurring amino acid
  Coding regions on vcDNA: vcDNA=SeqID_53400; Strand=-; Position=1 -295,390-455,1214-1264,1311-1364,1433-1542,1694-1757
  Homolog annotation: Hit_ID=NP_871896.1; Match level="QueryCoverage =98%, HitCoverage=72%, E-value=1e-57, Identity=50%"; Hit description =regulator of G protein (2G399) [Caenorhabditis elegans] gb|AAM98050.1| Regulator of g protein signaling p
ISADXQIFFILXLLKSLSPSXNISPSDQWAVKMLNQSKSRHFNSPPPLSQEIYKLLENDQFPRFRRSPLYLGFLEALLPRSYAERWTTSFDALLGNQVGRHHFRQFLFNVHAEENLRFWESVIEFRQLKNKSTAMQNMGKTIQQQFLRENMGKTIQQQFLREGAHNEVFLPFGLRQRVEVFLPFGLRQRVEKRIREKDVDETLFDEAVKHVEQILKNDPYVRFLQSKEYNDLLAKLH

SEQ ID NO: 126978 - protein, 57 aa, Heterodera glycines
  misc_feature (28)..(28): Xaa can be any naturally occurring amino acid
  misc_feature (32)..(32): Xaa can be any naturally occurring amino acid
  Coding regions on vcDNA: vcDNA=SeqID_53401; Strand=-; Position=1-172
PPPLKLCVGYPFHCLLRLRKGIISAAVXQVTXKIGAIKHNANIVFSFDTRKKGTKNG

SEQ ID NO: 126979 - protein, 117 aa, Heterodera glycines
  Coding regions on vcDNA: vcDNA=SeqID_53402; Strand=-; Position=1 -202,313-464
MTAALLVGGGAAGGVAQRRPSATLVLEMPNHQPQQHQQQQQQLRHHQPQQSIVPSSSALAKDHGNASDEGQQQQGKAVVELPNSTQQPKKQLNQMNKLTGDDFPLKVWQRIGLMVGH

SEQ ID NO: 126980 - protein, 125 aa, Heterodera glycines
  Coding regions on vcDNA: vcDNA=SeqID_53403; Strand=+; Position=1-376
MFRSPALFAMFLLMLIVFQLFGVGIVQGSKRSKGRARTKESEGISNRGKESAKESERIWKKEGKGREKEKKKQFRSGRIGGQKNAEKGRGGAKGGEGKGKKGPIDGRGNWNGTDGGTKSTSRRRR

SEQ ID NO: 126981 - protein, 583 aa, Heterodera glycines
  Coding regions on vcDNA: vcDNA=SeqID_53404; Strand=-; Position=1 -992,1111-1423,1472-1916
MMFHFMNAFYADLVLLSCVPLMLHSELINVDLTVDNQNYFDSGKYRTFSKDATALHFGYSWNTACRIAKCERDSEWAVSLQIVYTLHSYQSVFFKMKSLVKMSPLACFEYNGYSFNLFEDRESGETAIFRGHQQKIVQRLSKHGRVVFDPLSGRLFLIDKHQRRISEIELEYLEHLWLRKNQSSAHTILKSNFVAFLPPDKSDFTLVDNHVFVIRDQRIYKFHIGDYAKGNRALTFVTNSSDVRFNYLIYKPNDQNIIGGVFSHLRMSDAWIPISYLFNLFLIVLCTYILKQLRRVNRKNPLNGSGSTGYYSNPFIDDAYSSQHQQLLNIQLFSFAKTDTPYLPTYCMQRAIRYLIDSYGLSSVDDLYTCLKDEIKSGPEGGNCLYPNPLCAVDCVHIANADHPNQPVHIEGSLELIADVELYSTCYPKKKFEGIERTSVCGAEGLEDLPGRLAAVSVTPLRTIEQQQQQPDSGRAGSDQLLERRRTRKRDYNLVRVLCRFNNCGPYRLTKQLQKRRTENLAYLSQLDIETVHLRKNIKIIPDALCPIGANQVFAYRGFLGITVQQHLYTRHRVMLKYPTLPC

SEQ ID NO: 126982 - protein, 74 aa, Heterodera glycines
  Coding regions on vcDNA: vcDNA=SeqID_53405; Strand=-; Position=1-225
MYNSFSLEKISKRIKKCKGWKLIESEKSSTLLYPMIPNLYPLFDNNSRGSLVMWRTVSIGYSTLTGHAMQRVYL

SEQ ID NO: 126983 - protein, 60 aa, Heterodera glycines
  Coding regions on vcDNA: vcDNA=SeqID_53406; Strand=+; Position=1-182
VLRRFGGPCPWHGTDLRARPRPVGVAWLRAPSALGGLQNFGRAKQAAQVRDNHWHERHNL

SEQ ID NO: 126984 - protein, 37 aa, Heterodera glycines
  Coding regions on vcDNA: vcDNA=SeqID_53407; Strand=+; Position=1 -124,173-240
VMWRTVSIGYSTLTGHAMQRVYHREVVTASVIGQSDQ

SEQ ID NO: 126985 - protein, 158 aa, Heterodera glycines
  Coding regions on vcDNA: vcDNA=SeqID_53408; Strand=+; Position=1 -65,741-876,908-1183
MDVILINKLIVVIRKFKIYLMRHRSAAFGLGILPFVFRPDFGPLRPKRTERETQCRVHLRNHRDGFEKSRSDSFGLNIIRGAWKNYEEIMAKIEEKSGGERMGMVVVCQLWNFMDGLKKLVEFMSRDAETTKKEMDRTMEQLRKMTNNRRCRLKQMQN

SEQ ID NO: 126986 - protein, 118 aa, Heterodera glycines
  Coding regions on vcDNA: vcDNA=SeqID_53409; Strand=+; Position=1-469
PKNGYLFFLIFLPQTWYQQLPSLVWPYQTILRYLKRKQKKFLTKKWLSLFSHFFTANLVPTVAFSCLALSNNLTIFETQTKKILDQKMAISFFSFFYRKLGTNSCLLLSGPIKQSYDI

SEQ ID NO: 126987 - protein, 178 aa, Heterodera glycines
  Coding regions on vcDNA: vcDNA=SeqID_53410; Strand=+; Position=1 -321,585-800
IVPPGKYRLILWDKLSADGQSLQNNRWPNVGDRSLCHRDEIFCYYCAEPDNLLFYTDVIKFRLNELEKCFVNFYTVETDERGHFLVYKRNKKAFDQFNFYILPLKNSVPISGDDFVPYAEHKIIVKENLRKNFFDPLNLVDYFESSNDWKMNVLDLLNHWLSDEGFSYELSEKANSNN

SEQ ID NO: 126988 - protein, 151 aa, Heterodera glycines
  Coding regions on vcDNA: vcDNA=SeqID_53411; Strand=+; Position=1 -186,538-807
METTKAQLLGIFWDFFSEAAKANLLWKRLRFADQRIVELVDQFCRIDKQYLLSHSQITLALRNVDNAMAFCQNWLVACAKAANAMQTTIVMDAFSHWIYSGRPPLNGAIEIVHFWIELFSKRTATNDIRRMCRWPEIDKNLFRRIGDFGTF

SEQ ID NO: 126989 - protein, 28 aa, Heterodera glycines
  Coding regions on vcDNA: vcDNA=SeqID_53412; Strand=+; Position=1-152
VIEAVVTDCFLLTKVQFTTHFSHIYFLL

SEQ ID NO: 126990 - protein, 237 aa, Heterodera glycines
  Coding regions on vcDNA: vcDNA=SeqID_53413; Strand=+; Position=1 -99,1427-1613,1943-2040,2982-3112,3559-3755
  Homolog annotation: Hit_ID=AAU20839.1; Match level="QueryCoverage =82%, HitCoverage=42%, E-value=8e-13, Identity=32%"; Hit description =Temporarily assigned gene name protein 44, isoform c [Caenorhabditis elegans]
CEFSHEPLQLPEPIGEVTVRQEKVFVPVKQYPEPEGEDDLKKKQLMELAIINGTFRSTNGTAGGGASNRASPSSYGKGGAVACNASAAAAAASLLQLDPRLLGCPTTAFSNTSAGLAGTPLIMPSAAALASPHTSAAQLFAASPYSAGLASVAQAATAPNAIDYQQQLLALGQLQQQHQPQQSQLDVAAQSQQLSALFQQQQLALSALQQFDYGSGAVVGYGGGGGKTDSSPSSSAA

SEQ ID NO: 126991 - protein, 35 aa, Heterodera glycines
  Coding regions on vcDNA: vcDNA=SeqID_53414; Strand=-; Position=1-106
KNDKTPDLGTLMRAIEMEIGPVTSPDLFHSYVIAH

SEQ ID NO: 126992 - protein, 162 aa, Heterodera glycines
  Coding regions on vcDNA: vcDNA=SeqID_53415; Strand=-; Position=1 -147,373-503,664-874
MLLKAMIGGMCANFTFSGDEHLIKREIEKISEFVKDITGNATQWIRAELENSWPLEIIRHVKIGIKNPIIDPYSYNYTANLIDDIVSPRGPFGYVSQILVTNDFDRIENFWQRCPASYCAVVKGYKGINFSLFRHKVGHLTRAHKAERWFERKRDKMYDIIL

SEQ ID NO: 126993 - protein, 71 aa, Heterodera glycines
  Coding regions on vcDNA: vcDNA=SeqID_53416; Strand=-; Position=1 -84,172-303
MIAIPIILIFFVQPAICLKIVCFTHSKMFEANSFLQQQPNCSHLVIKDFAKIGLKEFKADLNARYKAQYLK

SEQ ID NO: 126994 - protein, 30 aa, Heterodera glycines
  Coding regions on vcDNA: vcDNA=SeqID_53417; Strand=+; Position=1-204
TFSNFHLINLRRILPFLINSLVKRQKNRLF

SEQ ID NO: 126995 - protein, 44 aa, Heterodera glycines
  Coding regions on vcDNA: vcDNA=SeqID_53418; Strand=+; Position=1-355
AFFLFSLVNLFKFSIFLAFFENFFVFFSAGTASDNVFYLFRKIN

SEQ ID NO: 126996 - protein, 53 aa, Heterodera glycines
  Coding regions on vcDNA: vcDNA=SeqID_53419; Strand=+; Position=1-350
LFFENFFVFFSAGTASDNVFYLFRKINFFFLLIYFNYISSLNFLINIFKLSPY

SEQ ID NO: 126997 - protein, 53 aa, Heterodera glycines; identical to SEQ ID NO: 126996
  Coding regions on vcDNA: vcDNA=SeqID_53420; Strand=+; Position=1-351

SEQ ID NO: 126998 - protein, 21 aa, Heterodera glycines
  Coding regions on vcDNA: vcDNA=SeqID_53421; Strand=-; Position=1-63
KRARSARLEPRCGLKASNNFL

SEQ ID NO: 126999 - protein, 111 aa, Heterodera glycines
  Coding regions on vcDNA: vcDNA=SeqID_53422; Strand=-; Position=1-336
MPPKGENWDKMPKQQQKEFSAGFSIVTNDRNRSFTVSAVQMLCNTAGNAPKIVEEANVEDYLFGWSEVSKRMSERFFCTYGIVESEKRRKGRIGGKVAMEHLTKEQQPINQ

SEQ ID NO: 127000 - protein, 42 aa, Heterodera glycines
  Coding regions on vcDNA: vcDNA=SeqID_53423; Strand=-; Position=1 -59,280-349
MDRGTGPDEDGAVRKKLAGRTLPVPVPVFQKELQIQVSPVLY

SEQ ID NO: 127001 - protein, 109 aa, Heterodera glycines
  Coding regions on vcDNA: vcDNA=SeqID_53424; Strand=+; Position=1-833
LFEYPKRTLEKIDFFVFGAVPPNRCAQIYGETESFRNSFPIACTLILRWIFAPHNCLSTPNGHLKKSIFFVFGAVPPNRCAQIYGETESFGNSFPIACTLILRWIFAPR

SEQ ID NO: 127002 - protein, 31 aa, Heterodera glycines
  Coding regions on vcDNA: vcDNA=SeqID_53425; Strand=-; Position=1 -66,194-223
MNQNLREIMKEISFYWYVSRSRTNTVFGYVA

SEQ ID NO: 127003 - protein, 53 aa, Heterodera glycines
  Coding regions on vcDNA: vcDNA=SeqID_53426; Strand=-; Position=1 -26,890-1025
MKMKNDQKYARDNAKMRECWISVPVIQNIFDEGGRENNFNRERNGKGVMSLLR

SEQ ID NO: 127004 - protein, 113 aa, Heterodera glycines
  Coding regions on vcDNA: vcDNA=SeqID_53427; Strand=+; Position=1-339
MSIFPYCACFGIKMSIPNVEPSYLWSSTVGKLKFQALGPQNVKSSNAAPHLSIHTVPAACETGIWLLVLRTSALAVLAAILAPLRTVFGILFLATVVTAARHIQCTVFLGAIF

SEQ ID NO: 127005 - protein, 89 aa, Heterodera glycines
  Coding regions on vcDNA: vcDNA=SeqID_53428; Strand=-; Position=1 -63,143-239,679-788
MNGAHPKSPTRETEYAPGKMEVSEPPSLSRVDRPIELSVTVTNPDAVVQAQAYGDHEVRLQLNDTEVDESPLICRVYDPASEGNQNLLI

SEQ ID NO: 127006 - protein, 198 aa, Heterodera glycines
  misc_feature (118)..(118): Xaa can be any naturally occurring amino acid
  misc_feature (194)..(194): Xaa can be any naturally occurring amino acid
  Coding regions on vcDNA: vcDNA=SeqID_53429; Strand=-; Position=1 -188,241-372,416-540,1570-1616
  Homolog annotation: Hit_ID=AAH01419.1; Match level="QueryCoverage =90%, HitCoverage=38%, E-value=2e-25, Identity=39%"; Hit description =Nuclear receptor-binding factor 1 [Homo sapiens]
HRLSSFSDAFTFFLPGFATLGINFPPAFAMLRHIVPLEKGDFLVQNASNCGVGRAVIQLANYFGYHTINLVRNRKEIDAFGYHTINLVRNRKEIDALKDELKALGADFVFSEEEFEKXNLKRNAKSLPKPRLALDCVGGRSAAKSLPKPRLALDCVGGRSALLLSSALSKGDTIISYGGKATSPIESRISLLKXFDRK

SEQ ID NO: 127007 - protein, 41 aa, Heterodera glycines
  Coding regions on vcDNA: vcDNA=SeqID_53430; Strand=-; Position=1-123
MNEAKEKGIQQNRSHQLIADVWKFDMNTAQWVRMRNNLAKA

SEQ ID NO: 127008 - protein, 418 aa, Heterodera glycines
  Coding regions on vcDNA: vcDNA=SeqID_53431; Strand=+; Position=1 -159,356-429,476-788,945-1070,1184-1297,1351-1464,1517-1552,1599-1762
  Homolog annotation: Hit_ID=CAB57358.1; Match level="QueryCoverage =90%, HitCoverage=33%, E-value=1e-55, Identity=34%"; Hit description =microsomal aminopeptidase [Haemonchus contortus]
SVSPHSLPMAKRAKSSSPALSLSHCQLYCSLLLFLLSILLSVLITFLLTRNAINETADEAKEERPEKRKEPGAEELRLPFQLFPIWYNLSLKVFVPGFGELRLPFQLFPIWYNLSLKVFVPGFGAEISPQLNLTFNGDLLLNFAVNRTTRTIELNALKLRFDPNNLMAYELKRTDNLATGDEVDRTPKVIGILDEAREKASKRAGKIPYSGPIASKLSGLYLTTYTTLSGEHKCAAVTQMEPTDARRMVPSFDEPEFKAIFRLSVTHPKGSRAVSNAKELREQQQTTEWIRTDFETEWIRTDFEETLPMSSYLLALVVSDFEFVEGNTSRGTRFRIWSRKDALNLFRIWSRKDALNLTSYALRATSYALRAGIKVLEFYEQYYGIPFPLPKQDMVCLSHLNSFLFAVLPFQMAFSRFC

SEQ ID NO: 127009 - protein, 139 aa, Heterodera glycines
  Coding regions on vcDNA: vcDNA=SeqID_53432; Strand=+; Position=1 -165,215-469
  Homolog annotation: Hit_ID=CAB57357.1; Match level="QueryCoverage =77%, HitCoverage=11%, E-value=1e-14, Identity=36%"; Hit description =microsomal aminopeptidase [Haemonchus contortus]
IYLTRFKYRNAEHSDLWDALTEAVPEGMKDWKGNKFSVKQFARQWTERTGFPIVQVKQIDGQRVQLSQQRFRMNADAAETGAGGNSSGTWEVPVWWSKDGQNGPMEWLKDGGSPASVCIDHPIHCQSRPSTRPTPPFWC

SEQ ID NO: 127010 - protein, 95 aa, Heterodera glycines; identical to SEQ ID NO: 125597
  Coding regions on vcDNA: vcDNA=SeqID_53433; Strand=-; Position=1-820

SEQ ID NO: 127011 - protein, 528 aa, Heterodera glycines
  Coding regions on vcDNA: vcDNA=SeqID_53434; Strand=-; Position=1-1584
  Homolog annotation: Hit_ID=XP_320889.1; Match level="QueryCoverage =90%, HitCoverage=57%, E-value=2e-41, Identity=25%"; Hit description =ENSANGP00000012033 [Anopheles gambiae] ref|XP_313651.1| ENSANGP00000013044 [Anopheles gambiae] ref|XP_314
MLADQQKMVQDQSQQIAQLIAIGQNAPNAAAQPNQGANSVPILPDISPFEPTDDKSRISEWIERFKFALDCTAPTADDEVKVKCLMNKLSESAFSEYSRSVLPSSVTDLSFKVTTEKLEKLFAKAQSIFIDRYECLKAVRGEGEQFRQFINRHKKLLTDFKFDELTKEQFNCLMLLMALKAPNEAALRQRILTKLSADCANISYDGVVEDLISFQSTISEAKAIEATSSSRPVNSIRQNSKPNNSTNKYVKESPKPNNLPNKFKERTNTEATTICWRCGFGVHRPDECRYKTSKCRKCEFVGHLDKQCERVQEWRRRQNAKKKGNNRVGHLRIGMTTHAVNSISLLKTAVLFNKKPVEFHLDTGSDIVVIDQLTHQYVGRPPIEKCNEIGKAFDGTKISFIGKGFGTFKFGKIEVEQTFFVAKAGSLNLLSCKMMDLFGLLDELKLKISNPAVNACHANGKKAENFIPNEATQIAGTGTEIQALEKEFHEIFSEELGHCLKEKAHLALKDDARPVYRKARPVPYNSLE

SEQ ID NO: 127012 - protein, 141 aa, Heterodera glycines
  Coding regions on vcDNA: vcDNA=SeqID_53435; Strand=-; Position=1 -115,374-539,668-812
MAELEQEVADDQKNAQQKDPSRASAPKRMELAKKLESKVGSSLFVQIGRSGQELSVRGFGAVFGRAQKDANAESDQQFVGHFPTDRRPTDQNERPLTLKRSLLLLTNFYGPVICRVLVPKNSVVNAETTTIFGDVNNADRL

SEQ ID NO: 127013 - protein, 86 aa, Heterodera glycines
  Coding regions on vcDNA: vcDNA=SeqID_53436; Strand=+; Position=1 -189,298-369
MKKFSIIPMPLLLVVVVLLIIPFVPFTLSQLCLYDSVTESCLKVNCLNECYVDSPGTCGCNARSNDAKIRSEKMLDSGILVAMEHT

SEQ ID NO: 127014 - protein, 152 aa, Heterodera glycines
  Coding regions on vcDNA: vcDNA=SeqID_53437; Strand=+; Position=1 -71,156-297,760-883,1022-1131,1629-1640
  Homolog annotation: Hit_ID=BAA28675.1; Match level="QueryCoverage =50%, HitCoverage=20%, E-value=5e-18, Identity=63%"; Hit description =orthodenticle-related protein [Hemicentrotus pulcherrimus]
MTAAANGFAFSTDWSNGGAPPRFGKQRRERTTFSRAQLDVLEGVFKNTRYPDIFVREEMATKINLPESRVQLQIKLEKIEDGTLNSSAQNGGIGSGGISPGSQLEVGGPPQSVIGQYTSYYSPFRNGAAHPYMAAYAPSACSMDMYTAATLA

SEQ ID NO: 127015 - protein, 139 aa, Heterodera glycines
  Coding regions on vcDNA: vcDNA=SeqID_53438; Strand=-; Position=1-421
  Homolog annotation: Hit_ID=AAC06261.1; Match level="QueryCoverage =81%, HitCoverage=14%, E-value=1e-09, Identity=35%"; Hit description =butyrylcholinesterase precursor [Felis catus] sp|O62760|CHLE_FELCA Cholinesterase precursor (Acylcholine a
LPPVPMPSALPLSLPFCLALLFLLLLSPSPCFSSSPPDDSPIVSTKFGKIRGQLLHVVDPVDGQPVALTAFLGVPFARPPLGKLRFEAIEIVAINQIAEILQKPLKPEKWSGVFNASEMAPACWPIARAEIYAEVHNEC

SEQ ID NO: 127016 - protein, 179 aa, Heterodera glycines
  Coding regions on vcDNA: vcDNA=SeqID_53439; Strand=+; Position=1 -3,182-494,669-811,867-947
  Homolog annotation: Hit_ID=XP_316911.1; Match level="QueryCoverage =82%, HitCoverage=14%, E-value=2e-10, Identity=27%"; Hit description =ENSANGP00000006552 [Anopheles gambiae]
MELLDPGKGFYDKDENKVKLAIDVIVDEPKTEKIISDPNKSNGTLSMEIEKLSEFEREIEGSHRKSETAVYIKGMPWKIFAYIKMKNESTEKWLGFALLCDASEKDGNWSRKCSGTLRIVSQKNGVEDFKKELDETVFNNESKSWGNNFISFVELMDPSKGLYNKDEDNVTLAIDFTCE

SEQ ID NO: 127017 - protein, 154 aa, Heterodera glycines
  Coding regions on vcDNA: vcDNA=SeqID_53440; Strand=+; Position=1 -82,132-257,533-789
  Homolog annotation: Hit_ID=CAE71966.1; Match level="QueryCoverage =62%, HitCoverage=43%, E-value=9e-23, Identity=56%"; Hit description =Hypothetical protein CBG19037 [Caenorhabditis briggsae]
MSFCGSFQRLGRSSKDAPEMVIDWAKNEICAHFSIPIEIFDNVEFTEKIKTVYPMFKDVNTDKLSTHRQLQRKISFSESPPTHPNPTHPYPTHPNPTHPYPTHPYPTHPYPTHPYPTHPYPTHPYPTHPYPTHPYPTHPYPTHPYPTHPYPTHP

SEQ ID NO: 127018 - protein, 192 aa, Heterodera glycines
  Coding regions on vcDNA: vcDNA=SeqID_53441; Strand=-; Position=1 -138,197-443,504-568,632-760
MQRTLADYNIQKESTLKLKKTRLSSRGVDAIITKVNRSPPHRFTDEISDDEIRQLSQSGNGRLPNAADARQNPPAGRHRGRHPWTIRGPEEDLLNAWPPAGAAVRLPGRLRRQRTPVVGDDHPPLLLQGEVPLQLHAAAREPRVRQHQQSLWLLRGDRPPLPATGRSSTLRPLQSSLRLDAIRRTGRREDPL

SEQ ID NO: 127019 - protein, 213 aa, Heterodera glycines
  Coding regions on vcDNA: vcDNA=SeqID_53442; Strand=+; Position=1 -112,2154-2320,2617-2751,2980-3136,3420-3488
MRGRTVDLRDDRVHASAGQPRFFQFKCRFLLDVVVGQDIDTFRKLMNEYNTLSGPAFDVLGNLLSVSENSKLLMKLTGPAGSLLAACIEIAFKPESPTLKALATFHDWADRKFTEQNNMVEIAMNSIRVAHDLNDFDNYINEKVNDNCNTMPRRIMPILSELRALFAGVFWRYDEQKLTIEYNELKKTYLRVLEKFAIASEEDAREIFIQIRD

SEQ ID NO: 127020 - protein, 146 aa, Heterodera glycines
  Coding regions on vcDNA: vcDNA=SeqID_53443; Strand=+; Position=1 -43,711-783,1100-1295,1534-1662
MRWGALDARETLKDELSAEFFLKNEKFSKFKNKIPFSESTNDKAPELGTLTKAIVEKVGPITSDPFYHSFVFLHVSAFSSSNCKIPTGISSGSYMGQEGFSFLEDLQGIFVYQHENQGYDWASITKVFKEPVIINNRFKNIVIKCY

SEQ ID NO: 127021 - protein, 19 aa, Heterodera glycines
  Coding regions on vcDNA: vcDNA=SeqID_53444; Strand=-; Position=1-58
MSALSDTLFGSLKIINFKK

SEQ ID NO: 127022 - protein, 71 aa, Heterodera glycines
  Coding regions on vcDNA: vcDNA=SeqID_53445; Strand=-; Position=1-217
ALVECLAKYKKPACKKICPTTKSLVRKVGTVRRKVSALLWLKIGEEQSEQLDLCEENNETDFGIANLFNDN

SEQ ID NO: 127023 - protein, 77 aa, Heterodera glycines
  Coding regions on vcDNA: vcDNA=SeqID_53446; Strand=-; Position=1-5,53- 281
MRHSVGPTNSAVKKASNVPLKIDEKCLTQFCPTFVFHSYQKRILQKALVINNILMIREFAILKMLEPGLDSLLDLDL

SEQ ID NO: 127024 - protein, 83 aa, Heterodera glycines
  Coding regions on vcDNA: vcDNA=SeqID_53447; Strand=-; Position=1 -126,611-736
MEEKEMEWTERETEWTMRLENGERELAMMRELGREQRGQQRRKKVMKELIVSYFYGYPKNVWSFKCMKLFKDQLIHTALYMKR

SEQ ID NO: 127025 - protein, 173 aa, Heterodera glycines
  Coding regions on vcDNA: vcDNA=SeqID_53448; Strand=-; Position=1 -85,195-379,542-674,744-825,952-981
  Homolog annotation: Hit_ID=NP_741945.1; Match level="QueryCoverage =98%, HitCoverage=34%, E-value=2e-43, Identity=55%"; Hit description =modulation of locomotion defective protein 1 family member (XR331) [Caenorhabditis elegans] gb|AAM69066.1
MIISFLTRLVLLLPQISYTDSVRLEQIAASRRLSAERISLLQRRNCEKRIWSERKRARKRRRGQRQKREKPTRECIPIDDNRRKALIQVVAENHYDKNNLPSSNHTSVIVELTVQSITEISEFSSSFKADVWFSQIQIWRDPRLDFSSLNYCLSNISLPSHKLSSLWTPNVCF

SEQ ID NO: 127026 - protein, 75 aa, Heterodera glycines
  Coding regions on vcDNA: vcDNA=SeqID_53449; Strand=+; Position=1 -160,276-343
MPQKRRKETRAINRIRKRRAELELLVSGNKDGGQNMDSKTDTKRAKETKTEDEEHLFAELRQQHLISRDFLSLIC

SEQ ID NO: 127027 - protein, 44 aa, Heterodera glycines
  Coding regions on vcDNA: vcDNA=SeqID_53450; Strand=+; Position=1-136
MFLISTVLFSVPSYLFAIRNDRRLRAVTPYGGVLAMLAWFSFVL

SEQ ID NO: 127028 - protein, 126 aa, Heterodera glycines
  Coding regions on vcDNA: vcDNA=SeqID_53451; Strand=+; Position=1 -90,215-324,401-580
  Homolog annotation: Hit_ID=EAL30352.1; Match level="QueryCoverage =99%, HitCoverage=17%, E-value=2e-28, Identity=52%"; Hit description =GA21025-PA [Drosophila pseudoobscura]
MDELVKPYNKIIDYITFKSGITEKMLSKVNTRLKDIQKRFCALLTDDAILCGHSLENDLLALQLSHPFCIDTSLLFNFSGRAFVRSGLKALADIFLNEKIQNSRQGHCSLQDAMATLKLLKLKLEN

SEQ ID NO: 127029 - protein, 28 aa, Heterodera glycines
  Coding regions on vcDNA: vcDNA=SeqID_53452; Strand=-; Position=1-84
MANCGGGGDRCAKGCDDNDPNYGDNIGM

SEQ ID NO: 127030 - protein, 486 aa, Heterodera glycines
  Coding regions on vcDNA: vcDNA=SeqID_53453; Strand=+; Position=1 -141,379-567,612-1017,1066-1207,1254-1356,1409-1571,1624-1838,1890 -1991
  Homolog annotation: Hit_ID=NP_507780.1; Match level="QueryCoverage =91%, HitCoverage=30%, E-value=6e-25, Identity=26%"; Hit description =predicted CDS, DNA polymerase type B, organellar and viral family member (5T899) [Caenorhabditis elegans]
MPFHQQTQHTAKCKWKCHNCLRVGSAFRGNCVQGNDNFFETCLGCNKHHQQKEHVCGQKFCKICLGFHAPRDCYIPYRPKVKKEKRFVFFDFECTTDFKPDPQLMRFKHQVNFCFAHVTCTRCIEKGIWDQELERACALCGRFRTYAWSPFEFWHTDVECRKVVEDPLATFTKWLLNFETEVLGMEPGAKKRRKRKNIDNTDGDAMEGEEDEDAVDEDAENNWMLGYEEAGEKPESVTSYAYAHAGSRYDHVLIYGEMLRMGVRPELIRQGNHLLEMKARKTGVYTTTIFRDSYKLIPIKLANFVKTFGLEIEGVDNKKYFPHKFNKAENYGTVLDTLLPMEDYYPGGLFPAERAKFEQWYDENRETGFELNEVIADYCKTDVQILAHGLVKMRQLFLSETRHDITDSVTIPSGCMKYWVQLAHHDKERVAIIPHLGYEKRGKQSTIARKYLKWRAEEELRENGRVLRHVESPGGEVKFGTTALDG

SEQ ID NO: 127031 - protein, 397 aa, Heterodera glycines
  Coding regions on vcDNA: vcDNA=SeqID_53454; Strand=+; Position=1 -64,109-270,320-515,560-725,775-891,942-999,1111-1541
  Homolog annotation: Hit_ID=NP_001004509.1; Match level="QueryCoverage= 87%, HitCoverage=24%, E-value=1e-23, Identity=27%"; Hit description =si:busm1-180o5.3 [Danio rerio] emb|CAD60788.1| novel protein similar to DNA polymerases [Danio rerio]
MYPRGLIDPEYNCDHFEDSERGFSTTVTHIELEAALRSWYKVTHVYRAYIWPLACDWSNGLFHSYLLKFLKMKFEASGYPASCTEAGISEEESARRKQEHIDKAKEKAQVPLEADRIKHNPGLRYLSKLCLNSLWGRFALRNRLTKTEIVECHAELAKLLNDSKIEVSSIDQLTEKFWMVCYKAKDEHVVEHSTSNVAIALWTTSAARIHLLESLKKVYGPAPGVERYDTRILYMDTDSIFYDYLTRLGDPLPGAGPKAYGLWLRNNATGEDEYKLKLRGITLDSDACERITFEKMKEMVQNKLGQPDNNVRFNYPTKNFRITKKGEIFTVPLVKQFNPTVNKGVVRDHGLKVVPFGYSDEEWCKWNCPGACTCLFNPDLNVNMFTEEELNDPDIMP

SEQ ID NO: 127032 - protein, 190 aa, Heterodera glycines
  Coding regions on vcDNA: vcDNA=SeqID_53455; Strand=-; Position=1-573
MTTIDQEIQFIKNEIVKRWKRERKIVQDANHLVTYCNKISFYAKTYMIIAFSAPGIHEIYEKFLELAQKIRQLYLQISNEYKNISKILGEFENCLKYKNIQRCHENENSSKHSMATCYKYRKQLRKFRIEIDDLFQNIVSLAINYLNPPEEPIKEQNENHQNEIFYTPYRRNRIIHGQLSEIFYSPYRRN

SEQ ID NO: 127033 - protein, 152 aa, Heterodera glycines
  Coding regions on vcDNA: vcDNA=SeqID_53456; Strand=-; Position=1-459
MIQRTEKGTAILLEALKKEAERARKEVSVLADEADEYAKSARGALNRAIKSREKAPYAPGVREWFVKMSDCIWEIFTILDQMNAEFETVESIWREAERSKDYDQVKKLEERVLKGLSEAKILHLESRRIHTKILELENRIQSVVWDFIGLHE

SEQ ID NO: 127034 - protein, 325 aa, Heterodera glycines
  Coding regions on vcDNA: vcDNA=SeqID_53457; Strand=-; Position=1 -414,875-1440
  Homolog annotation: Hit_ID=NP_502797.1; Match level="QueryCoverage =40%, HitCoverage=37%, E-value=2e-22, Identity=40%"; Hit description =HASI (4P602) [Caenorhabditis elegans] emb|CAB16520.1| Hypothetical protein Y57G11C.19 [Caenorhabditis ele
KQRTYTIHKPIRKRFPRLKTIPSGFHTDWQCDLCIFDQLKKHNDGYKYLLVCIDVLSRMIFSAPAKSKKSEDMIEAFDRVFEKSKIIPMKIYSDSGLEFQAGKMKKYFEEKFIIKNVMYSPDLHAGVVERANRTIKELFGLVFDQTNGNCCCLSNEEKQQLNAARKTIEKAFRDTTRLNNEARDFAAASHRAITEAEKIKVRHPEAPGMKTWFGRLLEGVRKVQGISEKINEERQKIGHIRKEMDKCLDRKDVLMCRELADEAKGAFEIVKQYRQDVGTAYRNAYTQSDLGIGELADKVKETMKEYLYRPGPSPRPTFKDQFISD

SEQ ID NO: 127035 - protein, 31 aa, Heterodera glycines
  Coding regions on vcDNA: vcDNA=SeqID_53458; Strand=-; Position=1 -49,142-188
MRVNHRKEKIYSENDQSDVMGLVSEHVFVYE

SEQ ID NO: 127036 - protein, 85 aa, Heterodera glycines
  Coding regions on vcDNA: vcDNA=SeqID_53459; Strand=-; Position=1 -216,285-326
MDKQKKSRGRPPKNTEKREIPQKENLEKKEIPHKEKIKILRPKIKLKGRKIELDTENSTNSVPTKIKLPPIYIFFSEKYVISGDY

SEQ ID NO: 127037 - protein, 115 aa, Heterodera glycines
  Coding regions on vcDNA: vcDNA=SeqID_53460; Strand=-; Position=1 -49,91-268,309-377,423-474
MSKEYADSKILEVVCAGPKQYALKLQNQKGEIWYKTKIRGMTQNKNNKIDYEEFKDMVLNYEEEKKIRFTHPNKFGPTRESYVISRNITKDYRPIQKKGIILDDENLTVLPFGYW

SEQ ID NO: 127038 - protein, 167 aa, Heterodera glycines
  Coding regions on vcDNA: vcDNA=SeqID_53461; Strand=-; Position=1 -31,190-457,497-701
  Homolog annotation: Hit_ID=NP_001004509.1; Match level="QueryCoverage= 65%, HitCoverage=7%, E-value=5e-20, Identity=41%"; Hit description =si:busm1-180o5.3 [Danio rerio] emb|CAD60788.1| novel protein similar to DNA polymerases [Danio rerio]
MIYYYLQIVLPLELGAVIDRFYRGYHYENFDGNLFKNYVRKFLKLKVEATGWPQDVKTEEEKIEFVKTYRETYEIELDPNNMNFNPGLRHIAKLALNSLWGKFSMRNKLCSTKMISKPSEFFELINDYTIEMGKPIRFNDNTLRVIFCKKDEYVKEHKCSNIMISIW

SEQ ID NO: 127039 - protein, 141 aa, Heterodera glycines
  Coding regions on vcDNA: vcDNA=SeqID_53462; Strand=-; Position=1-424
MNVQFAAVLMRAIVLLVCVLLPKICEASPKKEKHYNVPKDQFASSVQFLTGTDTTRSNTNFQDRSTLLKPTLDWANSSSFKSWLMPVEQAGGSASSATSPSDYFQPHEIANSSIGNQINGMEKRLFMPPKWLEDANNKKKS

SEQ ID NO: 127040 - protein, 87 aa, Heterodera glycines
  Coding regions on vcDNA: vcDNA=SeqID_53463; Strand=+; Position=1 -162,339-440
MSEEICATISEVFRADFQLQISAHGTNSIALLVNKKAASVPAALLATFLALNITYDKQIGKIDAELKEAIETEAKSTKTQLVKRRDD

SEQ ID NO: 127041 - protein, 95 aa, Heterodera glycines; identical to SEQ ID NO: 125597
  Coding regions on vcDNA: vcDNA=SeqID_53464; Strand=+; Position=1-818

SEQ ID NO: 127042 - protein, 285 aa, Heterodera glycines
  Coding regions on vcDNA: vcDNA=SeqID_53465; Strand=-; Position=1-859
  Homolog annotation: Hit_ID=KGZQHL; Match level="QueryCoverage=50%, HitCoverage=65%, E-value=3e-19, Identity=27%"; Hit description =histidine-rich glycoprotein precursor - Plasmodium lophurae emb|CAA25698.1| histidine-rich protein [Plasmodium
IQSLGLNPPTFQSPGLNPPVFQSLGLNPPVFQSLGLNPPAFQSLGLNYQTFQSLGLNPPTFQSLGLNPPAFQSLGLNPPAFKSLGLNPPTFQSPGLNPPVFQSLGLNPPAFQSLGLNPPTFQSLGLNPPTFQSTGLNPPAFNHWDSTHQHSNRRDSTHQYFNHWDSTHQHSNHWDSTHQHFNHWDSIHQHFNHRDSTHQHSNHWDSTHHIPITGTQPTSIPITWTQPTNISIAWDSTHQHSNHWDSTHQHFNHWDSIHQHFNHWDSIHQHFNHWDSTQQHSNHWD

SEQ ID NO: 127043 - protein, 234 aa, Heterodera glycines
  Coding regions on vcDNA: vcDNA=SeqID_53466; Strand=+; Position=1 -214,485-610,1035-1246,1799-1951
  Homolog annotation: Hit_ID=CAE60739.1; Match level="QueryCoverage =58%, HitCoverage=3%, E-value=1e-28, Identity=45%"; Hit description =Hypothetical protein CBG04423 [Caenorhabditis briggsae]
MVTCRMGRMFAMPLMTTNSPTFHGEALSCSPQFRRVSHHSVFGMDEDLMPMPNLAFCKRFLQIKNRDNVCQEIVLDLNIHKSSVYKLLAHYRNPTEVNVELEVKLVPVQTQTPDSEQFAKAVFAPSGGHPQNAFVETNPEHTFVLSPGRWNLHVRSPKRLYLDYLVLIPADYYQGEALTERIIEPCRANETENCVELLYPPIPIASKVDAITDLAKFEEVEPGTENVQNILSHV

SEQ ID NO: 127044 - protein, 159 aa, Heterodera glycines
  misc_feature (2)..(2): Xaa can be any naturally occurring amino acid
  Coding regions on vcDNA: vcDNA=SeqID_53467; Strand=-; Position=1 -176,233-341,399-447,529-609
  Homolog annotation: Hit_ID=NP_496308.1; Match level="QueryCoverage =98%, HitCoverage=65%, E-value=3e-36, Identity=42%"; Hit description =COLlagen structural gene (col-79) [Caenorhabditis elegans] emb|CAA86756.1| Hypothetical protein C09G5.3 [
AXGVPGPIGRRGKNGRPGADGKPGPKGPPGDYGPAGPAGPIGPPGPPGTDLHSWARGVGVKGPSGPPGSPGDAGQPGVKGPSGPPGSPGDAGQPGTNGEPGQDGESGPPGQVGLRGLRGDDGTPGKPGNVSESGSPGKPSPDGNYCPCPPRSDAAKSGA

SEQ ID NO: 127045 - protein, 201 aa, Heterodera glycines
  Coding regions on vcDNA: vcDNA=SeqID_53468; Strand=-; Position=1 -226,356-481,548-701,789-839,2351-2405
  Homolog annotation: Hit_ID=NP_505550.1; Match level="QueryCoverage =95%, HitCoverage=23%, E-value=4e-41, Identity=38%"; Hit description =MEChanosensory abnormality MEC-9, extracellular protein with mutiple EGF-like repeats and Kunitz serpin d
AQKDPPPPLHPNSAVRFRSLLTAVSFSRAKNVCARRNPCRNGGVCVYDELTEKSICKCAAPFTNDFCTERIDFDPCSPNPCQNGATCSAIAGTQRTEFDCFCARGFAGRHCEFRPPCEDNPCKNGGTCRTTRAQSLFFCACPPGWAGKTCMVGGGGEFANKYFNNTTRQLSSGKAEWIEELKREEGEPGGGQENACPEILQ

SEQ ID NO: 127046 - protein, 83 aa, Heterodera glycines
  Coding regions on vcDNA: vcDNA=SeqID_53469; Strand=+; Position=1 -70,159-340
MKQFLLLSLLLCCLFFAVFSLSFNDQVELPTFCSGPNKENARVLSCCEAVKAFEGSEMSESGGAAPPELKECVQCGTELCPRE

SEQ ID NO: 127047 - protein, 105 aa, Heterodera glycines
  Coding regions on vcDNA: vcDNA=SeqID_53470; Strand=+; Position=1 -81,141-237,290-426
  Homolog annotation: Hit_ID=CAE75321.1; Match level="QueryCoverage =98%, HitCoverage=18%, E-value=7e-30, Identity=58%"; Hit description =Hypothetical protein CBG23295 [Caenorhabditis briggsae]
MPLGLPDSRARESGETQFDSRLFNQTGGLDSGGIDDETYAAYDKPWRPQDGIQQHIYRPRKDIDSSIYGADLDRIISTNRFVPDKGFSGADGAGKEGGQRSGPVQ

SEQ ID NO: 127048 - protein, 300 aa, Heterodera glycines
  Coding regions on vcDNA: vcDNA=SeqID_53471; Strand=+; Position=1-903
  Homolog annotation: Hit_ID=NP_001004509.1; Match level="QueryCoverage= 99%, HitCoverage=20%, E-value=2e-26, Identity=28%"; Hit description =si:busm1-180o5.3 [Danio rerio] emb|CAD60788.1| novel protein similar to DNA polymerases [Danio rerio]
MALKIHATGFPSWCESEEQKSEYIEECWMKFAIKLDKEKMKAEPGKRYIAKLCLNSLWGRFSMRNLLSKAVINNDPCVLRQYTDDKKIDIMDIELMDEDNDVFMLTYKPKEEFVDENKYSNVVISLYTTSMARLYLYEVLKKVADTPGCEILYFDTDSIIYVHPEENDPLPTGKGHLGELTDEKPDHNILEFISAGCKNYGLKLERKDNGEIEYDLKIRGITLDEQTVQTIHYDSVKDQIMRYGSDDPADPIIVTYPHFIRPNLIQGKVYTQSLTKHYQPVFTKGIINDSFQVLEFGYRK

SEQ ID NO: 127049 - protein, 119 aa, Heterodera glycines
  Coding regions on vcDNA: vcDNA=SeqID_53472; Strand=-; Position=1 -78,396-677
MPPPANTSALPTNYSQKRNEFDAFQKAPSLPISFIKKIPILVEHILNFHKNFFPLMLMCFNCIFFTSVRMNWLPVSKANGPHWYSTKRFHKSAKDTSAMSQIRLDFEFAIACVGMPEPN

SEQ ID NO: 127050 - protein, 48 aa, Heterodera glycines
  Coding regions on vcDNA: vcDNA=SeqID_53473; Strand=+; Position=1 -118,1091-1119
MRVFVHISMVRLLGFATWGPDIWGSDTYGIRHLETSFTTYYCFIYIFL

SEQ ID NO: 127051 - protein, 147 aa, Heterodera glycines
  Coding regions on vcDNA: vcDNA=SeqID_53474; Strand=+; Position=1 -48,97-273,811-1029
  Homolog annotation: Hit_ID=AAO39658.1; Match level="QueryCoverage =77%, HitCoverage=8%, E-value=5e-20, Identity=46%"; Hit description =AT04875p [Drosophila melanogaster]
MPTNEQEILDAFEAVLAKKDLPPDKMRILRDCDLKKKWDLVCDEHQFTHNQCITEPHVYLNQLMAIMDKKKSTKKKKKILAGDSPTQILKHLEISLRTNSIEWVRSFLSPQNNGQSHNQSLLLCQQIFPFRTPSCGGISQPSAAIIE

SEQ ID NO: 127052 - protein, 60 aa, Heterodera glycines
  Coding regions on vcDNA: vcDNA=SeqID_53475; Strand=+; Position=1 -65,241-358
MKKSYRSYNLKSPNQDQKFGNRKLLTLQKSATNQWVTEKMKITLKALKIFILTFLPFLIL

SEQ ID NO: 127053 - protein, 52 aa, Heterodera glycines
  Coding regions on vcDNA: vcDNA=SeqID_53476; Strand=-; Position=1-156
MATLLEYPASVVEQISVKLSAPNLNTIAMAYPKVEVPKYSRATLSAGIVHFG

SEQ ID NO: 127054 - protein, 21 aa, Heterodera glycines
  Coding regions on vcDNA: vcDNA=SeqID_53477; Strand=+; Position=1 -54,577-588
MRTRPIWQVKQRLLTSQKKGF

SEQ ID NO: 127055 - protein, 99 aa, Heterodera glycines
  Coding regions on vcDNA: vcDNA=SeqID_53478; Strand=-; Position=1 -78,140-211,1010-1159
MTQPQKALTEPSANESNIPEKVPKAEPHSEKNELSSSKFEALCEPPTPDQNAHCEEVRYAKSAFFGWHCPRLYVNHLVTVRPLGAALIHFLLTKKEIFH

SEQ ID NO: 127056 - protein, 36 aa, Heterodera glycines
  Coding regions on vcDNA: vcDNA=SeqID_53479; Strand=+; Position=1 -12,194-292
MGPAAAKVEKAPDNPSVDNPSVMNNPSTLQQILYLK

SEQ ID NO: 127057 - protein, 22 aa, Heterodera glycines
  Coding regions on vcDNA: vcDNA=SeqID_53480; Strand=+; Position=1-66
MGEFRVKFRQLEADIEELKGKN

SEQ ID NO: 127058 - protein, 68 aa, Heterodera glycines
  Coding regions on vcDNA: vcDNA=SeqID_53481; Strand=-; Position=1-204
MRGNEAVVRLLLFPQSFAILRQNDLFAGQIQSTSDDVTGIEFGQVLLGAAYNSVATYIAIVEVGKSAG

SEQ ID NO: 127059 - protein, 156 aa, Heterodera glycines
  Coding regions on vcDNA: vcDNA=SeqID_53482; Strand=+; Position=1 -53,128-424,504-685
  Homolog annotation: Hit_ID=AAV34698.1; Match level="QueryCoverage =96%, HitCoverage=47%, E-value=8e-16, Identity=35%"; Hit description =IC5 [Globodera pallida]
EIVYYEVKIFSAEQKDFGTQNDSIGIGFAPKSMPLGTKVGTHPGTFAYFNDGNVRGHRIVGSTKQNLAKFDAGDVIGCGLNLTSKEIILTKNGERLGKKEQTYHRFISSHYGSELFDTNFFFASKDADDLYPAISLNNPGDEVEANFGPNFKYTLN

SEQ ID NO: 127060 - protein, 203 aa, Heterodera glycines
  Coding regions on vcDNA: vcDNA=SeqID_53483; Strand=+; Position=1 -195,316-493,1562-1690,1746-1855
MGSSSSSSSSSSSNYTSSSSSSSRTTIKINFMDFSSNDNGSSSGFIEEGYCSCPWSHLRSISITLLEYHFAGSDNSRSPIETAIGIGSSLLSSIVPLIDDEDKELKTIGKLLGIPSVICGKVSKETHAFCIDCLGKYTNAAHETMPFAHSALGLKCMAKKCENPIPWQEIKNWLPKELKSIGALENYCAELSVEMAGLSYLER

SEQ ID NO: 127061 - protein, 121 aa, Heterodera glycines
  Coding regions on vcDNA: vcDNA=SeqID_53484; Strand=+; Position=1 -53,130-229,485-616,691-771
MLLYQVFQCKIIDKLTRNGLQEQQLLQNVDKTEEVVPKAAVEIDQNSQQNVPQRPNYSRDQLKKLECVFEGKNYISSNESEQLAKEIGLTKEQIEKWFKNRRAKQRAQKRVEEVISETIKS

SEQ ID NO: 127062 - protein, 105 aa, Heterodera glycines
  Coding regions on vcDNA: vcDNA=SeqID_53485; Strand=+; Position=1 -57,737-997
MSKIYFHYFKLTIRKLVRSRNNPGVLIFINLEVHIQKSIAARNPDFQRQIPVIFVPWNFGFPFQKFLGSRNAIQLNTRARVIYGSSPTIWEKSRGTGIKFPEDYL

SEQ ID NO: 127063 - protein, 52 aa, Heterodera glycines
  Coding regions on vcDNA: vcDNA=SeqID_53486; Strand=-; Position=1-272
VSLFAFAFRIIRIFWRFAFRFLARKATFTPLRIGLNSHKIFQNFTYKLANFQ

SEQ ID NO: 127064 - protein, 109 aa, Heterodera glycines
  Coding regions on vcDNA: vcDNA=SeqID_53487; Strand=-; Position=1-330
MAKEFANYGENRHGESEGQMEKPKSEIEMAKTNSDNEAEPIVTIMKDGRIEVEETERREKPKTKRNAGGGAKKRTMSPDAMDAADSMLKLAFTEQQKVKKRRGKEKQKG

SEQ ID NO: 127065 - protein, 43 aa, Heterodera glycines
  Coding regions on vcDNA: vcDNA=SeqID_53488; Strand=-; Position=1-128
FLFEGEKAKGTVERQRRIFGVERRGEEGKREEEQRGAFWGGGG

SEQ ID NO: 127066 - protein, 25 aa, Heterodera glycines
  Coding regions on vcDNA: vcDNA=SeqID_53489; Strand=-; Position=1 -28,683-732
MAKGTPRRNVATNVLEANWTTNCWR

SEQ ID NO: 127067 - protein, 251 aa, Heterodera glycines
  Coding regions on vcDNA: vcDNA=SeqID_53490; Strand=-; Position=1 -360,412-804
  Homolog annotation: Hit_ID=EAA20872.1; Match level="QueryCoverage =52%, HitCoverage=28%, E-value=2e-11, Identity=32%"; Hit description =hypothetical protein [Plasmodium yoelii yoelii]
MDMFRFNVHNAVKDTDDAAADSAAHDQCQQRQQREVASPRTMPLSLLVEEQAHVSAAAEAAAEAASAVDQKMSAAPNDTPAITDTKIDFMTDEQTVAAAPPPLFSEIEPTQQQQQQKKQQGRTAEIIAPKVELSVEDNGDDDDDDEAGQQVKQEADRNGMDAHHSNCAKGPLLFIDEQENEEEESEEDEDISTTHRRQGMDSSFDYEDDDDDDDNDDDDDDDEMESVSGCAESDKCGHCHHPHQLPRNALE

SEQ ID NO: 127068 - protein, 205 aa, Heterodera glycines
  Coding regions on vcDNA: vcDNA=SeqID_53491; Strand=+; Position=1 -88,139-459,991-1198
MLKLSFPFLPIIMMDFAIGRIALNDKCQKDFFATADQLQEMASEIFAAADKQTENGKFFEKGFDIFCCIAFEIEKDALNKDELAMIEDFEAKQRNFCHQMKKGQNIWEAMESPAGNAIVTAAKNLKVNPQTYEEGLHERLAQTLLAGGGQTVSDQSSALSAQPAPTRSDQLPKGKSHGEGKGRVNGQNALVLLHWPAFPAMCAVY

SEQ ID NO: 127069 - protein, 164 aa, Heterodera glycines
  Coding regions on vcDNA: vcDNA=SeqID_53492; Strand=-; Position=1 -165,433-530,959-1209
  Homolog annotation: Hit_ID=CAE63242.1; Match level="QueryCoverage =100%, HitCoverage=18%, E-value=6e-56, Identity=60%"; Hit description= Hypothetical protein CBG07607 [Caenorhabditis briggsae]
ENARFVPNFVISFTFLALFCICCSFTLSSRHAFAIDWIRSKPYVACAGLFNTILALISSFGFLLLLGIPYNVINTIIPFLIIAVGIDDMFVMNSCWDQSDPALSPDQRMAQMMQNGGVAVSITNITDILAFLIGCVTELPGIELFCLYAFAAVLFCYVYQASFF

SEQ ID NO: 127070 - protein, 100 aa, Heterodera glycines
  Coding regions on vcDNA: vcDNA=SeqID_53493; Strand=-; Position=1 -13,514-541,603-721,2532-2674
  Homolog annotation: Hit_ID=CAE63242.1; Match level="QueryCoverage =54%, HitCoverage=5%, E-value=2e-18, Identity=70%"; Hit description =Hypothetical protein CBG07607 [Caenorhabditis briggsae]
MDDPAYVFTPRDARWKKELGTFSKLWPLEENKFIPGKSFEMKRFVNVLCKAKDGHAGIFGHCPWRHRIERHGRHGDGSKSHTAVLLPETGPTRRTTVLHG

SEQ ID NO: 127071 - protein, 18 aa, Heterodera glycines
  Coding regions on vcDNA: vcDNA=SeqID_53494; Strand=-; Position=1-57
LDISWAGHFVGQRKTVIK

SEQ ID NO: 127072 - protein, 20 aa, Heterodera glycines
  Coding regions on vcDNA: vcDNA=SeqID_53495; Strand=+; Position=1-60
ARFKPPNSSGQLTGTVCTER

SEQ ID NO: 127073 - protein, 141 aa, Heterodera glycines
  Coding regions on vcDNA: vcDNA=SeqID_53496; Strand=-; Position=1 -222,684-890
  Homolog annotation: Hit_ID=NP_741614.1; Match level="QueryCoverage =67%, HitCoverage=17%, E-value=4e-36, Identity=72%"; Hit description =AKT kinase (62.7 kD) (akt-1) [Caenorhabditis elegans] emb|CAA98238.1| Hypothetical protein C12D8.10b [Cae
YVLVLLLFSKFHKLESLGFKKSRRTTQFDTFMSTHLIQNFCSLSDYGRSVDWWGVGVVMYEMMCGRLPFYSKEHEKLFELILQCALRFPSRLSPEAKILLSGLLVKDPNKRLGGGPDDYREIQATEFFRPIDWDRLYRKVR

SEQ ID NO: 127074 - protein, 100 aa, Heterodera glycines
  Coding regions on vcDNA: vcDNA=SeqID_53497; Strand=+; Position=1 -240,326-388
  Homolog annotation: Hit_ID=CAE63849.1; Match level="QueryCoverage =56%, HitCoverage=19%, E-value=4e-12, Identity=55%"; Hit description =Hypothetical protein CBG08408 [Caenorhabditis briggsae]
MKHQYQNELNTQSSRAVTSPLADDDETLDESRERAYKLVAYTAVGFSLVAILAVAICLPVVFNFVDHIQRQTKRELDFCKNPAVRSGKMALRILKAMHLL

SEQ ID NO: 127075 - protein, 54 aa, Heterodera glycines
  Coding regions on vcDNA: vcDNA=SeqID_53498; Strand=-; Position=1 -68,120-216
MNLMTTFLTTKRKSWVLISFHFQNCGPEQRLLRQKRGQSDIGHRCDSERSKKRA

SEQ ID NO: 127076 - protein, 65 aa, Heterodera glycines
  Coding regions on vcDNA: vcDNA=SeqID_53499; Strand=-; Position=1 -43,251-405
MKPSTGRELMTMTETQPKDVDIIILCGIILADVSAAVESLNEIRLGIMSGSREILHLSNGITSQG

SEQ ID NO: 127077 - protein, 57 aa, Heterodera glycines
  Coding regions on vcDNA: vcDNA=SeqID_53500; Strand=-; Position=1 -108,378-443
MPLSPTRAQVLLLLPPAEVVARVVVALAAVVLVTGADWSQGGRTLVFHFLLYKLNAP

SEQ ID NO: 127078 - protein, 42 aa, Heterodera glycines
  Coding regions on vcDNA: vcDNA=SeqID_53501; Strand=-; Position=1 -23,304-409
MPPPPITLLLIETFMAIECWQQVRSIRTRSKISNILIPHYFI

SEQ ID NO: 127079 - protein, 186 aa, Heterodera glycines
  misc_feature (137)..(137): Xaa can be any naturally occurring amino acid
  Coding regions on vcDNA: vcDNA=SeqID_53502; Strand=+; Position=1 -210,959-1064,1143-1366
  Homolog annotation: Hit_ID=AAF80746.1; Match level="QueryCoverage =91%, HitCoverage=60%, E-value=9e-41, Identity=50%"; Hit description =pectate lyase 1 precursor [Globodera rostochiensis] gb|AAF80747.1| pectate lyase [Globodera rostochiensis]
FFAFCQDTDFGFTTFVGGHDILGGGDCEVNNGDMKYMFKLADGVTIKNAILNTPGMGIFCRGTCTLENIYYKRLCYHAAGFGYEDINQVNTYKVIGGGGMGSPDKYFTQSGQYFTQSGQGETQISGFCGDGRFRVYXHYDKIYHTDKKIENTSPKQVSGRFLKILEISLFILNAESNQIEFLINSS

SEQ ID NO: 127080 - protein, 65 aa, Heterodera glycines
  Coding regions on vcDNA: vcDNA=SeqID_53503; Strand=-; Position=1 -18,137-316
MDTGFMALTEDIDFYVDSSCEEDDDGDIVLEPPVAAETEPEESQKEEEQREEGKAEEEAANSKAI

SEQ ID NO: 127081 - protein, 96 aa, Heterodera glycines
  Coding regions on vcDNA: vcDNA=SeqID_53504; Strand=+; Position=1-348
SKKEKEICSQSAKDTQHKINCLETLSKYYRIINCHSNCFAIGRLLFGFSLLPLFLLLLRFLRFSFSSNRRFEDDVTIIILFTRRINVEVDILRQRL

SEQ ID NO: 127082 - protein, 41 aa, Heterodera glycines
  Coding regions on vcDNA: vcDNA=SeqID_53505; Strand=-; Position=1 -29,384-480
MLYTIEVVKKKFGRARSEAILEVEDEEEEQEEDMEWDEEEA

SEQ ID NO: 127083 - protein, 67 aa, Heterodera glycines
  Coding regions on vcDNA: vcDNA=SeqID_53506; Strand=-; Position=1-203
MNAYQQQQQQQLLQAYYSQFQPQGVAGADGQVPAKYKSTLCNIWLMEGICTRGKQCHYAHGIKELNY

SEQ ID NO: 127084 - protein, 29 aa, Heterodera glycines
  Coding regions on vcDNA: vcDNA=SeqID_53507; Strand=-; Position=1-88
LIIFVCNFLEMLELSCFLVLLHYSDFVLS

SEQ ID NO: 127085 - protein, 53 aa, Heterodera glycines
  Coding regions on vcDNA: vcDNA=SeqID_53508; Strand=-; Position=1-203
KVCSISITNRPSVHENGLEDQCCFVCTRPVNTSNECNAEAGPILRDTPWPSSA

SEQ ID NO: 127086 - protein, 123 aa, Heterodera glycines
  Coding regions on vcDNA: vcDNA=SeqID_53509; Strand=+; Position=1 -96,266-541
MVSTKFRAAAIDEMVPERRTKIERRPCIGVLTVLVCLYFCIVNEAMSNYYGRIGHLVGFNPPSNRNEAEEMIIEEDARLLLEQSLDENGLLVDQYFEEMGLNEVQDENSHDVNSEDGEVDIMN

SEQ ID NO: 127087 - protein, 113 aa, Heterodera glycines
  Coding regions on vcDNA: vcDNA=SeqID_53510; Strand=-; Position=1 -142,1057-1256
MPAVDCLNGYRSYTDRCGEFFMGDPLDPNMETDFDFAGNLALFDKAVKLSMTFGNSPTQERKLGEQETQFDETITRTGIACDRIRLQLKKCIKESDCIQVDNLVLRLDHVPFI

SEQ ID NO: 127088 - protein, 59 aa, Heterodera glycines
  Coding regions on vcDNA: vcDNA=SeqID_53511; Strand=-; Position=1 -13,119-285
MFVAELSMTFGNSPTQERKLGEQETQFDETITRTGIACDRIRQQLKKCIKESDCIQVDI

SEQ ID NO: 127089 - protein, 61 aa, Heterodera glycines
  Coding regions on vcDNA: vcDNA=SeqID_53512; Strand=-; Position=1 -62,108-231
MGLTRPAIVLGTIAMMRMFFRILPVLSRGPKIPLLMMMTIKTILPPLRSTDLIKRFEHRPI

SEQ ID NO: 127090 - protein, 168 aa, Heterodera glycines
  Coding regions on vcDNA: vcDNA=SeqID_53513; Strand=+; Position=1 -189,233-550
  Homolog annotation: Hit_ID=NP_509222.2; Match level="QueryCoverage =71%, HitCoverage=26%, E-value=3e-14, Identity=38%"; Hit description =putative protein family member (49.4 kD) (XH885) [Caenorhabditis elegans] gb|AAB37021.2| Hypothetical pro
QQSRPNSPANGVSKLILPRSRVASIRRESDCNSEKGFGEAEAAHEKMVKSAQQVAMGFEDFCLDDKAFEERKRAKSLSEPICIFTNAFLPQCSSPSPSRGSMDGQKVRTTDSDFDRHSVVIRSAMLFSVCPASRPQQFGVFSESESNSVWHSVNAPNEVLRESNAPSR

SEQ ID NO: 127091 - protein, 500 aa, Heterodera glycines
  misc_feature (7)..(7): Xaa can be any naturally occurring amino acid
  misc_feature (10)..(10): Xaa can be any naturally occurring amino acid
  Coding regions on vcDNA: vcDNA=SeqID_53514; Strand=+; Position=1 -157,206-330,371-471,525-729,771-816,884-1039,1097-1167,1221 -1303,1350-1475,1521-1660
  Homolog annotation: Hit_ID=NP_498164.2; Match level="QueryCoverage =97%, HitCoverage=78%, E-value=2e-89, Identity=42%"; Hit description =fumarate reductase flavoprotein (51.8 kD) (3G553) [Caenorhabditis elegans]
INSQTYXVLXIIVIGGGLAGMSATLEALSNGAKVILIDKEPTLGGNSAKASSGINGCGTKVQEINGCGTKVQEKLGIDDTAERFHSDTMAAGDRENDPGLVDLLVHQSASAIDFLTENGVVHQSASAIDFLTENGVDLADINLCGGHSVPRTHWLLSPLLSPKEGKPLPVGVAIIRTLNAKLEEWKARDPERLKIILGTAVLGLVTWNDYVTGVRIRDGDNKISALINGKAVILTTGGFSSEISALINGKAVILTTGGFSSETSLLTSLLVEFAPSVLPLPTTNGPFATGDGVKMARAMGAGLVGMGKVQIHPTAFVDPKNPTAHTKFLAAPKNPTAHTKFLAAEALRGKGAILVNEKGQRFGNELVNEKGQRFGNELGRRDYLTEKEQSEPLNCARQKSVNCARQKSVADLPIAWMLMNDQMADSFGRPAFNFYAKIKGFFTHFANVDELATEHFANVDELATEIGCSGEMLRKTLAECNEYAEMSTKSDKFVDPFGRS

SEQ ID NO: 127092 - protein, 204 aa, Heterodera glycines
  Coding regions on vcDNA: vcDNA=SeqID_53515; Strand=+; Position=1-615
  Homolog annotation: Hit_ID=CAE56838.1; Match level="QueryCoverage =92%, HitCoverage=82%, E-value=4e-09, Identity=26%"; Hit description =Hypothetical protein CBG24663 [Caenorhabditis briggsae]
MATDIKTILLRLSSIETLLSNNNNNTLATQMAEQFNAIAERLNEIERKINSNNNDNSSAEEKERKRSLVLIGLPEAVAEKPSERAKEDAETVAEVLDALDVEVCPQMVYRMGRRIDEKRKGPRLVKVVLPATTFQRFALAQWGRNRTELKQHVGWQRLLVRPSLTKEELAAEREIREQRRMNYEESKKNEMVTTRRGGNMGKNF

SEQ ID NO: 127093 - protein, 270 aa, Heterodera glycines
  Coding regions on vcDNA: vcDNA=SeqID_53516; Strand=-; Position=1 -567,644-889
MSKSGAKGLSRFEISSSTGAAGKRRGSSAEELPANLKGLAEVVDFGSVGVFYVRAKLVNLQYSLYNVSFHQYFIKFVVVADGSIRSQACPLKFSGGLFCRRKLDSELRCPSCDHRAKKPLVCMYCRVELKDIENPEVTQCATMFSYVAEKYIGIKAASMLDMRDQNPDKLEKLLEAKLEKELVVKMTIKEATAEDFEGQFDWLISKVFASDDEAEGSSQTAKKARIVEAEREEDEDEIVVVDHKTAVTAPSTSAVDEQEGKEKPNSEKTK

SEQ ID NO: 127094 - protein, 594 aa, Heterodera glycines
  Coding regions on vcDNA: vcDNA=SeqID_53517; Strand=-; Position=1 -471,517-778,827-1145,1190-1745,1788-1961
  Homolog annotation: Hit_ID=NP_507780.1; Match level="QueryCoverage =98%, HitCoverage=44%, E-value=8e-58, Identity=27%"; Hit description =predicted CDS, DNA polymerase type B, organellar and viral family member (5T899) [Caenorhabditis elegans]
MGRENVVPIFLENGHWDGLKNYVCFFNRGREFCIDCECFYDKDIYHTFDCRARCYYCNKVGGVPCQKESGVKIECPKCCRYFYNLECYNYHQEHQTCKLWRRCVICDKTYRFNPKKGHECEETYCQLCSVSHDPKRGCYIIPIEEKEEKAVYRIVVWDTETSQDSIYKGDQKEHVINYILVRVTCTECCDDKNRTNCKICGEERTKDWSEAEGHEPTKAFVEWILTAFSNYDTYIFAHNAGRFDGHFVFNYLCRTGKNPIPLINGLKIYEFKVRNSKKHSMLIWRDSCLLMPVKLESLKATFNLGCEDKPFFPYYYNKKENYGVRLQHLPPMEDYSPGSMNKNKYEKFEKWYNENKDTPFYLNDELRNYCRNDTEILLLSIIEFRRILINDITKGFDPLPRSCTNAGVAMNIFKAMFLLTEQLSIVPEKGYERCDRASVMAIKYLEWRSKRDEIEIRHAGNGREVKIGNYKLDGFIANNGARDKCIEVMGCYIHGCMNCYDPAAELIGGRTAQELNDETQERLAELRKTLDVEEVWGCQIEELKKDEEMRDFFDDRGNEKGPIDPRMAYAGGRTGPMKLFAKSDEKKKISVYDI

SEQ ID NO: 127095 - protein, 64 aa, Heterodera glycines
  Coding regions on vcDNA: vcDNA=SeqID_53518; Strand=-; Position=1 -52,338-480
MVGQRRFGQRRGPLASPTPNVVAHLSLLHVGTVHAHLQQIWTNVDKKFGRIAGTARTCGPVTIV

SEQ ID NO: 127096 - protein, 42 aa, Heterodera glycines
  Coding regions on vcDNA: vcDNA=SeqID_53519; Strand=-; Position=1 -32,208-304
MVQLYVGACKWWVANKFIIIMLDGETAKVINNLMFKYSICFS

SEQ ID NO: 127097 - protein, 238 aa, Heterodera glycines
  Coding regions on vcDNA: vcDNA=SeqID_53520; Strand=-; Position=1-714
MAINISDTKSLFNQILAQSDITITTSGITVSGPRLSTPRFLPFDDCGRCRVCKATEAEVDIMVTKEGVTLWCTRINKPQFVPFDVVYDLPGHCFFRVKNKARVFNVPYGDLPSGTCAKSKPTDHQQQQQQQQQQDLKRKAKVALDLVEAELMADAMQDGTRWKKAKTAINVLGNLQLAESLDSTNRNSTDVPTQANEAADIKEEEENVQGEEENKEDIGDIDKTLDDFFNSLNASTSN

SEQ ID NO: 127098 - protein, 100 aa, Heterodera glycines
  Coding regions on vcDNA: vcDNA=SeqID_53521; Strand=-; Position=1 -63,115-210,1031-1174
MKTLRNQVGRQTMPMVVNFDQTGDAQRTGQVGGRRSMPPSVVPANLGGGPPYQWYNWFTPTTAKQACVEALAFAREGGLKHENILKIMKTLEEREKRDKK

SEQ ID NO: 127099 - protein, 78 aa, Heterodera glycines
  Coding regions on vcDNA: vcDNA=SeqID_53522; Strand=+; Position=1 -209,392-419
MIFLLSPVIDIELWSESSNTSYTYSSTDKILATTTTAHPAFQPLVKATQLEWRKPEHDGGNLYQKWTAINDKWLVVHQ

SEQ ID NO: 127100 - protein, 512 aa, Heterodera glycines
  Coding regions on vcDNA: vcDNA=SeqID_53523; Strand=-; Position=1 -320,401-559,647-728,816-912,1030-1345,1426-1584,1672-1753,1840 -1936,3300-3434,3497-3588
PPTTKASSTKKPPTTKASSSANDEPCDEDATNEHPTTKASSTKKPPTTKASSSATEATSQASSSVTEEPCNEETSTSPSCAFVCSGFGWTIYNGNCYKVIEGLMNQSQAVAACNAEDSKAQLVSIADEAENRLLGRIIAQPLARSLLTYQLSSTIFNTFWIGLRRVRVGNLYQSTWANGSPATFGNVPEITTAATTTGTKNQYPWAEGQPSGTNKYTDPTGANEECVHMINANGQWNDARCAIQMTGAICKKAAQAVGIGSQAAVTPVGTGQIRVQSAGSSAAPPQASSSSFDLCNPSVSVCGGFGWTIFNGKCYKVIEGLMNQSQAVAACNAEDSKAQLVSIADEAENRLLGRIIAQPLARSLLTYQLSSTIFNTFWIGLRRVRVGNLYQSTWANGSPATFGNVPEITTAATTTGTKNQYPWAEGQPSGTNKYTDPMTNGLLYISESDLFPRVTLYNSGDVILANFGHNFMHNFNVASRSQKLAEIDQTITKMKDKNRNKRSCRCSGITML

SEQ ID NO: 127101 - protein, 223 aa, Heterodera glycines
  Coding regions on vcDNA: vcDNA=SeqID_53524; Strand=-; Position=1-671
  Homolog annotation: Hit_ID=EAL29494.1; Match level="QueryCoverage =93%, HitCoverage=20%, E-value=1e-19, Identity=31%"; Hit description =GA18465-PA [Drosophila pseudoobscura]
MTAMRGIKIKAKITLECSPIEDEGKGSSSSKESASSEESSAEHCSSDEDSSPVTKEPPTTKASSSATDEPCDEDATNEHPTTKASSTKKPPTTKASSTKKPPTTKASSSANDEPCDEDATNEHPTTKALSSATDEPCDEDATKKPPTTKASSTKKPPTTKASSSATDEPCDEDATNEHPTTKASSTKKPPTTKASSSATDEPCDEDATKKPPTTKASSSATDE

SEQ ID NO: 127102 - protein, 107 aa, Heterodera glycines
  Coding regions on vcDNA: vcDNA=SeqID_53525; Strand=-; Position=1 -60,125-274,1338-1453
MREMNRCPRVSYQQVTTMTALNDPSTDNKPMIVINGQRAITPTINTLMREDDADTSKQQQQKEQQRNSSKIFYNSLMDTLIRVLATRNGNSWQFELMESSRDELKVY

SEQ ID NO: 127103 - protein, 136 aa, Heterodera glycines
  Coding regions on vcDNA: vcDNA=SeqID_53526; Strand=-; Position=1 -73,1159-1284,2744-2803,2869-3018
MRGGKRFLRQMSSHNRVGGGGSIGPYSNRVVPGHPNPETRIPTFFSSRNPNPDPMILIGIRDKISTEMREMNRCPRVSYQQVTTMTALNDPSTDNKPMIVINGQRAITPTINTLMREDDADTSKQQQQKEQQRNSS

SEQ ID NO: 127104 - protein, 88 aa, Heterodera glycines
  Coding regions on vcDNA: vcDNA=SeqID_53527; Strand=-; Position=1 -37,281-363,621-765
  Homolog annotation: Hit_ID=AAH57756.1; Match level="QueryCoverage =94%, HitCoverage=31%, E-value=4e-20, Identity=50%"; Hit description =MGC69136 protein [Xenopus laevis] dbj|BAC82378.1| developmentally regulated GTP-binding protein drg2 [Xeno
SVAASYEFTTLTCRGRQVIAVAKTADLILMMLDATKGEIQKTLLEKELEAVGIRLNKRRKHLFQKKKWGRTEITHTVPLTLCTRTDPN

SEQ ID NO: 127105 - protein, 51 aa, Heterodera glycines
  Coding regions on vcDNA: vcDNA=SeqID_53528; Strand=-; Position=1 -45,108-217
MDMGFGIIQRLIPGKKSETHPAACSLTRDCKLRKLLAFRKSPTLQLRPKKG

SEQ ID NO: 127106 - protein, 333 aa, Heterodera glycines
  Coding regions on vcDNA: vcDNA=SeqID_53529; Strand=+; Position=1 -79,652-1574
MLIVIKCLLGFDGIIALFVIFVFLNLAAANTITAPTASALIGREALKKRTGISASTDGEVGDKADVGPQTATTTTHGEVLKEKILEQQKHTDNDDKADVGPQTATTTTHGEVLKEKILEQQKHTDNDDKADVGPQTATTTTHGEVLKEKILEQQKHTDNDDKADAGPQAATTTTHGEAVREKILDQQKRTDDDDKAAVGQQTIPTATKTHGETLKEKISQEQKHLVDDKSNSANAKQDDGSGTDEKIAHGQTLIARLKQSEEQKKEWGDPSQDNDDDGRAPKHGEMLWKLLRSTVPTNQQQMGDVIHHQFADAEQTRGRGTDGAVEKHFRRKN

SEQ ID NO: 127107 - protein, 85 aa, Heterodera glycines
  Coding regions on vcDNA: vcDNA=SeqID_53530; Strand=-; Position=1 -100,1062-1217
MVLCEFSELPNFAIRRRCSQPIGQCDDPKTQHPRQQTVQQSEAGLGAVQRGGPTRPLRPPLSAYGEHCTPRMAGRVGAALSHHRR

SEQ ID NO: 127108 - protein, 34 aa, Heterodera glycines
  Coding regions on vcDNA: vcDNA=SeqID_53531; Strand=+; Position=1 -43,157-218
MTKRKKYACGAIGGVYTTTKKDTTMLYFDKFQAT

SEQ ID NO: 127109 - protein, 39 aa, Heterodera glycines
  Coding regions on vcDNA: vcDNA=SeqID_53532; Strand=-; Position=1 -7,2138-2250
MEGKDDDDKITVEELARKKFSQQGMALNVRWLIVNKSML

SEQ ID NO: 127110 - protein, 103 aa, Heterodera glycines
  Coding regions on vcDNA: vcDNA=SeqID_53533; Strand=-; Position=1 -68,222-465
MNPSIEEVDGSEIEMMNDTELFRKCFGQLSPAAIPLFNSLNSISQIKVKRKGKTEKKKKQNNGYFFPFCCGNAAFATFLFCFNLSFMCQSSTYIISLLNVKRV

SEQ ID NO: 127111 - protein, 22 aa, Heterodera glycines
  Coding regions on vcDNA: vcDNA=SeqID_53534; Strand=+; Position=1 -51,190-207
MRGRHLRNGQGLSAGTDSLRGA

SEQ ID NO: 127112 - protein, 77 aa, Heterodera glycines
  Coding regions on vcDNA: vcDNA=SeqID_53535; Strand=+; Position=1 -90,147-290
MPPRGKAEENRTNCTAIQRTAKPNEPNKRMAKLTGEEECQLEALEGQMVELLGRIDTERREAEKSERQSATSRQVKD

SEQ ID NO: 127113 - protein, 290 aa, Heterodera glycines
  Coding regions on vcDNA: vcDNA=SeqID_53536; Strand=+; Position=1 -183,781-987,1187-1344,2282-2606
  Homolog annotation: Hit_ID=CAE63470.1; Match level="QueryCoverage =18%, HitCoverage=21%, E-value=1e-16, Identity=75%"; Hit description =Hypothetical protein CBG07937 [Caenorhabditis briggsae]
MTSNGALVAAKTPPEVQREFASLAQVPVVAGTVNRGSELIGAGCCVNDWIAFTGEWWWCRAESENVDDLRASCERMSAELEQEKKEKEEEKKQKEEAKARVAELENENEQLKNEIEQLKNALNAERSKSKKEKEGKTDEKEEKEKQKEEEEKKGGEVEEEEENEKEQDDEQNGGNKPKRARFMDFDRTTFEHSEHIQSLRDNPNLSAQLGVPLGCARSSGLPSLSAKFAAAVRHDAGGMSPSSSAMPTAQQLRAEQSAKLAMAHVRRGAELTRDNKCFEAIQVVHGTGIG

SEQ ID NO: 127114 - protein, 64 aa, Heterodera glycines
  Coding regions on vcDNA: vcDNA=SeqID_53537; Strand=+; Position=1 -81,785-898
MQNLQQIQSQRAEQKYTLNGYMYVKDKRTLEGSDRTNNYAEACNRKLKIGFGYAHPHICVLLTI

SEQ ID NO: 127115 - protein, 18 aa, Heterodera glycines
  Coding regions on vcDNA: vcDNA=SeqID_53538; Strand=+; Position=1-56
YREAIPEGFGLPINLGAS

SEQ ID NO: 127116 - protein, 46 aa, Heterodera glycines
  Coding regions on vcDNA: vcDNA=SeqID_53539; Strand=-; Position=1 -33,179-286
MYPLQLKLNFLAIVCAKGGQNERKYSLKMSPGPAEEKVNGLLGNDK

SEQ ID NO: 127117 - protein, 111 aa, Heterodera glycines
  Coding regions on vcDNA: vcDNA=SeqID_53540; Strand=-; Position=1 -75,201-445,619-634
MQLLGKWCPNGCTLRQKMDSRSDCVKFIGANTSVNFIVHFLLYPSTPIVPFALVNNRINQKLTLSKETDYYWVMKRCQIGQIVQWEEQNLADNLNNVNFMLYADYIGSRIK

SEQ ID NO: 127118 - protein, 121 aa, Heterodera glycines
  Coding regions on vcDNA: vcDNA=SeqID_53541; Strand=+; Position=1-366
HLLNNTSSSSSSSADDGPSSSSSPSSVSAADNTNKTPTSSSSPSPIRFCIRLTVNDWGEPVQRLPFRWLGSSLSGQCVVLVERRPVDNLNVELCIVRCPYMEAVQRGLMDNAVTMNDLEAS

SEQ ID NO: 127119 - protein, 74 aa, Heterodera glycines
  Coding regions on vcDNA: vcDNA=SeqID_53542; Strand=-; Position=1-367
EFHEVCVITDVRLPRTEKLNGGELAFLQLIKISFLIGHKFTEKHWWHVPGEQLQPHAIHRRQDNVGSGKWHRAI

SEQ ID NO: 127120 - protein, 270 aa, Heterodera glycines
  Coding regions on vcDNA: vcDNA=SeqID_53543; Strand=-; Position=1 -268,308-851
  Homolog annotation: Hit_ID=NP_913627.1; Match level="QueryCoverage =100%, HitCoverage=22%, E-value=1e-37, Identity=32%"; Hit description= putative helicase [Oryza sativa (japonica cultivar-group)]
MAFSGIASTLLKSGRTIHNRFKFPLNLNAQTVSGVVQGTKAAEEIINSDFFVIDEAPMTPRFALDVIDKKLRELTKCNLLFGGKTIILAVKSEIVDLTIKKSVLWNNFEQLKLTINIRAKDIFAKQILDIGDGVSPNSFIQLPPECILSNESDLIDEIYGDIFLKHNFNELKNHIILTPYNNLTDNYNEIALDKFPGKCVTYLSIDEVETSNNFPITPEIMNSFNSPGFPLHELKLKQNCKVMLMRNISIENGLCNGTMLQVIELKDNML

SEQ ID NO: 127121 - protein, 340 aa, Heterodera glycines
  Coding regions on vcDNA: vcDNA=SeqID_53544; Strand=+; Position=1-1020
MTPKVYPCSAELTKHHVVAMEHVVGAALQIEMEREVDMMIEARFEGRARKFDGADCLIVFGSRSKKEVNELAKVWEPESQVKVFKELGEKHFALGVVKDVEVLHAEYEKLELHIVIFLNNIQERKNVDIARKVDEFIQGGSVVIHPVPATAVEDRLFCFRCNVPSIIADEDSPRGRIMAVLLGRPAMEGIRMEKQSVDDSTDSWMEEEGPLHPAILALNSRQRVTARLMLGGGLVQQQAPPGTGKTKVAAAIIKAMMDSNPGFRIVVMACANIPVAKLVQEAEGTCAEKDLDGARAIALFSGFARCKYTDQIRDVQRHTLPNKVNSEEFVKQLSPNVQKQ

SEQ ID NO: 127122 - protein, 20 aa, Heterodera glycines
  Coding regions on vcDNA: vcDNA=SeqID_53545; Strand=+; Position=1-62
MEGRKKERMARLLNIVPTVV

SEQ ID NO: 127123 - protein, 327 aa, Heterodera glycines
  Coding regions on vcDNA: vcDNA=SeqID_53546; Strand=-; Position=1-3,71- 212,267-638,721-833,1099-1236,1279-1436,2079-2136
MKNDYSDEKEFKFFKNRSEEIYENYPALSQLLEGLFAAVVSANEAMKKENNNTLSSRKNELKQSLAYAVFFMAKRGQIPLESPLGEKEKEPKEISIELIDIYDELQMDDGITVESCQKSDEKERRENGQKGRGKYGQKERRIVQFDARSLEIEWNANAFIADGQNKDGDDNDVSHFPALNVVYLYINLRHKSSSETRQTAQCAGAGIRRMGILETKFHEDEDFQQVSDHYLSRISFLLLQMNSKGTATRKEEKIRERKRQFKSSEYDSIEYSSSEPALVESGSSENYIRAETPDILFSEAPTKELLESISIGPWQVVKLPEKRAPLF

SEQ ID NO: 127124 - protein, 63 aa, Heterodera glycines
  Coding regions on vcDNA: vcDNA=SeqID_53547; Strand=-; Position=1-191
MPNVYFLFFVCLAAMAPAATAGDSSLGNLVYGPPNCGPSPAPQPPHAEKLAMEDDGTGTNFGW

SEQ ID NO: 127125 - protein, 74 aa, Heterodera glycines
  Coding regions on vcDNA: vcDNA=SeqID_53548; Strand=-; Position=1-574
KIISKCNWLNFILIKKRCFHIFIQFSVDHFPIGFFSDCALLEIDAKFEKENGNGFFYLHNLFNGNWEIARHFDA

SEQ ID NO: 127126 - protein, 309 aa, Heterodera glycines
  Coding regions on vcDNA: vcDNA=SeqID_53549; Strand=+; Position=1 -74,577-657,711-873,1264-1625,1681-1930
MKKTQFSMLYPIKAFINVKLSDAKNPLSSDVGIWKLCNGKNGTILVENGCTKLLLCYQSEMATNRKIGKRFGVGKGNIGKLKFVECAEEIAEDQWHGLIITKHQDGCLSQTLVAPKTKAPFVGTTKFHGKTKTTTTTSIPTTTERQTFAFEPFSEFVSHFGTNCSKIVFPVEVAKFILNITAVPYRIACNEYEQDYEIGQSVELYLANSNKSFFNACMEVPTTKCAKHVELSACYKSMKTVGPNDNVVAKLCQDHLNETNVAGFSVQICIHRDEKEQKLVFETFLNLSTTDELYGQIMRDLMMSLINFT

SEQ ID NO: 127127 - protein, 23 aa, Heterodera glycines
  Coding regions on vcDNA: vcDNA=SeqID_53550; Strand=+; Position=1-73
TRRSRVPEREALSPQQQNSIDNV

SEQ ID NO: 127128 - protein, 144 aa, Heterodera glycines
  Coding regions on vcDNA: vcDNA=SeqID_53551; Strand=+; Position=1 -142,241-369,412-554,976-996
MGEKKQNQTLQKLTQTPPIYVHNASQQPRQVRLFVVQRFVDTNGRTIEELVSAPSPIAVFSSLKTPNESPKKRNLQSQQPQQGMSSNKATGSAVVGRKSANPYPLPKETKMSLGKKVRRMASWLRKTVSEKDCALIVLISYIIN

SEQ ID NO: 127129 - protein, 60 aa, Heterodera glycines
  Coding regions on vcDNA: vcDNA=SeqID_53552; Strand=-; Position=1 -30,700-852
MSAIFRPLMSRQLGKMMRIKEAIQRRKLIQQLNEDYLVSQIESESHPFLRSRSFNLLIYR

SEQ ID NO: 127130 - protein, 192 aa, Heterodera glycines
  Coding regions on vcDNA: vcDNA=SeqID_53553; Strand=+; Position=1 -378,924-1124
MGRFKITKFFISPFFIIGSISLLVNGRNDNLGPNSDFKIGISSAKKGQIGEQNVKGKSQQIIEDGTEKRNDLFSIFKKKEIFDELIEKKRIEKGKFDEFVEEMRENDQLIKMAFEPQQSDDYQEEKLEKQTIRAISKGLNNVKIDNEKITETQQEKQFKEKYREFRGHKRKRPGVVSINGTIKFVPYSNGVG

SEQ ID NO: 127131 - protein, 187 aa, Heterodera glycines
  Coding regions on vcDNA: vcDNA=SeqID_53554; Strand=-; Position=1 -79,467-675,720-821,852-1025
MGHLIVVCKSSSQQQKYIVGEANGPLANFELLIMDQEAIHSDVSKDVQETVAFLVDNVVDNIFKEYKRQEKELLFEERRKRNITLPELMAYSNMFKHQTATKKPKLHDDEDDSIVFIKEVPAFDKHVGLDLLLKQKDSFNRGDDTNLIAALKMDEEAQKVKEAHNLLSSNSENNSTELINLSSDSEN

SEQ ID NO: 127132 - protein, 264 aa, Heterodera glycines
  misc_feature (258)..(258): Xaa can be any naturally occurring amino acid
  Coding regions on vcDNA: vcDNA=SeqID_53555; Strand=-; Position=1 -171,274-457,504-627,723-843,899-967
  Homolog annotation: Hit_ID=CAE67878.1; Match level="QueryCoverage =90%, HitCoverage=38%, E-value=2e-53, Identity=46%"; Hit description =Hypothetical protein CBG13471 [Caenorhabditis briggsae]
FYSFFDFKFLSEKQLKMLLLDLFFAGSETTVTTTKWGILLLLHHPEVQQRCHAELIELFRFSVELRHRSRFVYLNATIAEIQRLANILPINLLRTCTENVSLDAFFFPSGTMVLPQISITLNDPAHFPEPDRFSPERFIPQISITLNDPAHFPEPDRFSPERFIDPLNGTLRRIDAFLPFSIGKRQCLGESLQCLGESLARAELFLIFSSLIRHFEFRTDRPPSRQRIYGLTVSPLPFKCQVSPLPFKCQIIRRKISXNSERKE

SEQ ID NO: 127133 - protein, 323 aa, Heterodera glycines
  misc_feature (212)..(212): Xaa can be any naturally occurring amino acid
  Coding regions on vcDNA: vcDNA=SeqID_53556; Strand=-; Position=1 -72,166-307,371-459,609-711,853-1059,1250-1299,1354-1423,1474-1589
  Homolog annotation: Hit_ID=CAE67878.1; Match level="QueryCoverage =100%, HitCoverage=52%, E-value=5e-57, Identity=37%"; Hit description= Hypothetical protein CBG13471 [Caenorhabditis briggsae]
PSLLVQATLWLVLSPLTFAVLASALLPSYALLPSYNVSSLFLFLLFGSYVFHELYWKRRLLPPGPIPWLIAGNMPQVHGAHNIDALLQRWHVDYHGAHNIDALLQRWHVDYDGIFTFWMGPIPICMVSRVDLLRRFFVSHGEAFSGRWQNFITHTFMDGHNGVVQIQGEKWREQRRFALHLLRDFGLGRALMEKKIQDEVWKMIGQSINPQXFDLSTFQVKSLIAHCIANIIDNILFGCTYAHDDPAFIRVQQDDPAFIRVQQMVDRQSSLVVRPVMGLYLCAPFTGLYLCAPFTTRLPWICSAWRQWLAIRDDFWAFLDTHI

SEQ ID NO: 127134 - protein, 57 aa, Heterodera glycines
  Coding regions on vcDNA: vcDNA=SeqID_53557; Strand=-; Position=1-171
MVGAVNSLFYPHNSIRFFKVAYPRGCGSLVFDSLNAAQLCLAAGEKHSVNGHSIEVK

SEQ ID NO: 127135 - protein, 128 aa, Heterodera glycines
  Coding regions on vcDNA: vcDNA=SeqID_53558; Strand=-; Position=1 -109,513-615,661-835
MGSNELSGGWVGRFMCQTLDKYINSMTLLMSPFSSLIIVNDTLPIEHKNLLAILSNGIVTTVVHRTNFSKKPPLCALIVVTWTGNCVRRCPFRRIRSAHSAQLFRTPLKVTISSTCSTSSTFIDFPMH

SEQ ID NO: 127136 - protein, 345 aa, Heterodera glycines
  Coding regions on vcDNA: vcDNA=SeqID_53559; Strand=-; Position=1 -246,624-1415
  Homolog annotation: Hit_ID=CAB62280.1; Match level="QueryCoverage =17%, HitCoverage=85%, E-value=2e-12, Identity=59%"; Hit description =hydroxyproline-rich glycoprotein DZ-HRGP [Volvox carteri f. nagariensis]
MERYKRQQQQQQQAKVSQLIKENANWLCALSKAKCVKRCGRLIRKANTDQLLSLVEVCLNIIASRFRLTTRQKKRLMPYVDTMRKEHADRPTKVELTKGISVLMNRGGEEGEVVDTPRRPPAPPPPPPPPGRPPRRPPPSPPGGPGGPSPPTSPPPRPQRPPRPSRTSRRGGRMEQWRKRRYDIQQQQRQPPPLVVRDLLAEAAAAPLPESDDDDDDDDEYMLENGFALPAPSQYYGDLPVLPDNAEEIEEMDTAQRRIAIRRKLKKDEADADDDLQRKKYMMIYQPPPLPRAKVKVEQPRPPTPRPRPNVKREQQQKPKSEFKPPSTSKKNRSPHSGKKSARVW

SEQ ID NO: 127137 - protein, 228 aa, Heterodera glycines
  Coding regions on vcDNA: vcDNA=SeqID_53560; Strand=-; Position=1-687
MGGITLSGPRLSVPRFIPFEENGRCRACKGTEAEVDTMVTKEGITLWCTRIEKAQFVPFDVVYELPGHCFFRVKNKARVFSVPYSELPSSDRCAQPLPPPPPPPMTTAKHQRTPDDEEEKNLRRKAKVALDLVEAGLAADAMMQDGTRWKKAKTAINVLANLLLAESLTDVSPTFEQQQQQQLSSKEEEKREECTNNSSAAATTESAPDGDVMDDFVNSIQAATSNMQ

SEQ ID NO: 127138 - protein, 118 aa, Heterodera glycines
  Coding regions on vcDNA: vcDNA=SeqID_53561; Strand=-; Position=1 -144,208-306,512-625
  Homolog annotation: Hit_ID=CAE62877.1; Match level="QueryCoverage =97%, HitCoverage=17%, E-value=5e-13, Identity=37%"; Hit description =Hypothetical protein CBG07063 [Caenorhabditis briggsae]
MPPPGMMRPPHGSFMLPPPPPGASVGDEPPNKRPREETLEPEERWLQKVHGQIAVQIATPQNDEWNLKGNTVQIQLDISSSVTALKSLIQEQIGVPATKQKLVYEVNTNLIPILSHLH

SEQ ID NO: 127139 - protein, 202 aa, Heterodera glycines
  Coding regions on vcDNA: vcDNA=SeqID_53562; Strand=-; Position=1 -64,113-480,932-1106
  Homolog annotation: Hit_ID=EAL31955.1; Match level="QueryCoverage =96%, HitCoverage=23%, E-value=4e-18, Identity=33%"; Hit description =GA11682-PA [Drosophila pseudoobscura]
PPQDSIIADLLSLDISGPPVAALPSQTANIMDIFGIPSAPSADTTASSAAPAVPPPNIFDAPPSSSVFDNAPPPLQPQHPLTTLSSANATNPLDQIFCASISQSSAITTSQSPDQFANLFGGSSAGTGVAPSLQTLGPFVPPYEVAVKNNVDVFYFAIVVPLNVFFEESGQMDKRDFLQLWKEIPEQNEVQFTVQNNRNLTA

SEQ ID NO: 127140 - protein, 29 aa, Heterodera glycines
  Coding regions on vcDNA: vcDNA=SeqID_53563; Strand=-; Position=1-88
MEWYSGDVTTALNIYQEKKGILIVYVFSD

SEQ ID NO: 127141 - protein, 31 aa, Heterodera glycines
  Coding regions on vcDNA: vcDNA=SeqID_53564; Strand=-; Position=1-94
CNLRPSCIVFRFIHHHEMYFNDHGTINSSNS

SEQ ID NO: 127142 - protein, 291 aa, Heterodera glycines
  misc_feature (22)..(22): Xaa can be any naturally occurring amino acid
  misc_feature (33)..(33): Xaa can be any naturally occurring amino acid
  misc_feature (53)..(53): Xaa can be any naturally occurring amino acid
  Coding regions on vcDNA: vcDNA=SeqID_53565; Strand=+; Position=1 -44,83-256,596-647,739-840,877-965,1156-1278,1329-1460
  Homolog annotation: Hit_ID=CAG05542.1; Match level="QueryCoverage =99%, HitCoverage=52%, E-value=6e-38, Identity=36%"; Hit description =unnamed protein product [Tetraodon nigroviridis]
AKRFVGEGGGRDQAVPFISKAXECLVPFISKAXECLAHRSEALRIDLRPLAWXAVHLPEYALFAVLHSNSEMYKAASAYYNQRVVECRIAAQVIAKQSGSEKLFLAKFQLLHCSAKMAIEQMLTLVDEHLAKRIHTREEICAILDCSDAQLAQWSLNANKRIHTREEICAILDCSDAQLAQWSLNANTQNMTEFWLAKRARHVYAEAARVLEFEWVCREGREDNGTVAKLGELMNASHLSCAQLFECLMNASHLSCAQLFECSCPELDETVANCLSAGCIGARLTGDFHGG

SEQ ID NO: 127143 - protein, 269 aa, Heterodera glycines
  Coding regions on vcDNA: vcDNA=SeqID_53566; Strand=+; Position=1 -405,449-852
  Homolog annotation: Hit_ID=NP_507780.1; Match level="QueryCoverage =81%, HitCoverage=16%, E-value=2e-13, Identity=25%"; Hit description =predicted CDS, DNA polymerase type B, organellar and viral family member (5T899) [Caenorhabditis elegans]
MEPYRIVAFDLETMQHQPVSPREPEKREHQPNFIAAKVFCPECIDNSRWRNGTAGCKVCGPHRTVAFCQRRFVNTTVDKQVVADNPLEAFVGWLINALPKKFDTYAFSHFGGRFDMVLVFRELFKIGFNPEMIRQGNKMFEMKVKKQKNRNPNIVFHDSFNLMPCALAQLVPSYGLEVEDKPFFPHLANRPENYGRHIYPTVDDYLANGMMPEKRRQFDLWYERISMSHFNWMRHWLPIAPMTWKSYRLLSSPSAANSLKSRSGMTTLM

SEQ ID NO: 127144 - protein, 175 aa, Heterodera glycines
  Coding regions on vcDNA: vcDNA=SeqID_53567; Strand=-; Position=1 -113,241-382,807-962,2642-2758
MEIFDGFIIVDEKVISINLLNCDRCIGTFCEITQFAALEFTISDYPILQITDVGNASSSNPSNEEPLAQIVRWDWGQNGAQRIKETLTLNKGSEINCGSNASSSFVIRILKKRSLFPAPSNSSTDHDQLTVKIGDKQVAALKSRCETHLINCVEIPLIDRFLLIERFGLDNLKVI

SEQ ID NO: 127145 - protein, 71 aa, Heterodera glycines
  Coding regions on vcDNA: vcDNA=SeqID_53568; Strand=+; Position=1 -57,611-769
MAFSSVMPARAFGQGPAEQSEAFNQKETVDQWNFNTIDQMQFATRLQRGHLKTEQLVSLIISLMNLKMSKK

SEQ ID NO: 127146 - protein, 192 aa, Heterodera glycines
  Coding regions on vcDNA: vcDNA=SeqID_53569; Strand=-; Position=1-579
  Homolog annotation: Hit_ID=EAK89729.1; Match level="QueryCoverage =91%, HitCoverage=75%, E-value=3e-18, Identity=27%"; Hit description =uncharacterized glycine-rich low complexity protein [Cryptosporidium parvum]
GLNPPTFRSTGLNPPTFRSTGLNPPAFQSLGLNSSAFQSLGLNSPAFQSLGLDPQAFQSQGLNPPTFRSTGLNPPTFRSTGLNPPAFQSLGLNSSAFQSLGLNSPAFQSLGLDPQAFQSQGLNPPTFRSTGLNPPTFRSTGLNPPAFQSLGLNSSAFQSLGLNSPAFQSLGLNLSNGIQNYLKGIQKLKYNP

SEQ ID NO: 127147 - protein, 52 aa, Heterodera glycines
  Coding regions on vcDNA: vcDNA=SeqID_53570; Strand=-; Position=1 -30,294-422
MLLKLADYFQKYFLHLDVDKLRAFFNANHEQFLPVISKEFLCALSVRALAGL

SEQ ID NO: 127148 - protein, 119 aa, Heterodera glycines
  Coding regions on vcDNA: vcDNA=SeqID_53571; Strand=-; Position=1 -116,217-349,404-514
MEVFDEFIVVDEKAINEISAPKCGGCNCSFRDVTQFAALEFVTSYFPILKIKDIGNASKPNSEPLAQIVRWDWDKNGAQQINETLTLNKGSEHNCGIYTNASSFVVRIHKKREKKSNET

SEQ ID NO: 127149 - protein, 52 aa, Heterodera glycines
  Coding regions on vcDNA: vcDNA=SeqID_53572; Strand=+; Position=1 -132,536-562
MPTNVSVSQWKWTSPVCSNPYSFNVFSSSNFFFWYLLSNATASGKKLKITSE

SEQ ID NO: 127150 - protein, 311 aa, Heterodera glycines
  Coding regions on vcDNA: vcDNA=SeqID_53573; Strand=-; Position=1 -764,821-876,1424-1536
  Homolog annotation: Hit_ID=XP_550305.1; Match level="QueryCoverage =43%, HitCoverage=9%, E-value=2e-16, Identity=39%"; Hit description =helicase-like protein [Oryza sativa (japonica cultivar-group)] dbj|BAD68127.1| helicase-like protein [Oryz
MCRQISPGETGEHFWIPPQFLVKSKEELIDYVYPNFQQLLGNDKELLNRLILAPHIDTCDEVNEIMMANVPGQVREYLSTDKPLDDRPLDIDEIESEVAALNRRTDSGMPPHSLRLKVGCVVVLLINKSDKEGLINGTRIVLEELGDDRLIGRVINSNAIGGQVRFFLGRTRNVYEDKSPGGIKYELWQFPMKACIRYDHSKRVRAKQSALSALIWKGKYFPTVNCIRPSLGRQTETMSVFMLPTGKLMPKAEPKAVGHMVFGEMPIPFPSALWEEEEDKPPPTSILVAPFNENAPEFILFNTCHVQKAAV

SEQ ID NO: 127151 - protein, 131 aa, Heterodera glycines
  Coding regions on vcDNA: vcDNA=SeqID_53574; Strand=-; Position=1 -111,316-600
MKIVHFLKICVCGAFIATIITGTIFMVRSSADDRNGKQMKAPHEDGMQKSEDNEWDDKAHFPEQQKASKKGVNSEEEKQQQENDGDGVGQAPAPPQKHPKDIKKQVFLSEVLLGDILGWEIDNFYRLMPQF

SEQ ID NO: 127152 - protein, 92 aa, Heterodera glycines; identical to SEQ ID NO: 125147
  Coding regions on vcDNA: vcDNA=SeqID_53575; Strand=+; Position=1-304

SEQ ID NO: 127153 - protein, 33 aa, Heterodera glycines
  Coding regions on vcDNA: vcDNA=SeqID_53576; Strand=+; Position=1-101
MIGRAVRNRPFIFEGIFKFILYPRKMAISFFEK

SEQ ID NO: 127154 - protein, 497 aa, Heterodera glycines
  Coding regions on vcDNA: vcDNA=SeqID_53577; Strand=+; Position=1 -132,176-433,479-602,652-747,874-1196,1338-1434,1485-1603,1654-1859
  Homolog annotation: Hit_ID=NP_495686.2; Match level="QueryCoverage =95%, HitCoverage=32%, E-value=1e-126, Identity=50%"; Hit description= ubiquitin thiolesterase, family 2 (150.2 kD) (2I337) [Caenorhabditis elegans] emb|CAA87795.2| Hypothetic
QRPELLDENGHRYVGLFNQAMTCYLNSLIQTLYMTPEFRNKVYSWKFVDTPTDWKFVDTPTDEDNKNIPYQLQRLFLLLQTSEKASLETKELTTSFGWVSNEAFEQHDVQELCRIMFDALEQRWRKTENDESVHKLYKGTVEDYVKCLRCKRENVRKDDFLDKGTVEDYVKCLRCKRENVRKDDFLDLSLAVRPFGASESFKSIEEALSAEEALSAFIKPEILNGNNQYQCEVCASPQDAEKGLRIVEFPYLLTIQLKRFDFDYAALHRIKLNDRVTFPDYLDVNDFVYSPRRRPNRSRVTQKWPKSFSVYEFLEIDMVLFRLPEQDTAVQPSTNGQCTSATEDEVAADSQLLKRGKYIYELFSIMVHQGSASAGHYFAYIRNLDNLDQNKWFCFNDSSVHVASLDDIFRTFGGHANGWMNNMNAYMLMYRYMLMYRQIDHSQNEHFVRSTELPEHLILLKDKWRRRKNEVDNDRLTQNSAQVRRILSIFMKGVKQE

SEQ ID NO: 127155 - protein, 627 aa, Heterodera glycines
  Coding regions on vcDNA: vcDNA=SeqID_53578; Strand=-; Position=1-1883
  Homolog annotation: Hit_ID=NP_920291.1; Match level="QueryCoverage =95%, HitCoverage=39%, E-value=8e-54, Identity=28%"; Hit description =putative helicase [Oryza sativa (japonica cultivar-group)] gb|AAP52578.1| putative helicase [Oryza sativa
MYEDCNTIFARCHDAKKARLFITFTNNREWPEFKENIYKNGQMFTDRFDMWMRVWCGKIAVFHQELYEKGFFGTILGSGESMEFQGRGGPHAHIVAQTDLDAIPEVIQEYIWAHIPPLPDKDDDSPIAKMHREVRELMHMQLHRCSDSWCGPRDPNFGRCKKGFPAPFSKCTILHPDRPALYYRPSPSDGGAKIEVNGLIYDNSQVVPYNPYILLRYRVHHNVLFAYGNKANIKYALKYPFKGPGHCYVECKEESGSKIGIDEPAQYAKMNFRGATEAFAVVHSIPFAKLSHQVVHLSIHLPNQQPVVYRAFQLVSKAEEIQRGELPETPCSAYWKQWQTEWQHVPSLKDMLFEKVPEQFRWAKDRWLPYKRKPAKRPPIGRVVPVPPTDRERFALYALMRHFPGDPDHLKLVNGQQYNTFTEAALQHGLLEDDQIWHKTLGEAALHRWPDQMRWLFVSILVFGQPSNAIELWNKYKDQMYNPQGITSAAIRQARELQALADIDWRLHYFNLSCVHCGLPDPPNSKAKNTNLAVEEFFFGDDGLNMPHGQPNQRPQQNTPPPLNSDQQKVFDAVVRAIQSDPKDQTVPRRFFIFGDGGTGKTFLFGQIIKRLRKPPYTFKVLATAST

SEQ ID NO: 127156 - protein, 622 aa, Heterodera glycines
  Coding regions on vcDNA: vcDNA=SeqID_53579; Strand=-; Position=1-1868
  Homolog annotation: Hit_ID=NP_921817.1; Match level="QueryCoverage =44%, HitCoverage=17%, E-value=2e-20, Identity=27%"; Hit description =hypothetical protein [Oryza sativa (japonica cultivar-group)] gb|AAP54104.1| hypothetical protein [Oryza
MTFGYDPNVPAEVILLPVHFPGHWTLIVHDVQFGTHFADSLPTPYGRLDPQLTDKIRKIISDILSSTVLTGIFNVENLTEQHDGNSCGYFVCLYAESWLMNNRTFVLPDLSINYEKKRILWHINELYGSDNVPYHPREGVPTPCPIVYRHTDEAQSTSKAAESMEVDDKNDIMIIEPQTSGQAANAILTQAQVDGENQVDTLGLVSESCVPQEPIAQADDAIFVRPKTPPRRSSRIGRRQSASISRSPSPAPRRSLSAKAVEKVTAFTQRCYLAHKGWCCAAAAAKHYPGYSNSGKLGEKKCSHCGALLFPHEDSRVCCRQGRVVLPKLNPHPKELEELIVCDKQPREGKEFVRNMSRYNNLLQFASVSAGNKPCPAGGPMAVILNGEFHRRISSMQAGTTQIPGFGQLYILDPVEAMEQRRKNPTFTGEKITNEEEFVQGHQLNDETLEILEKMIQENHPAASAYKQAREQLQELLRQQRTEELRFFRMTLLNERSAPGGMKDPKLHPHQIITPSTGEGMFAIHADPTGAPAPKGIWVENKQGQLNEIAPFSPWTDSLTYPLIKPKGDDGYTIGIPYAKPAQRRRKSNMSADMLDTEAMSDDDMCETESIAESDAGSEASM

SEQ ID NO: 127157 - protein, 399 aa, Heterodera glycines
  Coding regions on vcDNA: vcDNA=SeqID_53580; Strand=-; Position=1-1199
MLKKRKKEEHLRRTEKSVSPGRSPIPNCPPKGNSNCPILDKPLVADENGVVSHPGTTTPNIGALQLSTPASSIGSKRRQFTSATQNVESSPSSKKWKVNEVDRPMSANEAIASTPVSTQRNRGRPAKKNRGPGRGKTNDSMSESSSIDQGSEATTSVAVLPTVPEKINFSTVQINFATSRNMACKIRRWADVGLYERDGETEQGPRSGPKFIETCWNDLTQFLNDAFVAEYLAYLASISVRKVVVVDPIVWQIGIDRVMPYKNMTFGYDPNVPAEVILLPIHFPGHWTLIVHDVQFGTHFADSLPTPYGRLDPHLTDKIKNIISDILPSTVLTGIFNAVNLTVQHDGNSCGYFVCLYAESWLMNNRTFVLPDLSINYEKKRILWHINELYGSDNVAYHP

SEQ ID NO: 127158 - protein, 92 aa, Heterodera glycines
  Coding regions on vcDNA: vcDNA=SeqID_53581; Strand=-; Position=1 -72,647-791,1915-1976
MLGWTFFPLLTMLNSASNWHYFRHLVCSDVWMDIFPLFDRPQPGLKLTLISPRFDVLVYKHFDVKGEVFPNFATAQQFSNCVTVWMDIFPFY

SEQ ID NO: 127159 - protein, 60 aa, Heterodera glycines
  Coding regions on vcDNA: vcDNA=SeqID_53582; Strand=-; Position=1 -82,573-673
MLGWTFFPLLTMLNSASNWHFFRHILMPFSLFDRTQLGLKLALLSLRFDPLVNKHFDGKK

SEQ ID NO: 127160 - protein, 35 aa, Heterodera glycines
  Coding regions on vcDNA: vcDNA=SeqID_53583; Strand=+; Position=1 -94,889-902
MRRGTTVMRRGTTVMRRGTAVIRRGTTVIQRELLE

SEQ ID NO: 127161 - protein, 286 aa, Heterodera glycines
  Coding regions on vcDNA: vcDNA=SeqID_53584; Strand=-; Position=1 -223,268-720,768-865,907-990
  Homolog annotation: Hit_ID=CAE69126.1; Match level="QueryCoverage =100%, HitCoverage=56%, E-value=4e-98, Identity=65%"; Hit description= Hypothetical protein CBG15152 [Caenorhabditis briggsae]
MHLCGLAQAPGNPVIACQINLDKNFAFIEFRSIDETTAGMAFDGINFMGQQLKIRRPRDYVAPTTNYELLGRMPVSNIVVDSPFKLYIGGLPNHLNSEQVKELLSAFGQLKAFNLVMDTTTGMSKGYAFCEYLDQSLTDQVGPIFTSFLQKSFKAVVGLNGMQLGDSRLLVQLAAAGARQSVTHPSTAVQIAGIDLSRGAGPPTEVLCLMNMVTEEELQQDEVYEDITEDIRVECNKFGNVVSMEIPRPGYDERGVGKVFVEFQSKEECQKAQAALTGRKFDSRVV

SEQ ID NO: 127162 - protein, 222 aa, Heterodera glycines
  Coding regions on vcDNA: vcDNA=SeqID_53585; Strand=-; Position=1 -236,281-502,552-580,879-1057
  Homolog annotation: Hit_ID=CAE69126.1; Match level="QueryCoverage =84%, HitCoverage=34%, E-value=4e-24, Identity=37%"; Hit description =Hypothetical protein CBG15152 [Caenorhabditis briggsae]
MDDENTHQANMERVREDEDEKIGLMDIKREIKAELNEAIGRQTEDGETEPKAERERERKSDRERERKKKSKRTSRDRSRGWHCPIHVICFLNLIKTRTPTKSLAVEGTPPRERAKPRKGKGRKEVESEEQQILGCATRWLRTHEPEGVQRTPSSGRPLELRKATGAIPRATLQSSVPVVGPSVTCQARRLYVGNIPFGSNEDAMLDFFNQQVNHGLFNGWDS

SEQ ID NO: 127163 - protein, 164 aa, Heterodera glycines
  misc_feature (153)..(153): Xaa can be any naturally occurring amino acid
  Coding regions on vcDNA: vcDNA=SeqID_53586; Strand=-; Position=1 -47,205-655
  Homolog annotation: Hit_ID=AAP92584.1; Match level="QueryCoverage =84%, HitCoverage=28%, E-value=3e-35, Identity=58%"; Hit description =Ab2-057 [Rattus norvegicus] gb|AAP85373.1| Aa1262 [Rattus norvegicus] gb|AAP85367.1| Aa1011 [Rattus norveg
WWGASRKRKSSGSGGSAWPFLVRGAICLVYSDNERDSSLLNSWLIASGHNFLEGFSVFSRTKLSNNRSVMPLDVRGCTRATLAKSACLPSPKGVGKPVKICRDWDRTLQLLSVNEEFLVGASHQLALNTSLPFVHTARRCPGLSHFEKFGDGXCSGRSVCRLEP

SEQ ID NO: 127164 - protein, 279 aa, Heterodera glycines
  Coding regions on vcDNA: vcDNA=SeqID_53587; Strand=+; Position=1-840
MALFSMLLMLLLLLLHLSGGEWINVELSVDPPNFFDRTFRSLSKTSPIQHWFGYNRNTACHVERETNINRLYNSADMWNIALTDVDNFMSMGRQTIELLSSALPWACFGHDRHSFVIFDLRNDANEVAVVRGHQHKIARNLSAYGRILFDHISGRLYMVDKHERRIHELLITDFVRWWTLNNTDGGGGGGGHNGGGENSTATHSLRSNFVGFLPEQKTDFFIAADHVYLIWRRRVYKFRVGHYFNDPSSQLQFLTNSSDIRFNFLIFERDDDATIGRQH

SEQ ID NO: 127165 - protein, 136 aa, Heterodera glycines
  Coding regions on vcDNA: vcDNA=SeqID_53588; Strand=-; Position=1-411
  Homolog annotation: Hit_ID=AAA29616.1; Match level="QueryCoverage =39%, HitCoverage=38%, E-value=5e-09, Identity=37%"; Hit description =histidine-rich protein [Plasmodium lophurae] pir||A54523 histidine -rich protein - Plasmodium lophurae (fra
MIKTFQSLLNPPTFQSLGLNPTAFQSLALNPPTFQSLALNPPAFQSLALNPPTFQSLALNPTAFQSLALNPPTFQSLALNPQHFNHWHSTHQHFNHWHSTHQHFNHWHSTQQHFNHWHSTQQHFSHWHSTHQHFNH

SEQ ID NO: 127166 - protein, 115 aa, Heterodera glycines
  Coding regions on vcDNA: vcDNA=SeqID_53589; Strand=-; Position=1-417
PIPSFMRHQLHSFLVLPNCLKCIPKNALKMIKPVFSRISCQYFPIRNDTVNSFASLIFIRALLRISLKISGRQFYILANFYFICDRQFLHTSHFLFYCDQAYLSSYFWDFFRMWS

SEQ ID NO: 127167 - protein, 51 aa, Heterodera glycines; identical to SEQ ID NO: 124998
  Coding regions on vcDNA: vcDNA=SeqID_53590; Strand=-; Position=1-155

SEQ ID NO: 127168 - protein, 32 aa, Heterodera glycines
  Coding regions on vcDNA: vcDNA=SeqID_53591; Strand=-; Position=1-98
MRRPRLGGGPPTLFVLSLFRLTGAQMDADFGH

SEQ ID NO: 127169 - protein, 69 aa, Heterodera glycines
  Coding regions on vcDNA: vcDNA=SeqID_53592; Strand=-; Position=1 -79,2279-2409
MWPSDQPTKEPRAFNLRDMDHPDAVAALELGLLHHYPPLLNASANHDDDSKQYFRLLELDGNHLLIGAA

SEQ ID NO: 127170 - protein, 22 aa, Heterodera glycines
  Coding regions on vcDNA: vcDNA=SeqID_53593; Strand=+; Position=1 -50,330-348
MAENYGQTNGLIVVPKSIFLNF

SEQ ID NO: 127171 - protein, 240 aa, Heterodera glycines
  Coding regions on vcDNA: vcDNA=SeqID_53594; Strand=-; Position=1 -114,362-970
  Homolog annotation: Hit_ID=CAI21299.1; Match level="QueryCoverage =54%, HitCoverage=80%, E-value=6e-09, Identity=30%"; Hit description =novel protein containing a homocysteine S-methyltransferase domain [Danio rerio]
MLSLNGTFPPQSLKPLALAFVLDGGIGSQLEELGYPINVYRCRGGYNRDEQLPRQHSETHGKPGLFAGTGRVHPPRTAPTLPLATLLTLPLFSYFICLSQKSVLIAREAIAASGRPVALVGAVGPYATYLRDASEYTGAYVKKPDFQEQVVTLLAIRSRQIIVSKFVWHSLQTIIDYYLLQCRPLIAAGVTTLNFETIPSVKEVECVAKVMDQLDDTVQAWVCCSCQVKVDKQIKRSKSI

SEQ ID NO: 127172 - protein, 117 aa, Heterodera glycines
  Coding regions on vcDNA: vcDNA=SeqID_53595; Strand=+; Position=1-356
FQSLGLNSHAFQSLGLNSLAFQSLGLNSLAFQSLGLNSLAFQSLGPNLTWSFGIAIIETQFCDIPITGTQLTSIPITGTQFSCISITGTQFSCIPITGTQFSIIPIPGTQSHQHSNH

SEQ ID NO: 127173 - protein, 134 aa, Heterodera glycines
  Coding regions on vcDNA: vcDNA=SeqID_53596; Strand=+; Position=1 -82,123-211,264-497
MSRLFILLLPAELIFEIVCNIPTLSLFGRNGPPCITGIVNRQFETFRDLKKENFKKLNDLIDIISIKCKIQITYWGHINRRFYVHEHAVKRDLVDLVYNELHYYVRYGRSEKNLLEGVTWFSPVNEVIYEREYR

SEQ ID NO: 127174 - protein, 98 aa, Heterodera glycines
  Coding regions on vcDNA: vcDNA=SeqID_53597; Strand=+; Position=1 -112,166-350
MATVIKKIRIFVQVRGRDPELCRNKCHIREQRPRKPTVLHWWLSYEIRRLTTDGHPRVSASVSSDEEEEQQGKAEEEEEEIIGGERMPNRRAQQTNNL

SEQ ID NO: 127175 - protein, 343 aa, Heterodera glycines
  Coding regions on vcDNA: vcDNA=SeqID_53598; Strand=-; Position=1-1032
  Homolog annotation: Hit_ID=NP_920205.1; Match level="QueryCoverage =94%, HitCoverage=21%, E-value=7e-36, Identity=33%"; Hit description =putative DNA helicase homolog [Oryza sativa (japonica cultivar -group)] gb|AAP52492.1| putative DNA helica
MVNGLLCTSFTEAAIMHGLLEDDKIWDKTLAEAALSRWPDQMRWLFMSILVYGRPSNAVELWNKYKDQMYFPQGITTPAQRQAAELEALADIDWRLHSCFNLSCVHFSLPDPPNSIAKNTNAAIDEFFFGDDDLNLPPGQPNPRPQQITPPPLNSDQQTVFDAVVKAIQSDPRDSTVPRRFFIYGDGGTGKTFLFGQIIRRLRKAPYTYKVLATASTGCAAILLPYGKTAHSTFRLGREVSLDKLPSIPLESFFARRIREAQLIIIDEITMLHNTVIEVIDRVCKEMAIRQHKDLLFGGKTVIFSGDFKQSLPVVPHEGLTAQVTACFQSNNSLAMTRSCSTA

SEQ ID NO: 127176 - protein, 303 aa, Heterodera glycines
  Coding regions on vcDNA: vcDNA=SeqID_53599; Strand=-; Position=1 -709,753-957
CISAGVYAAQNEILTTGRTTKQMDELTSKTPISLPVPQCPIILVHQIDRMQEDPTSFSATNPMQTRTVMKCLTFLRPCFNGLIRVVCFYAGQAKEIGTEVSALNMPNVMVTTVDGCQGHEAEFVFVVTTKAGLSSNDNSGAFWNDERRVNVALSRSKFGMMVVGDLKLLWTADGIWRRFLRRALDKAIAVTPEYIHAMMDPKPQFVDGVIATSNGSVKAFDFYDDWQGSDGPSLPRQQQSARQPGSAHPNMPAGLCHYCLRPGHFLRDCPDRPSPSPNMPRPTSSRPGQWTNRTNDGRGRRND

SEQ ID NO: 127177 - protein, 458 aa, Heterodera glycines
  Coding regions on vcDNA: vcDNA=SeqID_53600; Strand=+; Position=1-1377
MTLVYPQDQQQQVLIEQPNFSQNHQKFTRQVFQIPETNQEPRHFPTYPQPNVAPSNLEFNLILERIPDLNGNEGTDSVRRFFKKFDAYTDGWPNAKRISVLESKVFNKAERAFEAAKSTQPYRYEHIRKDMIQQLEETDSKQLNAFDDLMLGVRRRQNESIDELAGRISRLVKSAYPGLTNNLCDEYSIKFLIRSMGNPDLALNLELIRTPGMTLDHFVSLAARAESTQRASKRFSTHPNDGFQQREQQPKWRQNFGGNSSQNMAKVQNFAGNINQHPQPKEDTRNQWKCYNCDEYGHLSRNCSRPRTFMQNQPINQQKNFVAIGANRTQIQPPNQNRNFQTPKPNSANFLKQNCLVVQHEEVLAEARVNKIELAPEVSEFYEKLERITESKNEIFLPTIGKVMSLKLEVFGTETDAMLDGGAQISLISGDFLHKLLIEKAITLETLKSSKRKPKFLT

SEQ ID NO: 127178 - protein, 61 aa, Heterodera glycines
  Coding regions on vcDNA: vcDNA=SeqID_53601; Strand=-; Position=1 -96,1100-1189
MCDFEGEFAGVNVRLEHAYGLRIEGRFARMTRYNRKLLLFGVSTRSSQLITCLKNRIAYEK

SEQ ID NO: 127179 - protein, 202 aa, Heterodera glycines
  Coding regions on vcDNA: vcDNA=SeqID_53602; Strand=-; Position=1 -540,896-964
MKFAKKMLMIPEAEYLALRSAMNSGDYLQNEKASLDAKISQNLQDPGISEDLKAKRHDWLYKERRTVKGILKNRPQKVVIENHVPGPNVAPYLGLKNQSKPQETEEPRKIIIPRKRLKEQTPDPESYNDTLEELTPERQTTSTLKTPIPIKTIIHPTLLNGLFRYVKENKDLFKITAAGKKGYIKGVKGQFDWYIVSKCKTR

SEQ ID NO: 127180 - protein, 77 aa, Heterodera glycines
  Coding regions on vcDNA: vcDNA=SeqID_53603; Strand=-; Position=1 -168,224-289
MPPNENSDRPFQQPDNVQPDQQPHQQQPDEDTELRAQIEDAEEDLLLNWWREDPTIIRFLFWTQTRPCHRSCASSTR

SEQ ID NO: 127181 - protein, 223 aa, Heterodera glycines
  Coding regions on vcDNA: vcDNA=SeqID_53604; Strand=-; Position=1 -268,562-965
MHVDFDPLQVDWSTFSSEYVQFGGYNIYRGLPYQRGAGVGAVFRSLMRYLLPIGKQIGSAIGRQGIESGNRVLTNVLEGKDLKESLVSEIPPTNVSVVRSFFRQVLPLATITQESPYLFRLYSDNLWTDLSRIYLYLELSIEKPGANDKWVAIEDTDTGVSAIQGIGQTFVQQLKVTVGNTEVYDSGNLYPFKAYITNELSFPINAKKRFSLFNGVLLHRKPR

SEQ ID NO: 127182 - protein, 532 aa, Heterodera glycines
  Coding regions on vcDNA: vcDNA=SeqID_53605; Strand=-; Position=1 -189,237-1321,1570-1894
  Homolog annotation: Hit_ID=AAA93301.1; Match level="QueryCoverage =64%, HitCoverage=92%, E-value=6e-54, Identity=37%"; Hit description =HASI
VSEEGQVLRAGGRPFITSSVDDIVSHLLNKDKRGQNKEPTAFKEFVERARQNPLLSRHLFPEAIIMDLKKLRLLEFLYKDLSSPVAFTSVEPLLREARKSQPKINRNDVQNYLTSQRTYTLHRQAKRRYRRLPTLAPGLHTEWQADLAIFDRLDKQNHGFKYLLVCIDTLSRQVFVEPVKTKTSANMIIAFDRIFKRSKYIPWKVLTDQGKEFTARAVQQFFRTKDVEHFCMLTSPQFHAGMAERANRSIKERLYRYFTERNTYKWIDVVQDIVRAINHSPNSSIGMRPADVNFKNAEALRQKLHDAAENVVRRQPKYRVGDRVRIEKYKHVFQKGYLPRFTNELFTVAEVHSERSPVVYRLRDDHNEIISGWFYANDLCKSLEDKQQKMYEIEKILVKKRQNGVDYALVKWKGYSARFNSWIPVEWQTGNTVRIELPSSNVTNPHELGKNLYRLLGEGSDPLAKKVRSTQNSFMLTINKARRWTREEYIKRKTKEKRGVRDEELLLQALLTDTETVVDLNIMTHGLLAREK

SEQ ID NO: 127183 - protein, 140 aa, Heterodera glycines
  Coding regions on vcDNA: vcDNA=SeqID_53606; Strand=+; Position=1 -42,522-620,758-857,1012-1193
  Homolog annotation: Hit_ID=CAE63601.1; Match level="QueryCoverage =65%, HitCoverage=19%, E-value=3e-35, Identity=79%"; Hit description =Hypothetical protein CBG08092 [Caenorhabditis briggsae]
MICIHWKGPLVLQQFYLIVVSALMALLFIKYLPDWTVWTVLAILSIWDLVAVLSPKGPLRILVETTQERNEPILPALIYSSTVTVLYSYVLHGVVSSAFIVAAGVGTNGDDEDEQQQRQPQPNDGRQQGWAKSENKTRNL

SEQ ID NO: 127184 - protein, 50 aa, Heterodera glycines
  Coding regions on vcDNA: vcDNA=SeqID_53607; Strand=+; Position=1-150
MRRQQIMLMVIDNNNNDDDADEPSQQQRKQCATQSMISDQISDRSDQCAA

SEQ ID NO: 127185 - protein, 37 aa, Heterodera glycines
  Coding regions on vcDNA: vcDNA=SeqID_53608; Strand=+; Position=1-233
KQNESNFEFLGFSGSLNTNIYEYTLYITPCLTLGPSE

SEQ ID NO: 127186 - protein, 57 aa, Heterodera glycines
  Coding regions on vcDNA: vcDNA=SeqID_53609; Strand=-; Position=1 -52,166-245,608-649
MDRLKVQSIHIEPDYGTGLNYILPQNYSVDKIVFFLLLRMLIIKNFLYEYVMVNLTS

SEQ ID NO: 127187 - protein, 980 aa, Heterodera glycines
  Coding regions on vcDNA: vcDNA=SeqID_53610; Strand=+; Position=1-2943
  Homolog annotation: Hit_ID=NP_498959.1; Match level="QueryCoverage =83%, HitCoverage=39%, E-value=4e-56, Identity=24%"; Hit description =zn-finger, CCHC type and RNA-directed DNA polymerase  and Integrase, catalytic domain containing protein
MQLLRQQNIERRNVSPLRSPFEQNFRENVIVNPIRNENRGPNQHFADGFGGQPNPNARLQVFRQQHAEIDRHYSSAFHAPVPMRQTCHGQIQQAAYMEQHGAHQPMLLQQQNMRGVMHHQQPMAGRNEYFPEYYGGRHLYPDGREQPNSGNNELKIGNMEYVLTMDRLPELNGNEGTDKMKSFFKKFSNVTEEWPEKKRIKALESEVNGRAERAFNAALNTQPYRFDSIRRAMQQQLEDTDCREMSAFDELMSGVKRKPNESLDALADRIQSLVSRAYPGLTQNLCDDYAIRHLIRALSNPDLSLTLEMSRRPGMSYDEFVALAARAESIQRATKVQATENRSTDNRNRNFYTSNNPIRQQSGGYESNPQQTRKGVVCYNCNEPGHISRECQSVRGQRNVNTGADRSRQQFATGANNISLRNNADNQRNAIRTYPAVKSQNFLKQNCIVMQEDKPPDAFCRGVKLTSEISSFIENELGEATQTEMSKGKDRVGKILVINVETYGTQTVAMLDGGAQISLIGAGFLYELIKERGLDLKKSDFSRTSARIADVNGQQLKCFGVVTIPITRKGCSQIPICFHITTAQFGYDLLLGTNSLSKLGFLLYDTANKEMIEFEEISQNDSNSARVIFSTKIQPRSTRLIEIGVGDQWNGKDVVISPQTVKGNVKVEESVGKVENGKVVAQITNLSAFLAQIDEKTEIATVESAEIVFDSENSIIQAEIYSPIAKPNSGNRNVGNDFNVGKLSESQMLELSELISGHAEIFAFSEEELSQTDLVQHTIETGDAAPIKSQMRPVPYAYREKISVMIQDYLSRGIIQPSNSPWASPIVIVPKKDGTLRFCVDYRKLNSVTVKDAFPLPNIDNTLLALGGRRVFSTLDFMSGYWQIKMDHNSIEKTAFSTEFGLHEFLVLPFGLCNAVATFQRFMTRLFSDCLNKFVFIYIDDILIASESWEQHNKHLKEVFERIQNAGLKLKNQQMSFCVK

SEQ ID NO: 127188 - protein, 607 aa, Heterodera glycines
  Coding regions on vcDNA: vcDNA=SeqID_53611; Strand=+; Position=1-1824
  Homolog annotation: Hit_ID=NP_498959.1; Match level="QueryCoverage =52%, HitCoverage=14%, E-value=4e-39, Identity=30%"; Hit description =zn-finger, CCHC type and RNA-directed DNA polymerase  and Integrase, catalytic domain containing protein
MKIVATSEPFELVCLDILSIGPAHSSCKYILVAVDHFSKYLVATPIPNKNADTIAREFVKNVVLIFGTPKKIHSDRGKEFVNETLNEITKILQMEKTLTSGYDPQANGVTERVNQTILGMLKRSTASNWEWDDRLPFVVFSYNTTPSETTNISPYHLLFGKPANFPSNISLPVNPLYTIDVNGYIQLFRENIAHLVEKAREHSENERQKMKSYYDKQAKVTANKFVVGQRVMVIFPGSNKRSPHHKLMWNHFGPFKITEITDSTAFVIPVDKPNDVPLKVPIERMIRVPDGVPDTSTLPKGKNPYKNQLNTIICFVSLICEEKVDNGKVGGVGKKEKFQEVEQEQLLEKEVEKNAEVFDQFPKLKSKVGGELNFGANVCQLRTIFSSEGVEDMEMDTTEFAITWDLQCGGLGPEHRNCVQLIAADLDPVLERAGFGLKVPGEFRTRKKGNLGLKVVGTPLKALLATFLLKSDAISSSAVGRKLAQSVIGSPVGFELITFIGSREDQIKSGRIPTEEDLETILRKWADCCAVTRAKLTKSGFGRIHVPMPQSIEDLPDGERKPWAELLEKTGFLLEKVKATSVMRKQHFVTSPRIIMGDSNAKQLVER

SEQ ID NO: 127189 - protein, 190 aa, Heterodera glycines
  Coding regions on vcDNA: vcDNA=SeqID_53612; Strand=+; Position=1-573
MDKLGRLVQMCATFPHVTFFWLPPPFVRDRQFEHETLIGKLRDFFGQKTKNIQFVATTTNGRSLLEIWRYGNGYNTDHVSPEGVMKEKGLNMLKAWLLTQVKEFPGDQELGIEKKKPESGEKGKGAGTAADRQHGRTEPPPFRRDGPVFRRSNSRPFVQHPYSRTAVDRHPFRPFRTPNLPNPNRRHFDR

SEQ ID NO: 127190 - protein, 331 aa, Heterodera glycines
  Coding regions on vcDNA: vcDNA=SeqID_53613; Strand=-; Position=1 -432,671-1234
MPYIHQVQGLWNVKYPGEYKIFIFNDYQIRPITKSDVTDYQFPILLYHNNNHFDGIKTLPKFWNKRYYCLSCESAFSNKPQHSMNCTSLCHGCREVGVDYPCEAQQGYFKKCLHCNNYFYNNDCYERHLHKDLCTKFQRCEDCGRLPSSAPIALSMGDWNKSLQGKKCQICGPHRSITFSPFDYTETTVDQKIITQHPLRDFVQWLLFDHNKKFPTVAFAHFGGRYDMTMIIKEVLAQGIHNPDIIKQGNRLYELKINQNEHGPLTILHDSYNLMPIKLSGLIKSFGLHIKDKQHFPHMFNKSSNYDNILSHLPPREQYCPDQMKIPDQQK

SEQ ID NO: 127191 - protein, 168 aa, Heterodera glycines
  Coding regions on vcDNA: vcDNA=SeqID_53614; Strand=+; Position=1-507
  Homolog annotation: Hit_ID=NP_700900.1; Match level="QueryCoverage =84%, HitCoverage=70%, E-value=2e-11, Identity=27%"; Hit description =hypothetical protein PF11_0035 [Plasmodium falciparum 3D7] gb|AAN35624.1| hypothetical protein [Plasmodiu
MAFLGESKTFNWLLCWWWTISAGAKQSEENAKSTTAKRKQRIGRRRKRKWGEKRGKGRRKGAAAEAEEKEKKVAVEHHQKQQQQKQEVQAVQQQQQKQILVGMEMKMDNSKNGETREEVEKEGNSIGEGGETEEKERKRKRKNSAEGREERGENEAEKREEQQQIDTF

SEQ ID NO: 127192 - protein, 90 aa, Heterodera glycines
  Coding regions on vcDNA: vcDNA=SeqID_53615; Strand=+; Position=1-271
MPSSSRAIGALFYDPATDQIVADGTTTAQFEAPAAAANPRQNPLAAHPVLNAIEHLSANQRQTTARTDGREEEGEDEVPGAEFSAQYLAT

SEQ ID NO: 127193 - protein, 77 aa, Heterodera glycines
  Coding regions on vcDNA: vcDNA=SeqID_53616; Strand=-; Position=1 -137,239-335
MLAGLTNLYTDYWISAAMRNNKQKRGRKGRWLWKIADKKERRADDERHSSPLHGFLRFNYPSLRYLAYPAHNICGME

SEQ ID NO: 127194 - protein, 23 aa, Heterodera glycines
  Coding regions on vcDNA: vcDNA=SeqID_53617; Strand=-; Position=1-71
LSTAVRQRSSKIYSMPQILWAGY

SEQ ID NO: 127195 - protein, 77 aa, Heterodera glycines; identical to SEQ ID NO: 127193
  Coding regions on vcDNA: vcDNA=SeqID_53618; Strand=-; Position=1 -137,240-336

SEQ ID NO: 127196 - protein, 77 aa, Heterodera glycines; identical to SEQ ID NO: 127193
  Coding regions on vcDNA: vcDNA=SeqID_53619; Strand=-; Position=1 -137,240-336

SEQ ID NO: 127197 - protein, 77 aa, Heterodera glycines; identical to SEQ ID NO: 127193
  Coding regions on vcDNA: vcDNA=SeqID_53620; Strand=-; Position=1 -137,240-336

SEQ ID NO: 127198 - protein, 209 aa, Heterodera glycines
  Coding regions on vcDNA: vcDNA=SeqID_53621; Strand=-; Position=1 -231,297-695
MFNDATTRNADSSENEEENDDEDEDDFDEDDDDEPSDEKTLRDIPLDKIDIWCFMRLFKDKDEDGQGDRMICISLAQRFTDESHYIMGASDAGQLPMDVPLISINHCLADFIKPEDIEGSRCAQCSNATPPPSAPPTLVKQLMFTQLPDILVIIDHLLIDHRLVIPLFCLFHRSFASSASSMNHLITDTSNSVCPFRSRWTTKMDRATA

SEQ ID NO: 127199 - protein, 57 aa, Heterodera glycines
  Coding regions on vcDNA: vcDNA=SeqID_53622; Strand=-; Position=1-172
ALTTSPRTIPERTARSHGQKPPVSRNSPADPTFRDNSFPEVTNLICRLPLRYIILST

SEQ ID NO: 127200 - protein, 154 aa, Heterodera glycines
  Coding regions on vcDNA: vcDNA=SeqID_53623; Strand=+; Position=1 -158,1211-1517
MPIILNFHFLLFNWIHLFSRGKAAEGKCWSTEQKHRTEIGWKICRGGQKQCFGFAAIGFATKEVPLDGSIGQILNSYGYRSDGSFGCNGITRPCKMPMSLFGSSFSPVAMQSADVEMAYKSSEFSTGDVVGCGIFLDTRLIFLTKNGQRMGGPN

SEQ ID NO: 127201 - protein, 248 aa, Heterodera glycines
  Coding regions on vcDNA: vcDNA=SeqID_53624; Strand=+; Position=1 -151,202-366,413-843
  Homolog annotation: Hit_ID=NP_505882.1; Match level="QueryCoverage =88%, HitCoverage=61%, E-value=1e-11, Identity=28%"; Hit description =putative cytoplasmic protein family member (5L826) [Caenorhabditis elegans] emb|CAB07652.1| Hypothetical
MQKNALGRSDGTEPKYVVVSPEKSSNSAAGGEKEAEGEQAQVPAEQQPLPVAPAAAEAASAENAPTENAAAVPSSGYSGGEPAQAQAVAVQTVEQQQAASESEPTAIGTSNGNNEINDANSSSTDQQSDTADQPKQQQMVEQIQSKQRQRVHASKALTPAPGTWGSMCNSAELRQMMDSQMVPGNANASKRRIYELLNRKQFTEGVGGAQRLLDVICANSMFSYRIATDLFCEHTKANVTCFVYQQQP

SEQ ID NO: 127202 - protein, 189 aa, Heterodera glycines
  Coding regions on vcDNA: vcDNA=SeqID_53625; Strand=-; Position=1 -36,1057-1587
  Homolog annotation: Hit_ID=CAD22154.1; Match level="QueryCoverage =100%, HitCoverage=51%, E-value=1e-76, Identity=68%"; Hit description= pherophorin-dz1 protein [Volvox carteri f. nagariensis]
CRCYNFEFFNGRQPSMFETSPPPPQPPLQPLPTSQPPLQPPPQPLPHPPPQPSPHPPPQPPPLPHPPPQPHPQPPHPPPHPPPLPQPPQPPPSPHPPLHPPPPPHPPPQPHPPPQPPTHPPPPLHPPKPPPPPQPPPPPHPPPQPPPPPPHPPPQPPPPPPPNNPSPLNPPHPPPQPPPPPHPPPQPPP

SEQ ID NO: 127203 - protein, 518 aa, Heterodera glycines
  Coding regions on vcDNA: vcDNA=SeqID_53626; Strand=-; Position=1-1557
  Homolog annotation: Hit_ID=XP_320889.1; Match level="QueryCoverage =97%, HitCoverage=62%, E-value=3e-97, Identity=38%"; Hit description =ENSANGP00000012033 [Anopheles gambiae] ref|XP_313651.1| ENSANGP00000013044 [Anopheles gambiae] ref|XP_314
MQVAKVPEKRQANKNCCRCGAADHWGSECRFIGAKCRKCKFTGHIEKQCENVQQWRLKNKGKRFGNKRIGHLQIGMVNPKNEANSLRTKIRFNQKPIAFALDTGSDVNVIDEDSHVEAGSPPIEKCREIGRAFDGTPIRFIGKGFGTFEFGGILIENEPFYVAKRGSLNLLSRQTMDKFGFLDGIKQRISEHVINSCRATDQIGKHILELRKEFPGVFEDALGHCIKEKAQLKLKEGVAPIYRKARPVPHHSKEVIERELDRLEGLGIIRKVEHLDWAAPILVVKKADGNARLCIDYSTGLNDALIDYQHPLPIPEDIFATLNGGQFFSQIDLKDAYFQVELDEDSKKLCGLSTHKGNFAMERLPFGVKSAPSIFQSIMDKMLAGLNFATAYLDDIIVASRSFTDHIQHLKDVFNRLQSYGFRVKMTKCSFFHEEIKYLGFVIDKNGRRPDASKIKAITEMPAPTNLSTLRSFLGMVNHYQQFVQNMRFVRKPLDDMLKKDAESNWVENCRKAFEKLK

SEQ ID NO: 127204 - protein, 245 aa, Heterodera glycines
  Coding regions on vcDNA: vcDNA=SeqID_53627; Strand=+; Position=1 -288,1399-1850
  Homolog annotation: Hit_ID=NP_498959.1; Match level="QueryCoverage =34%, HitCoverage=3%, E-value=9e-10, Identity=40%"; Hit description =zn-finger, CCHC type and RNA-directed DNA polymerase  and Integrase, catalytic domain containing protein (
AVGDPKRQFVMLTDASKIGLSAILCQSDELGQLRPIYFASRQCNQHESRYCPTELEALAIRFGTKKYAQFITMIPTRVITDHRALVPMFKSKKETGGTDEAMETEQQKGKANIEEDTIYVLGEDEAETPKVISWSTCCTGDQHKDCADLLMADLDAVLDRSGMGLLKIDNPLKALLANFLLKSEAVKSGSAGKKLILQILEAEVSWELATYCSSREDDVKSGAFPSESDVEKTLEVWARALPNRE

SEQ ID NO: 127205 - protein, 167 aa, Heterodera glycines
  Coding regions on vcDNA: vcDNA=SeqID_53628; Strand=-; Position=1-502
MSSGSSGPEEGEIGAELFANEAFEEAEEPAGLVQFFRAESKRGRELIRSGGFEYAFEADSGLQEGANLGIFCPNPKLGIEFWHCINRPPYCPGRVHVSSAWHHDNQGRAYKLGRIVGRDHNHPVKHESVRDAQKILKENAEADNPIPARDAVTQARAQMPADVRAGQ

SEQ ID NO: 127206 - protein, 65 aa, Heterodera glycines
  Coding regions on vcDNA: vcDNA=SeqID_53629; Strand=-; Position=1 -87,210-251,327-393
  Homolog annotation: Hit_ID=NP_493614.1; Match level="QueryCoverage =95%, HitCoverage=4%, E-value=1e-09, Identity=38%"; Hit description =alpha-2-macroglobulin, N-terminal and alpha-2-macroglobulin family member (1P593) [Caenorhabditis elegans]
MPQTVVVENLSEESFLPEEDYSVYVKGETITSKMIFEDSARVQCSQKSVSIFVQTDKAIYKPGTT

SEQ ID NO: 127207 - protein, 123 aa, Heterodera glycines
  Coding regions on vcDNA: vcDNA=SeqID_53630; Strand=+; Position=1 -33,95-256,603-776
  Homolog annotation: Hit_ID=CAE64381.1; Match level="QueryCoverage =100%, HitCoverage=25%, E-value=1e-34, Identity=59%"; Hit description= Hypothetical protein CBG09068 [Caenorhabditis briggsae]
MDMFLYDTQPATLSGLNEEFISGARLDNLVSTYTAIKGLVESLEDTEAFDTDPNVRMVACFDNEEVGSRSAQGAQSHCFEWLLRRVLSSVDHPTAFECSIGRSFMVSADQAHSVHPNYAHKHE

SEQ ID NO: 127208 - protein, 150 aa, Heterodera glycines
  misc_feature (4)..(4): Xaa can be any naturally occurring amino acid
  misc_feature (6)..(6): Xaa can be any naturally occurring amino acid
  Coding regions on vcDNA: vcDNA=SeqID_53631; Strand=-; Position=1 -192,315-407,667-831
  Homolog annotation: Hit_ID=CAE70071.1; Match level="QueryCoverage =92%, HitCoverage=44%, E-value=6e-50, Identity=70%"; Hit description =Hypothetical protein CBG16511 [Caenorhabditis briggsae]
NLNXMXSPPDWQLAHVVPALIHKCFLAKRDGGPLVVAGSGKPLRQFIYSLDLGRLFVWAIREYEDVEPIILSVDPSDEVTITDVVTAIVKAMQFKGEVIFDTTKADGQYKKTSSNAKLRARLPDFKFTPFERAIAESVQWFEANYEKARK

SEQ ID NO: 127209 - protein, 161 aa, Heterodera glycines
  Coding regions on vcDNA: vcDNA=SeqID_53632; Strand=-; Position=1 -87,252-419,570-690,1075-1131,1183-1223
  Homolog annotation: Hit_ID=NP_498540.1; Match level="QueryCoverage =97%, HitCoverage=49%, E-value=4e-62, Identity=73%"; Hit description =tissue specific transplantation antigen p35B like (3I150) [Caenorhabditis elegans] gb|AAA50647.1| Hypothe
AAIRVLVTGGTGLVGSAIQQVLVATGCRDEQWFFVGSSECDLTDLEQTRALFRRVRPTHVVNLAAMVGGLFHNLRHNLQFFVKNLAICQNVLQCCHETDVERCVSCLSTCIFPDKTPYPIDETMAHNGPPHDSNFGYSYAPRMIDVLNVLNRGYAQEHNRK

SEQ ID NO: 127210 - protein, 324 aa, Heterodera glycines
  Coding regions on vcDNA: vcDNA=SeqID_53633; Strand=-; Position=1 -90,252-416,561-681,1068-1124,1180-1219,1851-1912,2060-2211,2475 -2567,2688-2852
  Homolog annotation: Hit_ID=CAE70071.1; Match level="QueryCoverage =99%, HitCoverage=99%, E-value=1e-128, Identity=69%"; Hit description= Hypothetical protein CBG16511 [Caenorhabditis briggsae]
AIRVLVTGGTGLVGSAIRQVLVATGCRDAEQWFFVGSSECDLTDLEQTRALFRRVRPTHVVNLAAMVGGLFHNLRHNLQFFVKNLAICQNVLQCCHETDVERCVSCLSTCIFPDKTPYPIDETMAHNGPPHDSNFGYSYAKRMIDVLNRGYAQEVLNRGYAQEHNRKYTSAVPCNIFGPRDNYNLENAHVVPALIHKCFLAKRDGGPLVVAGSGKPLRQFIYSLDLGRLFVWAIREYEDVTPIIFCVDPADEVTIADLVDAIVKAMQFKGEVIFDTTKADGQYKKTSSNAKLRARLPDFKFTSFERAIAESVQWFEANYEKARK

SEQ ID NO: 127211 - protein, 238 aa, Heterodera glycines
  Coding regions on vcDNA: vcDNA=SeqID_53634; Strand=+; Position=1 -56,558-1216
  Homolog annotation: Hit_ID=CAI01197.1; Match level="QueryCoverage =91%, HitCoverage=87%, E-value=1e-19, Identity=34%"; Hit description =hypothetical protein PB401108.00.0 [Plasmodium berghei]
LDGSQRICQKCQLNLGCDRVLSWPIVLSLVLSWPIVLAGVLSWPIVLAGVLSWPIVLAGVLSWPIVLAGVLSWPIVLSLVLSWPIVLALVLSWPIVLALVLSWQIVLAGVLSWPIVLAGVLSWSIVLAGVLSWPIVLAGVLSWLIVFAGVLSWPIVLAGVLSWPIVLAGVLSWPIVLAGVLSWPIVLAGVLSWPIVLAGVLSWLIVFAGVLSWPIVLAGVLSWPIVLARVLSWPIVLA

SEQ ID NO: 127212 - protein, 109 aa, Heterodera glycines
  Coding regions on vcDNA: vcDNA=SeqID_53635; Strand=-; Position=1-330
  Homolog annotation: Hit_ID=CAE57156.1; Match level="QueryCoverage =97%, HitCoverage=47%, E-value=9e-12, Identity=32%"; Hit description =Hypothetical protein CBG25090 [Caenorhabditis briggsae]
DTCKDNWPTKDTSKDNLPTKDKGKDNWPTKDKGKDNWPTKDKGKDNWPTKDTCKDNWPTKDTCKDNWPTKDTCKDNWPTKDTSKDNWPTKDKGKDNWPTKDPPIDYLIK

SEQ ID NO: 127213 - protein, 24 aa, Heterodera glycines
  Coding regions on vcDNA: vcDNA=SeqID_53636; Strand=-; Position=1-80
RTLSTAVRQRSSKIYSMPQILWAG

SEQ ID NO: 127214 - protein, 24 aa, Heterodera glycines
  Coding regions on vcDNA: vcDNA=SeqID_53637; Strand=-; Position=1-80
RTLSTAVRQRSSKIYSMPQILWAG

SEQ ID NO: 127215 - protein, 188 aa, Heterodera glycines
  Coding regions on vcDNA: vcDNA=SeqID_53638; Strand=-; Position=1 -494,553-624
GQREAELFGLRHIGDGTPLEQKRVEQAANDNNAGDEAQTLANSAETTSEKREAMHDWLNTFLPLLHANKLDTQCANQPQSESTRLFMALKAQDDAREGNDDGTAAAPHELLLAKQRTTVEEESSEFRLRMGCVALILTVLVCPSKVGKYDMPPISKGLEGRIMLLLVLDDFTCKGSAKTVSEKRTMKD

SEQ ID NO: 127216 - protein, 390 aa, Heterodera glycines
  Coding regions on vcDNA: vcDNA=SeqID_53639; Strand=+; Position=1 -446,487-682,738-1268
  Homolog annotation: Hit_ID=NP_507780.1; Match level="QueryCoverage =73%, HitCoverage=20%, E-value=5e-12, Identity=23%"; Hit description =predicted CDS, DNA polymerase type B, organellar and viral family member (5T899) [Caenorhabditis elegans]
MQATMVRTVGAMTRQHFYDYLHGIKTMIGKLQRETTEMMNAVNAPLNLLNYDAEIYVPRIIDWWNDEKFARQWKFKAFIFGSAGHYKPLFKYGADDYDVSILLYFDEGHFNGVQKNGNLFGKPYCLSCEGTYDRPKRHSKSCKARCIKCSQMGPIFPCKPIDGFRQKCSDCNKMFFNQACYQHHLSLNFCKTSKECKHCGVVWDLNNNTKNGREGHKCNERWCENCQIFHEFERGCFIRPLEPNHKKETMGWRLVTFDLETHNTRLSTRIFRKKRKHQVNFMTAKVACPDCISSGRWKESLRGKFCNVCGYHRTVTFSQMPFHETTVDKQNIDRHPLVAFVKWILYKLPKQYDTIAYSHFGGRFDMVLVFRELLLEGFNPSMIKKGNRLF

SEQ ID NO: 127217 - protein, 89 aa, Heterodera glycines
  Coding regions on vcDNA: vcDNA=SeqID_53640; Strand=+; Position=1-269
MNPNVTFRDSWNLIPGPWASMVPIGRVLNVQDKPFFPHLANRPEKLRMRSLPYKADYLADGMNIAKRKEFDKWYPENRNAPFLLDESLA

SEQ ID NO: 127218 - protein, 131 aa, Heterodera glycines
  Coding regions on vcDNA: vcDNA=SeqID_53641; Strand=+; Position=1 -287,779-886
MTKRSAGADGKADRAAYTTPHNGIDPIRHCITIASACMRHFRTNHLKPAHLALVPEKGYDSFGDNQSDLALNFMEWYAEKFDVQIQNAYSANGEKSFTTDYPIGHPTLHVPCEEVDWRRPEDNPYPLAILK

SEQ ID NO: 127219 - protein, 278 aa, Heterodera glycines
  Coding regions on vcDNA: vcDNA=SeqID_53642; Strand=-; Position=1-837
MCLPDHDSAKIYCQCRDIKLEPALADPEKRLPIQLKNLLIRNEKRDIFAEITYAPIQLSIQFEGLRIATEEDLTKCHAMSKGLFGCYSCHNGAYLHLQCHTDFGSALGYVRCSDGTEFTALCHKTPEVLNASLSFNRAEVDINCTIECSGGRNPFVINGHLRYVPKHFQTPNEGSSFASKAKPSNSCLIWCPDWNFDFSDVFWYFFGLQNALRTIGIITLALFIVYVLLRCNPALRSWRAISRIVLLFLALWPTTDSSAAGGLSHLLSIQNSAPKLQF

SEQ ID NO: 127220 - protein, 55 aa, Heterodera glycines
  Coding regions on vcDNA: vcDNA=SeqID_53643; Strand=-; Position=1 -7,269-397,433-464
MREEDENPIEIPDVDIEAFKTMLNFIYTDNLNAVNGNNAIDVLYDVFYDLRQGWS

SEQ ID NO: 127221 - protein, 274 aa, Heterodera glycines
  Coding regions on vcDNA: vcDNA=SeqID_53644; Strand=+; Position=1 -11,399-843,913-1169,1227-1338
MNRRYIDYSVLAFIRANQQIWDKGTKLRLLLPCTSPTTNVEPVWDTFVSQIWPIFATNIRHLTFRNSTYLTKLLHLISPIILTNLTKLDSIGVGSFKPDQIDEDFDGPNATPTAGQVLSEWLHVPTKDGRPKRLFCYFHPSGNTQWINSFKELFLRATSSVCYKIFIRTKATFEPFELVNERTNEKLTMPKPKEEKLAKQWIMKRCAIGETAAVQWEDNTDNLNDVTFCLQKVEVCIGPVSPPPTEEAGQSVEKEGQSSEKEGQSSEKGTSSDK

SEQ ID NO: 127222 - protein, 113 aa, Heterodera glycines
  Coding regions on vcDNA: vcDNA=SeqID_53645; Strand=-; Position=1 -192,294-443
MSTLCFAMPNDALGEQQGWHGIRPPKKLWTSKFRFLKKFGSRNSNSQKGVNLKLLMRQTDLGLKAFVSTSGKTAKMVSNYVRVTTRLLKNRQLRTFTFYLYNYKKYFPKGQWK

SEQ ID NO: 127223 - protein, 196 aa, Heterodera glycines
  Coding regions on vcDNA: vcDNA=SeqID_53646; Strand=-; Position=1 -125,1757-2222
MASPVEKRNEFSGAVISSSISENQQQSLGSFVKTSFGTRRHWNPDHSVLAFLRANQQIFEKATNLCLSVSSCFHDCLSLFVDNNVQPIWDVFACEIWPIFAPNIRRFNFRDGDHLDNLRRRISPTILTDLNQLNSINSGDLLPDGIADDGPNATAGQALAKWLHTPRNDGQPKRLRCGGGYMSKTEFVNIFKEVWP

SEQ ID NO: 127224 - protein, 93 aa, Heterodera glycines
  Coding regions on vcDNA: vcDNA=SeqID_53647; Strand=+; Position=1 -137,831-974
  Homolog annotation: Hit_ID=CAE61817.1; Match level="QueryCoverage =53%, HitCoverage=3%, E-value=1e-10, Identity=67%"; Hit description =Hypothetical protein CBG05787 [Caenorhabditis briggsae]
VTMDTIIDAICASKLPVSRILCDQIRSVGKSMLLVGPVESSKSRTKFNNSLVIAEVLGIEAARGSIISEILAIMGKHGIELDRQHVLADLMIY

SEQ ID NO: 127225 - protein, 137 aa, Heterodera glycines
  Coding regions on vcDNA: vcDNA=SeqID_53648; Strand=+; Position=1 -162,639-890
MTSRLLELVQARKDNLFPGSRHAEAGRIQKEAWSTVTETLNSEFPIDVPAGGLKARYDSPAFGRGTPISRGSSRPPSSRPSSSDIAELQLKVLQGDLERIELQKQLCEDAKQFLKEGRDFFAKGAKFYDEKKGEGEG

SEQ ID NO: 127226 - protein, 71 aa, Heterodera glycines
  Coding regions on vcDNA: vcDNA=SeqID_53649; Strand=-; Position=1 -75,151-291
MVHYPKDVFKEVSDLCSKNREDRAAKLVSFASVGAANFEPDHVEHLIKEGHRCASGCPMRNAPISSARRST

SEQ ID NO: 127227 - protein, 33 aa, Heterodera glycines
  Coding regions on vcDNA: vcDNA=SeqID_53650; Strand=+; Position=1-101
MCQCSDCGAEKQLGHLEKECIPYKKSLEHLFAP

SEQ ID NO: 127228 - protein, 160 aa, Heterodera glycines
  Coding regions on vcDNA: vcDNA=SeqID_53651; Strand=+; Position=1 -138,214-330,611-835
  Homolog annotation: Hit_ID=CAE62006.1; Match level="QueryCoverage =99%, HitCoverage=20%, E-value=4e-71, Identity=79%"; Hit description =Hypothetical protein CBG06014 [Caenorhabditis briggsae]
MVERTVWEWQKVNTMKPIWMRKPAEVEEDEYKEFYKSITKDFDEPLAHVHFIAEGEVSFKSLLYVPKTLATDAFQNYGKTEDNIKLYVRRVFITDDFQDMLPKYLAFIRGLVDSDDLPLNVSREMLQQHKLLKVIKKKLVRKVLDMLKKISPEKFDEFWK

SEQ ID NO: 127229 - protein, 690 aa, Heterodera glycines
  Coding regions on vcDNA: vcDNA=SeqID_53652; Strand=-; Position=1 -239,287-540,594-877,924-1135,1180-1615,1660-1917,1970-2359
  Homolog annotation: Hit_ID=NP_920291.1; Match level="QueryCoverage =88%, HitCoverage=39%, E-value=4e-71, Identity=32%"; Hit description =putative helicase [Oryza sativa (japonica cultivar-group)] gb|AAP52578.1| putative helicase [Oryza sativa
MQEACAEMSNLKRLQHYFAMLLAHAHPSNPQALFDEFLDEMNPPTAANHPGAVPKSAEVRAAEVMLNLEYYLNCMATNTKDVGLKGLPVGYDFQHQAQLLEEDNILDSFYGDDAGQRRKPPQQVAVEQIGRLNTDQRAAFDAISTSILGGCDQKLFFLEGAGGCGKTYFYNTLIKWCIAGKPPFDGNANAQWVRNQVLQRDTVVAAASTGIAALLLIGGGTAHRHFYVPNDVSQETPPMLNFESAKAEQLRHAQLIIIDEISMLSNTVLDYIDRLLRDVCANATPFGNKVVVLSGDWRQLTPVVEHGTREDQVGTSIKMGALFRLFKKISLTINMRTAQGEQSLRDWLQEIGNGIHRVGTDTQGFTNQLRIPPELLVDDLDHTIHFCFPEAMFDDPLANADAIAHNAILCPTNNDVQHINEVALGRMSGCGREFLSIDEPLEPNDEMHNFRTDFNMEAVHNEMPSGMPPHKLTIKVGTPVMLIRNLDVTQGLCNGTRLQVMRTSENNLFCRILTGPRAGAQNIIAIPQIQFEYGRARHHRGLRFRRLQFPVRLCFAMTINKAQGQTLQRMALVLNGRQCFSHGQVYVAMSRVTQMDGIRVYAPFCQSGYGTHIENVVYHELLDLETQQSRTPNRGLMDVDNDPDAAIPDVGPRVPDVANDPDVERDNGHAAGAHDQEPNDLDSSFDDFFD

SEQ ID NO: 127230 - protein, 269 aa, Heterodera glycines
  Coding regions on vcDNA: vcDNA=SeqID_53653; Strand=+; Position=1-808
MTNPTLNDNQRKERTCEEFLDRIKPNIGFLLRLVGLNSTKDLDRIKAQAEELEALLLTEKGQISDNLAHTVHALSGQRFGNRQTEQNRESNYRGPPFVSEANATPLNDRFAPRNFDNNNRNNNGNNNNRTQFRRNQRPNDRRPNFCRNRRSQFINNRPDPQPNRGRNGRNANYGTVNSVDAIPSNVSVLDSDQLIRAIANLGIMNQQPPLGNSVKREDANALNAITTVKSKPKIETKGIMNDSKNCEIPVIDSKNIKPPSPQLKASSWE

SEQ ID NO: 127231 - protein, 43 aa, Heterodera glycines
  misc_feature (2)..(2): Xaa can be any naturally occurring amino acid
  Coding regions on vcDNA: vcDNA=SeqID_53654; Strand=-; Position=1-137
RXFGEDSVIAFDEWAEWFTDYVGAVGRNWNEDEKVARFKMSLI

SEQ ID NO: 127232 - protein, 227 aa, Heterodera glycines
  Coding regions on vcDNA: vcDNA=SeqID_53655; Strand=+; Position=1-681
MLIAFMRNGQQMQISEYSKQKYEIHLGFIYYMRMNWKCDKIVGEFEEFERTECQKYRKYLDILYEYLFREYLGIPTVKPIFVFKDKIEINGPIIYAVNCLARISQFYFIKWEGRLYEYKLNELFNYQFEPKLLNNEKRLNYDEQKLSINEMILELAIDTANDWQTNESLDEIIKQNCGDKFEVNLEEMLKKADEWEEENEEGWSANEINYGKHRIIVGSKFDDKWKW

SEQ ID NO: 127233 - protein, 134 aa, Heterodera glycines
  Coding regions on vcDNA: vcDNA=SeqID_53656; Strand=-; Position=1 -141,680-906,1449-1485
  Homolog annotation: Hit_ID=CAE70653.1; Match level="QueryCoverage =82%, HitCoverage=15%, E-value=3e-29, Identity=55%"; Hit description =Hypothetical protein CBG17359 [Caenorhabditis briggsae]
LLANICSGILNIIGGCSWWQIWVYLLVSLQQIPHAMFNLSVVYMMYQPDHWCKVPGLNSGAANASGAPYQWDVTDTLAGSVVYPRTRNKQRDMLNFHSQCHYYDRGGWHDGGEPFNQPPPSPRKGETHIWRERE

SEQ ID NO: 127234 - protein, 40 aa, Heterodera glycines
  Coding regions on vcDNA: vcDNA=SeqID_53657; Strand=+; Position=1-125
YSYYKHGQWKIGMMKGHSKMWRERREEILRWDPNADLWKY

SEQ ID NO: 127235 - protein, 28 aa, Heterodera glycines
  Coding regions on vcDNA: vcDNA=SeqID_53658; Strand=+; Position=1-85
GERAIELNRHNAFWRRIFLLVSAEALVN

SEQ ID NO: 127236 - protein, 47 aa, Heterodera glycines
  Coding regions on vcDNA: vcDNA=SeqID_53659; Strand=+; Position=1 -81,182-244
MATHWVEAKAATPLSPLFLCFLSSTMLGDGFVIVIFPAVIALCIFVY

SEQ ID NO: 127237 - protein, 95 aa, Heterodera glycines
  Coding regions on vcDNA: vcDNA=SeqID_53660; Strand=-; Position=1-306
VEERADEKKSSDWSANRSTKGQQVNAVLNCSGGGGEINLRIFIPFKKILTVPFLSSSCLIVSGYERKIFWRRFGSFPRQLLIFFKKNNSISLKNK

SEQ ID NO: 127238 - protein, 135 aa, Heterodera glycines
  Coding regions on vcDNA: vcDNA=SeqID_53661; Strand=-; Position=1-408
MQILDLCDVEALPITQYRMGKLGTRPRPMKLVLPTRAHVRKCLLMARKKDSALRTQMPNVFLRESLTGEELKKRSDAIKLCSLLNKNPRFSVRGTFVVYATFHVLLKTQIPIFRNDNSFDGLSALNIDLNDPALS

SEQ ID NO: 127239 - protein, 674 aa, Heterodera glycines
  Coding regions on vcDNA: vcDNA=SeqID_53662; Strand=-; Position=1-2025
  Homolog annotation: Hit_ID=NP_510849.1; Match level="QueryCoverage =91%, HitCoverage=44%, E-value=1e-136, Identity=41%"; Hit description= predicted CDS, zn-finger, CCHC type and RNA-directed DNA polymerase and Integrase, catalytic domain cont
MPAPIDKSTLRSFLGALNYYGRFVKCMRELRAPLDRLLQKDVAWNWTSEQQNAFEKAKEMMTSDLLLTHYDPARPIVVSADASKDGIGATLSHTFPDKKEKAVEHAACTLTAAQQNYSQIEKEALAIVFAVQKFHRMVYGRKFILQTDHKPLLAIFGSKKGIPIYAASRLQRWSMVLANYDFEIRYVNTTSFGQADVLSRLIANYSRPEEDILIANICADTDCYINSVFENRMDQLPVTTVEITAEMANDQPLQTVLQFLRNGWPAKVADSEISPYFPKRDKIFEVDNCLLYEDRVIIPTSLRSRILKALHIAHPGIVRMKALARCHVYWPGMDSAIEKVVSTCEECQLGQKNPTKAPLSPWPTTDKVFQRVHIDFAGPCSDGHQYLILIDSFSKWPEVYRMNTISAYATVFVLRSIIFRLGIPEEIVSDNGTQFRSAEFATFCKEFGIKHTFTPPFHPQSNGQVERFVDTFKRSMKKMSKSEKDWIEKMLFSYRTTPHVALNGFSPDQLFFGRKLRTKLSLVHPKGEKAENFDQNSFKKGQTKYTDKMARNFDRKHGTKVINFSPNDHVLLINYRNNKTEWLQGKVVERLHKSPTYRVYVPVLRRLVHRHANQLRRRHLLEDEAEEEAPQVEQPPPVVEPPRQPQQIQPANYPLKVRRSSRIKKPTQFYSPSR

SEQ ID NO: 127240 - protein, 132 aa, Heterodera glycines
  Coding regions on vcDNA: vcDNA=SeqID_53663; Strand=+; Position=1-397
  Homolog annotation: Hit_ID=XP_308192.1; Match level="QueryCoverage =95%, HitCoverage=31%, E-value=2e-38, Identity=59%"; Hit description =ENSANGP00000021557 [Anopheles gambiae]
QLDKCKFLQPELLFLGHIVSANGIRPDPSRSDAIRKMPAPIDKSTLRSFLGALNYYGRFVKCMRELRAPLDRLLQKDVAWNWTSEQQNAFEKAKEMMTSDLLLTHYDPARPIVVSADASKDGIGATLSHTFP

SEQ ID NO: 127241 - protein, 253 aa, Heterodera glycines
  Coding regions on vcDNA: vcDNA=SeqID_53664; Strand=+; Position=1-762
MAKVANRKRNERRIRAVQDLARHLNHRMNRHRRWQRDGKRDPSEERHIRMTAERYADQLSRLGDDHIHRLQHQFPQLPNPRRRRSEVGGNLKGGKSQPKLASMVVRLPQGELLPSKDVGGAAPGASDSHGRNENEEEGREKAEKERGSRPRVLPPPGDSFGELLEKEAKARAEVAELEARAKKAKMEREEEEQKLKSAKEARLRDLETQADDLRQMLGDASWPWSRGKDGKNGGGGGSPRWESGGHASSADGG

SEQ ID NO: 127242 - protein, 154 aa, Heterodera glycines
  Coding regions on vcDNA: vcDNA=SeqID_53665; Strand=+; Position=1 -144,842-1162
MTTSDNDSYESCITIAEDPTELAAHDNDKIKQTKHSAENEENKCLAKLENVLSNATATDESVSSSSFTNSISAASINSRTALGVKNNNNGINTTNSTSSALSSSSAAGGAATASVRHHQQRNRVLSFHLNGTVVHRRRPNSASKNPIHVIKIFI

SEQ ID NO: 127243 - protein, 45 aa, Heterodera glycines
  Coding regions on vcDNA: vcDNA=SeqID_53666; Strand=+; Position=1 -61,245-321
MITTDDDDKNNNNNDLVDTTHFFLTNLLAIVNCRVERDRDLNTDN

SEQ ID NO: 127244 - protein, 242 aa, Heterodera glycines
  Coding regions on vcDNA: vcDNA=SeqID_53667; Strand=-; Position=1 -249,475-704,787-928,1481-1588
MNLLPHFLIFGCLSIFASAFLPQKGINRNDKSTAWHAFHADVRDEVAIANASRIFKPIENEEEAEEILGRDRGIRCGQTATNRVEYGQQSPNEEWPWVASVQLECVTKRTNQIELLQLCTGVLIGEKHLVTAAHCLYLPAETFMKCKDNQIQGEFDEGTSFLVTNKYVKVTLGGGDFRNSSKLGIKRFFKLQTFRQHELNDDISILEDDSGAPLMRQLADGRWALIGIVKGHREECQSKCKE

SEQ ID NO: 127245 - protein, 254 aa, Heterodera glycines
  Coding regions on vcDNA: vcDNA=SeqID_53668; Strand=+; Position=1 -252,753-961,1206-1341,1564-1733
  Homolog annotation: Hit_ID=AAH76748.1; Match level="QueryCoverage =88%, HitCoverage=41%, E-value=3e-39, Identity=40%"; Hit description =LOC445827 protein [Xenopus laevis]
RHPDWDNRTLLEWFSEKRWTDEDNFPPFSEKHLQIIDQAVAEMKLLIRYAQLFGSDPSRIVFQPSLARGLDYYTGIIFEVVMKDSAGSLAVGSVAAGGRYDKLVGMFTDMGRNKDDGGVATAPKKRPEVPCVGISFGIERLFTIMELKARADSNAVKVSPTQVYVASVSVAKEETDKMLEQRMRLCAQLWNAEIRAETGYKANVKFLQQIKFCETQQIRWMLILGPEEIAKNSVKLRYIPAKDKGEEVRLGIGK

SEQ ID NO: 127246 - protein, 61 aa, Heterodera glycines
  Coding regions on vcDNA: vcDNA=SeqID_53669; Strand=-; Position=1 -61,649-773
MGFIDKTNGNTFVFYVSNFCSLKCRNSESIDGQSFADESIVEYCSNSTESKHFPDSCGAVV

SEQ ID NO: 127247 - protein, 402 aa, Heterodera glycines
  Coding regions on vcDNA: vcDNA=SeqID_53670; Strand=-; Position=1-1209
  Homolog annotation: Hit_ID=AAM51140.1; Match level="QueryCoverage =71%, HitCoverage=26%, E-value=8e-35, Identity=30%"; Hit description =SD27140p [Drosophila melanogaster]
MTVKSSDGKGKHKVWGAIFVCALTRMIHLELVTDMTAKRFLLAFTRFVRRWKIPQRIVSDNGTNFVLGNKALTEIVQQSIKEKEHWLKVLKDEEVQNFSNQQKIEWVFISPFAPWRGGQYERMIGTVKYHLKREIRNKLLSFEELWTLFSEVERIVNERPITYTSQSEVIQPLRPIDLILPNIGNNRLEINTRSVENSDNDYILENSNTANVVQRYQKAMNMAEKFWQNWKDSYLLGLRERHQGNKHTPGKAPKLGDVVIISEPQTPRNCWKLGKIEEILSQRTARVRISEKSIIERAIKHLYPLELAENANNSDSGIKQQEHSFVKQIHYNWAKGLPQNKALVKANSPNHYKWAKQPPKIINDITNVTCISEMNRDFDAVSLDCEEMGRDLEDETRKKNRG

SEQ ID NO: 127248 - protein, 54 aa, Heterodera glycines
  Coding regions on vcDNA: vcDNA=SeqID_53671; Strand=-; Position=1 -95,224-291
QDLKKHIAPKIDRLFLVSSLDKNCSGVIVFAKSQVKQLEIKAQLQNDALLYRYR

SEQ ID NO: 127249 - protein, 69 aa, Heterodera glycines
  Coding regions on vcDNA: vcDNA=SeqID_53672; Strand=-; Position=1-209
MGNEQSQSREERPRKLPKQNNGEPNENIVRINRTEMPEEFQAVLLSDNVVQQVMKSGQNTTNDLRTREL

SEQ ID NO: 127250 - protein, 175 aa, Heterodera glycines
  Coding regions on vcDNA: vcDNA=SeqID_53673; Strand=-; Position=1 -233,396-562,952-1079
MRRKNMLIHIIYNPNNDETPINSVEINISKNFAATIENCNKFDEEFHLSDDIMTKNLMIDWVHNVLVPVLRPGEQSLLIWKQFTRKITEFVMIYDVKINLHDRDNIIKLQSLIHNQFQAERFNGWINFAWRKAGLSQEFFVALYFSHKNAICLGNIKIIIEIIIMVTKLINRLKI

SEQ ID NO: 127251 - protein, 122 aa, Heterodera glycines
  Coding regions on vcDNA: vcDNA=SeqID_53674; Strand=-; Position=1 -220,447-595
MALCNGEPPSKRSSRTVSSPIEDPAPHLQLLYPAMAPTPPIVNTSAATPFVNNQYNDSNDNYNTIPMDEDDDDDIQVLEVLPRRPPPPIMPMPSTPPLPVTQPGMMNGSFTLPPYHKALEHN

SEQ ID NO: 127252 - protein, 243 aa, Heterodera glycines
  misc_feature (233)..(233): Xaa can be any naturally occurring amino acid
  Coding regions on vcDNA: vcDNA=SeqID_53675; Strand=-; Position=1 -176,244-357,540-726,821-986,3112-3160
  Homolog annotation: Hit_ID=NP_932138.1; Match level="QueryCoverage =92%, HitCoverage=23%, E-value=7e-42, Identity=39%"; Hit description =D10Ertd802e protein [Mus musculus] gb|AAH42443.1| D10Ertd802e protein [Mus musculus]
VPKSIPICLISPHLSPQIGLLLMQRVILLLEKMAPDAVKQHLLPLIYNSLTGDNVRVQELTLIEVPNIVKFELTLIEVPNIVKFVDREQMRTQLIPKLIRLMLESKDLSIRVQTMVCLAKLLPHMEPWMVTDQLLPALPKITSKDPSVLMAVLGIYKIVHENTKFGINKEQCARSVLPYLISTAVEPTLNLQQFGQYMELVHQLIRRVETEQRHCLEQLSASQEEQRSLTLYXVRGSSAPFCV

SEQ ID NO: 127253 - protein, 106 aa, Heterodera glycines
  Coding regions on vcDNA: vcDNA=SeqID_53676; Strand=+; Position=1-318
  Homolog annotation: Hit_ID=XP_320121.1; Match level="QueryCoverage =86%, HitCoverage=51%, E-value=5e-09, Identity=32%"; Hit description =ENSANGP00000018066 [Anopheles gambiae]
MDPQQLQQLLNALQQMVTNAAPQNAAPANLSNANLASSIDARLSAFHYNPEVGTTFESWFKRFGKLIEDDGSTLPEASKVRLLLGKLGEEEYSKYRDTISPTQPDQ

SEQ ID NO: 127254 - protein, 50 aa, Heterodera glycines
  Coding regions on vcDNA: vcDNA=SeqID_53677; Strand=-; Position=1-150
ECVESAIRNFNHFCFSPFCPIPGLLAVHHPIHPKFPFLFQLPIFMTFPQS

SEQ ID NO: 127255 - protein, 1089 aa, Heterodera glycines
  Coding regions on vcDNA: vcDNA=SeqID_53678; Strand=+; Position=1-3269
  Homolog annotation: Hit_ID=CAE56862.1; Match level="QueryCoverage =36%, HitCoverage=77%, E-value=5e-23, Identity=25%"; Hit description =Hypothetical protein CBG24692 [Caenorhabditis briggsae]
MTTNLPQGKEAQNSGSDFDPIYFSPEENQKWANLLVRMRAFEQAVCRQFRQIETQFVQISSQIQISNTVDRVRELESSLRELENTMEMDTFQTQEKMIDVEQEVGKVNMRMDYQERLTKVRFGKIIEKMKAEVSKVLESLDTLQARVQILEYEQDEEIGRTMWMEDGHSEEHAQLPTNQEENGENNQVQEECEIMISDPFLGGISPLEGYDGNPSVSFSRWVARFEDMLTLYPQYTETQKLSRLRILLKGQARAEFEAMEPPPTSLSVALGHLKSKFENENTRSIARQAMASCRQAPGERVYEFANRLSEAVRTALAGEKEEIIRKRLFEEFLEKLTPELQFEVKSGRPSSYSNAYELAQHFELLLATKRANHVSVADSVAELSHKVEALTIHQQPIPNRRGSERRACYYCKRPGHIVKDCRDKRRDEERRYRGDQRDGHKYFGGERRWSRERNFRDNRNFAPRGRGQRDGRIHRTPTPYGEENGQNFESARRHSPGRRVSFGGRVGAARIASPLFLALIMVISLFGRNSATSQMASPMICHPDSPASLWSIPVDPICPTWSPTEIPVTMKLSVYRLNTIQYKTAATACKCIKTKISRRIGFFGGRYEEVATSPIEMPTATCRKMRENGESPAGQLVQINGIFRATQNSLEVGWRNWPAAMFWRSTEVSNCYAYETVVFTRHGMEGLNTPTNDCPTCAYQSGSCRCPQISLIWKPDLTQRCAYVKIAEWQGEYSSRIWTAESGDFALTFVNISEKTDTNGNDFVISDQTFAVPKVEFVEMLRKSEQANTKLRKKRSHAFINGVRREYVINETDTTVKWLEPDQETKELEKVGLVYSSQLAAQLTALSVKVTANTQKLFAETVHKICTSLRFLADQTLTLAEANPTLLARFFLANPYLTARLVTKDMLEIRPCFAVNERELHFHWQNGRCFERLPVTFRLFGSYEKTKHGFLDPKTLIIHSNARENSCKDFRYLYVQTKGTHSQYDQITGDVKEISSESIHYLSRQGKIDFPEMPIQFFRNKVIANLSVLYSPDNFAETIEVAKIAQEIVRLNRPNAWEFISEKSDHMATNIVSNGLFSFLRGGLISANQ

SEQ ID NO: 127256 - protein, 48 aa, Heterodera glycines
  Coding regions on vcDNA: vcDNA=SeqID_53679; Strand=-; Position=1-145
VESAIRNFKPFLFFAFLSHPRPSGRPSSYSSKISFLFQLPIFMTFPQS

SEQ ID NO: 127257 - protein, 363 aa, Heterodera glycines
  Coding regions on vcDNA: vcDNA=SeqID_53680; Strand=+; Position=1-1099
  Homolog annotation: Hit_ID=AAM11674.1; Match level="QueryCoverage =92%, HitCoverage=40%, E-value=1e-65, Identity=39%"; Hit description =pol protein [Drosophila melanogaster]
YVYKTHEDVFSTHDYDSGMLNKCPPILTNSVPERVKPYPVPEKYEKELKLHMKMLEAGVIKESCTPWAHNVVLVKKSNGQLRPCVDFRPLNKITIPDPYPIPRMDKTILRVAGQKYYSTLDLSSGFWQIPLDSESSYKCGIVTPWGLYQMLKLPFGLRNAPSVFQRTMDKILEGISNVTVYIDDILVHTNSIEEHLKTLELVFARLRKNGLKLKMSKCMFLKNKCTYLGHILTEKGYRPSLNNQEVIEAFPEPRNAKEVKRFLGMMSFFRKFIPSFASVASPIQRVRGKSPEFRWEEPQRKAFLELKGKLLNAPCLRAPNYGLPFYLFTDASAVAYAGALMQTQNGEDLHAVGYWSRTLSTTE

SEQ ID NO: 127258 - protein, 135 aa, Heterodera glycines
  Coding regions on vcDNA: vcDNA=SeqID_53681; Strand=+; Position=1 -91,268-414,775-921
  Homolog annotation: Hit_ID=NP_496407.1; Match level="QueryCoverage =99%, HitCoverage=10%, E-value=4e-30, Identity=43%"; Hit description =haem peroxidase family member (2L532) [Caenorhabditis elegans] emb|CAA88973.1| Hypothetical protein T06D8
PSVPLPCCAHGFAHDDCDPIDVSNTDPNYGFRISCVPFARSLAAPHENCALGPREQANLVSSFLDASQIYGNWRKKNKMPQGDHYCQSENGRRKCFLSGSADVNLLPGIALLHTVWNRQHNTVTEKLTFVTYKWT

SEQ ID NO: 127259 - protein, 72 aa, Heterodera glycines
  Coding regions on vcDNA: vcDNA=SeqID_53682; Strand=-; Position=1 -69,603-743,823-831
MDVHVQKAAEKIAALTLDLAYLENVQMIIDRIKPYFIYILDPHGCCAEADWKTFTKYCKSEVSKPIDGIKDL

SEQ ID NO: 127260 - protein, 22 aa, Heterodera glycines
  Coding regions on vcDNA: vcDNA=SeqID_53683; Strand=+; Position=1 -54,148-162
MNNLNDFQVECSGTVAGTFIEI

SEQ ID NO: 127261 - protein, 30 aa, Heterodera glycines
  Coding regions on vcDNA: vcDNA=SeqID_53684; Strand=+; Position=1 -3,176-262
MVLDKPQKLHQQPEREHRPRQCHRLRMLSP

SEQ ID NO: 127262 - protein, 84 aa, Heterodera glycines
  Coding regions on vcDNA: vcDNA=SeqID_53685; Strand=-; Position=1 -251,667-670
MTDKNDDNRKKGSSSHGAGGDDDGQRKENKLKEYNKAAAKCNKLTTREECEKLKKNDINLCYWNPNVQYPDRRIGQCEPSQYTK

SEQ ID NO: 127263 - protein, 87 aa, Heterodera glycines
  Coding regions on vcDNA: vcDNA=SeqID_53686; Strand=+; Position=1 -60,200-403
MFKLAQKLPLLIIEKNYFMEKKEHTSIYKNLIFVYFYLTIFRVKRLMVNMATMGRMVVAFLTTNSRQMTMNYVLIDRVKKRVMVMVK

SEQ ID NO: 127264 - protein, 91 aa, Heterodera glycines
  Coding regions on vcDNA: vcDNA=SeqID_53687; Strand=-; Position=1 -24,159-410
MAESTADLILAFNRCLDFFSPRFSNFLFAGHRTLLWNLACSLYAFYWAFFLRPAVYSSVYFGSFYNPFAGYRTDEKHRSSSIDRDREKKSF

SEQ ID NO: 127265 - protein, 44 aa, Heterodera glycines
  Coding regions on vcDNA: vcDNA=SeqID_53688; Strand=+; Position=1-135
EHKESIDNNKMVGQEQQDEQRLTNGPTEPEKEITDLKATGWLNN

SEQ ID NO: 127266 - protein, 89 aa, Heterodera glycines
  Coding regions on vcDNA: vcDNA=SeqID_53689; Strand=+; Position=1 -41,647-739,1087-1222
MAGEWLTATCNTNIVIIPSKVPQLCSALAQTIGKIVFPMIPILSSFNIPVDSQARMNPEALEECIIKCKDEVLNFFVNYSKKDFQVFPY

SEQ ID NO: 127267 - protein, 777 aa, Heterodera glycines
  Coding regions on vcDNA: vcDNA=SeqID_53690; Strand=+; Position=1-2334
  Homolog annotation: Hit_ID=NP_491240.1; Match level="QueryCoverage =88%, HitCoverage=52%, E-value=1e-149, Identity=39%"; Hit description= zn-finger, CCHC type and RNA-directed DNA polymerase  and Integrase, catalytic domain containing protein
MDQLASGIPGVVGYMDDFIIASSTVNEHFSTIFKFFKRIQEFGFRIHMDKCKFLVKEIKFLGQIVSSDGIRPDQNRTRALQEMPAPTDITTLRSFLGAINYYGKYIKNIHQIRAPLDELLKQGVEWQWNEKHREAFEQAKSILLSDLALTHYDPNLPIIVTADASNKGIGATISHRFPDGKEKVFQHAARTLSKTEQNYSQIEKEGLGLIFAIQKFHQYIFGRKFILRTDHRPLLGIFGSKNGIPIFSASRLQRWALILLNYDFSLEFVRTDNTGQADVLSRLISEQRNSAASEDMVIAQLCAETESEVEHLLNVQLEQLPVTVDEIQTAQQDDELIREVIKFTQNKWPNHGINPEIKPFFSGRQKLSIVSGCLVFNGRSVIPPSLRHRVLKALHLAHPGIVRMKNLARTLVYWPSIDSDIEEIVRKCRQCQEAAKQPQKQPLQPWPTTTQVFQRVHIDLAGPCSDGNTYLVIVDSFSRWPEVFMLRHTSSQHVIEQLQWLFDRFGIPKTLVSDNGPQFSSSHFKDFCDSNGICHLFSPPYHAQSNGAAEKFVDFFKRQLKKCSGDKNWLKQSLLSYRSIPIAVLNNRSPAELFLGRPLRTKLSLMKPERPNPFFRGPYQQRMAQQFDKKHGAKRVEFNIGDKVQFVNYRDGKTLWLFGEVVTKKGLIFGIRSPQIANRIVTRHANAIRLTQALGTDQTWPNFDEEPKKNKSPVRAPQIQRNVTPTPPAERNHDQFEQNEEEQNQQQTPVLRRSERVTKRVRFLSPRMTGQRHNIRQ

SEQ ID NO: 127268 - protein, 20 aa, Heterodera glycines
  Coding regions on vcDNA: vcDNA=SeqID_53691; Strand=+; Position=1 -39,159-182
MTNSKLIHLNNGKVLSSNAT

SEQ ID NO: 127269 - protein, 20 aa, Heterodera glycines
  Coding regions on vcDNA: vcDNA=SeqID_53692; Strand=+; Position=1 -39,159-182
MTNSKLIHLNNGKVLSSNAT

SEQ ID NO: 127270 - protein, 319 aa, Heterodera glycines
  Coding regions on vcDNA: vcDNA=SeqID_53693; Strand=-; Position=1 -233,282-438,682-738,783-1295
  Homolog annotation: Hit_ID=XP_395616.1; Match level="QueryCoverage =53%, HitCoverage=49%, E-value=5e-20, Identity=34%"; Hit description =similar to ENSANGP00000021998 [Apis mellifera]
MQKGDKDWQPSLGSILELQFLSTNNGGLGVPIEGITSPYFYLRKAGSYFTAHTENSDLYSVNLLCPSSGTDNVGITIWYSIPAADFLKFKNLLSTFFVKEFTNDPEYLRNKSILVNPNIIRENRIRCIRTRAGEGIITLPGSVHFGFSTGLNCAVAYNFGPPSWIPYGIDSKPCSGVYTYAFIEAFELAKLYVLKCEDGDTARAAELWNTKYKNILNYGHGFDPIYPNCRPTITESNDIIPRKYVLLSGIWFRSEGLIEKETGIRRGIRYRCINYNCRASSTYDLSTLLFTNTNPAHQPVEHNFEPNRSLINLPYYVLF

SEQ ID NO: 127271 - protein, 118 aa, Heterodera glycines
  Coding regions on vcDNA: vcDNA=SeqID_53694; Strand=-; Position=1 -203,303-456
MCDYDSIVGAKTITPSSDDLGSNIDYFFDNIISLNVWSRLIGVIRFRIPESFQLPICRITNRNRVLVRQCQLKKRASGFYHQNVLSEEYKTIADYKQNTQWPCLETDQYEKCGLFVNL

SEQ ID NO: 127272 - protein, 362 aa, Heterodera glycines
  Coding regions on vcDNA: vcDNA=SeqID_53695; Strand=+; Position=1 -46,101-235,284-405,536-712,972-1110,1923-2234,2516-2658,2796-2810
  Homolog annotation: Hit_ID=CAE62132.1; Match level="QueryCoverage =58%, HitCoverage=32%, E-value=6e-10, Identity=25%"; Hit description =Hypothetical protein CBG06176 [Caenorhabditis briggsae]
MFRYNVQNSKNSIGKGHATKKNLILVPDIEIGAFKTMLRFIYTKSFDGLDANNLLEVLKAADKYNISGLVKECANFCAKVSIKKLPNVFVAFEQALLLNMELFYFYRVVRDRDLILKERTTEYLRPGFDRDREKSRVFPCFASQKFPVFQPEKYWSRFSMALRWSDEQCRQKGIECSAENRGKILDPVLSNIRFPLIPKEDFTKSVVPTGVLTIEEVISVYQHYSHPKFDVPGLIKLKFPTHQRYKNGEKIEMEIEKVSEFAVEEVGSERFSDAMDIGGFPWKIMAQIETKYKSNEKWLGFYLSNDGPKKENWSCKSSATLRIVSQKNGTEDLIGTFIDRIFNKECSSHGFYYFISFAILKN

SEQ ID NO: 127273 - protein, 67 aa, Heterodera glycines
  Coding regions on vcDNA: vcDNA=SeqID_53696; Strand=+; Position=1-203
MNPPTFAPFRLLRQHFDRLAVILLNSPPAAVVPCGDFAFPADWAKIWNSANIRLCTDGAANHLMKLC

SEQ ID NO: 127274 - protein, 28 aa, Heterodera glycines
  Coding regions on vcDNA: vcDNA=SeqID_53697; Strand=+; Position=1 -50,313-349
MCMCAVAECPCRPTPTWVLTIFAKMHWT

SEQ ID NO: 127275 - protein, 34 aa, Heterodera glycines
  Coding regions on vcDNA: vcDNA=SeqID_53698; Strand=+; Position=1-105
CPFGVLEHLWGAKIQRRIKVQAIGKLLPKDSVSP

SEQ ID NO: 127276 - protein, 274 aa, Heterodera glycines
  Coding regions on vcDNA: vcDNA=SeqID_53699; Strand=-; Position=1-825
  Homolog annotation: Hit_ID=CAG83749.1; Match level="QueryCoverage =99%, HitCoverage=35%, E-value=3e-32, Identity=39%"; Hit description =unnamed protein product [Yarrowia lipolytica CLIB99] ref|XP _499823.1| hypothetical protein [Yarrowia lipol
MNVLITVVPLLITFVRFVITFVPLLITVVPLLITFVPLLITVVPLLITFVRFLITFVPLLITVVPLLITFVPLLITVVPLLITFVRFLITFVPLLITVVPLLITFVRFLITFVPLLITVVPLLITVVPLQITLLITVAPLVITFVRFLITFVPLLITVVPLLITFVPLLITVVPHLITFVPLLITIVPLLITVVPLLITFVPLLITVVPLLITFVPLLITFAPLLITATPLLITAVPLLITLLIAVVPLLITLLIAVVPLLITVTPLLSLLYLF

SEQ ID NO: 127277 - protein, 495 aa, Heterodera glycines
  misc_feature (212)..(212): Xaa can be any naturally occurring amino acid
  misc_feature (311)..(311): Xaa can be any naturally occurring amino acid
  misc_feature (356)..(356): Xaa can be any naturally occurring amino acid
  Coding regions on vcDNA: vcDNA=SeqID_53700; Strand=+; Position=1 -35,757-1169,1219-2222
  Homolog annotation: Hit_ID=XP_522969.1; Match level="QueryCoverage =96%, HitCoverage=85%, E-value=2e-56, Identity=33%"; Hit description =PREDICTED: similar to putative protein family member (XC187) [Pan troglodytes]
SNPLASYRPGTGCVGRGTTVIIRGATVIRRGTTVIRSGTKVIKRGTTVIRRGTKVIKSGTTVIRSGTKVIKKRTKVIKRGTTVIRRGTKVIKSGTTVIRSGTKVIKKRTKVIKRGTTVIRSGTKVIKKRTKVITRGAAVIRRGSKEVQKGTTVIKRGTTVIRSGTGTTVIKRGTTVIRSGTSIKKRTKVITRGATVIRRGVTVIRRGTNNDXKRYKSDRRGVTVIRRGTTAIRRVIRSTTAIRRVIRRGTAVIRRGVAVIRRGAKVIRRGTKVIKRGTTVIRRGTKVIKSGTTVIRSGTMVIKRGTKVIRXGTTVIRRGTKVIKSGTTVIRSGTKVIKKRTKVITRGATVIRRVIXRGTTVIKRGTTVIRSGTKVIKKRTKVIKRGTTVIRSGTKVIKKRTKVIKRGTTVIRRGTKVIKSGTTVIRSGTKVIKKRTKVIKRGTTVIRRGTKVIKSGTTVIRSGTKVIKRTKVIKRGTTVISFIIKIFFTKFNLKN

SEQ ID NO: 127278 - protein, 173 aa, Heterodera glycines
  Coding regions on vcDNA: vcDNA=SeqID_53701; Strand=+; Position=1 -105,380-596,745-944
MENPCQKPSKVLAEIRANTKDETFVSMGTDLALVALLDVLKRAKKISVDGTFKVSPAAWTQCFVIGAFVNRRLALCVHALLPGKQRKYYEEALNAVKAVMAPSTPAHKNGAKWAWRNCMPTTKEQLIGDALDEAEYNTDEDVMNILSLLSLQMQGYVGGLRARGAQHEHEDRE

SEQ ID NO: 127279 - protein, 41 aa, Heterodera glycines
  Coding regions on vcDNA: vcDNA=SeqID_53702; Strand=+; Position=1-132
AREGLFFGIPPSVGELETKRKRVLMHFTRHNFFVVVLIHVK

SEQ ID NO: 127280 - protein, 91 aa, Heterodera glycines
  Coding regions on vcDNA: vcDNA=SeqID_53703; Strand=-; Position=1-7,63- 331
MSGCCVTPPLDSSTQRFVYSTIRLLDDSSTQPKSDDSSTQQKLNDSSIQRFVYSTIRLPSQKVTIRLLSKKATIRLFNDSSTRRFVYPAKK

SEQ ID NO: 127281 - protein, 338 aa, Heterodera glycines
  Coding regions on vcDNA: vcDNA=SeqID_53704; Strand=+; Position=1 -22,279-1273
  Homolog annotation: Hit_ID=XP_320889.1; Match level="QueryCoverage =90%, HitCoverage=37%, E-value=4e-39, Identity=31%"; Hit description =ENSANGP00000012033 [Anopheles gambiae] ref|XP_313651.1| ENSANGP00000013044 [Anopheles gambiae] ref|XP_314
MKTRLLVVKPQREKERQGRQRQFSTSSQSGHFNEGRTRSQSVNGRQSSKPRPPFPCKTCGGNHWNNECRNKRGGSQRNNECNNKRSQKCFNCNRVGHFARECRSKKQANSNDSMSVMNVSDDTDGWITVDCLINGRLVSLVADTAARKTIIQTPIWEKLGKPKFKTGKTFGKSYSGHNFELIGSFDCTVEFAGIKLELECFVAPTGALNLFGLPWIRAFELALQRPIATTLQIVQPEPAFMAMASSADLASKLKRKFPEVFSSELGHCTKMRAHLYLKPEAKPIFCRPRPVPHGAIDAIDTELDRLLAIGAIKQIDYSRWAAPIVASEKEVGRRPSLH

SEQ ID NO: 127282 - protein, 15 aa, Heterodera glycines
  Coding regions on vcDNA: vcDNA=SeqID_53705; Strand=-; Position=1-47
MPMGPAKGQLLFLRL

SEQ ID NO: 127283 - protein, 223 aa, Heterodera glycines
  Coding regions on vcDNA: vcDNA=SeqID_53706; Strand=-; Position=1 -391,469-514,636-869
  Homolog annotation: Hit_ID=CAE62373.1; Match level="QueryCoverage =82%, HitCoverage=33%, E-value=2e-35, Identity=41%"; Hit description =Hypothetical protein CBG06459 [Caenorhabditis briggsae]
MCPGNLSPLFALLLLALSLNANVLSAHEDTLLDEMEPVKEDDAGEYLTKFGYTTPSQLNVKTDGMAGDLSNVFEMAVKAFQEIAHLPVTGVLDIKTRKKMAEPRCGMPDGVEMLTEGGGAAFKWKKTDLTYTFHNFSPDLPRNTAREVPTSQQADINIKFASGMHDDPWPFDKRGALAFLQFDVPSPSHSSGGVLAHATMPPSGMLHFDEAENWVYMDAEKIR

SEQ ID NO: 127284 - protein, 42 aa, Heterodera glycines
  Coding regions on vcDNA: vcDNA=SeqID_53707; Strand=+; Position=1 -94,306-340
MIDRLRGIRPNSAEREDNQSNETHSFNPRIERQGPIRIMEKD

SEQ ID NO: 127285 - protein, 45 aa, Heterodera glycines
  Coding regions on vcDNA: vcDNA=SeqID_53708; Strand=+; Position=1-135
MGTNVHLRRKPTAGKLEAGKGVGNGQRNGGRRRESVAAENEQRKK

SEQ ID NO: 127286 - protein, 24 aa, Heterodera glycines
  Coding regions on vcDNA: vcDNA=SeqID_53709; Strand=+; Position=1-76
VTGVSIIAVLFLVFLMPLQNLVRF

SEQ ID NO: 127287 - protein, 258 aa, Heterodera glycines
  Coding regions on vcDNA: vcDNA=SeqID_53710; Strand=-; Position=1 -129,619-750,1035-1159,1403-1560,1608-1656,1896-1929,1992-2066,2114 -2186
  Homolog annotation: Hit_ID=NP_872170.1; Match level="QueryCoverage =91%, HitCoverage=24%, E-value=6e-57, Identity=45%"; Hit description =ankyrin and patatin family member (5V188) [Caenorhabditis elegans] emb|CAD54162.1| Hypothetical protein W
DIYDEVLDKLPEVSSDEDTPPDHNFINVLSLDGGGIRGLVIIQLLICVERIMGEPIFPYFDWVGGTSTGAMVTAGLAMGQTLHQIQRLYLRFKDMVFDNRRPHNTQVLEKFIRQEMGAETMFSDLKWPRLMFTTTRAEFFPVQLELMRNYKLPTNDEENEELGYRTPDDLLLWKVLRRSSAAPTYFASVDNKYIDGGGKSIFGQLHKYKNFPNAVNVGCFLSIGTGVIPPTPLKPTYIEVAQNWIAQPLTSINAFWTI

SEQ ID NO: 127288 - protein, 114 aa, Heterodera glycines
  Coding regions on vcDNA: vcDNA=SeqID_53711; Strand=+; Position=1-680
  Homolog annotation: Hit_ID=CAE61648.1; Match level="QueryCoverage =96%, HitCoverage=11%, E-value=7e-30, Identity=52%"; Hit description =Hypothetical protein CBG05582 [Caenorhabditis briggsae]
TTTRAEFFPVQLELMRNYKLPTNDEENEELGYRTPDDLLLWKVLRRSSAAPTYFASVDNKYIDGGIIANNPSLELLQEINFWTASQNFPNAVNVGCFLSIGTGVIPPTPLKVFF

SEQ ID NO: 127289 - protein, 41 aa, Heterodera glycines
  Coding regions on vcDNA: vcDNA=SeqID_53712; Strand=+; Position=1 -49,101-174
MHTGSNNRIGIRSGSAASSASAGAVSDEQFRSSFEAVPNVR

SEQ ID NO: 127290 - protein, 112 aa, Heterodera glycines
  Coding regions on vcDNA: vcDNA=SeqID_53713; Strand=+; Position=1 -95,472-592,666-788
MQLFVRNLVGKTIVVETDQQFGTVRSIKEQIEFLLDTFCTMTSSWPAIVLLLLLAICPLAVPFICLFGLMAAVHKMGILIFKMACGAWPDNRVPTELWPIPSHQGRASFNYF

SEQ ID NO: 127291 - protein, 156 aa, Heterodera glycines
  Coding regions on vcDNA: vcDNA=SeqID_53714; Strand=-; Position=1 -122,925-1139,1185-1318
TKNNTKGASYGLAMSLSVSPAGRTFIGRMPSGKGSHWAYAQPICVGYAPKGLRKDQTVGWADNTYGVDSTGQIFNNGKESEYVAPFSKGDKIGVFHNKRENCLSYFLNGDLLGQNKQFIADSNSGLWPAVTLRHPGDRVEFRVDSELGQMPGGLWK

SEQ ID NO: 127292 - protein, 630 aa, Heterodera glycines
  Coding regions on vcDNA: vcDNA=SeqID_53715; Strand=-; Position=1 -70,131-372,415-1471,1515-1882,2123-2278
  Homolog annotation: Hit_ID=NP_507780.1; Match level="QueryCoverage =65%, HitCoverage=32%, E-value=2e-47, Identity=27%"; Hit description =predicted CDS, DNA polymerase type B, organellar and viral family member (5T899) [Caenorhabditis elegans]
MSRFCPLVETKELGRLSAPKGKFSLFYSLEFARNYRLIGKEITEDKFRYLMKTEKKQREMAVKLMEKAGISGEEKTFGLQHLGLIQNFWDKEYPEMFRIVAFDMRSGIKPIFKGEGIRKNEVCVIKDGDHWDGMKSVTQFFCVRNFCVSCEVTRERPERHRLECKERCKKCCRMGFGFPCADVCAGIYCAECNRNFYNTECFESHKKTACREYKKCEKCGETHNTRNKHTCGEKFCRICKIYHPKRGCFIQKLKIRSTRKYRIVAYDLETTLYNGVHAPNLVCAALTCSECVGEKRKCEICEEPRMLTWSAANVEDPIGGFIDWIMGFKQFETVAFAHYAGRFDSHFVLRVLTERGLNTELMMADLKIYQIKAKGVYFRDFWLLSQNKLADLPKTLGLSIPAKLYFPHKYNKNENFGKRLSHLPPFDDYNPNAMKEEEYEKFEGWYNENFETEFELGEQLKVYCENDVEILMEAILKFRQLFLDITDGMDVLKDSVTIAGVVMRIFRTKFLKDRHIPIMPEGGYERADNQSKIAVKYFEWLAHREGIRVRHAENGGEIKFGDLKVDCVIGGQKRIIEFQECEVKAELKKNKEMKRFFESVPDKGPINPRDAYAGGRTMPFCLYAKATEAV

SEQ ID NO: 127293 - protein, 403 aa, Heterodera glycines
  misc_feature (8)..(8): Xaa can be any naturally occurring amino acid
  Coding regions on vcDNA: vcDNA=SeqID_53716; Strand=-; Position=1 -212,307-362,415-489,532-563,879-1036,1204-1343,1425-1533,1630 -1740,1790-1875,1954-2025
  Homolog annotation: Hit_ID=NP_509129.1; Match level="QueryCoverage =98%, HitCoverage=71%, E-value=1e-134, Identity=62%"; Hit description= acetylcholine receptor, non-alpha nicotinic acetylcholine receptor subunit, functional in oocytes if coe
FLGPNLFXLIINRIIINFQFPSDVEERLIADLFRGYNHLIRPVPNVSSTPLEIRFSLALTLLINVDEKNQIMQTNVWPTMRWIDYQMQWNPLEYGNIRTIRVPPDKVNPLEYGNIRTIRVPPDKVWLPDIVLFNNADGNYEVSFNNADGNYEVSFYSNVVVEHNGEMLWVPPAIYKSSCIIDVEFFPFDEQICAMIFGSWTFNKDEVIISYLNNKRQAELNDYSESGIWDIMEVPGQLIHQKSKIAYQIKIRRKKTLFYTVILIIPTVLMAFLSMLVFYLPAEADEKITLAISILLALVFLLLVSKILPPTSDTIPLIAKYLLMTFVMNIITILVTVIIINIYFRGMNIITILVTVIIINIYFRGPTTHTMPEWVRTVFVRTVFLRYLPIFLMMNRPRNDPSE

SEQ ID NO: 127294 - protein, 18 aa, Heterodera glycines
  Coding regions on vcDNA: vcDNA=SeqID_53717; Strand=-; Position=1 -47,258-267
MRDEGMQWVGQMETIRLY

SEQ ID NO: 127295 - protein, 52 aa, Heterodera glycines
  Coding regions on vcDNA: vcDNA=SeqID_53718; Strand=+; Position=1-157
MHQQQPSSSSAAHNGPQVPGAEEQRTASLTVPTRPTDGQQQHQQQNAVEIIN

SEQ ID NO: 127296 - protein, 249 aa, Heterodera glycines
  Coding regions on vcDNA: vcDNA=SeqID_53719; Strand=+; Position=1-750
MAKVANQKRNERRIRAVQDLARHLNHRMNRHRRGQRDGKRDPSEERHIRMTTERYADQLSRLGDDHIHRLQHQFPQLPNPRRRRSEVGGNLKGGKSQPKLASMVVRPPQGELLPSKDVGGAAPGASNSHGRNENEEEGREGKRQPPEGAPSAGGQFWRIAEERGESSGRSGRARSPGKEGENGEGGGGTETEIGEGSAPSGLGNPSRRLAPNVGQCELAVVEGQRREKWGGGGSPRWESGSHASSADGG

SEQ ID NO: 127297 - protein, 100 aa, Heterodera glycines
  Coding regions on vcDNA: vcDNA=SeqID_53720; Strand=-; Position=1 -96,262-468
MMPLLLLLLRTVLTLLGALALVLQPLWARQTLFFLISEKNVYSMPLPFGDSFFPFFILHFPQGFRSAHRDLEAQLLLVTDNDALREQIAEVAKISTKAQK

SEQ ID NO: 127298 - protein, 30 aa, Heterodera glycines
  Coding regions on vcDNA: vcDNA=SeqID_53721; Strand=-; Position=1-156
RLACLSLHLISLFILISLCHFCIAIKIHVI

SEQ ID NO: 127299 - protein, 30 aa, Heterodera glycines
  Coding regions on vcDNA: vcDNA=SeqID_53722; Strand=-; Position=1 -58,210-244
MYEHYALDFVRRAVQANQTVHVTREQCRNV

SEQ ID NO: 127300 - protein, 83 aa, Heterodera glycines
  Coding regions on vcDNA: vcDNA=SeqID_53723; Strand=-; Position=1 -75,182-358
MGLFNVNQEVELFSKLFSSCTTTSSQNGDDDLRRLEFTLISAYFNLFDPYADLILHKCRDPFKIVFASPQVFFDCNFQLAQSN

SEQ ID NO: 127301 - protein, 705 aa, Heterodera glycines
  Coding regions on vcDNA: vcDNA=SeqID_53724; Strand=+; Position=1 -69,441-563,1018-1168,1842-2055,2432-2540,2620-2710,2939-3021,3374 -3460,3505-3695,4415-4622,5176-5254,5569-5795,6005-6078,6320 -6353,6410-6458,6525-6598,6940-7071
  Homolog annotation: Hit_ID=AAB96970.1; Match level="QueryCoverage =98%, HitCoverage=98%, E-value=0.0, Identity=63%"; Hit description =gamma-glutamylcysteine synthetase [Onchocerca volvulus] sp|Q9NFN6|GSH1_ONCVO Glutamate--cysteine ligase (Gam
MGLLTLGTPLSWPRIVEHLQYIKAHGIDQFIALYHRVKGRERDQLRWGDEIEYTIVKFDDEHKKVRVSLRAKDLLDALMASEDVNRSLGEENRSLWRPEFAAYMVEGTPGTPYGGLMSCFNIVEYNMRLRYDDVSALLRPNESLLSISFPALGAPDFTDPPAVPRPTHPDSVGHSVFYPDEAIYSGHPRFRNLVRNIRGRRGEKVAINVPIFRDQNTPSPFTCIFKETFENAECIFKETFENAEASRAALPDHIYMDHMGFGMGLCCLQMTFQAVNVMEARWLYDQLTPITLIFLSVCSATPIFRSYLSDVDSRWPIISASVDDRTPFERGLVSSASVDDRTPFERGLVSSASDGYSKFHAIPKSRYDSTDCYIYPCSAQYNDIQLQYDEQLYQQLIAGGCPTVLFSHIAHMFIRDPLQVFEERIEQDDQKSTEHFETIQSSNWMNMRFKPPPPDANIGWRVEFRPTEVQLTHFENAAYCCFLVLLTRVIVSYRLTFLIPISLVTENMQRAVRRDAISTQKLHFRKTLAHCWHTPEGKPCPEGRPPAAGARADDNNVAEMSIDEIVNGGNTDFPGLVPLMLQFLNSADVDVDTRCTVSQYLSFIQKRARGEIKRARGEIWTTAKWMREFVHQHPTYKVHQHPTYKKDSHVPDECIYDMMKTMDKISRGEHCEKLLGCFKTKTEQRIPSAVKRAEEEMTMLIARRK

SEQ ID NO: 127302 - protein, 30 aa, Heterodera glycines
  Coding regions on vcDNA: vcDNA=SeqID_53725; Strand=+; Position=1 -36,378-434
MADASPPSCPNKANIGYLGLSNDTKKVGFG

SEQ ID NO: 127303 - protein, 110 aa, Heterodera glycines
  Coding regions on vcDNA: vcDNA=SeqID_53726; Strand=+; Position=1-333
  Homolog annotation: Hit_ID=CAE62810.1; Match level="QueryCoverage =65%, HitCoverage=22%, E-value=3e-21, Identity=63%"; Hit description =Hypothetical protein CBG06986 [Caenorhabditis briggsae]
MGDFVLLAHPIQGPPVCFAISPLNCPLYPIRTATSPIQGAYGIPGEPGESGTPGTPGLPGEQGLQGYPGDDGFPGIAGKPGSPGELGPPGDQGKQGGCDHCSPPRTAPGY

SEQ ID NO: 127304 - protein, 159 aa, Heterodera glycines
  Coding regions on vcDNA: vcDNA=SeqID_53727; Strand=+; Position=1 -63,209-302,352-401,882-966,1076-1263
  Homolog annotation: Hit_ID=AAA80437.6; Match level="QueryCoverage =62%, HitCoverage=36%, E-value=3e-22, Identity=41%"; Hit description =Carbonic anhydrase protein 5 [Caenorhabditis elegans] sp|Q10462|CAH5_ CAEEL Putative carbonic anhydrase 5 p
MNRQMFLFLFLLTIVQSNFEFANEFGTTKNRRAAEMNFGKDAEKQHKHHNHHEAWGYDDHDGPHKWGKQLEFATINELQFVNYDVSGAVEIKNNGHTVVVSGFEKWQNRQRPYIYGGGLNGKYLLAQFHFHWAADHDDGSEHTVNALHYPIEVRNLELF

SEQ ID NO: 127305 - protein, 56 aa, Heterodera glycines
  Coding regions on vcDNA: vcDNA=SeqID_53728; Strand=-; Position=1 -14,134-230,508-567
MKIRNSTCAGKNWLFGPAGHGYSGKIQENPAGLGKTKFISFFFFFLFPFFSKYFVK

SEQ ID NO: 127306 - protein, 285 aa, Heterodera glycines
  Coding regions on vcDNA: vcDNA=SeqID_53729; Strand=-; Position=1-858
  Homolog annotation: Hit_ID=NP_917837.1; Match level="QueryCoverage =84%, HitCoverage=11%, E-value=7e-31, Identity=37%"; Hit description =B1158C05.18 [Oryza sativa (japonica cultivar-group)]
MKLTINQRLGQGQQAYLQMCRQIGLGETGEHFWIPPQFLVKSKEELIDYVYPNFQQLLGNDKELLNRLILAPHIDTCDEVNEIMMANVPGQVREYLSTDKPLDDRPLDIDEIESEVAALNRRTDSGMPPHSLRLKVGCVVVLLINKSDKEGLINGTRIVLEELGDDRLIGRVINSNAIGGQVRFFLERTRNVYEDKSPGGIKYERLQFPIKPAFAMTIQKGQGQTIRTVGIDLEREVFSHGQLYTAFSRATDGNNVRVHAPNREIDAQGRAKVLNIVATNMLKLQ

SEQ ID NO: 127307 - protein, 38 aa, Heterodera glycines
  Coding regions on vcDNA: vcDNA=SeqID_53730; Strand=-; Position=1 -68,263-311
MAFDEEKPVDLLVHPILPTILRISKSAEHITMLGVLED

SEQ ID NO: 127308 - protein, 98 aa, Heterodera glycines
  Coding regions on vcDNA: vcDNA=SeqID_53731; Strand=+; Position=1 -34,78-253,401-484
MAIVYTEFTREEIDEAIEEAVLKVKGGTERDGMRAALETIVSSPHLLLNDVAARHNIDYRKVSKYRNRFNDDAQPARETEHHYGDYESEILGYFKRRQ

SEQ ID NO: 127309 - protein, 223 aa, Heterodera glycines
  Coding regions on vcDNA: vcDNA=SeqID_53732; Strand=-; Position=1 -152,334-436,531-726,790-951,1093-1113
  Homolog annotation: Hit_ID=NP_504015.1; Match level="QueryCoverage =92%, HitCoverage=42%, E-value=4e-35, Identity=35%"; Hit description =general substrate transporter family member (50.6 kD) (5E92) [Caenorhabditis elegans] gb|AAD56301.1| Hypo
HKNLIWPISNVPLKQILRSRLIWVVWLNAFADLFSGVFLLMYIPSYLNYVLHYGIEKTGFLGALPSLSHIPLKFLFGYCSDQFKCLPERTKLILFNTIAVGVPAIAYLAIGFVPVDRPMWTVLIFTAILMLLSTAGGGFYKCGTLCSRQYSHFVVANIQFVKYSHFVVANIQFVKSLTLFVGPALLWLFVEDETDRDQWRKVFILLAVMLIVVRVSKKYLTVN

SEQ ID NO: 127310 - protein, 210 aa, Heterodera glycines
  misc_feature (185)..(185): Xaa can be any naturally occurring amino acid
  Coding regions on vcDNA: vcDNA=SeqID_53733; Strand=-; Position=1 -168,273-490,687-876,1246-1304
  Homolog annotation: Hit_ID=CAE66803.1; Match level="QueryCoverage =92%, HitCoverage=43%, E-value=2e-41, Identity=44%"; Hit description =Hypothetical protein CBG12165 [Caenorhabditis briggsae]
EKIWLHAFVRYFILLLSWLCLTSISSNMLALNFTLICMGSVPTNGTDLSGAEVGEINDFTLMSMPWHLWAVAVGSMLGTFPFSWLYTRFGARFVLFGAGLASAIATALIPIATSFSFNLFLALRFVQGISYAADFAAMGMICSRWASLKQNALFISVLTCYSPLSTTITNPISGMVGTLFKSAFXSAYLPAYSGIFPTILWHFPSNPLPY

SEQ ID NO: 127311 - protein, 63 aa, Heterodera glycines
  Coding regions on vcDNA: vcDNA=SeqID_53734; Strand=-; Position=1 -74,135-250
  Homolog annotation: Hit_ID=NP_501127.2; Match level="QueryCoverage =100%, HitCoverage=4%, E-value=9e-23, Identity=88%"; Hit description =RNA Polymerase, Class III (C), rna polymerase (rpc-1) [Caenorhabditis elegans] gb|AAA83341.2| Rna polymer
MTLKTFHFAGVASMNITQGVPRIKEIINAVRFISTPIITVALADERDEKLARRVKARIEKTTL

SEQ ID NO: 127312 - protein, 28 aa, Heterodera glycines
  Coding regions on vcDNA: vcDNA=SeqID_53735; Strand=-; Position=1 -30,347-403
MAAGDGLILVANREHLGLSNDTKIIGFG

SEQ ID NO: 127313 - protein, 147 aa, Heterodera glycines
  Coding regions on vcDNA: vcDNA=SeqID_53736; Strand=+; Position=1 -155,643-931
MYPKLVDQIAGGIAKAVQKATDSHAFHEFPDCLSLAHTDRLSIKLNAAHSQIHRSLHRSANLTQLDAISFKIRNEEQKKKLVMTAEVQKGNGLLLKNEAGKAVMLVRLSTHTADSLGKLMHPSQATLFKVGMVTLASSAPGMGQIEK

SEQ ID NO: 127314 - protein, 139 aa, Heterodera glycines
  Coding regions on vcDNA: vcDNA=SeqID_53737; Strand=-; Position=1 -302,448-564
MPKTPRQQRICQLKGTDGVAVVITNVPVSSITHPNNRSKPYINTDKRPSEEKQMPYLYAENANQIRAHHNYATEESGKWMMFFEKGSELDDHWDMAKRLYNEGKLDGITSMKVSTAFDNPRASDNRKVAKNSEWTDKME

SEQ ID NO: 127315 - protein, 62 aa, Heterodera glycines
  Coding regions on vcDNA: vcDNA=SeqID_53738; Strand=+; Position=1 -24,275-439
MDEIYKRSELAAQNSNHKMCIFLTENRKKRTNLNEKRIRKTEFRQCLAKNGIHCTKIGEHME

SEQ ID NO: 127316 - protein, 217 aa, Heterodera glycines
  Coding regions on vcDNA: vcDNA=SeqID_53739; Strand=-; Position=1 -89,276-441,761-1003,1402-1559
VMIIIRCFSIVSSSGSFASCFQCSTISSRRFFCHQRRAKVSTPCPPPPDPSAEFRVVPTSSVIPPISGTENPSLGRGEARRISSLITDNFRADVVARRYRLDRLRPSDWLLVYNYRVGSWLFTVGRYAFALLCVIFLIAVDDFVRVGSGKFTLQKLRVTHNELIRLGIVGKFFCAIALLIFFLLLRVRSLFLLRMYVHRKEPNRICATIAKGVFSKK

SEQ ID NO: 127317 - protein, 92 aa, Heterodera glycines
  Coding regions on vcDNA: vcDNA=SeqID_53740; Strand=-; Position=1 -84,566-671,769-857
MRLIAAGTAPTAQQQQQPQQLQQQISFGEFLEFVRAVFALRGRSDQCERKRKADSLLVGGTGGARFFRRDNEIPLYGPVLITTDLPNIDGSI

SEQ ID NO: 127318 - protein, 80 aa, Heterodera glycines
  Coding regions on vcDNA: vcDNA=SeqID_53741; Strand=-; Position=1 -222,591-611
MAKHQKATPPIGTEQNGENSFAAVASSNSTNSIAECADDYVDSHDKPWKLVAKINAGNCETLEQRKHLHKFCSEGNEIFF

SEQ ID NO: 127319 - protein, 127 aa, Heterodera glycines
  Coding regions on vcDNA: vcDNA=SeqID_53742; Strand=-; Position=1 -113,708-978
MRASDQTKKDKNKLWTTDENRREKKQSDGLMVIDHTFSIGTFFHFQLNGFHRVDQNGAGGEAADQNCPLYSARHARRRHVRQSERSADVPNFTPYPAAVTTIIVGTVPKYGEFDTLARLSMCIDGSP

SEQ ID NO: 127320 - protein, 62 aa, Heterodera glycines; identical to SEQ ID NO: 125756
  Coding regions on vcDNA: vcDNA=SeqID_53743; Strand=+; Position=1-287

SEQ ID NO: 127321 - protein, 34 aa, Heterodera glycines
  Coding regions on vcDNA: vcDNA=SeqID_53744; Strand=-; Position=1 -34,520-590
MAQPNTPTAEVALLTRIRNRPILYNWLPVRVHDA

SEQ ID NO: 127322 - protein, 57 aa, Heterodera glycines
  Coding regions on vcDNA: vcDNA=SeqID_53745; Strand=-; Position=1 -118,261-316
MYIDEKAVATATTNLKKGRTMPPRAAETGTFVTDRVGAVVFAFFSTTLSQTMQKRRI

SEQ ID NO: 127323 - protein, 230 aa, Heterodera glycines
  Coding regions on vcDNA: vcDNA=SeqID_53746; Strand=+; Position=1 -99,683-858,901-1317
MKERWPHNNSHPSSGGCGLVAKTTDPRKGPRAAIIKRARHEVNAPPAVPQNIEQLIVPPAYRTYEPTDGNEEQFLLGDSGVFFEPGNENPQRILLFGRESFGRWADRMKECFGDGTFSLAPPMFYQIYTILAKCCFNLISRENCFKAWVVGYRRVPLLADVQVASVLREDVWTSPSSLVDILACLVQNGLRDRCAQRRCCHVSCMRNQILLLPFRAEFAKKNQGTKSLGG

SEQ ID NO: 127324 - protein, 199 aa, Heterodera glycines
  Coding regions on vcDNA: vcDNA=SeqID_53747; Strand=+; Position=1 -158,228-298,373-744
DVVDAMPKPVNVTRPIVVSTRRHLKVGRARKENVEQLEDTDDDDDYQNPRSSRVSEEGQVLRAGGRPFITSSVDDIHTKRYLLVPKEIYQSLAAPPPSDGTPIGLVRTRIKQIKNDDAINEAERAVKYEQELKRLNKLTKDEDERPVGVKLENLSDVVDAMPESSTVGWSITNGLSFPDGLCPDGLATVGYPLADCPDP

SEQ ID NO: 127325 - protein, 159 aa, Heterodera glycines
  Coding regions on vcDNA: vcDNA=SeqID_53748; Strand=-; Position=1 -99,323-534,1959-2039,2271-2355
  Homolog annotation: Hit_ID=NP_495415.2; Match level="QueryCoverage =74%, HitCoverage=55%, E-value=4e-12, Identity=47%"; Hit description =acid SphingoMyelinase, sphingomyelin phosphodiesterase (asm-1) [Caenorhabditis elegans] gb|AAC46756.2| Ac
MAFRRSFDGISLRIGTFLLLFTNSALLLQPPAATNATADRILSVADFVCRHFADSDSFVCHGITTQFREEFLYVLGRLVISPGQLCALLVTDCGTPLDPFGTNCRGSYMVPLLPGIRLISLNNGYCEKTNMFIYINQTDPDGSLSWLVDQLWAAEKADE

SEQ ID NO: 127326 - protein, 105 aa, Heterodera glycines
  Coding regions on vcDNA: vcDNA=SeqID_53749; Strand=+; Position=1 -108,670-879
  Homolog annotation: Hit_ID=P30757; Match level="QueryCoverage=35%, HitCoverage=30%, E-value=2e-09, Identity=78%"; Hit description =Histone H2B pir||S16084 histone H2B - sipunculid (Sipunculus nudus)
MPPKPSGKGAKKAVKSTKAVRTGDKKRRKARKESYSVRQRRFRAHCRGSLSSGPLQQAIDHLFARNPNGRPSDSAWRVGQARRVGGDQGGDEVHLVKVMMRRCWR

SEQ ID NO: 127327 - protein, 305 aa, Heterodera glycines
  Coding regions on vcDNA: vcDNA=SeqID_53750; Strand=-; Position=1 -134,201-274,661-873,1050-1216,1267-1596
  Homolog annotation: Hit_ID=NP_496570.3; Match level="QueryCoverage =51%, HitCoverage=19%, E-value=3e-10, Identity=34%"; Hit description =CeNTaurin, beta (81.4 kD) (cnt-1) [Caenorhabditis elegans] emb|CAA10735.1| centaurin beta 1B [Caenorhabdi
MDTLETEHRNILLQLGNRKVNAIFLRNLPNAEENAKMGISRHTNRESREQWIVAKYVEKKFASQPLYQMAYSRSVTALNKNEREGGGSDGGQTGATAQHSTETNPSSAAATTSTTVKLRHTVLLDDAAVTDALSVDDNFYAENRLSRASSFGSDSNLVQSARAAIAQRASACFARGVVGQQHRRLVNALRTGCLEEVLRAMIQDGLNLNEELQLHANTQQQQQQKQQHEDGGEERGSNSKGSGNDATATTNANIEQCHQQNRPKQQHGGAVIAAIRTTTMTTTITLPLHIAVENVRFVYNGNKFT

SEQ ID NO: 127328 - protein, 214 aa, Heterodera glycines
  Coding regions on vcDNA: vcDNA=SeqID_53751; Strand=+; Position=1 -99,204-486,684-830,939-1054
MHWMNFLDRKMISFIKRGLKCCPNDGGRSLIKMDRRFLIKHQKIDKLSPVPKLQFIFMCVRFVVHFVVFPMPSIPKLNFGARQLSVLIKDLGRKLQKLINDSNYVEEYDPKKRAELKWKLEEDLFLDDTDEDKLLRILDELDKMKNEEEKKKHELKHNSAETKTKQKTKMEKNRKERHAIQLKILEFLLTSDELFRINHRFDERVTKGNTLQHS

SEQ ID NO: 127329 - protein, 103 aa, Heterodera glycines
  Coding regions on vcDNA: vcDNA=SeqID_53752; Strand=+; Position=1 -86,278-503
MLTKVFLLFPGNVSVPFLLENFFLIYSIWNWPLPLQLTDIKHKMADQFLSWSTTTISAELTKKYINLDQKNSVEMPIIAPIFPEQNVMNLINASDARKIKNEF

SEQ ID NO: 127330 - protein, 159 aa, Heterodera glycines
  Coding regions on vcDNA: vcDNA=SeqID_53753; Strand=+; Position=1-3,59- 399,705-840
MGGIGCAVLASLGLVPTGFGAPLLNSSLLLPLDGGGSATSATITPRNANSDRRSNENMSDILPTFQMVSANNGQFPNAKTNDNLPSVGNASDSAFVPFGLDVNEAQVAQAGLSASSHRLVRPRLDAHWFCGVQCVLLERLSDHGFQPNIRQKKLMTTQN

SEQ ID NO: 127331 - protein, 129 aa, Heterodera glycines
  Coding regions on vcDNA: vcDNA=SeqID_53754; Strand=+; Position=1 -159,259-489
  Homolog annotation: Hit_ID=CAG82271.1; Match level="QueryCoverage =83%, HitCoverage=20%, E-value=8e-13, Identity=39%"; Hit description =unnamed protein product [Yarrowia lipolytica CLIB99] ref|XP _501951.1| hypothetical protein [Yarrowia lipol
MKLTEYALSDALNNNEVKKIYFGEEILEALASFDADKRRAYILMEKLRPMSVKNHIIWAEDGEESSGEDFLEDVTPELGIFGTLLGNIVNGEVLYNAQFGHQLKTKLASENARGITTGNCAFDTAYLVD

SEQ ID NO: 127332 - protein, 218 aa, Heterodera glycines
  Coding regions on vcDNA: vcDNA=SeqID_53755; Strand=-; Position=1 -56,277-367,1238-1365,1449-1830
MATVALKIRHLSDEMGLQRYSNRVLIVEDIELDGGRWSFIENCSEANCVVLRAVRGVHVVITRFDFEQDTNRAQRSNEWFSRNKGEISNAIIKFALFPSPNLHFLFICETGFYQTFRAFELKKLIFCQILSNWHASNKDLPTVFSEVNWALHNQLSNFSLYRNFVLIRREKWLSSSCLIDTANSTVPIRGTHPTENMATALINPFLFDAYCYALFLFL

SEQ ID NO: 127333 - protein, 73 aa, Heterodera glycines
  Coding regions on vcDNA: vcDNA=SeqID_53756; Strand=+; Position=1 -167,240-296
  Homolog annotation: Hit_ID=NP_491350.1; Match level="QueryCoverage =98%, HitCoverage=18%, E-value=2e-25, Identity=75%"; Hit description =GDP-mannose pyrophosphorylase (43.3 kD) (1E875) [Caenorhabditis elegans] gb|AAF60648.1| Hypothetical prot
PWSRVEGSPTSPNPNIPFAKLDNKPLFNVDGRLNPSLTILGSDVNVPRETVILNTVVLPYKELSANYKNQIIL

SEQ ID NO: 127334 - protein, 75 aa, Heterodera glycines
  Coding regions on vcDNA: vcDNA=SeqID_53757; Strand=+; Position=1 -55,136-308
MPGEHATGTLVFLNNVLIKKGAKFTLRESRQRTVGYGIVSELYKPVFIDTFKKKVFNFEKIMERAEVMTEGNVTP

SEQ ID NO: 127335 - protein, 46 aa, Heterodera glycines
  Coding regions on vcDNA: vcDNA=SeqID_53758; Strand=+; Position=1 -34,319-423
TFTWFGKSTAQSSAGEHVGLLCKNLYYDPISRGFWLTKPGTVTPTN

SEQ ID NO: 127336 - protein, 120 aa, Heterodera glycines
  Coding regions on vcDNA: vcDNA=SeqID_53759; Strand=-; Position=1 -92,530-800
MNRLIRMFYQLAPLQLCLCVRPAQTFGRQMCSIIQNIHPTIETVPIACAICCPTAATVWLSSPVPSERPTEGTARPTPRRTRPSQHSVPSDTRGHRLAKSFLFETTHKMVQIHSIRLLIK

SEQ ID NO: 127337 - protein, 120 aa, Heterodera glycines
  Coding regions on vcDNA: vcDNA=SeqID_53760; Strand=-; Position=1 -92,533-803
MNRLIRMFYQLAPLQLCLCVRPAQTFGQQMCSIIQNIHPTIETVPIACAICCPTAATVWLSSPVPSERPTEGTTRPTPRRTRPSQHSVPSDTRGHRLAKSFLFETTHKIVQIHSIRLLIK

SEQ ID NO: 127338 - protein, 28 aa, Heterodera glycines
  Coding regions on vcDNA: vcDNA=SeqID_53761; Strand=-; Position=1-83
WLQYRCLFSLSEMYSRTRQDLVVQLRSA

SEQ ID NO: 127339 - protein, 196 aa, Heterodera glycines
  Coding regions on vcDNA: vcDNA=SeqID_53762; Strand=+; Position=1 -68,212-329,424-641,702-887
  Homolog annotation: Hit_ID=AAN84839.1; Match level="QueryCoverage =100%, HitCoverage=28%, E-value=1e-12, Identity=23%"; Hit description= Hypothetical protein C43E11.11 [Caenorhabditis elegans] ref|NP _491339.2| putative nuclear protein, with 2
MRLVQTVYKCVQAHTDSVATVIRDALNPLKTSILSQSFKNLTTFVDQTFEQDERRDTIVVEQLNATFRAELASVAWDMALQREMEGNVSKALQYVGVKLEQQMTFGDDALRFTGRISRAQTHNYQLLNIAHELAKYWPGLCGPLFSLIQTAVNTILERMRTTVSLVLDSMHDENLAVALAPSATSSEYVKELCGHL

SEQ ID NO: 127340 - protein, 677 aa, Heterodera glycines
  misc_feature (29)..(29): Xaa can be any naturally occurring amino acid
  Coding regions on vcDNA: vcDNA=SeqID_53763; Strand=-; Position=1 -168,226-378,468-515,612-750,861-1032,1142-1317,1383-1502,1625 -1767,1824-1942,1973-2109,2302-2436,2494-2589,2644-2735,2806-2897
  Homolog annotation: Hit_ID=CAE57616.1; Match level="QueryCoverage =99%, HitCoverage=86%, E-value=2e-84, Identity=33%"; Hit description =Hypothetical protein CBG00597 [Caenorhabditis briggsae]
VPSDRISELERLVFYLQKRHNPNESYALXQNLIIAFLVDSDSLASMEIHAKMDDLESYMELLYEEGEPKQRGVSYMELLYEEGEPKQRGVAMLAELVRHVEASQLAQIVENEQLMGALTRIWREDSRKNFELAIHLAQLFIGLLSVQTVDFELGRWELWREQTHEKEEKERLKWEYAMRKQDQLIAVVLNILLNLADDLRTEHKMLRKGLLPTLFKCLDRSSPQLLTVAVKFLWKLSQFSENHAVSECCGGVGSPLPLSSSSPSDFLGPLFSLLFNCSFEPSSRRCMVAAGLVSLLAPHISENDVALALMYNDVALALMYQLSIVDDAKAMIAFTDCIPTVCFLDCSFPGSLLVKSLLVNIVLEKRNAQLLCGSEGQGLDSLMAFALENEGGDVLAMKVAVARNIASHEGPTREMFTKWVPQLLENAVEKAQGDDSNNNKSIFALECLAICASIFALECLAICALLPNANWAQLEDSHSVVAFLAQILKRSQQSERDVTTKPSSRMKQFKVVQLCGTVAGHSLEMAERVEKHLLPLIISTLNNRQDDDEIVLQCVFVFLSLRQDDDEIVLQCVFVFLSLLAHGGEMAKRICQPAVVPLLLLAVVPLLLLNLMHDKNTQIRALCEQTLERVAEVNAHWRERIREARFEVNAHWRERIREARFRWHNAQWLEMVETTTD

SEQ ID NO: 127341 - protein, 68 aa, Heterodera glycines
  Coding regions on vcDNA: vcDNA=SeqID_53764; Strand=+; Position=1 -69,472-608
MAEDGVLKSVIGLRIERVAELDGHIFCARQPFVNWTRLLESTAANSLRRAEDTLEIEAQISVTEIVGY

SEQ ID NO: 127342 - protein, 19 aa, Heterodera glycines
  Coding regions on vcDNA: vcDNA=SeqID_53765; Strand=-; Position=1 -19,243-283
MTNSNLASNEHSAFNFEGK

SEQ ID NO: 127343 - protein, 309 aa, Heterodera glycines
  Coding regions on vcDNA: vcDNA=SeqID_53766; Strand=+; Position=1-928
  Homolog annotation: Hit_ID=CAA82797.1; Match level="QueryCoverage =80%, HitCoverage=42%, E-value=1e-17, Identity=26%"; Hit description =gag protein [Ascaris lumbricoides]
MSAHFRAQLKLAYNDSEEFLTDQESFPVPQQNGQPDILYAKSIRSQLQSLDDHNSDVKSVLTQLEDNSDRWMTLRTNMTGAERTQDNPLYDAFVLDTPFPKAISDLKKYLRTLRTERRALEAALPVANVQNASAPSLVHLPKTSLPTFSGDCTNYTSFWNTFKAGVHDLNIPNSLKFTYLKQCLSGPPLTLINSLPISDDSYDSAVSLLSQHYENPEEVARALHNSLRKLPRIRPGDYFCEDLRALLDQLECICIQMSQQNHSYDTVAVQMEVEERLPRFVLDEIFMSKENDDNWSSDKLKSRLWAILK

SEQ ID NO: 127344 - protein, 517 aa, Heterodera glycines
  misc_feature (73)..(73): Xaa can be any naturally occurring amino acid
  Coding regions on vcDNA: vcDNA=SeqID_53767; Strand=+; Position=1-1572
  Homolog annotation: Hit_ID=NP_508324.1; Match level="QueryCoverage =95%, HitCoverage=19%, E-value=8e-80, Identity=38%"; Hit description =predicted CDS, peptidase family A16 and RNA-directed DNA polymerase and Integrase, catalytic domain and Z
YKSLISHPKIRIPNQWPPDFFTLEGIGIRDDLQPISVDEIVLKQFDQSIEFVKNRYQVKLPFRSDPKTLPLPXNFGLCFGRLRSVFNTLSAKPDLLQKYDSIIQEQKKMGIVEIVKNPFEFSPPLHYLAHHPVISPLKSKVRIVYDGSAHVGKELSLNECLFPGPIILPDLIGLLLRFRIPPIVITTDIEKAFLQVNVHPAHRDCTRFLWLKNTSLPPSKANTQILRFTRVSFGLTCSPFLLAATILHHLSAFPSNLSTEISQNIYVDNILISASNSTEGQKKSTSAISLFQKAGMPLREFASNCQEAISHLPRQLKLPGTEQKFLGLKWNTEKDFLIVELSVPPPDFPTKRSVLSFIASHFDPLGLISPLILPLKLFLQSLFELKLNWDERFPTEIITNWQKSIESWKRTDKVTIPRSPISSPLSAREYQLHCFTDASTLAMCAAVFLRVSHPKFSPETFLIFSKTKVKPIHNVPLTIPKLELIAVEMGTRALKFTQAQFPSLNTNLNLWTDSAIV

SEQ ID NO: 127345 - protein, 241 aa, Heterodera glycines
  misc_feature (223)..(223): Xaa can be any naturally occurring amino acid
  Coding regions on vcDNA: vcDNA=SeqID_53768; Strand=+; Position=1 -554,1803-1979
  Homolog annotation: Hit_ID=NP_509552.1; Match level="QueryCoverage =88%, HitCoverage=11%, E-value=2e-34, Identity=39%"; Hit description =reverse transcriptase RNase H-like protein family member (XJ813) [Caenorhabditis elegans] gb|AAA85753.1|
PPIVITTDIEKAFLVNVHPAHRDCTRFLWLKNTSLPPSKANTQILRFTRVSFGLTCSPFLLAATILHHLSAFPSNLSTEISQNIYVDNILISASNSTEGQKKSTSAISLFQKAGMPLREFASNYQEAISHLPRQLKLPGTEQKFLGLKWNTEKDFLIVELSVPPPDFPTKRSVLSFIASHFDPLRRFTVIMHLLLSLFQNFWRSNPTLWNFRVPHTVAWRALXAFDLTGQTSSTKGIYLIS

SEQ ID NO: 127346 - protein, 213 aa, Heterodera glycines
  Coding regions on vcDNA: vcDNA=SeqID_53769; Strand=+; Position=1 -549,634-726
MENFARTFVEQLAKHTDNETSRKVHGGQLQLNIKRRGGGQTVQFDLPVQIGRFASANHSQKHQISEVSVIPIAVAIGRSRLIAESVTNAGQSTSERPKGNGHKKCHGNNCVGRGECRSHTWSPAVPPRICSVRTHLSADDSDFAVGSVRQRRANQRGTPASVLNGTKEKMGTKEQMPRFFGRFAEVKHIARAEHINAMQSLGKSERISAKEML

SEQ ID NO: 127347 - protein, 55 aa, Heterodera glycines
  Coding regions on vcDNA: vcDNA=SeqID_53770; Strand=-; Position=1 -118,200-249
MNLKPIVFDDTSRNEYNLSLEDEDHIQFAAFIDKIWKAKKFFCAKIVFDINSALF

SEQ ID NO: 127348 - protein, 18 aa, Heterodera glycines
  Coding regions on vcDNA: vcDNA=SeqID_53771; Strand=-; Position=1-54
MRTRPIWQVKQRLLTSQK

SEQ ID NO: 127349 - protein, 95 aa, Heterodera glycines; identical to SEQ ID NO: 125597
  Coding regions on vcDNA: vcDNA=SeqID_53772; Strand=+; Position=1 -41,218-852

SEQ ID NO: 127350 - protein, 43 aa, Heterodera glycines
  Coding regions on vcDNA: vcDNA=SeqID_53773; Strand=+; Position=1 -39,689-781
MARVVVPKCSQDKGWQAATDAKHSSGEPLSLNTVLVFVHILHF

SEQ ID NO: 127351 - protein, 17 aa, Heterodera glycines
  Coding regions on vcDNA: vcDNA=SeqID_53774; Strand=-; Position=1-66
HKHLFDLFYHIHNLIKI

SEQ ID NO: 127352 - protein, 271 aa, Heterodera glycines
  Coding regions on vcDNA: vcDNA=SeqID_53775; Strand=-; Position=1 -273,317-559,682-981
  Homolog annotation: Hit_ID=NP_493879.1; Match level="QueryCoverage =85%, HitCoverage=70%, E-value=5e-39, Identity=34%"; Hit description =transposase family member (2B289) [Caenorhabditis elegans]
MEEFTAVMSANCRATHSVAILAELKTKASAEKSCATTERMRLDGAGLPVHRPDIDTELAEWIAKKRKNKQPESRNIIRQRAAALFMDTDIKASIGWLQKFLSRHNFMLRKKTSVCQKPPSNYAEAVPKFISFVEQRRKVMNNFPGGIFAMDETAVWFDCPDNRCIDNKGAKDPYVLVNRKRPVPQIVNQFAGKLVINFAGSIWMNDDTTEDYLHKIIEAKLFVGERLLVWDAFGSHKSERTTKVVKGLRVETVFIPGGCTKFIQVPNHPSQ

SEQ ID NO: 127353 - protein, 423 aa, Heterodera glycines
  Coding regions on vcDNA: vcDNA=SeqID_53776; Strand=-; Position=1 -300,333-630,741-992,1045-1263,1588-1787
  Homolog annotation: Hit_ID=NP_509204.2; Match level="QueryCoverage =91%, HitCoverage=25%, E-value=2e-45, Identity=27%"; Hit description =laminin gamma-1 (XH764) [Caenorhabditis elegans] gb|AAC48152.2| Hypothetical protein C54D1.5 [Caenorhabdi
MWLRSDRVRLTRNIPNLSVYPLVFSSETLECDVSSGQCLCRQNVEGRRCDQCSENRFNLRGGCPACDDCYALIQSRKNELNGTMSELRENLDEIINNPVIIKVDDREFDAHVQKVRVEVESLHERALKKMGKFYVPNERVITHRPAEGDDSHIRDQAISMRAQLAEADTLVLGLRDRLQQIDTNAAVIEQQLGQFSTDKETTHKELSVGVNYVQTQGEQHLAKAQEAFDRYGEKSQQLSEIAGESKQLSDTQEQRRREILSLAEQIRKESRQSLSDANEAIFGASSTSLQISALLTEVHELEQRLKAIQQMATEQSLETNQTHDGAAFILSGVDSIRLPNVFSDELMEKVKRAQEEDFHSKIEQSRAEATEEMTNLADIEKEIEEAQATTKEAEDAVGDASQNAKEAAEVAEEAKMKAQNLAM

SEQ ID NO: 127354 - protein, 93 aa, Heterodera glycines
  Coding regions on vcDNA: vcDNA=SeqID_53777; Strand=+; Position=1-279
MAETETRRTAERVGGGQQEEAGLALITALTLNILKTKKGHEKTEKKNKWNNLFANTRSGGGGTSRGVVEGAICITTTISEGSGEKLRKMSVKQ

SEQ ID NO: 127355 - protein, 38 aa, Heterodera glycines
  Coding regions on vcDNA: vcDNA=SeqID_53778; Strand=+; Position=1 -110,797-803
MLVLSDCAMHSRVFGVADHESDIHLHQFRTPNPNSNKI

SEQ ID NO: 127356 - protein, 411 aa, Heterodera glycines
  Coding regions on vcDNA: vcDNA=SeqID_53779; Strand=+; Position=1 -565,608-796,862-1056,1107-1199,1315-1505
  Homolog annotation: Hit_ID=AAN11401.1; Match level="QueryCoverage =96%, HitCoverage=66%, E-value=1e-37, Identity=31%"; Hit description =metalloprotease 1 precursor [Ancylostoma ceylanicum]
MDSEEVKKHNEEKEKVKKLLAEYKQKVNKQMEKNVEEMEKDEKLKEVLREIEEAQAKHPGEKRKAAKSITEINEKHWDELYQGDIELSVEQAQYLLDTVTKTENRALMRAKRGAARNARKFPNHKWPILVPFSFDGSICKFQLRAESTFKYLRVSSIIGPSIRTPTPTSIKALRGVEKRTFGTRIKENASEMKAHIYEAVKLWNDNTCLNIVEDDEVSPRIQFTNIKGMGCLSNVGMQSSDTYQEIKLEYPTIAHEIGHALGFFHEHERYDRDSFVTFYADNVDPKNYYAFEKETIETTDNYQVPYDLGSVMHYNAKTFSINGEYTLVPRVGASYINTIGQEYGPSLKACHVTMNCDNDGFQNPDTCTTCICPQGYIGAKCQDVDIGGYAPASIANTCEGNILFATSNWQN

SEQ ID NO: 127357 - protein, 453 aa, Heterodera glycines
  Coding regions on vcDNA: vcDNA=SeqID_53780; Strand=+; Position=1 -311,377-1427
  Homolog annotation: Hit_ID=XP_320617.1; Match level="QueryCoverage =54%, HitCoverage=31%, E-value=2e-32, Identity=35%"; Hit description =ENSANGP00000024791 [Anopheles gambiae]
MKLREFYGSNIEELKKLQPDDLAKDLEDNKVLGIRWKPKHNRLIFKLPIFEGKITKRTILSQIAKVYYPLGLMSPVLLPAKLILQEVQNLNPKWDDEMPANINKHIQAIDSVEFHCFCDASIYGMGIAVYQKAKTIIRKDECNLIYAKSLVKPIKVAVHDGTIPKLELQALTLGVKAVKFIQAQIKFADHQVIMWTDSQCSVERLRENKRQDRFVANRLQKIREANFQVRHVRTDSNPADMASRGADPQCLRTSLLWRFGPIWLSKADKWPESNVIYRPGDEFKEVEKPPIVDIPAQPIQEVHSFIASVMDDSVSLAGSDDESQQPRPKKKFKIPKRRSALLRPIGQQQSPLQGQHKRRKQLQDSGLRKLFQAISDQQGSSKATTKVIEESREMQKAPRHEQIEHEQRMVRKSQQEANRHLQPKKRQQKEIQEVPHSTTEEQQRETKRQQIER

SEQ ID NO: 127358 - protein, 188 aa, Heterodera glycines
  misc_feature (132)..(132): Xaa can be any naturally occurring amino acid
  Coding regions on vcDNA: vcDNA=SeqID_53781; Strand=-; Position=1-581
  Homolog annotation: Hit_ID=XP_318284.1; Match level="QueryCoverage =99%, HitCoverage=25%, E-value=1e-21, Identity=34%"; Hit description =ENSANGP00000021965 [Anopheles gambiae]
MKLREFYGSNIEELKKLQPDDLAKDLEDNKVLGIRWKPKHNRLIFKLPIFEGKITKRTILSQIAKVYYPLGLMSPVLLPAKLILQEVQNLNPKWDDEMPANINKYWLKLMAQWLDRGEAITIEFPGTSKPSXSVEFHCFCDASIYGMGIAVYQKAKTIIRKDECNLIYAKSLVKPIKVAVHDGTIPKL

SEQ ID NO: 127359 - protein, 140 aa, Heterodera glycines
  Coding regions on vcDNA: vcDNA=SeqID_53782; Strand=+; Position=1-420
MDQPDPTEKQPEETDQPTKSKQQSTKNKEDKELERHRIGRKKTIDMQEKRQRSRDEWPEENETLLSYVQRIYGPENWTSAWQRGRVLRELHELEDQGRWMIHHKSDRLQLSVSRMYGGKRPFAEFRFVEGRYYSHMVPED

SEQ ID NO: 127360 - protein, 47 aa, Heterodera glycines
  Coding regions on vcDNA: vcDNA=SeqID_53783; Strand=-; Position=1 -583,620-661
LCFFFHLFQSASALRFCVLTLLFFPFIPIDHVNSFSIHLVSYFMKLY

SEQ ID NO: 127361 - protein, 21 aa, Heterodera glycines
  Coding regions on vcDNA: vcDNA=SeqID_53784; Strand=+; Position=1 -54,575-586
MRTRPIWQVKQRLLTSQKKGF

SEQ ID NO: 127362 - protein, 68 aa, Heterodera glycines
  Coding regions on vcDNA: vcDNA=SeqID_53785; Strand=-; Position=1-458
AVLVRFITAPNLLASQQSLLNLPDRTGAHDSTVPSTPPKAKRYNQNIRKNFLKNFFSIFLFDTKASEC

SEQ ID NO: 127363 - protein, 76 aa, Heterodera glycines
  Coding regions on vcDNA: vcDNA=SeqID_53786; Strand=-; Position=1 -173,402-461
DATNVEKPVGSIADYDPLAAEKQQQKAPAAGAAAPKANGGGFTVKALYDYTAADKDELGNATGKLRGTSQTARGTV

SEQ ID NO: 127364 - protein, 107 aa, Heterodera glycines
  Coding regions on vcDNA: vcDNA=SeqID_53787; Strand=-; Position=1-324
MIIIVLICYVISNDKEKDKDHTSIGNSKAHKSDLYSDKSNLQPEDAQINQQHRNANRDSNKFDHNHNNGTNTNCDANQHDQHHHANGVDGDSDDNQLDQLYANHQLV

SEQ ID NO: 127365 - protein, 88 aa, Heterodera glycines
  Coding regions on vcDNA: vcDNA=SeqID_53788; Strand=-; Position=1 -154,295-407
MGGNETDGSTIGRRVCSVIIEGKEDNGKEKWQQKEKHTPYYTKASRANSEIQFEFSTFVRIRVRESKLAEMDAGFVFSDPKNPWKSCF

SEQ ID NO: 127366 - protein, 301 aa, Heterodera glycines
  Coding regions on vcDNA: vcDNA=SeqID_53789; Strand=+; Position=1 -231,290-362,420-566,613-701,750-810,870-1022,1075-1224
  Homolog annotation: Hit_ID=EAA59641.1; Match level="QueryCoverage =87%, HitCoverage=32%, E-value=8e-30, Identity=34%"; Hit description =hypothetical protein AN8019.2 [Aspergillus nidulans FGSC A4] ref|XP _412156.1| hypothetical protein AN8019.
ADDVAPPAPSVAVDDFAQRTGQFFDFIRQGNIDRLRALIDSLSVDELNTLLQMRYNEQQFALLVAVMEGHPEIAALLLDKGADVHQTTVGRVNNVTMGEQFAVMPLWIAVNMRHLEMCRVLIAHGADVDLGSDSSFTPLLLACAKGSTAIVTLLVESGANVNLGDSEGVTPIMITSRFGRVEPVHFLLSHGANVEQMDYSGMRFALLDAAADGHLEVCRLLVDDWAADVNQQAIDGTTPLMGACSFGHFEITVFLIEHGADIDHADMDGYNALMWAVKYEKAGVAQHLLAIGANADQVGID

SEQ ID NO: 127367 - protein, 60 aa, Heterodera glycines
  Coding regions on vcDNA: vcDNA=SeqID_53790; Strand=-; Position=1 -22,399-541,609-626
MGSDPLACLKIFSLLVRLIEHVKSFRVIPTMLYLDVKEKSYRGKRAGAETRVPKRKIFVF

SEQ ID NO: 127368 - protein, 73 aa, Heterodera glycines
  Coding regions on vcDNA: vcDNA=SeqID_53791; Strand=-; Position=1 -33,272-460
MLIFPVHILKNGPANKGGPCGGLGSAIAFMSLALQKPVKKFVAVTGRISDCGAVGFVTGIPQKVIAAILGNMK

SEQ ID NO: 127369 - protein, 90 aa, Heterodera glycines
  Coding regions on vcDNA: vcDNA=SeqID_53792; Strand=+; Position=1-273
MGSDNALSCMMRRQKKKILGNVDCVNPMAFVIPDKLRMKNGEDIVLYDSRNVRIGEKDVVLVFGSERVIDQDEIVIKMLILDFGHFEPKQ

SEQ ID NO: 127370 - protein, 34 aa, Heterodera glycines
  Coding regions on vcDNA: vcDNA=SeqID_53793; Strand=-; Position=1 -46,905-963
MAIKIEEYGNYNNKIDIAKHDKETAKKRDDEADI

SEQ ID NO: 127371 - protein, 189 aa, Heterodera glycines
  Coding regions on vcDNA: vcDNA=SeqID_53794; Strand=-; Position=1 -429,493-630
MKNSILTYFFAFILFLLFLKHQFFVDGTKTGKSVEAKKRGETLGQLMTKEGKDKAENLQAEEKQKKKNLGDLISEEKHETLADLLAKERRKEKENPEKTKGKLGELLKMEEIKDDEFDQLLLDLKETEQISFAVFSKPKTAEGEFKGMLARVFSKRKSVKEKKNDDRMGLGEKYERFMSIKANDPALSQ

SEQ ID NO: 127372 - protein, 88 aa, Heterodera glycines; identical to SEQ ID NO: 124691
  Coding regions on vcDNA: vcDNA=SeqID_53795; Strand=+; Position=1 -96,135-305

SEQ ID NO: 127373 - protein, 24 aa, Heterodera glycines
  Coding regions on vcDNA: vcDNA=SeqID_53796; Strand=+; Position=1 -52,295-317
MEKACKIWRDYIDFSALELLELAS

SEQ ID NO: 127374 - protein, 24 aa, Heterodera glycines
  Coding regions on vcDNA: vcDNA=SeqID_53797; Strand=+; Position=1-76
ITGVSIIAVLFLVFLMLSQNLVRF

SEQ ID NO: 127375 - protein, 229 aa, Heterodera glycines
  Coding regions on vcDNA: vcDNA=SeqID_53798; Strand=-; Position=1-690
MKRTNASNITPPRAKRSMAPPLDLDPNTVALAEQERQRTLVFIGLPESNAVRPSERVQEDREATTKILDHLEVEAEPTAVFRLGRFDPQRTTPRPLKVVMPTATHQRVALGGWKRERARLRSQQNMARLFVRPALTKEQLKKEYEERLRKRQQTPTPMAPASSQTNAPTPVVEDGPNQKEASDDISKPPEVFDQTILVCYEALNSFPPTDKIVHQIQSLKKQYPHLFNK

SEQ ID NO: 127376 - protein, 253 aa, Heterodera glycines
  Coding regions on vcDNA: vcDNA=SeqID_53799; Strand=+; Position=1 -129,200-262,420-458,519-606,672-706,760-874,921-993,1110-1215
  Homolog annotation: Hit_ID=CAE61323.1; Match level="QueryCoverage =98%, HitCoverage=41%, E-value=2e-80, Identity=61%"; Hit description =Hypothetical protein CBG05160 [Caenorhabditis briggsae]
FLLDNSYAQMVACMRALARRHPKLVQFITIGKTHEGRSIDGLEIGSRGFRKRAIGSRGFRKRAFWIDGGIHAREWAAPHTALYFIHLLTSRLTSRYGKDAEITRLLDELTWVVVPLLNPDGYEFTRSSTHPNYEFTRSSTHPNVRLVRLWRKNRSPTHCVRDQWGRNRCCKGVDLNRNFDFHFKESGSSDDPCSSGSSDDPCSEIYQGISAFSEPESRSVRDAVLSNRYRGRIDGFITLHTYSQIWIHPYGHK

SEQ ID NO: 127377 - protein, 1282 aa, Heterodera glycines
  Coding regions on vcDNA: vcDNA=SeqID_53800; Strand=+; Position=1-3847
  Homolog annotation: Hit_ID=S08405; Match level="QueryCoverage=77%, HitCoverage=83%, E-value=0.0, Identity=38%"; Hit description =hypothetical protein 2 - silkworm transposon mag
MAAVVKAGKGPGPYTSETSWTIWEERFEFFIKLRGITDAETKKLLFFSEIGPIYKELRQMALPDDVRDMSIDEIKALMEERFGETKTIAAKRFELFSAKQTLGLSIRDYSIQLRTLIAKAEWHKDSVDMCLSALFINGLKKDSIRAELIKKGVNEMKFKDAVETAVLLEQSDLDAEQIGGHKKAEVAKVFAPKGGRKSSAPTQQMQCHRCGRNGHRNNECPNKDSKCRKCGNVGHWAVMCKTKQGSNWPRRQGKPVHQVNTESQKAHDIGTLAKSEEVKSISVPPAMIKLQLSKKATDFELDCGADVTLITKNDWMSIGRPKLGQTSGLMAYGKKPIKVLGSFKTDVVYNGKEVNAEIYVVDGEGKNLCGRDLIGELQIDLNKAFGIRSINEVKCKAVDRELGAVLLKYGEVFNDGLGRCTRQISLKFKPEVQSKKCKPRPVPFALRPEVEKVIDNWVKDGVLEQVTTSEWATPLVIVPKAGNKIRLCCDYKVTVNQWLDIHQYPLPRPEELFSVLNGGEKFSKLDLKEAYLQLMLDDKAKECLTICTHKGLYQFTRMPYGVASAPAIFQQVMEDVLRGIDGVAVYLDDIVVTAPNDAEHLKRLEMTLQRIQKFGLRVKKEKCSFMQKQIAYLGHIIDKEGIRTSPDKVEAIQKMPAPKNLKELQSFLGMVGYYGKFIPSMATISEPLNELRRSETKWHWGQQQQKSFEQIKIMLSSNELLAHFDPKKPLYLATDASDYGVGAILFHKDGNTGKFGVIAYASRTLSPAERNYAQTEKEGRAVIFGVEKFNQYLYGRKFILQTDHEPLKRIFGPKGELPVVAARRLHRWSLKLMNYDFEIEYCSTKNFGYADGLSRLPSPEIDQVCKESLELNKIQQESQNALPITAKDIAKEIGNDPVFAKVKGFVLNGWPTRIEDEKIRPFFLVKDELELNNGCLMLGCRTVIPSKFRENLLKLIHETHPGIVRMKALARQKVWWPGIDKDIESMKKKCKICQTNAPEMRKVPLHPWEVPEKPWQRLHIDFCGPFFGKMWLITVDAKTKWPEVAMMKSTTTEATIEALRKLIWTHGLPEQIVSDNGPQFASKEFEEFCSKRGIERTLTAPYHPQSNGEAERFVQTFKKGMLLVKKDTNWDNELAKNQFLLKYRVTPHSATGRSPAEMMFGRKLRTLLDLVRPSESTKIEGGEEKAKENAEKHGQKYLARAKKNFDRRTWKRSFKTGQRVFARNYRDGSKWMAGQIMSQISPSLFLVRTARGVWKRHLDQLKSDETKPDLESNTDVDSTSSI

SEQ ID NO: 127378 - protein, 204 aa, Heterodera glycines
  Coding regions on vcDNA: vcDNA=SeqID_53801; Strand=-; Position=1-614
  Homolog annotation: Hit_ID=S08405; Match level="QueryCoverage=100%, HitCoverage=17%, E-value=1e-40, Identity=39%"; Hit description =hypothetical protein 2 - silkworm transposon mag
VLLKYGEVFNDGLGRCTRQISLKFKPEVQSKKCKPRPVPFALRPEVEKVIDNWVKDGVLEQVTTSEWATPLVIVPKAGNKIRLCCDYKVTVNQWLDIHQYPLPRPEELFSVLNGGEKFSKLDLKEAYLQLMLDDKAKECLTICTHKGLYQFTRMPYGVASAPAIFQQVMEDVLRGIDGVAVYLDDIVVTAPNDAEHLKRLEMTL

SEQ ID NO: 127379 - protein, 25 aa, Heterodera glycines
  Coding regions on vcDNA: vcDNA=SeqID_53802; Strand=+; Position=1-76
IWCLKSDMLHGGGLCAIVNGSGSAC

SEQ ID NO: 127380 - protein, 353 aa, Heterodera glycines
  Coding regions on vcDNA: vcDNA=SeqID_53803; Strand=-; Position=1 -473,542-606,668-773,2267-2276,2411-2574,2766-2830,2895-3019,3080-3135
  Homolog annotation: Hit_ID=NP_491237.1; Match level="QueryCoverage =77%, HitCoverage=50%, E-value=9e-40, Identity=52%"; Hit description =protein phosphatase 1A (34.6 kD) (1E406) [Caenorhabditis elegans] gb|AAB42233.1| Yeast glc seven-like pho
KQLEDGRTLPGYNIQKESTLHLVLRLRGGTLSSASLDAIIAKVNRSPPHRFTDEVEKFLSFSNINFPPPPFFPQQISDDEIRQLFKAAKAAFRDQDTLVRIHPPAVIVGDIHGQFADLKKIFSTHGLPPEQQYVFLGDYVDRGPQSMETIILLFCYKVKYPSNFMLLRGNHECANINRVYGFYDEIERRYPRPGARRLFDLFNQVFAWMPFVGLLKSGKQLEDGRTLPGYNIQKESTLHLVLRLRGGTLSSASLDAIIAKVNRSPPHRFTDEVKYPSNFMLLRGNHECANINRVYGFYDEIDRRYPRPGARRLFDLFNQVFAWMPFVGLVGEKILCMHGGISDQIRSLTSSAA

SEQ ID NO: 127381 - protein, 208 aa, Heterodera glycines
  Coding regions on vcDNA: vcDNA=SeqID_53804; Strand=-; Position=1 -126,188-252,342-439,741-1078
  Homolog annotation: Hit_ID=NP_956157.1; Match level="QueryCoverage =40%, HitCoverage=46%, E-value=6e-10, Identity=39%"; Hit description =ubiquitin-conjugating enzyme E2G 1 [Danio rerio] gb|AAH45512.1| Ubiquitin-conjugating enzyme E2G 1 [Danio
MTTTTRTNARDSPRRVLMRQFEMLLQNSNANIGFRACINDGNSHPFKQIFKWRIFIDGPPDTPYAGCTFTALLKFPASFPSYPPTMTFLTDILHPNSFVPQRPGTIQGGSASTCGDGDSEDGTNTTGSATAAGRAWDATAGRTEDATAGRTKGATAGRTEGSTAGRTGDATAGRTEDDATAGRTGDATASDTAAGRAAATNGRMVHLM

SEQ ID NO: 127382 - protein, 367 aa, Heterodera glycines
  Coding regions on vcDNA: vcDNA=SeqID_53805; Strand=+; Position=1 -750,803-881,939-992,1047-1267
  Homolog annotation: Hit_ID=NP_499756.1; Match level="QueryCoverage =34%, HitCoverage=61%, E-value=2e-22, Identity=40%"; Hit description =polyposis locus protein 1 family member (3O468) [Caenorhabditis elegans]
MSSDDADKAAAKDGPAPDTPSDAKVTDGGPPTATEDKPKEQTEAKVPDEPTATKEEPKVPDEPSTTKEPTAPVTDGPPSEAKGDKSDEPKVSDEPATKVPDEPPATEPPKDSATTEGSDEPSTDTPKDSATTEGSEDEAPAPEDQPKKADEKKSEEAASEPPKAPEDQPKKADKKKSEEAPAKEPKKKADKKKKSKSEESVASVSVRLQPRKVPVNSFKDVRPTVQKSLAGLKYPFIKKLEKQAGMDREKLFYSALAVLSVYLMVGPGNTFLSALIVKAWPVYQTILAVHTQNRKDDTQWLAFWCAFAAFSVLDHFFAPLELLFGLYLLFKTAALLYLGLPQTYGAHNLYVKHVHPLVDRLGKIKVK

SEQ ID NO: 127383 - protein, 68 aa, Heterodera glycines
  Coding regions on vcDNA: vcDNA=SeqID_53806; Strand=+; Position=1-296
TITKKTTAIAIFSIIFRQSHIFNFNWLIIMMYLYVQLSLEHKMNFVTCIHRILVKNKWKKMQKLTLYS

SEQ ID NO: 127384 - protein, 278 aa, Heterodera glycines
  Coding regions on vcDNA: vcDNA=SeqID_53807; Strand=-; Position=1 -118,538-747,822-913,973-1175,1725-1939
  Homolog annotation: Hit_ID=NP_504583.2; Match level="QueryCoverage =42%, HitCoverage=25%, E-value=6e-46, Identity=77%"; Hit description =expulsion defective protein 2 like family member, EXPulsion defective during defecation EXP-2 (53.1 kD) (
SVLRRVGVSAGAIVGDEQRGKGGRNQLRQIVLRPIAAPNVTEYIPTGNRSVITSNGTSIEREEFEAVRVEHPAFVFTERICIAFFTIEYCLRLFAAPRKLRFALKPLNLVDILAILPFYLELMLTLLGVDDKKLRDLRWAFLVVRILRVLRVIRIIKVRYLLIVFCPIISFSFAVGSLLQRSANLRHDFAAESEAIANDGHRFADRSALPITIIVDNFIKVAQEEQQTEQIKAELLAMEDQEKQQAQEQQKRREKIDKCNGGDNRGFGGGGTQMLLAS

SEQ ID NO: 127385 - protein, 226 aa, Heterodera glycines
  Coding regions on vcDNA: vcDNA=SeqID_53808; Strand=-; Position=1 -25,1267-1458,2021-2143,2273-2317,2371-2460,2515-2594,2706-2792
  Homolog annotation: Hit_ID=CAE64510.1; Match level="QueryCoverage =100%, HitCoverage=40%, E-value=3e-53, Identity=51%"; Hit description= Hypothetical protein CBG09245 [Caenorhabditis briggsae]
QLLFRQLRVSGNMIAAAQQQHRKRRLAIRKTDSMNLAERHNGRILDLIWCGGRAVIQQGKTNGENDRGNCELLRLNIGGSTFLILVEAILRADPTTFLARFVQLNHQTRLKVADAYLQSECAYYFQRSPLARSPLAFEPVLQYYATGVVHKPPEECPSAFNAELEFWRISTSYIGNKAELEFWRISTSYIGNKCILMDLQKMTDSKEDPNFDPVSGRLRRRMTFLE

SEQ ID NO: 127386 - protein, 226 aa, Heterodera glycines
  Coding regions on vcDNA: vcDNA=SeqID_53809; Strand=-; Position=1-681
MKILLLYFLLFSIFQLNQSESENKKLQQQKSFDEIFGEKWEEKEEEKLEEKREIIGKYYKIKEKIKQKGRKYTAKEWNKINSKIAKKLGTNRNKTNQWIKELGLNQRIQKSYKSTTDEEKLEIVQKFIGIKNEYKQKRKYSAKEWHQNYAEICKKIGVSKGTIIKWKKQFGMSKFITQKEKLEKMKIYWKIKRENPKMSDKEIAKILKIDRTTISKWKKQFGEELF

SEQ ID NO: 127387 - protein, 30 aa, Heterodera glycines
  Coding regions on vcDNA: vcDNA=SeqID_53810; Strand=-; Position=1-90
MPQQENAANCVPCATENGRRTRNLTKITVM

SEQ ID NO: 127388 - protein, 45 aa, Heterodera glycines
  Coding regions on vcDNA: vcDNA=SeqID_53811; Strand=+; Position=1-261
KLCMSSKGFIDICIDIHSILFYFTLHFILLYFLTLFILIFFLCAT

SEQ ID NO: 127389 - protein, 45 aa, Heterodera glycines; identical to SEQ ID NO: 127388
  Coding regions on vcDNA: vcDNA=SeqID_53812; Strand=-; Position=1-250

SEQ ID NO: 127390 - protein, 188 aa, Heterodera glycines
  Coding regions on vcDNA: vcDNA=SeqID_53813; Strand=-; Position=1-567
  Homolog annotation: Hit_ID=XP_309989.1; Match level="QueryCoverage =86%, HitCoverage=59%, E-value=3e-22, Identity=31%"; Hit description =ENSANGP00000015194 [Anopheles gambiae] ref|XP_319667.1| ENSANGP00000022407 [Anopheles gambiae]
MSADQIKQFLEAMRVQSDAIQQLMGQAPQNAASASLNQANLASSIDGRISKFNYDAETGNTFEQWFKRFGVLIEEDGKDLPESTKVRLLLGKLGDDEYGKYRDSISPTQPDKVTWVDSITKLKGLYAETRSLFVRRYECFKIRQQPSQDISSLVAHINASCENANLSPTKEQLKCISWSLHSTTSTTT

SEQ ID NO: 127391 - protein, 50 aa, Heterodera glycines
  Coding regions on vcDNA: vcDNA=SeqID_53814; Strand=+; Position=1 -41,360-471
MPSKKALVVLNTKLNADSPKTRSEHQFSSAINGGATLDKSKADGNDEKAN

SEQ ID NO: 127392 - protein, 25 aa, Heterodera glycines
  Coding regions on vcDNA: vcDNA=SeqID_53815; Strand=-; Position=1-76
REKKIMFFSGTLYLLVHISFFRTVC

SEQ ID NO: 127393 - protein, 39 aa, Heterodera glycines
  Coding regions on vcDNA: vcDNA=SeqID_53816; Strand=-; Position=1 -42,315-392
MDTFKISDRQYSYYQKCQISGNILHRWVDCDRSEKTFIA

SEQ ID NO: 127394 - protein, 149 aa, Heterodera glycines
  Coding regions on vcDNA: vcDNA=SeqID_53817; Strand=+; Position=1 -54,97-209,253-380,1574-1618
  Homolog annotation: Hit_ID=NP_492109.1; Match level="QueryCoverage =93%, HitCoverage=15%, E-value=3e-19, Identity=35%"; Hit description =metalloprotease III family member (1I107) [Caenorhabditis elegans] emb|CAA96596.1| Hypothetical protein C
AYDFGSVMHYPAGGNHEQRGLYDLITLPRFYQQTIGQRERIHEQRGLYDLITLPRFYQQTIGQRERISFKDAAIINRIYCEDSCKGHEDKCQNSCKGHEDKCQNGGYLKPNDCTKCNCPDGYGGQNCKELEESENYQKTGNNKKIGTIN

SEQ ID NO: 127395 - protein, 88 aa, Heterodera glycines; identical to SEQ ID NO: 124691
  Coding regions on vcDNA: vcDNA=SeqID_53818; Strand=+; Position=1 -96,135-305

SEQ ID NO: 127396 - protein, 202 aa, Heterodera glycines
  Coding regions on vcDNA: vcDNA=SeqID_53819; Strand=-; Position=1 -37,1041-1211,1254-1474,1527-1706
MLISALQRRLLRRFLAHKNPGPTNQEIKTKRNKEKLEHEGSLYVLHKLSDDGLRKYWRCEFFGANDKCKGRLHTDINGNVLKIIGSHTCDMSAAHVECQRRITQLKRRAVETCEAPATIRAQVLQNTATPVLAAFPTKAATKQVIKRVRHDENVPPAAPLSLEALELPPAYRMYKRTETDEENFLLADTGVFQIQGQAGPQR

SEQ ID NO: 127397 - protein, 44 aa, Heterodera glycines
  Coding regions on vcDNA: vcDNA=SeqID_53820; Strand=-; Position=1 -74,158-218
MKCGVCNETFLFYIVTWQFSSENWGTKKSSSLFLQKKEKNLNPN

SEQ ID NO: 127398 - protein, 56 aa, Heterodera glycines
  Coding regions on vcDNA: vcDNA=SeqID_53821; Strand=-; Position=1-594
RQNAHLKLRKHKLIFAIRTDYLVNRKQINHKIRTKNDFILECKLKMHNKLIYSNLF

SEQ ID NO: 127399 - protein, 34 aa, Heterodera glycines
  Coding regions on vcDNA: vcDNA=SeqID_53822; Strand=-; Position=1 -44,405-465
MGMRRLKRALPFRDRALTSKMGSIFFFKNATFVE

SEQ ID NO: 127400 - protein, 51 aa, Heterodera glycines
  Coding regions on vcDNA: vcDNA=SeqID_53823; Strand=-; Position=1-316
PKNSYLFFLIFLPQTWYQQLPSLVWPYQTILRYLKRKQKKFLTKKWLSLFS

SEQ ID NO: 127401 - protein, 118 aa, Heterodera glycines
  Coding regions on vcDNA: vcDNA=SeqID_53824; Strand=-; Position=1-469
PKNSYLFFLIFLPQTWYQQLPSLVWPYQTILRYLKRKQKKFLTKKWLSLFSHFFTANLVPTVAFSCLALSNNLTIFETQTKKILDQKMAISFFSFFYRKLGTNSCLLLSGPIKQSYDI

SEQ ID NO: 127402 - protein, 34 aa, Heterodera glycines
  Coding regions on vcDNA: vcDNA=SeqID_53825; Strand=-; Position=1-102
MRSRAKRVATDVSQVVTIRSRRFALRAFVTVHAT

SEQ ID NO: 127403 - protein, 16 aa, Heterodera glycines
  Coding regions on vcDNA: vcDNA=SeqID_53826; Strand=-; Position=1-49
EAIPEGFGLPINLGAS

SEQ ID NO: 127404 - protein, 18 aa, Heterodera glycines
  Coding regions on vcDNA: vcDNA=SeqID_53827; Strand=+; Position=1-55
MCFAIFGQRMANVRGAIQ

SEQ ID NO: 127405 - protein, 40 aa, Heterodera glycines
  Coding regions on vcDNA: vcDNA=SeqID_53828; Strand=-; Position=1 -37,1191-1274
MCEGWGASRSAPANFLPFHCCARVWRSAAGQMGRGLGAGE

SEQ ID NO: 127406 - protein, 53 aa, Heterodera glycines
  Coding regions on vcDNA: vcDNA=SeqID_53829; Strand=+; Position=1-168
AKPKFLFSNLFCLFSFLFTTVSNFLVSIFPLVSNFLVSNFRCPIFWCPIYREP

SEQ ID NO: 127407 - protein, 191 aa, Heterodera glycines
  misc_feature (10)..(10): Xaa can be any naturally occurring amino acid
  Coding regions on vcDNA: vcDNA=SeqID_53830; Strand=-; Position=1 -186,620-674,733-872,1521-1680
  Homolog annotation: Hit_ID=NP_501358.1; Match level="QueryCoverage =100%, HitCoverage=100%, E-value=9e-47, Identity=49%"; Hit description=putative protein of bilaterial origin (21.3 kD) (4I894) [Caenorhabditis elegans] gb|AAB92069.1| Hypothe
VIPKISKQLXFSRLFILVFFTLLVFRSHSFGPLDTIFSPGSDSFAYENPWPMLNKGRLDWLFNDGWRRPLAADQGAHMRRQWIYFKCIPRDRRQWIYFKCIPRDEHKDWKKWHGTMPIFGTGCFVMLTFVWQYCNSDWPSAKEWALREAHFELVRRERAGLPLISPDLIERSRVEAALPAEEELRDFEILI

SEQ ID NO: 127408 - protein, 134 aa, Heterodera glycines
  Coding regions on vcDNA: vcDNA=SeqID_53831; Strand=+; Position=1 -43,353-498,590-805
  Homolog annotation: Hit_ID=AAC46878.1; Match level="QueryCoverage =74%, HitCoverage=27%, E-value=1e-17, Identity=48%"; Hit description =cathepsin B proteinase
MTISILGQIFEEIPAIDWHTLSRNVCWEQVIKEELFYNGSIPVDFIVYNHLFVYDGGILLQRREDGVQRGAHVVRLIGYGRVNCTDGRRVKYWLGVNSWNTSWGENGGFFRIKRGENVFGIESRDISFGRVELP

SEQ ID NO: 127409 - protein, 365 aa, Heterodera glycines
  Coding regions on vcDNA: vcDNA=SeqID_53832; Strand=-; Position=1 -171,301-384,442-672,1027-1152,1209-1403,2254-2349,2739-2933
  Homolog annotation: Hit_ID=NP_871817.1; Match level="QueryCoverage =53%, HitCoverage=48%, E-value=1e-63, Identity=58%"; Hit description =oxysterol-binding protein (1G409) [Caenorhabditis elegans] gb|AAN84853.1| Oxysterol binding protein (osbp
VSFIAEQVSHHPPVSAFYVEHPEAGVSCTTHIYTKSSFLGLAIGVQMVGKATVRIHKHHETYIATFPNGYGRAIMATPWFELAGKVELRCEKTGYRAEIDFLAKPFFRGKAHQIHGQIFHTSRKTALMQLKGEWNGEIYLKRDGATDYQLFTDVRQKPDVRKECVPVREQEDRESRKLWRHVTAALFSNNIEIASQCGLKANIYQSDALSNANGTKRWGVSGSVTSGNRASLSASATVHRPTRGGTVTRWSNGRRRTGRSYGAVQQPNRVGHAAVALYRSALKSEEGRNALDYWAQHGEMKIVLRADSASQLSELCKQAHQHGLIAQLIHDAGHTQIPAGSCTVLGIFGPREEIDEVTGHLKLHN

SEQ ID NO: 127410 - protein, 88 aa, Heterodera glycines
  Coding regions on vcDNA: vcDNA=SeqID_53833; Strand=-; Position=1 -72,380-574
MRLVQSLNNRVKRKKENAKWEPWTELMSKKKLKQKSDVKKPVAFTCRCHCPPLEPIDQPSRTNETDQYTKICPKKAQLKWTTTLVGLG

SEQ ID NO: 127411 - protein, 28 aa, Heterodera glycines
  Coding regions on vcDNA: vcDNA=SeqID_53834; Strand=+; Position=1-87
ILHIDREKNSESIIRKFNTKIRPTLELF

SEQ ID NO: 127412 - protein, 178 aa, Heterodera glycines
  misc_feature (1)..(1): Xaa can be any naturally occurring amino acid
  misc_feature (166)..(166): Xaa can be any naturally occurring amino acid
  Coding regions on vcDNA: vcDNA=SeqID_53835; Strand=+; Position=1 -83,137-201,635-876,997-1094
  Homolog annotation: Hit_ID=NP_498412.1; Match level="QueryCoverage =87%, HitCoverage=13%, E-value=1e-43, Identity=55%"; Hit description =peptidase M16 inactive and insulinase-like peptidase, family M16 (111.2 kD) (3H529) [Caenorhabditis elega
XMLKMVWKKTADILIGGKVPLAIYHSNRSKIRVFVAETPGPMVDSKIRVFVAETPGPMVDGHITFVTETHTNDGLPHTLEHLVFTGSQRYPYKGMLDIIANRCLASGTNAYTDQDNTAYELRTAGSSGFLKVLPVFLDHLLRPTLTQSQYDTKVHHINGEGGGLIXAPPKNKKKNYNK

SEQ ID NO: 127413 - protein, 171 aa, Heterodera glycines
  Coding regions on vcDNA: vcDNA=SeqID_53836; Strand=+; Position=1 -215,259-375,432-506,569-677
MKKGEDDTATAAAAVPRGKRPNSNSVSAAHFSTESEEMKSCKKEEPMATGCRKGAKRQYPYSLMSARAQDVWSLKLDQLEEKYSRMEEELSEDSDDAIDFYEDGIDDIVEKINRFEAKVKKWSVNHGNTPVVKKPRYNTNADENSNDADDDAPTSTVYLNLHNDKMIEKSN

SEQ ID NO: 127414 - protein, 64 aa, Heterodera glycines
  Coding regions on vcDNA: vcDNA=SeqID_53837; Strand=-; Position=1 -38,392-548
MPSVCRVTRTCAHFSSECVTLYEFRPAGVRVEGNSAEFAEGFVRVPITCQCQLRRKKKHGIYSN

SEQ ID NO: 127415 - protein, 37 aa, Heterodera glycines
  Coding regions on vcDNA: vcDNA=SeqID_53838; Strand=-; Position=1 -78,347-370,1182-1193
MEIGIARSLQLLLSSVLLISALYLYLPFPRLVHTAWQ

SEQ ID NO: 127416 - protein, 33 aa, Heterodera glycines
  Coding regions on vcDNA: vcDNA=SeqID_53839; Strand=+; Position=1 -52,94-143
MNNIAFIAFAFSALFEFGLAQPKPTPENGLNNF

SEQ ID NO: 127417 - protein, 115 aa, Heterodera glycines
  Coding regions on vcDNA: vcDNA=SeqID_53840; Strand=+; Position=1 -63,170-331,1030-1152
  Homolog annotation: Hit_ID=AAP30763.1; Match level="QueryCoverage =73%, HitCoverage=17%, E-value=7e-14, Identity=53%"; Hit description =putative gland protein G8H07 [Heterodera glycines]
MLKIPNHQWIRHLRFIENWPKKNKENAQTSKDQPTSAGGQNEAIPSPKKPSPKGKLKSDFRPKLGQELFHGRFRKRKMKKMHRPQRSRHRWKGKMNQSLHQKSQAPRGSPKAISS

SEQ ID NO: 127418 - protein, 364 aa, Heterodera glycines
  Coding regions on vcDNA: vcDNA=SeqID_53841; Strand=+; Position=1 -108,184-279,356-1248
  Homolog annotation: Hit_ID=NP_608540.1; Match level="QueryCoverage =90%, HitCoverage=66%, E-value=4e-36, Identity=28%"; Hit description =CG2839-PA [Drosophila melanogaster] gb|AAF51469.2| CG2839-PA [Drosophila melanogaster]
SLKRGVKKGAHLARDKAKDANSYMHEKGRHHSENNEIPRHHSSSSSMSKGRHYSSAKEGNQNKRSRKETKNLNNKGEKGENVRNFEENEQKTTEENLEEEKEENMEEEKEEKEKMEEKKEEEKEEKMEEAKEEENEEKEKMEEKKEEEKEEKMEEAKEEENEEKEEGGEKSLESEELRRRRPGRKFGFNNISKSEEEEEEESEEENPLEEKKEKGEEKEREENGGEMEKQNAKKEEEESAKTGEEMGKENAKKGEEKEKESANKGDKTGNKTNNENSGGEKQKETATNGKKNDKKEGQKKKNNEQNAKDMDKNGKKEKGQMAKENETKSANNGTVQSATGANANGGAAKWGGQRASANNSKTVQ

SEQ ID NO: 127419 - protein, 139 aa, Heterodera glycines
  Coding regions on vcDNA: vcDNA=SeqID_53842; Strand=-; Position=1 -223,617-725,787-820,1102-1155
  Homolog annotation: Hit_ID=CAA33463.1; Match level="QueryCoverage =53%, HitCoverage=1%, E-value=5e-17, Identity=59%"; Hit description =twitchin [Caenorhabditis elegans]
MGDDDWTRANIGVPGAKTVRDTRCTVKDLPEKEQFEFRVRAVNKAGEGEPSNLVFTTDQPGRPVFDMSNLKDTTDSSDQPLSSTARRSESRRPKSARKEAAALTPLDAMQCSHLTPPHPKNMCIWIDLGNKDVLWYKKF

SEQ ID NO: 127420 - protein, 163 aa, Heterodera glycines
  Coding regions on vcDNA: vcDNA=SeqID_53843; Strand=+; Position=1 -102,360-419,471-560,660-698,822-1022
MKRPSSVVAFGSHLFVGFILLSLFIGTLGTEKKEAKHPPPVAAHAAAGAGHASDPKHASPSPAGAAAAASHAHPPNGGAAHAAEPKHAAAPAIKITDEANNVYSVCVERDVLPAPENASKDKLKAIAAKCDECGAAKCKAKCGGKEVNDACRTCIMQNCPPAK

SEQ ID NO: 127421 - protein, 92 aa, Heterodera glycines
  Coding regions on vcDNA: vcDNA=SeqID_53844; Strand=-; Position=1-304
MIGRAVRNRPFIFEGIFKFILYPRKMSISFFEKFYTSQKRLRMRRRAVHNRHFISQRIFIFRGYPRKMAISFFDKFYTHTNALEHDREGGAQ

SEQ ID NO: 127422 - protein, 92 aa, Heterodera glycines; identical to SEQ ID NO: 127421
  Coding regions on vcDNA: vcDNA=SeqID_53845; Strand=-; Position=1-304

SEQ ID NO: 127423 - protein, 37 aa, Heterodera glycines
  Coding regions on vcDNA: vcDNA=SeqID_53846; Strand=-; Position=1 -49,96-159
EAIPEGFGLPINLGASGPFGGLQKLWGGKIQRRIKGQ

SEQ ID NO: 127424 - protein, 36 aa, Heterodera glycines
  Coding regions on vcDNA: vcDNA=SeqID_53847; Strand=+; Position=1 -76,199-233
MLSAPFGALLGAVVAVAVLLPSHCNDRKRVGPGSTP

SEQ ID NO: 127425 - protein, 19 aa, Heterodera glycines
  Coding regions on vcDNA: vcDNA=SeqID_53848; Strand=-; Position=1-70
IYFTRNEKVKVILIRLIGL

SEQ ID NO: 127426 - protein, 493 aa, Heterodera glycines
  Coding regions on vcDNA: vcDNA=SeqID_53849; Strand=+; Position=1 -146,198-562,605-808,858-1032,1062-1260,1306-1418,1466-1604,1670-1812
AEPLGNELQEALSSAAFLDDFMPFVLAFEFVAKFCGENGGTTKLCKEKCLSQSLVAPKTKAPFVGPTKFHGTTPRSVPKTTFGIVPTTEQTFAFKPFVRHVDHFGTNCTNIFFTSEVDKFLLNITATPYEIACNDYEKRAKIDEPIPSDYWSGGRFVNACMAVPSAKCEKHVELYACYESIGNKPSVNAIGELCQKHLNNAINAAGFAVQICAHRHQTEATNELIVESFINFSFTNEPFQKTRILPISMDKIWDTKKKTPYFLIEFGQDEQKSAIREKGDGENFGGAKWLNEAKSNNDGIGSILKDIAPQIVDGTLAKMIHFVPPSNDDKMLPFFQIERPKYSKFITNDTDLLPYKNDPNNTRRATPCDIYGADCVPIRNLLLKIEALENCGKNESENDAIFKMPPWAPPLPPPVTMKKPSETLLCGGDMFCDKRRLQQQYNRLREICGLKPEEMENQREKRQYDPYQKWTESPIKIAFNKTARNNLATSYSI

SEQ ID NO: 127427 - protein, 175 aa, Heterodera glycines
  Coding regions on vcDNA: vcDNA=SeqID_53850; Strand=-; Position=1 -114,178-322,727-995
MGKDKQGGYDPDIHGNWQNEEKPCACHCSYLRAKKFYRVECDFMNRTTKRWANAGRVTLGLLSAPLLFVPVVNELVARPQLQSVGQDITHTALEVHFECGLCGQIAYRTYEIVCEDVTSDRWGRYMKTYGDEPIFGIGTTEFDGIQRVFDGMWKNYDLIYRNCKDWTSEMIERLS

SEQ ID NO: 127428 - protein, 64 aa, Heterodera glycines
  Coding regions on vcDNA: vcDNA=SeqID_53851; Strand=-; Position=1 -29,643-808
MQSQSANAMDLQSVKLATSFRQSTSRHGVFRSTAAEICNLMSQCEWRTAEAEGSSNNNGGKTEH

SEQ ID NO: 127429 - protein, 72 aa, Heterodera glycines
  Coding regions on vcDNA: vcDNA=SeqID_53852; Strand=-; Position=1 -12,96-275,573-599
MKIKVKLFGAGAICHFEDFSTRSAAKAEEVNLFKNVVIYFFFKFKQKMFFFVKARKKAPILFYLIRKSELVK

SEQ ID NO: 127430 - protein, 106 aa, Heterodera glycines
  Coding regions on vcDNA: vcDNA=SeqID_53853; Strand=-; Position=1 -134,397-583
MNELMSKKQNKNCTKIVNKLTRKSIKNHSKIQLETNLEKGSENIYGQQILAFVQQMKQQMASLAATSTSANLTGFELCAQTNTTTKNGPQQLGSLNSVVKSKTEIS

SEQ ID NO: 127431 - protein, 74 aa, Heterodera glycines
  Coding regions on vcDNA: vcDNA=SeqID_53854; Strand=-; Position=1-225
SKLANHWGIVPLATDNGTADQQQLFTLPNNVHLYPGKSFASAGISVNGADRPEIVILDVQSVLCTEKHDDAATN

SEQ ID NO: 127432 - protein, 82 aa, Heterodera glycines
  Coding regions on vcDNA: vcDNA=SeqID_53855; Strand=-; Position=1 -59,524-713
MSKEGPTDEDAIIAVALGIWQNTIQYKTEATACKCVNKHFKKNRFLWRENRRNKYKPSGSPNSDLPPNERNEAFTHRKLKFL

SEQ ID NO: 127433 - protein, 72 aa, Heterodera glycines
  Coding regions on vcDNA: vcDNA=SeqID_53856; Strand=+; Position=1-219
LHNNKSCNIVEKLNIRNTKQFNIDIRVEEGNGLFTVTFDTGGKATKCQYRSPDMPTWAVQYITVRTELAQLI

SEQ ID NO: 127434 - protein, 113 aa, Heterodera glycines
  Coding regions on vcDNA: vcDNA=SeqID_53857; Strand=+; Position=1-342
MPSKEQRRKEAMRLRSRAIRHTPDVGNALVGPSTIGQQPLDLDQGSGCFSYENLNLFVEPSTSTGIRAQIRQQRNDRQAIVGTPAMQLDTSVVSTPTTEGIRTLTIVGGLDLS

SEQ ID NO: 127435 - protein, 180 aa, Heterodera glycines
  Coding regions on vcDNA: vcDNA=SeqID_53858; Strand=+; Position=1 -101,667-773,851-1185
MWDQCLDNAVRLEQRLLPHVIYDDAEHEAHHNDLTPSFDQIKQMIEAIRTQGDCPAVDILAPADNLTVYDAFVCKVLADVLDILKRQRFYTNLELIERDARARGEAKWQNAAEAAGAVDASATGSSATTTDGKGTAAAKGEDDPLMLAGPSSLSVEQHNLVAHVTSTHEKAGVLRFWKKI

SEQ ID NO: 127436 - protein, 34 aa, Heterodera glycines
  Coding regions on vcDNA: vcDNA=SeqID_53859; Strand=+; Position=1-104
MKMKISDDNVTSMVCAKNFTENSDQINHINYTPD

SEQ ID NO: 127437 - protein, 27 aa, Heterodera glycines
  Coding regions on vcDNA: vcDNA=SeqID_53860; Strand=-; Position=1 -24,194-253
MLIGKTNKADANMKYLGLNATCSMLPE

SEQ ID NO: 127438 - protein, 96 aa, Heterodera glycines
  Coding regions on vcDNA: vcDNA=SeqID_53861; Strand=-; Position=1 -45,91-169,509-675
MPNLIVHLSNSREIKQNKEGAHDGAVPPSDNSSNDVAGRTTHRQHSEVPFPGAEAGRASGGHFCQHRRLRFVPPAQLENRQRKGRGGGTERIGATL

SEQ ID NO: 127439 - protein, 622 aa, Heterodera glycines
  Coding regions on vcDNA: vcDNA=SeqID_53862; Strand=-; Position=1-1866
  Homolog annotation: Hit_ID=XP_318550.1; Match level="QueryCoverage =87%, HitCoverage=54%, E-value=1e-120, Identity=41%"; Hit description= ENSANGP00000020240 [Anopheles gambiae]
MTSDLLLTHYNPALPIIVAADASKNGIGATIGHVFPDKSEKVIEHASCVLSNSQQNYSQIEKEALALVFAVQKFHRMLFGRKFTLFTDHKPLLAIFGSKKGIPIYSASRLQRWALIMANYDFDIKYTNTASFGQADVLSRLIANYPKPEEDVLIANICVETDCYINTILQSQTDHLPVTAQEIAESTTKDETLQKIVNFVISGWPTKCREPEIAPFHPKRNEILEIGGCLLYKSRVIVPSQLRGRILKALHFAHPGIVRMKALARQYVYWPGIDSEIERVVRQCDECQGAQKCPIKAPLAPWTVTDKAFQRVHIDFAGPCQDGYVYFILVDAFSKWPEVYQMSSITAKSTVFTLRSIIHRLGIPEEIVSDNGTQFKSAEFAAFCKEFGIKHTFSPPFHPQSNGQVERFVDTFKRAMKKCSTDDKNWTGKVLLAYRTTPNNAIDGYSPDQLFFGRKLRTKLALVLPQEHKNNSENIDKIQLNKRRKDYSNNMAKQFDGRHGVKEKVFFPAEPVLLLNYRNQKTYWLHGTIVERVRNSPTYRVHVTVLGRIVHRHSNQLRRNCVFEENSKHNPGPDQQPIPPVNGQAQNLAHQIADPVDQRTDQQAANDPPTMALRRSQRKPKP

SEQ ID NO: 127440 - protein, 220 aa, Heterodera glycines
  Coding regions on vcDNA: vcDNA=SeqID_53863; Strand=+; Position=1 -225,355-517,775-1049
LALLENANFNKEIERTSEFLFTDYGESANFIDNRFEWHCRQLSFLILLEGPTLMDRIVNRVLEDRTESVMLNFVKFVKCTPGLLNCAPPVELLKRLREAIDREGQNLLLVRLKFGLTSQCDNIKRIEDIDSASATLKRQTVNTAQQGQIINATKPGQIANATQQRQIVSTAQPGRIANSAQQRQPVNSQFAQQRQIVGTGALRNRGKDARRNATRQRKAA

SEQ ID NO: 127441 - protein, 69 aa, Heterodera glycines
  Coding regions on vcDNA: vcDNA=SeqID_53864; Strand=-; Position=1 -36,668-788,914-966
MESLIIIDTFFKKVIYEFFCIHKIGGKYRRKSIQSATTSMGAVALDMLEGMDRAYVMCICVYCSIGSFM

SEQ ID NO: 127442 - protein, 52 aa, Heterodera glycines
  Coding regions on vcDNA: vcDNA=SeqID_53865; Strand=+; Position=1-156
QLKIMEKSANNFSKILWTQNEHRFQQICALPFIREQKDGTLAEERYRHYIIQ

SEQ ID NO: 127443 - protein, 35 aa, Heterodera glycines
  Coding regions on vcDNA: vcDNA=SeqID_53866; Strand=+; Position=1-105
MMLSAEFGALLMLLLLSFGAPEMSLLVGTGFGVAQ

SEQ ID NO: 127444 - protein, 19 aa, Heterodera glycines
  Coding regions on vcDNA: vcDNA=SeqID_53867; Strand=-; Position=1-57
AGVGEARLSTRSRSRRRSP

SEQ ID NO: 127445 - protein, 62 aa, Heterodera glycines
  Coding regions on vcDNA: vcDNA=SeqID_53868; Strand=-; Position=1 -22,180-241,474-578
MDLPFGYVPPCFDLEESCLNFVTHCNVPSVAQVCSQSCGLCHGPFPYGQGQLPYGQPPILTG

SEQ ID NO: 127446 - protein, 125 aa, Heterodera glycines
  Coding regions on vcDNA: vcDNA=SeqID_53869; Strand=-; Position=1 -99,144-270,412-563
MCNLEWRVFDFSQMVSGRVRQLNSYAWKVFAMAHVFSEYDTVVWVDTSISFDNDNLSSILRQIQTGQIGPVQLLGWMYKYLPMVANFGPNKTYEWTGNDDPPQFEANLVIIHKTEQTRQLMKWHD

SEQ ID NO: 127447 - protein, 317 aa, Heterodera glycines
  misc_feature (309)..(309): Xaa can be any naturally occurring amino acid
  misc_feature (311)..(311): Xaa can be any naturally occurring amino acid
  Coding regions on vcDNA: vcDNA=SeqID_53870; Strand=-; Position=1 -79,496-562,615-726,848-920,965-1124,1249-1389,1501-1694
  Homolog annotation: Hit_ID=CAE68625.1; Match level="QueryCoverage =93%, HitCoverage=27%, E-value=1e-52, Identity=40%"; Hit description =Hypothetical protein CBG14512 [Caenorhabditis briggsae]
QIFNANSKQNATLIQNMDTSGQTIKTKRSSVSKLSVQRNAVFDLLKQLATDNFTYFRQNCSSSVLATDNFTYFRQNCSSSVYGKRMSECCDDLSASADLMREIIRKLQFASQKCDYDENTPGNGFRSLVCITDIVLLHLVSVLRICGNGFRSLVCITDIVLLHLVSVLRICSESRGILMFRLAYYCKEIEAYSAILRFLVLAYQVVLLFNRLDGGSLFPPLEGDYQQYNILFKGIESLDGSCFYGRPLGFQFFFFPSVTRIFRVIGLVLATYSLSWENGSAALSSLINSDGMLLNPEQRAKTLKKVTFXLXEFFSHF

SEQ ID NO: 127448 - protein, 242 aa, Heterodera glycines
  Coding regions on vcDNA: vcDNA=SeqID_53871; Strand=+; Position=1 -47,106-381,432-837
  Homolog annotation: Hit_ID=AAL78214.1; Match level="QueryCoverage =58%, HitCoverage=75%, E-value=2e-11, Identity=30%"; Hit description =putative esophageal gland cell protein Hgg-20 [Heterodera glycines]
MSDNPKEAEKEMEKAIFIAADCWLEVFDLLPPSQLGLGIAMISRRFDYFIDEHFKTRKWKLGKMKIRRKIGQNGANEMKIVNSNGKALQIPQNPLPKKVMAFKSIEIDFIDQNVITFLGHFHRFFAACSTTLSIDTENVRVSEFVVRTIWPMFKDTIYDTMLIPIAFRRMRQLVPSMLNDCQSLQFVSFDGAISLEFPPDDSANATDGQTVAKWLFTPRHDNFPKKLICYMNSTMEVEQSKR

SEQ ID NO: 127449 - protein, 49 aa, Heterodera glycines
  Coding regions on vcDNA: vcDNA=SeqID_53872; Strand=-; Position=1-150
QVARDPSGLVFRILIFKKAHFSIFGLGPKRPRGPKTGAQTRGPKNGGPN

SEQ ID NO: 127450 - protein, 482 aa, Heterodera glycines
  misc_feature (389)..(389): Xaa can be any naturally occurring amino acid
  misc_feature (461)..(461): Xaa can be any naturally occurring amino acid
  Coding regions on vcDNA: vcDNA=SeqID_53873; Strand=+; Position=1 -20,1272-2623,3654-3753
  Homolog annotation: Hit_ID=NP_498506.1; Match level="QueryCoverage =96%, HitCoverage=79%, E-value=8e-82, Identity=36%"; Hit description =RNA-directed DNA polymerase family member (3I9) [Caenorhabditis elegans] gb|AAA21080.1| Hypothetical prot
SKPQKINIELNAALVWKALRKLPNRNSTSPDGLPYILIKQCADLLAPIISELFRMVLDYGEIPNLWRTSFIIPIYKKGDKSNPNNYRPISLTCTLCRVFERLLVWNIVKHLEKYKILTDEQFGFLKSRSTTTQLLVSLDYFYKSIEDGQIDIIFIDFEKAFDSVPINLLIVKLQNIGISGKILKFLQNFLTYRSYRVKIGEYYSSFRTYSGVPQGSVLGPLLFLIFINDLTNYIPPEVGIKLYADDVKIYISHDNDVSLALANLAKWSKDNGIAISHEKCAVLYLGKNNPKHEYKIGEKVILSVDCVRDLGVLVDQKLSFNNHISKILKAAYFKAYQILKILKTRNISTLILAYKSYIRPHLEYASEIWNISSKEQSKRIEKVQKYFTXIVYKKCGLKAIPYEKRLEICKLEKLSTRRSLTDMNMTFKKIRGLTHLDPKKYFEFSSRSQRHPYLFLLIYPXVICYLVSLRPLPNSSDFLQIL

SEQ ID NO: 127451 - protein, 217 aa, Heterodera glycines
  Coding regions on vcDNA: vcDNA=SeqID_53874; Strand=-; Position=1 -77,130-336,418-609,657-730
  Homolog annotation: Hit_ID=AAN32886.1; Match level="QueryCoverage =88%, HitCoverage=96%, E-value=2e-92, Identity=90%"; Hit description =gland-specific protein G2D01 [Heterodera glycines]
SSPSVSVLAIVAIVCLMCQCCFSAPHPCCPGSQKVVSLMSNPCCPGSQKVVSLMSNYVGTFANSISKSSLCSDAQNVADALKGQLIGCSKGGDRTLLADIEASLATHSADECALSLGFVRAMFAIAASASSHASNNSEWQTLSGQFGQKVTEIDSKCAEFGISIGKVPINGPKGVHVQNVPNSESVISMPGLAVHVQNVPNSESVISMPGLAGSHTQ

SEQ ID NO: 127452 - protein, 247 aa, Heterodera glycines
  Coding regions on vcDNA: vcDNA=SeqID_53875; Strand=-; Position=1 -280,1212-1418,1467-1720
MIWKIQNLGLNRIRAALTEERANERGEGTNEGEVANGVNNEDGEAVNEGTDNGIIINCNVATTKRRKTTKEQHNESNGRNTPLDKCCSNSPQNSMESQLIPIFPSLKDGKKGFDKIKEMAANLDPKMLQDMLGKIDTGKINEVIKNMMTPENMWNMLPANVKELLPHSWFLIGKKLGNVLAKEWDKIVELMDSVDKLGSAEELWAAVKQKTPMLADLLENDLWKGSKERWTKFEGNLGDEAKQYKEN

SEQ ID NO: 127453 - protein, 200 aa, Heterodera glycines
  Coding regions on vcDNA: vcDNA=SeqID_53876; Strand=+; Position=1 -246,396-583,644-812
MYITYCRGWHVGKNVATVYHPFSQLYSEEQFKTYMHEAGDAIRDCALGCAGWRFNYDGVSPNMTMLSINNNNPSDELQSARQNRSSHGTLSAEGAGAAEAIQSLNELGKDDEERDELGNNNGNRQMMDGGGGGGLSQEEDLNEFNLYYSMAEDGVRLDYFQFAYEGVSESDEPDSVTCSRRNSQESEEEKGWNGRVMDTV

SEQ ID NO: 127454 - protein, 139 aa, Heterodera glycines
  Coding regions on vcDNA: vcDNA=SeqID_53877; Strand=+; Position=1 -150,236-503
MLNALPLPSNREHVEKAAAAGPGRWSPVPKRARTVEENMALIESRWQYLEELRLEREETAKREGEKGEEDGDNLFRLDLSEVAATDENGNSEEQQRQMAEERMDDEENGVSGDNDKNANNTDNNNNNEDGFPMECVDGM

SEQ ID NO: 127455 - protein, 82 aa, Heterodera glycines
  Coding regions on vcDNA: vcDNA=SeqID_53878; Strand=-; Position=1-249
MIFNISVFNSRKRSRIDAGHPSSPQKIVDSNLINTVADNVKNVLKQLDSLSALSTIDNDALNGASLRCQSATPGLLYTAHTN

SEQ ID NO: 127456 - protein, 351 aa, Heterodera glycines
  Coding regions on vcDNA: vcDNA=SeqID_53879; Strand=-; Position=1 -239,284-488,539-1147
MAGGGGRAALSAYAIRQDQHGADAADLLTNAGVALNKHTYTLDDVRQLQQWLNNQHGVGQIRLVVFEKEQEYRIVFKGDGIAARFNLCLLLERAHYNYIGRIEQLFKVPGYCIDCERRADARYHASGCKVACRLCLRFGAGYPCKSEQLPNGESSARRCNECGFVFPCDDCFNYHLVNQAPDPLDGRGLRQRRTLCQWRRFCRDCGRVAYLGLHQCPPLGQADEGAHDCRLCAGPHTNDQPCFIQPLGPGPSRAARVNNNSINIDVASEDDDENDTDEDDDEQPLRFCFFDAETSQDRPLQLNNNNNQVAQKHVPLLIVAEVICDRCIKAGISVHDGHGQRALGCVCMCGS

SEQ ID NO: 127457 - protein, 216 aa, Heterodera glycines
  Coding regions on vcDNA: vcDNA=SeqID_53880; Strand=-; Position=1 -354,727-1023
  Homolog annotation: Hit_ID=CAE60844.1; Match level="QueryCoverage =96%, HitCoverage=34%, E-value=5e-11, Identity=28%"; Hit description =Hypothetical protein CBG04553 [Caenorhabditis briggsae]
MAGGRAGGGGIAPFHSPPHYQWQQQPQQHQQQQSSYMMVSSGGGGSRSGGGGGNANSVLGPSLMSMASPFMPQHQQQQQQQHQPLGKESWRGSQRQLMDMEVQQPKYGGGGYHQQRGMERDIGGGGGGYDMRRSSGGGGYDDFGASAGTSYGGGGGGGHGMMQQQQPPPLGSSLASAGHYNTSLYGGGGGRGGAGPTPPKRHRYASPQPPPVERFF

SEQ ID NO: 127458 - protein, 62 aa, Heterodera glycines
  Coding regions on vcDNA: vcDNA=SeqID_53881; Strand=-; Position=1 -130,1069-1124
MEEKMKDDENEFGALRAVQIDAALLDNTLLALIQARIDQIVDIDPPNDCLVVDPFMCRNRQL

SEQ ID NO: 127459 - protein, 125 aa, Heterodera glycines
  Coding regions on vcDNA: vcDNA=SeqID_53882; Strand=-; Position=1 -326,392-680
GKVRAIMLVNPQNPEAGYFSLDEIRPVVHWALSRNLFVLLDEIYDLSIYDEDNECPFRSAVELFEDERSRQKLIWLWGLSKAKAKNRKGKGNGGEKKMRKKGTKGQQNGQRANKTDKGPTKRTKG

SEQ ID NO: 127460 - protein, 198 aa, Heterodera glycines
  Coding regions on vcDNA: vcDNA=SeqID_53883; Strand=-; Position=1 -156,415-555,650-844,1005-1109
KETLPTIEHVRDKAAQLQMALSDAEQVPDLEEQERARQREEERARRAKLPAQNAKDLDPCTLSRPQLMKLATLNDRAQFAQAITGCFIRLNAGAANHFEIDQIVKVEHPPAATEEAASKKAADKAVLELKVTGTISLTALTYIASNFKFTEDEFRKSWLAETTEANPLPTMEMVQQKQKELEEAFRAVSQAADAQQRV

SEQ ID NO: 127461 - protein, 24 aa, Heterodera glycines
  Coding regions on vcDNA: vcDNA=SeqID_53884; Strand=-; Position=1 -50,310-334
MNICQLWTTITKLINFKEKLTIDN

SEQ ID NO: 127462 - protein, 39 aa, Heterodera glycines
  Coding regions on vcDNA: vcDNA=SeqID_53885; Strand=-; Position=1 -85,571-605
MDGTYECATEESANGKVPLAIYSLRVDGERDGKMEQILN

SEQ ID NO: 127463 - protein, 186 aa, Heterodera glycines
  Coding regions on vcDNA: vcDNA=SeqID_53886; Strand=+; Position=1 -83,160-312,380-704
MTSTVPQIVLRLLLFAVLILNCFDCCHGRVHSKSSTVPTTTKSSTVPTTTTKSPPAPKKGSILDKLPIWATIVIAVLIGMVIAIGIVCCAWWCCLRQRYVRRSATDGPSSSLSDTEKSKGGGYSSKPSGLMSKLPLWKSSSSTTKTKMPDSLKSDIQPSRASSSKTKDKSSSTIPDSKYTMLTQKH

SEQ ID NO: 127464 - protein, 527 aa, Heterodera glycines
  Coding regions on vcDNA: vcDNA=SeqID_53887; Strand=-; Position=1-1585
  Homolog annotation: Hit_ID=CAE57029.1; Match level="QueryCoverage =89%, HitCoverage=47%, E-value=9e-21, Identity=21%"; Hit description =Hypothetical protein CBG24906 [Caenorhabditis briggsae]
KTFSCLDIRKALQAIVEVKEEVQRCAHVLRGDERPRSSAFNSPPQQRGAWNQRGDHRHSNNRQSQPPRPFNRGGTPQPEYRAFSAINKNPERAKTPARKWGRSCSFCSGTDHLPSECPAFPTPGARRKRLKEQQRCLNCLVQGHNTEECTSPYRCRNCGNKHHFLICFKREESHSRSNGNRSASSPKSGREPGGRKFPQRQVESQTHLITAGFQQNDQSNPPPREGEIVQSMGMSTVDTSKGRANKVPKCKKPHAYLMTRRLLAKSSRDSRNIIKVAVLFDPGSQTTYGADPLIDKLRPHKLTSEEMEVHGFGGKREPLLFHSPIYSVLLQRADGKWEEILLNRTEKISTHFSMVEWSADESVTNHHEACEAMCFTKEEPMILLSARHFWQFFQGKREVSPGLFVINTAFSPLVNGESTIGPPNSSQKALSMMAIHSTNVEQMPTINEVEHFFNLESLGIQDDPAQDDDQTAMELFNKSIRQETDGRYSVKWPWKESNPDLSSNFKMAHSRLSSVLTKLRHSPQILE

SEQ ID NO: 127465 - protein, 37 aa, Heterodera glycines
  Coding regions on vcDNA: vcDNA=SeqID_53888; Strand=-; Position=1 -41,104-176
MLTKGLLVQHMNWIVERKLKSVKKEEETDWIEDNKEL

SEQ ID NO: 127466 - protein, 213 aa, Heterodera glycines
  Coding regions on vcDNA: vcDNA=SeqID_53889; Strand=+; Position=1-639
MGTARTSAGLPHPGTFDGTADFHNYLKSFNLVATAHGCTPVRCAQILPLYLRGSARAIYDGLLQDDKSNWKTLVDALATNLKKVSSSLVARQMLAKRKQHVGESLDEFAQEIRTLVSKAYPDTSLEMNFDALVLGDMEEDVKREHDERLKRFRSGIAKDFFRSNMTASIKEKILFMDEPQSFEEAITQAKRVQQMQGALAEDLWKQTQGTKAE

SEQ ID NO: 127467 - protein, 55 aa, Heterodera glycines
  Coding regions on vcDNA: vcDNA=SeqID_53890; Strand=-; Position=1-167
MFDFVDKEKSYSPKTGLAPKRAAPKRAAPKRVCPCCCAAAVCWMRWEREGVGKKR

SEQ ID NO: 127468 - protein, 95 aa, Heterodera glycines
  Coding regions on vcDNA: vcDNA=SeqID_53891; Strand=-; Position=1-290
APQLNPNAEMSPQDEAGPLTSAASAEEAMESPPPTPGPVRTPEMDDEILEFGFSLPSTSVTPIGDLVPFSTTPTASMDTGETTPPPLAIDELNLI

SEQ ID NO: 127469 - protein, 18 aa, Heterodera glycines
  Coding regions on vcDNA: vcDNA=SeqID_53892; Strand=+; Position=1-56
PYRDRGLSFSKPGTGNRD

SEQ ID NO: 127470 - protein, 285 aa, Heterodera glycines
  Coding regions on vcDNA: vcDNA=SeqID_53893; Strand=+; Position=1 -754,1089-1194
  Homolog annotation: Hit_ID=AAS38911.1; Match level="QueryCoverage =83%, HitCoverage=83%, E-value=1e-26, Identity=38%"; Hit description =similar to Leishmania major. Ppg3 [Dictyostelium discoideum]
YDNDGSSSSSKDSSSKDSSSSKGSSSHKDSSSGHSSESKESHSSKDSSLKPCSPNEDSSSVNEKPSNSKSSDTVSTSEASPSHIEESSTFDDLSSVTEESSTSEGLSSVTEESSTFDDLSSVTEESSTSEDLSSVTEESSTFDDLSSVTEESSTSEDLSSVTEQSSTFDDLSSVTEESSTFDDLSSVTEESSTFDDLSSVTEESSTFEDLSSVTEESSTISESCASVCSGFGWTNYNGNCYKVIEGLMNQTIGLRRVLVGNRYQSTWTNGSAAIFGNVVSEKLIN

SEQ ID NO: 127471 - protein, 110 aa, Heterodera glycines
  Coding regions on vcDNA: vcDNA=SeqID_53894; Strand=-; Position=1-333
MATKNVQMANVCRKNEPNLTGKCVPNWLNICNRQLQIDATSVPNVLVGTEKCDHGMVNVTDEICNALIPLKARDAIENFSKSGHRAQKIRFWGQKSEHFAKLLQIFYFYN

SEQ ID NO: 127472 - protein, 215 aa, Heterodera glycines
  Coding regions on vcDNA: vcDNA=SeqID_53895; Strand=+; Position=1 -284,854-910,950-1256
MVCQTSIEPFELVNKRTNEKLTLTNEDTCGKLIGGLCGDAQLLGRRRRSNRGQSQLRTTKDKRQICRNIRRLSLSPITIKKFVVCLPKFGVCRFAVLSKLIIVESLAVKITHRQLCRIWARVGNGQNNAIFVIIVLKAPPPPPLDKLIFQGLPDNPTVDNPTVDNPTVGQSDSEDNPTEVDNPTVNFYFKKYFQVIRTDYFLKISQSNQFGSGIR

SEQ ID NO: 127473 - protein, 51 aa, Heterodera glycines
  Coding regions on vcDNA: vcDNA=SeqID_53896; Strand=-; Position=1 -31,683-807
MMCDYITSQGFYRDWTIRQWTIRQWTIRQLDNPTVRTIRQKWTIRQWTIRQ

SEQ ID NO: 127474 - protein, 179 aa, Heterodera glycines
  Coding regions on vcDNA: vcDNA=SeqID_53897; Strand=-; Position=1 -62,110-194,618-690,919-1236
  Homolog annotation: Hit_ID=NP_495705.1; Match level="QueryCoverage =100%, HitCoverage=67%, E-value=2e-58, Identity=63%"; Hit description= transitional endoplasmic reticulum ATPase TER94 (89.6 kD) (2I431) [Caenorhabditis elegans] emb|CAA88314.
MASVPTQKDEKTKRNEELATAILKKMPKPNRLIVDQSPKDDNSSVLMAQAYRPVYKGDTFTVNAAMRTVEFKILIETDPAPACIVVPTTIIHCEGEPIKREDEENNLNDVGYDDIGGMRKQLAQIKEMVELPLRHPMLFKSIGIKPPRGMLLFGPPGTGKTLVARAVANETGAFFFLLN

SEQ ID NO: 127475 - protein, 250 aa, Heterodera glycines
  Coding regions on vcDNA: vcDNA=SeqID_53898; Strand=+; Position=1-754
  Homolog annotation: Hit_ID=NP_702063.1; Match level="QueryCoverage =97%, HitCoverage=5%, E-value=4e-16, Identity=23%"; Hit description =hypothetical protein PF14_0175 [Plasmodium falciparum 3D7] gb|AAN36787.1| hypothetical protein [Plasmodium
IQSLGLNSPTLQSTGLNSPAFQSLGLNPPTFQSKGLNPPTFQSTGLNPPAFQSLGLNSPAFNHWDSTLQHSITGTQPTNIPINGTQLSSISITGLNPPTFQSKGLNPPTFQSTGLNPPAFQSLGLNSPAFNHWDSTLQHSITGTQPTNIPINGTQLSSIQSLGLNSPAFNHWDSTLQHSITGTQPTNIPINGTQLSSIQSLGLNPPTFQSTGLNSPAFQSLGLNPPAFNHWDSTSANFFSIFNFLCALGC

SEQ ID NO: 127476 - protein, 200 aa, Heterodera glycines
  Coding regions on vcDNA: vcDNA=SeqID_53899; Strand=+; Position=1-603
  Homolog annotation: Hit_ID=AAQ73925.1; Match level="QueryCoverage =45%, HitCoverage=2%, E-value=5e-09, Identity=38%"; Hit description =erythrocyte membrane protein 1 [Plasmodium falciparum]
MAHSQQQQMMAPNVAVIQNGGGIKGGEEVRKESTEEDESDDEEMDDEDVDDDDDDEEEEEEEEEESGSGEEANHRRHGTESGDTATTTPAGASTEVPLAAHMATDVAQTQAAPGNAAAAAPPTGTELLAIRANLQILNHQVVMARWDEYQGVAWHKKSVQMGKSGLIQLSIISYASKQSKWNSLRDSSMCSNLCHPWLAV

SEQ ID NO: 127477 - protein, 71 aa, Heterodera glycines
  Coding regions on vcDNA: vcDNA=SeqID_53900; Strand=-; Position=1-246
ICSKIPRKLPKFELDREWHRRAKAPPGEPHPFGHTFFSSGVQYLERRPRGADSAPLPLMSAPPAENRLCCC

SEQ ID NO: 127478 - protein, 137 aa, Heterodera glycines
  Coding regions on vcDNA: vcDNA=SeqID_53901; Strand=-; Position=1 -74,158-497
MASSEYCRAFLSLSPVRCLLHHFPFHFEATALTTAINESAASNSAHFGAQQQSFKSAKTTAENGQIASEPLKERTNPKGTQGEGAARGMAAGNSPKSGDSAGGKMLVPMNKGKGGREYIWQHTTTMALIGEEHDDFL

SEQ ID NO: 127479 - protein, 186 aa, Heterodera glycines
  Coding regions on vcDNA: vcDNA=SeqID_53902; Strand=-; Position=1 -60,427-669,738-993
MTRTNNNSRSIGKSACRLASRWGEKERLFCQKNHFCLFSKKTNRPIGSAVPMAMKIYAIFLANVVPIILMDYILAKRLLVNCVEVLIVVCSLLPAPILGSILFLALFATTAVADRYTDYVNIGNNAAAKGCEPNCGTETTAETTTTTTATPTATQTGILIGIVVGAVVVVILAISFVVWLCHRRKR

SEQ ID NO: 127480 - protein, 88 aa, Heterodera glycines
  Coding regions on vcDNA: vcDNA=SeqID_53903; Strand=+; Position=1 -125,172-313
  Homolog annotation: Hit_ID=NP_492437.1; Match level="QueryCoverage =97%, HitCoverage=43%, E-value=2e-22, Identity=65%"; Hit description =sorting nexin (1J640) [Caenorhabditis elegans] emb|CAA22253.1| Hypothetical protein W06D4.5 [Caenorhabdit
SPLPGKAFKRQLPPSKDDGIFEEGFIEERRKGLEQFLNKVAGHPLAQNEKSLHIFLQMNELDKCVLLVLLVSLFPFDRNYVPGRIRTA

SEQ ID NO: 127481 - protein, 222 aa, Heterodera glycines
  Coding regions on vcDNA: vcDNA=SeqID_53904; Strand=+; Position=1 -342,462-742,800-845
MSSLFSAVFVLFSPLVQLISFIKENSDRILMSIFRNIWPMIAKNICGMHLFPNIFRRLRQLAPSFLNDCPSLRFFSLYGTDDFPDFPCDDSAAASDGQAVAKWFFTPLQNNVPKPFASASSPVNFIVVIWFHWSHAVVPFALTNELTGEQLAFKKTDNWRRFLLVRCPIARDADKWAKWEKEAIDWQIRDQWNQIGIKINDEDEIGDGLLDETPGSSDQQQK

SEQ ID NO: 127482 - protein, 163 aa, Heterodera glycines
  Coding regions on vcDNA: vcDNA=SeqID_53905; Strand=-; Position=1 -82,788-930,1073-1262,1647-1723
  Homolog annotation: Hit_ID=CAE72112.1; Match level="QueryCoverage =40%, HitCoverage=13%, E-value=2e-14, Identity=54%"; Hit description =Hypothetical protein CBG19205 [Caenorhabditis briggsae]
MSKKVVNIDLYIKHPDQFFLGQLAILGGGREEKINEQNDEQNDDESNEWSNLSSSERLQSFRLSERNPKKDGTPRVFTACFAAFAHGRNDVSNSISRLVAMLSCGINGTVKEKEDTSPWLLLFGVFSICLGLWILGHRAGHSSRVWCYFCRTDVYFESVSFNK

SEQ ID NO: 127483 - protein, 71 aa, Heterodera glycines
  Coding regions on vcDNA: vcDNA=SeqID_53906; Strand=+; Position=1-354
QILKSFSIPFTRPFSSLPKCTFRPIHKTIRCPIGLCFVPGFSPFISNCADLSKISPAPRKHSIISFRLTKR

SEQ ID NO: 127484 - protein, 233 aa, Heterodera glycines
  Coding regions on vcDNA: vcDNA=SeqID_53907; Strand=+; Position=1 -274,575-688,2488-2682,2774-2850,2903-2944
  Homolog annotation: Hit_ID=NP_586209.1; Match level="QueryCoverage =55%, HitCoverage=80%, E-value=5e-31, Identity=50%"; Hit description =UBIQUITIN-CONJUGATING ENZYME E2 SUBUNIT [Encephalitozoon cuniculi] emb|CAD25813.1| UBIQUITIN-CONJUGATING
MVKNPLPEGCTARPLDQRTMTPWTVTIRGRAGTPYENGNFQLSMAFPRDYPFKAPQVTFTTRIFHPNIDTRGKVCLDILQTHWAPTLTIEKVVISIIVLLNDPNPDNSPINAQAASLYRTDRAEFNRRARNAYLNGYLVEHSPGAHLPYCHDDHVRWFAALFCHLRRSSAFVDHSSRICYYHPSAGAATHGFVQARRRKESKEQRNAVAGLEMLGREKKVRKETPKKDSDGKN

SEQ ID NO: 127485 - protein, 116 aa, Heterodera glycines
  Coding regions on vcDNA: vcDNA=SeqID_53908; Strand=+; Position=1 -99,357-608
MELIKMSELYLALQGEQCYYTVPSIHKGFNVKNLPFECPSFSIALEQQLQQIVDFSGCVKAIETWKAEHLYNRTDCLDSVKKAILESIIDAYNIYQNEADRMRREVCVKAGNLSNN

SEQ ID NO: 127486 - protein, 361 aa, Heterodera glycines
  Coding regions on vcDNA: vcDNA=SeqID_53909; Strand=+; Position=1 -295,387-667,792-1016,1193-1474
MRKLRYPNNVGKRPEIAGETSKARDGAALDGGAFVGVEIDAEKMVGKLNFYAAGILYKEKDENVQPIEKVPDEKVPIGKWHKFEGQEIELMPREIDMTDENDNICIEFLAFADADEMKDDAHFKMDDTERIQAKLGKYICKNMKENEKNKQKNPKKLNYKFNWTTVDDVQFYAEEAMGAMREKFGINYKELADSFLSDDLTDLGIKGKSSNKIYRTEDEKFLLKQIPQPYQMETMERTLKDYLKHMMQMGDKSFINKIFFVFRVEIENTQTLFLLMENVFKNAKDLPLLNFDVKGVFSRQPKLVEVVPKQRLNDVVLKWYNYFGGEPPLVPEEVMPMFPEGILLDKETHRNIVERLKRDFE

SEQ ID NO: 127487 - protein, 116 aa, Heterodera glycines
  Coding regions on vcDNA: vcDNA=SeqID_53910; Strand=+; Position=1-351
MTCAYAKLLGPCFKTGRTDDRLLHRERTTESPSWTELVAGTCRTRPPPTPSSSQHGPETIAQFTQSKQHSPDPGTRPRKAGLKTELTQLLRASQRTPPANAPFATEQKDSKPQSGG

SEQ ID NO: 127488 - protein, 178 aa, Heterodera glycines
  Coding regions on vcDNA: vcDNA=SeqID_53911; Strand=+; Position=1 -18,77-259,311-416,666-786,851-959
MPLLNMDSERGKLENELMLNEIQQLVVRHSADDNGTLALNAVQSRQIAQLTQDYMSNLLKLFSVSCQLNREGRATEIARRTTNSKLIQAMCNYASKARRPGLTKDGTERTVADTVAPNVNKMLVPKRKVTADELLDSLRAEDGAKKHKQNAKMCPPPPSVPSSLSSSSATLSSALWDR

SEQ ID NO: 127489 - protein, 74 aa, Heterodera glycines
  Coding regions on vcDNA: vcDNA=SeqID_53912; Strand=+; Position=1 -174,482-532
MAFIGYGALTAALSGIILYANLPTRLTIGAIVPTVEFLAETQLKKLEPGQAVAGPQIKGFDQYLDKSQEIKNGY

SEQ ID NO: 127490 - protein, 19 aa, Heterodera glycines
  Coding regions on vcDNA: vcDNA=SeqID_53913; Strand=+; Position=1-58
FLNFVGLGRALRDRFLNLF

SEQ ID NO: 127491 - protein, 100 aa, Heterodera glycines
  Coding regions on vcDNA: vcDNA=SeqID_53914; Strand=-; Position=1-303
MTPRDETETRKTREISRVETLAHPYKFAQICAFPSPLWHTFEMCSKICCPPPPPKSALCTQSVANAAAQTNAEELLSPALGGIRLATTARIPLAYAQKKQ

SEQ ID NO: 127492 - protein, 459 aa, Heterodera glycines
  misc_feature (83)..(83): Xaa can be any naturally occurring amino acid
  misc_feature (110)..(110): Xaa can be any naturally occurring amino acid
  misc_feature (184)..(184): Xaa can be any naturally occurring amino acid
  misc_feature (203)..(203): Xaa can be any naturally occurring amino acid
  Coding regions on vcDNA: vcDNA=SeqID_53915; Strand=+; Position=1 -264,786-834,917-1063,1329-1406,1440-1607,1948-1999,2091-2192,2229 -2317,2508-2630,2681-2823,3049-3087
  Homolog annotation: Hit_ID=CAG05542.1; Match level="QueryCoverage =96%, HitCoverage=88%, E-value=4e-75, Identity=40%"; Hit description =unnamed protein product [Tetraodon nigroviridis]
RPSVVRLFRQRSVNCDPQWLIRCPGRVNRIGEHIVYSDYSVLQMAIEHSTWVGRLIYDTHSDQRIGTHSDQRVFTLIRGSLLXLEDRHPKWHHYFLAGWRGILESFFCAXAKGMRAVVASRIPPSAGLSSSSALVCAAALATLCVQSADFGGGELAEIATHAERFVGLEGGGMDQASKWLHSPXGVRMFGASGRALRIDHSPXGVRMFGASGRALRIDFRPLGWRAVQLPENALFAVLHSNTEMNKTASAYYNQRVVECRIAAQVIAKQSGSEKEKLFLAKFQLLHCSAKMAIEQMLTLVDEHLAKRIHTREEICAILDCSDAIHTREEICAILDCSDAQLAQWSLNANTQNMTEFWLAKRARHVYAEAARVLEFEWVCREGREDNGTVAKLGELMNASLMNASHLSCAQLFECSCPELDETVANCLSAGCIGARLTGDFHGVFCLPYVSSISLQNFKK

SEQ ID NO: 127493 - protein, 103 aa, Heterodera glycines
  Coding regions on vcDNA: vcDNA=SeqID_53916; Strand=-; Position=1 -62,299-392,440-592
MLGFDDKEKSYSQNHAGAETRKLADDAFQILPLPDIDPTVTSTPAVVNNLIEAVESLDSRMPLAFQEQQQILKMQGEMLQLGVSCKEHYKKIHEQSVMRYNLE

SEQ ID NO: 127494 - protein, 157 aa, Heterodera glycines
  Coding regions on vcDNA: vcDNA=SeqID_53917; Strand=+; Position=1 -210,729-992
  Homolog annotation: Hit_ID=XP_507705.1; Match level="QueryCoverage =65%, HitCoverage=12%, E-value=4e-09, Identity=37%"; Hit description =PREDICTED: similar to amyloid beta (A4) precursor protein-binding, family B, member 1 interacting protein
MHHPLMVPPHTIMNLEASQPQWMTDSFLPTMASHSVICAPSSSAAAPPRLSQIQQMAARSDDGTTPQASKQSSSSDPILNHTPPPPPPPLRPFHPPPLPPQGNRNFLRSPPCLLPPSPSGTVAFLHTPPPPPPHPRAAIPPLMMQMSTATTPTAMRL

SEQ ID NO: 127495 - protein, 127 aa, Heterodera glycines
  Coding regions on vcDNA: vcDNA=SeqID_53918; Strand=+; Position=1 -94,535-719,1107-1211
  Homolog annotation: Hit_ID=CAA50795.1; Match level="QueryCoverage =54%, HitCoverage=99%, E-value=8e-13, Identity=61%"; Hit description =GCR 101 [Drosophila melanogaster] pir||S49193 GCR 101 protein - fruit fly (Drosophila melanogaster)
MTLPDTMMHFGPPHTSPMPLRMAPPDTMMHFGGRRGGGAGRKGGGRGGGAGRKGGGRGGGAGRKGGGRGGGAGRKGGGVAGRKSGGVDSKYYQQMTFSGVCARLRASSKDAPETVLIWAKESISLAT

SEQ ID NO: 127496 - protein, 166 aa, Heterodera glycines
  Coding regions on vcDNA: vcDNA=SeqID_53919; Strand=-; Position=1 -122,174-267,315-467,798-929
MKKHVTFTPSIGDDVHSTNVSSVAESEFSVKGRAEVPEIFKKLADDAFQILPLPDIDPTVTSTPAVVNNLIEAVESLDSRMPLAFQEQQQILKMQGEMLQLGVSCKEHYKKIHEQSVMRYNLEKSVNKNIDDLKEGAVVAQKLVKAKSAYEEMVAKAEALLAKANK

SEQ ID NO: 127497 - protein, 183 aa, Heterodera glycines
  Coding regions on vcDNA: vcDNA=SeqID_53920; Strand=+; Position=1 -375,436-519,564-586,745-813
MFARSIASPMHQRMAPSVTMMHFGTSRPSPMPFRMAARQMFPSAAAPPQRMTAPTSVLPTMASPPPVICAPFSSAAHPPPQPRQLPAVQEEKDERTLRIERMADQILDQRQLRAERRAQGIMYDEEIIEGRVVRFNYAGEFCEQRGIGEIHRQLRHFMIGCALVGAVTFAFVKIDLKKKRRRK

SEQ ID NO: 127498 - protein, 193 aa, Heterodera glycines
  Coding regions on vcDNA: vcDNA=SeqID_53921; Strand=+; Position=1 -321,382-465,519-541,700-853
MFARSIASPMHQRMAPSVTMMHFGTSRPSPMPLRMATSFLPTMAFPPPVICASFSSAAHPPPQPRQLPAVQEEKDERTLRIERMADQILDQRQLRAERRAQGIMYDEEIIEGRVVRFNYAGEFCEQRGIGEIHRQLRHFMIGCALVGAVTFAFVKIDLKKKRRRKMWERQNQLYEARKEAMKKQKQQQLMMAT

SEQ ID NO: 127499 - protein, 102 aa, Heterodera glycines
  Coding regions on vcDNA: vcDNA=SeqID_53922; Strand=+; Position=1 -15,1065-1254,1304-1405
MFHLNTVQPNTSKLHSRVVSLFIAFFESVIASGIGRLWTCHLTRLPSKPIQNYTGRAFRTSIALHTSFVCRPSLGTAEKSLHRTAAPNPGLTTLGRERGASL

SEQ ID NO: 127500 - protein, 88 aa, Heterodera glycines
  Coding regions on vcDNA: vcDNA=SeqID_53923; Strand=+; Position=1 -145,926-1047
MCRLTVCLAPFPVGLGRHCARRKRVACTRCVSTVSATWTASWPTTQTPDFDAGKTAFHYQTNESYYGTFGCRMMVNTEPRCAPLFVSI

SEQ ID NO: 127501 - protein, 164 aa, Heterodera glycines
  Coding regions on vcDNA: vcDNA=SeqID_53924; Strand=-; Position=1 -30,246-405,931-1235
  Homolog annotation: Hit_ID=CAE60056.1; Match level="QueryCoverage =88%, HitCoverage=53%, E-value=3e-37, Identity=53%"; Hit description =Hypothetical protein CBG03570 [Caenorhabditis briggsae]
MVKDRLMEFQTEDDHLVASQSQFMEDFFEQVEEIRASIDLIATSVEEVKKKHSAILSNPVNDPTIENNLDHDENGGQANVDLRIRKKPSVNFRIRIQKASADQRIRQTQHATLARKFVEVMTDYNKTQTDYRERCKGRIQRQLDIGQWEGTRLTTDSLLGAHCI

SEQ ID NO: 127502 - protein, 62 aa, Heterodera glycines
  Coding regions on vcDNA: vcDNA=SeqID_53925; Strand=-; Position=1-188
MHSLLCPRASSSQLSALFKRFSVGNGTASTDCATKKGPVDVLRARLLYQSRKRGIRENDILI

SEQ ID NO: 127503 - protein, 112 aa, Heterodera glycines
  Coding regions on vcDNA: vcDNA=SeqID_53926; Strand=+; Position=1-339
MALKKWAANVRGENVGPQKTDRNCRFWLVAANVVTRNQQQQKGNSEGGGEGRENGGKERKREEKKEQQLKKRKKKIAAEHQQKQQHQQKQEHWKEERRKRKRGKWRRKRSSN

SEQ ID NO: 127504 - protein, 98 aa, Heterodera glycines
  Coding regions on vcDNA: vcDNA=SeqID_53927; Strand=+; Position=1 -11,73-358
MNRRWICNDVWMDIFPSFDRPQLGLKLALLSPRFNALVDKHFDGKSELAIWRPIEIHKGKGPEPKLSVWMDDESNNVVPFPLPDRPLPSKIRFKCLRI

SEQ ID NO: 127505 - protein, 20 aa, Heterodera glycines
  Coding regions on vcDNA: vcDNA=SeqID_53928; Strand=+; Position=1-63
ALPGPGPGPELFKTRDREPG

SEQ ID NO: 127506 - protein, 361 aa, Heterodera glycines
  Coding regions on vcDNA: vcDNA=SeqID_53929; Strand=+; Position=1 -279,333-780,832-1112,1173-1251
  Homolog annotation: Hit_ID=AAL78214.1; Match level="QueryCoverage =51%, HitCoverage=94%, E-value=9e-11, Identity=29%"; Hit description =putative esophageal gland cell protein Hgg-20 [Heterodera glycines]
WICNDVWMDILPCFDRPQLGLKLALLSPRFNALVDKHFDGKSELTIWRPIEIHKGKGPEPKLSVRMDHKFVEFPLPDDRPLPCKIRFKRLQIDYIDHSVIAFLRSNHQIFEKRGIDLYLWIPYSHTTDGQRIWDVFVRELWPIFSTNIRCLGFFRGDHLDNLLRLISPTILTDLNKLNSINSYDLLPEAIGDDFDVPNATISAGQALSKWLHSPRKDGQPKRLRCEDYNAQANTDWINNFKEHFLCANAISSVNYEIRFTVRAPSIQMVPFELVNEWTMEKLTLTKENENEWDTIWIMKRSKIIGETAAVNWKDGNWDNNCNCVFFWLDSDTNCIGPLSPPPKEEDEAGQSSEKGASSADK

SEQ ID NO: 127507 - protein, 818 aa, Heterodera glycines
  Coding regions on vcDNA: vcDNA=SeqID_53930; Strand=-; Position=1 -411,464-895,1390-1643,1726-2101,2172-3155
  Homolog annotation: Hit_ID=NP_507780.1; Match level="QueryCoverage =56%, HitCoverage=34%, E-value=4e-33, Identity=26%"; Hit description =predicted CDS, DNA polymerase type B, organellar and viral family member (5T899) [Caenorhabditis elegans]
TTNTAITTTTTVYPQKIGVPRLASSTRMGKGNVSGKPLKIVTTTTANTNISRNTTTTTKNNNNNSSKITTPIPKTAKLVVDEQLPVATLLPTLIHQMCKDRPGEENFYQQAICWALFALYLMVFVSLVLHQLCSICWQSRETARVFRGCFPSDQLPAPDTLRYPAALVVNNDPHYKQGSHWCAIYAPSKTEEAVIYFDSLAKTIPPIVKTSFMDKFPKGFVTNKHPYQSPLTTTCAIHCIVFIYHMSLCHPFDAFLRMLDASESPDMYSLCILNKMINPYLSAKSEHMDSHTPHFRADSIMNRFLEVAQSKSREGSLWGSPFTVTITTLDVAQLPQRQQVRGSGKRTTNSVQHIIKESALLRINNNINRQNGRRLEDVFGLMSSANIRTDLREYDAVVYVPIVVDYWNRKYATSNQRFKVFIFGTTGTYRPKFQYGPDNYNIEIPLYHHNGHFDGIRCGVGKAVFGRDYYCFSCECPYDNANDHTLQCKAKECTACGKDFISQDCFSHHLSSNVCRQFKKCKQCGVVWNVKQNRRKGRSGHVCGEKFCYTCKCYHKPERGCFIQQLKARRPKKYRLIAFDCETTQNTRIEGDRRLHSVNFISCYVVCTKCINEILWRNSLQAPCGICGRQRTVTFSHRVYERTQTDAQFITPCPMAAFAQWLLSEFDPRYPTMLFAHFGGRFDNIMLFRQFFLNGFCPQMIRRGNKLYEMKIARGEKNPEIIVRDSWNLMPVPLGALPGAFGLNVQDKEFFPHLANVETNYGLILQSLPPKADYLYGGMTPDRQRRFDQWYAEHRHQQFDLCEQLAAYCTNDTRILIE

SEQ ID NO: 127508 - protein, 88 aa, Heterodera glycines
  Coding regions on vcDNA: vcDNA=SeqID_53931; Strand=-; Position=1-267
MPLDESEAASGANSVPIAVRVPSETVPDTNSLPTAVTVPTDNVAATGANSVPLGTRVQDDGTPNGEAKDPAIQNNSAPLPSEDANDEW

SEQ ID NO: 127509 - protein, 25 aa, Heterodera glycines
  Coding regions on vcDNA: vcDNA=SeqID_53932; Strand=-; Position=1-75
TCACGVVVKLSTFHNFSPGFNSPLG

SEQ ID NO: 127510 - protein, 69 aa, Heterodera glycines
  Coding regions on vcDNA: vcDNA=SeqID_53933; Strand=+; Position=1 -108,585-684
MRPRGPAFTDARRAVRKANLAAVRTAKRLPEGRTKRAVHVSTRVGAAARTARQPRWARSTKAVTIVVMP

SEQ ID NO: 127511 - protein, 112 aa, Heterodera glycines
  Coding regions on vcDNA: vcDNA=SeqID_53934; Strand=-; Position=1 -13,372-697
MWCRAIVNMPSGSVIWQIGLYKKSNNNDFEYECAECCKNIICKKGNTSNAINHLKSKHKNSEYEAKYEEFFVFFRRQICSHLESLREEQFSEEVLPLPNSPISKKPKGLLDF

SEQ ID NO: 127512 - protein, 109 aa, Heterodera glycines
  Coding regions on vcDNA: vcDNA=SeqID_53935; Strand=+; Position=1 -163,743-908
  Homolog annotation: Hit_ID=AAB51667.1; Match level="QueryCoverage =88%, HitCoverage=18%, E-value=1e-26, Identity=56%"; Hit description =acetylcholine receptor alpha subunit precursor [Haemonchus contortus]
HGKLANRANAKSADAELLNEKLAKLYSSPQAIKSFENLCFIAALLRKKDMDTKVDQEWKFVAMVFDRLFLIIFTFACLFGTCWILFQAPTFYDTRQPKQPMMLMIMIIF

SEQ ID NO: 127513 - protein, 601 aa, Heterodera glycines
  Coding regions on vcDNA: vcDNA=SeqID_53936; Strand=-; Position=1-1806
  Homolog annotation: Hit_ID=XP_320889.1; Match level="QueryCoverage =66%, HitCoverage=48%, E-value=3e-53, Identity=32%"; Hit description =ENSANGP00000012033 [Anopheles gambiae] ref|XP_313651.1| ENSANGP00000013044 [Anopheles gambiae] ref|XP_314
MAQQQQDNKIKSAKGPGAYSPEMSWDSWAERFDFFIKLRGITDPEMKKLLLFTEIGPIYDELRMMAQPDDIRDMDFAEITALMCERYGEAKSIVARRHELFTARQHSGQSIRDFSIQLRSLIAKTEWGKDSIDMCLSALFVNGIVDDSIRAELIKKGDKDLKFKDAVELAVVLEQSNVDAQAIGSDSLKGNVAKISGRGGGYDRAKGTNNSKSADSKPCYRCGRSGHWANICPGKADKCTKCGRVGHWAIVCRTNGGNKNPARVESRLWKSSKHVKQIQLQCNEKPPVISSLERKSAKTETVPPSFIQLKVHKGNAEFELDSGADVTIIGSQDWNHIGKPELKESQGLLAYGGIPIKGVFGMANVNVEYNGMQINTDIYVVKGNKRNLCGRDVIRRLRIDLNKAFGINAIQIGSTNNDQKEVDKILEKFQEVFRDELGRCTRQISLKFKPGVQPKRCKARPVPFELKAEVEKILDKWVQQGVLEPTNNSDWATPLVIVPKPNGKIRLCCDYKVTVNQWLDVHQYPLPRPDDLFSVLNGGQKFSKVDLNDAYLQLMLDDEAKKCLAVCTHKGLFQFTRLPFGVASAPAIFQQVMDEILQGIE

SEQ ID NO: 127514 - protein, 455 aa, Heterodera glycines
  Coding regions on vcDNA: vcDNA=SeqID_53937; Strand=-; Position=1 -773,821-1346,1400-1465
MKGLSTHRQQTEQSQTWDGPTRPSPPFHLKQLPARHHLFGSAPPPSFSPPAPSVDRLSEQCCAGWDSGLSSAAATDSQSGRGQQQHNAATCQSTDAARTSLEERCCVCRNEQRSCPTTASTSPEWSTLTEKEDKEDWVRILDALETVGEEEMLRKLEECILSGQASNYTTNRGAKKWSETLAQCQNSIFVPLSSNDFANFTQNGFLSCRFPSNFPIKGMNSLKTPLASTNYRAGESVRNIASVTLPRPQTPVSREKQKGEQMCHNGNTFVVELPPPMPSPRAASNALALLTQLNSNSKVGEVSSTVPPIIPSHNASTFAPSADEEEHQRVRCSSVVPFITSPTEDDGNCEQEEENEANEEEEDQFDSEVFTIQLCRCPYTKSFGFSVCDGTADETARGEREQQRQGGIYVKSVVKDGPADKSGRLQPGDRILNINRRSIQFLTCDLALPLLATDR

SEQ ID NO: 127515 - protein, 37 aa, Heterodera glycines
  Coding regions on vcDNA: vcDNA=SeqID_53938; Strand=+; Position=1-117
KRGDPFVLQNFFKIKNHDNFLSGVLKVANHESDMYFD

SEQ ID NO: 127516 - protein, 101 aa, Heterodera glycines
  Coding regions on vcDNA: vcDNA=SeqID_53939; Strand=+; Position=1-306
  Homolog annotation: Hit_ID=XP_522969.1; Match level="QueryCoverage =96%, HitCoverage=70%, E-value=3e-11, Identity=37%"; Hit description =PREDICTED: similar to putative protein family member (XC187) [Pan troglodytes]
MVIRRGTTVIRRGTKVIRRGTTVIKKGTTVIKRGTKVIRRGTKVIRRGTTVIRRGTKVIRRGTTVIKKGTTVIKRGTKVIRRGTTVIRRGTTVIRRGTIMV

SEQ ID NO: 127517 - protein, 52 aa, Heterodera glycines
  Coding regions on vcDNA: vcDNA=SeqID_53940; Strand=+; Position=1 -51,1208-1313
MAKVEEDRTDLAAFYEKITECIRSIESLREYILVDMKDVPDLRKMAARASYR

SEQ ID NO: 127518 - protein, 148 aa, Heterodera glycines
  Coding regions on vcDNA: vcDNA=SeqID_53941; Strand=+; Position=1 -266,308-387,548-648
MRCCCAHSVVPGTYNLFVYASVAIEDNKEIVIFFHRDVFLRSNPSNIYISNLYRVRMSIRQIVLLLNKREWLISPVTIVVNSFLNYADGELLNKWKYLPCRAPILKEICCDKIARILFGFAFGQENSNCCCLSNEEKQQFWRFIELND

SEQ ID NO: 127519 - protein, 27 aa, Heterodera glycines
  Coding regions on vcDNA: vcDNA=SeqID_53942; Strand=-; Position=1-128
KFSILMSLSVTRNHYFGDFVTKIVKNH

SEQ ID NO: 127520 - protein, 96 aa, Heterodera glycines
  Coding regions on vcDNA: vcDNA=SeqID_53943; Strand=+; Position=1 -91,636-835
  Homolog annotation: Hit_ID=O02623; Match level="QueryCoverage=94%, HitCoverage=22%, E-value=9e-22, Identity=57%"; Hit description =[Pyruvate dehydrogenase [lipoamide]] kinase, mitochondrial precursor (Pyruvate dehydrogenase kinase) gb|AAB525
MATFMQEFDLLPAKLLQTPSARHVGSWYKQSFSELLHFEGLEPSDMVLDKFNNQLRTILHRHNTVVETMAEALLELKESHGVDIACERNIQVEWMN

SEQ ID NO: 127521 - protein, 27 aa, Heterodera glycines
  Coding regions on vcDNA: vcDNA=SeqID_53944; Strand=-; Position=1 -42,158-199
MAGRVHHDCLARLICWFCNIRMEIRFK

SEQ ID NO: 127522 - protein, 233 aa, Heterodera glycines
  misc_feature (20)..(20): Xaa can be any naturally occurring amino acid
  misc_feature (80)..(80): Xaa can be any naturally occurring amino acid
  Coding regions on vcDNA: vcDNA=SeqID_53945; Strand=+; Position=1 -244,367-489,573-680,759-949
  Homolog annotation: Hit_ID=NP_957290.1; Match level="QueryCoverage =84%, HitCoverage=44%, E-value=6e-34, Identity=43%"; Hit description =similar to pyruvate dehydrogenase kinase, isoenzyme 2 [Danio rerio] gb|AAH45993.1| Similar to pyruvate de
RCAVNACTEMAGMEGTGGCXDLINTIISILFLKSPLTCNFWYLSSPNCSLLVCKILKNSVNFEQSYSRKYTNKQVFKLFXNSMRATIEHHHRVKGFDADSSDDLAEVRACIVLGAENLSIKISDRGGGVPSAKLANLFHYLYSTAPKPSDDSNTPFAGYGYGLPISRLYSAGYGYGLPISRLYSRYFLGDLSLTSMDGYGTDAVISLKVDNDQLELFNWEIRSSLPLENGTGN

SEQ ID NO: 127523 - protein, 115 aa, Heterodera glycines
  Coding regions on vcDNA: vcDNA=SeqID_53946; Strand=+; Position=1 -54,264-399,459-616
MPMALDYRSRVAVVEAEAEFIDQIDEIKRMPKNGRQKQFAKELGISKETLRKWKKEFGIEMSKSPIRFTEEQKMSKMNDYYEMKKANPSLSDKEIADILKIGTATLKRWKKENNS

SEQ ID NO: 127524 - protein, 65 aa, Heterodera glycines
  Coding regions on vcDNA: vcDNA=SeqID_53947; Strand=-; Position=1 -93,189-289,637-640
MPNPFLFVLFTCPLSVIWATRKSATRNTLEKKYKIISKKQGRSEDRKLTRSRSADSNCCVALHPW

SEQ ID NO: 127525 - protein, 67 aa, Heterodera glycines
  Coding regions on vcDNA: vcDNA=SeqID_53948; Strand=-; Position=1 -118,224-309
  Homolog annotation: Hit_ID=NP_872134.1; Match level="QueryCoverage =98%, HitCoverage=18%, E-value=6e-16, Identity=56%"; Hit description =mitochondrial substrate carrier (39.7 kD) (5P134) [Caenorhabditis elegans] emb|CAD56651.1| Hypothetical p
MSNLKLLFAGGAAGMCSWLSNYPTDVVKTRFQSDDAYENYREVVKKAYSEHGWRTFFAGLGSTLIRC

SEQ ID NO: 127526 - protein, 54 aa, Heterodera glycines
  Coding regions on vcDNA: vcDNA=SeqID_53949; Strand=+; Position=1-163
LSHKNADDDEQQQKVTLGVERFALPELLIRPGDVEVQQMGIPEALCAVIERLPK

SEQ ID NO: 127527 - protein, 130 aa, Heterodera glycines
  Coding regions on vcDNA: vcDNA=SeqID_53950; Strand=+; Position=1 -228,279-391,441-491
NLFQKWGRFKAANAAIASTWDASRANAFAEMHFSTIRSATFPTSGLLSLEMFDDYDKMLRAMSEAIKWLILHLPKDEFMSRNKRFNLFAIAEDSGEILTVLKQLSQFEYKFRKAITPLRNNRQDCINALH

SEQ ID NO: 127528 - protein, 271 aa, Heterodera glycines
  Coding regions on vcDNA: vcDNA=SeqID_53951; Strand=+; Position=1 -255,302-511,851-1201
  Homolog annotation: Hit_ID=NP_491784.1; Match level="QueryCoverage =77%, HitCoverage=26%, E-value=7e-11, Identity=24%"; Hit description =putative protein of eukaryotic origin (115.3 kD) (1G767) [Caenorhabditis elegans] gb|AAB54215.1| Hypothet
AVPRAVFHEMAKLNDCFPTDTSSVSIEKARIREFSDFKRRSILADLTFKISKLALGISNTCIKQLGDVEIQPRALLADGLRRELDIRLIQIFASDVQPNILRTLQNQSLKLQQFRKSFLFICDHVGIRDGIRIWTEQLKSILEESLNDKIFKTAENWLLYGLNSMVATLLAKDVFELQRIVARLPFEQHRSLSASPTALIAQLTTNAAEFTQSGPNRELLFALAKLGQQLLLLRNLQMFVKAEKHSQLGTLQTAERTLRRSSTHLESRDQG

SEQ ID NO: 127529 - protein, 84 aa, Heterodera glycines
  Coding regions on vcDNA: vcDNA=SeqID_53952; Strand=-; Position=1 -210,1122-1166
MTLPTRFHANQMTPRHTDDDDHGNEALNIFNDAFGLPLAPPDGPNEAALPADQQAAPAQQTDEANAERGHLDLWRRVDGHSAIF

SEQ ID NO: 127530 - protein, 16 aa, Heterodera glycines
  Coding regions on vcDNA: vcDNA=SeqID_53953; Strand=+; Position=1-50
MQRPFGNLAVFQPLID

SEQ ID NO: 127531 - protein, 32 aa, Heterodera glycines
  Coding regions on vcDNA: vcDNA=SeqID_53954; Strand=-; Position=1-248
THFVFINFEKFWTFRGFLLFWTFRGLDTLWGC

SEQ ID NO: 127532 - protein, 422 aa, Heterodera glycines
  Coding regions on vcDNA: vcDNA=SeqID_53955; Strand=+; Position=1 -95,139-256,358-459,504-576,674-804,1213-1395,1624-1677,1726 -1767,2072-2541
  Homolog annotation: Hit_ID=CAG04177.1; Match level="QueryCoverage =59%, HitCoverage=74%, E-value=9e-26, Identity=30%"; Hit description =unnamed protein product [Tetraodon nigroviridis]
MTNRAEYLFRFFESMPEKELREELRKAPLYQGGTRKQMLKRLRDHHRKELIEHRKKNHRNFLTENLYDYLIVIDFECTCEAGKYEYDNEIIEFPAVLVSVKGRKIIDTFHAVIRPKMNPKLTEYCTKLTGFVNFFHFLTGITQQMVDEACTFPEVLDMFRDWMAKHGLDGLHRALGHWQVFAVGLPALGHAVAARLPQLCEPAPCVRQLLLPRAARPAEAGTSAQRGVERNAQAINIARIVIQMLNDHAELRVNEKLVNGALLLPWHQKQLIFTDQMWEKRQKNGTTTNNNQSKAAPSPPLAALEASHAATMSFLDSFGSSTSASSSAEDIICAGMARMGFRDVDDDGYEEEEAAAVNGGGGTSPMNGGGNNKLATATTTAKLFQNGITTNTNGKKGGDDDDDGQEEEANDGDTTITAHGNG

SEQ ID NO: 127533 - protein, 65 aa, Heterodera glycines
  Coding regions on vcDNA: vcDNA=SeqID_53956; Strand=-; Position=1 -204,382-414,928-1221
  Homolog annotation: Hit_ID=NP_510604.1; Match level="QueryCoverage =100%, HitCoverage=100%, E-value=1e-23, Identity=80%"; Hit description=ribosome associated membrane protein (XQ461) [Caenorhabditis elegans] emb|CAB03157.1| Hypothetical prot
MAPKQRMSVANQHFSKNVVARGQVAKSLKPKENQYPAAPWLIGIFVFVVCGSAVFEIIRYVKLGF

SEQ ID NO: 127534 - protein, 287 aa, Heterodera glycines
  Coding regions on vcDNA: vcDNA=SeqID_53957; Strand=-; Position=1 -419,604-661,705-1003,1110-1194
  Homolog annotation: Hit_ID=NP_496282.2; Match level="QueryCoverage =88%, HitCoverage=30%, E-value=1e-29, Identity=33%"; Hit description =glycosyl transferase c14a4.3 (2K881C) [Caenorhabditis elegans] emb|CAA90107.2| Hypothetical protein C14A4
MKVVNLSLKLKFSIKIPKKLMKILNTSSFVPCQERFLFPVYPHICVLAALGFDLLRRLCQASFSNRDDGIAAAAVPSSSSSSSVRRPAGGATIRRGQQQQQQFGIGTALCALVAALFVLFSVSRIAAVRRNYAGLMDTYRAFNEQILQRQQLLDYAEMRDPIRLCVGKEWHRFPSSFFLPESAAIIIDDNGTNNSGTSGGKPRQRPAVEMEFVRSEFRGILPAHFAGSADDGTSSTLRHSTAHAPLGRMNDANREEMDRYVPVESCDFLVHLEDGQETELEPNYAKM

SEQ ID NO: 127535 - protein, 67 aa, Heterodera glycines
  Coding regions on vcDNA: vcDNA=SeqID_53958; Strand=+; Position=1-204
MPNLYNVWFNEYSNVADGGGTLSDQPSTSQQPDFDQFEECSDEEFLDDPEVPSTSHQTNPHQRHPPA

SEQ ID NO: 127536 - protein, 109 aa, Heterodera glycines
  Coding regions on vcDNA: vcDNA=SeqID_53959; Strand=-; Position=1-330
MMFRQRRFGVHRRGRRPQGVARTTYLPTNQTKNEKGTNVPSRVPSFRCWTVQIAQTWQSFAFQIGTRSLPMCHYNHHPFDLLRLVVGVVHQKEQVQWSRQIGTMPSRKK

SEQ ID NO: 127537 - protein, 254 aa, Heterodera glycines
  Coding regions on vcDNA: vcDNA=SeqID_53960; Strand=+; Position=1 -411,875-1228
  Homolog annotation: Hit_ID=AAQ11020.1; Match level="QueryCoverage =92%, HitCoverage=75%, E-value=3e-20, Identity=29%"; Hit description =mesocentin [Caenorhabditis briggsae]
MEYCNCSIPTGRPLPSDASGHFVDQSDEQIPLDQFGQPLGPDGLPLMTNSRGEYVVHSSPAIPTASIGPTTVPIALPFPALSGPGLKAEAEKEEEETEEGMPPTDSTGRLVLPVISADTGQLMPRNEEGQFVNAHGEVIPTDDFGRPFDWHGKVLPRNELGQFVFHDAVQWPDDHQTAPPEVGDAASTALLAQREQQQMLQRRRNQTAHCFVGGFVELLNVFDTSANVKILDYRMMKEAVKVSGGNGEAADQHV

SEQ ID NO: 127538 - protein, 348 aa, Heterodera glycines
  Coding regions on vcDNA: vcDNA=SeqID_53961; Strand=+; Position=1 -29,564-688,749-812,858-941,997-1107,1206-1280,1340-1549,1799-1952
  Homolog annotation: Hit_ID=NP_509165.1; Match level="QueryCoverage =97%, HitCoverage=43%, E-value=6e-73, Identity=41%"; Hit description =UNCoordinated locomotion UNC-6, netrin (68.4 kD) (unc-6) [Caenorhabditis elegans] gb|AAA80449.1| Uncoordi
TQTKLNEKSACNCNLHSRKCRFNAELYRLSGYQSGGVCLNCRHNTAGRNCHYCRFGYFRDQSKPITYCRFGYFRDQSKPITHRKACKPCLCHPIGSLSRNCNQTSGCLCHPIGSLSRNCNQTSGQCICKPGVDGPTCNRCAKGFQQPTCNRCAKGFQQSLSPDTPCVRKSPLLPFASPFQRVSADADECEKCRASPSRLTLKKFCRRDYALKLQLISRELVEGWAKFRLKLQLISRELVEGWAKFRAQLLDEPIKDELGTLLGAEMGRGTEISLWLPNRNLICKCPRLKVGRKYLLMGEKSLAKPSSAIVFDRHVVMMEWADEVAERATRFAQKRHFGEMPTDESKGR

SEQ ID NO: 127539 - protein, 292 aa, Heterodera glycines
  Coding regions on vcDNA: vcDNA=SeqID_53962; Strand=+; Position=1-876
  Homolog annotation: Hit_ID=Q03650; Match level="QueryCoverage=96%, HitCoverage=83%, E-value=3e-35, Identity=33%"; Hit description =Cysteine-rich, acidic integral membrane protein precursor
MINLQNVDDSSVTDDKSSNVDDCSVTDDKPSDVDDSSVTDDKPSDVDNSSVTDDKSSNVDDCSVTDDKSSNVDDCSVTDDKSSNVDDSSVTDDKSSNVDDSSVTDDKSSNVDDCSVTDDKSSNVDDCSVTDDKPSDVDDSSVTDDKPSDVDNSSVTDDKSSNVDDSSVTDDKSSDVDDSSVTDDKSSNVDDSSVTDDKSSDVDDSSVTDDKSSDVDDSSVTDDKSSNVDDCSVTDDKSSNVDDCSVTDDKSSNVDDCSVTDDKSSNVDDCSVTDDKSSNVDDSSVTDDKSSN

SEQ ID NO: 127540 - protein, 113 aa, Heterodera glycines
  Coding regions on vcDNA: vcDNA=SeqID_53963; Strand=+; Position=1 -24,294-421,802-991
MPRDEAENVRHCCCCCFTPLNILRTHQLFMLNTSNIEPYYNTLAKQHLVCSHFFFTTQFRAQALSDFGTLHDKWRTNSWPFPCAVMACHGDGQVLMCQPENRPNDPGRGHKTM

SEQ ID NO: 127541 - protein, 126 aa, Heterodera glycines
  Coding regions on vcDNA: vcDNA=SeqID_53964; Strand=-; Position=1 -128,222-367,863-905,1150-1215
  Homolog annotation: Hit_ID=CAE68703.1; Match level="QueryCoverage =97%, HitCoverage=20%, E-value=2e-33, Identity=56%"; Hit description =Hypothetical protein CBG14624 [Caenorhabditis briggsae]
LIDDYKNAIDSMHTRLWRHSMPNALHFVGELLAVDVKFSPKMDHLVCFLAGTLALGHHHGMPSLHMEMAKNLSATCHAMYQNPTGLGPEIARKAAATTVPDLYIKPLDAHSLLRPEAFEGGWHSME

SEQ ID NO: 127542 - protein, 136 aa, Heterodera glycines
  Coding regions on vcDNA: vcDNA=SeqID_53965; Strand=+; Position=1 -107,225-334,392-482,540-641
QWRKEFLDGRYGSKQPTPPSTPRAPSPSFPIPVIVGRQMFPNDDGYESEDDEILLPPPPIPPQLGHPPPNVPAVRVQPMHVGQQRLPLRVLPQIFHPPPHVPGRSCPINAATRTNESRATIPHLPQNARYLEPRFS

SEQ ID NO: 127543 - protein, 222 aa, Heterodera glycines
  Coding regions on vcDNA: vcDNA=SeqID_53966; Strand=+; Position=1-669
MKFCILLFLFLIALIIPIESEKKKLQQKSFDEIFGEKWEEKEDKREIIEKYYKIKEKIKQKGRKYSTNEWRKIEGKIAKKLGTNRQYIYKWIKEFGLQKCKSYKSKTDEGKIEIVLKFIEMTKEYKQKSKYSQKEWNQNYAEICKKIGVSKTTIIKWKKQFGISKKIITKEEKIEKMKIYWEIKKENPKMSDNEIAKIVNTSNANICNWKKQFGEENFERLN

SEQ ID NO: 127544 - protein, 71 aa, Heterodera glycines
  Coding regions on vcDNA: vcDNA=SeqID_53967; Strand=+; Position=1 -48,111-278
MGREGATAGARCEGHNFGDYFASVRIRLDFAITFAHKNMKNGVRYLQIQVNLCIYDTVKNYKMKKCHIGKI

SEQ ID NO: 127545 - protein, 220 aa, Heterodera glycines
  Coding regions on vcDNA: vcDNA=SeqID_53968; Strand=+; Position=1-663
MKLFPLLLLIILFLIVKIGSEKKKLQQKSFGEIFGEKWHEKEEEKRNELKKREIIAKFNKIKEKIKQKGRKYSTKEWDKINSKIAKKLGTNRNKIYEWIKEFGLQKCKSYKSKTDEEKFKIVQEFIEMTEEYKQKSKYSLKEWHENYAEICKKIGVSHGTIYKWKKHFGIRSKITEKEKMGKIKKYWEIKKENPKMSDKEIAKMMKINRTNISKWKKLFG

SEQ ID NO: 127546 - protein, 104 aa, Heterodera glycines
  Coding regions on vcDNA: vcDNA=SeqID_53969; Strand=-; Position=1 -168,513-656
MASTKPNTLFNKMRNLVGEQSSNMLGNIAGGGGGAGTQLSSQHRPSTAQFHHFNAGQASAGGGTAAGANNSAQLGQQYVNFLRASSEQLQQVIADEVWVNRLLE

SEQ ID NO: 127547 - protein, 135 aa, Heterodera glycines
  misc_feature (103)..(103): Xaa can be any naturally occurring amino acid
  Coding regions on vcDNA: vcDNA=SeqID_53970; Strand=-; Position=1 -157,431-502,581-760
  Homolog annotation: Hit_ID=CAE74552.1; Match level="QueryCoverage =94%, HitCoverage=11%, E-value=3e-40, Identity=61%"; Hit description =Hypothetical protein CBG22310 [Caenorhabditis briggsae]
AFAWFSDLLADHSEIFWSLYSVDLDAALELQPPDSWDSFPLFQLLNDYLCIDQNLRMGIFHSKLISQFSPMVVRYIDLMEHSISQSIEKNFCREKWEVSELYXLSLCTLKPKRNDQRTPEKDLRDHLAIRGLTRL

SEQ ID NO: 127548 - protein, 232 aa, Heterodera glycines
  Coding regions on vcDNA: vcDNA=SeqID_53971; Strand=-; Position=1-699
MQIFSCAEFSMQNVDYQAVNNCYRYIPVQIRIEKKTLNAFLDPELHILTASSPFADCGNFRYHYLQLSQNNWIKIDTRTATIQKIDSSSISEIREASGDKSLLEITPLVFHRCTIDNETGEGLFAHLDEWLRLDQWKSKEKEHKTARALTLGALPNGVIGLTEEWFMDKLRLLVSYWTTACCIYVTFMCPPIVPFFPLHFPSHFVPIVTISPLCISHTFLMYGFNYPSLSLR

SEQ ID NO: 127549 - protein, 183 aa, Heterodera glycines
  Coding regions on vcDNA: vcDNA=SeqID_53972; Strand=+; Position=1 -170,372-753
MSPTLSTASHCPVVSVSAFSFLSVLFILDLFIALAERSGKRVSEKRREVLRKANLSCQYIFGDNNCEGNDGENDGQQLADGSESLRETQLLASILGHLQNALEGRMANCVDAEGENVAKWQIGEKEEEEKGHEEEAKMVASLWEEQVEIVRGMARHLTPILDGWSKSGGTDQNTSDGSATGQF

SEQ ID NO: 127550 - protein, 86 aa, Heterodera glycines
  Coding regions on vcDNA: vcDNA=SeqID_53973; Strand=+; Position=1 -91,297-446,528-547
MHNPFGLDTLNIDYNDDPLAHFQVHQINISGSAAKVHIIAPGDKLPFANNSVDFVINSHVFEHFYDPIRTIEEWLRVVKPVIIFFM

SEQ ID NO: 127551 - protein, 103 aa, Heterodera glycines
  Coding regions on vcDNA: vcDNA=SeqID_53974; Strand=+; Position=1-312
MPGAAHLARLIQGHSLKSQNASLRSDHFDLCLSEWLCSSQHHMQAETWKMPVVPRTERSGAFGRSTPAVLQKMVSARLMIKCPQVPHGCWCAKPDKRRTTRNM

SEQ ID NO: 127552 - protein, 17 aa, Heterodera glycines
  Coding regions on vcDNA: vcDNA=SeqID_53975; Strand=+; Position=1-52
LGSPIIWKSIFFSWTVG

SEQ ID NO: 127553 - protein, 77 aa, Heterodera glycines
  Coding regions on vcDNA: vcDNA=SeqID_53976; Strand=+; Position=1 -76,469-626
MPLRSSAEARRSDRGQPGAGSQMAEAAETDFMTDIKLRALKKSIKMERGPLRDIYDIQEAEVEEYSASEATSVQNGS

SEQ ID NO: 127554 - protein, 71 aa, Heterodera glycines
  Coding regions on vcDNA: vcDNA=SeqID_53977; Strand=+; Position=1-3,84- 167,235-303,1476-1535
  Homolog annotation: Hit_ID=NP_741810.1; Match level="QueryCoverage =71%, HitCoverage=12%, E-value=2e-17, Identity=80%"; Hit description =aspartate aminotransferase Complex With Alpha-Methyl (45.6 kD) (XG861) [Caenorhabditis elegans] gb|AAA803
MILGVTEAFKRDDNPKKVNLGVGAYRDDQGMPFVLPSVKQAEKELLEANLDKVSVSVRTPSSVRTRKKQPE

SEQ ID NO: 127555 - protein, 126 aa, Heterodera glycines
  Coding regions on vcDNA: vcDNA=SeqID_53978; Strand=+; Position=1 -117,611-874
MPGDVERCLAETGIDAVMSAEGVLNNPHLFDGKNPFSFEVLSTPHFFCKPYVRQMLKCAAEASENGDDVPNLPVSVSAYREKRRAEIERLAKEAGVSKRQIRKREKRKRGQTKEQNRKQTYPKCER

SEQ ID NO: 127556 - protein, 24 aa, Heterodera glycines
  Coding regions on vcDNA: vcDNA=SeqID_53979; Strand=+; Position=1-73
IPAPKAAAAIKKYSSAIEVVRWLQ

SEQ ID NO: 127557 - protein, 223 aa, Heterodera glycines
  Coding regions on vcDNA: vcDNA=SeqID_53980; Strand=+; Position=1 -339,456-587,637-834
  Homolog annotation: Hit_ID=NP_499802.2; Match level="QueryCoverage =91%, HitCoverage=34%, E-value=2e-56, Identity=47%"; Hit description =CD36 antigen family member (3O640) [Caenorhabditis elegans] emb|CAD45598.1| Hypothetical protein Y76A2B.6
TSVLTEGTIILSKWSDPTYFIRTQMYTFTVRNPDEITHGAIPSVKRQGPYSFDQIQKRKIHQIVNGTVQFETLQSYHFNEEASCAECFLYNRIWIPNLVYQKFVEAASKPAMRVEVAELLYDGYKDPFLDQICSLPVVNFVCEQILHLPDRIGLFYKKNGTANGVFVVEDGHTENAESLGRILSWKGSKSLPDYWWEGDQALLINGGNEKQSLQSLGHSPPFE

SEQ ID NO: 127558 - protein, 324 aa, Heterodera glycines
  Coding regions on vcDNA: vcDNA=SeqID_53981; Strand=-; Position=1-975
MSAKIIRVPKIACDLSLEKNGVSKNRNYAQKASQTILALPIPSTIAFIHPIMSAKIIRVPKIACDLSLAKNGVSKNRNYAQKASQTILALPIPSTIAFIHPIMSAKIIRVPKIACDLSLAKNGVSKNRNYAQKASQTILAHPIPSTIAFIHPIMNAKIIRVPKIACDLSLAKNGVSKNRNYAQKASQTILALPIPSTIAFIHPIMSAKIIRVPKIACDLSLAKNGVSKNRNYAQKASQTILALPIPSTIAFIHPIMSAKIIRVPKIACDLRLEKNGVSKNRFSNNFTLPKASQTILAHPIPSTIAFIHPIMSARIIRVPKSHVI

SEQ ID NO: 127559 - protein, 42 aa, Heterodera glycines
  Coding regions on vcDNA: vcDNA=SeqID_53982; Strand=-; Position=1 -80,605-653
MSSLIWQIGLFNKLLEGKAECTETAEIFELLSFHMSLCFAFI

SEQ ID NO: 127560 - protein, 341 aa, Heterodera glycines
  Coding regions on vcDNA: vcDNA=SeqID_53983; Strand=+; Position=1 -133,530-739,1019-1149,1478-1738,2221-2511
MTKVSYLLSFRSFRSGNSLQWPIWEQDIAHFFLPNANNAISLQLDFLTNCHGLIQQLLAFQFNVGIMETVAWDLSLSIFRALPTIKKFGISQSATPTIAQWHILGYEKIVGAMPGKDLARIGDHKFATENAIKVNPNYFRERNVNSYIKLHEQAIKTVEEKFLEAIRQEKLSRKIFEDILIQENFSEWEFKHRMDFFITNTQPFLDFPIVEQEIAKERSIKQKNRIIFIGGITMPKNGALPSLSEDNKQIFESARNKNGGVVLLSFGSVVPMHDDDAHAVAFKNIVVNLFSKQYPQMNMIIKWGERPPIGMGDQYKKMSENIYAKAWLEQSAILGIAKMAS

SEQ ID NO: 127561 - protein, 105 aa, Heterodera glycines
  Coding regions on vcDNA: vcDNA=SeqID_53984; Strand=+; Position=1 -148,198-367
  Homolog annotation: Hit_ID=CAA52214.1; Match level="QueryCoverage =76%, HitCoverage=16%, E-value=3e-12, Identity=50%"; Hit description =UDP-glucoronosyl transferase [Pleuronectes platessa] sp|Q91280|UGT3 _PLEPL UDP-glucuronosyltransferase (UDP
MPKLFITHGGQNSINEAVKFGVPLLLFPFFADQFNNAEAMAARGVAKVLDIRSKTLENELAEALNEIFANYSMYKQKIEELSNKLSSIDIAKEFLGAFRQLRKTL

SEQ ID NO: 127562 - protein, 176 aa, Heterodera glycines
  Coding regions on vcDNA: vcDNA=SeqID_53985; Strand=-; Position=1 -135,513-703,750-954
MIFVHTYIIYIGHILFVERTMATFMANKYESVKNNWFSASWFIILLTENIRTGHQLWPTFLLHFSIIGWTSIFNFLYYIIIYSLFLFFVQFNYLFLSFYHLLIEYTIISRHPILRQNAVQILKKIFNKFSMKIPCNNRVNDNVKHPTIGRIDGRNLPEKHLMNETDQHFKILKELW

SEQ ID NO: 127563 - protein, 98 aa, Heterodera glycines
  Coding regions on vcDNA: vcDNA=SeqID_53986; Strand=-; Position=1-297
MSNSSADDQGEASQFIKIGIPIVLGLNVCVFVVQIPLSLLNIGILCRTSLLHRNLKFILFIQSVLFCTFALTLCVQFLIIAFYGIQQWASFTPLLVNY

SEQ ID NO: 127564 - protein, 78 aa, Heterodera glycines
  Coding regions on vcDNA: vcDNA=SeqID_53987; Strand=-; Position=1 -130,196-301
MTDQCQREKGDIRLIRARGNGEGTGRGSDEKEKGNGRAKEPNEAKVPQTNRPQIQTLMGQSDAGDRFCSPIRPRMTAH

SEQ ID NO: 127565 - protein, 362 aa, Heterodera glycines
  misc_feature (69)..(69): Xaa can be any naturally occurring amino acid
  Coding regions on vcDNA: vcDNA=SeqID_53988; Strand=+; Position=1 -293,457-492,549-595,644-761,877-1049,1117-1284,1328-1439,1490-1510
  Homolog annotation: Hit_ID=NP_499725.1; Match level="QueryCoverage =89%, HitCoverage=43%, E-value=1e-75, Identity=46%"; Hit description =leishmanolysin-like (76.1 kD) (3O317) [Caenorhabditis elegans] emb|CAB16471.1| Hypothetical protein Y43F4
SYQANISLFSLALISHFGCIPLQVPGPDQLTFGVPLLRPFPFSPPRPAPFRRPRPTTAPLSPRLGRKPXFRPLRIHLHFDPVIIELSIEISALIISTLLPQAISFWQKSLLVRPANKSLLVRPANVPIRLSRKCESNQYYSDQSSAFLRKCESNQYYSDQSSAFLRCVTRCKAITNCGEVQVPDAHLFFCLQSNPLSCIPSGPSDGPGVSDTDFLLYVSAVDTQRCRNEETIAYAAHCQQESELDRPIAGHVNICPGALSTHAHDKEVLLSTVKHEILHALGFSAGLYAFFRDAEGKPRSKRNVNNRPLSFNVNNRPLSFNRERGYYDADPSTVRTVVREDWWTAEGQIPHPIHLIPHPIHL

SEQ ID NO: 127566 - protein, 22 aa, Heterodera glycines
  Coding regions on vcDNA: vcDNA=SeqID_53989; Strand=-; Position=1 -28,195-235
MSLLRTVKDCHVELRKKIGKKL

SEQ ID NO: 127567 - protein, 69 aa, Heterodera glycines
  Coding regions on vcDNA: vcDNA=SeqID_53990; Strand=-; Position=1 -15,904-1098
MGPENLPKIEEFSYKWGKAVLISQLLLCPGWLYKMKVSNLKELDELMSEQSYKNFLAEESNKDDETQHF

SEQ ID NO: 127568 - protein, 111 aa, Heterodera glycines
  Coding regions on vcDNA: vcDNA=SeqID_53991; Strand=-; Position=1 -193,619-760
  Homolog annotation: Hit_ID=XP_392504.1; Match level="QueryCoverage =100%, HitCoverage=21%, E-value=2e-34, Identity=66%"; Hit description= similar to Protein kinase shaggy (Protein zeste-white 3) [Apis mellifera]
PGSGNERSIELQYSEAKVIGNGSFGVVYLAKLVYNNEDVAIKKVLQDKRFKVPPNVVWIGLAGVNRELQIMRKLDHRNVVKLKYFFYSSGDKKDEVYLNLILEFVPDTVYR

SEQ ID NO: 127569 - protein, 251 aa, Heterodera glycines
  Coding regions on vcDNA: vcDNA=SeqID_53992; Strand=+; Position=1 -25,94-284,384-533,679-1017,1285-1335
  Homolog annotation: Hit_ID=AAP88799.1; Match level="QueryCoverage =98%, HitCoverage=28%, E-value=4e-44, Identity=40%"; Hit description =karyopherin (importin) beta 1 [Homo sapiens] ref|NP_002256.2| karyopherin beta 1 [Homo sapiens] gb|AAH2404
MAIPLKVEVLKSDFQKYIIEFKPFLLTSLDNHEDPQVCIAAIGVISDLCRAFEQHIAYVMDEIMEKLLGILQDPKVKRTVKSQVLNAFGDVALALNAQYSRYLASNMKWLSDAIAAAQITNPDDYDQVEYVENLRESCCYAFSGIVQAMNGTDEGKQQIQHSIQPMLQLIVLIANSQPSAPESLCASACALAGDLLHAFGVQFLPVVDAADFGISALITKCKKSRQNKAKTIANWVTRELSRVKRQAAGQS

SEQ ID NO: 127570 - protein, 158 aa, Heterodera glycines
  Coding regions on vcDNA: vcDNA=SeqID_53993; Strand=-; Position=1 -71,145-216,271-776
  Homolog annotation: Hit_ID=XP_520831.1; Match level="QueryCoverage =78%, HitCoverage=12%, E-value=4e-11, Identity=34%"; Hit description =PREDICTED: similar to copine VIII [Pan troglodytes]
SPIKSILCLSVPRLVPIRFVQNLEVNDPRCRGVDGLLEAYAIALSHVELRWTNPPASVAFRFRFSLPIAFSGPTDFTPTIRLAARRAAALPENGSRYCVLLIVTDGAITDFEETKEEIVKVFTGCLPARFLLSIIFTVSLISCPPPIFRLLLFPCPLL

SEQ ID NO: 127571 - protein, 284 aa, Heterodera glycines
  Coding regions on vcDNA: vcDNA=SeqID_53994; Strand=+; Position=1 -111,154-225,467-763,1036-1206,1257-1458
  Homolog annotation: Hit_ID=NP_872104.1; Match level="QueryCoverage =80%, HitCoverage=37%, E-value=2e-32, Identity=37%"; Hit description =c2, putative phospholipid binding domain containing protein (69.8 kD) (4S226) [Caenorhabditis elegans] em
MKDQSSLHRFDHSNRPNQYEIAIGAIAEICQHYSKNKLFNAYGFGARIPSLDDKVHYNFPLNLEVNDPRCRGVDGLLEAYAIALSHVELRWTNPPASVAFRFRFSLPIAFSGPTDFTPTIRLAARRAAALPENGSRYCVLLIVTDGAITDFEETKEEIVKVLPNFDDHFWHFPQFVQMRKFLPPHRSLTEQELATAKAKLAKEVLFEVPAQLIGYMKSKGICPRPPDDPFTAVNQCETLAQRFMKWESGESGGTEGTAQQQRRSSSLKSSKEMLRAMQQKRASA

SEQ ID NO: 127572 - protein, 140 aa, Heterodera glycines
  Coding regions on vcDNA: vcDNA=SeqID_53995; Strand=+; Position=1 -162,200-497
NLNECLLLAIKHNAKSDQCVFLLIIPKSNQTSSAASSPSPSSPSFHLPLPSVRLCLVRFLFTHTIFPGPKPIGTVGKLHPLGIWRAVECPPSPDILDIFENFSSNLAPLSPAHRPKSGPIAADNRRGDGWKLTNLRCGTP

SEQ ID NO: 127573 - protein, 59 aa, Heterodera glycines
  Coding regions on vcDNA: vcDNA=SeqID_53996; Strand=+; Position=1-178
MEDSLSKGLAQYRQGVGPQNSKIRQSKSAQCSDHQLQPAVPQLDNFQRLGQATTKTGGN

SEQ ID NO: 127574 - protein, 99 aa, Heterodera glycines
  Coding regions on vcDNA: vcDNA=SeqID_53997; Strand=+; Position=1 -161,324-406,457-512
MCSAPTRAIPSPNFLPPLCPSECRRSRSVSIDRIGLTPPIGPIDTIEISTLTSRYQYDSPYYYRRYHDNYNIFYNTELMSYGNRSKLMENLYQGTPITQ

SEQ ID NO: 127575 - protein, 159 aa, Heterodera glycines
  Coding regions on vcDNA: vcDNA=SeqID_53998; Strand=+; Position=1 -45,347-781
MERDRPCEPLVKYLQEKNAAGVISVPGAVVYVLTDTPITQKLVKFFTPRLCPLLTPTPNHLVLVLKLTAQPTVMGGANSGGGGNAMTAAPTSYGLLSATMAPPNLTTAEMKKELVDTTTMAMMTTNSVVKTETWKVVGGEEIAPPPPPPQPPSGTADYT

SEQ ID NO: 127576 - protein, 164 aa, Heterodera glycines
  Coding regions on vcDNA: vcDNA=SeqID_53999; Strand=+; Position=1 -100,477-720,905-1056
RLEHCGSDFYACVEQLSSNFPSFPQIREEIVEKTLSILSKGGGQCRNIAFAKILLPIFASIGPIQRAELISRIISFDYFDQNSESISICGALGQTKLHLHQLFLFKELVSTTKFDLVESREEIFQFIMRIIQIAMKRGQMERWRLFSMAGNAFGVFFFFVYIQD

SEQ ID NO: 127577 - protein, 34 aa, Heterodera glycines
  Coding regions on vcDNA: vcDNA=SeqID_54000; Strand=+; Position=1-109
PSAPFAVDTQRINSDTTIWTHLSAEGPQKATIVI

SEQ ID NO: 127578 - protein, 29 aa, Heterodera glycines
  Coding regions on vcDNA: vcDNA=SeqID_54001; Strand=+; Position=1 -50,419-458
MKEWRFEVKKLLNNIPRKLIDVIVPGSYI

SEQ ID NO: 127579 - protein, 87 aa, Heterodera glycines
  Coding regions on vcDNA: vcDNA=SeqID_54002; Strand=-; Position=1 -126,340-477
MLEHLGIFNKTVIGFSALGYEIMRKNDGVLDLNKFTKLNISMICSILYGERRSVLYDRQSLTTSFLRHNTFVIFNMPYQKSLKERVR

SEQ ID NO: 127580 - protein, 245 aa, Heterodera glycines
  Coding regions on vcDNA: vcDNA=SeqID_54003; Strand=-; Position=1 -364,412-785
MRNVPRNTRGEICEMRFLPLEDTQRPDLLMEVLIQHLLDRVLDGHPPPSLVGLQLHPPGFDRPYVIRLRPPEQNNAAALAAAIERLNEQSAAGIDLFAGTTVAKVLAVWPLEPIRADPQRGGGCDLEAEHHASHTVQSLVRVVNPNDRLCLARAVLLGLRDRETRMAGGGGRATFTEYARHQEQHGRDAEELLTRAGIPLDKGMYTLVDVARLQRMLNNTNGIGQIRLAVFEKEREYLIVYKGQG

SEQ ID NO: 127581 - protein, 119 aa, Heterodera glycines
  Coding regions on vcDNA: vcDNA=SeqID_54004; Strand=-; Position=1 -344,388-403
KEFLITKTHLSVCEVPIVLGFGTRPPAYKSFNLKNHLTWINDTQESLVGIKIGCDIGLAYRNNYVIGSAIFHPQQQQSGGQSILYPYFAIYVNISIFVHILAFFQKTFIITAPIRKRHF

SEQ ID NO: 127582 - protein, 48 aa, Heterodera glycines
  Coding regions on vcDNA: vcDNA=SeqID_54005; Strand=+; Position=1 -83,272-335
MEEDIGGEESDNDTIDFFADSVDEIMENNSEKDEDEPTSTVYLDRKKS

SEQ ID NO: 127583 - protein, 359 aa, Heterodera glycines
  Coding regions on vcDNA: vcDNA=SeqID_54006; Strand=-; Position=1-1080
  Homolog annotation: Hit_ID=NP_502797.1; Match level="QueryCoverage =98%, HitCoverage=98%, E-value=2e-53, Identity=33%"; Hit description =HASI (4P602) [Caenorhabditis elegans] emb|CAB16520.1| Hypothetical protein Y57G11C.19 [Caenorhabditis ele
MELINTILDKMYNDPSSPAAFAGVTALWKEARKKIKHVRKDQVQSYLDGHRTYTLMRPRRVHFPRAKTVAAGFMTDVQVDLADFQALSRHNGGHRYLLVAIDVLSKRLFVIPLKNKRAEEMLEAFKKLIDQMPMVPHRIFSDKGTEFKNRLLKEFFEEQEIGKHEPVHSSVKASVAERAIRNVKQRLYRYFAQKQTLNWVDTVQQIVDGINNAPSRVHGIRPIGVNFQNAQKVWKRMYGPQSFVKKSPRFRKDDFVQMSREKGQFEKGYLPNYGDEILEVDQVLKTVRPIRYKLRDDNGEKFRGTFYEQELARVRKDEETSYRIEKVLKKRRKPDGSTEMLVKFIGYPEREWISESQLV

SEQ ID NO: 127584 - protein, 17 aa, Heterodera glycines
  Coding regions on vcDNA: vcDNA=SeqID_54007; Strand=-; Position=1 -38,419-434
MGRTTVRVQHYMRTKKS

SEQ ID NO: 127585 - protein, 81 aa, Heterodera glycines
  Coding regions on vcDNA: vcDNA=SeqID_54008; Strand=+; Position=1 -153,534-626
MALDANKNTLMVFLIPTGAPCRVRPNCCTTMPNSTCCAALPPKQCFIGTTTRHAEKSGILVVFLPKNDNLAIFVSMFKKYD

SEQ ID NO: 127586 - protein, 277 aa, Heterodera glycines
  Coding regions on vcDNA: vcDNA=SeqID_54009; Strand=-; Position=1 -250,397-980
  Homolog annotation: Hit_ID=CAA82797.1; Match level="QueryCoverage =48%, HitCoverage=21%, E-value=6e-14, Identity=34%"; Hit description =gag protein [Ascaris lumbricoides]
MSGQLRAKIPLLNRVLIKEIQKIKSKIEEGNFEYDKNNFDDCSRIFNKTKEIIQRIEPNFEKLKILHQKWQNLMRQMNKTEWNKSDQENESIDEEQLNDDEEAGEEEDEDEKEYDSDQEDESQEMHSSDQIHRNRIPFAHQRSRIKLPAQTLTHFSGKFSQWPSFWDDFKSSVHNDPNMENIQKLKYLRGLLHDEPYRIVSPYPLINKNYPIIIKLLKSRYGNPELIRENLHSELRNLKRPIESTIELRKFILLIDRMILQLKSQGEDIIEGKLSSL

SEQ ID NO: 127587 - protein, 175 aa, Heterodera glycines
  Coding regions on vcDNA: vcDNA=SeqID_54010; Strand=-; Position=1-529
TSITGTLFSCVSITRTQFLCIPITVTHSPAFQSLGLNPPAFQSLGLNSLAFQSLGPNLTWSFGIAIIETQFCDIPITGTQFCDIPITGTQFSIIPIPGTQSHQHSSHWDSVLLHSNHWDSILHFSRILRHRNNRGLSSPPFQSPRTQSFTIPNNELNFTDSSACQSRDLIQTCSA

SEQ ID NO: 127588 - protein, 86 aa, Heterodera glycines
  Coding regions on vcDNA: vcDNA=SeqID_54011; Strand=-; Position=1 -102,347-439,549-614
MLMQDKHLEIFYNNKHHEHPLFSRFSQHALRKDGLLLFWFIESHAGLIVARELMGELFETFKMDMSTGSLYDETNNGIVQRSGNGI

SEQ ID NO: 127589 - protein, 154 aa, Heterodera glycines
  Coding regions on vcDNA: vcDNA=SeqID_54012; Strand=-; Position=1-462
  Homolog annotation: Hit_ID=CAG83749.1; Match level="QueryCoverage =96%, HitCoverage=32%, E-value=2e-18, Identity=43%"; Hit description =unnamed protein product [Yarrowia lipolytica CLIB99] ref|XP _499823.1| hypothetical protein [Yarrowia lipol
MHFFCPLLITVVPLLITAVPLLITAVPLLITAVPLLITAVPLLITVEPLLITAVPLLITAVPLLITAVPLLITVEPLLITAVPLLITAVPLLITVEPLLITAVPLLITAVPLLITAVPLLITVEPLLITAVPLLITAVPLLITVEPLLITLLIA

SEQ ID NO: 127590 - protein, 99 aa, Heterodera glycines
  Coding regions on vcDNA: vcDNA=SeqID_54013; Strand=-; Position=1 -210,332-421
  Homolog annotation: Hit_ID=S70713; Match level="QueryCoverage=94%, HitCoverage=6%, E-value=1e-09, Identity=36%"; Hit description =protein-tyrosine kinase let-23 precursor homolog - Caenorhabditis vulgaris
MGHYERLRKSYSRCRRVIGNLELTHVDEHDVRRDVQRQNNQSASDKDGAASFAQRLTDRAPFHFLEHLEEITGYLLIYNVKIREISLPKLRLIWGAKIA

SEQ ID NO: 127591 - protein, 58 aa, Heterodera glycines
  Coding regions on vcDNA: vcDNA=SeqID_54014; Strand=-; Position=1 -167,399-408
MRVRHFLQLVLYRHFVHSLIIFLIITDWSSNAARRRGGGSTTQRKKQGNQKLTTKKKI

SEQ ID NO: 127592 - protein, 141 aa, Heterodera glycines
  Coding regions on vcDNA: vcDNA=SeqID_54015; Strand=+; Position=1 -306,416-517,814-831
FHEDVKVISPPPLLADCHADENGNYSYEYAVADDSPPGVEFIGQKFDENEAKLDEKNEEEKEKHWMREKGWDGTRAEESEEDEAEAFGQSRMIGCGQTMFHRVEYGQQSPTADWPWAASVRIACETKGSNKSEVQQLAGPV

SEQ ID NO: 127593 - protein, 68 aa, Heterodera glycines
  Coding regions on vcDNA: vcDNA=SeqID_54016; Strand=-; Position=1 -86,1354-1451,1677-1699
MDNATKLRRDSRDRVRTGSVYGFLRIRSPVTIGVIPLGLWCIFWPAREASLCQNSDPTHLKYLIDILD

SEQ ID NO: 127594 - protein, 83 aa, Heterodera glycines
  Coding regions on vcDNA: vcDNA=SeqID_54017; Strand=-; Position=1 -65,271-382,722-796
MLNSQSSATVAHANNGNLVPLRPTNTRQWCKAKSIVELNLRPNLMAFWCQLWSRKVQFLSLKPSYIGRPYLSLLWPGLLDILM

SEQ ID NO: 127595 - protein, 251 aa, Heterodera glycines
  Coding regions on vcDNA: vcDNA=SeqID_54018; Strand=+; Position=1 -369,413-552,593-748,898-988
  Homolog annotation: Hit_ID=XP_312685.1; Match level="QueryCoverage =68%, HitCoverage=29%, E-value=2e-11, Identity=27%"; Hit description =ENSANGP00000015358 [Anopheles gambiae]
MDFDDEVFDPNLNIDEQNNTEAEGQIVERERKLEITEPPSSLRHYFVYVKGQNDAKCRICSKKLGRKDGTTGGMLRHLKSAHNSLFKKYEKAKSTKTETKKQTRTSSSFAGPPPKQLRMDELHGKKAEKTEKSPEIIDDLLLRFICLSCQPLSFTEQNGFSDFLKAVCPSYELKKRDFFTRKMEEKYGQVFSGIKELMKNVNYFSFSTDIWSNKRKRNSFLRQLLNQFEIPNDKVHLVATCRFNICHFNTQ

SEQ ID NO: 127596 - protein, 69 aa, Heterodera glycines
  Coding regions on vcDNA: vcDNA=SeqID_54019; Strand=+; Position=1 -105,407-511
MSAYGAIMSLKPLLDWGIIVDWGINGDWGIIRANTAIRDGIDHPKKGVKSICEMLQKARNDCRCKTIRI

SEQ ID NO: 127597 - protein, 107 aa, Heterodera glycines
  Coding regions on vcDNA: vcDNA=SeqID_54020; Strand=+; Position=1 -129,230-402
  Homolog annotation: Hit_ID=NP_499637.1; Match level="QueryCoverage =100%, HitCoverage=27%, E-value=4e-31, Identity=60%"; Hit description= CBS domain containing protein (3N628) [Caenorhabditis elegans]
SLHKAAQLLCEHKIHRLPVLEHSTGNILYILTHKRLIKFLYLYINDLPRINDLPRPPFMDKTPKELGIGSWGHICTISKDTPLIEAMKIFLAKRVSALPLLDSDGRV

SEQ ID NO: 127598 - protein, 160 aa, Heterodera glycines
  Coding regions on vcDNA: vcDNA=SeqID_54021; Strand=+; Position=1 -83,138-197,469-808
YKAMENEEEPQLHIDVLLNVAEKLIFSPDNDFRLDLRDPNADIVNFMFFQGPFVVTDQFFYTLFCRGILRPTVVDTFFIFGNDVVTFDSVPSSSASIMMNDWREQLEDGEETEEGEIVEPMHGDSQWHEEKCESNFGPCEISFTDGESPAESLVRLFLVR

SEQ ID NO: 127599 - protein, 110 aa, Heterodera glycines
  Coding regions on vcDNA: vcDNA=SeqID_54022; Strand=+; Position=1-334
VIADRTSKLVFAYTIDVINPERDCAFHFPTNEFVALLCYIAACCPNLDTFSLSFLLQGEFSDEDFKQLSSWLYRTIQSVLSLRCSILCIDCNLTIEFRAFFPEATLMAHF

SEQ ID NO: 127600 - protein, 334 aa, Heterodera glycines
  misc_feature (1)..(1): Xaa can be any naturally occurring amino acid
  misc_feature (65)..(65): Xaa can be any naturally occurring amino acid
  misc_feature (296)..(296): Xaa can be any naturally occurring amino acid
  Coding regions on vcDNA: vcDNA=SeqID_54023; Strand=+; Position=1 -303,387-593,766-948,1057-1340
  Homolog annotation: Hit_ID=CAE73617.1; Match level="QueryCoverage =98%, HitCoverage=41%, E-value=5e-60, Identity=41%"; Hit description =Hypothetical protein CBG21107 [Caenorhabditis briggsae]
XEDILEYRNNINLPTPLLRDNIRERQIETLRALLIKHHELARDQEKDHFHALQQLKQRNLEEQHXLELNSQKDFNRRALEQKTKEHAMQSKQQPRELKVEETIIRKQFRQETIIRKQFRQAVKIQTRQFKAYQSQMLQMAPREEHRELLNRLKDEQSRKIASLADQYEATIETMVTEQTIKLDAQQEEDLRQLTEKLNRELSMLTEYQEKQRVELSAQIERERVQLQDRVNLRLAVLKQKMNEEKVHFERNRERQLAQLHDRQAQALSAFSVDERRKKSSMGSDGGRNDASSTNLXIGPSGHSAFSLLLSPSIFNCFDNFYLSFSFSNEFLYVF

SEQ ID NO: 127601 - protein, 32 aa, Heterodera glycines
  Coding regions on vcDNA: vcDNA=SeqID_54024; Strand=+; Position=1-96
MSLRFFGFHDSVSEGKFLWEILTQLRGLGVGP

SEQ ID NO: 127602 - protein, 67 aa, Heterodera glycines
  Coding regions on vcDNA: vcDNA=SeqID_54025; Strand=-; Position=1-205
SPLLAATRVLDVAFSDDLCEGAYYEDSRVTALKCADDPEFVWSVGTSVRDMIVDSNANSFNKSESTE

SEQ ID NO: 127603 - protein, 52 aa, Heterodera glycines
  Coding regions on vcDNA: vcDNA=SeqID_54026; Strand=-; Position=1 -154,357-361
MRADFAICAFFAYFLCETLAGIAYSKSNKNNSSTASESDLGTTNSSNTEKQD

SEQ ID NO: 127604 - protein, 344 aa, Heterodera glycines
  Coding regions on vcDNA: vcDNA=SeqID_54027; Strand=-; Position=1 -640,862-1254
  Homolog annotation: Hit_ID=CAE74936.1; Match level="QueryCoverage =41%, HitCoverage=37%, E-value=5e-16, Identity=33%"; Hit description =Hypothetical protein CBG22824 [Caenorhabditis briggsae]
MQHTKRYLLVPEEIYQSLATPSPSDGSPIELVRARIKQIKNNDAINEAERAVKYEQEIKRLNKLKKDEDERPVGVKLENLSDVVDAMPKPFNIKRPIFVATRRHLKVGRARKENVEQLEDDDDDDEDDYETPRASSTNKRQPTQMEILNLIYKNAQSLGVSEEGQVLRAGGRPFITSSVDDIVSHLLNKDKRGQKEPTAFKEFIERAKQNRQLTTQRTYTLHRQAKRRYRRLPTLAPGLHTEWQADLAIFDRIAKQNRGYKYLLVCIDTLSRQVFVEPVKTKTSANMINAFEHIFKRSKYIPWKVLTDQGKEFTARAVQQFFRTKDVEHFCMLTSPQFHARVAE

SEQ ID NO: 127605 - protein, 224 aa, Heterodera glycines
  Coding regions on vcDNA: vcDNA=SeqID_54028; Strand=+; Position=1 -232,886-1328
  Homolog annotation: Hit_ID=AAT42173.1; Match level="QueryCoverage =79%, HitCoverage=44%, E-value=2e-14, Identity=33%"; Hit description =TATA sequence-binding protein 2 (TBP-2) [Zea mays]
MDLILATDWINNAYPEMDQQDHNKETPKKDQQDHNNETPKKDQEDEEETKEPSWISLIDEEQKQDPFTPIYDEPPRAKYNPRRFHAIIMRIRYGAKTVAALIFQSARVVLTGVPHPDQAQKFAARVLRRIEYTQCRTMTIYELRVVNIVGVLTFDQRIRVEKLQQSLGGIYDPTIFPALRCKLDNGATCLIYISGKVILTGVKNVENLKNSFDYLSKIVPNYFR

SEQ ID NO: 127606 - protein, 112 aa, Heterodera glycines
  Coding regions on vcDNA: vcDNA=SeqID_54029; Strand=-; Position=1-549
LGTPKTCACAERPRPIPLVEHLCKRFNCSAHELHVLFRNLEKRRDIVEHLRSAQLRTAHLRPFVRNFPVRCNDLSILDAHSVPAYRGFLGITVLFGNLVDIIKDFRYECITT

SEQ ID NO: 127607 - protein, 1493 aa, Heterodera glycines
  Coding regions on vcDNA: vcDNA=SeqID_54030; Strand=-; Position=1 -23,191-476,631-726,904-1315,1555-1726,1774-1876,2026-3616,3667 -4001,4049-4390,4433-4662,4708-4991,5035-5317,5368-5692
  Homolog annotation: Hit_ID=NP_001004509.1; Match level="QueryCoverage= 55%, HitCoverage=55%, E-value=2e-84, Identity=28%"; Hit description =si:busm1-180o5.3 [Danio rerio] emb|CAD60788.1| novel protein similar to DNA polymerases [Danio rerio]
MRHISKCRPLCLTVVAVDHRPHQQTPAGPLPVTNVVLRNGDGQRVEASGWQHQASVLASLDIGSAYWFTNCTARARYQHLDCWYRIGVDGKTAIVVPHTAAPQATTVQTGGGRTVNQTLAPPAAGPIEEEDENNNATRPIEDCFVIERTTPMRNTLRNTRGELCEIRFLPLEDAERPDLVLETLIQHLLDRVLEGHPPPMLVGLQLHPPGFDRPYVIRLRPPEQNNAATLAAAIERLNEQSAAGIELLAGTTVTKVLAVWPLESVRADAQRGEAVVLLTRAGIAVDKDLYTLEDVGHLQRLIINEHGVGQIRLVVFEKEQEYRIVFKGEGVAANFNLCLLLEHGHFNYVGRIEQLFKVPNYVLTLPNGGSSSRRCNECGFVFPNDGCYDYHFANMAPAPIDGRGQRQRQPICHWRRFCRICGRVAYANNHQCAPLHRPVGPIDCRRCHGRHTLDEPCFIQPLLDRTAHQNNNDDDDDDDDDADILDDDEADDELPLRLCFFDAETSQERPLQLNNQIAQKHVPLLIVAEVICEPCLRAGINVNDGFGRRAPDCVCLCRMVRGQQMRRWSSPPFVNGAGDNTPHPEGAPAFNQRRFYFHSFDDEANDPIEQFLLFLMKHGSKKAHTVCIAHNGGKYDFHLVLEALHRRSIPPKRLCTTGLKIYSMKLRGLNQRRITFKDSINYFFCELDALVKSFDLPQHLATVKPFFPYLYIQRQHLLQRLNGLPAIEYYSPDTMKVEKRTKFLRWHGDNDADSNFQLREQLIMYCVNDVAILRESVLRFRQLIGEHTQGLDPFLCASTAAGLALATLRRCFLPANRLVHSPEGGYLRGRRASAESRRYIRFFELENDGAQVQCADWSVGEAHIEDSGYRVDGLWRREPPLRPLAIEWMGCFYHGCPECFPDRQQKLAAGRTAEDLYERTMRRLFELEHQHGCELHVIWGCQWKERLRRDHELKQRYEAVFTPCPLDPRTDALRGGRTEPFKLHHVCADDEEVLCIDIVSLYPYVMKVNPFPVGNPMVLTREVLLHPPTAPLPWTCPENNTFRGLLLVRVLAPRNIRVPLLGYRTKDERFTFPLCGLCADRRQQRPCLHGDDKRSWVCAYTHVELNKALQLGYVVTDLFEVWDYAEWDDTLFSSYVNSFVGLKVQASGWPEGCDAEEQRQAFVAEFLRTEGIHLDPTKMAFNPGLRLIAKTLANSLWGKLAQRVGHTEIQYTRTPAEFHKLLDDPTYDKLDFVHVSDHMDRVVVRKRPEFAKAPLTNCLPVAIFVTSYARLHLYGYMEQVLALNNAELLYCDTDSIYYVNKIGAPCVPEGEALGQMKRELVDRRIVEFVAGGPKNYGIRHTARDGADERANLKIRSFRLSYATQQLINFDAMKELTLSTYNIDGPIDDVIDNDDLFVYGGGAHRAIRVSFPQIDRNVQADLFTREAHKDYRPFYAKGRVRPGMQTRPFGYVEDAPQPMDVEQHAQPPPLPPTERRKRTLIEADPTQPGHSRWF

SEQ ID NO: 127608 - protein, 147 aa, Heterodera glycines
  Coding regions on vcDNA: vcDNA=SeqID_54031; Strand=+; Position=1-595
LKITKYSPLSFENNPILLLLLEHDKPNLSNTVLIDDQTLQMTNVLQRVQVLVHRNSSTCQQNHSFWPMLVLSCGIRIESVASTTVRLSRLTVTEPQEDGTRQTMRSFGLTTRTRDCTVLETLCSVSKSQAPKFIRKINIKCRVQPPR

SEQ ID NO: 127609 - protein, 74 aa, Heterodera glycines
  Coding regions on vcDNA: vcDNA=SeqID_54032; Strand=-; Position=1-612
ICVDGRTHFWSIEYREYVDAYARIYRITLIYHSHVDNVRIKNKYVLMDVRISGALNIVSMWIRTHASTVYINLP

SEQ ID NO: 127610 - protein, 71 aa, Heterodera glycines
  Coding regions on vcDNA: vcDNA=SeqID_54033; Strand=-; Position=1-352
ICVDGRTHFWSIEYREYVDAYARIYRKTLIYHSHVDNVGIKNKYVLMDVRISGALNIVSMWMRTHASTVKH

SEQ ID NO: 127611 - protein, 92 aa, Heterodera glycines
  Coding regions on vcDNA: vcDNA=SeqID_54034; Strand=+; Position=1 -68,764-974
MSTGFMAVSTVSWVLYLEFIKKWSLVASERATMAWRKHDGSGKRQKPDANRLAELAARKREQRARQKKEGHVPQKKIKEKDTIINLDDIDFD

SEQ ID NO: 127612 - protein, 872 aa, Heterodera glycines
  Coding regions on vcDNA: vcDNA=SeqID_54035; Strand=-; Position=1 -482,725-1217,1497-2226,2854-3784
  Homolog annotation: Hit_ID=NP_500013.1; Match level="QueryCoverage =99%, HitCoverage=61%, E-value=0.0, Identity=39%"; Hit description =predicted CDS, polyprotein family member (4B673) [Caenorhabditis elegans] gb|AAC02594.1| Hypothetical prote
PVRCLMDTGASLTVAPRSVADELNRTFSSDLEAMSASGHVIRLKEYAQVNLNIAGYTVRSLIYFVDDSEFTVARDYSVIVGWDVFEKLPPVKFDHLNGKFFVGDNIQIVLSFDSFTEDLRVSAEKNTLIPADSQILVDASIESTPNPKNSFCIDRPDINFSKAMVEGKNLEKLKALIEEFSDVFSKRYDLGLFTAAEHHITTTTEEPIASAPRRMPYKYKEELKKHINQLLEAGVMVESDTPWVTPIVIVQKKDGGIRPCLDFRKLNEVTVPDKYPLPRLDSIMERVGNCQFYSSLDLASGYFQIKLSEETSRKCGIITEDNFKPSLSRIEILKEMPVPLNVKEVKRVLGQAGFYRRHIENFAMVVEPLLKLTRQGNRFEWGREQQKSFDKIKELLTQAPSLIFPDYDKAFHIFTDASSTGQGGVLMQKDDVTGTFSAISYCSRTLSAAERKWPAVQIEMSAIIYALREFRPFIFMSDIELHTDHKPLAFLLKKSETNQQLARWLIELQNYQVKIVHVAGKANTLADALSRAAEDKPLSDVDELEDIIAFPVCLALAAHSRVLTNCYLKYGGCVELITDNASAFTSEFFREFCSMLYIDKKYACPHWSQGNASTDATFRTFHNILAKYISKTQPDFDEFLDAANFCYNTSVHASTGETPFFLIFGRDPIFCVDQIIDPKVRDPIAISDRNEFKQKLVVAIRHAWHAAADEYAKAQRKMKEQYDRKARPQQITIGDRVLIRNYDGRVGTSKKFQLPWRGIFRVIKIEGIYVTVISCTSPNSNPKRLHLNQIKKCFEILGPPCTTPMQPIEEQKCLEHTQSVEDVSSERSEIRNEMDPESRKDENLDQIQPEGRKKDQKLKPRRRKSMKKRIWN

SEQ ID NO: 127613 - protein, 536 aa, Heterodera glycines
  Coding regions on vcDNA: vcDNA=SeqID_54036; Strand=-; Position=1-1608
MFLSGKDDESSISAIDRKLWQGKTTIKISDLEKAQNDMGKLEDGVNRAFRYLNRSLNQKVNWVKDVVANTNANFETLKVQFETLTERVDMLEQDSDGTNSGGTVSITNLNRASRAPFVTPMGNAQPNQVVPNQEPIHQLSSEDEDDGPTLFGLNMLSSGPTVGSGLEMFCEESVFAFDDWAERFKDYLSVSGKAYTEQEKVTRLKLALRDTPRALFKELLPAQMDTLDSALSELRQKLDSPQRREIAKRTLSLCKQREDKTVAQFLRRLTPLVDATNSSLTGEIRKEKICEEFLDRLKPNISFLIRLVGLSRAKDLDLVRAQAEELEALLLMNKGDEASRLSQAVHALSNQSPQSNWSTGANPNNDRAGQWSSGNNVRGFRPFSGSNATRQQQRGRGGRGRSRNWGGGRQEQFSQRNWSSNPRCHYCDRAGHFAYNCHQRRANFRGNSNQSFRQGRWSNQQPRQSQGQWQNRQNPVNVMDATSSYNASPGFFENLAQSLLDLKIQDNRNYKNEEPRSGAMNALTRIKPETTARDCQ

SEQ ID NO: 127614 - protein, 73 aa, Heterodera glycines
  Coding regions on vcDNA: vcDNA=SeqID_54037; Strand=+; Position=1 -12,435-554,618-690,751-767
  Homolog annotation: Hit_ID=NP_492376.1; Match level="QueryCoverage =87%, HitCoverage=16%, E-value=7e-25, Identity=75%"; Hit description =f-box only protein (42.5 kD) (1J356) [Caenorhabditis elegans] emb|CAB09415.1| Hypothetical protein DY3.6
MPKESFDPFTWRQLFFSLKKYYGLKEVYADLIHICCHCKALFWKDHGHPCVSKETAPSVRVTPQQFVDMQLFL

SEQ ID NO: 127615 - protein, 41 aa, Heterodera glycines
  Coding regions on vcDNA: vcDNA=SeqID_54038; Strand=-; Position=1 -81,1006-1050
MPPRATSATEKATASAWGVLLTTPLPTQQYAEGLRSSASGI

SEQ ID NO: 127616 - protein, 32 aa, Heterodera glycines
  Coding regions on vcDNA: vcDNA=SeqID_54039; Strand=+; Position=1-100
YTFETIGQDKKRMKLMPHETRNWLCLVENMLT

SEQ ID NO: 127617 - protein, 46 aa, Heterodera glycines
  Coding regions on vcDNA: vcDNA=SeqID_54040; Strand=+; Position=1 -86,246-300
MLNATHFAFAFQVLFLCVVGTQIAMASDRQKLSKNNFYSLIAVANE

SEQ ID NO: 127618 - protein, 18 aa, Heterodera glycines
  Coding regions on vcDNA: vcDNA=SeqID_54041; Strand=-; Position=1 -49,96-101
EAIPEGFGLPINLGASGP

SEQ ID NO: 127619 - protein, 78 aa, Heterodera glycines
  Coding regions on vcDNA: vcDNA=SeqID_54042; Strand=-; Position=1 -180,499-555
MASSTTTMNSNNNSGGGGGSAKTTMLVNAVSMESLDSSASATNGGGSGGSVAGGGDAQAQVRTLFVSGLPVDVKEREL

SEQ ID NO: 127620 - protein, 290 aa, Heterodera glycines
  Coding regions on vcDNA: vcDNA=SeqID_54043; Strand=+; Position=1 -71,408-693,1751-1964,2033-2334
MSPPINGNNNSPANSISRSFSSDRFYRLVDDEDQRAPLNALNSSSNSEEESSASNQQQQQQHTGGNFSLANSRQTSITMPVEGNGTTAAKLTVGVRDFNTRLCAVLERLYALALSEDRRVLCWIVRLLLDTSEDRMHLAKLLTNSSASLANLSQTVSYLPMDMDLNMSYGVAPPSSPSLRTSTENGDEGNDNGRGLDGVVGGDIDIDGTKAMAKEQRGEEEKEEYKNVSNNNDNEDGRNGRRRREEIADRANNGNNNKDNGTNEMPGKLMLMPTDAIEAEMPNGQLTMNT

SEQ ID NO: 127621 - protein, 348 aa, Heterodera glycines
  misc_feature (2)..(2): Xaa can be any naturally occurring amino acid
  misc_feature (26)..(26): Xaa can be any naturally occurring amino acid
  Coding regions on vcDNA: vcDNA=SeqID_54044; Strand=-; Position=1 -184,313-420,565-656,714-786,1187-1282,1330-1463,1704-1807,2034-2219
  Homolog annotation: Hit_ID=CAE58594.1; Match level="QueryCoverage =88%, HitCoverage=23%, E-value=4e-71, Identity=43%"; Hit description =Hypothetical protein CBG01761 [Caenorhabditis briggsae]
LXAAVTVWSMVWIKPERLLFGHSFWXKKKQIAKIVNFSFIRHSERANPYFVLQRRKGHREDGLSALFVSTIDSIFDTRPPPYRIIYQRELDEGQIAWVIAIAVDWRDVLDNWQCLETSLLPILEVFSKENELENELEKFVLTKIDGFLALRDEMERPVFPVLEHVSNAAILRKFLKLFDLPPCEKLVNYYSCTYWRGNKPFQGKLYLYSCTYWRGNKPFQGKLYLSVNFLCFYAFIVGSQTRIKIRWTDILKMEHNSSLFLSNGLTVSTRDGQTHIFSMFMNFSDAFKHCTQLANFAMKQLIEEKGFSEDAALRTKFLLEDPQKRAKRSMSFVKRDLEARQRTEAYRC

SEQ ID NO: 127622 - protein, 194 aa, Heterodera glycines
  Coding regions on vcDNA: vcDNA=SeqID_54045; Strand=-; Position=1 -258,416-604,947-1082
MAQVFLHRNRPAPSHSIRHLSTGLDFFFIIILFLQVTDVISYNERIIYFNGYRMQKQGRPNGNIQVIKYLKNNLSMKHLFKKQFEQKKLNKTRHARCAAIKRWNRNREFSEAMDFEKNQHTNGTSRDSVHESGHIICYWFLEYASEFTSIADITEGNEDAVLAEAEDEVRRLVTPKKCLIKKVENAKFKVIIIA

SEQ ID NO: 127623 - protein, 74 aa, Heterodera glycines
  Coding regions on vcDNA: vcDNA=SeqID_54046; Strand=-; Position=1 -42,272-452
MAELAARMESAERMDEEFDVSTNRTDRKSNFAPEQYLTNPTYPIVRIALELEEQSEEEKKEEKEKEKEEEKEKR

SEQ ID NO: 127624 - protein, 218 aa, Heterodera glycines
  Coding regions on vcDNA: vcDNA=SeqID_54047; Strand=-; Position=1 -149,202-706
  Homolog annotation: Hit_ID=CAE64508.1; Match level="QueryCoverage =99%, HitCoverage=88%, E-value=1e-18, Identity=27%"; Hit description =Hypothetical protein CBG09238 [Caenorhabditis briggsae]
MDEKEEKATKEEEEKSKRGQRIVERVVAIWRGKRDRERPKTAMDGESGKSRNEEVTSSSKEKMKKQTQQKRKQTIQQIGENEQENTDQETKTKEETETDQQVKSEIDQEMNTKQETDQQVKRGTDQKTKTTKKETETDQLMKKGTDQERKTNEETETDQQMKRGTDQEMKSMEETETDQQMKRGTDPQIKTKKEIKTDQQMKRETDQEMKTKQETDHQ

SEQ ID NO: 127625 - protein, 85 aa, Heterodera glycines
  Coding regions on vcDNA: vcDNA=SeqID_54048; Strand=+; Position=1-255
MAKLVAIFLPTLVVVSAATVPILPQQLLSANDQNSNSLPNLTNVLADEISLSAIDCAALPPALWCTKFVRYKCGTSNLCRKHDDA

SEQ ID NO: 127626 - protein, 84 aa, Heterodera glycines
  Coding regions on vcDNA: vcDNA=SeqID_54049; Strand=-; Position=1 -131,506-629
MLHSEWTLSMVVNRPEILKWPGLDPALGKWTEGTPFFRHYRFRCCAVKASEKEVEKAVDECYMEHNVVNVQHKRCECIGNNVPW

SEQ ID NO: 127627 - protein, 71 aa, Heterodera glycines
  Coding regions on vcDNA: vcDNA=SeqID_54050; Strand=-; Position=1 -15,511-585,646-771
MMMIRLNDNLHFVLPRIVVQEGSGDCIYRQCSCDEQNQCFGVLIDETAKCFEVAYDEVKADLIKAVLIAKY

SEQ ID NO: 127628 - protein, 169 aa, Heterodera glycines
  Coding regions on vcDNA: vcDNA=SeqID_54051; Strand=-; Position=1 -364,419-562
YIDHSVLTFIRSNKPIWDRMGTKFEFFAKSIRQLGFTSGDAFDNLRRLISPTILTGLDQLNSIDSNELFPDGIADDGPNATAGQALVKWLHTPSKNGQPKRLYRNNYFGPQNLEWVNNFKETFISATTSVSYNIQLYFHVNTIPTEPFELVNKRTNEKLTLKQEIDEFD

SEQ ID NO: 127629 - protein, 52 aa, Heterodera glycines
  misc_feature (36)..(36): Xaa can be any naturally occurring amino acid
  misc_feature (49)..(49): Xaa can be any naturally occurring amino acid
  Coding regions on vcDNA: vcDNA=SeqID_54052; Strand=-; Position=1 -79,796-1021
NSLISLRSVKAFCVATVVPGKSRKTSISVSTLCLLXSFFDQVHVRQHIXRQQ

SEQ ID NO: 127630 - protein, 57 aa, Heterodera glycines
  Coding regions on vcDNA: vcDNA=SeqID_54053; Strand=+; Position=1 -45,338-466
MKELIVSYFYGYPKNCCLCIDAKKINRCHAFTSRTHKQQQNSDKKAETVTNSKGGDR

SEQ ID NO: 127631 - protein, 54 aa, Heterodera glycines
  Coding regions on vcDNA: vcDNA=SeqID_54054; Strand=+; Position=1 -116,1133-1181
MDLNNRFKHLINVLQRVAVESSAKATAKAPPPETPPSVVNLNNFRRYPKIRTFL

SEQ ID NO: 127632 - protein, 39 aa, Heterodera glycines
  Coding regions on vcDNA: vcDNA=SeqID_54055; Strand=-; Position=1-192
IYYAGQFIFLENVLKKDKNNYFILPSLDMHMYFKFFIVM

SEQ ID NO: 127633 - protein, 78 aa, Heterodera glycines
  Coding regions on vcDNA: vcDNA=SeqID_54056; Strand=-; Position=1 -28,311-519
MTVLGKIGTVDKVRFTSMSCVPTRSACARGYYEDAFVTCTNLYCCRADLCNGVPDRVVQPWVERLGSVDLGLVFSVPS

SEQ ID NO: 127634 - protein, 104 aa, Heterodera glycines
  Coding regions on vcDNA: vcDNA=SeqID_54057; Strand=-; Position=1-315
MKIEFILLILLKIYSKILAFRLLKFSKNVCGSCRIPHKNQIWDPVAGLEFKIFCRTGSGRINPANPANPAFSKKCRIADWDPAKSCAGSGPAPGSTKDRPPATP

SEQ ID NO: 127635 - protein, 759 aa, Heterodera glycines
  Coding regions on vcDNA: vcDNA=SeqID_54058; Strand=+; Position=1 -908,1024-1924,1981-2450
MQKPTPSNRPNSSVSKTLACGLEKIVNLSGNEPLSVPVLADRSDPLGLKSVQPDPVPMESAEAGTKELEVMEVDEMSGEKGKKGEMGKEKVKSGGIEEEEESECSEGELLGDGGFGNLQLNPSLRAGNKAVEKEDKGKPYLVAQVRSDGVIAARMKLFWDFPELVFVPFSLFDNAQPIEIGDLFRLHKCEWTKSETGWEERGDWLYEATGRLNYQATATDVSQLRQRIPTQAVGILVDVQRARDRHVKVAMVSAPELSCVMRAYRRHFPADFTDTDIRYRSVVRLQLRQINSPPWVLYSQQFAAELSWAKVQLGEKVMAAAVAAQSFDVKADLRKHTLFVEPVVINEISTRSVIIQFVMPVPSIEELTELCKIWEVDLAVGCKVNPAAKAKPCAHGYVLSIEKRAFCVGYEIDVKVILSYQAAKEQDAQEEFDQLRTGELDGCVELIPQTSVRALQERMFTLRSNDCSKVAKDEAKVGRIMSILLGRPVKPESPKANNPLMTFGALSKLKEGQIDTALCMLDEVPRLVFQQAGPGTGKTFSAASIVATVLATDPTARVLALAPPNVAVVKLVLEMQDALAAGNHVEPMLALFSGTGKLRYAKEELLQKDQERVKVERYLDACERNPRLAQEMAVAKIVQEHKNRRLCFATLSFCEQLPALFGETTHLIIDEAGQAPYVQILNLVSQLPCLTKVLITGDRRQLRVHLPSLPIAIREDFGMDTVIQNLDVARGDGRHTIGSVCFRSHSALVAARRAGFTTA

SEQ ID NO: 127636 - protein, 265 aa, Heterodera glycines
  misc_feature (23)..(23): Xaa can be any naturally occurring amino acid
  Coding regions on vcDNA: vcDNA=SeqID_54059; Strand=+; Position=1 -757,1276-1322
  Homolog annotation: Hit_ID=NP_499726.1; Match level="QueryCoverage =99%, HitCoverage=11%, E-value=4e-37, Identity=35%"; Hit description =predicted CDS, RNase H integrase-like protein family member (3O318) [Caenorhabditis elegans] pir||T26836
SPSPFLLAATISHHLSVNPSPLXNEIQENIYVDNLLLSSNNPIEAQTKCLDSIELFAKASMPLREFCSNSNEALSLLPRIIKLNGPDQKFLGIKWNTDSDCLILSHQPPSTFNPTKRAVLSFIAACYDPLGLISPVLVPLKLFFQSICKENYNWDQPLPFNLTDQWQNLFKNWSSDSISVPRYQCFLPDLKKYQLHCFVDASCLAMCTALYLRITHPSSQNSVIVLIFAKTKVKPNKGQNLTIPRLELIGSVIPQTLIQFIFREE

SEQ ID NO: 127637 - protein, 73 aa, Heterodera glycines
  Coding regions on vcDNA: vcDNA=SeqID_54060; Strand=-; Position=1 -95,216-342
MNVFCLVGEMNVFCLVGEMNVFGLVGEMNVFGTNYKFTKLVFNTNIQSQQMQKQDEEQLVRSVKEASEIIRKF

SEQ ID NO: 127638 - protein, 131 aa, Heterodera glycines
  Coding regions on vcDNA: vcDNA=SeqID_54061; Strand=+; Position=1 -102,161-454
MNSEKSEKANSILLEAAKKETERAWQDVAALTDEKRLLTNGIRELYLKMSDSIWEIFTILDKINLESEKAESTWRDFERCKTFDQATKLEEQSQNSLMEARRLHFESRRVQSQMLNYENRLKTIVWEHVGI

SEQ ID NO: 127639 - protein, 165 aa, Heterodera glycines
  Coding regions on vcDNA: vcDNA=SeqID_54062; Strand=+; Position=1-497
EEKEQFTSARRTVEGVFRDIIRLDNEAKEFSFSAHNTMVEAQNIKNKNPDKPGVNFWHSKLLDGVLKIHALFDKIKKEEKNMKNIKKGMEKCLDRKDLTMCQELAEEAKQSIEIAKNYRQEIGHIYRTAYSQPDLGIGDLANKLKETMRENQIRFERQRPQEEFR

SEQ ID NO: 127640 - protein, 143 aa, Heterodera glycines
  Coding regions on vcDNA: vcDNA=SeqID_54063; Strand=+; Position=1 -20,170-319,702-861,1172-1251,1775-1796
  Homolog annotation: Hit_ID=NP_501127.2; Match level="QueryCoverage =100%, HitCoverage=10%, E-value=4e-41, Identity=55%"; Hit description= RNA Polymerase, Class III (C), rna polymerase (rpc-1) [Caenorhabditis elegans] gb|AAA83341.2| Rna polyme
PPPPKKGTFQQAVLCNTCGEKLDTCVGHFGFIDLEYPVFHVGFFRLVIQTLQCICKACSRTLLQGEPKEALLRQALTPNLDYLRKKALHKRMLALSKKCSLCTHCGFLNGVVKKAVGAILKIAHVEPIDAESVTDFETAFSVN

SEQ ID NO: 127641 - protein, 42 aa, Heterodera glycines
  Coding regions on vcDNA: vcDNA=SeqID_54064; Strand=+; Position=1-128
PFYFVSCHCLSVNVCGRSPLQNGTVFPKFGPLVGWHFLFSPT

SEQ ID NO: 127642 - protein, 71 aa, Heterodera glycines
  Coding regions on vcDNA: vcDNA=SeqID_54065; Strand=+; Position=1-214
MSAAASVAPNAAPSFQQQLGSHAFNVGGFSSSSDSVGGPPRPQPSQISSLREKRKNNEYESPLARIGSSSG

SEQ ID NO: 127643 - protein, 211 aa, Heterodera glycines
  misc_feature (3)..(3): Xaa can be any naturally occurring amino acid
  Coding regions on vcDNA: vcDNA=SeqID_54066; Strand=+; Position=1 -133,180-221,385-503,595-721,784-908
  Homolog annotation: Hit_ID=NP_496529.1; Match level="QueryCoverage =92%, HitCoverage=34%, E-value=5e-42, Identity=46%"; Hit description =membrane glycoprotein HP59 family member (53.7 kD) (2M135) [Caenorhabditis elegans] emb|CAA93878.1| Hypot
ISXLIVYSSHSLIKGFTKVFHTRTRFLLIVLCLLCLASVWANILCFNFAIICIDHNEKTFNFAIICIDHNEKTNGSAVPAKTSKSFTPRQKLYLTSAVAAAALVANFAVVTLVNNYGIRTVFVLLGFLSAVATCLLPTAIELGFFYVLACRMLQGVTFSCTFPVIGAFVTFSCTFPVIGAFTSKWTYYKQNGLFVSVLVAYVQFAPAVTLP

SEQ ID NO: 127644 - protein, 104 aa, Heterodera glycines
  Coding regions on vcDNA: vcDNA=SeqID_54067; Strand=+; Position=1 -148,577-743
AGVFVQRRRASTIVTNSLLLALDKPLDLSIKSTVILRDEWLLLGAQEGLSLRPFQHFRCGVLFGRGFGHWLFARLANHGFKIGPMQHASAVEQGHGTLRTGTAE

SEQ ID NO: 127645 - protein, 365 aa, Heterodera glycines
  Coding regions on vcDNA: vcDNA=SeqID_54068; Strand=-; Position=1 -276,364-565,609-635,708-1298
  Homolog annotation: Hit_ID=NP_500458.1; Match level="QueryCoverage =67%, HitCoverage=13%, E-value=1e-80, Identity=57%"; Hit description =predicted CDS, sushi domain/SCR domain/CCP module and Coagulation factor 5/8 type C domain  and Hyalin an
MRGPSHLKCLSDGNWNGTVPICVPATCQGIKNNTAIGLFVRPDSISIPYRHNLSFVCSQANRPSKHSPLGETRQCIYDPRTDGTEYWLSGSEVICPLIDCGSPPALSGAYFESENNGPGTFKVGSAFLFQCRLPYSVVGKSSYDDRMIRCNVDGTWDLGDLRCEGPVCVDPGHPDDGQTHLDSIEEGAVARFTCNRPGYLPFPSDTLSCALGTACVLSEDVGISTGFIPDGAFSDNSDKTIWGYEASSGTFTLTWLALIKRNPCHPNPIPCHYIPGLPLDKKKIRNRTGTAKVFRVWVWDYKKISELGFKLNPLLPSFPIPCHAFPFDPIACHSLASLATQSSHVLNGLVRFQRCVHLPGGGPAK

SEQ ID NO: 127646 - protein, 550 aa, Heterodera glycines
  Coding regions on vcDNA: vcDNA=SeqID_54069; Strand=-; Position=1 -81,302-587,656-802,1219-1371,1445-1632,1661-1997,2051-2511
  Homolog annotation: Hit_ID=XP_312182.1; Match level="QueryCoverage =93%, HitCoverage=13%, E-value=2e-60, Identity=30%"; Hit description =ENSANGP00000010271 [Anopheles gambiae]
MANVCLIAFVATASTTAATSVMSLIAPLNFDSFETEQHQDLVSVVDGGPAENASISVRAEGGNTRGQSVPSFYFVPVQLVTLSGQPRPPQSLTFESASNRMVVRFRSDHAIQARGFQASWRAVSASCGGLLSVQSQPQQLISPDWPRPYPNGMECVWHMNAPEGQLISLAVRCDNVIRRSHGILTSPGNAHFPYAPAQICRWTIELPMAQTEEKMWERTAAEEAISLTLAVNSWDVSDSGDSLRIFEYSADGQAEEGRPLHPIEKGFGAESPPPKTASEPAKKQTIFARQSRVELVWRADELRQGVGWNISFSTSQPPQPRHLSIDRPLWPIPAGCPRLSLPSRRVLLSTRNTAYGTRVTVSCERGAEFVSGRGRHFETVCELGGRWSESEPIPDCQPIYCSPIPQIANGFAVMASNVSFAGIARFRCYDGFGFPSGKEMEEIFCTDEGRWTQTPKCKSWHFRMPICCLFSSFKSQSAPICPMLPVFNFGERSLQFGDGIGYGSVYSFQCSAGYRRDGAQNIVCQSNGQWSAAQPQCKSTVQCAGSILLP

SEQ ID NO: 127647 - protein, 47 aa, Heterodera glycines
  Coding regions on vcDNA: vcDNA=SeqID_54070; Strand=-; Position=1 -58,332-417
MTIFYLKEICLFCGLFIALCFSIQLNIFELSVQFWLFSNQLIISIEL

SEQ ID NO: 127648 - protein, 182 aa, Heterodera glycines
  Coding regions on vcDNA: vcDNA=SeqID_54071; Strand=-; Position=1 -117,179-234,453-726,2146-2247
MAFSGTRKQKYIGGLKNYINVETKDAKDWMAYVKTGRIWETFGPIPPPMYADRMRAFSMACAFRWKASTENVLPSEAIRQALISAFCDSYGKSKQFKETEEQLEEAKTKKWTDLVQNEYSIAQYTVTIFGVELFKHLMEQSGKYTWNFLFNQIYQLRSLFYALHFSICRFFYPIAINLSVVS

SEQ ID NO: 127649 - protein, 54 aa, Heterodera glycines
  Coding regions on vcDNA: vcDNA=SeqID_54072; Strand=-; Position=1-163
MSPLRFLAVLLLICAMFSFNNLGLANGEESKDSQVALRPDVAAVQPDLVVVRAR

SEQ ID NO: 127650 - protein, 66 aa, Heterodera glycines
  Coding regions on vcDNA: vcDNA=SeqID_54073; Strand=-; Position=1 -78,147-269
MKRMKMPMPMHLLRNQMETKNSLKQQLIMMKKSHQILSLANRRLMEKTVPTQRQQQSFKMVRQMQI

SEQ ID NO: 127651 - protein, 174 aa, Heterodera glycines
  Coding regions on vcDNA: vcDNA=SeqID_54074; Strand=+; Position=1 -385,450-523,577-642
  Homolog annotation: Hit_ID=T10699; Match level="QueryCoverage=62%, HitCoverage=62%, E-value=2e-10, Identity=41%"; Hit description =hypothetical protein - common buckwheat dbj|BAA21761.1| declined protein during seed development [Fagopyrum es
MKGVPAEEEEAVTAPPPAAAENLPEAEEEEAPFVVVEDEEVRMAAAAAAEEAVVVENEELGVAPLPPPAEEEEEAVVVVEDEGMEVASAEEAAAVIDEEAVPPPAAAAAATEHILDGDEGADAMDTVLVLDDGSPGQPGQPGQPSHKRHKRGKNVAGSERRRRRIAREAAAQNQ

SEQ ID NO: 127652 - protein, 29 aa, Heterodera glycines
  Coding regions on vcDNA: vcDNA=SeqID_54075; Strand=+; Position=1 -54,469-504
MTSKLIKLAEEIRKQRKWLYKFLLESPSY

SEQ ID NO: 127653 - protein, 396 aa, Heterodera glycines
  Coding regions on vcDNA: vcDNA=SeqID_54076; Strand=+; Position=1 -7,289-885,929-1296,1532-1750
  Homolog annotation: Hit_ID=NP_507780.1; Match level="QueryCoverage =76%, HitCoverage=24%, E-value=9e-33, Identity=26%"; Hit description =predicted CDS, DNA polymerase type B, organellar and viral family member (5T899) [Caenorhabditis elegans]
MESRKYRIVAYDLETTLYNGVHAPNLVCAALTCSECVGEKRKCEICEEQRMLTWSAANVEDPIGGFIDWIMGFKQFETVAFSHYAGRFDSHFVLRVLTERGLNTELMMADLKIYQIKAKGVYFRDFWLLSQKKLADLPKTLGLSNPAKLYFPHKYNQNENFGKRLSHLPPFDDYNPNAMKEEDYEKFEGWYNENFETEFELGEQLKVYCQNDVEILMEAILKFRQLFLDITDGMDVLKDSVTIAGVVMRIFRTKFLKDRHIPIMPEGGYERAENQSKIAVKYFEWLAHWEGLRVRHAENGGEIKFGDLKVDCVIGGQKRIIEFQECEVKAELKRNREMKRFFESVPDKGPINPRDAYAGGRTMPFCLYAKATEEVEISMFDIISLYPFVNYGKKSA

SEQ ID NO: 127654 - protein, 247 aa, Heterodera glycines
  misc_feature (240)..(240): Xaa can be any naturally occurring amino acid
  misc_feature (244)..(244): Xaa can be any naturally occurring amino acid
  Coding regions on vcDNA: vcDNA=SeqID_54077; Strand=+; Position=1 -122,204-444,593-757,809-998
  Homolog annotation: Hit_ID=CAE59888.1; Match level="QueryCoverage =82%, HitCoverage=16%, E-value=1e-81, Identity=73%"; Hit description =Hypothetical protein CBG03371 [Caenorhabditis briggsae]
ILKAVQMLWVNLILDTLASLALATELPNEDLLKRKPYGRTSPLISRPLISRTMMKNIIGHAVYQLTVLFTLIFAGASLFDITSGLYAPLHAPPSQHFTIVFNTFVMMTLFNEINARKIHGERNVFQGMFNNPIYCTIWVFTLILQYVIVQFGGRWFATAPLKWEQWLWCLAFGVGSLLWAQVVISVVISIPTKGLPKSLTIGGGEVEGDRQQIACASDESDERREKMTAAYSRISLIVKXIIVXKHF

SEQ ID NO: 127655 - protein, 71 aa, Heterodera glycines
  Coding regions on vcDNA: vcDNA=SeqID_54078; Strand=-; Position=1 -69,513-576,1381-1463
MAFVVLATVTAMVVVVVVEKAGMNLRKCLGSKIDERRMDRKGQRVILRQMLDQQKIINVNSLVAMINVPAV

SEQ ID NO: 127656 - protein, 16 aa, Heterodera glycines
  Coding regions on vcDNA: vcDNA=SeqID_54079; Strand=-; Position=1-49
EAIPEGFGLPINLGAS

SEQ ID NO: 127657 - protein, 44 aa, Heterodera glycines
  Coding regions on vcDNA: vcDNA=SeqID_54080; Strand=-; Position=1-132
MVSSIRFTLSAAYVVLSCKDFVEFGEKVGQCREIDDDQMPGQID

SEQ ID NO: 127658 - protein, 16 aa, Heterodera glycines
  Coding regions on vcDNA: vcDNA=SeqID_54081; Strand=+; Position=1 -35,663-678
MSFVLGKAESSKDYDN

SEQ ID NO: 127659 - protein, 149 aa, Heterodera glycines
  Coding regions on vcDNA: vcDNA=SeqID_54082; Strand=+; Position=1 -192,305-455,519-625
MPSKSTDGQPIVVTGPDKASVEATEKALRALCPVTELIEMNAEHRSSLMGRGGAILQELIRKHSVQIVVPRGEASSSCNVSVSGAPEDVRACLMEIREHILPITRTILVTPEIRGSLIGSGGHKVKELCDKFLVKIHFSNKSAYCCEIT

SEQ ID NO: 127660 - protein, 187 aa, Heterodera glycines
  Coding regions on vcDNA: vcDNA=SeqID_54083; Strand=+; Position=1 -121,180-427,598-792
MEKQFHCQVIGKGGEFLRRLKRKHGVKEINVPSEFSNSDPGPSLFSLRSCKDDLLKLLDDWRNDCYEEVPVQRRFVPMIRGKNSNKIVNLLDGLPRVEVDLPPHTNNDATEDSLIKIRGHKSEFAKFVCAKKKQIEHRLPKLKLDFQSDDDTAQNANRTVRLIGPLDQVEAAKETVLELIGSLRVCI

SEQ ID NO: 127661 - protein, 210 aa, Heterodera glycines
  Coding regions on vcDNA: vcDNA=SeqID_54084; Strand=+; Position=1 -171,283-741
MGTCPPAKRRNEHSDPRPHQPHAPWAPARQRNVEMSTQTSWIPHIVKSGVLLSLIDRLQITHTLCNALHPSTPVWQMPTTTAAGANNAKVEQKPPELNAVPKIMASTMALRNGGQLQMNNGGNSTKSTATNGAVVNHSKQYQEQLLEQQRRAREAQSNDDSNESAATTTMAYDEELQQHNHQSLKQDRGEEEREEDNSRRRQLLREQCFK

SEQ ID NO: 127662 - protein, 324 aa, Heterodera glycines
  Coding regions on vcDNA: vcDNA=SeqID_54085; Strand=-; Position=1-972
MHSGSGRPKKLLISPSEIATTSKANMEVINHPQANDLLNLFASESIQFPISQPMIDIDRVTVAGVNKEVISSMWKDNKEMFTEDLIFAFQRYLTRVITNKKVVVVNPLYTDLNMHFGMHIFDYNALDNCYNYSNDYDILLMTIIFPGHFALIIFDRSDRENIQCLFIDSLPDYDRLTDTQYPLYDFRKTEIIKKGICELTPGLSQTDINIRTLNHNEFTRQNDGINCGVFVILYSELYLLSGSLFLPNLNINVERHRILWHLMKLLYSNDVAHVGRNNLITHQLVQNPSLPLYNVESVVDETCPRDGNAAFICVEPEFDTAPEV

SEQ ID NO: 127663 - protein, 42 aa, Heterodera glycines
  Coding regions on vcDNA: vcDNA=SeqID_54086; Strand=+; Position=1 -16,231-343
MKGTQMNAEASLRDECPKEDSGRSSVCVFLASRLLRSFEGIF

SEQ ID NO: 127664 - protein, 96 aa, Heterodera glycines
  Coding regions on vcDNA: vcDNA=SeqID_54087; Strand=+; Position=1 -72,184-402
MKKVDIEASNQVRNAFFMLIITPQYGISAGIPNGVPICFQKNFKSKSSNSTAEYDTIMRSFFLQRKRRKLKFSTDIFTISQFLRVRDNVRMSNCCL

SEQ ID NO: 127665 - protein, 79 aa, Heterodera glycines
  Coding regions on vcDNA: vcDNA=SeqID_54088; Strand=-; Position=1 -5,206-326,645-758
MRKKPSGNSMPKSPFWPTERRTGLFHGFLKRAFRNKFLYQDWEIDQQNSEDEKGSSTSTKRVNPFLKPDGSSYNKDKDE

SEQ ID NO: 127666 - protein, 185 aa, Heterodera glycines
  Coding regions on vcDNA: vcDNA=SeqID_54089; Strand=-; Position=1 -211,333-679
  Homolog annotation: Hit_ID=CAA56603.1; Match level="QueryCoverage =24%, HitCoverage=12%, E-value=2e-13, Identity=63%"; Hit description =P75K [Cylindrotheca fusiformis] pir||S50062 cell wall glycoprotein, 75K, precursor - diatom  (Cylindrothec
MFFLKFYNLNNVLDPVPDPVPDPVPDPVPDPVPNPVPDPVPDPVLDPVPDPVPDPVPDLFLGNKYLQIDLLPRDREFWANPGPGPFWVENPGIFGWENREKTGTSPGPGQNRDLGTQLYSVVRYQVPVPWHSILNHIRILRRKFILFYFYFCNLIIRFNLFTKKQKTFFGITPKSFLTALSERGF

SEQ ID NO: 127667 - protein, 133 aa, Heterodera glycines
  Coding regions on vcDNA: vcDNA=SeqID_54090; Strand=-; Position=1 -73,123-451
MIKNFDENIMNFSQLIKLDLNLDKDKQLFILPELISELEQMQKNGNWNYANLKHIKMAEWNLLELALHKEGESKKWLEIKKLWNKWKKAFNGKFKNSNKMPNFKKLMDELNKKLKDLREKKQKETEKKEEIKG

SEQ ID NO: 127668 - protein, 238 aa, Heterodera glycines
  Coding regions on vcDNA: vcDNA=SeqID_54091; Strand=-; Position=1 -476,814-1054
MQFCDALQNAVHSALKAREVKRETIQKITELDEFKFLEAILSSLEYKGESTEKLKKFSMVFSKKSFADKCKSLSALLAILDQIKTEYNRSSEIISSKSAKIGIELNEWELENVKFGEILYETLKSHSNKVKYDEKHQLMEFPLQMCEQFIERLYAFVERNLAKNMPIYEEIDFIKTIESVVSEEEKELVMEKRQKSIWPSVNLKLFKLLFTMAIRLCCLQMEQKEFALSTLSFALKTE

SEQ ID NO: 127669 - protein, 336 aa, Heterodera glycines
  Coding regions on vcDNA: vcDNA=SeqID_54092; Strand=+; Position=1-1011
  Homolog annotation: Hit_ID=AAV44035.1; Match level="QueryCoverage =97%, HitCoverage=19%, E-value=7e-60, Identity=40%"; Hit description =putative helicase [Oryza sativa (japonica cultivar-group)]
MMHGPCSEKSLCWNKTKKKCNKKFPKQFREVTVINEDGYPLYKRPDNGRYIYRKGQKLSNQFVVPYNPFLSKTFRAHINVERVTDISVVKYLYEYIYKGYDAATIECVQIGEDGTKKILNYDEVAKYLEARYLSPCEACWRIFKFPMQGKSHSVDQLDVHLENTQRVFYRKNATDQEIEEALLKNSTLTAYFKFCLENPDKEIKYTDMPKYCTWVKKDKKWKYPRQGYQNKIGRMVPIHPSETEKYYLRFLLLNVYGKSFKDLKTVNGVEYDSFGKACLARGLVRDDEEWHKCLEEATYFSRKHAKGLRTLFANILVHCAPKYPARLSGFIQRVYG

SEQ ID NO: 127670 - protein, 103 aa, Heterodera glycines
  Coding regions on vcDNA: vcDNA=SeqID_54093; Strand=-; Position=1-312
MNLFILFLLNIILFLITKIDQIKTVNKKLEQKTFDEIFGEKWQEKEEEKLEEKREIIGKYYKIKEKIKQKGRKYTAKEWNKIEEKIALIFIKSLYIVNLFYFY

SEQ ID NO: 127671 - protein, 221 aa, Heterodera glycines
  Coding regions on vcDNA: vcDNA=SeqID_54094; Strand=+; Position=1 -244,672-1093
  Homolog annotation: Hit_ID=AAO50779.1; Match level="QueryCoverage =26%, HitCoverage=4%, E-value=5e-13, Identity=59%"; Hit description =similar to Mus musculus (Mouse). Sex-determining region Y protein (Testis-determining factor) [Dictyosteliu
MNGTGAMPSSAPPMSSGTTTVSPANGCHAGAQIMPSADGGIIGTVGQSIGAGATVTTTAGVSVVDHQQQQYLMAAAAMNGFAPPHPHLGQFMLNGGGAPPTAMPPMPADFYGFPGSAAAVNHGPMMASAFAGGAIVGAGGAAGGGGPPFSPSFHHQNQHHHNLLNQHQMQAVVAEQQQQQQQLEQYMPHHQHHLHHHHQQQQQQLQQQYQQNNHAAATILQ

SEQ ID NO: 127672 - protein, 209 aa, Heterodera glycines
  Coding regions on vcDNA: vcDNA=SeqID_54095; Strand=-; Position=1 -237,997-1389
MIAAAPGGAGSTSGYRHYQAARPVDGWAAHAAALNGGGGADNAPPRVMVDSTSTRHTHVGTPLHGGGGGMAASTTAPLMMNSSGGRGGTPVKGSGMFVAAMPSPEHDGGYHQHHYDTPNRQYPHHNPQQQQHHYSASATRDDASSEPGNNNHLQQQSPPTPISPATSSGAVANGQLKVVVVDADTLINDDNSDNMLINCWEQNKNSDHY

SEQ ID NO: 127673 - protein, 51 aa, Heterodera glycines
  Coding regions on vcDNA: vcDNA=SeqID_54096; Strand=-; Position=1 -109,162-208
MKANGQNGKMKRLDGKLMINGTKLAFTFITRTNSGKGFSTKLLAQVISLQK

SEQ ID NO: 127674 - protein, 71 aa, Heterodera glycines
  Coding regions on vcDNA: vcDNA=SeqID_54097; Strand=+; Position=1 -153,256-318
MLIVPWLLLLVVVLALVIITIIFMQLVLAISRRRSIISGGEDGVHVDFLCPKIFGGKRKAPNPLTHIWQNL

SEQ ID NO: 127675 - protein, 81 aa, Heterodera glycines
  Coding regions on vcDNA: vcDNA=SeqID_54098; Strand=-; Position=1 -47,175-373
MMRIIGGFFTNFAKYGNPNTHWTQKINMNTVFTTTNDTAPSADGQHQLHENDGDNDQCQHHHQQQQPWHNEHCGSDSEQSI

SEQ ID NO: 127676 - protein, 134 aa, Heterodera glycines
  Coding regions on vcDNA: vcDNA=SeqID_54099; Strand=-; Position=1 -78,191-298,473-586,855-959
MAKWCVRCAAPTLSRWTVAFITAMGAGHRETEIEYQDAPLVNIKRSQKKADRSKGEGKGPRERPRKLRVDPHLCERALAQDGDFPAYMDTVGTRICTSTKIVAKVASVLTDEPFRLPKQCVVSTFSMKFYPFFF

SEQ ID NO: 127677 - protein, 39 aa, Heterodera glycines
  Coding regions on vcDNA: vcDNA=SeqID_54100; Strand=-; Position=1-181
SFPISPSICLFHAFVHVLNTDDAFHSLRIKFLINQILDL

SEQ ID NO: 127678 - protein, 26 aa, Heterodera glycines
  Coding regions on vcDNA: vcDNA=SeqID_54101; Strand=-; Position=1-80
MNGYSILCVMLLVELVVVPIVNGSPV

SEQ ID NO: 127679 - protein, 151 aa, Heterodera glycines
  Coding regions on vcDNA: vcDNA=SeqID_54102; Strand=-; Position=1 -122,631-964
  Homolog annotation: Hit_ID=AAN32891.1; Match level="QueryCoverage =85%, HitCoverage=26%, E-value=1e-66, Identity=98%"; Hit description =secretory protein 5D06 [Heterodera glycines]
MTSSSESNVPKSENLGSSEMETAEEAAQTYLNNLRVDLNKIPSMKIPFLEPIIEKYVDEYKKSRQLFAECMQKILRKSKNPNQTVKIIEFKKTIEKEMNDLLKHTDLPPDQLIDLLNTREWLLSMKKTLARAKIAQHRPLMPKGRPWESLF

SEQ ID NO: 127680 - protein, 326 aa, Heterodera glycines
  Coding regions on vcDNA: vcDNA=SeqID_54103; Strand=+; Position=1 -70,134-1044
MPFLNIYFLLLFLLVNRTFCDEIAHWIESCKKIAQNIHSLATELDQIPDSLETEKIIEKINKLKNFAVQLSEFRNDEPILLESLVIEHGQKIGQFCHNLLICDAKDGEVIRERLRHGIDQQMARAVQIRQLIDTMLIDWEIWPILHNFELAEDPSNAVAYLIDELGQKIGKMHKLLANCGSYYNTDPFDEALRRLLMVAMDEEQSPIKKLDQCRAIVPKLMAKSVQEMLENLLMDLLEPTSPFFGMTFLAEIANELNVAENICAGILRSSKLSPMAQFTVNEKLQKLRAMAKAMFLEQYRTTIEEQIKNIGTQLKDGMGRLIHIGM

SEQ ID NO: 127681 - protein, 107 aa, Heterodera glycines
  Coding regions on vcDNA: vcDNA=SeqID_54104; Strand=-; Position=1 -112,396-607
MFGREIGHFFFMPFSMGSTFRQLRIRSVIATWSSSSFEPTVPKNTCQILGLFGFYETCQILDLFGFYETCQILDLFGFYETCQILDLFGFYQKSECRNALACLSVIR

SEQ ID NO: 127682 - protein, 100 aa, Heterodera glycines
  Coding regions on vcDNA: vcDNA=SeqID_54105; Strand=+; Position=1-303
MKRVQLIETLKNVQNLFVITHNELAMIEMLETKKVMEQKLDELGQIMAQLQDNEKNGNGTPNDEDDQVAITERILSCLNVEPIEKGIEKEMTNFATKHLF

SEQ ID NO: 127683 - protein, 184 aa, Heterodera glycines
  Coding regions on vcDNA: vcDNA=SeqID_54106; Strand=-; Position=1 -223,1685-2016
MSQRNFFARSPVYDGWSYGYEKDGHNCVDFVYEFVCNLFDGNCPPEKFFPKNFVEIDKKLNGSHAFKNKTIQLYGQFNECSLKVHELRIEYALAKHGKYGTPVVTYETGVVEDPFEKIMSLDDVRLIQEIRNEQKCHVESIESDGAVLCKAVLHVCSNKYVMCMAIKDYTASFTIKITSSAKTN

SEQ ID NO: 127684 - protein, 207 aa, Heterodera glycines
  Coding regions on vcDNA: vcDNA=SeqID_54107; Strand=-; Position=1 -91,137-343,432-757
MENIFHFLSLSLFAAFALQNGVFSSQFDCYVFLPPIGLNPKSTSECPKGFQWFPSVQFCCISADQNFRPTPATDGLFYQQRYFSVPEFAANDSVPEGCIRAVHFQNESLAYCGPRPLSPSVERQIAKISHQFTDMLTIPVKDSLAQNIYCCSSDGKLSAKDQIKWQSVYHGTIAANYMLIAESGTKQISIRAACNKQSHQNLLGEEY

SEQ ID NO: 127685 - protein, 164 aa, Heterodera glycines
  Coding regions on vcDNA: vcDNA=SeqID_54108; Strand=+; Position=1 -222,285-453,635-738
  Homolog annotation: Hit_ID=CAE59216.1; Match level="QueryCoverage =71%, HitCoverage=36%, E-value=8e-13, Identity=36%"; Hit description =Hypothetical protein CBG02531 [Caenorhabditis briggsae]
MGTLLSSTILKLKKAFNIGIMNCSEEPFRFSYRREMSTRMEDNSLFLEELARQTDEIRQNGLDAMPRHGSLTDKILELEEEVERLHAENRELNEQCTDLQAQLLHNSVECGRNLLADAGQPSLAAELSGTGILVRVIELHPEILEIKDDMNSSQSVASNGSAQS

SEQ ID NO: 127686 - protein, 46 aa, Heterodera glycines
  Coding regions on vcDNA: vcDNA=SeqID_54109; Strand=-; Position=1-356
INKKHCQRQCLPKKRQKIFRKKAKKIENLNKFTSEKRKKAYNTFDS

SEQ ID NO: 127687 - protein, 34 aa, Heterodera glycines
  Coding regions on vcDNA: vcDNA=SeqID_54110; Strand=-; Position=1-348
IYLNFQFFSFFSKNFLSFFRQELPLTMFFIYLEK

SEQ ID NO: 127688 - protein, 87 aa, Heterodera glycines
  Coding regions on vcDNA: vcDNA=SeqID_54111; Strand=+; Position=1 -62,447-516,1226-1357
MDNPSVKDNPSLMDNPSLDNSRQIGYYQWVSFVLAISALMFHLPRHIDDALRYQRDLIARSRGVFLFALINVGRIYGKRTKQMQKLA

SEQ ID NO: 127689 - protein, 164 aa, Heterodera glycines
  Coding regions on vcDNA: vcDNA=SeqID_54112; Strand=-; Position=1 -187,256-347,404-464,527-679
  Homolog annotation: Hit_ID=AAR82779.1; Match level="QueryCoverage =53%, HitCoverage=2%, E-value=4e-09, Identity=42%"; Hit description =LD31436p [Drosophila melanogaster]
ADDIPPPPAVAADGGDVVVDLEQHVRQLIMSIGQGSEDAVHELSILIESFNQEQLVDFLQIMARMYVESGFSVDMPGGQEGITMLMVAASSGRVDFARYLLAHGATVGHLDATGSVFPLMLAAESGELEVCRLLVEEWAAEVNQQAIDGTTPLMSASSEGRLDV

SEQ ID NO: 127690 - protein, 42 aa, Heterodera glycines
  Coding regions on vcDNA: vcDNA=SeqID_54113; Strand=-; Position=1 -51,160-237
MFCHVESPYYAELPMEELWKMVAFVRDPIERFIAGFVDKCFQ

SEQ ID NO: 127691 - protein, 68 aa, Heterodera glycines
  Coding regions on vcDNA: vcDNA=SeqID_54114; Strand=+; Position=1 -96,222-332
  Homolog annotation: Hit_ID=NP_509543.2; Match level="QueryCoverage =98%, HitCoverage=24%, E-value=2e-14, Identity=56%"; Hit description =putative protein, with at least 6 transmembrane domains, of ancient origin (30.4 kD) (XJ777) [Caenorhabdi
MLVMSSALNFVMSLAGAVLFSVYLVFDIDDIMNHYNEEDYIIACLSIYLDIINLFLRILQILNEINRN

SEQ ID NO: 127692 - protein, 65 aa, Heterodera glycines
  Coding regions on vcDNA: vcDNA=SeqID_54115; Strand=+; Position=1 -114,420-500
RHCKPNGSCGASDQCKANDTNHNDQSHIKIIPPIVGIVFPNFLRWQHLKWKYFVERIRNSRQITL

SEQ ID NO: 127693 - protein, 95 aa, Heterodera glycines
  Coding regions on vcDNA: vcDNA=SeqID_54116; Strand=+; Position=1-289
THFGQQLLSDSEVRQVLGFMVISGKNYSGKCNSTAKLMYKWHDKEYLGAAHGVSGIYQMMLRWAANRVGGIKLTLLCQLDALASGTCLMPLRSRT

SEQ ID NO: 127694 - protein, 40 aa, Heterodera glycines
  Coding regions on vcDNA: vcDNA=SeqID_54117; Strand=-; Position=1 -62,105-173,219-292,338-410,456-527,573-645,691-763,809-911
VNSSFLHQTLNVAFGCNEQIYSLHLNYIIPTPDVERCIWM

SEQ ID NO: 127695 - protein, 40 aa, Heterodera glycines; identical to SEQ ID NO: 127694
  Coding regions on vcDNA: vcDNA=SeqID_54118; Strand=-; Position=1 -62,105-173,219-292,338-410,456-527,573-645,691-763,809-913

SEQ ID NO: 127696 - protein, 81 aa, Heterodera glycines
  Coding regions on vcDNA: vcDNA=SeqID_54119; Strand=+; Position=1-246
MVELKVETMQMEQRDNASARVAPADAALAELAPFCYDYAAIYDGPKVKGWPTPAEGMARPIASSHGFSTVCSLLSRPLRPF

SEQ ID NO: 127697 - protein, 67 aa, Heterodera glycines
  Coding regions on vcDNA: vcDNA=SeqID_54120; Strand=-; Position=1 -67,117-139,351-417,467-513
TTSFLHQTLNVAFGCNEQIYSPHYILPTPDTTSFLHQTLNVAFGCNEQIYSPHYILPTPDVERGIWM

SEQ ID NO: 127698 - protein, 53 aa, Heterodera glycines
  Coding regions on vcDNA: vcDNA=SeqID_54121; Strand=-; Position=1 -118,682-725
MRSQKEMKKGGRRRRWPFDVHKNMMTIAQIQKAIKISSQGGNYGRNCCFCVGG

SEQ ID NO: 127699 - protein, 44 aa, Heterodera glycines
  Coding regions on vcDNA: vcDNA=SeqID_54122; Strand=+; Position=1 -46,175-263
MAKYGPKYGEKLPNLKANKLQKVDYFKSQEKGPIIDYKAKNDQN

SEQ ID NO: 127700 - protein, 234 aa, Heterodera glycines
  Coding regions on vcDNA: vcDNA=SeqID_54123; Strand=+; Position=1 -67,197-654,810-989
MQLINFNFNFNLVPVLPLSNSQGFYDKKYNYNKTYNYNKKPAYSVKKPAYSNSYRKLSNNDGNAGKKPSYGGDTVKNYDYSKQAAGNGQYKSGAGQQQYGDQSAAAYGGYNNDYDKDKSRPAYNYGDANKNGDILDCFLFKLILKNKDMMATMKEDMTTKSQSTIMMTTMTTTKMRRKVLAAAAAEKAAAAKAAAAKAAAAKAAVRRSTVMKSTEKTLTIRKDQCHHTFIHLTK

SEQ ID NO: 127701 - protein, 34 aa, Heterodera glycines
  Coding regions on vcDNA: vcDNA=SeqID_54124; Strand=+; Position=1 -64,408-448
MPMIQFVFYSSSEENAHRKDYVNKAEILRAIYHN

SEQ ID NO: 127702 - protein, 82 aa, Heterodera glycines
  Coding regions on vcDNA: vcDNA=SeqID_54125; Strand=+; Position=1 -206,730-772
MDGPIAATENYPNNEQTVIEPNDKLKFHCPECNYEMCRKCNAKWVEEHNNLTCEQFAKQQNEQIQRNLKSFKQSIEHISHLT

SEQ ID NO: 127703 - protein, 61 aa, Heterodera glycines
  Coding regions on vcDNA: vcDNA=SeqID_54126; Strand=-; Position=1 -91,549-643
MCSSEHRTLLAFHFLLSSYTVSTHRCFTKSELGLKWLSAKGTHVMDAGGGEVWAPEIWASN

SEQ ID NO: 127704 - protein, 127 aa, Heterodera glycines
  Coding regions on vcDNA: vcDNA=SeqID_54127; Strand=-; Position=1 -70,300-466,515-661
MRLCLALFIAASALSLGRWIEAGVVEDVKDYVDAFSEISAPAATIGEQLRKISARVSKLVQLGGPVGSLAALAMQKALEYYNNKHNVIFIFTSLIAPSLLAGERGNGRVEIVALHHGQEIRCIGPSS

SEQ ID NO: 127705 - protein, 53 aa, Heterodera glycines
  Coding regions on vcDNA: vcDNA=SeqID_54128; Strand=-; Position=1-325
IHTPLRKSLKMHKSSFSQLSWPSSPGMPMFFLYFSRTYIGLTQRQMLDGVDAF

SEQ ID NO: 127706 - protein, 286 aa, Heterodera glycines
  Coding regions on vcDNA: vcDNA=SeqID_54129; Strand=+; Position=1 -127,179-228,500-682,831-966,1009-1375
  Homolog annotation: Hit_ID=CAE75401.1; Match level="QueryCoverage =71%, HitCoverage=24%, E-value=8e-11, Identity=27%"; Hit description =Hypothetical protein CBG23391 [Caenorhabditis briggsae]
LLRLPQNVPNNGTLGLLDPLILNMDLHRPPFFPFDPDSHPLGECAADQSNPRQFTQCEEGPTVLYESLAAADFYEFSGGDSSSQCPFFDKSIGKKCQNQTKNTSNGTVLKSIAASRNNNGPFTYLQNLTENYVRLFGRVVSLTGTIIDEDFDGIGDQRQKQRNKNKSVGNSSKMPTHFFRILFRCEDDLWHLNGINCKWTNATRVLAFVLPNVQRDLNCLVSCGGFSLSICSFKLPKRADEYLLVNTARVRDIELLTDVQFFAERMWYPTEDQLQWRTNISTELWH

SEQ ID NO: 127707 - protein, 269 aa, Heterodera glycines
  Coding regions on vcDNA: vcDNA=SeqID_54130; Strand=-; Position=1 -229,489-614,1655-1869,2024-2261
  Homolog annotation: Hit_ID=NP_203699.1; Match level="QueryCoverage =71%, HitCoverage=84%, E-value=7e-30, Identity=45%"; Hit description =alpha 5 type IV collagen isoform 2, precursor [Homo sapiens] gb|AAF66217.2| type IV collagen alpha 5 chai
MCPSGPPGYPGPPGDRGEDGLPGQDGEPGNPGLSGSTGFLGPQGMPGESGKPGTIGEPGMPGLPGVIGQKGDNGAPGQKGPIGPAGPPGRPGIDGKPGLIGVPGNGGNTGDGGLRGPPGGNGGGQKSDGGGTRKAAPIARGVEKRFLDDLRDGIWGQHFGQLFEAMGRIGKGKTNGGTADKAGRRTTAGQPGNWIFVRGENKWKLIDLQSAIPNFEQYKPLQMGKEERFPEDFMEFACNSLNNEICLTKFIAPANERPSTYASPEHSTA

SEQ ID NO: 127708 - protein, 173 aa, Heterodera glycines
  Coding regions on vcDNA: vcDNA=SeqID_54131; Strand=-; Position=1 -303,354-570
MSIQDPSSADVKSQSAHLNAKIMHKSANVLVQKTFSNKNLETEQTESRVNKKSKNEQKQRKTDERQKEKAEGKSEETEKEKAIENEKKEKPKRTDQTTLLEAMPSSSNAPQKVPVPLIDRQRTHTVMTVEENVRAGIVAYLDTIGPSNETGSSRSKKPQSIVKPMPQQQREDG

SEQ ID NO: 127709 - protein, 177 aa, Heterodera glycines
  Coding regions on vcDNA: vcDNA=SeqID_54132; Strand=-; Position=1-534
  Homolog annotation: Hit_ID=S35221; Match level="QueryCoverage=74%, HitCoverage=18%, E-value=9e-13, Identity=39%"; Hit description =globulin Beg1 precursor - barley gb|AAA34269.1| storage protein gb|AAA32936.1| embryo globulin prf||1916404A b
MTEMDRTRSLERKALHGHATVTSRPSLSTQMEEEIAGTTNMIINGQDGRDEEKKETNWKEEDGGERRSGMNQRDEDDGRINEKEEDDGGRRRGMNSREEEEEDGRRKRGGMNSMEEEEEDGRGRKGGMNSREEDDGGGRSGINEREKEGEDGRGGRRGMNSREEEDGGRKRKKGRDE

SEQ ID NO: 127710 - protein, 45 aa, Heterodera glycines
  Coding regions on vcDNA: vcDNA=SeqID_54133; Strand=+; Position=1 -51,320-406
MGTKMEGCDRNWCRFDNGGHLCSVYVCGQYGGRTEWHHDWSYFWR

SEQ ID NO: 127711 - protein, 223 aa, Heterodera glycines
  Coding regions on vcDNA: vcDNA=SeqID_54134; Strand=+; Position=1 -586,1093-1185
  Homolog annotation: Hit_ID=NP_913627.1; Match level="QueryCoverage =90%, HitCoverage=13%, E-value=2e-31, Identity=38%"; Hit description =putative helicase [Oryza sativa (japonica cultivar-group)]
LNRLILAPHIDTCDEINDIMMANVPGQAREYLSSDKPLDERPLDIDEIELEVAALNRRTDSGMPPHRLRLKVGSVVVLLINKSDKEGLINGTRIVLEELGDDRLVGRVINSNSVGGQVKLKEHAMSTRTKRLALKYERLQFPIKPAFAMTILKGQGQTISTVGIDLERDVFSHGQLYTAFSRATDGNNVRVYVFRSEGQLSANGAETAFSKFFLKLLGFKIFL

SEQ ID NO: 127712 - protein, 134 aa, Heterodera glycines
  Coding regions on vcDNA: vcDNA=SeqID_54135; Strand=-; Position=1 -105,155-313,371-508
MGGNIRITFIDECQICSQSELTMSKLITMSPQQISQMRLDSDESDIAWFLGSVIHLLAFQTYPLEEWHSRNKTLANQCQLDGTFKMPQTSESFCMFLLQNSVNKMLFSAEKLQIPTDFPHGFEKEYAILGQIMM

SEQ ID NO: 127713 - protein, 58 aa, Heterodera glycines
  Coding regions on vcDNA: vcDNA=SeqID_54136; Strand=-; Position=1 -107,251-320
MEKVGRPSDDSPTVISCRNQFYCISQFVSLAFFNVNFRDINCGRGLSSTNVAKSRKKS

SEQ ID NO: 127714 - protein, 545 aa, Heterodera glycines
  Coding regions on vcDNA: vcDNA=SeqID_54137; Strand=-; Position=1 -278,342-1701
MGAAAAVQRSFEMEKLAKQTVNVQLVWQRPEVRPDEVQTNLKKAQRVSFEWLINNKSAVADFLEAWEEDTPVEAKVARDSRAQCCSVGRVIGLAKKGYDRGWEDWESILDERESNVIPIPNYGGLPFREQAFELSVPSDIAEGQYPVSKILKILMGMGKDGAEQRPTVRLSSNEIAVGKLNEDQRITHGLFLDDESRVIFMQAPAGTGKSVSVAACIASVLKKDRDAAILAVSPLNVAVCELVKDTMESLSEKVPMLALFSGQGKGRYMDRIRPLGDNLLVEAVQRDGNVPSAEGTEPKKWSDNKTFKQYVDDFNTAPRRARERTTTAALLKQTKYRVYFMTLALAEELALDLGNVTYVLVDECGQATLSAVLSILTQFRSVKKILLTGDKQQLRVHLPSQMTVIRGKFGFESILEVLETAKGIDRTVLSKCYRLHSAIVRCLDAGVYSPAGDRLVPGRPDVEMSSFLNYMGPRIVAENCPIILIHQKSSTQMESISFSSHNPEQRETALGFLGIIQGTFFDSKSGSRACPCHHDSLRGWTIIGS

SEQ ID NO: 127715 - protein, 37 aa, Heterodera glycines
  Coding regions on vcDNA: vcDNA=SeqID_54138; Strand=+; Position=1-145
WHQLPPFFHVNEFHFLSEKELPGVKCNFHPSTILMDL

SEQ ID NO: 127716 - protein, 123 aa, Heterodera glycines
  Coding regions on vcDNA: vcDNA=SeqID_54139; Strand=+; Position=1 -87,131-256,311-469
  Homolog annotation: Hit_ID=CAE60857.1; Match level="QueryCoverage =83%, HitCoverage=15%, E-value=8e-29, Identity=53%"; Hit description =Hypothetical protein CBG04568 [Caenorhabditis briggsae]
MDYLLARCNGFDSATNWDWNDALSPGELQRLSIGRVLYHKPRVAFLDEATSCLGFDMESSLYKVLRDEGITVVSTGQRCSLKQFHELELNLRGRHWTLVELDSVRSMVTEPSLGGAAEEGSRA

SEQ ID NO: 127717 - protein, 151 aa, Heterodera glycines
  Coding regions on vcDNA: vcDNA=SeqID_54140; Strand=-; Position=1 -63,410-644,851-1008
MQLAMFCVHVTATIIFLQLYLGFTEAGIECQLDGHCKDNAAQLLRVRCAQNATVAPSKSCCSQVYANPYAKCPIKGWRRKGYKGNVPVEIGVPSKKRDAGCSKGNPCKEGYKCVAYKKGDDHGFCWRGPQGDGGPSNFALAVAIAGLVILL

SEQ ID NO: 127718 - protein, 29 aa, Heterodera glycines
  Coding regions on vcDNA: vcDNA=SeqID_54141; Strand=-; Position=1-89
TVQMPFRSVLVTNGMCGDQWSLIFLMTIK

SEQ ID NO: 127719 - protein, 1263 aa, Heterodera glycines
  Coding regions on vcDNA: vcDNA=SeqID_54142; Strand=-; Position=1-3790
  Homolog annotation: Hit_ID=S60004; Match level="QueryCoverage=75%, HitCoverage=67%, E-value=1e-124, Identity=32%"; Hit description =hypothetical protein - common roundworm retrotransposon R4 (fragment) gb|AAA97394.1| reverse transcriptase co
MCSLAQGSSGTLSHNGKGVAMHRCPSDDCAGKDPPQRGSQKGNLRSVRWTPSEEKAVFEYWSRLEQHAMLNGSEARGTCAITRSQFLIHWDGERESRSLSDGVPEYPMRTERAYYERVRLLRQRGWQWDCANECLVIGQCAEPCRKPNVVAIKADKGMKRSLVKGKLLSLPHVMGEINQVSVQVEVPLPSVPASVPQVEGVESKGFTETEPSNKPSLEGNPAEEGLRKPERVNVPVHGIISDSERKDLKDRFWSAYKTAKRSVGFRPALKIEPNRVNRAQWEVLDSCVVEVLKKRETSNGYRGCVLRHLNVAVYAAGYVLAEGNKERRQVIRRQSAEWLLRQKSEINNIRRHIGWITDELTRRRTGKNPTSRQLSNFAWLQRRYQVLGKPVRETRDLEVQRERLVSRLRLAQDRINSSMDREERVRKRMLPLRRKLEEPLGDSKLDTKQARTFWASLIGERKEFGKIPELENWAEEVRSKVTDGQGFASDHVDQTVWKKILGKARPLKAPGPDGIPNLLWKRLPSANQALFKWLMGIKRKQLSVPSWLTKGRVVLLPKGGDPVDPANYRPIACLNTQYKLVTGMVTAWVSEHLTTYSILPIEQRAMVSGTWGCTHAMVIDRAITSYAEATGLPLYVGFVDFAKAFDSVSQPWIRYALKVAGVHKRIRCLIGILMKCWSVRYEVFKSGRVLRSAPLAVKNGVLQGDTLSPLLFCLSVAVVSSAVGSLFDFEVTIPGRGVMQQQNHLFYMDDFKGFAPSEASLTRMLVTLERTASALGLKINKRKCALVHPRERENEETGSDIPVLGLRDTYKYLGIEERFGIVFEDAWDRVRTKMFERMRTLLCTEHTFGELRAAFASTIAPVARYLFLNVIVGGPSWSETLTKAKDMDLRIRRLLWERRDNEPGWRFKHCSADRLYLRVQYGGLGFVSVEDTLSESIIYCWAYVQCRPELELARELFGTLNRSARSGIKQSIAKGARKVFRSYALLSKNSAQRVSDLDGDASPGFRVGEMIFMEPTRGARAIVKILRKENDSRRLAAWKGRPMGGRVVSLPELDQVHSYHWLIRARIGRRSFRDCIAAQEGQLKARELMCPHINAKAKWCRRCGDGRVETEQHILSGCAWSRTGTMLDRHNGVVRQVHTALCRKYGLPVSSHVVPLHAVIENEHAKILYDVALHTSPAGVLPREDGSTSYTGLRSTRPDMVIFDKKARTILIVEISVPWRENLVKQELIKWRKYAINSMIEPLELAEAEIPGPNLKHALGLAY

SEQ ID NO: 127720 - protein, 264 aa, Heterodera glycines
  misc_feature (2)..(2): Xaa can be any naturally occurring amino acid
  misc_feature (41)..(41): Xaa can be any naturally occurring amino acid
  misc_feature (57)..(57): Xaa can be any naturally occurring amino acid
  misc_feature (68)..(68): Xaa can be any naturally occurring amino acid
  misc_feature (163)..(163): Xaa can be any naturally occurring amino acid
  misc_feature (196)..(196): Xaa can be any naturally occurring amino acid
  Coding regions on vcDNA: vcDNA=SeqID_54143; Strand=+; Position=1 -212,1265-1408,2146-2228,2610-2971
  Homolog annotation: Hit_ID=NP_671477.1; Match level="QueryCoverage =95%, HitCoverage=87%, E-value=3e-38, Identity=41%"; Hit description =rRNA promoter binding protein [Rattus norvegicus] gb|AAK21974.1| rRNA promoter binding protein [Rattus no
VXSPASFPCCLPPARIPPHKLQRSNAGGRNRGTHWRFPSFXAPQQRRNPVLPTGHGXPYSVRFLEPVXNPQGTTPTTPYLTSKALARPAPLAQAGTSRNCSSGTTASSELSANHHPHPNRKGLGLAQPVQHLGTFATRPTPTRLPARLTRPLEPILFPKLRIXFADFPYLHYSRLEAVHLGDLLRISVRSGRRFKXLPSHFQGPCGAHETPQEPRCFTGATSLSQAEPLPGTHTLNEKRTLARTPHDVCEFICVTAQNSSCEPS

SEQ ID NO: 127721 - protein, 104 aa, Heterodera glycines
  Coding regions on vcDNA: vcDNA=SeqID_54144; Strand=-; Position=1-315
MFAGGKFGGAIAKGRKFAVKEENKTRKSRLSFALPGQVSVLVEDSVDTFERGAGAFVVPFGVSGANESQGKTRDANTSLCADGDMSLLSEKKTQFTFGQFKKIF

SEQ ID NO: 127722 - protein, 73 aa, Heterodera glycines
  Coding regions on vcDNA: vcDNA=SeqID_54145; Strand=-; Position=1-477
FGPPFLGPGVVWAPVFGPRGRLGPNPKIEKCAFLKIKILKTTPEGTLATWYKLGLINIRSFFTILLIPNPIIF

SEQ ID NO: 127723 - protein, 44 aa, Heterodera glycines
  Coding regions on vcDNA: vcDNA=SeqID_54146; Strand=+; Position=1-133
MDSVSTIAKDGHGVVKYFCVASLDLPDDGGDNEIVAGAAQNNQQ

SEQ ID NO: 127724 - protein, 128 aa, Heterodera glycines
  Coding regions on vcDNA: vcDNA=SeqID_54147; Strand=+; Position=1 -215,568-741
  Homolog annotation: Hit_ID=NP_491572.2; Match level="QueryCoverage =100%, HitCoverage=30%, E-value=8e-53, Identity=73%"; Hit description= AP-2 Medium chain, clathrin associated complex (48.6 kD) (apm-1) [Caenorhabditis elegans] gb|AAB54125.2|
NRGKAVELEDVKFHQCVRLSRFESERTISFIPPDGEFELMSYRLSATIKPLIWVEVQLEKYAHSRVEYIVKAKSQFKRQSIANHVEIIVPVQNDADSPKFKSTVGSARYAPEISAFVWTIRSFPGTNE

SEQ ID NO: 127725 - protein, 201 aa, Heterodera glycines
  Coding regions on vcDNA: vcDNA=SeqID_54148; Strand=-; Position=1 -81,332-856
MANAHLRRFSSPTTADFAAHLLCPIHWQGAVLERVINLVHHEPSSQNDNQQIAPSASSSSSGTENAPQNDQLLLITGGEMPSHGSDSGSATAGQVPSHGSESAIAEEGPSHAVGNDSASNDSAADSSFLMDTFSPFVNFLIALALFLFSVGAAGKVVPNSLFFFVISLLVSALCFIGATDGGARECYAYALMALVANFVSW

SEQ ID NO: 127726 - protein, 19 aa, Heterodera glycines
  Coding regions on vcDNA: vcDNA=SeqID_54149; Strand=+; Position=1-61
PINTNERTVKDPNDYLEKI

SEQ ID NO: 127727 - protein, 78 aa, Heterodera glycines
  Coding regions on vcDNA: vcDNA=SeqID_54150; Strand=+; Position=1 -114,268-390
MAYENSMKKTQIGWNTLRLPSTRSPNTPAGSVKQLQTRKFLDNIFSKKHLPKKTKKLQVSWLIIYVVIHAVLMEKESR

SEQ ID NO: 127728 - protein, 61 aa, Heterodera glycines
  Coding regions on vcDNA: vcDNA=SeqID_54151; Strand=+; Position=1-214
GREAALIAQQIYKRARSARLRSRSCLNSPTNLETGAKRPYKPNKIKKTGAKRPFEAAKWPK

SEQ ID NO: 127729 - protein, 36 aa, Heterodera glycines
  Coding regions on vcDNA: vcDNA=SeqID_54152; Strand=+; Position=1-111
DVSVPSTKKAQRCLTCQIGRDGVLSTWYGRKRKDSN

SEQ ID NO: 127730 - protein, 29 aa, Heterodera glycines
  Coding regions on vcDNA: vcDNA=SeqID_54153; Strand=+; Position=1-88
DVSVPSTKKAQRCLTCQIGRDGVLSTWYG

SEQ ID NO: 127731 - protein, 185 aa, Heterodera glycines
  Coding regions on vcDNA: vcDNA=SeqID_54154; Strand=+; Position=1 -309,375-620
  Homolog annotation: Hit_ID=XP_455812.1; Match level="QueryCoverage =36%, HitCoverage=10%, E-value=2e-09, Identity=45%"; Hit description =unnamed protein product [Kluyveromyces lactis] emb|CAG98520.1| unnamed protein product [Kluyveromyces lac
MDTDDGMRRSSTDRGGRKRGGDAEDEEEEGEGRLVVAEEDDDEEEKKHRRRMERWDRVDDWDDDDDDDEEEADDDEEDEDGSPNGEVPPPPPGTLSYRRFGQENVLVERETHTPPTLWTLCPEQREWGGNGYPSGSDAGKVPTDSDEKAQREDEDGSTDWERAGNKKRSGMAIMQLRGWPEPDEA

SEQ ID NO: 127732 - protein, 137 aa, Heterodera glycines
  Coding regions on vcDNA: vcDNA=SeqID_54155; Strand=+; Position=1-414
MLKKLPKPFLIVYDDLMGDIDAKKLADLYTKKSHHNNFSVIFLTQNLFDKAMRVPRSNAQYIFLMRAPSDMLSIRNLASQMFPREQGFLMDAYKQACADPYGYLLVTLHANTDNLLRLRTNIFPDDEEKIVFVPKNG

SEQ ID NO: 127733 - protein, 399 aa, Heterodera glycines
  Coding regions on vcDNA: vcDNA=SeqID_54156; Strand=+; Position=1 -93,516-1619
MKYFVFGIFARLFYSFSFPSISNANASSSMSIDDNAFLAFLKGWKSFDKFYTEEVLLLGQKKEVLAQKFEVLLAALHSLRWDWKCHRIKNEKEKCKKYRNFAHSLYDYLFRVYAVFPAVKPIFMLKKQKFVKIGTLAELVNSLDRIRKFFFDTEFARSFEFKLKKLFMVYFKPKLKKELLENGKNSPISPIPAGLKVPKFINFDRKLKAMHIDQQFAAFVKEQPNSASNSGPLFTLVVNDPYGFIQQKLAQNYETAFGAVYYLRMNWHCAKIGKKFDEFGQLKCQEYRKYLDILCEYLFRLFSGIPAMKPIFKLKKQENEEIYASLIDVIENLGEIMKFFFNSQFGRGGKFKFETFLAKHYEPILLNMDEVGDYVSIGQLGDNSHAKFGKKFEFQMKNI

SEQ ID NO: 127734 - protein, 75 aa, Heterodera glycines
  Coding regions on vcDNA: vcDNA=SeqID_54157; Strand=+; Position=1 -87,486-536,952-1041
ANRASKELSNDTTMLDLVGKEKSYSPKTCASTYKTLLITVVTLLISTSTYNRKGCRNWQLFSTNFVQFSPRRITH

SEQ ID NO: 127735 - protein, 164 aa, Heterodera glycines
  Coding regions on vcDNA: vcDNA=SeqID_54158; Strand=-; Position=1-495
MPMGHAKGERMCQRKKANGKMPMGHAKGERMCQRKKANGKMPMGHAKGERMCQRKKANGKMPMGHAKGERMCQRKKDNGKMPMGHAKGERMCQRKKANGKMPMGHAKGERMCQRKKANGKMPMGHAKGERMCQRKKATGKMPRSKIINGKMAKGNKSKKTKERK

SEQ ID NO: 127736 - protein, 92 aa, Heterodera glycines
  Coding regions on vcDNA: vcDNA=SeqID_54159; Strand=+; Position=1 -137,216-357
MDRRDSRRRRMREKREEGKQRERAETRDCYFVEEDGQESERMRFLKIPFLIIGPQNPDLKTHSFIVNVNSTVLFRYGVALSNFKKLTIGANF

SEQ ID NO: 127737 - protein, 614 aa, Heterodera glycines
  Coding regions on vcDNA: vcDNA=SeqID_54160; Strand=+; Position=1-1843
MQQALDNIDESNDTAGFGTSHLRCAIVQVQSSMAVAMLKRFTKNCPWFFGISNGTPTGSDRRLRLGDEVVIVNFAWKSGYEVLWHLDQDGTSPPWLNAGNINIQATAIKANIANPTNIVPKIGIVLNVKRRGMRKTNVIQSLTVVAPGMKVAQSLPGWALGEKDWFRTGQAVLVETVELMRPNLWKVNQIYALPLNCPFGQVNDRKAYHPFVAVGIDQSPILHKFPFRRGDWDATIAQGEQAIAAAVTACLDKLEEDILRFTITAEPQVEYGAEADTAIITIRHRLDNKQEMVDMSKMWTEDQPIHVRVAAKGAKPCATGFIMNVERQESETGLSIVAKLFLAYQEAKNYDCEEAWDRIMDGELTEIEPLHSRKILMQRAEKFSVNLFTEMAKNTTTGLGTIMSILMARQGERTPPQNSWDELFVAKQPALNDLIGGQRETARLMLDSVPRVVFMQAPPGTGKTKVSVDIIAAHLRTNPDAHVLFVAPLNVAVVKAVEEMAKTMERMGWREDMLALFSGSGKKKYMLELNKIGPHLLAAALRAPQLFEELKDDQKRTVLRYIKACETSPRTANEGKAAQILLSKEKRRIIFCTLSLAEQIGTIFDETDMIIVDE

SEQ ID NO: 127738 - protein, 53 aa, Heterodera glycines
  Coding regions on vcDNA: vcDNA=SeqID_54161; Strand=+; Position=1 -3,506-664
MHFCCGRHFTIGPIKNDEKNEMALIVFKMAQNGAPSEVQLDGNAKNAAENFTF

SEQ ID NO: 127739 - protein, 305 aa, Heterodera glycines
  Coding regions on vcDNA: vcDNA=SeqID_54162; Strand=-; Position=1 -94,151-183,252-370,416-530,576-706,901-976,1055-1221,1272-1302
  Homolog annotation: Hit_ID=NP_499884.1; Match level="QueryCoverage =99%, HitCoverage=26%, E-value=2e-69, Identity=48%"; Hit description =aminoadipate-semialdehyde synthase (103.8 kD) (4B3) [Caenorhabditis elegans] gb|AAB94142.1| Hypothetical
PSANGISSNSSRLLTIPDAKYLLTTVNKSVPGCPSLPHRLVPGCPSLPHRLMAICDIMAICDISADPGGSIEFMTECTTIDKPFVIYDADTNKCHENFDASSGCLICSFDASSGCLICSVDNMPAQLPVEATEQFGSLLLPYMMDLLNCNTDQPFASLQCRDEILNCNTDQPFASLQCRDEIKRAIITSDGQLTPGYKYIDELRLEQRFRRSAHKSRVVAVSSKRVLLLGAGMVSDPLAKYYASRSNVQLTVASDSSKDGQRLASLGSNIESVVVDVNKEPEVINSLISDHELCIDHELCISLLP

SEQ ID NO: 127740 - protein, 154 aa, Heterodera glycines
  Coding regions on vcDNA: vcDNA=SeqID_54163; Strand=-; Position=1-464
  Homolog annotation: Hit_ID=CAE70291.1; Match level="QueryCoverage =94%, HitCoverage=40%, E-value=9e-20, Identity=37%"; Hit description =Hypothetical protein CBG16811 [Caenorhabditis briggsae]
MAELFRPLDEWMVSTLPSRPGLYILFGLFSEEQQLRWLGRSLFEYPEPPNITNLSSNGTYSGSSVFKTCGAEKLRWTTLGLDYDWTSKDYSMEEKALPMEIKQISKLVIDGAFWLSFLHIERLLSSVLGSFPLVPDAAIVNYYPKNASISPHAD

SEQ ID NO: 127741 - protein, 96 aa, Heterodera glycines
  Coding regions on vcDNA: vcDNA=SeqID_54164; Strand=+; Position=1 -66,113-337
MDLLEIIAQKRKQIEDIAIEHGSGAKMIRHSDLFKKEKDAYLERQKQLGKEQHLSVKGLNTEELLDAKFSLTGSDSMPRPEVVRLEGPRAAHSAFW

SEQ ID NO: 127742 - protein, 244 aa, Heterodera glycines
  Coding regions on vcDNA: vcDNA=SeqID_54165; Strand=-; Position=1-733
  Homolog annotation: Hit_ID=NP_494302.1; Match level="QueryCoverage =95%, HitCoverage=17%, E-value=4e-41, Identity=38%"; Hit description =predicted CDS, putative protein of ancient origin (2C878) [Caenorhabditis elegans] gb|AAB95006.1| Hypothe
MNLALNPEEGDDPAYGQIFIVDTEHAMRAMRHANVGIEPQLLRTAYEVIRNVNPFAEAYMMMKEEEDEEVERARTENREPAEIKLLFETGRQLDRRLGYNVPRANEVAAVYVPGADGEVPNAKIVVRERGKELKILKSTDSMVTPMTYPLFYPRGTLGWDPEMKHRNSNRRVTRLQYVCYTVAIREREFNPILYGGKLFQQYCVDEYVKIEGDRMNWIKSNQKKILADAYKNVDNMLIRRAQER

SEQ ID NO: 127743 - protein, 66 aa, Heterodera glycines
  Coding regions on vcDNA: vcDNA=SeqID_54166; Strand=+; Position=1 -52,83-158,246-315
IILTCTRISGIILTRARISGIILRISGIILTCTRISGIILMYQNKRNYSDVYQNERNYSDVYQNKR

SEQ ID NO: 127744 - protein, 16 aa, Heterodera glycines
  Coding regions on vcDNA: vcDNA=SeqID_54167; Strand=-; Position=1-49
EATPEGFGLPINLGAS

SEQ ID NO: 127745 - protein, 89 aa, Heterodera glycines
  Coding regions on vcDNA: vcDNA=SeqID_54168; Strand=+; Position=1 -155,216-330
MALNRLPDSGHSDSGQSDNPTEVDNRTVGNPTVKCTKRLRKCHRRSEPIGQRGNLRRRARIRPYFGSVSNPEPGLEQKFENSIFRTSQF

SEQ ID NO: 127746 - protein, 367 aa, Heterodera glycines
  Coding regions on vcDNA: vcDNA=SeqID_54169; Strand=+; Position=1 -87,658-1392,1701-1982
MNCLFLILFFAFCPLFRIAFFSQLSSSAEIDNDALVAFVKGPSNFVQFCAAKGVANNESKGLLARVYGTHLGMLYHMRLNWHCARTNNSIHRMLYKRKCEYFRKSVDILYEYLSRVHNGGNAEVTRPIFKAESTSIQLTFVDVVECLATISNFYFCDQKMTNNYEIMKEMAKFSQFKLENEEQQLDFKSGKSAKQKNKRLKTDGKANGIEFEQKMEKMFRKIIIENAKLANGSSSSAFSSSTFPSSAFPLPISMCTVPIYDAALRVPIYDMSDAIEEELFLKFVNGSADFSAHFAAVPLDEIKKYETHLGLLYAMKTNWRCANAKNKIDNSCTKDRRYIDILYEYLFMIRYGIKSVKPMFETLVGQR

SEQ ID NO: 127747 - protein, 25 aa, Heterodera glycines
  Coding regions on vcDNA: vcDNA=SeqID_54170; Strand=-; Position=1-77
MVISFLYQNPSSYDAAEEITNMTWA

SEQ ID NO: 127748 - protein, 80 aa, Heterodera glycines
  Coding regions on vcDNA: vcDNA=SeqID_54171; Strand=+; Position=1-243
  Homolog annotation: Hit_ID=NP_498532.2; Match level="QueryCoverage =81%, HitCoverage=12%, E-value=3e-13, Identity=61%"; Hit description =gaba receptor (3I109) [Caenorhabditis elegans]
MKVSYVKSLDIFLGVCFFIVFASLLEYATVGFLMKRRRQKSSSTSSSVMPRSSTVCFRELEDGTLKMLAPMHHNHHQVNN

SEQ ID NO: 127749 - protein, 146 aa, Heterodera glycines
  Coding regions on vcDNA: vcDNA=SeqID_54172; Strand=+; Position=1 -49,620-792,1100-1318
  Homolog annotation: Hit_ID=AAH78292.1; Match level="QueryCoverage =90%, HitCoverage=22%, E-value=2e-28, Identity=48%"; Hit description =Coactivator-associated arginine methyltransferase 1 [Danio rerio] ref|NP_001003645.1| coactivator-associat
RMLESFMYARKFLRPGGRMFPTRADLHLALFTDDALYAEQQQRAAFWAQQTFHGVALGVLQEPALDELFRQPVVDAWSGAILASPSVKWTVNFERDPVERLHRIQIPFTVSFTNSPAKERRKFLKNLAFFSTKFARNFHFFFWRRL

SEQ ID NO: 127750 - protein, 57 aa, Heterodera glycines
  Coding regions on vcDNA: vcDNA=SeqID_54173; Strand=-; Position=1 -108,378-443
MNDSRIIRGRKFNCSLTWLLDHYKLSDKYAIKKKIKLNNNFPNQPGFEQKVENFQFQ

SEQ ID NO: 127751 - protein, 43 aa, Heterodera glycines
  Coding regions on vcDNA: vcDNA=SeqID_54174; Strand=+; Position=1-131
MSSVRSISSTARAGNVLVLLDLYASGFASSNTSPTIPMLTSRT

SEQ ID NO: 127752 - protein, 104 aa, Heterodera glycines
  Coding regions on vcDNA: vcDNA=SeqID_54175; Strand=+; Position=1 -50,1282-1409,1563-1699
  Homolog annotation: Hit_ID=NP_112263.1; Match level="QueryCoverage =100%, HitCoverage=71%, E-value=6e-29, Identity=60%"; Hit description= ubiquitin-conjugating enzyme E2D 2 [Rattus norvegicus] ref|NP _082778.1| RIKEN cDNA 1700013N18 [Mus muscu
SSYQGHPFHSFFEFSSGYPCTPSIVKFINDIYHPNVGESGDICLDLKQMWAPALTISKVLLSISSLLCDPNPDCALRQDIAIMYRDNREEYNRNAREWTKKYAM

SEQ ID NO: 127753 - protein, 129 aa, Heterodera glycines
  Coding regions on vcDNA: vcDNA=SeqID_54176; Strand=+; Position=1 -105,295-441,512-649
  Homolog annotation: Hit_ID=AAP30770.1; Match level="QueryCoverage =66%, HitCoverage=32%, E-value=1e-20, Identity=59%"; Hit description =putative gland protein G17G01 [Heterodera glycines]
MSLLRFSQLFWSALVSLALLFYGIMEMLRSIEEYKIGIYSYAFASIFCWDCSVVYSSKLLLHWTDFWTCVNFQADHTNVPLITLVLSIVLLCSSVFEIILHKFVLNDVDTECANMIFHQHQKKNGSAIE

SEQ ID NO: 127754 - protein, 137 aa, Heterodera glycines
  Coding regions on vcDNA: vcDNA=SeqID_54177; Strand=+; Position=1-414
MHLHAFQPANTFFAENSVELRRNPSDTIVAGPSCALAGFVALISLAIGRSPERFGLTGCFEPNGIISQVGGMEKKLMRLVHSGINNVLVPNDNYKKQMPSEMPTMPAMTWVPSLTLTFVVHINELWHSLFPLFLDAQ

SEQ ID NO: 127755 - protein, 18 aa, Heterodera glycines
  Coding regions on vcDNA: vcDNA=SeqID_54178; Strand=+; Position=1-54
MASNQKILFFVRMAKTFV

SEQ ID NO: 127756 - protein, 49 aa, Heterodera glycines
  Coding regions on vcDNA: vcDNA=SeqID_54179; Strand=-; Position=1-159
SGTGNLGQNRDRDLPRPEKPGPGPRFFFGTGNQDQPGNLEIQKNFKKFK

SEQ ID NO: 127757 - protein, 103 aa, Heterodera glycines
  Coding regions on vcDNA: vcDNA=SeqID_54180; Strand=+; Position=1 -159,370-522
MMNILMIPDFKGPEHVHCGKCGFDFYFYNVKWQDCLVDAGMGPGQCWLGEDNIPPGALGKYNEKLLSEMDKVEKILDDPERLLDQIVGIVEDEDTIPLGAEVS

SEQ ID NO: 127758 - protein, 35 aa, Heterodera glycines
  Coding regions on vcDNA: vcDNA=SeqID_54181; Strand=-; Position=1 -7,463-563
MSYTSDLFISSFSSIADHLFPCFTLNSIGTTIWFF

SEQ ID NO: 127759 - protein, 130 aa, Heterodera glycines
  Coding regions on vcDNA: vcDNA=SeqID_54182; Strand=+; Position=1 -61,150-238,327-419,481-569,830-890
MSISTNSINCGDDFTPAENREVNGDAISLENDGQFDGNSETITDQQQQLKEFHEKFAKLETELKMAKLETELKMAKLELENKALKLKHQELVGEQKALKEKVIKIEQKNGSNFSKSEHIGGNECSDCPNF

SEQ ID NO: 127760 - protein, 226 aa, Heterodera glycines
  Coding regions on vcDNA: vcDNA=SeqID_54183; Strand=+; Position=1 -565,1075-1190
MGIFTSPFVAQLRHKSGSPIAECYEVRILLSSLMARINLLERSLYEYNDNLPAPTRKACLEKIVRAKNEFYAKIAEGNLSHLRKTFCVMYQFAKFLEKSVAVGRLGEAIERWEATECQNENVVKETILAHRAQKKRTIFDIIISAVKKEEVMRQLREIRGCYTRISRYLEDQRMFKKLLKEADFYEQRVFLAHKNPSSSHYLNSQNLEILGRFYFSTFVFCVGALD

SEQ ID NO: 127761 - protein, 403 aa, Heterodera glycines
  Coding regions on vcDNA: vcDNA=SeqID_54184; Strand=+; Position=1 -133,445-1520
  Homolog annotation: Hit_ID=AAG00554.1; Match level="QueryCoverage =88%, HitCoverage=78%, E-value=1e-24, Identity=25%"; Hit description =retinitis pigmentosa GTPase regulator-like protein [Takifugu rubripes]
MPMALSETQEKSWHCFENWIQNLHFDVLKQMLNKQTIFFDNIKRFFESKPKEHTDKLMLFLHNKQNVENILRLLGIDFEANGSSDGDPTERTPGAEDDDWPSTDSPMGSTASPVVSPSTERKKAKRKKAKRSKNQRKTSIVEHEIDEEMFLSSETPKNGTESQKKQSEEEEKPSEQEEDEAVIEAAEIEELIGEESSKDEAANGGKAQEKDEAKIEEEPTAERAPDKEEDEEEEAVNEENGPKEDEEEETVETGELIREEPSKEEAVKGAKAPAKHEAKNGEEPTGSAPDEEEEEEEAVHEEKAIKEEKESEEEEAAVIEEKGAKEEEAVKEALEGEKLTGDKKAPKDKVDIGKKAFEGKAVIVKEPMEKEPLKNEAEKAENEKMPEHSLAIPSVQKAEREMD

SEQ ID NO: 127762 - protein, 508 aa, Heterodera glycines
  Coding regions on vcDNA: vcDNA=SeqID_54185; Strand=+; Position=1 -487,608-676,720-886,932-1036,1317-1620,1868-2029,2076-2134,2294-2467
MAKESVTVPGEDASVRAIVHLLDLGIYANEIWHRLNAIRLVEQIWPELGILQSEVAKIEGQWAKIKGIKLSLKSQWTELEKYLHQMLKQLLVLMDKKKFPGINYDGVANDNEGELLREIRLLKDEMHLRNLAFSLAESKSAQTIWHSLCPAQSASFLSLLFSHLFRKHLHQRVNFAMKENNQQKIDVKLYYEFRNNKNLKRFVPFKMSANFATKKLNQISELWQHMAFGEDRFNELDIYNLKNEIAKGNNYLIFDVNQKAMVENIIREMDELLKNWKENLLALQRIQKDYFNSVPQIHFTYKTLPVTIMAILVPNLGQEVPNGSLDVQKIKTIAQKFGDEIEKLIRADHLFDEGQFRISQRVNDQTMEQLANSIVHADFTTHAKIHWFLLDKLDTTQKEAASTVLNRNINNHNNLFINFAFLLAYLEQWAKSNHINGEHIGFLNFNILVVMALATAGSIDRNLCPQKGRISELDAGQRMVHKKATFAQKDAQGDPCRIGNGHHYADIP

SEQ ID NO: 127763 - protein, 56 aa, Heterodera glycines
  Coding regions on vcDNA: vcDNA=SeqID_54186; Strand=+; Position=1 -75,322-417
MLDFDDKEKSYSQKHAGPKCAGPTEHFCNYGLLKLSHQRQSWQDPVDPYRPSPGTF

SEQ ID NO: 127764 - protein, 28 aa, Heterodera glycines
  Coding regions on vcDNA: vcDNA=SeqID_54187; Strand=-; Position=1 -32,80-134
MRDREPRKNPAIFGRQAFSQDIYDQSRR

SEQ ID NO: 127765 - protein, 142 aa, Heterodera glycines
  Coding regions on vcDNA: vcDNA=SeqID_54188; Strand=+; Position=1-429
MAEKSMRAAEKTIFESPCLQPEGMRRNVINELESQEERERRKRFATRTPPSGQAFANTVWAEKDWKKDDEGEKDEKEEPVFTKIIKIQRKLKEANEELKMLAKDVERLVSAEKSIAEKEKKWDGFPTNVNEFGEAGTSNRWR

SEQ ID NO: 127766 - protein, 59 aa, Heterodera glycines
  Coding regions on vcDNA: vcDNA=SeqID_54189; Strand=-; Position=1 -50,714-843
MFFLMSFGINGIGLYYCAWLNNVITPVNSSILAPIINMAKTEKAKRKWRFLKNENNLED

SEQ ID NO: 127767 - protein, 145 aa, Heterodera glycines
  Coding regions on vcDNA: vcDNA=SeqID_54190; Strand=-; Position=1-438
  Homolog annotation: Hit_ID=EAL35936.1; Match level="QueryCoverage =91%, HitCoverage=61%, E-value=6e-24, Identity=40%"; Hit description =myosin heavy chain [Cryptosporidium hominis]
MGEVRFLRPKYYAAALKQREEAEAAAKKAKEEAEAEAKKAEAEAKEAEKKEAEAEAVEKKEEEGEVDKEEVEAKKEAEEDKKEAEEVKKEEAAEVKKEAEEDKKEAEEVKKEEAAEVKKEAEEDKKEVEQDKKEAEKDEAVKSEL

SEQ ID NO: 127768 - protein, 95 aa, Heterodera glycines; identical to SEQ ID NO: 124528
  Coding regions on vcDNA: vcDNA=SeqID_54191; Strand=+; Position=1-659

SEQ ID NO: 127769 - protein, 89 aa, Heterodera glycines
  Coding regions on vcDNA: vcDNA=SeqID_54192; Strand=-; Position=1-268
MHVDFDPLQVDWSTFSSEYVQFGGYNIYRGLPYQRGAGVGAVFRSLMRYLLPIGKQIGSAIGRQGMESGNQVLTNVLEGKDLKESLVSE

SEQ ID NO: 127770 - protein, 286 aa, Heterodera glycines
  Coding regions on vcDNA: vcDNA=SeqID_54193; Strand=-; Position=1-861
MLLINKARRWAREEYIKRKTKEKRGVRDEELLLQAMLTDTGTLVDLNNVAQGLLAREKSAATSNVPLRMSADDTNSYQEKLDEYFSKLSDKNLNILDELGMTKLNAEIKNLTEEERVILEATKEMGTEAWIQAYREIRLVCQFNYDVNRNRFVLNTDPRYVKKVQVSPQLAYILGFNNTEFIQSENEAKFMPDMSGGVSSFHVYTPDLIEPMMIGDVTAPVLRIVTIRGNPDQVVEEQFFAIQYHKLLLKEFSEILIEIRTNSGILMPFQYGTCTLTLHFRKMSYF

SEQ ID NO: 127771 - protein, 78 aa, Heterodera glycines
  Coding regions on vcDNA: vcDNA=SeqID_54194; Strand=-; Position=1 -191,243-288
MLLTTPISLSSSDDDCLLMFVRCPIARDKSKWTKWEKEAIGWHICDQRNIIDSAIYGEDEIGDGLLDATPGPSDQQQK

SEQ ID NO: 127772 - protein, 61 aa, Heterodera glycines
  Coding regions on vcDNA: vcDNA=SeqID_54195; Strand=+; Position=1 -161,532-556
MIKLIGQNEAKSWRRKVMTLRYRFQCPFASLEVFVDVKVKSVADQRNSEAKLRSDNIIRQS

SEQ ID NO: 127773 - protein, 137 aa, Heterodera glycines
  Coding regions on vcDNA: vcDNA=SeqID_54196; Strand=-; Position=1 -171,220-462
MAETNPKWKEAKEREAAAETMRRIYASQQRDHSPYITDRAKFEVFDKLEFRGPWDADILRELHKLAYKGSEFENDVWVGKFRGEYGALEPEGMNFSGVKRDKVKDGVEELVKWMNLCDATNMPTQGFAAQAFLTFFS

SEQ ID NO: 127774 - protein, 132 aa, Heterodera glycines
  Coding regions on vcDNA: vcDNA=SeqID_54197; Strand=+; Position=1 -126,599-683,929-1116
  Homolog annotation: Hit_ID=NP_501220.1; Match level="QueryCoverage =84%, HitCoverage=12%, E-value=1e-13, Identity=33%"; Hit description =aminopeptidase (100.0 kD) (4I310) [Caenorhabditis elegans] gb|AAB03152.1| Puromycin-sensitive aminopeptid
MANGSDKFSKLPQLASPSLYQICLSVDVDTCKFKGNEIIHLEITKPTNFLTLHAGALEVEKASLKLEDGTVLSDLKRELDTKWTLLTLQWPKEVKPQKAELEFAYSGQLATNMQGFYKWATGKNNLKKQRGK

SEQ ID NO: 127775 - protein, 39 aa, Heterodera glycines
  Coding regions on vcDNA: vcDNA=SeqID_54198; Strand=+; Position=1 -59,89-149
MLPLFWQEINTNGKVFRELEYVFLMADLKKNKRDTEPEK

SEQ ID NO: 127776 - protein, 127 aa, Heterodera glycines
  Coding regions on vcDNA: vcDNA=SeqID_54199; Strand=+; Position=1 -86,581-752,824-902,1233-1272
  Homolog annotation: Hit_ID=CAE62158.1; Match level="QueryCoverage =99%, HitCoverage=62%, E-value=9e-33, Identity=39%"; Hit description =Hypothetical protein CBG06205 [Caenorhabditis briggsae]
GTAETRGLISVVDRPDPPEGPITYPATTKHSITLSWRPPKDDGGAELSAYHIEFKGLDERDWERVPDHVTLPNYTVRNLEKGAQYQFRFRVFAENMVGISEPLNGEPVTAKDPFGPPGPPSTPEVTA

SEQ ID NO: 127777 - protein, 45 aa, Heterodera glycines
  Coding regions on vcDNA: vcDNA=SeqID_54200; Strand=-; Position=1 -75,219-281
MIVRAKSSIPQRNTNFKFYKLIENKHSKDILYFLYKLRNVQEVRL

SEQ ID NO: 127778 - protein, 88 aa, Heterodera glycines
  Coding regions on vcDNA: vcDNA=SeqID_54201; Strand=+; Position=1 -165,584-685
ITPFDWFFDWVRLYRNSLNNDTLFLFSKLFFNALVSLGCLCIVIMEMLRSVEEYEVLSIVMVCLYVFELFYRIRDIATYAIEEDDDDI

SEQ ID NO: 127779 - protein, 109 aa, Heterodera glycines
  Coding regions on vcDNA: vcDNA=SeqID_54202; Strand=+; Position=1 -137,199-322,559-626
PSTGLLADAFQDDIYQFFIGGVYSISFGCICCYVTIFLIVRLKKSVTQQTNTRLLRSLVIILSINIGGYLGTLIMSQLIGTIGQVYFTEYRQLFKKELRAVKDHFFKRN

SEQ ID NO: 127780 - protein, 152 aa, Heterodera glycines
  Coding regions on vcDNA: vcDNA=SeqID_54203; Strand=-; Position=1-457
  Homolog annotation: Hit_ID=CAE71161.1; Match level="QueryCoverage =98%, HitCoverage=38%, E-value=4e-41, Identity=51%"; Hit description =Hypothetical protein CBG18017 [Caenorhabditis briggsae]
VYRAKYHRGRMLNRPYEWVFGMIQRGSNKVRFFPVPDRSADTLLPIIAENIEVGSTIVSDGWAAYGGINNMQQQYNHEWINHQIYFVDPANPQIHTQGIEATWRALKQSLKHLHGTTPELLPTYLFQYAFRRYHENKKIFQHILEEMRHNYP

SEQ ID NO: 127781 - protein, 237 aa, Heterodera glycines
  Coding regions on vcDNA: vcDNA=SeqID_54204; Strand=+; Position=1 -276,328-766
  Homolog annotation: Hit_ID=AAL78214.1; Match level="QueryCoverage =60%, HitCoverage=75%, E-value=1e-16, Identity=32%"; Hit description =putative esophageal gland cell protein Hgg-20 [Heterodera glycines]
FICGDCWLLVFDFLAPSQLGLGIALINRRFDRIVDEHFKTRKWKLGKMRICHKIGKNGTKQMQIVNSDGNPLPILQNPLPNKVVGFRGITIAYIDQNVIAFLRHFHRFFAVCSTDLYVITENVRISEFILFDIWPTLRDAIHVINVTSIVFRRLRQLVPSLLNDCPSLRGVSFCGGSLPEFPPDDSANASDGQAVTKWLFSPRPDGLPKFLRYSLNPPVIQWSSTMKQIRAVIMLHI

SEQ ID NO: 127782 - protein, 283 aa, Heterodera glycines
  Coding regions on vcDNA: vcDNA=SeqID_54205; Strand=+; Position=1 -208,309-594,642-825,1024-1195
EDSSSGNIISNRVGGPPPMTAHCGGNCRMLTGEPNLFRQGAHQQQHGYGTYGYGGGGGTVPSIHSACHPICHKSCIHSCPSSRSPSTGSIDQQNNNNNFGSGGFSPSEFHHQQHNQPMPSMDSLKGNNNFNCFPSKCRANCLGACSRIFDAQQRQQQQQIRENFVPSNGIENDIDVEPHYQVEMGGGQTKLSSPDHGNNNNENIMSTGRNVCQCSPSAANVCECQEPCYPICVDTCESNCLQQQMQQSPANQRAQCAQFCHLECQHDCAMEQQQQQRVPARKA

SEQ ID NO: 127783 - protein, 92 aa, Heterodera glycines
  Coding regions on vcDNA: vcDNA=SeqID_54206; Strand=+; Position=1 -78,287-487
MFGRNYGKENKHKAYGNEREAYGNGRNKDKDRICVQRVGEVNSETEFVEKSMGPIRVDKCTGQEENEPTKGGKKPRRDKPRTERQPRRFWKS

SEQ ID NO: 127784 - protein, 79 aa, Heterodera glycines
  Coding regions on vcDNA: vcDNA=SeqID_54207; Strand=+; Position=1 -127,178-287
MVPSPVVVPDVEADAFRTMLGFIYTDDLSGMDGDNLFDVLYAAKKYNIVGLVNACLDFPIPSLPNVFFAFAQARFLEEK

SEQ ID NO: 127785 - protein, 48 aa, Heterodera glycines
  Coding regions on vcDNA: vcDNA=SeqID_54208; Strand=+; Position=1 -43,1563-1666
MAPSPKFFDRFHGIGNKSNIWYVNYEEIGSTFSDYCFILGMIIISDSA

SEQ ID NO: 127786 - protein, 91 aa, Heterodera glycines
  Coding regions on vcDNA: vcDNA=SeqID_54209; Strand=+; Position=1 -21,558-812
MKMIVKKQKQQSADEIAVFAPSLSVPPICISPLHIHRFISAPPLLGLPPSHLPSHPPPLSLHRTSFTPPPPGPTAWTMPLKNDGRKTFHIV

SEQ ID NO: 127787 - protein, 145 aa, Heterodera glycines
  Coding regions on vcDNA: vcDNA=SeqID_54210; Strand=-; Position=1-436
NKEEESKDERKGISQIPVEERRPWDGVGEKRVIINAPIAFVGDDEVEPIGRTFQDNGLRALVLVHSLRDVVWWHRLPEVVTINDVCQMVVVRTTEWAEHIRPFLSLLGRWAKPAVWIGSTIHVEGVAWLEPAQTVELDINRLVFM

SEQ ID NO: 127788 - protein, 409 aa, Heterodera glycines
  Coding regions on vcDNA: vcDNA=SeqID_54211; Strand=+; Position=1-1230
  Homolog annotation: Hit_ID=CAA82797.1; Match level="QueryCoverage =41%, HitCoverage=26%, E-value=2e-16, Identity=32%"; Hit description =gag protein [Ascaris lumbricoides]
MSDIYVERIETAKYAIELYLDKPLPILPQGVLTSQQRHNLICDQREWKEVADEIQTQVDEIKAARALYNQEASTLHGDEKTEFQRQYRASVNANDLQNLLRRANHKLADTRTLKGNIDRLLQDGPGGTARRNIALPKLSLKEFDGSDWDDFWPLFESTIHADADLDYVQKMSYLDSLLRGEAKKVIQGLLPFSRDNYDLSVSLLKDKYGKNENLIRDLHNQLARLSNSKSLGDDMKLQLELERVCRQLEHYNQDLSSPQIYMSLEQKLSKKVLTRYVDLKNVKLSAMPHGSDWSTDLFRDTFKAAIEQLKQINDIVQRANPEQTQHTYKREKHKSEVKESTLNLAVIYKDQEKTDDRQPSVAVKPKPWRGTSTSSEGSSSRSSSKSSRYGRAPGRKAGSPWPNESRRRE

SEQ ID NO: 127789 - protein, 1426 aa, Heterodera glycines
  Coding regions on vcDNA: vcDNA=SeqID_54212; Strand=+; Position=1 -1529,1584-2513,2676-3559,3764-4513,4771-4956
  Homolog annotation: Hit_ID=CAE56152.1; Match level="QueryCoverage =15%, HitCoverage=25%, E-value=2e-14, Identity=26%"; Hit description =Hypothetical protein CBG23765 [Caenorhabditis briggsae]
MCYICLFNNHMARNCPRKLRKCFLCQRTGHHPALCEKRKLMARGQVATTTSKKQENTSTNVFAIQSCMKNPIQPLRPIDLILPNIGKEKLEINTRSVENLDSDHIFENSNTANLVQTYQKAMNMAEKFWQNWKDSYSLGLRERHQGNKHTPGKAPKLGDEVIISEPQTPRNCWKLGKIEEILSQRTARVRISEKSIIERAIKHLYPLELAEKANNSDSGIKQQEHSFVKQIHYNWAKGPPQNKALVKANSPNHYRWAKQPPKIINGITNVTCISEMNKDFDAVSLDCEEMERDLEDENKEEESKDERKGISQIPVEERRPWDGVGEKRVIINAPIAFVGDDEVEPIGRTFQDNGLRALVLVHSLRDVVWWHRLPEVVTINDVCQMVVVRTTEWAEHIRPFLSLLGRWAKPAVWIGSTIHVEGVAWLEPAQTVELDINRLVFMGAPRITQRGGSALYKKRCQQPFSDDRSSGATKSKRFRPVEDQPSHSEWTQEIRPIRPVEDPPSHSRWASNPRLHRQQQFPVKAVYDFWKLESIPPIPPFINDRAPFCRRVRVEERGELLGFFNQQFYFSNFNEAYEFVIHGRTYRCVEQYYCAQKALYLKRFDAADAIMLGTNRYGKRISAFEMKKFANMNGEDEVTVQEWTELKIGIIEEALKAKFSVPDLKDVLLSTGSAIICELSLDQFWGVGCRPGLIYDKWPTADIQQWNGSNTLGRLLMQLRDDLKEATPKGTTRAVQPNYGWPKNREENFQNIPVEEDVFDLKSFKNLEITSTDEAKRGDKPKDSTNANSISELLMSHADEVAETEEKTNEKFALSERMNQQKYPRTEMELRARGNTPVLKIKLEFHVDLTIGRSEKLNGVYNSVWLATLVRINDLFSSVCLLIKEWGTDINQPEFGSFNSLSLVIMVQSYFAEQKLLPSLFRLYPDIYKEDKIVKFYDAEFHQKLAEDAKAKCPQSTSSLIEVLTNFFLWLDDIDFARVKLSAKSGKIDRTEGNGLQSVIIEEPFDAKSNCSRSLTDKEFQNFKGLLRRTNTHLRAKDWYTVKRLFRLNPVNDVAWSMTDESEDDSFDKIAVEQINESMKRFAGIKPDNVRTTHNVRRSQTEDRDFERNFGFPKELTLYRPDQKEYTFWGHQCLLLKHSVQFWTNLLNDPFDIKSQEMMPISAEECQEISKTKKCRFGILVGDSDGTMITENKLIYEHSWWSWGKKSVETVNCIVNNITIIGYPGSQRIDSIVGDLQHCQYDDGRCSLHDSIVVWDVDRYHTSAPWAARHGHCVFKSFSKKNGTIYRIGWISDPPDLALTFGENPTFITSCLRRLVVSQQGFAIEEREFVNFNRQLDRTRRNVNFDEPLDGEVRTSQLDAQLTALKVTLVRKDKPILAYLGPKALIISAEARKVDRQTDRYKHIVLEGRLYEIDQVLGIKTPVKEI

SEQ ID NO: 127790 - protein, 21 aa, Heterodera glycines
  Coding regions on vcDNA: vcDNA=SeqID_54213; Strand=-; Position=1 -54,576-587
MRTRPIWQVKQRLLTSQKKGF

SEQ ID NO: 127791 - protein, 42 aa, Heterodera glycines
  Coding regions on vcDNA: vcDNA=SeqID_54214; Strand=+; Position=1 -36,107-199
MAAPKWAVPVFWFSFLTFILNTKHNEYKHIELIIRRQLFRPM

SEQ ID NO: 127792 - protein, 485 aa, Heterodera glycines
  misc_feature (272)..(272): Xaa can be any naturally occurring amino acid
  Coding regions on vcDNA: vcDNA=SeqID_54215; Strand=-; Position=1-1471
  Homolog annotation: Hit_ID=NP_494149.1; Match level="QueryCoverage =100%, HitCoverage=33%, E-value=2e-88, Identity=38%"; Hit description= predicted CDS, putative protein of ancient origin (2C297) [Caenorhabditis elegans] gb|AAF39854.1| Hypoth
NIRRYNSMFACASISCFRFKFQSPGPPCYKIQGQIYHKFNQNAMPKDNEIPTNGQLYFIDSEEAIDIRSENYKCRSEIIEFLETFLRKINPFAQSFLMMKEVYKKEENNCKENGKNSKNYDKRRYSIPRCNEVGAIVVCDANDEIPPARIVVYPKGEKQLKNIYPLDKCVDQMCYPLLYPIRSEGFNVNIKNLTGKKISLCDYQILLFFRENVNFFPHFYAKNFQQWLVDQAAKIEWDRLEYIRTHQMELCSSNCLNVEDLLKNRASKTGAXIKKVILPSTFTGGPRSVHNFMDALAIVNETGKPDLFITFTCNSNDYDILKCLLPNQTPSDRPDLVSRVFHLKKNHFLDLIFNKQIFGEVIGDCWVIEYQKRGLPHLLLITLHPKNKWHTINDIDNFISAEIPDEKKDPEHYKIITNCMMHGPCNEKSPCWNEKKRKCNKKFPKPFTENTKITEDGYPLYKRPDNGRCVYKKGKMLTNQFVVPY

SEQ ID NO: 127793 - protein, 128 aa, Heterodera glycines
  Coding regions on vcDNA: vcDNA=SeqID_54216; Strand=-; Position=1 -279,1170-1277
QLGQSFNYTSFALCFRSPEHIVLVSHRDVIVHVNELLGGTWAVVDTATVNKYVQYENGNVQQKEDDDILSKLVIEHTGVHVRYKYQVNPHQPGKANNYIGEAKRLLATVEPFLSPIHRRQMVISKLIM

SEQ ID NO: 127794 - protein, 57 aa, Heterodera glycines
  Coding regions on vcDNA: vcDNA=SeqID_54217; Strand=-; Position=1 -122,857-908
MSIFKNGFVSKIWRGQSCYHSHLVAVPLMGDGQTDRHGDCRLIEHPKGSRMISRKLD

SEQ ID NO: 127795 - protein, 34 aa, Heterodera glycines
  Coding regions on vcDNA: vcDNA=SeqID_54218; Strand=+; Position=1-107
KVVEKLVKHVTLLNALHDRGVDNNQENTSDYPNF

SEQ ID NO: 127796 - protein, 367 aa, Heterodera glycines
  Coding regions on vcDNA: vcDNA=SeqID_54219; Strand=+; Position=1 -90,460-625,962-1069,1969-2708
  Homolog annotation: Hit_ID=NP_346206.1; Match level="QueryCoverage =90%, HitCoverage=92%, E-value=1e-20, Identity=29%"; Hit description =cell wall surface anchor family protein [Streptococcus pneumoniae TIGR4] gb|AAK75846.1| cell wall surface
MSSSSSVLQDLLRDHSSEIGNWSEIVNNHQDESSKPEPFTNIDHNGPFYIFVPNLTLDYAVDSVNMEVYKMFGGHKNVCNLDSENAFRCLRLSVGEESVAIIHADGTGLRKLCSSVEDGGEEKPKKSPFGDAKPINTTKKLLSVEEKLREESIAAAAAAAAAVAAAAASAAAASASGTSSATTMSFVATATPAAAASGTSVPVAASDSGTSSTTNASLVPAATPAAAAPAASGTSVAAQPARGGGAISASRSSTASAPAVAAAARSAMSSVSRSSSSATASVAAAATSATSFSSGTPSVGAATVAAPAVAPVYTAHSNNHNNNINSSTNTIGHGHGAVASAAAAKKPKGNNKKKKKSFSKNVIIKII

SEQ ID NO: 127797 - protein, 37 aa, Heterodera glycines
  Coding regions on vcDNA: vcDNA=SeqID_54220; Strand=-; Position=1 -82,1178-1209
MTTETHTPRKKKPTALPTALFQSPSLTRNQDRALVEV

SEQ ID NO: 127798 - protein, 146 aa, Heterodera glycines
  Coding regions on vcDNA: vcDNA=SeqID_54221; Strand=+; Position=1-441
MATGVATNQQGMLPFPSRNLRSVSIPVRTARDRIERASGTLAARIAEAREVIDQDLTEGEAGYQAARLLAMERGLKEATQIFQGHFEIGMAAAGAEPAGHQDFFYDILTTPLPAATKQLQLRTHPTPAELLQIADEHIGDLTGTRG

SEQ ID NO: 127799 - protein, 45 aa, Heterodera glycines
  Coding regions on vcDNA: vcDNA=SeqID_54222; Strand=+; Position=1 -29,255-363
MNRAALIFLRLVKQLRENVLKSIDFEEMAGDVNKRRLIQKSVFIE

SEQ ID NO: 127800 - protein, 21 aa, Heterodera glycines
  Coding regions on vcDNA: vcDNA=SeqID_54223; Strand=-; Position=1-64
MNSQTSCGVRALVRRSGTQSA

SEQ ID NO: 127801 - protein, 126 aa, Heterodera glycines
  Coding regions on vcDNA: vcDNA=SeqID_54224; Strand=-; Position=1 -290,1399-1487
MSIEGDDVRGWEGQTMFYMDGTYTLPQFKTKLATLLGGRAAEIMFTGTSVGHVQDEQEWLRLADHVNTIKTHSNLSPGSELGKPMVRCGPGTSRFYGILGPPTVVSLDGHQQRGRASVSLRSQVLN

SEQ ID NO: 127802 - protein, 24 aa, Heterodera glycines
  Coding regions on vcDNA: vcDNA=SeqID_54225; Strand=+; Position=1-73
IRLALMPVLSMPRFSNTFLSSLTF

SEQ ID NO: 127803 - protein, 434 aa, Heterodera glycines
  Coding regions on vcDNA: vcDNA=SeqID_54226; Strand=+; Position=1 -129,351-780,824-1167,1499-1612,2012-2298
  Homolog annotation: Hit_ID=NP_733041.2; Match level="QueryCoverage =50%, HitCoverage=29%, E-value=3e-15, Identity=27%"; Hit description =CG6995-PB, isoform B [Drosophila melanogaster] gb|AAN14018.2| CG6995- PB, isoform B [Drosophila melanogast
MDKQNATDGDQQQQNVAPVDGQQANDETTTTVADVGQQQKQPMETITNHGDGGDGIDHRNAHDETTVQPVTDPITTGQTGDGGSDKNNGHGNGGDHQMDHDEPDIIIETPKKAIKTECVEDVVLIGHTASASAVGSAGRGAGNGHKAAERSDESDCNCRNNTVFGKLCCAINSSFQHRSATESAFSATATKVLSVATTNANTAVTNAPPLLTSSSAGSTGDDVILLNSDQQQQRQGKIGKEKDAVAAQPSDDSAGGKKQSAATPTGTTSGTSTAQLVDGNNLSSSLWIRNITTTTKAADLKALFSKHGKVITAKIFTTKNKQSPTCFGYVTLADAETANADRSNLSQIGTQQQQQQQPAAASDGSGAKTGTAKSGGSSKAAGGSSDGGKGSGAEPSASSSSSKKVRPRITAATASPTQRQHRNNNTNSAKTARR

SEQ ID NO: 127804 - protein, 144 aa, Heterodera glycines
  Coding regions on vcDNA: vcDNA=SeqID_54227; Strand=+; Position=1 -138,191-247,314-355,1645-1738,2583-2686
MLSPFSYDPFYRRSLWPMATHVGNVLSPFRQLERELDHFFEGMQPMLRDHVAQLNVSDKGDLTYKVDVSGFRPEEINVEVDVSGFRPEEINVEVIGNEIIVNGEHREQNDTKTNFILNAQRNGGSGGHCRGGRRLDTLHVVEAL

SEQ ID NO: 127805 - protein, 52 aa, Heterodera glycines
  Coding regions on vcDNA: vcDNA=SeqID_54228; Strand=-; Position=1-158
SVKHRGIYFGLHSFKGIYFGLQSFNNMQSVQSSATAAVTAASTVPLSIQNEV

SEQ ID NO: 127806 - protein, 36 aa, Heterodera glycines
  Coding regions on vcDNA: vcDNA=SeqID_54229; Strand=-; Position=1 -46,94-158
MHQFPTLSVLSVFPFASQCHSVLLSDLRNLLQLFSA

SEQ ID NO: 127807 - protein, 64 aa, Heterodera glycines
  Coding regions on vcDNA: vcDNA=SeqID_54230; Strand=+; Position=1 -15,418-597
MTFQKLIRGTKIVGRCVGRGTTVIRRGATVIRRGATVIRRGATVIRRGTTVIRRGTTVIEEVQQ

SEQ ID NO: 127808 - protein, 28 aa, Heterodera glycines
  Coding regions on vcDNA: vcDNA=SeqID_54231; Strand=-; Position=1 -12,95-169
MNFIDENTTIIEKPMSKNGKSVSPARTT

SEQ ID NO: 127809 - protein, 78 aa, Heterodera glycines
  Coding regions on vcDNA: vcDNA=SeqID_54232; Strand=-; Position=1-235
KQAQPLAECFGSAFVSVILILSFFLKFSQLKGSLLCVTPFLVLALGVDDAYLMLNAWQRLRIRRALAFLAQFTQILVH

SEQ ID NO: 127810 - protein, 153 aa, Heterodera glycines
  Coding regions on vcDNA: vcDNA=SeqID_54233; Strand=+; Position=1 -64,158-243,585-667,1014-1055,1102-1199,1849-1889
  Homolog annotation: Hit_ID=CAE62788.1; Match level="QueryCoverage =94%, HitCoverage=13%, E-value=9e-41, Identity=55%"; Hit description =Hypothetical protein CBG06961 [Caenorhabditis briggsae]
SEKSDVVNALVLSETFLTDEVVRAGLTLLPFLLIGFSIMVVFSSCTMSISAFYVRQMGAQKILLAVVACSCPFMACGTALGGMFWLGFRFGSLLCVTPFLVLALGVDDSLLCVTPFLVLALGVDDAYLMLNAWQRLRIRRKIFGILPAVHIRH

SEQ ID NO: 127811 - protein, 166 aa, Heterodera glycines
  Coding regions on vcDNA: vcDNA=SeqID_54234; Strand=-; Position=1-501
MPKQHQQQQQQDQQHQTDVIEHDHCYARPTNQLWKLKRQKYMLTFKLCKMCAQELYNRKDDITECNDGGVDLNFHLCKHCTMLNMRLSDMNSVQFMAYHPRNNNYNNTNNRNKNRNNKNNDNDENDSQNNFWYDNYGPTYCRGGPRNNYMQGKRKCLERIDMDDMN

SEQ ID NO: 127812 - protein, 156 aa, Heterodera glycines
  Coding regions on vcDNA: vcDNA=SeqID_54235; Strand=-; Position=1 -92,138-249,459-725
  Homolog annotation: Hit_ID=NP_498715.1; Match level="QueryCoverage =92%, HitCoverage=67%, E-value=6e-46, Identity=59%"; Hit description =isomerase (23.3 kD) (3I983) [Caenorhabditis elegans] gb|AAA28230.1| Hypothetical protein ZK688.3 [Caenorh
MSAMIKLKKFHEFTQKIICIGRNYRDHALELSNPVPKEPLIFAKTSNALLLSGGEIKMPSGCSELHYEVELGVVIGSPGSRIKKESAFDYIGGYCIALDMTDRGMQDRLKKAGHPWFLAKSFDTSCPIGEFINKSVIQNPHDIEIYCLGIMNPIIF

SEQ ID NO: 127813 - protein, 176 aa, Heterodera glycines
  Coding regions on vcDNA: vcDNA=SeqID_54236; Strand=-; Position=1-531
MKIRILFIPIIFLIIKIHQIKTENKKLPQKSFDEIFGEKWEEKEEKQRNEENKREIISKYYKIKEKIKEKGIKYSKKEWDKINTKIAKSLGTNDNYIKKWIKEFGLQRNKCHKSKSDEQKLEIVQKFIEMSNEYKQNRKYSRREWQQNYEEIGKKIGVDRETIQNGRNNLALAVNE

SEQ ID NO: 127814 - protein, 39 aa, Heterodera glycines
  Coding regions on vcDNA: vcDNA=SeqID_54237; Strand=-; Position=1-151
SMSNYGKNYSDSLQKLTITIFFEFLNKFRIRQKYPQKKI

SEQ ID NO: 127815 - protein, 55 aa, Heterodera glycines
  Coding regions on vcDNA: vcDNA=SeqID_54238; Strand=-; Position=1-167
RDVPRFRISPFALFAFFGVSHFAFRFLARNATFTPLRIGLNSHKIFQNFTYKLAN

SEQ ID NO: 127816 - protein, 36 aa, Heterodera glycines
  Coding regions on vcDNA: vcDNA=SeqID_54239; Strand=+; Position=1-111
VLPSDPENPPSSDKIPGLSVGAHEFTCHVIPYFDIQ

SEQ ID NO: 127817 - protein, 50 aa, Heterodera glycines
  Coding regions on vcDNA: vcDNA=SeqID_54240; Strand=+; Position=1 -67,589-674
MALEAMDLDLSTDGNDSEPSLADCGGPQQMKNAVPHLMIAYRALTRLILT

SEQ ID NO: 127818 - protein, 69 aa, Heterodera glycines
  Coding regions on vcDNA: vcDNA=SeqID_54241; Strand=-; Position=1 -139,186-255
  Homolog annotation: Hit_ID=AAH18281.1; Match level="QueryCoverage =75%, HitCoverage=4%, E-value=6e-15, Identity=66%"; Hit description =6030411K04Rik protein [Mus musculus]
ILFERLVALRPHPWGLLITFIELIRNQRYGFWKHEFVYCATEIERSFVPQCCKFLQCKRTGKPSLERNL

SEQ ID NO: 127819 - protein, 150 aa, Heterodera glycines
  Coding regions on vcDNA: vcDNA=SeqID_54242; Strand=-; Position=1-450
  Homolog annotation: Hit_ID=NP_498516.1; Match level="QueryCoverage =31%, HitCoverage=1%, E-value=5e-13, Identity=65%"; Hit description =NOT-like, component of CCR4/NOT complex (ntl-1) [Caenorhabditis elegans] gb|AAA21168.1| Not-like (yeast cc
TSAVSAAASPCARLCLPLAGHHWPSQFHRPSALGEPGFGAYKCHVHPTAALSSQVFGPLFAQCSTAKAHCLHLQGHSACAVGAFARLSRFYPVSPPFIIRLSIFKEILCEYYYILCDVIPANCVQLRNLVLSAYPCDMRLPDPFTETMAR

SEQ ID NO: 127820 - protein, 79 aa, Heterodera glycines
  Coding regions on vcDNA: vcDNA=SeqID_54243; Strand=+; Position=1-238
MITSFYRFSVHGKGINVTNPNSQLGEFSYNPEMDSTFQNWLDRYGPFIQVDGKDLPDQMQVRLLLGKLGSEEYNRYAQK

SEQ ID NO: 127821 - protein, 192 aa, Heterodera glycines
  Coding regions on vcDNA: vcDNA=SeqID_54244; Strand=+; Position=1-580
KRLKHRSDNFLGSILFKRGIDQFSSSPLSDKSDRFSYSSPSNLSDHRSEEAKSNASENDSSILSEQTENEITPAADFDYGQPSNSSEHFSYSDEEMSYGRATTGAHDKRTQPNTVELSRTPSDKVVRKFGKVSKLSNLGEKLHLWHLEKTLDMRLWKLKMKDASIVRHFSGKKHDQAFPSDSSTGSSISDQK

SEQ ID NO: 127822 - protein, 180 aa, Heterodera glycines
  Coding regions on vcDNA: vcDNA=SeqID_54245; Strand=-; Position=1-541
MVLVSEFCAQFLSCPTKSLRDRLNHPEDRVRVLQQLIGKKVQTTYKDRNGMRKSFLVGGMTERGAAFEPAYGRLRKPFNINVAAHFYARHRVKLHYPYVPCIIEGFTRGEDRYYPMELLEIVDDKKGGRLFGRLFTEIEEQEEEDTKSEASHSSNSSYLQFNGKGCKWYESIDEITNTGR

SEQ ID NO: 127823 - protein, 109 aa, Heterodera glycines
  Coding regions on vcDNA: vcDNA=SeqID_54246; Strand=-; Position=1-327
MTKHSAIVSSCETPPSSGAQTPTAATDPQNQAVPETVAAEEQTQQQQQPKRKSSLNSMVASALADAPATLASLFNVPSSSSIELAAQNSEQQQRQQQQNNERKSGEQAP

SEQ ID NO: 127824 - protein, 23 aa, Heterodera glycines
  Coding regions on vcDNA: vcDNA=SeqID_54247; Strand=+; Position=1 -39,628-660
MSAMFKQNKSMERDNKIHLNPPE

SEQ ID NO: 127825 - protein, 221 aa, Heterodera glycines
  Coding regions on vcDNA: vcDNA=SeqID_54248; Strand=-; Position=1 -190,233-374,745-879,926-1123
  Homolog annotation: Hit_ID=CAG01051.1; Match level="QueryCoverage =98%, HitCoverage=74%, E-value=7e-39, Identity=37%"; Hit description =unnamed protein product [Tetraodon nigroviridis]
GNGEMEAMFRVLAKLYPRTYFIGIGFSMGANVLTNCLASGLDPSISSRILLGISVCQGYCASDASSLLFDWQGGRRLYNYIITESVKRLLRRNYAMVVLPHVKSGLVDERKIWSSTSLLWLDEFYSRRVHNFASVSDYYSHISCLPRIKDIKIPMIFINTLDDPLVPEALWEPVRQLCETHPLHAFVLLKHGGHLGFLEGNSLRPRSITWLDRFILQVAAA

SEQ ID NO: 127826 - protein, 57 aa, Heterodera glycines
  Coding regions on vcDNA: vcDNA=SeqID_54249; Strand=-; Position=1 -138,191-363
QRGIFLVSLAPRTANPNNSLRICGSFGPISAHGGYGSFCLDCQALCDKFYSMLLNET

SEQ ID NO: 127827 - protein, 399 aa, Heterodera glycines
  Coding regions on vcDNA: vcDNA=SeqID_54250; Strand=+; Position=1 -3,173-264,485-590,986-1258,1378-1641,1930-2124,2263-2529
  Homolog annotation: Hit_ID=NP_705464.1; Match level="QueryCoverage =96%, HitCoverage=48%, E-value=8e-13, Identity=22%"; Hit description =hypothetical protein [Plasmodium falciparum 3D7] emb|CAD52701.1| hypothetical protein [Plasmodium falcipa
MPNTPEKVGQKQSETQSKKEPKNAKPTEKSTQLQMLISNEKLLTVMMKYVEMKLKDMSKQYKEFHERVKQWKDDVQFIKAAFGEDKQMYKKYMEMAVTWPEKKSKGTPEKVPKSLKQTHLDNLAQMANKFEEFRQVVKQWPDSGCFMTFPLEKNVFNKVFLFDHALTLKEDDLQKELATGLYTHAEFRKESPADFFNNPDWSQKKLEDAEKDDDEDEDDDKEEEEEEEDDDDEEGDVRMATNALLEALLKGRDGFGKEATLNLRNLPKWDGKPNQSKSMWQMAKKIVRNLIKFVKWPLRIFWEYSNKLTRKVRNAMKSKEEKEKMRKKLEEVKKDGMLYKIYQMLDNSKNKAENFDEKAKKNMEKEGMKPDEPTIDHSAHEQLTDKDKQQHPFTFLQGE

SEQ ID NO: 127828 - protein, 136 aa, Heterodera glycines
  Coding regions on vcDNA: vcDNA=SeqID_54251; Strand=-; Position=1 -147,194-250,295-409
  Homolog annotation: Hit_ID=NP_504166.2; Match level="QueryCoverage =86%, HitCoverage=24%, E-value=2e-24, Identity=48%"; Hit description =RNA polymerase (41.2 kD) (5E681) [Caenorhabditis elegans] gb|AAL38961.1| Hypothetical protein H43I07.2 [C
DGAWDVSKYCDDISLRMVSQSEDALDLEFDLVNVEAPIANALRRVLISEVPSMAIEKVFLYQNTSCIQEVPSMAIEKVFLYQNTSCIQDEVLCHRLGLDEVLCHRLGLIPIYADARQFTFPPPPNSSATQQINTDI

SEQ ID NO: 127829 - protein, 74 aa, Heterodera glycines
  Coding regions on vcDNA: vcDNA=SeqID_54252; Strand=+; Position=1-320
QILKSIKSFSIPFTRPFSSLPKCTFRPIHKTIRCPIGLCFVPGFSPFISNCADLSKISPAPRKHSIISFRLTKR

SEQ ID NO: 127830 - protein, 277 aa, Heterodera glycines
  Coding regions on vcDNA: vcDNA=SeqID_54253; Strand=-; Position=1 -36,82-237,303-395,450-598,866-994,1202-1294,1344-1416
  Homolog annotation: Hit_ID=CAE72287.1; Match level="QueryCoverage =98%, HitCoverage=84%, E-value=7e-57, Identity=42%"; Hit description =Hypothetical protein CBG19415 [Caenorhabditis briggsae]
FHEHFDTDAYLKDFYARVDDAAMQMDFYARVDDAAMQMVLFHLPNIVARLGSLPSLLDFGSGPTIHVAVCFRHTAEEIYLADYLPQNRDELCQWLSGQSKFDWSTVMRIIAAREAVPLSIIAAREAVPLSEIRQMEQKAREKVREKSFCKTVQRVSINCPNLFFCPSSAITTFFTLKYCCLSSYEYAWQSFECPFAPDGVLIMGGVLEETWCAFGGRQFKCLFVSRKLMMECLRGAGLILEDQLDNELFYELDDQLDNELFYELDGMYILVARKMAE

SEQ ID NO: 127831 - protein, 136 aa, Heterodera glycines
  Coding regions on vcDNA: vcDNA=SeqID_54254; Strand=+; Position=1 -183,417-644
MPEGGYERAENQSKIAVKYFEWLAQRKGVKVRHACNGGEVEFGGLKVDCAIGAEKKIIEFQECDVKEELKKNKEMKKFFESVPDKGPINPRDAYAGGRTMPFCLYAKATEEMEISMFDIISLYPFVNYGKNLHNFC

SEQ ID NO: 127832 - protein, 79 aa, Heterodera glycines
  Coding regions on vcDNA: vcDNA=SeqID_54255; Strand=-; Position=1 -184,708-763
MSHSFSSTERDQMAQQTTGEEMNKMKQQMKESYEELKRWDEAERVTDNIIPEDRVMTNGTRRAHERRKSLREDKDGRRK

SEQ ID NO: 127833 - protein, 122 aa, Heterodera glycines
  Coding regions on vcDNA: vcDNA=SeqID_54256; Strand=+; Position=1 -167,593-638,804-959
  Homolog annotation: Hit_ID=NP_741091.1; Match level="QueryCoverage =42%, HitCoverage=7%, E-value=1e-13, Identity=73%"; Hit description =protein Phosphatase with EF hands, homologous to Drosophila retinal degeneration C (80.3 kD) (pef-1) [Caen
MKEFMEACQVLGQYANIDLNERSIQNIAESIDFNKDGFIDLNELLEAFRLVDIGKFPLPSAFISFFHPYLLTGSLRLQIRSSDYDPKGKIDSGIGPMSHYRISGLDLYACEYLWPALCECCK

SEQ ID NO: 127834 - protein, 177 aa, Heterodera glycines
  Coding regions on vcDNA: vcDNA=SeqID_54257; Strand=+; Position=1-535
  Homolog annotation: Hit_ID=NP_702063.1; Match level="QueryCoverage =90%, HitCoverage=5%, E-value=7e-16, Identity=19%"; Hit description =hypothetical protein PF14_0175 [Plasmodium falciparum 3D7] gb|AAN36787.1| hypothetical protein [Plasmodium
LNPTAFQSLALNPPAFQSLGLNPTAFQSLGLNSPAFQSLALNPPAFQSLGLNPPTFQSLALNSPAFQSLALNSPAFQSLALNSPAFQSLALNPPAFQSLALNSPAFQSLGLNPPAFQSLALNSPAFQSLGLNPPAFQSLALNSPAFQSLALNPPALKPTAARPLSGLALFFWHFLMA

SEQ ID NO: 127835 - protein, 251 aa, Heterodera glycines
  Coding regions on vcDNA: vcDNA=SeqID_54258; Strand=+; Position=1 -62,1021-1724
  Homolog annotation: Hit_ID=NP_510671.1; Match level="QueryCoverage =100%, HitCoverage=26%, E-value=4e-50, Identity=42%"; Hit description= predicted CDS, endonuclease/exonuclease/phosphatase family and RNA -directed DNA polymerase (XR69) [Caeno
LSLRFPIKSSVPRICETIRNIKNKKISEFQFGFVRNRSTTSQLNSCGRLEAIINGKNVDCIYIDFQKAFDSVPHELLLYKLEKIGIRGKLLMWIKDFLSNRTFRVKIGDDLSSSKVTSGVPQGSVLGPLLFLIYINDLPDALPSGVRIKLYADDVKLYICYKARVDTEIMHKALHNLSEWANKWQIRISIKKTFVLYLGNKNPKEIYKIDGNIINVVDTIRDLGINIDNKLQFSNHVALIRKNAYLRMRSL

SEQ ID NO: 127836 - protein, 57 aa, Heterodera glycines
  Coding regions on vcDNA: vcDNA=SeqID_54259; Strand=-; Position=1-173
MASPTENLEDESWVEYHYSESEVEELDEFSLLHSQMVPNRVVPCCVNCAEIMVRSDH

SEQ ID NO: 127837 - protein, 335 aa, Heterodera glycines
  Coding regions on vcDNA: vcDNA=SeqID_54260; Strand=-; Position=1-1008
  Homolog annotation: Hit_ID=CAB53471.1; Match level="QueryCoverage =55%, HitCoverage=43%, E-value=2e-42, Identity=47%"; Hit description =polymerase polyprotein [Lampetra fluviatilis]
MNVVEFSPMETHANSAHIIYRVTLLPQSSTLVELSMTNGQEDKEVTVIGRNDLDEQLRIEPTLTSSKNGQIAVPITNFSSIPITLEANESVALVEHVDEWHELEHSFFPPFFVSSVTHENENIRTEQIKEILRTRIGMSQQHEADKLERLIIGFEQIFALDDSELTQTEITQHFINTGDASPIRGRMRPLPFAHREKVSMMLQDYLSRGLIRPSKSPWASPIVLVPKRDGSLRFCVDYRGINSVTVKDAYPLPNIDYILLALGGKKYFSTLDFLSGYWQIKMDEKSIEKTAFVTEFGLHEFTVLPFGLCNAVATYQRIMSRLFEDLINDFCLRLS

SEQ ID NO: 127838 - protein, 43 aa, Heterodera glycines
  Coding regions on vcDNA: vcDNA=SeqID_54261; Strand=-; Position=1-439
MFGFFLAYQNFIEPGSFYSLSNRPKFFLQLNKALLSLFPENLA

SEQ ID NO: 127839 - protein, 155 aa, Heterodera glycines
  Coding regions on vcDNA: vcDNA=SeqID_54262; Strand=+; Position=1 -3,1198-1471,1569-1756
MKKRGNILNFEEEEFDEIISNGTSKRDNSPYTDHDYAGTRQLATAKGATGKHQRQKGGGGTAKEPKKKTALVSGTDSGVRSSARPHRPTKRFVEETNESFIRGTSKVRRTSPRKHGKKSTAEGGSEGEESEDDGKEYSVEKVLKKRVKGGKMEYF

SEQ ID NO: 127840 - protein, 165 aa, Heterodera glycines
  Coding regions on vcDNA: vcDNA=SeqID_54263; Strand=-; Position=1 -47,263-675,1381-1417
  Homolog annotation: Hit_ID=CAE57341.1; Match level="QueryCoverage =97%, HitCoverage=26%, E-value=8e-52, Identity=58%"; Hit description =Hypothetical protein CBG00277 [Caenorhabditis briggsae]
GGMGRIVEIDESKFFRAKYNRGRMLQRQYDWVFGMLERGTNKVRFFPVAERDAATLLPLIAQNIEPGTLIVSDGWAAYGGIQNMQQQYDHHWVNHRVFFVDPQDRQVHTQGIEATWGALKTSLRHLRGSNEEMLPTYLYQYMFRRYHANDKIFTHLTAELSAMPE

SEQ ID NO: 127841 - protein, 306 aa, Heterodera glycines
  Coding regions on vcDNA: vcDNA=SeqID_54264; Strand=+; Position=1-921
  Homolog annotation: Hit_ID=AAL87694.1; Match level="QueryCoverage =94%, HitCoverage=22%, E-value=2e-11, Identity=26%"; Hit description =non-transporter ABC protein AbcF4 [Dictyostelium discoideum]
MARNRSFEVGSEGEEPEDDPLEDSAEKEAKKRAKGGKREHPASGATRKGAKNRTPQKPNKNRHHDRPQGPPKAKGAGHDDGRNTREPRESPKHPEGPKQHEKAQQKAAEKNKPEAEETEEDEEEEDEDNEHKAEKAPDRREKGGRGEHRASRTQGNGGKAPPANQNKGKGYDDSWNSWEPSKSGKHFEVVKQYEKEWKQQHQQEKQQPVSAKRSLRLSVGHKLQSDENCTKAVWCIKRTEQTPTSKGTTPSSSVSVSTKRIRVVVRKEQDDGPAHVEQTEMDAVSVETKELAPKTPSKKKKKRSRY

SEQ ID NO: 127842 - protein, 118 aa, Heterodera glycines
  Coding regions on vcDNA: vcDNA=SeqID_54265; Strand=+; Position=1 -108,738-986
MTFDFEKRGDNADDEDSSADECSSSTGSGTPNSEYSEAVATHPMSNNNNQSDYVQKLRPHRSLCLPPTSAAVPSAGRKGPKKKGSAKRTTAAKTPVSIPLLEAKAMLHTSRVRVFILV

SEQ ID NO: 127843 - protein, 157 aa, Heterodera glycines
  Coding regions on vcDNA: vcDNA=SeqID_54266; Strand=-; Position=1 -94,344-523,985-1152,1829-1861
  Homolog annotation: Hit_ID=AAH84762.1; Match level="QueryCoverage =94%, HitCoverage=11%, E-value=4e-39, Identity=46%"; Hit description =Unknown (protein for MGC:81682) [Xenopus laevis]
QKLWQGTRFVLSRLGPDFIPSDTLGKNGQSNLADRWLLSRLSHCVSECDVGFRTYNFRQLTSAIHHFWIHEFCDIYLESVKSIFVVNNANAVTTARHVLHLAVDSALRLLAPIMPFIAEELWQRLPARPSERAESVCVAHYPQPAEYCLRGGTNSIN

SEQ ID NO: 127844 - protein, 173 aa, Heterodera glycines
  Coding regions on vcDNA: vcDNA=SeqID_54267; Strand=+; Position=1 -135,185-329,497-738
  Homolog annotation: Hit_ID=CAB88204.1; Match level="QueryCoverage =100%, HitCoverage=71%, E-value=7e-87, Identity=74%"; Hit description= putative cuticular collagen [Globodera pallida]
MQETQIIVGVASLCSILAILATVVVVPSLYSEINEIATKVHDGVQAFRVDTDSAWTDLMDLQITVTPPSKPRQNPFSSIFRQKRQLPGHCQCAGPPCPVYTPPCQHCPAGPPGQPGSQGPQGRPGAPGQPGQPGRNSGQGPPGPPGPQGGAGQPGRPGGPGQPGQPGAPGVIT

SEQ ID NO: 127845 - protein, 267 aa, Heterodera glycines
  Coding regions on vcDNA: vcDNA=SeqID_54268; Strand=+; Position=1 -470,615-758,1072-1262
  Homolog annotation: Hit_ID=NP_495921.1; Match level="QueryCoverage =98%, HitCoverage=48%, E-value=2e-19, Identity=28%"; Hit description =TAR DNA binding protein like (45.4 kD) (2J289) [Caenorhabditis elegans] emb|CAA90120.1| Hypothetical prot
DQKAKISIPMTSRKREHAEGEQEIEEGKSVLSGESVSDGEEGRNGEETNEKEADERERERDRKEKRPRKEWVVAGVPKNCSDLYVVGIPYDLEDEALKEYFEQFGSVELSEVSEWMSKGREGARKEIHGREPPGEKRKGKDGRKSVVIRQVCSVWKIKRDKSGLSRGFAFVRMAQYDDQVKVLSKPVHVIGGRECHTRISSTDKANPRVFVGNLESDIGKDRLREFFLEHIRRLDKTADIVDLYYPKPFRNFAFLTLTSSFAAKELV

SEQ ID NO: 127846 - protein, 43 aa, Heterodera glycines
  Coding regions on vcDNA: vcDNA=SeqID_54269; Strand=-; Position=1 -101,181-211
MFLQCIIRCSFIKEKIILLNYAIIYFKILLMQIYWESIAIKYV

SEQ ID NO: 127847 - protein, 30 aa, Heterodera glycines
  Coding regions on vcDNA: vcDNA=SeqID_54270; Strand=-; Position=1-90
LQRAAPSHRHGLVRETPATNPQPFGTIYYS

SEQ ID NO: 127848 - protein, 175 aa, Heterodera glycines
  Coding regions on vcDNA: vcDNA=SeqID_54271; Strand=+; Position=1-529
ECPFFTVNYAKFWNHRQKHKRANRFTCKHCSFSSGSVQCYAEHMELHGDTGTTATITSIINQNIGNNSNVATEFGMMPEALVAMPKHATSTVTATTATSSSGIRSSPEAASSGSSSLDGAETLSEKKLSIMPTKIVHEKSDDEEMEMTTTASISQAVAASLVDEAVHFLVFVSDS

SEQ ID NO: 127849 - protein, 198 aa, Heterodera glycines
  Coding regions on vcDNA: vcDNA=SeqID_54272; Strand=+; Position=1 -223,711-781,1245-1416,1947-2074
MEMHRNSECRPFTCALCSFGCFSADSLHAHLALHASATTLEGGGSGTYNNESIQQRMDPPPDTQTSAAGGPITDAPFSAVLNNAAAAAAPSVPTTVSTLIQQRLMTIIKRAAVMENCCFGNGATTIKMDKMPKANGAGNGRTVDKQHYCTRCSFRYPFITAHFYWTVRSQVTVFKHSHVTGNTIALTTVGLAFSSAAH

SEQ ID NO: 127850 - protein, 48 aa, Heterodera glycines
  Coding regions on vcDNA: vcDNA=SeqID_54273; Strand=+; Position=1 -51,1062-1157
MDERLTNSITVPVAHFVDIPLTSLCKNIELVKEQQKRQSVADDDVEKQ

SEQ ID NO: 127851 - protein, 227 aa, Heterodera glycines
  misc_feature (201)..(201): Xaa can be any naturally occurring amino acid
  misc_feature (207)..(207): Xaa can be any naturally occurring amino acid
  misc_feature (212)..(212): Xaa can be any naturally occurring amino acid
  Coding regions on vcDNA: vcDNA=SeqID_54274; Strand=-; Position=1 -219,342-566,625-831
  Homolog annotation: Hit_ID=AAP30755.1; Match level="QueryCoverage =98%, HitCoverage=90%, E-value=2e-78, Identity=71%"; Hit description =putative gland protein 29D09 [Heterodera glycines]
FTDFPCCPGSQQVVSVMSKYIGTFSAAGEESTVCSMAKSTVDGLKSYLSSRGGCPSGGEAQIVDEIDRQLRTFMKMKITYEDECPYNLGFARAMFDLAAAAAGHAGTGTEWHSLKSQFEQESQAIKAISQALNIEVTDVHFGHPSKGNSAHQNVPSPSHVNSAHQNVPSPSHVIANPGQQSSVPWKGRRTVVIRFRLLRKXKKGINXKENSXYRKHFVDYMKNIYLF

SEQ ID NO: 127852 - protein, 153 aa, Heterodera glycines
  Coding regions on vcDNA: vcDNA=SeqID_54275; Strand=+; Position=1 -84,141-218,268-343,527-747
  Homolog annotation: Hit_ID=CAE72829.1; Match level="QueryCoverage =85%, HitCoverage=72%, E-value=6e-40, Identity=63%"; Hit description =Hypothetical protein CBG20111 [Caenorhabditis briggsae]
MNTAISKLFELRPDPYDNSQRKYLRLCLFLNVENASDLADLVKVMDIALIRAELVLEPFILLVAANRALFQAAHNQLSTRSLSAELIYCLSPNRNIRESLATFGIAGTTRALLVAIFDDAKGKKMREAAKHIKGTPVTLEKLRENADEALIRQ

SEQ ID NO: 127853 - protein, 56 aa, Heterodera glycines
  Coding regions on vcDNA: vcDNA=SeqID_54276; Strand=+; Position=1 -11,42-201
MQLSWTDLNHRPKDVFNHYSPPLYQLSYSWHTYPLIIILFIPLILSPQVKNNTRRK

SEQ ID NO: 127854 - protein, 76 aa, Heterodera glycines
  Coding regions on vcDNA: vcDNA=SeqID_54277; Strand=-; Position=1 -12,44-262
  Homolog annotation: Hit_ID=BAD35374.1; Match level="QueryCoverage =96%, HitCoverage=67%, E-value=1e-26, Identity=63%"; Hit description =putative glycine-rich cell wall structural protein [Oryza sativa (japonica cultivar-group)]
MWKKEADNVRRGGEKGVGGGGGGGGGGGGGGGGGGGGGGGGGGGGGGGGGREGGGGGRAGGGGRAGGGEGGAAKGG

SEQ ID NO: 127855 - protein, 172 aa, Heterodera glycines
  Coding regions on vcDNA: vcDNA=SeqID_54278; Strand=-; Position=1-517
MMNEPEWTTAVARFGIDGTGAGGMMPTAMGAPNLRNGCGPQPLPRRLFSPSRKASATYHHQHHHNQLMALAPPASAQLPAAAAATAAICPIGGESSAADTSHYTTSNSSSSGAQSAVDCKRTRGGCGGTAATATTVGCPTVIDRLAPANGASSAGAAAAQQPPAVPPPSVNT

SEQ ID NO: 127856 - protein, 79 aa, Heterodera glycines
  Coding regions on vcDNA: vcDNA=SeqID_54279; Strand=+; Position=1 -53,741-927
MVYTTHYTFVAFNNCVPKPLMNAAITIQIGVQHSYIAIASVVIFVSLMNGPNFLTYKISEQTLDMTCGDLVVDQYRFAK

SEQ ID NO: 127857 - protein, 57 aa, Heterodera glycines
  Coding regions on vcDNA: vcDNA=SeqID_54280; Strand=-; Position=1 -125,462-510
  Homolog annotation: Hit_ID=CAE74426.1; Match level="QueryCoverage =75%, HitCoverage=48%, E-value=2e-13, Identity=72%"; Hit description =Hypothetical protein CBG22159 [Caenorhabditis briggsae]
MYCLQWLMPVLLIPKQIVHPTFLFDQAMFLWFYIIGFVLERSPIGDFFDFINGKPNA

SEQ ID NO: 127858 - protein, 226 aa, Heterodera glycines
  Coding regions on vcDNA: vcDNA=SeqID_54281; Strand=-; Position=1 -150,384-524,964-1176,1641-1760,1809-1865
  Homolog annotation: Hit_ID=AAF05746.1; Match level="QueryCoverage =94%, HitCoverage=68%, E-value=2e-15, Identity=27%"; Hit description =pregnancy-associated glycoprotein-7 [Capra hircus]
MEDPTTPISCQNATKFNSEVSTTYRNTNQPFSIVYGFGFSAGTIGQDVVKLGLASDSSAFTLANIYFGQTVQKDTQQTGFSGIFGLSYSASGNNVPPEIKLDSNVIINGGQSAAIVDTGTSLLLGPREEVTKIYNHYDANLSDHSIPCDQNVGPISFLINGHKYEVTKETLILKRGKDNNKCIFALSDFGTATNLWVLGDPFCRKFCQIHDIEKLRVAFPEAKKKH

SEQ ID NO: 127859 - protein, 25 aa, Heterodera glycines
  Coding regions on vcDNA: vcDNA=SeqID_54282; Strand=-; Position=1 -54,104-127
MQRCLTSKILNMLYKYQLSLAFLHL

SEQ ID NO: 127860 - protein, 217 aa, Heterodera glycines
  Coding regions on vcDNA: vcDNA=SeqID_54283; Strand=-; Position=1 -55,139-254,514-594,669-780,886-972,1062-1187,1275-1351
MSSSIASPDTFLRSETDQTPAASAAEEVGKYEVFSWHGNLSDQLSAELFVTDQQLLKECREKLAKSELKETKLLWNNGELNAENRALKAELEKQKLMTEHIELKAKVFNMEQEKQQFEKKYVSVDVFNSLAERIKQLENQQQEKREEDRNVSVGQLLEKFLAGEKQQKQQKKDNAQQRLDGKCSVVDKNNVAEIKKQGLDPFELLYAVKRYYSKKNL

SEQ ID NO: 127861 - protein, 38 aa, Heterodera glycines
  Coding regions on vcDNA: vcDNA=SeqID_54284; Strand=+; Position=1-148
FGHFSEMANPIATKKQKVKLSYEGHLYTFAKMSSDGMT

SEQ ID NO: 127862 - protein, 86 aa, Heterodera glycines
  Coding regions on vcDNA: vcDNA=SeqID_54285; Strand=+; Position=1 -79,336-517
MATSLFVKRMMANSCCFGLLLLYVMFAMAFSMAKTEVTNQQQMRRLSSQQRNVSLSIVCSESSTRRRAGGAKHGTSEMPSSTALAF

SEQ ID NO: 127863 - protein, 110 aa, Heterodera glycines
  Coding regions on vcDNA: vcDNA=SeqID_54286; Strand=+; Position=1 -234,413-505,1192-1197
MGWYPNMAWRLWLRSWRKIGTPCHHNRNNKWQWRAFAQPFLPPMGMPPPMGFPPPVPFVPLFANPPLPMPYPPPPILQPIPIPPARPLYGAFNAPQMRPPPLINMPFAPI

SEQ ID NO: 127864 - protein, 148 aa, Heterodera glycines
  Coding regions on vcDNA: vcDNA=SeqID_54287; Strand=+; Position=1 -37,300-709
  Homolog annotation: Hit_ID=AAS38609.1; Match level="QueryCoverage =97%, HitCoverage=19%, E-value=2e-10, Identity=27%"; Hit description =hypothetical protein [Dictyostelium discoideum]
MMMKREKVKLNKTNRGKLRKRKRPLEGEAFTEREQRKWDQFHERLSLDRKIAREERKRRRNERRQGGIKEMSEGEIEWGREDIDWEGMDRESINMEMAKDENRRRNSEKERNYHNGREKERWNEKRKSHSREKQSNDEKKRRRGRKRH

SEQ ID NO: 127865 - protein, 31 aa, Heterodera glycines
  Coding regions on vcDNA: vcDNA=SeqID_54288; Strand=+; Position=1-94
DYLSKHLVDWGIIGDCGINRDRAIIRAYTVI

SEQ ID NO: 127866 - protein, 330 aa, Heterodera glycines
  Coding regions on vcDNA: vcDNA=SeqID_54289; Strand=+; Position=1 -116,254-683,754-1049,1111-1197,1625-1688
MAFLSPRFNALVDKHFDGQSDLTIWNEIAIKKIGTQAKFYIDHSVVTFLRSNQQIFDKGTNLDLDLDVEAKDVQPIWDVFSREIWPIFATNIRHMSFSDTDHLDNFRRRTSPTILTELNQLISIYSDALLPDAIADDGPNATAGQALSKWLHTPTKDGQPKQLICCDNLEPPNIKWITNFKDAFLRAKTSSASYIIRFEDFEPTENGSFELVNERTNEMLTLEKEKNDDENMEKDDEDEEYATEDWLLKRCQIGKTIQWEDENFENLNSVSFTLCGTSCVGPLSAPKASQMDAKSQLKMNPGPSGQRKKKNFPILDENKALPQIRTFLRN

SEQ ID NO: 127867 - protein, 170 aa, Heterodera glycines
  Coding regions on vcDNA: vcDNA=SeqID_54290; Strand=-; Position=1 -127,180-565
MKEKGRKGKSHQNGQSQRKNECETFRKNVPIFYEFLFRIYVEAVDPTVTQKRPAEMPKFQLGTQNGTTLIEVLDNLCDIGTLCFGKTNVVEKDQNKLDELSNKSKKPKKWDKLKNGKTIGQKKAEKVKQKEIQKKFDEMMREKAAEAMETINSAGEGIGQKKTLLRWLWP

SEQ ID NO: 127868 - protein, 71 aa, Heterodera glycines
  Coding regions on vcDNA: vcDNA=SeqID_54291; Strand=+; Position=1-648
YSHKHKTEQKFIPKAYVLLTKNQLGTPFKAIAIAKVFSSGQCLPPPNLSFPSLPLPFPSSFRQISFEFPFV

SEQ ID NO: 127869 - protein, 62 aa, Heterodera glycines
  Coding regions on vcDNA: vcDNA=SeqID_54292; Strand=+; Position=1 -64,508-632
MSEHEILSKWDFQVPNWAQSKVAAHTLCAKCAVVCRCDVSKPFTKQQQLQRWQQQKTEQQQH

SEQ ID NO: 127870 - protein, 78 aa, Heterodera glycines
  Coding regions on vcDNA: vcDNA=SeqID_54293; Strand=-; Position=1 -120,343-459
MLVFFSIFLCFFSSYHFGQVPSLSKICLSRSTRRTNPSLLADTGKFIVIMETVFVNDGGITLFSKKVFLCVFEVAKQK

SEQ ID NO: 127871 - protein, 278 aa, Heterodera glycines
  Coding regions on vcDNA: vcDNA=SeqID_54294; Strand=+; Position=1 -157,1058-1113,1362-1558,1606-1770,1812-2073
MCSIGDPAHQPETNSMSNILALLTYCAEFTCYALIWLIKHFRNGQHHGQSFAAVFVLMANKAEATYSRVLETGKLSHYYTTNNEYKILVRSLAALSFLEEIRVVPAFYLLRQRANELGIQVVPNAGQPVAIFDYFGRHYVAGHDGRPPLFPVHTWNHHDSVLQDLGRTNNAQEGFHLALRMQFNSVHPPLSKVITVLKKEERIAADKLRQYELDPTQGIRIRERKKTYRENDLAIRNLVEGFDAIENPNEDEILAHLRSLQYRLMRNDFENWDDPNGD

SEQ ID NO: 127872 - protein, 133 aa, Heterodera glycines
  Coding regions on vcDNA: vcDNA=SeqID_54295; Strand=-; Position=1-402
MSDLYLKLASFSSPSPPKSAHPHNHQCSESVVRLLGICNLGTRHLGTRLLGIPTFGDPTFPTFGDPTFGDPDIWGPDIWGPDFWGSRHLGTRHLGTERHLSKRHLRKPRTFGNPTFRDPTFGDFNKTKKNLKI

SEQ ID NO: 127873 - protein, 80 aa, Heterodera glycines
  Coding regions on vcDNA: vcDNA=SeqID_54296; Strand=-; Position=1 -62,105-285
MAIASDYKKLHAKSTKCQKIKLSKMEQKLFGQKPVEIIGKTQHNGIVWYIVQLEKKNAILLNHDFVIKKYPQLLLKSYGL

SEQ ID NO: 127874 - protein, 154 aa, Heterodera glycines
  Coding regions on vcDNA: vcDNA=SeqID_54297; Strand=-; Position=1 -351,486-599
  Homolog annotation: Hit_ID=XP_342522.1; Match level="QueryCoverage =77%, HitCoverage=23%, E-value=9e-12, Identity=33%"; Hit description =similar to centromere autoantigen B [Rattus norvegicus]
MVGQPRKERKQIIEQLKNNSDFDEQLGKVKVRRKKSEGQNEDKEEEVKPKKEEEEDEVGRRKTKDGGRGGRGQTSSSSDEEDGEETDDNELKEEESSEGDGGEGDSPPTAKRRKRELLHVRNVECSSSDENDTEEDSDTDIEIKEEEEDSEDGE

SEQ ID NO: 127875 - protein, 72 aa, Heterodera glycines
  Coding regions on vcDNA: vcDNA=SeqID_54298; Strand=-; Position=1 -108,154-266
  Homolog annotation: Hit_ID=XP_521102.1; Match level="QueryCoverage =75%, HitCoverage=22%, E-value=8e-11, Identity=51%"; Hit description =PREDICTED: similar to hypothetical protein MGC21416 [Pan troglodytes]
SVAIKSLSLLFWHKSSANLLLRALATVSGFAWALYASTLFLAGSEPPNRRFLFYYPLVLFYFVFSWLVISFA

SEQ ID NO: 127876 - protein, 62 aa, Heterodera glycines
  Coding regions on vcDNA: vcDNA=SeqID_54299; Strand=-; Position=1-186
LEKEIQAKEAASKRDNVTDTKVQPDLKGNIGSGTSAQTKRKSNVVGLEEDFDTLDEPIWETI

SEQ ID NO: 127877 - protein, 68 aa, Heterodera glycines
  Coding regions on vcDNA: vcDNA=SeqID_54300; Strand=-; Position=1 -43,107-212,727-783
DQSESQFHDMALIKLSRPMARVQPICIHCAKVDRFRNGTAYVMGWGQETNDCVGLTRPAKMLNGRPVK

SEQ ID NO: 127878 - protein, 16 aa, Heterodera glycines
  Coding regions on vcDNA: vcDNA=SeqID_54301; Strand=-; Position=1 -37,333-346
MIQGFLGLNDVKKILE

SEQ ID NO: 127879 - protein, 43 aa, Heterodera glycines
  Coding regions on vcDNA: vcDNA=SeqID_54302; Strand=-; Position=1 -121,424-434
MVIRRGTKVIRTGAKVIRRGATVIRRGTTEIRRGTTEIRRDKK

SEQ ID NO: 127880 - protein, 82 aa, Heterodera glycines
  Coding regions on vcDNA: vcDNA=SeqID_54303; Strand=-; Position=1-246
MWGPPAFALNGRTIGERKGRTDRVLVIGIFKRKRNSISKKTNEEKDGKAIATEAKQSIELDVLTAIYSQKRSDRNKEIKSKA

SEQ ID NO: 127881 - protein, 67 aa, Heterodera glycines
  misc_feature (52)..(52): Xaa can be any naturally occurring amino acid
  Coding regions on vcDNA: vcDNA=SeqID_54304; Strand=+; Position=1-201
VLTAIYSQKRSDRNKEIKSKAVSAVPHLFASPITNIRWTRWTSRPSLFLLQXAMIQWCFSTCSKLNR

SEQ ID NO: 127882 - protein, 47 aa, Heterodera glycines
  Coding regions on vcDNA: vcDNA=SeqID_54305; Strand=+; Position=1-142
MKRAKGLDIIPDDFVNIDGLPVDMRYVHPPGRPHGAQMRIWSPHQSP

SEQ ID NO: 127883 - protein, 94 aa, Heterodera glycines
  Coding regions on vcDNA: vcDNA=SeqID_54306; Strand=-; Position=1-285
  Homolog annotation: Hit_ID=NP_701782.1; Match level="QueryCoverage =100%, HitCoverage=12%, E-value=4e-19, Identity=44%"; Hit description= hypothetical protein PFL2110c [Plasmodium falciparum 3D7] gb|AAN36506.1| hypothetical protein PFL2110c [
MKEEQKVEEEDEHKVDEKVEEEQKVEEEQKGEQEEEQKEEVEEEQKVEEKQNVEEKVEEEQKVEEEQKVEEEQKAEEKVEEKQKVEEEQKVKRK

SEQ ID NO: 127884 - protein, 38 aa, Heterodera glycines
  Coding regions on vcDNA: vcDNA=SeqID_54307; Strand=-; Position=1 -79,164-201
MPKEKKLEVQNWRQFRTQNGKKKLKGGDGPNFRIFSKI

SEQ ID NO: 127885 - protein, 56 aa, Heterodera glycines
  Coding regions on vcDNA: vcDNA=SeqID_54308; Strand=-; Position=1-168
MEDYCFDATAAAAAEQSRRQSGAASDLVQGDGLSSGFLDAIITKVNRSPPHRFTDE

SEQ ID NO: 127886 - protein, 196 aa, Heterodera glycines
  Coding regions on vcDNA: vcDNA=SeqID_54309; Strand=+; Position=1 -108,168-392,452-634,1347-1378
  Homolog annotation: Hit_ID=AAP30770.1; Match level="QueryCoverage =97%, HitCoverage=68%, E-value=5e-51, Identity=57%"; Hit description =putative gland protein G17G01 [Heterodera glycines]
MRKIVYFKLLQIVLSLAFVWQLLSLHQFCGTFVSPKAFLHDISGAFLHDISGGHCKRFTFIGKDSKTGEFGAVFDERKWHNQLMSSTNGQPIEEQQLKFMDELAEKLPPAGRHCIPITLSPFFWTELSPFFWTEKDRNVLDYVMDLFSGQLLIAMCSLLTLGVGLFRMARSAAEYEVSSTDGWTQHIFCFCATITF

SEQ ID NO: 127887 - protein, 750 aa, Heterodera glycines
  Coding regions on vcDNA: vcDNA=SeqID_54310; Strand=-; Position=1 -90,141-195,251-341,393-492,536-574,631-771,894-967,1025-1236,1296 -1382,1436-1458,1516-1662,1992-2250,2303-2471,2521-2618,2669 -2825,2875-3115,3163-3432
  Homolog annotation: Hit_ID=CAE75294.1; Match level="QueryCoverage =99%, HitCoverage=66%, E-value=0.0, Identity=70%"; Hit description =Hypothetical protein CBG23262 [Caenorhabditis briggsae]
MVANRGEIATRVFRALTELNKTSVAIFSEQDKRSIHVYKADEAYLVGTGLPPVAAYLNIEQIVDTAVRNDVEAIHPGYGFLSERADFAQACKDNGIVFIGPTPEVMRRMGDKVAARQAAIEAGVNVVPGTPGPVTTVAEVKQFVQQYGCPVIVKAAYGGGGRGMRKIEKEEEIEDAFNRAFSEALAAFGDGSLFVEKFVERPRHIEVQIIGDHYGNLVHLYERDCSVQRRHQKVVELAPAPVLDPAIRQRMLDDALKLTRHVGYQNVGTVEFLLDTKGNHYFMEVNARLQVEHTVTEEITGVDLVQSQIRIAEGKSLEDINLRQDSIHVNGAAIQCRVTTEDPARGFQPDSGREFRIRGVKTNIPFLVNVLEQPAFRTGVVDTYFIDEHPELFSFKPSQNRAQKLLFYLGQLKVNGSLTPLVTEMKPKNVQPTVPVVPAGLHDQPPVGIRDILVKKGPEAFAKALRANKGCMITDTTFRDAHQRSVPKFDFFDASGLLATRVRTYDMAKIAPFVSHKFANLFSMEMWGGATFDVAMQFLHECPWERLELLRKLIPNIPFQMLFRGANAVGYSSYPDNVLDKFCELSVKSGMDVFRVFDSLNYVPNMVVGMEAVGKAGGVVEAAISYTGDVSDPNAQRYNLEYYLNLAKQLVNANAHILSIKDMAGVLKPEAAKLLITALRDQHPDVPIHVHTHDTSGAGVASMIECARAGADAIDAAIDSMSGMTSQPSMGAIVASLQRTPHSTGSQMLI

SEQ ID NO: 127888 - protein, 102 aa, Heterodera glycines
  Coding regions on vcDNA: vcDNA=SeqID_54311; Strand=-; Position=1 -198,252-362
MDSDTEEDLDTLQRFDFYYEVGQVRPVLLSTNIAPIQQTLRSNRAFVSDLSSEEDDELANFVVHSVESEEDANDHESFFSEITSGLYSPSPMHSPDSQSDDN

SEQ ID NO: 127889 - protein, 35 aa, Heterodera glycines
  Coding regions on vcDNA: vcDNA=SeqID_54312; Strand=-; Position=1 -88,139-158
MNTEIKPLIVKMCEDPEFDVRYFAEETKIELGMAA

SEQ ID NO: 127890 - protein, 78 aa, Heterodera glycines
  Coding regions on vcDNA: vcDNA=SeqID_54313; Strand=-; Position=1-236
MQINEQIKPSDDNVIAAASEDQNVYLFDLRGNEGDGLCTKLRQEGTAFCAVWNPQNHNIVAVCNKKTGLLVYDLRMSN

SEQ ID NO: 127891 - protein, 28 aa, Heterodera glycines
  Coding regions on vcDNA: vcDNA=SeqID_54314; Strand=+; Position=1-84
HNSALVLIWQKIKPFFLRTHMCSIHPTK

SEQ ID NO: 127892 - protein, 109 aa, Heterodera glycines
  Coding regions on vcDNA: vcDNA=SeqID_54315; Strand=-; Position=1 -178,785-936
MIALRTDIDQKARILFGLAIDQAFRSVLVGSFIHSRRQILCYITCNAIKNYPKFAYNGLRHIPFINLFMVVKISQMADWILEIWIWGFGWDKSNLCSRREIVQHRDWFC

SEQ ID NO: 127893 - protein, 193 aa, Heterodera glycines
  misc_feature (188)..(188): Xaa can be any naturally occurring amino acid
  misc_feature (190)..(190): Xaa can be any naturally occurring amino acid
  Coding regions on vcDNA: vcDNA=SeqID_54316; Strand=-; Position=1 -134,192-284,329-489,1200-1304
  Homolog annotation: Hit_ID=CAE59558.1; Match level="QueryCoverage =91%, HitCoverage=32%, E-value=7e-26, Identity=41%"; Hit description =Hypothetical protein CBG02955 [Caenorhabditis briggsae]
PFFCLFCFLSLPLPNCPPFLFSLVGCRLLQLYYVLRLHVEDATGSAALEMGSAALEMDFPLTIATVPFRPGHSQLYSVGYDFCVDHVETGKYISPEFRLGQVVGYDFCVDHVETGKYISPEFRLGQVWDGRTEGEKDFVDDVVLYRPVYVKVLDRTPNSPFVTSNWAQAFVGRVAILPICATSNGSKXRXLKH

SEQ ID NO: 127894 - protein, 144 aa, Heterodera glycines
  Coding regions on vcDNA: vcDNA=SeqID_54317; Strand=+; Position=1 -150,320-416,473-598,655-716
MPFFSPSSAVFLLPFQFLLVVLGAVFVVLSQCCGCSKKEKASFQPPSPQRNTGAPPPQPPTFLSPAPQITAAGPGTGPQFVPMNDPKYETLNSLDPNIFLKSASAKPPQKPPQATNGPKPVPVPANDPKYETLNALDPNIFVKK

SEQ ID NO: 127895 - protein, 45 aa, Heterodera glycines
  Coding regions on vcDNA: vcDNA=SeqID_54318; Strand=-; Position=1-138
EHFFQLQNELGLENVSICLVVFADNSNNTWRVQAIPVSDVSSFDN

SEQ ID NO: 127896 - protein, 154 aa, Heterodera glycines
  Coding regions on vcDNA: vcDNA=SeqID_54319; Strand=+; Position=1 -18,439-738,792-938
MTSSCKACPFRSKGLICRRKLSDDNMCEACGQKAIAPIHTVFVRLLLQDVEQADIAQRVTMFSSVAEEFLGMKAAELLAKEKEPESLAKHLDDLIAVKIIAKVNIKANSQTYTGFDWIVNLFKKCPGKNDSDVPKEKDDDDDVDEIATKKTKKN

SEQ ID NO: 127897 - protein, 616 aa, Heterodera glycines
  Coding regions on vcDNA: vcDNA=SeqID_54320; Strand=+; Position=1 -144,358-612,666-815,863-1033,1323-1580,1633-1791,1848-1982,2032 -2292,2381-2644,2699-2751
  Homolog annotation: Hit_ID=XP_479185.1; Match level="QueryCoverage =26%, HitCoverage=9%, E-value=4e-10, Identity=27%"; Hit description =putative DEAD/H (Asp-Glu-Ala-Asp/His) box polypeptide 8 (RNA helicase) [Oryza sativa (japonica cultivar-gr
MDNILANKKVLTFLRIANELCGVGKEAAFVVSMACAGGHILRDLALIPENLLKLLREPGDDLEFAYRLYQLTFNKKGKKLLNKLCHNSPVKIGNIMQIAEMASELATNYSSNCSYIEHRRIDEDCRAFRPVDLRNVNKFGFLVISALSYAFCQAFDENICNFYDIYGDGKGFFYNPLLGCTVTLCDNSFARQTDKWPKINQSRIVSYRFSKTTEDKNGMLEAFFVCRLPISLIHQYPITELNQFKINIGPMVAEKLLSSDFVNNLCEGDLASFQGYNPATGLLSIACSARSALKLRQLTDGTVNSLFELLNTMDKLRWFDEESGALISFGPGFQISQLNANPSEREKDTIVVSYIDSFEHFEPMVHQLTEFSLQFCESRNCKPLLFTDCKSRRCFVTLLAPSIINDLKSSIDSLLQFFPGVSVETRPGNISEYFAGYNAIRSSGSVFDNSSYPTDCCAICFGTIDGQFIRLSLCGHVYCDDCFIGLLKNAIQFPVSCQSGCLYQILFEDIALIFSRNFRGVDEIQQFLTPVFRLSLHSFLLAHRDQFVRCQSEGCHCLMPLSKGTANGAVGSPMICFGCKMKRCTLCGEAVHQEITCQERQEQKFSIEHPDLSAWK

SEQ ID NO: 127898 - protein, 159 aa, Heterodera glycines
  Coding regions on vcDNA: vcDNA=SeqID_54321; Strand=-; Position=1 -213,479-578,751-917
MASNNGSPPTDSARIGHGAREGKSAKKDGTPASKIAEFRQRRESSAKKSTERLCLQLIMDKLRKQLNGIRIKYCQAWSKKSQKPTNDTNSAKHTSTETPGKNCKKLQRKLSQLVNHRLKVFEGVDVRNDDCVLLPLRWICIQLRNLKARTKGNLKIVSD

SEQ ID NO: 127899 - protein, 87 aa, Heterodera glycines
  Coding regions on vcDNA: vcDNA=SeqID_54322; Strand=+; Position=1 -235,420-448
MNVEVAPDGHMVTDPFYAQAMMVIDAFSVYGLREDDEETGDDAEREDDNPLHKYRDNWTAMFNRFKKVLIIPVHGGGGEISLFFPYV

SEQ ID NO: 127900 - protein, 256 aa, Heterodera glycines
  Coding regions on vcDNA: vcDNA=SeqID_54323; Strand=+; Position=1 -60,578-890,1044-1141,1190-1282,1440-1542,1706-1788
  Homolog annotation: Hit_ID=BAA08309.1; Match level="QueryCoverage =100%, HitCoverage=4%, E-value=1e-109, Identity=78%"; Hit description= ryanodine receptor [Caenorhabditis elegans]
MADKEESAGGEQDDVSFLRTGDIVCLTCLVSNSQRDGAGAESERVCLSSEGFGNRMCALENVSDRDFPPDIASCMLYIDNALSMRALQEMMNAESGEIKGTGGTGGHKTLLYGHAVQLKHVQSEMFLACLSSCSSNDKLAFDVGVQETNAGESSWWTIHPASKQIHPASKQRSEGEKVRAGDDVILVSVATERYLTAVYHSHFMVIASFHQTLWNVTSVSSGSVRIRNMGSLFGNDVVRLFHGNDECLTIPEWSEY

SEQ ID NO: 127901 - protein, 496 aa, Heterodera glycines
  Coding regions on vcDNA: vcDNA=SeqID_54324; Strand=+; Position=1 -65,187-298,504-606,658-733,923-1129,1173-1393,1462-1504,1645 -1778,1932-2170,2221-2386
  Homolog annotation: Hit_ID=CAE71970.1; Match level="QueryCoverage =98%, HitCoverage=8%, E-value=0.0, Identity=72%"; Hit description =Hypothetical protein CBG19042 [Caenorhabditis briggsae]
KPDEKEEEGMGIATIRYGETNAFIRHADKELWLTYQTLEVTKKGLGKVEEKKAIAHSEGHMDDCYTFFMALEEESMSARVIRKCSSVLNRFLKGIEGLQTEGEESGIEGLQTEGEESVDWMRVDLQEVLKLMQDLITYFAQPNDELDFESRQNRFRALRSRQDLFQAEGVLNMILDTIDKFSVMEAMPNFVGLIGEENQLMWEEISTYLYLLVAAMIKGLMWEEISTYLYLLVAAMIKGNHSNCAQFAALLRLDWLFGRLSNPQSAEGILDVLYCVLTESPEALNMINEGHIRSVISSVISLLEKVGRDPKVLDVLSSLCEGNGMAVRSSQNTITDYLLPGKDLLLQTQMRDYVASMMPNILVGVVDGSSLFKRWYFEAEVEHVESYANQQPYLRVGWANTVGFKPFPGPGDGWGCGGVGDDFYSYGFDGMNMFCAGKARQVGHRLGKARQVGHRLLRKGDVVGCALDLISTEIRFSLNGEVSKLAPKKNNDSPST

SEQ ID NO: 127902 - protein, 234 aa, Heterodera glycines
  Coding regions on vcDNA: vcDNA=SeqID_54325; Strand=+; Position=1 -148,195-748
  Homolog annotation: Hit_ID=AAC95573.1; Match level="QueryCoverage =95%, HitCoverage=50%, E-value=6e-18, Identity=23%"; Hit description =orf 48 [Ateline herpesvirus 3] pir||T42963 hypothetical protein 48 - ateline herpesvirus 3 (strain 73) ref
RKNEEQPEDDQQGNTEEGGGENGRSADGRTNGAQTEEQRQPENQGEHENEIYPENPFSINENDDKENNDEQRSKEKGIEEALREEKREKQNNGMEFYPEEVVIGEQNKEQNANESDNDNDNDNDASQKESVERDNGDPRDQADTWGDEGEQVGKEAETVKDNGKGEEEKKREKRETNSMLEREKERSEREKKRAEEEKEKTEKENIIEGKKAEDEKKSAAGNEGLFRMFPEQQI

SEQ ID NO: 127903 - protein, 55 aa, Heterodera glycines
  Coding regions on vcDNA: vcDNA=SeqID_54326; Strand=-; Position=1 -25,628-770
MPGEGISKNGGQQIRRQFAQGIGGEASGERKKKKKKPFIIHCATSAAENGKKLQD

SEQ ID NO: 127904 - protein, 228 aa, Heterodera glycines
  Coding regions on vcDNA: vcDNA=SeqID_54327; Strand=+; Position=1 -84,127-200,242-524,566-811
  Homolog annotation: Hit_ID=NP_001004509.1; Match level="QueryCoverage= 88%, HitCoverage=13%, E-value=3e-28, Identity=34%"; Hit description =si:busm1-180o5.3 [Danio rerio] emb|CAD60788.1| novel protein similar to DNA polymerases [Danio rerio]
MEENYRNTLNRIEKLRRICKKFCILEVWECEVREQLKKNKEMKNFFENIPDRGPINPRDAYVGGRTMPFALYAEATEKQVISMFDIVSLYPYVNFVTPYPVGIPKVIKKLNPNVIWKDPGDIPYDGLLKVKVIPPKKLRYPLLPFHADGFLLFPTCGECARKSKQDFVRVECFKKYRHSAEGRELVGVFTSIVLRKALELGYKITKFYRAYHYENFDTNLFKNYVRMF

SEQ ID NO: 127905 - protein, 104 aa, Heterodera glycines
  Coding regions on vcDNA: vcDNA=SeqID_54328; Strand=+; Position=1 -152,427-589
MLFVLLRFLLLCSLSMPILAIRNFTFSKVNDRSQLPHRMRRMVRVEWDGSTLAFAWNRRFADRILPEEVVYLTWNLWQSGNSSADNDGRSVYFSATDFNGFGNG

SEQ ID NO: 127906 - protein, 101 aa, Heterodera glycines
  Coding regions on vcDNA: vcDNA=SeqID_54329; Strand=-; Position=1 -263,315-357
MPIEPFELENKVTNEKLTLKQSKEYNLVNWLLQRYPIGETATAPVKWKKRENSGANLNYIRFDPRYGNNACANLNIVRFDLGGNHWIGPLSPPAVVEEELD

SEQ ID NO: 127907 - protein, 80 aa, Heterodera glycines
  Coding regions on vcDNA: vcDNA=SeqID_54330; Strand=-; Position=1 -121,220-341
MTNFNIIGIRVAAGYPKPDIFLDPKPDPMILVGFRVEISTVFVLMVVWFIGYTFCLSLFFASVQFPTGIEYFIFSSNSFN

SEQ ID NO: 127908 - protein, 554 aa, Heterodera glycines
  Coding regions on vcDNA: vcDNA=SeqID_54331; Strand=+; Position=1-1665
  Homolog annotation: Hit_ID=XP_318550.1; Match level="QueryCoverage =86%, HitCoverage=48%, E-value=1e-101, Identity=40%"; Hit description= ENSANGP00000020240 [Anopheles gambiae]
MLYGRKFTLLTDHKPLLAIFGSKKGIPIYAASRLQRWALILSNYEFDIKYVNTNSFGNADVLSRLIANYPRPNEDILIANICEKTECYVNFVFQAKVEQLPITAKEIADQTKTDEVLQQISKFTNKGWPQKCEDTDLMPFYPKRDQITEIDGCLTYGDRVIIPTTLRRQILKSLHFAHPGIVRMKAIAKNHVYWPGINSEIERTVRQCDDCQMAAKNPTKAQIQPWKAADEVFERIHLDFAGPCEDGQTYLVVVDAYSNWPEVWEMSCATSEKTVAMLKSFVHRMGIPREIVSDNGTQFRSAEFANFCKEFDIRHTFTPPYHPMSNGAAERFVDIFKRAMKKCRKEGKDWIQKALLAYRTTPSAVLDGHSPDELFLGRRMRTKISLVHPANQKIPKVDLKNFGNFQQDYRQNMKRQFNKKNGTKTITFRNGEPMFIWNLKGNKANWLPATIIERVGNSPTYRTDVPTLHRAVYRHANQIRRRFPVDLETPEIGQRNGHILAGDQTNRAPVKEIQKAKSPVGQCQNAQRKSARAKRAPQRLDMDPSKPKYDLVRP

SEQ ID NO: 127909 - protein, 120 aa, Heterodera glycines
  Coding regions on vcDNA: vcDNA=SeqID_54332; Strand=+; Position=1 -54,520-828
MNDPPRMIIAHGPNRWCTLFFCFFFADQVKHCARKVQLLVAVQIGQINGGPQKCQNMHSNGNGGQHQNQNFDHAEARATADVGQLGDEVAGQPKQQQPLHRVRHHRSGLTTGRRKLNGNS

SEQ ID NO: 127910 - protein, 172 aa, Heterodera glycines
  Coding regions on vcDNA: vcDNA=SeqID_54333; Strand=-; Position=1 -12,443-545,1284-1399,1449-1530,1805-1870,2432-2569
  Homolog annotation: Hit_ID=NP_493429.1; Match level="QueryCoverage =22%, HitCoverage=1%, E-value=1e-13, Identity=94%"; Hit description =predicted CDS, mechanosensory transduction channel NOMPC (1O503) [Caenorhabditis elegans] emb|CAC14420.1|
MLYLKNQLLAFALLFAFVEFLDFLTVHHLFGPWAIIIRARLPTGGRGQCRTDAFGIAQPNLGNAVFLAVWPRRAGQHAPAPFGARFCKNCAQVLVRHLHDGHIDLPGLGSAKLNSKYRHVQFQGHNVRFCTQKAQQDLRYEENIDAFTMDGQQGRQSPTFKGGGATGDEKEP

SEQ ID NO: 127911 - protein, 88 aa, Heterodera glycines
  Coding regions on vcDNA: vcDNA=SeqID_54334; Strand=+; Position=1 -117,465-613
RYSKELESEMELELKQRDQKISELESVKHRLSTALEQLKTKSEKDRHEHRTTEEQLRTRLLNSDGQCTELRHKLRAVEQQNDNLERRE

SEQ ID NO: 127912 - protein, 150 aa, Heterodera glycines
  Coding regions on vcDNA: vcDNA=SeqID_54335; Strand=+; Position=1-660
LFESPKRTLEKIDFFVFGAVPLNRCAQIYGETESFRNSFPIACTLILRWIFAPHNCLSTPNGHLKKSIFFVFGAVPPNRCAQIYGETESFGNSFPIACTLILRWIFAPHNCLSTPNGHLKKSIFLFSGQSPRTDAPRFMGRPNPSGIASL

SEQ ID NO: 127913 - protein, 42 aa, Heterodera glycines
  Coding regions on vcDNA: vcDNA=SeqID_54336; Strand=-; Position=1 -37,239-330
MLKKIQKLRDKKDEKLKKESPITPSALKAQFLGYEIQRQSLK

SEQ ID NO: 127914 - protein, 43 aa, Heterodera glycines
  Coding regions on vcDNA: vcDNA=SeqID_54337; Strand=-; Position=1 -95,144-179
MTSFAKFDISGPDVVPLLQKLCSANIDRAVGTTIYTGMHNEQG

SEQ ID NO: 127915 - protein, 100 aa, Heterodera glycines
  Coding regions on vcDNA: vcDNA=SeqID_54338; Strand=+; Position=1 -75,329-556
MQWFPAAVRKSARNFAICLQFPSDVHLLKHSLQLSTNQAVSNKSVPSKSKAERKKRTKERELKKGEKVTLESEKVNVNSRNKKQKMADVDDLEVKFEALK

SEQ ID NO: 127916 - protein, 301 aa, Heterodera glycines
  Coding regions on vcDNA: vcDNA=SeqID_54339; Strand=+; Position=1-906
  Homolog annotation: Hit_ID=AAO51915.1; Match level="QueryCoverage =45%, HitCoverage=6%, E-value=4e-11, Identity=29%"; Hit description =similar to Dictyostelium discoideum (Slime mold). Non-receptor tyrosine kinase spore lysis A (EC 2.7.1.112)
MATASNWHATDCVRMFPLFLEGEAKEIFLNIPPNKKKTWRDLTNAMADQTKKIDGPMWPKKLLARAKMGHESITEYANKIRELVEQASPDPNYTSEARECESVHYFLNGLPIFLKRKLFFMKKPKTLVEAISMAKEVNQAREELANDEKGDEIKQQINEIREQINVISSQNNGKNENQREFVNNSWRNNFGNGNSWNRGRENNYRGGQRARNFNKFYTRNTNIGPRNSNFVPLNQNNWNRNWNENGGNNDRNWNGRFQRNLEIAEEIREEEEMTDKSTVSIWWEMKKKPPQHRSDVHLPRY

SEQ ID NO: 127917 - protein, 171 aa, Heterodera glycines
  Coding regions on vcDNA: vcDNA=SeqID_54340; Strand=+; Position=1-516
MAAVTKTVPTPKVETPPFSKSWIKLKQTEQKYIIKRVNVGKIGTTIIPVTKTTKTVKNAPTTTVKTPLMIFTTTKPKQEKTPKNISNSVFENEKSKQGNKTKTETKAKKEEKHPKTVKIGKELNEKTMPKEEKVPKIVTKNITTTETPKMTTIKTISTTTPKPKVNEMEMK

SEQ ID NO: 127918 - protein, 54 aa, Heterodera glycines
  Coding regions on vcDNA: vcDNA=SeqID_54341; Strand=+; Position=1 -93,315-386
MKWNREGRENDQLDCGKAKPNDVLTMRAVPKCNYSSLGIHYFGAYEILSDNSTN

SEQ ID NO: 127919 - protein, 317 aa, Heterodera glycines
  Coding regions on vcDNA: vcDNA=SeqID_54342; Strand=-; Position=1 -58,111-260,332-834,1041-1132,1185-1335
  Homolog annotation: Hit_ID=AAC24255.2; Match level="QueryCoverage =43%, HitCoverage=97%, E-value=7e-40, Identity=54%"; Hit description =Hypothetical protein B0041.6 [Caenorhabditis elegans] sp|O02058|PTPS_ CAEEL Putative 6-pyruvoyl tetrahydrob
MVKAAPDDDEYGQMIRNDFAAAEFCSNFVDHSSPKFDISEHSNEKQMANFMPSVDTDSGALKESLGLSHAMLSMFMNTLRDDNVSAINDMTNDDKFNNNNIAIPSIPPWSAKKRQCSSSRVTTAPSKSDAITASSNLIPTGSSSNNNNNDILPTSSLSVLMQQSSVAASAQQRQQQQPIVKMCRVETFSAAHRLHNDNLPDYLNREVFGKCNNGNGHGHNYTWKVVLKGPVDQHTGMVYNLADLKREMNEVLEQVDHKHLDKDLPYFRDNGIVSTTENLSVFLYNELSATMSSPELLHKVVVCETDKNCFSFAGYSS

SEQ ID NO: 127920 - protein, 511 aa, Heterodera glycines
  Coding regions on vcDNA: vcDNA=SeqID_54343; Strand=-; Position=1 -107,164-339,406-490,751-960,1042-1128,1168-1225,1338-1470,1639 -2036,2087-2185,2237-2267
  Homolog annotation: Hit_ID=CAE72594.1; Match level="QueryCoverage =97%, HitCoverage=92%, E-value=1e-104, Identity=45%"; Hit description= Hypothetical protein CBG19783 [Caenorhabditis briggsae]
KNIHVYWGTATTALPHVGYLVPIQKIADFLRADIRVTILFADLHAVTILFADLHAFLDNMKSSIELLQNRVLYYECVIKALLNALNVPIGKLHFVRGRSYQLTETYTKDLLRFTYTKDLLRFCGLVSLRDATRAGAEVVKQVDDPLLSGILYPLLQALDEQHLKVVGQFGGVDQRKIFILCEEQLLKMKFAKRFHLMNPMVPGLTGSKMSSSEENTKIDLLDSPESVSAKIDSAACPKMPDENGVLAFFKHVVVPDENGVLAFFKHVVVPIQSEAQIVINGTFFDSFDAIRNAFVRGDLSESALKEYLKNFLNTILSSGRGHFDGRFVFGQFGTGRSQMRVDTLWPIPGGVFDFLPFRVNFFPLFSPKFVASSVRVSSPEFLFSSNKSSTDFRPLRVLWRLSPKGRLTLGHLSALFTLKWLSTFGHHITILLSDLDAFLDHAKCPWTEMKARALQFEKRALQFEKWLREILRSLNMENVEIKHSSEYEFDSDFSMEMYQMADFSMEMYQMA

SEQ ID NO: 127921 - protein, 20 aa, Heterodera glycines
  Coding regions on vcDNA: vcDNA=SeqID_54344; Strand=-; Position=1-60
MELNDAQQKRKELIVRNLQE

SEQ ID NO: 127922 - protein, 95 aa, Heterodera glycines
  Coding regions on vcDNA: vcDNA=SeqID_54345; Strand=-; Position=1-288
DAWFVEVLSAHLLKHKDICPFALSDWMEDILDTEFSLISDDGTLEPTAKLLVELADLTVGRGAHKGAEAEAKLEEHLQRLRTLSAKSVRFHRILI

SEQ ID NO: 127923 - protein, 242 aa, Heterodera glycines
  Coding regions on vcDNA: vcDNA=SeqID_54346; Strand=-; Position=1 -483,527-772
MQQFPSNLALNQEIESPNALNNDRDAEYQDLQRVDKNARTVLHRAALDQNYSLVTQLCERAEKIGLGHYVDTIDKFGNTPLLSACVVHNYQTSRYKLQCIQALIQNKADPNKKNDTTLWTPLTWCSFYGETEAIKKLLENKGFPYLVDNEGRFPLDHCGLQDKHGNRKKAATVLIESLVQLIQKFDENPEKLAYEGYTDYRRHLGSPLLRTSVLYWAIYFKLDVDGYVKKLLAMNGVYPELP

SEQ ID NO: 127924 - protein, 295 aa, Heterodera glycines
  Coding regions on vcDNA: vcDNA=SeqID_54347; Strand=+; Position=1 -812,885-962
AEPANPDKENATNSKNNHQQNITTTATATLSSETPAEQILADQDNSIAEKDEAGTPPPSSGLGQSGDAAATSVTQVEDGRNLPQAAALTSNNPKIVAKQSTVATDRRKEKIIEKLIDEQVDRMVDGTHAQQKMLQEEGKDNESQHRISTYKLIEEVLHGEHGQLMSQQRESKMAAEFAYNEITQRFGIRMGPGVMHVDLSKQLSYVLGFDHKTRIYNNQSAKYPPDLSGGVRQLYVYAPKLVEDSIIGDRMAPLLRVVNVSGTPGLDMPETAFGRYVKFGWGTTVITLHFRQKLF

SEQ ID NO: 127925 - protein, 27 aa, Heterodera glycines
  Coding regions on vcDNA: vcDNA=SeqID_54348; Strand=-; Position=1 -41,284-326
MSGSEPMSNEILNKFLSTIMIAFIFIN

SEQ ID NO: 127926 - protein, 352 aa, Heterodera glycines
  Coding regions on vcDNA: vcDNA=SeqID_54349; Strand=+; Position=1-1064
  Homolog annotation: Hit_ID=NP_510671.1; Match level="QueryCoverage =99%, HitCoverage=35%, E-value=1e-68, Identity=41%"; Hit description =predicted CDS, endonuclease/exonuclease/phosphatase family and RNA -directed DNA polymerase (XR69) [Caenor
NKNGTSPDNISYKILKICHSSLSTVITDLFRISLDIGSLPDIWKESIVFPLKKGDKNNPENYRPISLTCSLCRVMERILSKNIYNFLLKNKKISEFQFFVRNRSTTSQLITVVEDWYEAIINEKNVDCIYIDFQKAFDSVPHELLLYKLEKIGIRGKLLMWIKDFLSNRTFRVKIGDDLSSSKKVGSGVPQGSVLGPLLFLIYINDLPDALPSGVKIKLYADDVKLYICYKARTETEIMHKALHNLSEWANKWQIRISIKKTFVLHLGNKNPKEIYKIDGNIINVVDTIRDLGINIDNKLQFSNHVTQIIKNAYLRMRSLFRVIKSKSSRIWIILYKTGGGPLLEYAPEVGI

SEQ ID NO: 127927 - protein, 102 aa, Heterodera glycines
  Coding regions on vcDNA: vcDNA=SeqID_54350; Strand=+; Position=1 -25,92-131,390-631
  Homolog annotation: Hit_ID=XP_314784.1; Match level="QueryCoverage =99%, HitCoverage=20%, E-value=4e-17, Identity=46%"; Hit description =ENSANGP00000014187 [Anopheles gambiae]
MSGGIYGGDDVGALVFDPGSHSFRVGYGGEEFPRFDIPARVGVCPRPSAGTDASQTADATIEEVASGRGANASNKFDHYIGTTKLNVPRAGMEVKPYMREGM

SEQ ID NO: 127928 - protein, 54 aa, Heterodera glycines
  Coding regions on vcDNA: vcDNA=SeqID_54351; Strand=+; Position=1 -75,128-218
IFIIFQIPHYEMEEPKPAQTSFFLWMNENRHRFYQPGMTQADVAKAAGRTNGGN

SEQ ID NO: 127929 - protein, 233 aa, Heterodera glycines
  Coding regions on vcDNA: vcDNA=SeqID_54352; Strand=-; Position=1 -120,553-660,710-871,993-1224,1271-1347
  Homolog annotation: Hit_ID=CAE71951.1; Match level="QueryCoverage =47%, HitCoverage=15%, E-value=2e-18, Identity=37%"; Hit description =Hypothetical protein CBG19019 [Caenorhabditis briggsae]
METVENGHDDTRQQSYHTERTLLASQGEEDERNGDDTLQQSRPMTCCFGMVVPFLMKLHPFIAFPKVPTPQVTMGACFVSLLHNIPIHVNCCAQYFHPANRKQFMIIGAEQGIFAMDLTHLTTEEEALFQGKTPYLYRHEMLQLFQQELITQKLAKSLDKLPQKLKPKALMSTLRMPETRSVEYGDWPTKICLVIGPGSGKLGDYHKAIAISVTWKGASMTKTFTFVVPFLTL

SEQ ID NO: 127930 - protein, 71 aa, Heterodera glycines
  Coding regions on vcDNA: vcDNA=SeqID_54353; Strand=-; Position=1 -93,903-1025
MKITQNRKNKSFKPKESDAEGKCPGDLLRTLANRGHLGLSKDTNNVGFDELGVVRLNTTRALRYQDFFAKP

SEQ ID NO: 127931 - protein, 171 aa, Heterodera glycines
  Coding regions on vcDNA: vcDNA=SeqID_54354; Strand=+; Position=1 -58,700-881,1889-1986,2298-2475
MPGGTAAVENDAEVTQARKEAAARDDTVRDGSAPTAIGTDFRCLDCRAVNVPMGNGRSIIVYESMGNGKTGRWTVQRIAQATGLVFFGVYTLPAPALGELGGRVQVHFVGDTVYGSFCSAHTDGTERCLSCAIRRPKGTVIELVFTNCSIKSGNQRDISDSAPVIRTFANF

SEQ ID NO: 127932 - protein, 237 aa, Heterodera glycines
  misc_feature (15)..(15): Xaa can be any naturally occurring amino acid
  misc_feature (28)..(28): Xaa can be any naturally occurring amino acid
  misc_feature (206)..(206): Xaa can be any naturally occurring amino acid
  misc_feature (226)..(226): Xaa can be any naturally occurring amino acid
  Coding regions on vcDNA: vcDNA=SeqID_54355; Strand=-; Position=1 -122,297-449,969-1073,1147-1218,1484-1733
  Homolog annotation: Hit_ID=AAC72366.2; Match level="QueryCoverage =80%, HitCoverage=16%, E-value=2e-56, Identity=55%"; Hit description =guanylyl cyclase [Heterodera glycines]
GLLTRIWFEKKAIKXALKMEKASNLEAXNDKDQKATKLSQSGGTKVTLGSNNKKLETDTYAHFLYNREIVFGVKYLVKVRIDAKQLGQLRKLRFIDHDNLNKFYGICTDAPILYAIWKHCQRGSLKNLIAKNLIAKEQYVGDVFVMVSLMRDITNGLSALHQTFVGAHGSLSSENCLIDDRWRVKISDFGLNLIGESRPMPRASEXWTRMFLVFDFEFQNLNFKNXFNYTIRNFERT

SEQ ID NO: 127933 - protein, 85 aa, Heterodera glycines
  Coding regions on vcDNA: vcDNA=SeqID_54356; Strand=-; Position=1 -44,107-218,619-720
MPKPFDFSGEGKFSRFGHYVDYMEEIRRKDVSLSYASVDDIFKNMPVKAYCAFDDVFDEFDSRPCGAVRFTFIFLIVHFYTINKD

SEQ ID NO: 127934 - protein, 196 aa, Heterodera glycines
  Coding regions on vcDNA: vcDNA=SeqID_54357; Strand=+; Position=1 -130,198-481,538-645
  Homolog annotation: Hit_ID=NP_501141.1; Match level="QueryCoverage =97%, HitCoverage=16%, E-value=3e-45, Identity=46%"; Hit description =solute carrier family 12 member (4H981) [Caenorhabditis elegans] gb|AAA81476.1| Temporarily assigned gene
GSVNTLIQSIGIGGLRPNTLLLSWPTTEVGKDEVADSEYRTFTDKLLAGAVNKLLAGAVNGMALLVAKGIPEFPSNVKLSGYLDVYWIVRDGGLCVLITFLLEQNEVWSSCKTRIVAVARPQENSAKLKKQIQNYLYQLRIDAEILVTKLNDPELSITAYVTKLNDPELSITAYERTLLMEERTKMLKQIQRRGMP

SEQ ID NO: 127935 - protein, 66 aa, Heterodera glycines
  Coding regions on vcDNA: vcDNA=SeqID_54358; Strand=+; Position=1 -39,82-219,640-661
  Homolog annotation: Hit_ID=CAE58399.1; Match level="QueryCoverage =93%, HitCoverage=15%, E-value=2e-10, Identity=52%"; Hit description =Hypothetical protein CBG01528 [Caenorhabditis briggsae]
MPSLILYSLPTLMLANLAIFFGQALFSFVPHILLVFAIIFFEGMLFGSGYTFFGKIHRKVQPGLDP

SEQ ID NO: 127936 - protein, 96 aa, Heterodera glycines
  Coding regions on vcDNA: vcDNA=SeqID_54359; Strand=-; Position=1 -37,350-457,508-653
  Homolog annotation: Hit_ID=AAP30764.1; Match level="QueryCoverage =69%, HitCoverage=11%, E-value=3e-15, Identity=67%"; Hit description =putative gland protein G28B03 [Heterodera glycines]
MSGIGVGDRGARAPPKYVFIWSGNNEKKNLEVDPRVIRLSIELSELFHAKEDQPDNAQQQGEEVQAKNDQSVNAKHGKQVQTRKKLQESFFANLIF

SEQ ID NO: 127937 - protein, 93 aa, Heterodera glycines
  Coding regions on vcDNA: vcDNA=SeqID_54360; Strand=-; Position=1 -105,517-693
  Homolog annotation: Hit_ID=CAE67854.1; Match level="QueryCoverage =84%, HitCoverage=10%, E-value=3e-13, Identity=45%"; Hit description =Hypothetical protein CBG13444 [Caenorhabditis briggsae]
MAIPQNSVIVLDGNYCADEQMESVSAIYWGEDALKIQRGSWFYADSFQPIRADFADEIEAHHLKSFRDNVIPETPVFSDAESSKKPGTCKTMG

SEQ ID NO: 127938 - protein, 40 aa, Heterodera glycines
  Coding regions on vcDNA: vcDNA=SeqID_54361; Strand=+; Position=1 -80,499-541
MLKIPGKLKKYPFFYSKELTVLVKSASSEILRFNATTIHH

SEQ ID NO: 127939 - protein, 369 aa, Heterodera glycines
  Coding regions on vcDNA: vcDNA=SeqID_54362; Strand=-; Position=1 -57,688-756,1008-1181,1231-1563,1633-2109
MCSKCAHWPTSGALLASRTVLRLRQQLADTLLEDRELEDGIQDLCHRVERWKSRANAALERSFAAAAAQQTVNELYALVTEAREEFNVKLEAEGLDRLKSELARCQWLVNAQTIWRQIERCHNTAGNGIATNGEDGKEEQKQSVDEQKHHKVTEEVERDSKKDTKTEDDKNAEGIVEEQSSTIDEGMAPEEEGEEAEGEDEQKRVELHELAKTVADGLKWCTSCTAVQQLNAKLEHFLNHGNALDQRAADFLAFARNQQQKHQQALPTTTTAQSSSSSAGGGCVANTAPTGAVVAVVGVELARQKWAEIAAAMTAQQNNCDGNDAAGNGGPPSSSSSAFGIDWIQSPAIDRFRAELQAMAMEGPRDGTN

SEQ ID NO: 127940 - protein, 488 aa, Heterodera glycines
  Coding regions on vcDNA: vcDNA=SeqID_54363; Strand=-; Position=1 -80,137-236,734-977,1394-1484,1539-1599,1668-1711,1863-1977,2024 -2133,2231-2492,2626-2821,3338-3365
  Homolog annotation: Hit_ID=NP_502032.1; Match level="QueryCoverage =95%, HitCoverage=29%, E-value=1e-105, Identity=43%"; Hit description= RetinoBlastoma binding protein Related (rbr-2) [Caenorhabditis elegans] pir||T27924 hypothetical protein
LFIWNNILSIFTVFSFCFSYKQQYFNLPIQEVPPDRPIQEVPPDRVEREFWRNVIDIDKGVQVKYGADLISSKVGSGFPRRDGVAADARERQQYANHPWNLHNLPKVRESVLCHMTTDISGMIIPWVYIGMLFSTFCWHVEDHWSYSINYNHWGERKIWYGVPGEEAELFDKVVKESAPELFMENKDLLHQMITHIESAPELFMENKDLLHQMITHINPQFLIDRGLHVYTVHQNAGEFVITFPRSYHAGFNEGLNCAEAVNFAPPDWVPMGRLCLENYANVGRTCVFSHMGRLCLENYANVGRTCVFSHEELVMKMVTVAHKLSIAMCMATLDELSWIVARETDFRHRLSIAGVCATAFCRFEDIPDDERSCAVCRTTLFCSGLCCRHDGRMVCAKHVQQLCTECSMEQYCLKFRYTLDDLVPLVHRLTERTTAFFEWRTTVTQLLNDTTKTPSTEADDNNSSSSNNIDGTTDGKLMKHIRFTIANF

SEQ ID NO: 127941 - protein, 70 aa, Heterodera glycines
  Coding regions on vcDNA: vcDNA=SeqID_54364; Strand=-; Position=1-213
MNISKKEENSSAKEWHQNYTEIGKKIGVSYGTIRKWKKQFGMNGGERLTEKEKMEKMKTYWQIKQKRIED

SEQ ID NO: 127942 - protein, 70 aa, Heterodera glycines
  Coding regions on vcDNA: vcDNA=SeqID_54365; Strand=+; Position=1-213
MRAFVSHCGLNSVSEAIQFGVPILAIPLLGDQLYNAIMARVKGIAVQLDIGQLNGEGAEQLLVDGIDKAN

SEQ ID NO: 127943 - protein, 335 aa, Heterodera glycines
  misc_feature (230)..(230): Xaa can be any naturally occurring amino acid
  Coding regions on vcDNA: vcDNA=SeqID_54366; Strand=+; Position=1 -36,92-145,190-313,422-556,607-720,766-816,880-921,1096-1159,1205 -1273,1317-1372,1423-1449
  Homolog annotation: Hit_ID=CAE66236.1; Match level="QueryCoverage =96%, HitCoverage=53%, E-value=3e-76, Identity=47%"; Hit description =Hypothetical protein CBG11480 [Caenorhabditis briggsae]
TNASQKRKEIYRYKASYKASFNVYAMGWSTKLDNHLKFRLAIGSFHLKFRLAIGSFIEEYNNKVSIVQLHEDQGEFGHLGTFDHPFFLFSVLWIPDPKSAFPDLLATTGDYLRIWRIGGHNGASLEVRLDNNRSSEYCAPLTSNRSSEYCAPLTSADWNEVDVSLIGTSSIDTTCTIWQIETGQAVANTEHAIGGNVKTGQAVANTEHAIGGNVKTQLIAHDKEVYDIEXKRNNPLKCKLTGADGSIRMFDLRHMEYSTIVFLRHMEYSTIVFEEPSKKPLLRLAWNKQDHNYLATFAQWNKQDHNYLATFAQNSNEIYILDIRIPIYILDIRIP

SEQ ID NO: 127944 - protein, 134 aa, Heterodera glycines
  Coding regions on vcDNA: vcDNA=SeqID_54367; Strand=+; Position=1 -123,423-704
MLSFRMISKMLDLDDIEKSYTKLSWKNMLAPKRARPNAVDPLFKDFFATSPTSHGRIELKTKAAETCGFLHYVTNCPLSVRNKDTWEPCLNVIIETHILAKILSLGVDKTKGRNLLVAIFFKYLMRRYLQSGPF

SEQ ID NO: 127945 - protein, 22 aa, Heterodera glycines
  Coding regions on vcDNA: vcDNA=SeqID_54368; Strand=-; Position=1 -16,60-112
MQTVKAYNLANNRPNKTILCSF

SEQ ID NO: 127946 - protein, 43 aa, Heterodera glycines
  Coding regions on vcDNA: vcDNA=SeqID_54369; Strand=+; Position=1-135
MIVINDAAQCSFSASNLPSISESKNLKARAKNGAKQTISSFTE

SEQ ID NO: 127947 - protein, 223 aa, Heterodera glycines
  Coding regions on vcDNA: vcDNA=SeqID_54370; Strand=+; Position=1 -153,420-938
MPKGKRTIPNLELHATMLCGKYINFVKIEFEKEIKIQNCTIWSDSTDVLDFINSAIKEKDFCEFEKHFKRFSKWDRLKNSIAYALRAFKKENQKKVSQNMEKISDIKNKKNGNEITKGIIKLIRPLEAKEIPKAEKLIFKLIQTNSSPTKSILRNLDLFKDEDDLWRTKGRILKSGLNYNTINPIFIPNNSYIATLLIRDAHMKTMHGGRELVNSKLRENLDS

SEQ ID NO: 127948 - protein, 282 aa, Heterodera glycines
  Coding regions on vcDNA: vcDNA=SeqID_54371; Strand=+; Position=1 -31,90-907
  Homolog annotation: Hit_ID=NP_496808.1; Match level="QueryCoverage =97%, HitCoverage=10%, E-value=2e-23, Identity=31%"; Hit description =integrase, catalytic domain containing protein family member (2N547) [Caenorhabditis elegans] emb|CAB0249
MLGSNIYMFNSFRRFIKRRRVPKLIISDNGTNFVLANKALKQIVLEENIQNKLWSEIYRDPTVQNFSSNLGIDWQFNSPYANWRGGAYERMIGLVKTHLIRSLGKQLLSFEELMTYLIEVERIVNERPLSYITQDEVIEPLRPIDILNPTDGEPFSLKLDPTFDRKDVNEYFEKKTKREELFEIYKKAIFKSEIFWKEWSEKYLLSLREKHINKNKEGNKYPKIGQVVIVRDQDNYPRSMWKLGKIFEILSDRTVKLKIGNRMAERPTKLLYPLEIEDEGEE

SEQ ID NO: 127949 - protein, 99 aa, Heterodera glycines
  Coding regions on vcDNA: vcDNA=SeqID_54372; Strand=-; Position=1 -90,136-210,397-531
  Homolog annotation: Hit_ID=NP_504172.1; Match level="QueryCoverage =98%, HitCoverage=28%, E-value=5e-10, Identity=36%"; Hit description =predicted CDS, putative protein family member, with at least 6 transmembrane domains (5E718) [Caenorhabdi
MFTKPVLFSGVYLSWFYNPYVGYTDDFGEIYSNTIASAHNYIVIIGLSSIYLLFPIFIQVIIISLFNSIASVIYISMQFVRISKIYIIVGTYAWVFSSG

SEQ ID NO: 127950 - protein, 76 aa, Heterodera glycines
  Coding regions on vcDNA: vcDNA=SeqID_54373; Strand=-; Position=1 -94,145-281
  Homolog annotation: Hit_ID=CAE58304.1; Match level="QueryCoverage =84%, HitCoverage=18%, E-value=6e-10, Identity=43%"; Hit description =Hypothetical protein CBG01414 [Caenorhabditis briggsae]
MNALETGILGIIGAVYCDYPLLIYTTGALGAALWYAETSVEMLLAINRCMELLRPELAFAIFSGQIFINIFIRRLE

SEQ ID NO: 127951 - protein, 208 aa, Heterodera glycines
  Coding regions on vcDNA: vcDNA=SeqID_54374; Strand=+; Position=1-629
  Homolog annotation: Hit_ID=NP_702063.1; Match level="QueryCoverage =98%, HitCoverage=4%, E-value=2e-22, Identity=20%"; Hit description =hypothetical protein PF14_0175 [Plasmodium falciparum 3D7] gb|AAN36787.1| hypothetical protein [Plasmodium
FQSLGLNSPAFQSLGLNSPAFQSLGLNPTAFQSLGLNPTAFQSLGLNSPAFQSLGLNSPAFQSLGLNPPTFQSLGLNSPAFQSLGLNSPAFQSLGLNSPAFQSLGLNSPAFQSLGLNPTAFQSLGLNPTAFQSLGLNSPAFQSLGLNSPAFQSLGLNPPTFQSLGLNSPAFQSLGLNSPAFQSLGLNPPTFQSLGLNSPAFQSLGLNP

SEQ ID NO: 127952 - protein, 443 aa, Heterodera glycines
  Coding regions on vcDNA: vcDNA=SeqID_54375; Strand=+; Position=1 -135,183-530,580-711,801-896,949-996,1059-1157,1214-1328,1379 -1430,1665-1725
  Homolog annotation: Hit_ID=CAE67946.1; Match level="QueryCoverage =94%, HitCoverage=35%, E-value=1e-100, Identity=49%"; Hit description= Hypothetical protein CBG13546 [Caenorhabditis briggsae]
TSEEQKSIKSIIHLHLPPTQRVAAGITVMNEAGLDPGIDHMLAMECIDKIHSYGGKVRSFVSFAGGLAMECIDKIHSYGGKVRSFVSFAGGLPAPEASDNALRYKFSWSPRGVLLAIMNPARYLFDSRVVDIGGGGEVLDDLYKIDFMPGFSLVGYANRDSTKYADIYGVSGECQTLLRGTLRYEGFVEAVKALGFVEAVKALKAIGYLSMERKDFLNPMQGPDMAWKQITASLLNQQPDIFPDSLMNFVAELLGKEKKRELKALDELGLFSEGIPFSEGIPERQITPLDTLVPHLAKALAYVPHLAKALAYEHGERDLVVLNHDIEAQLPAGTFERHRISLVAYGDPEGFERHRISLVAYGDPEGFSAMARTVGYTTAVVSHMILDGEIQQRGMLRPVSKAVYRGEIQQRGMLRPVSKAVYRPALQRLKEFGIKATTKVSVK

SEQ ID NO: 127953 - protein, 86 aa, Heterodera glycines
  Coding regions on vcDNA: vcDNA=SeqID_54376; Strand=-; Position=1-258
  Homolog annotation: Hit_ID=NP_593299.1; Match level="QueryCoverage =96%, HitCoverage=22%, E-value=2e-10, Identity=38%"; Hit description =farnesyl pyrophosphate synthetase [Schizosaccharomyces pombe] emb|CAB11097.1| SPAC6F12.13c [Schizosacchar
MVIKAQDDFLDCFGDPAITGKSNLTDLAERKCTWITCALVDKLSKTAPEKLAIFRENFGGKSEQQLKLARQIVLEEQIAQQFEHYQ

SEQ ID NO: 127954 - protein, 130 aa, Heterodera glycines
  Coding regions on vcDNA: vcDNA=SeqID_54377; Strand=-; Position=1 -28,75-187,234-260,321-344,389-432,536-777
FGTMVCVSKTPRSLPKKRRQSTEQNTDTPPNDHPEVKKAKIEDLLKKFSNGGFDQFWNEGFQPEEEPSPDFAIGISAKSQENAFFALRKKRKKKRKRTKNEWKRENEKTGGAAKQKAKLPENVQCVKYVY

SEQ ID NO: 127955 - protein, 36 aa, Heterodera glycines
  Coding regions on vcDNA: vcDNA=SeqID_54378; Strand=-; Position=1 -52,484-542
MLALLNASFILISIACARFKGRFSGAYFYEIFWVDS

SEQ ID NO: 127956 - protein, 112 aa, Heterodera glycines
  Coding regions on vcDNA: vcDNA=SeqID_54379; Strand=-; Position=1 -46,154-300,472-617
MSKSLVERMKNLLSTDFVNWSFFDCVFYFNPFKLMPAHKLILRSASEVFEAMFRFDSKNEKTEFASANCPVEVPDVEAAAFKVMLSFIYTEELSELDGDNAMAVLYAGEFYL

SEQ ID NO: 127957 - protein, 301 aa, Heterodera glycines
  Coding regions on vcDNA: vcDNA=SeqID_54380; Strand=+; Position=1 -118,165-254,361-548,877-977,1401-1537,1585-1705
  Homolog annotation: Hit_ID=NP_501713.1; Match level="QueryCoverage =47%, HitCoverage=87%, E-value=5e-20, Identity=36%"; Hit description =predicted CDS, ctr copper transporter family member (4K417) [Caenorhabditis elegans] emb|CAA92470.2| Hypo
SKFHSLQFPFIVFKMMWMFFHTQIKDTVLFKWWKVETVGSLLITCLVMYFGAICFEAIKWLTVGSLLITCLVMYFGAICFEAIKWLRLMLEQKSLPPISRRYAESLLSRVHLLQSVLFTVQLLLSYLLMLCFMTFSVWIGMAICAGAATGFWLFGRRVGLPFPLSLQFPSLPFVSLSLFFACCARPFGGLWNFQENLPFPSLSASSQLVSHFHLFQSLLHFIQFFLGFSLMLVAMTYNVPIFVALLLGHSIGYFLTAPLMTYNVPIFVALLLGHSIGYFLTAPLYRHGLAEENRTGGDCCC

SEQ ID NO: 127958 - protein, 1023 aa, Heterodera glycines
  Coding regions on vcDNA: vcDNA=SeqID_54381; Strand=-; Position=1 -825,875-964,1016-1160,1220-1317,1397-1668,2005-2257,2315-2755,2830 -2943,3004-3618,3678-3719,3782-3955
  Homolog annotation: Hit_ID=CAE71342.1; Match level="QueryCoverage =33%, HitCoverage=11%, E-value=2e-35, Identity=29%"; Hit description =Hypothetical protein CBG18244 [Caenorhabditis briggsae]
MTIHHHNLSSSAVASLPFNPPMLPAGGVHTQKRQQQSMDLEQDFKVQEARLEQLKKDKRALAARQRLLQKKTHPMAPEEANRHAEEVRAVQNNFEVAKKALQVQQRLVDKQRQRLKEQQQKQSQAISAQSTSVLADPNGSNTTTSNMTGTQHPSMIGQQQHSQQRQQKPMMVVGQQQQQLPTQIQQQKVVAERTRPPSTTTSNAQQHQQQPTTSGFLSSMHLVEQQQKVASQTSDHGQQRQQQTVTTPTLGEQKPIIGVGQQQQVKGTRGRKRKKPLPENVRSSVLGGVPFTALGTQLERDVYETVDILVGFVAAKMDSSSSSGAPADDNLLVQKILSQQNNTNNGINAIAQQWKVKKRRQTQTKTRSQPDTTNELDLIQERIKKTVELIPPINNYMEQYQANDKQMMKYPDQSALPDHEGSEPPLHGNATGEYTLPFMPDYYDELETVREYVDEETLLPPTMGEICWNVDLDALAKDTEDPSPSAVNGENSDDVKDFPPVACLSVTSAGGNNDEDEKLLNFLSIDQIGNRSKIVKSVTLLGAPGPSQETPLEPHWSRFDEEPRDLDRMVDVVLTVDPSVMPRDEFVDSLCQILGIPHIDHITELDTPPYTPDSPRNDGGGGGGYYQSLAEHNSTNQQQHKLYYHHQQQTIKSEIGETTVRTELTATNRNNGQGNGGGTICKHCNSVIPPGKTPIDDTHGRLGLLSESKDEKIHFCSMQCYYKFLALFRIPLSVESLEMAERYVDNVTLETLRQISADNFAKRINAGFTPQAKFLGEQQQHSSGAAASASIVQTATTSGANSTMTLTAATVTIDGGAAIAQREFLIKSSELPALLMIQQSMEKKRVAQALHDGGFKWRGFGWNICDTTLVQSFRRQYDGTKQVKSVAFCLDFLPFGCSLQQFAAVHLQTNEKRMNWSEDSRQCSFCEQIGDGDQRLTGRLLNVDANKWVHVNCALWSAEVHVAEDGGLINVEAALRRAKVTECRLCGLKGASIRCYKLDCANNELAFHLICAKHSHGHFVKDK

SEQ ID NO: 127959 - protein, 19 aa, Heterodera glycines
  Coding regions on vcDNA: vcDNA=SeqID_54382; Strand=+; Position=1 -21,315-353
MGVKLCCESGQKDAKNALT

SEQ ID NO: 127960 - protein, 156 aa, Heterodera glycines
  Coding regions on vcDNA: vcDNA=SeqID_54383; Strand=+; Position=1 -115,574-929
MIRKEKFQIILFLIISLCLAITLIKSACPTIVHPTAAEERKVGILSSSSPLAPNTSPETSIGNGIFEPHQHRRRWRRGKSAKKQFVRSLSSKSMKSSSYRTKSGRRVMEELLPKEVLKKKSFLEKLFGILSKNACHKNPSNFQGETKISAHKQTYI

SEQ ID NO: 127961 - protein, 16 aa, Heterodera glycines
  Coding regions on vcDNA: vcDNA=SeqID_54384; Strand=-; Position=1-49
EAIPEGFGLPINLGAS

SEQ ID NO: 127962 - protein, 95 aa, Heterodera glycines; identical to SEQ ID NO: 124528
  Coding regions on vcDNA: vcDNA=SeqID_54385; Strand=+; Position=1-656

SEQ ID NO: 127963 - protein, 38 aa, Heterodera glycines
  Coding regions on vcDNA: vcDNA=SeqID_54386; Strand=-; Position=1-116
MVSPPLGFDGSLRWEWHCCSGWAGHCQQQPPKATERQQ

SEQ ID NO: 127964 - protein, 31 aa, Heterodera glycines
  Coding regions on vcDNA: vcDNA=SeqID_54387; Strand=-; Position=1 -51,662-706
MYIYQNLFYNLGHKIPLKKINKSRLDQIFND

SEQ ID NO: 127965 - protein, 328 aa, Heterodera glycines
  misc_feature (3)..(3): Xaa can be any naturally occurring amino acid
  Coding regions on vcDNA: vcDNA=SeqID_54388; Strand=+; Position=1 -157,218-292,389-454,507-575,678-781,838-955,1011-1079,1141-1252,1323- 1425
  Homolog annotation: Hit_ID=CAE61120.1; Match level="QueryCoverage =96%, HitCoverage=53%, E-value=7e-52, Identity=38%"; Hit description =Hypothetical protein CBG04877 [Caenorhabditis briggsae]
ILXFQLIAFCAQIAPIFTMPISGELCTSSLGCPSVYYLHGIVTIILFTIFMLYHRNSPNKHPYHRNSPNKHPMMGKTEIMKVPKDKIKKKSRKVPYWAMYSDKSIWAILVASFGNFMGTQLSLVASFGNFMGTQLSLQFMPTYINKVLHMPIEQTGMASAISPAIMFFIKLFAGQSSDRIQFISFISDGRKLRIYNTLSLGMMGLLFIVLALLNPNKTPALCLVILIVSVILIVSTCILGFNSGGFFKSSQMVSRVSRQHSHFTLANISFLNCVSMLLVPLLNEIIAPENEPENNWAIVLWIHGIILLLTNAFFCAFASAKSAEWTKD

SEQ ID NO: 127966 - protein, 215 aa, Heterodera glycines
  Coding regions on vcDNA: vcDNA=SeqID_54389; Strand=+; Position=1 -3,183-824
  Homolog annotation: Hit_ID=NP_608540.1; Match level="QueryCoverage =88%, HitCoverage=63%, E-value=7e-23, Identity=36%"; Hit description =CG2839-PA [Drosophila melanogaster] gb|AAF51469.2| CG2839-PA [Drosophila melanogaster]
MTNPGIWAKLGPDISGSSKAGSGSKFLNRVREEQKVEEEQKVERNRKWKRKWKRNKSGRGKESGRGTERGRETECGRESVRGTESGRETESGRETESGRGTESGRESGRGTESGRESGRGIERGRETERGRESVRGTESVRGTESGRESGRGTESGREEEEQKVEEKQKVEEKQKVEEKVEEEQKVEEKVEERQKVEEEQKAEEKVEEEQRVEEK

SEQ ID NO: 127967 - protein, 125 aa, Heterodera glycines
  Coding regions on vcDNA: vcDNA=SeqID_54390; Strand=+; Position=1-378
MARQKLAQRRQFAGETLDEFAQEIRSLVAKAYPDNTLEMDLATLALGDRENEVKEENAKRIQQFRSEIARDFFRANMLPEIKERVMYMEEPQNLMEALTQAKRVEQIQGSLANDQWRMVQSSKSV

SEQ ID NO: 127968 - protein, 535 aa, Heterodera glycines
  Coding regions on vcDNA: vcDNA=SeqID_54391; Strand=+; Position=1-1608
  Homolog annotation: Hit_ID=EAL50634.1; Match level="QueryCoverage =79%, HitCoverage=68%, E-value=3e-50, Identity=37%"; Hit description =hypothetical protein 19.t00007 [Entamoeba histolytica HM-1:IMSS]
MSRHEAFIPEKARKSRDQSSPTPPPILVSISSDESAEEASEAGNQLKQQQRPVRPQDGRLHEFSMKEVRVLSTTDEKAKESIREKEIQELKQKLLLLEAEKASDARKAAKAKKEAEKRAKKEAEARVKREMEAKARKEAEEKAKKEAEAKAQREAEERAKKEAEAKAKREAEERAKKEAEAKAQREAEERAKREAEERAKRESEEKAQKEAEAKAKNNLRAPSEISLCEDELEWEEAEKKVLNILKKSSEIAKKKEEKKGEEKVARGIIRRKLTVKEKEEKAKKDSSEAAKRAENNAIEEGREEIRKIVREAEEEAKTKNEKIGERGPLIGENSKKLILDTMEQEYVPGKVVGYIEDPREEKEEEWDMARALKNRSKEDEVRIKKREQREEGWKELISGERKAKGRERPKLVEKFVKNLLGPAENDVSRNPGIPPPEGSRRGPTPIPCWNRYKKRPRFVSPIRNISPVRTRQSTVGTQTTNAWPSCTGDVVEQMQLMKTKLDELIAALKKREEEKNNGNNEQIGEKEEQQKENGK

SEQ ID NO: 127969 - protein, 158 aa, Heterodera glycines
  Coding regions on vcDNA: vcDNA=SeqID_54392; Strand=+; Position=1 -313,730-893
MNCSSNFFDFAATFVPVFFACKHAGTVLFAFQAKKVRRKLTINAPMYADVVENCETLRMIGCCCQFIPLSLPPMLCPMVALSVSGIVILSPVLKHWLIIRNANFSLTFEFCTSFVGDLTFGVILRLVFTAFSLEQINGDNVKEISSYEVDNVMGIAGG

SEQ ID NO: 127970 - protein, 92 aa, Heterodera glycines
  Coding regions on vcDNA: vcDNA=SeqID_54393; Strand=-; Position=1-278
MPIEPFELVNERTKEKLTLKQETEESSNEIIYNWLLKRCPIGETATAPVKWKNRENSGANFNYVRFALRHANYSDANLNNIRFDLWGANDPI

SEQ ID NO: 127971 - protein, 194 aa, Heterodera glycines
  Coding regions on vcDNA: vcDNA=SeqID_54394; Strand=-; Position=1 -11,98-671
MNRRWLCNDVWMDILPSFNYAKLGLKMALLSDRFDVLVDKHFDRKSELTIWRSVVIRKDKGPKANNIGPKPKVSILIGGYGKFVGFPLPDHPLPNKISFKNLQIQSSLTFVYAKAFFSCFRYIDYSVIKFLRSKKRFFDRNGTKLKVFVHSIDTDVQPIWDVFIREIWPIFATNIRHLGFDDGDALDKTSKRCV

SEQ ID NO: 127972 - protein, 43 aa, Heterodera glycines
  Coding regions on vcDNA: vcDNA=SeqID_54395; Strand=+; Position=1 -46,261-346
MQKNFNKNNKRELEQVNTYWNNNCFEFCNFYIHKTHGSTLETE

SEQ ID NO: 127973 - protein, 206 aa, Heterodera glycines
  Coding regions on vcDNA: vcDNA=SeqID_54396; Strand=-; Position=1-621
MKFCILLFLFLIALIIPIESEKKKLQQKSFDEIFGEKWQEKEEERRNELKKREIIGKYYKIKEKIKQKGRKYSAKEWDKINSKIAKKLGTNRKYIYKWIKEFGLQKQIQKSYKSKTDEQKLEFVQKFIEMKKEYKQKRKYSAKEWYQNYDEICKKIGVSQRIIEKWKKHFGIRSKITEEQKIEKMKIYWKIKSENPKMNDNKIAKT

SEQ ID NO: 127974 - protein, 96 aa, Heterodera glycines
  Coding regions on vcDNA: vcDNA=SeqID_54397; Strand=-; Position=1-291
MKLHQLFILIVFLIIELHQIKMENKKLQQKSFDAIFGEKWEEKEDKREIIEKYYKIKEKIKQKRRKYTAKEWNKINSKIALIFLKSLYIVNLFYFY

SEQ ID NO: 127975 - protein, 198 aa, Heterodera glycines
  Coding regions on vcDNA: vcDNA=SeqID_54398; Strand=-; Position=1 -509,555-639
MPEKIGHQNLLTLTPAGLGNWIFDPFQKELHPNIEQLNNLENALIAQIENAENNDSSTDASPPSAGGNASESLALSMKRRRRQSNQQNAKMIDDTDRVPKMKQQRQPKLAKSVPEIFAEEGEVASDEEELEEMEEEQLSALNRSLSVSAAQQWAGFDGRPIQIDTTDETNPLLLFASHAAARALNLRIPPRYFQRYQK

SEQ ID NO: 127976 - protein, 147 aa, Heterodera glycines
  Coding regions on vcDNA: vcDNA=SeqID_54399; Strand=-; Position=1 -6,198-633
  Homolog annotation: Hit_ID=AAC58118.1; Match level="QueryCoverage =87%, HitCoverage=11%, E-value=2e-23, Identity=44%"; Hit description =putative immediate early protein [Alcelaphine herpesvirus 1] pir||T03166 probable immediate early protein
MKRKEALYSLNNAWHNFLKAGEKMDGGDENEEEEESDEEESEEEEREEDESEEEREEEDEREEEESEEEREEEEEREEERSEEEREEEEREANDDEVVEESEVEDVDVDGVINGGDGAENGDGRGNGGGGNARGGSGGGGGGSGGGT

SEQ ID NO: 127977 - protein, 19 aa, Heterodera glycines
  Coding regions on vcDNA: vcDNA=SeqID_54400; Strand=+; Position=1-59
LIFGPLEVLQSDLKSIVNS

SEQ ID NO: 127978 - protein, 46 aa, Heterodera glycines
  Coding regions on vcDNA: vcDNA=SeqID_54401; Strand=-; Position=1-231
ILINIEIKTHKKIYSLLFRQLVKSFRMIPNLSRFDRFKKVRSVKSL

SEQ ID NO: 127979 - protein, 47 aa, Heterodera glycines
  Coding regions on vcDNA: vcDNA=SeqID_54402; Strand=+; Position=1-257
INKSHLIAPNSNYLPILRSKKNYLFVTLHIFSFISNLPIDSFFCAKI

SEQ ID NO: 127980 - protein, 195 aa, Heterodera glycines
  Coding regions on vcDNA: vcDNA=SeqID_54403; Strand=+; Position=1-588
MSPTACPLLKIHGSLQQKLSAKRTAAHLTTSPLSTIPTKRQQFLDGAAQLDITALLTSTEVSEPVRAVIRQLDALLKLAVDMVHKTSTQDTRAVLEEDRQEHSVVLMGVPESDSCLSSTRRAIADQQQVLDILDVCEIEAMPTKVYRMGQRKEGRPRLLKVEMPTRKMTQTFLRNKNRLKNSKFQAVSVRPVSLP

SEQ ID NO: 127981 - protein, 20 aa, Heterodera glycines
  Coding regions on vcDNA: vcDNA=SeqID_54404; Strand=+; Position=1-63
DYEEVAIDTVEGDGAGDDDY

SEQ ID NO: 127982 - protein, 217 aa, Heterodera glycines
  Coding regions on vcDNA: vcDNA=SeqID_54405; Strand=-; Position=1 -171,703-838,1072-1122,1210-1341,1779-1940
  Homolog annotation: Hit_ID=NP_496011.1; Match level="QueryCoverage =99%, HitCoverage=43%, E-value=7e-37, Identity=40%"; Hit description =glutathione synthetase (55.4 kD) (2J706) [Caenorhabditis elegans] emb|CAB01655.1| Hypothetical protein M1
YAFGDPKGIILFITHRRNRNRFAQRHIEYELWRLTKHKAETVRIGYPECTEMMKNGRLTLDDNFKLRFDDRTVAIVYFVTDFFKPSEDDWEMRLMIERSTAIKSPTSGLQLASMKKTQQVLAQPGMVERFLPENPKKAAAIRETFAGLWSLTDQDDAAIEATKDAIVNPSNYVLKPSKEGGGNNIWDDEITNKLLNFTSEERSAHILMQKLQPMFFK

SEQ ID NO: 127983 - protein, 62 aa, Heterodera glycines
  Coding regions on vcDNA: vcDNA=SeqID_54406; Strand=-; Position=1 -80,128-233
MAKKHTIVLTVVGVCIVVAVVAWGIIRSQLGGSNTSGIVTVPVQLYSSSILHIWLKTRSATQ

SEQ ID NO: 127984 - protein, 42 aa, Heterodera glycines
  Coding regions on vcDNA: vcDNA=SeqID_54407; Strand=+; Position=1-131
FSKSPNPTSHNSEQSTRTDLTSPEKQIGKARATKNNAAGNKR

SEQ ID NO: 127985 - protein, 80 aa, Heterodera glycines
  Coding regions on vcDNA: vcDNA=SeqID_54408; Strand=-; Position=1-306
LISSQKSCQLKTAKKAEFSKFFISIFFYSSKFSVIFSRLIEPVKSFRMISRLFDSVNNFKSYIYSKLAQTELARRSWPVP

SEQ ID NO: 127986 - protein, 31 aa, Heterodera glycines
  Coding regions on vcDNA: vcDNA=SeqID_54409; Strand=+; Position=1 -43,725-777
MCNIHKRGIDIGTMGFLAHKNPVSNNQYPAY

SEQ ID NO: 127987 - protein, 148 aa, Heterodera glycines
  Coding regions on vcDNA: vcDNA=SeqID_54410; Strand=+; Position=1 -30,648-782,832-903,1392-1601
MMEQLRHDETVSDLCSDVATKMDDQKQCVNTTTNNGLVHHRRLSSKLEWLVFLVEQCHSVASSNLSSLELSLAPSEAILKMEKSPETDNRSSVNKLPNSMREQLLCRILPMRKRRPKQLRFCQTTTAQSETELAMGQRKRRKPNGEKR

SEQ ID NO: 127988 - protein, 84 aa, Heterodera glycines
  Coding regions on vcDNA: vcDNA=SeqID_54411; Strand=+; Position=1 -175,224-304
  Homolog annotation: Hit_ID=NP_509390.2; Match level="QueryCoverage =85%, HitCoverage=34%, E-value=2e-17, Identity=52%"; Hit description =putative protein family member, with at least 3 transmembrane domains (XI852) [Caenorhabditis elegans]
IANCPFLFGRFFYFRRFSSPPKMGEVRFHSDYVSSTAESQIIQIVLGFVVCSVLCSNWYGGYSCFGEGRLGYVSGLNFVCLMIN

SEQ ID NO: 127989 - protein, 107 aa, Heterodera glycines
  Coding regions on vcDNA: vcDNA=SeqID_54412; Strand=+; Position=1 -120,551-673,724-804
MMWINTNRKLRRELGLENGNKNGEKKFLERQNTSKLIELQEFLIFYSMSIEQVFTFWSKTKENLINKKYDNNKCNFFLYAKVKKNLAEITRERMSEFVATRIELENM

SEQ ID NO: 127990 - protein, 193 aa, Heterodera glycines
  Coding regions on vcDNA: vcDNA=SeqID_54413; Strand=-; Position=1 -221,547-907
MDMVKEYMDLVQWVVEITIVPLVEQPILGIDPSAFLALLSQIQSQNIACFLISKQHKMDLDKLISMAGDYLQRALGATNKIRNIFIDAITEAMMHAENNGGQQNGPNLLIQNAKIYLKIYQTIAVCMLDEWVPMISAVPSIAYPWIAMKTFLRQSADQLSELIAEWKMAKEHQFSDRELEEKAIRKFFMKNCN

SEQ ID NO: 127991 - protein, 364 aa, Heterodera glycines
  Coding regions on vcDNA: vcDNA=SeqID_54414; Strand=-; Position=1 -811,1216-1499
QTGLNFGSSTDQNQVPNLGLNIGNVSNQQNFLATNQQFAHNNMAPKNSNIQSQMNTLGVQKKPKKQRNRRKLSQPTYLLESDAKNFANNVQYWTGGKFSNLLSNQTAGPSVPNTLNANQLNSMPGPSLGQEFQNYQLNSMPGPSFGQRNFQPNSMPGASLQQLQNYQLNSMPGPSLYQTWQNHETNPTPRRQFEQQNNTLHEIHLQSNMVNSLLCAQNEQQIGIGTSKQFTTVFGMQTPNIEHGNAGFYAELLTFINRLIESAAISSHNNVINVRRIVDLSLVCLDIMPHSVDTQLEFIKSNELTPNVVLYETRIGHNIDAAKVVNCLNERLIAAINAHECLEVFKPKVADIQREIELMFGQNQ

SEQ ID NO: 127992 - protein, 116 aa, Heterodera glycines
  Coding regions on vcDNA: vcDNA=SeqID_54415; Strand=-; Position=1 -71,117-396
MFVGCCAILWFYWNHFKKPPKKKIFISADCWLCVFDLLTPSQLGHGIAMISHRFGIYVDEHFKTRKWALKFIQIHSKIGENGTKEVEIVNDGGEALPIPQIEMPRKVIGFERISIL

SEQ ID NO: 127993 - protein, 59 aa, Heterodera glycines
  Coding regions on vcDNA: vcDNA=SeqID_54416; Strand=+; Position=1-260
GMCLGFAFRISHYSHFLAFRISLFAFRFLARNATFTPLRIGLNSHKIFQNFTYKLDNFQ

SEQ ID NO: 127994 - protein, 33 aa, Heterodera glycines
  Coding regions on vcDNA: vcDNA=SeqID_54417; Strand=-; Position=1 -98,526-529
MENAVAKTHSAIVRKWAALLALFSPALTLLLSS

SEQ ID NO: 127995 - protein, 37 aa, Heterodera glycines
  Coding regions on vcDNA: vcDNA=SeqID_54418; Strand=+; Position=1 -57,620-676
MPEEHQNEDGNKWNRNGPRHPTTRHLPWHFVLSLFWP

SEQ ID NO: 127996 - protein, 93 aa, Heterodera glycines
  Coding regions on vcDNA: vcDNA=SeqID_54419; Strand=-; Position=1 -18,65-328
MLFPIALWNLTHRLEIGLSRSNNSLEAWHNIWGALLEPNPLFSKFVKRMLKEFERWQHIVADFHNAPANGIRGKGLKRKSIYLQQEQFAATLR

SEQ ID NO: 127997 - protein, 129 aa, Heterodera glycines
  Coding regions on vcDNA: vcDNA=SeqID_54420; Strand=+; Position=1-390
MFFMYSQGTAGAQSAGDGKPAEPIAEATPPSADIAPSKNALGANSLKKSEYCCANVFQNEYLSCEFFLHVAAWPNGRSAAEESHWADGDGAGSGRNGAKGGRGTHSRAHGIVVHDEKAMGEVESADRNC

SEQ ID NO: 127998 - protein, 89 aa, Heterodera glycines
  Coding regions on vcDNA: vcDNA=SeqID_54421; Strand=-; Position=1 -56,94-196,1348-1458
MTFAFFEAPTLFLTVTLFQNNPTDGITVVDDGDTWSKVGKKGGWQKLSLGQRNFKGHGHPQPFLHAYNWAEGKAIIQRHCVNQPHVLAW

SEQ ID NO: 127999 - protein, 765 aa, Heterodera glycines
  Coding regions on vcDNA: vcDNA=SeqID_54422; Strand=+; Position=1-2298
MGQENKNLNTRVNYALYRLNAERRQQYEQIYVQACENTKFQLQLAKAILQINPNEGVRKIFDRDDLIARWVGENLEIGFCVPIIPEKIFWDHKVDGECFEWLPINAENVTFFVKPGTRELSVLGKRIDCEKVESNRIMDNETQLIIVGELSKNLEKIKPKYRNMQNPLILKAGTLFESENTRLEKAMLEYRSKINTLPSANLRAIQRPNISEVIRLIKEEANETLGAVFGKTGDWIDMVKNIPEKAREAVNHLKGISYLLILIPLLLLIALVTYFGIKYRVIICAGFRAGTLLVRIIRRILGMKRQKTRVAAVPTAPELDSMDQEAYVLDYLPPRRVAVITNDPRRLPSIHIQINGLSTTALVDSCASVSYCREKTALRAGLKISELNDEKVNLLTANDTKIQILGKTCAKIRIKDEMSGKIREWDAILLVSPDKHCPGPVLIGLPLLMELKGIISWAEKKVRLGEVWTNIISVVGAETSKPLRITMEKTEIFEPWTENIVMARVNEVFPSEQNFLVKGVQHQYPGIIVGRTLVAPGESKNVILQLMNAGKAPVKIYGNSHLADLETIKINALPGDEISPKDYIPPEARWSTKLPTLPKPGLNRPPSKRICLEGTKLSNSGQISLKNIVDKYSEAFVGDDGKIGLYNGPMQNVMAMLLSIRNKALDVHDEAQNAWNELMKMKGKGEKKEEEGMDSGLPGFSTADWQSDHDRWRGQNRWRGGRGARRWGQPWRGREWNQPNQGAGPSTSAASQEGQWNFSKMAGYG

SEQ ID NO: 128000 - protein, 39 aa, Heterodera glycines
  Coding regions on vcDNA: vcDNA=SeqID_54423; Strand=-; Position=1 -92,183-210
MAKEYSKYLCGFRQKENINCFDEHGQMVSFGFMQLTFVV

SEQ ID NO: 128001 - protein, 114 aa, Heterodera glycines
  Coding regions on vcDNA: vcDNA=SeqID_54424; Strand=-; Position=1 -30,324-638
MCACDQRIVMKPELDDVALQLSQNQFGQQLNQTVDGNGANGISGDCVSADQVPTTAQIIAMINQYSYTYNLINGKSSGVTVSDSSSNAEITSAIGTIMRQTSQLQQQLQSNSKK

SEQ ID NO: 128002 - protein, 79 aa, Heterodera glycines
  Coding regions on vcDNA: vcDNA=SeqID_54425; Strand=+; Position=1 -56,129-312
MFLSAQSVAELFSIRNWLRFLVVRQRIPHLILGIQFAWVVEEKKKKQKSSANAISPKKRCRTICNKMLTVFGIKKLGKK

SEQ ID NO: 128003 - protein, 49 aa, Heterodera glycines
  Coding regions on vcDNA: vcDNA=SeqID_54426; Strand=-; Position=1-150
SDECPLGRLRTFGVALGDEVQDQNLMLDRIQKKTERNDGVIRSQEDQMR

SEQ ID NO: 128004 - protein, 29 aa, Heterodera glycines
  Coding regions on vcDNA: vcDNA=SeqID_54427; Strand=+; Position=1-87
MARAHLAALKWLALSWPCTPPIGIDFIAR

SEQ ID NO: 128005 - protein, 47 aa, Heterodera glycines
  Coding regions on vcDNA: vcDNA=SeqID_54428; Strand=+; Position=1-643
KWREIARQREWRGRVAARDKGNGEFGWREGKGGQINKSINGISQFLT

SEQ ID NO: 128006 - protein, 59 aa, Heterodera glycines
  Coding regions on vcDNA: vcDNA=SeqID_54429; Strand=-; Position=1 -60,477-596
MHSDKEPEKTAQLFTMESDFKINCFANSIKQAITFSIFLMSTLSRRHIQFHNGIIKSIE

SEQ ID NO: 128007 - protein, 139 aa, Heterodera glycines
  Coding regions on vcDNA: vcDNA=SeqID_54430; Strand=-; Position=1-420
MGAGPDKEAMQKALLTSHAVPMPSDMVQLFIQLWHSSKFGAVPQQLRAIKCPSRSRRRRKRQNGGDLSLFDLVMFIVSVYVASYVVELLKNLLEKGNDFLEFNIVSISITIFIFAFIRQQPMPKLGAKFIAERIIERLG

SEQ ID NO: 128008 - protein, 50 aa, Heterodera glycines
  Coding regions on vcDNA: vcDNA=SeqID_54431; Strand=-; Position=1 -55,175-272
LHRIAEKIRDQFPNVDRLIAKTKAVFVKAPYRVKKFGNISHMQFQLINLK

SEQ ID NO: 128009 - protein, 26 aa, Heterodera glycines
  Coding regions on vcDNA: vcDNA=SeqID_54432; Strand=+; Position=1 -33,372-419
MSAIVPHFPSTKLTQVVLLVHHRIFH

SEQ ID NO: 128010 - protein, 40 aa, Heterodera glycines
  Coding regions on vcDNA: vcDNA=SeqID_54433; Strand=+; Position=1 -77,439-484
MPRIIIFFKIKVLVRNCVTAQTFYFRLTEKTLGFQMVPRM

SEQ ID NO: 128011 - protein, 184 aa, Heterodera glycines
  Coding regions on vcDNA: vcDNA=SeqID_54434; Strand=-; Position=1 -93,542-807,1335-1530
MPSSDGKSPPSSEQSNVLSLAFRLCWSLSVEKKFFFNLFPVVLCLDCVSLAVFCPVPVSTTPTRTAAGVRCVAARNAGVAAVPTLTARRAEPAMVGTVARPSIARCAVAGVHGGKFGLARAAASARATAVHHRHRFILITSVGIVPSCDNCLCNEQPLQCAVINATAKPTATTVCVQERYSESR

SEQ ID NO: 128012 - protein, 55 aa, Heterodera glycines
  Coding regions on vcDNA: vcDNA=SeqID_54435; Strand=+; Position=1 -24,75-142,665-740
MYPWDYIEKVFVWFRKFFCSGESKKFTQEQRLLQNKGSADNFPILRRGLRPCKLM

SEQ ID NO: 128013 - protein, 51 aa, Heterodera glycines
  Coding regions on vcDNA: vcDNA=SeqID_54436; Strand=-; Position=1 -112,514-557
MTALMVDAKMHFDHRVGWSLVSMRSMGAVRTKCDPFFVELLGTGTGTGTDR

SEQ ID NO: 128014 - protein, 39 aa, Heterodera glycines
  Coding regions on vcDNA: vcDNA=SeqID_54437; Strand=+; Position=1 -90,1095-1124
MKNPCCKALRIYEEQFMVFCVMCPYVKSDDADKEIYVDN

SEQ ID NO: 128015 - protein, 75 aa, Heterodera glycines
  Coding regions on vcDNA: vcDNA=SeqID_54438; Strand=-; Position=1-228
MSLPTKATTPITTNVPSKAEAKGGQNGTIWIVAIVAIVAIVAIAIFVAVAVTAVAVPTITTIVAALTQSVALFCG

SEQ ID NO: 128016 - protein, 39 aa, Heterodera glycines
  Coding regions on vcDNA: vcDNA=SeqID_54439; Strand=-; Position=1-117
MLKSANELVDNASKLPLEKQNATKMFELVKPNLFGIVCD

SEQ ID NO: 128017 - protein, 31 aa, Heterodera glycines
  Coding regions on vcDNA: vcDNA=SeqID_54440; Strand=-; Position=1-93
QSHFLPQFVQQQHLSASQFPQWQFAGPKLSV

SEQ ID NO: 128018 - protein, 131 aa, Heterodera glycines
  Coding regions on vcDNA: vcDNA=SeqID_54441; Strand=+; Position=1 -165,525-755
MHFFPAIANLYFVGVYSRNVVPHILIVERILATVFVRSYEHWRGYLFTIIWAPIALTVCIYIAFTTSPHSVRPLANLITTAVEVLTGSVELAIFMKLCAYNLKIYQKMMQNEGQHSLSLRYQAILNFSNLI

SEQ ID NO: 128019 - protein, 192 aa, Heterodera glycines
  Coding regions on vcDNA: vcDNA=SeqID_54442; Strand=+; Position=1 -261,505-819
MCAKSDKLPPSSAASSFSSPAYGRPPSAFTAASLNRAGSPYSMGGGSEYGGRRKGVSWSDVVEEPKPTTRTRSDSPPPASFIRHSMPQNPFDRADGWVSSNPWTGSLDHRGGRSRDKERQGPGSFFKPDLPTYSALGRSPDNFNPFQTHLHREEAKGLRKSQEREELIKFHSYGDHKVSGIEMKPKGWTGGE

SEQ ID NO: 128020 - protein, 44 aa, Heterodera glycines
  Coding regions on vcDNA: vcDNA=SeqID_54443; Strand=-; Position=1 -100,410-444
MFVKCWIVNCNIKCLAQMFCSNCKMFVKCWIVNLIVKCLSNVGL

SEQ ID NO: 128021 - protein, 258 aa, Heterodera glycines
  Coding regions on vcDNA: vcDNA=SeqID_54444; Strand=-; Position=1 -154,233-644,773-983
MTMLRLLRIVKGACFLRQNLNQMIIGEFYRKWVHNCANGCVLPENIGCCENATVTPDKHWRHRNDELCSPCAELGLIRLPTVEDFSACSTLERSPKSARGAYGGTFPPDTVPSPDSAAGGAPLAPHEEPLSASVTPLPPTESERSNNDGTSAKKMVNTVVPIGTVALLEYWEIRHYPDSFWHRNAKDFRFPSNSRPSMAMALFHWKCPRVLPQLLRWHRTLPRPHVHCICSPICPRLVRPHRMNVAQLMESNENKLEI

SEQ ID NO: 128022 - protein, 456 aa, Heterodera glycines
  Coding regions on vcDNA: vcDNA=SeqID_54445; Strand=+; Position=1 -556,755-1569
  Homolog annotation: Hit_ID=AAO52302.1; Match level="QueryCoverage =97%, HitCoverage=62%, E-value=8e-15, Identity=19%"; Hit description =similar to Homo sapiens (Human). Dentin sialophosphoprotein precursor [Contains: Dentin phosphoprotein (De
MILPAVRNQPSNSDQTKQLSVNDDSNMLMRVNPANNLPEVIASVTNSQQLTDQNNQPLTENPTDQSVRSNQNNQHEIQEILHLPMKNQQNNKRAAAPNSRQEFGFDLEKVPKAKKGKGLAEWLGHSIDQKQKIAVENASEQPTITDHINLSSQTTQLNNLNNPTTNQSVVDLSDKTLSTRQTNEVGQNQTNNDNHSEQSQPVTQQIKDAQTQILPKPDGLLGWLYRNMDNSENHDNSFDQSNCPSQKNQTNYSADTSTDLLMLPNTVNHYIHSNPMMTLSQQNYYNQENPSTSTNQSTYPDHANTMALNNQSIYADQANTYALNNHSTFSDQTNSLALNNQSNYPDQANSLAMNNQSNYPDQANSLALNNQSNYPDQANTLALNYSDQANPLALGNQSTYPDRSLFMANQNNEVNGLIPTIDSDQTDQTILQSNKGSTDNNCSKMCKFSREMFRQC

SEQ ID NO: 128023 - protein, 159 aa, Heterodera glycines
  Coding regions on vcDNA: vcDNA=SeqID_54446; Strand=+; Position=1 -184,231-512,1174-1187
MADNDEEHERLAEQGREWKAARRAESIANLFGGAPPPAQDEEDEDEEVEDEGVEDEQRPRRARSAGRRGGDEDEEEDEGGRGRPRRRGSYFFSCFLKLMLAEQGREWKAARRAQSIGNLFAGAPPPPPAQEEEEGVEEEVEEEEVEEEEDNRPRRVEII

SEQ ID NO: 128024 - protein, 48 aa, Heterodera glycines
  Coding regions on vcDNA: vcDNA=SeqID_54447; Strand=-; Position=1 -37,565-674
MATNYIKYRSYLFFKDSYKVLPLSVFDLTINEARKKRKEPMIMNQLKN

SEQ ID NO: 128025 - protein, 173 aa, Heterodera glycines
  Coding regions on vcDNA: vcDNA=SeqID_54448; Strand=+; Position=1 -53,166-295,351-372,428-559,957-1141
  Homolog annotation: Hit_ID=AAN78250.1; Match level="QueryCoverage =95%, HitCoverage=47%, E-value=3e-49, Identity=56%"; Hit description =ODR-3 [Caenorhabditis briggsae] emb|CAE64644.1| Hypothetical protein CBG09409 [Caenorhabditis briggsae]
MPCCEKILKNKLENFKRIVFDVGGQRSERRKWIHFFDDVNAIIFVAAINEYDQKLREDNKTNRLIEAMELFDGIANSKFFTKSSMILFMNKKDLFEEKIKRVSLNILFPSYKGDLTYEDGVAYLRVKFRKLYRNKRSLYIHETFATDTNQINTVFRSVLDTILQENMQDTGML

SEQ ID NO: 128026 - protein, 1899 aa, Heterodera glycines
  Coding regions on vcDNA: vcDNA=SeqID_54449; Strand=+; Position=1 -370,433-1461,1524-2347,2427-2745,2810-3633,3713-4031,4096-4919,4998 -5316,5380-6203,6726-6773
MVNISINIGSIFLFAFATSLCGGKPNDDKNAASSSSVPSETENPKNEESKKNLVIITDMGADDQFTLEMISATELAGKVLAIGTTEKGRKAALSQSLGFEKVPVYVRSSGEEYEKMLFMNPNQKDTKREENEFQHFLKNLLDERLKTNAMKVHFLVLAPPIDLSAVLLENRQLAKAVGQIHITDGCKNCQELQPPTPLSLNNFLRQLPREHTKPTTYNVSMDALATVYLLEMAANGEVNVLLVSSSLLAEKFGDGVEFGKKFPNLKLTRKKKTLGFKIIVEREKKCQQKPHIDEQFSAAGPIAVLAIMDMTNVRVDGVPESDNFVLFTTQSKKVSLITPKSGEQKPEHGEYQVEIGIKKATKIRLLVNFNVDTFGNAMTLILEKINKQRQEAKRNLVIITDMGVDDQVALAMISATELAGNVLAIGTTEQGKEAALAQSLGFEKVPVYVRSSNEELEKMVFMNPNQKDTKREENEFQHFLKNLLDERLKFMGVKVNFLVLAPPTDLTAVLLRNKKLAEAVGEILITGECKNCQDLQPPAPLSLNKFLWELPREHTKPTTYNVSMDALASLYLFEMASNGEVNVLLVSSRLLAEKFGAEDNFDKRFPKLKLISKKTMGAKIIVNREEEFEQKPHIDQQFSAAGPIAVLAIMDMTNVRVDRVPESDNFVLFTTRSKKVSLITPKSGEQKPEHGEYQVEIGIKQATKIRLLVNFNVDTFGNAMTLILDKSNKQWNYKISSEKQKGKEKNQDPNDEKNTASSSSVPSEKENPKNEEAKKNLVIITDMGVDDQVALAMISATELAGNVLAIGTTEQGKEAALAQSLGFEKVPVYVRSSNEELEKMFFMNPNQKNQKREENEFQNFLQNLLDERLKFMGVKVNFLVLAPPTDLTAVLLENKKLAEAVGEILITGECKNCQDLQPPAPLSVNKFLWELPREHTKPTTYNVSMDALATLYLFEMASNGEVNVLLVSSRLLAEKFGAEDNFDKRFPKLKLISKKTMGAKIIVNREEEFEQKPHIDQQFSAAGPIAVLAIMDMTNVRVDRVPESDNFVLFTTRSKKVSLITPKSGEEKPKHGGYQVEIGIKQATKIRLLVNFNVDTFGNAMTLILDKSNKQWNYKISSEKQKGKEKKQDPNDEKNTASSSSVPSEKENPKNEEAKKNLVIITDMGVDDQVALAMISATELAGNVLAIGTSEQGKEAALAQSLGFEKVPVYVRSSNEELEKMFFMNPNQKNQKREENEFQNFLQNLLDERLKFMGVKVNFLVLAPPTDLTAVLLKNKKLAEAVGEILITGECKNCQDLQPPAPLSLNKFLWELPREHTKPTTYNVSMDALATLYLFEMASNGEVNVLLVSSRLLAEKFGAEDNFDKRFPKLKLISKKTMGAKIIVNREEEFEQKPHIDEQFSAAGPIAVLAIMDMTNVRVDGVTESDNFVLFTTRSKKVSLITPKSGEEKPNHGGYQVEIGIKQATKIRLLVNFNVDTFGNAMTFILDKSNKQWNYKISSEKQKGKEKNQDPNDEKNTASSSSVPSEKENPKNEEAKKNLVIITDMGVDDQVALAMISATELAGNVLAIGTTEQGKEAALAQSLGFEKVPVYVRRSNEELEKMFFMNPNHKNQKREENEFQNFLQNLLDERLKFMGVKVNFLVLAPPTDLTAVLLENKKLAEAVGEILITGECKNCQDLQPPAPLSLNKFLWELPREHTKPTTYNVSMDALATLYLFEMASNGEVNVLLVSSRLLAEKFGAEDNFDKRFPKLKLISKKTMGAKIIVNREEEFEQKPHIDEQFSAAGPIAVLAIMDMTNVRVDGVTESDNFVLFTTRSKKVSLITPKSGEEKPKHGGYQVEIGIKQATKIRLLVNFNVDTFGNAMTLILDKSNKQWNYKISSEKQKVEHEAERYPAREFTI

SEQ ID NO: 128027 - protein, 47 aa, Heterodera glycines
  Coding regions on vcDNA: vcDNA=SeqID_54450; Strand=-; Position=1 -70,141-214
MNFYNSNITVFLVIFALTGICKFGTIASPVHNEEAELKNTQPIFEIG

SEQ ID NO: 128028 - protein, 692 aa, Heterodera glycines
  Coding regions on vcDNA: vcDNA=SeqID_54451; Strand=+; Position=1 -370,433-1461,1524-2203
MVNISINIGSIFLFAFATSLCGGKPNYDKNAASSSSVPSETENPKNEEAKKNLVIITDMGADDQFTLEMISATELAGKVLAIGTTEKGRKAALSQSLGFEKVPVYVRSSGEEFEKMLFMNPNQKDTKREENEFQHFLKNLLNERFKTNAMKVHFLVLAPPIDLSAVLLENRQLAKAVGQIHITDGCKNCQELQPPTPLSLNNFLRELPREHTKPATYNVSMDALATVYLLEMAANGEVNVLLVSSSLLAEKFGDGVEFGKKFPNLKLTRKKKTLGFKIIVEREKKCQQKPHIDEQFSAAGPIAVLAIMDMTNVRVDGVPESDNFVLFTTQSKKVSLITPKSGEQKPEHGEYQVEIGIKKATKIRLLVNFNVDTFGNAMTLILEKINKQRQEAKRNLVIITDMGVDDQVALAMISATELAGNVLAIGTTEQGKEAALAQSLGFEKVPVYVRSSNEELEKMVFMNPNQKDTKREKNEFQHFLKNLLDERLKFMGVKVNFLVLAPPTDLTAVLLRNKKLAEAVGEILITGECKNCQDLQPPAPLSVNKFLWELSREHTKPTTYNVSMDALATLYLFEMASNGEVNVLLVSSRLLAEKFGAGDNFDKRFPKLKLISKKTMGAKIIVNREEEFEQKPHIDEQFSAASPIAVLAIMDMTNVRVDGVTESDNFVLFTTRSKKVSLITPKSGEEKPKHGG

SEQ ID NO: 128029 - protein, 37 aa, Heterodera glycines
  Coding regions on vcDNA: vcDNA=SeqID_54452; Strand=+; Position=1 -66,589-636
MTLILDKSNKQWNYKISSEKQKVEHEAERYPAREFTI

SEQ ID NO: 128030 - protein, 47 aa, Heterodera glycines; identical to SEQ ID NO: 128027
  Coding regions on vcDNA: vcDNA=SeqID_54453; Strand=-; Position=1 -70,141-214

SEQ ID NO: 128031 - protein, 130 aa, Heterodera glycines
  Coding regions on vcDNA: vcDNA=SeqID_54454; Strand=+; Position=1 -54,111-256,302-383,438-506,558-599
  Homolog annotation: Hit_ID=NP_491672.1; Match level="QueryCoverage =99%, HitCoverage=30%, E-value=3e-54, Identity=79%"; Hit description =proteasome Regulatory Particle, ATPase-like, S6a (48.1 kD) (rpt-5) [Caenorhabditis elegans] gb|AAC19196.1
MLELLNQLDGFQPNDDIKVIAATNRVDVLDPALLRSGRFDRKIEFPAPNEKGREQILRIHSRRMNVDKNVNFVELSRCIEDFNGAQCRAVCVEAGMVALRRDSTKILHEDFMDGILEVQCLKKNNLVYYG

SEQ ID NO: 128032 - protein, 28 aa, Heterodera glycines
  Coding regions on vcDNA: vcDNA=SeqID_54455; Strand=+; Position=1-87
FRPYFANFLPLFRSLNWNFSPLKIRTLI

SEQ ID NO: 128033 - protein, 197 aa, Heterodera glycines
  Coding regions on vcDNA: vcDNA=SeqID_54456; Strand=-; Position=1 -63,123-211,269-399,467-614,697-768
  Homolog annotation: Hit_ID=CAE72754.1; Match level="QueryCoverage =100%, HitCoverage=13%, E-value=7e-50, Identity=46%"; Hit description= Hypothetical protein CBG20003 [Caenorhabditis briggsae]
VVHDIYECKHNTKGLNCEQCQDLYNDLPWRPGDLYNDLPWRPGSGEQSKERGECECNGHVPRCHCHFDWSVYNSTAFASGGVYDNCQQNTRDRNCEKCKLYFYKQSQSSLQDPNVCRPCQCDKRSLQDPNVCRPCQCDKRGTQNDGTCVAEDDTAHQLVAGQCLCKENVQGKNCDRCKDGFCDLSEDNSKGCKKCHC

SEQ ID NO: 128034 - protein, 89 aa, Heterodera glycines
  Coding regions on vcDNA: vcDNA=SeqID_54457; Strand=-; Position=1 -39,457-687
MPRIADRGRAPPLGRSGPGLFGLKNRDFLAGKTGKKPGNFPVPFKTGQNRDFGTQLYSVVRGLVPVPTHSIFCSNKMSDNRKEAEAKAM

SEQ ID NO: 128035 - protein, 377 aa, Heterodera glycines
  Coding regions on vcDNA: vcDNA=SeqID_54458; Strand=+; Position=1 -161,235-522,572-1010,1121-1366
  Homolog annotation: Hit_ID=AAL78214.1; Match level="QueryCoverage =42%, HitCoverage=80%, E-value=4e-12, Identity=28%"; Hit description =putative esophageal gland cell protein Hgg-20 [Heterodera glycines]
MASAVKKRKKFSSDNRRLISSTGIGENEQQKSLGKRRILFRHAKKMNNRILRKIWICTDVLMDILPFFDHAQLGLKLALISPRFDVLVDTHFDGKSEWPIWKLVEIHKDRGSEPKLRVFTSYVDFTNIMNFPLPDRPLPEKTRFKRLVIMYIDHSVIAFLRSNKQIFNGTRFALSLSVQASKNAAQPIWDVLAREIWPIIAPNIRRLYVPDADHLDNLRSRTSPTILTDFNINSILSGHLLPDVLDDFDGPNATASAGQSLSKWLHTPTTDGKPKRLRCDDFNGQGNAEWVHNFKEPFLRATSSVCYIIQFFAFSSTPIVPFELLNERTNEKLTLTMSTEYIWLLMRCQIGQTFQWDAKNLNFFVGIHLYGYKKCIG

SEQ ID NO: 128036 - protein, 67 aa, Heterodera glycines
  Coding regions on vcDNA: vcDNA=SeqID_54459; Strand=-; Position=1 -62,940-1081
MNAGIWPFMKSLFVIFVLVFGDAFGFYSIPQIKNKILGLKICKRLYNQNLHILEKTNVNKKFSYVLL

SEQ ID NO: 128037 - protein, 273 aa, Heterodera glycines
  Coding regions on vcDNA: vcDNA=SeqID_54460; Strand=-; Position=1-833
  Homolog annotation: Hit_ID=XP_311331.1; Match level="QueryCoverage =99%, HitCoverage=99%, E-value=4e-41, Identity=40%"; Hit description =ENSANGP00000001657 [Anopheles gambiae]
ENCSSSNHSSSSDHCCTSSNNCTSSNDCCTSSNHSCTSSNHFCTSSNHSCTSSNHFCTSSNHCCTSSNDCCTSSNHSCTSSNHCCTSSHHFCTSSNHCSSSFNHYCTSFNHCSSSFNHCCTSSNHSCTSSNHFCTSFNNCTSSNDCCTSSNHSCTSSNHFCTSSNHSCTSSNHFCTSSNNCTSSNDCCTSSNHSCTSSNHFCTSSNHSCTSSNHFCTSSNNFTSSNDCYTSSNHSCTSSNHFCTSSNHSCTSSNHFCTSSQKSTSSNDCCTSS

SEQ ID NO: 128038 - protein, 75 aa, Heterodera glycines
  Coding regions on vcDNA: vcDNA=SeqID_54461; Strand=+; Position=1-228
MPKVEGEPEKKRLKSRGNQRKRDSKAEGTREKETQKQREPEKKRLKSRGNQRKRDSKAEGTREKETEDNANRNMI

SEQ ID NO: 128039 - protein, 46 aa, Heterodera glycines
  Coding regions on vcDNA: vcDNA=SeqID_54462; Strand=+; Position=1 -88,283-335
MLKKKRQCIKGGKERKKIVREKSEMKREIVFMLYLFGYLSNCQAIA

SEQ ID NO: 128040 - protein, 85 aa, Heterodera glycines
  Coding regions on vcDNA: vcDNA=SeqID_54463; Strand=+; Position=1-256
MIGRAVRNRPFIFEGIFKFILYPRKMAISFFEKFYTSQKRLRMRRRAVHNRHFISQRIFIFRGYPKNAISFLIILYTYNALEHDR

SEQ ID NO: 128041 - protein, 92 aa, Heterodera glycines; identical to SEQ ID NO: 125147
  Coding regions on vcDNA: vcDNA=SeqID_54464; Strand=+; Position=1-304

SEQ ID NO: 128042 - protein, 18 aa, Heterodera glycines
  Coding regions on vcDNA: vcDNA=SeqID_54465; Strand=-; Position=1-54
MWIPDNRTVDNPTLDNPT

SEQ ID NO: 128043 - protein, 400 aa, Heterodera glycines
  Coding regions on vcDNA: vcDNA=SeqID_54466; Strand=+; Position=1 -140,251-553,607-740,953-1095,1231-1415,1537-1669,1876-2012
  Homolog annotation: Hit_ID=NP_498516.1; Match level="QueryCoverage =100%, HitCoverage=15%, E-value=1e-130, Identity=56%"; Hit description=NOT-like, component of CCR4/NOT complex (ntl-1) [Caenorhabditis elegans] gb|AAA21168.1| Not-like (yeast
KKILAILTTALNNDHEQQKFAFNGLPFHWIVVIVMKELPSTDAVLYLHCSCTLLFVPFRQVLFLLQPRRVPGFAYHWLDIIGHRNFIGRLLSESRDLARTSAIYTQLLLCHLKFLAPFLRNVQLPKPIAYIYKGTLRVLLVLLHDFPEILCEYYYILILCEYYYILCDVIPANCVQLRNLVLSAYPCDMRLPDPFTETMARIECLPEMSNHPKMHREMTNVVPSELRKRIDAYLETRSVVYLSDLPSMLSSFTTTTTKYSISVVNAVVMYVGVRAIDSIHGKGQRVSMETIAHSPFMDIFQNLAVSLCNEGRYLLFNAIANQLRYPNSHTHYFSCTLLYLFLGANSKHIQEQITRILFERLVALRPHPWGLLITFIELIRNQRYGFWKHEFVYCATEIER

SEQ ID NO: 128044 - protein, 328 aa, Heterodera glycines
  misc_feature (1)..(1): Xaa can be any naturally occurring amino acid
  Coding regions on vcDNA: vcDNA=SeqID_54467; Strand=-; Position=1 -183,293-443,487-631,694-845,896-970,1026-1095
  Homolog annotation: Hit_ID=XP_308252.1; Match level="QueryCoverage =90%, HitCoverage=48%, E-value=5e-72, Identity=49%"; Hit description =ENSANGP00000010942 [Anopheles gambiae]
XTLILRKNRQIDKCKAKWIDRLAESVAIRSVSPSAEHRQEVFRMIDWTEKALLRIARNKQKNPLGTETLSDGTTLPLPPILFGTLGTDKNKRTLLVYGHLDVQPAAFEDGWNTEPFQLIEKDGKLFGRGSNTEPFQLIEKDGKLFGRGSTDDKGPVLGWLNVIETMQGLGIDMPINIKFVFEGMEECGSFVFEGMEECGSDGLDECLEQRKDFLSGVDFVCISDNYWLGKQKPCITYGLRGLSPFAIEISGPNQDLHSGVYGRGLSPFAIEISGPNQDLHSGVYGGTIHEPMNDLCWLLSQLTDTKHEPMNDLCWLLSQLTDTKANIL

SEQ ID NO: 128045 - protein, 125 aa, Heterodera glycines
  Coding regions on vcDNA: vcDNA=SeqID_54468; Strand=-; Position=1 -200,259-436
  Homolog annotation: Hit_ID=NP_502044.1; Match level="QueryCoverage =76%, HitCoverage=22%, E-value=6e-26, Identity=51%"; Hit description =aquaporin family member (4L724) [Caenorhabditis elegans] emb|CAA22259.1| Hypothetical protein Y69E1A.7 [C
MLCFIIGIITDKHAQIPRVAQPAMMGLMLTAINMAFGLNAGNAANPARDFGPRLFTLLAGYGWEVFSYNSFGWFWVPIVCPFFGAIVGTLAYQLLVSAQFGPTKEGKLLENSTNSSAEPSLAKAQ

SEQ ID NO: 128046 - protein, 230 aa, Heterodera glycines
  Coding regions on vcDNA: vcDNA=SeqID_54469; Strand=-; Position=1 -231,291-367,452-513,557-876
  Homolog annotation: Hit_ID=NP_502553.2; Match level="QueryCoverage =93%, HitCoverage=26%, E-value=5e-20, Identity=31%"; Hit description =beta-lactamase-like (79.3 kD) (4O40) [Caenorhabditis elegans] emb|CAC44310.2| Hypothetical protein Y67H2A
MLIHPFFCSAYTDLANSRLSQRESVFYDGSFPLLLHNLRLLSSDAIVSNSDEASTSDKQQKESKNGGTPTYVVKMFRDEITINFYSVQHIVIVEWMSNPVNDLFADATLSAILHAQTNPILDKNVPKDFGAKAQQIEQNLESILVGTLCELCGDKSLVEVKEEENQGEKDAAAEESDKKEGKRRRVIQLELDGKKACICPVSLQITECEDQLLHHLLSSLTQKVAHGILP

SEQ ID NO: 128047 - protein, 287 aa, Heterodera glycines
  Coding regions on vcDNA: vcDNA=SeqID_54470; Strand=-; Position=1-864
MGWSTPADAECQFEHMNTWDGQFHPSENVWTHKEIALSFDGKAQKIKDCDRTLVATDQGFAVDAGMFLNMINNANGPSGVPKKGQSPGGAQKRSLLPVDQFSADTNMRLEMMKQNANQTKAIIPKSVAAAPKTEVPKPAAPRPTVGPAKPEQPSRKAQLQPVKLPTPKQAAPIQKAIKPKTTTTAQKYQPPRPTTSPKAEPPKPIVAVPKVPSPVTTQTIQPTSPSEGQPKSRNRGRFRTRYVVRRNQSEPEKLRIYDSPRQKRATVHTEQLASQLTASQVNTMVQL

SEQ ID NO: 128048 - protein, 154 aa, Heterodera glycines
  Coding regions on vcDNA: vcDNA=SeqID_54471; Strand=-; Position=1 -168,316-459,594-744
  Homolog annotation: Hit_ID=XP_319319.1; Match level="QueryCoverage =100%, HitCoverage=39%, E-value=2e-11, Identity=31%"; Hit description= ENSANGP00000012351 [Anopheles gambiae]
MRRAYALASRAVRPDLEVFLGDLFDEGVLLGGDEQQFVDTRKRFMNIFPLNRYSTNRIYLPGDNDIGGEMEPVYAELYERFKQHFPPHFTNGSDNFKRFVSVYESDVINFGAVNRICCDQSDGTNTVRLLLSHFPVLPHATVKTEQVNKDVQTD

SEQ ID NO: 128049 - protein, 249 aa, Heterodera glycines
  Coding regions on vcDNA: vcDNA=SeqID_54472; Strand=+; Position=1 -105,164-312,388-485,560-954
  Homolog annotation: Hit_ID=NP_500339.1; Match level="QueryCoverage =39%, HitCoverage=28%, E-value=2e-15, Identity=47%"; Hit description =putative protein, with 2 coiled coil-4 domains, of eukaryotic origin (4E162) [Caenorhabditis elegans] gb|
MDQLQKRLAKLQAFRPPYLDEYERYEAQLRVRYAVYVILFRNLHALQSRLVQSEHAEREQALEAERSMREMVEKMRMESEQAAPLIAGIPLHIDELNQAADDELEEYGQNGRQRRPGAWMGRRSRRDFPGIPIPALLGHGFPLMRKDNVPMAVVLFSVKSQFPQTEVRVFGNMTGLGLSDDDEEDEEEDEDGLGGGRIIEMEDEEELDDDDDDNDDYMNNFIRGGGNGSTAAAEGNTTKRQRALIESKK

SEQ ID NO: 128050 - protein, 340 aa, Heterodera glycines
  Coding regions on vcDNA: vcDNA=SeqID_54473; Strand=+; Position=1 -31,82-142,188-333,567-661,707-842,887-949,1006-1091,1312-1471,1524 -1766
  Homolog annotation: Hit_ID=CAE63594.1; Match level="QueryCoverage =95%, HitCoverage=85%, E-value=1e-115, Identity=59%"; Hit description= Hypothetical protein CBG08085 [Caenorhabditis briggsae]
VFKKTSPNGKITTYLGKRDFLDRGETVDLIDGMVLIDDDYIKSSKKVTVQLLAAFRYGREDLDVLGLTFRKDLISQLYQPAQGDTGKPCGVDYEIKTMVGGDSTQEKPKKHNSVRLAIRKLTYCPQLERIQPMVDVTKNFIISPGGLHLEASLDKEMYYHGESIAVNVHIQNNSNKTIKVTVQQMADICIFTTARYTCDVDKIDSCEGFPVGPGSTLSKIYSLCPLLLKNKDKRGLALDGQLKHEDTNLASSTTFAALRQSVHENLGIIVQYKVKIRLLIAGALGGELSAELPFTLTHPKPTDSPHPTEKKANVANCHEQQTPPTNGAQQREQKGNFVAD

SEQ ID NO: 128051 - protein, 41 aa, Heterodera glycines
  Coding regions on vcDNA: vcDNA=SeqID_54474; Strand=+; Position=1-124
MARKDFRFPTFLGSEFRLPKFLMKSRKFLNFFFKNVSFVQF

SEQ ID NO: 128052 - protein, 133 aa, Heterodera glycines
  Coding regions on vcDNA: vcDNA=SeqID_54475; Strand=-; Position=1 -55,113-220,274-512
MSIFISLFAVFCLGLHSTALQCKVGHYSNYGAIIEILECPPLKTEFCIAYGCQKEPNDVYMGWQCSESDKCPDLSGANAFAGLNLTGCKCKIGEKGANLGNENFTFPIDDPASSEQNDAYHSSMESPDKSSGN

SEQ ID NO: 128053 - protein, 16 aa, Heterodera glycines
  Coding regions on vcDNA: vcDNA=SeqID_54476; Strand=+; Position=1 -7,561-604
MGKNMDVQKRLKMLGF

SEQ ID NO: 128054 - protein, 95 aa, Heterodera glycines
  Coding regions on vcDNA: vcDNA=SeqID_54477; Strand=+; Position=1 -22,348-613
MDPGFWLGSSTAHQTDEGRGGQRREAKRGRRRRRFGQMGRSDGKAKWENKKWILNGALFKVKRAKAEADRRAKLDTEKEGTARDAIKELEKVGVE

SEQ ID NO: 128055 - protein, 178 aa, Heterodera glycines
  Coding regions on vcDNA: vcDNA=SeqID_54478; Strand=-; Position=1 -53,340-388,538-849,918-1040
MHKINKNCENIESEKILISSVVIYRIACGEGLYQHLLAYEVPLVKHLLAHRWQSQADTDCRQQIAEHPIHTIQHQSANAIKPRVMEKLYGNHGFKNYIQISMKKNVGPAFSDRNTRLAHSSTRAWSAPNVLSPFWPRSGTARVPRHAILMDDNGYPTDKTQQSHPYVQADEYKLFKNV

SEQ ID NO: 128056 - protein, 243 aa, Heterodera glycines
  Coding regions on vcDNA: vcDNA=SeqID_54479; Strand=+; Position=1 -213,357-655,1257-1333,1385-1504
  Homolog annotation: Hit_ID=NP_502884.1; Match level="QueryCoverage =76%, HitCoverage=29%, E-value=3e-25, Identity=36%"; Hit description =putative protein, with a coiled coil-4 domain (4Q485) [Caenorhabditis elegans]
ESQQGGIPRKQDIQVEHSVIQSTPFAQTDIRMNRGRFQLVRKRGRSEVWNLFGQVVDMLTGQRLPYVACYACKVLYTDTGGGTGNMTRHRCSMGSSYRSVRRCGAAIGCGSFQMLICCRSSSDTTVGNESIASSVTQSSSSFESVGGVAGTGNGILMTSASSFALSSSTADKQLFVQAMVQFCAQDMHNCEVVEGEGFKNLVEGEGFKNLVETVLFIGRRSHENPSANIFATIRNLIPTARQL

SEQ ID NO: 128057 - protein, 82 aa, Heterodera glycines
  Coding regions on vcDNA: vcDNA=SeqID_54480; Strand=-; Position=1-249
MASQPHFFFLLLVLPTTSFPSFCCCTSCCITAVVARRFSDGIRAKSADDELAEQDEAEADDADAAALADDGAEERDVSEAGA

SEQ ID NO: 128058 - protein, 126 aa, Heterodera glycines
  misc_feature (84)..(84): Xaa can be any naturally occurring amino acid
  Coding regions on vcDNA: vcDNA=SeqID_54481; Strand=+; Position=1 -183,1580-1640,1697-1834
  Homolog annotation: Hit_ID=AAC32826.1; Match level="QueryCoverage =94%, HitCoverage=38%, E-value=2e-18, Identity=40%"; Hit description =aquaporin-1; AQP-1 [Toxocara canis]
MAPFSLSPVDRMRQSVFRVRSRLAVNLLSEGLATFLLLLVGNGIGAQHILGGGKLDNYMQVCFGWGMLIALLVFATYHTSGGHXNPAVSLAFVSLGKLPFAHFLLYPLAKLSAPFFAPALCSHIYR

SEQ ID NO: 128059 - protein, 143 aa, Heterodera glycines
  Coding regions on vcDNA: vcDNA=SeqID_54482; Strand=-; Position=1-8,69- 289,897-1099
MKDCVAFGFIAQRQMALDEYICTRDGTYAWLSNSLLWKNGSHTIDKRCKYGAGDTVGCGIDLANRKIFFTKNGIRLGSSDKCLIFEYFCTTHFVRHEMDMDQMEAKCQHRGGQHALGQPENFEAGRNAATAAFPFLVVRIEVH

SEQ ID NO: 128060 - protein, 109 aa, Heterodera glycines
  Coding regions on vcDNA: vcDNA=SeqID_54483; Strand=-; Position=1 -106,162-244,604-706,784-821
MQNNQFALLERISELEKQQLKQQKQQQDEHYDNEYASEQFTQLQNDQQQKIETNGLEKRQQKVISNYWDANFCHSDLEIIGADCLTVRHNGDIMVMHESRTDFKNATYC

SEQ ID NO: 128061 - protein, 89 aa, Heterodera glycines
  Coding regions on vcDNA: vcDNA=SeqID_54484; Strand=+; Position=1 -85,723-904
  Homolog annotation: Hit_ID=A45627; Match level="QueryCoverage=68%, HitCoverage=3%, E-value=1e-21, Identity=78%"; Hit description=myosin heavy chain [similarity] - nematode (Brugia malayi) gb|AAA73080.1| [Brugia malayi myosin heavy chain gen
MPKRCVTTIRHVSANSSEFILTVPDGWLHLLEKSRVIRQAPGERCYHIFYQIFSDHKPELRKKLKLTKNLKDYYFVAQAELTIDGINDK

SEQ ID NO: 128062 - protein, 64 aa, Heterodera glycines
  Coding regions on vcDNA: vcDNA=SeqID_54485; Strand=+; Position=1-197
VLKFIDCPCQNDDAQFFGQFHKSKKKFITLIHMVNKTIEADEKLESPSVCCVRLTLIGICDDVP

SEQ ID NO: 128063 - protein, 282 aa, Heterodera glycines
  Coding regions on vcDNA: vcDNA=SeqID_54486; Strand=+; Position=1 -840,1153-1175
  Homolog annotation: Hit_ID=EAL39338.1; Match level="QueryCoverage =87%, HitCoverage=24%, E-value=5e-35, Identity=35%"; Hit description =ENSANGP00000021151 [Anopheles gambiae str. PEST]
RISKDKLLFELLNPSNFLPTRRGILSDIASLFDPLGLCSPCLVKSKIFFQSLLDSGTGWDGPIGKENEQKWTEISSEWSGTSLTFSRTPGSQWKLQLHIFSDAGPNSYAAAVYLRAERNGQTETSLLFSKSRLRPNKNDGLTIPRLELLGLLIAVRAKNFITANFNRSFEKIIFWVDSQIVLSWVATPAPQPVFIANRQSEIRQEKEAFFRYVRSSDNPADLGTRGASCGELNGLRLWHTGPEWIKDSEREWTNEFRIVLPAEGNDLEKGELLSPQAGKFKN

SEQ ID NO: 128064 - protein, 101 aa, Heterodera glycines
  Coding regions on vcDNA: vcDNA=SeqID_54487; Strand=-; Position=1 -135,608-777
MFVQEISAFLHTVNNFPKKLEEHKKLEEDLEWTWTSESALEFEWMNLNTEKMHLERQLEVAKYWLEEQRQRAEETQRNLKSAEKEKDSLIERIEALKDNLK

SEQ ID NO: 128065 - protein, 147 aa, Heterodera glycines
  Coding regions on vcDNA: vcDNA=SeqID_54488; Strand=+; Position=1 -402,956-997
MNSLNGTASSSNRMQREQTGQTNGDAAAVPRGHPAAQRNAANSSSLDAAANGRQAQQHANSAAQRPDRTNRPQRGDQTRQTSAARPTRPIVQTVQGQPAERDQQRLQRNNEGTTEDEENALQANRAQLTLSDIAAGRQGKMHKFMHK

SEQ ID NO: 128066 - protein, 95 aa, Heterodera glycines
  Coding regions on vcDNA: vcDNA=SeqID_54489; Strand=+; Position=1 -21,210-352,441-564
MSAKIEESKILKIIRSNLFFFFIFQGRCHYVLRSHGLYAGQRADVGDEPANFFAVQANVMELEMYIDEKAVATATTNAASSGNGNICHRPGRRRW

SEQ ID NO: 128067 - protein, 34 aa, Heterodera glycines
  Coding regions on vcDNA: vcDNA=SeqID_54490; Strand=+; Position=1 -34,512-582
MAQPNTPTVEVALLTRIRNRPILYNWLPVRVHDA

SEQ ID NO: 128068 - protein, 79 aa, Heterodera glycines
  Coding regions on vcDNA: vcDNA=SeqID_54491; Strand=+; Position=1 -3,111-206,599-739
MNSLLCAKLNAAAATMADIYGALLLHAIFDGSKDYTMVSVSFRREHQPFLSEFGALCTNLRHFLLDIKQYLDERFPADF

SEQ ID NO: 128069 - protein, 173 aa, Heterodera glycines
  Coding regions on vcDNA: vcDNA=SeqID_54492; Strand=+; Position=1 -444,517-594
MVDGTHAQQKMLQEEGKDSENQHRISTYKLIEEVLHGEHGQLMAQQRQSKMAAEFVYNEITQRFGIRMGPGVMHVDLSKQLSYVLGFDHKTRIYKNQSAKYPPDLSGGVRQLYVYAPKLVEDSIIGDRMAPLLRVVNVSGTPGLDMPETAFGRYVKFGWGTTVITLHFRQKLF

SEQ ID NO: 128070 - protein, 63 aa, Heterodera glycines
  Coding regions on vcDNA: vcDNA=SeqID_54493; Strand=-; Position=1 -57,330-464
MQPTLAHWDVIPKLFVPMSVTIGFGDFCPPSNIAEGGDSANHYGGWILFILVGLTLCTLTVKP

SEQ ID NO: 128071 - protein, 33 aa, Heterodera glycines
  Coding regions on vcDNA: vcDNA=SeqID_54494; Strand=-; Position=1 -50,103-152
RRMEVPFGLVLVVIRRPMAKWRRPIDRRKCQIL

SEQ ID NO: 128072 - protein, 155 aa, Heterodera glycines
  Coding regions on vcDNA: vcDNA=SeqID_54495; Strand=+; Position=1 -268,567-766
MASDRCAVALTFWLGNGVNVQPSYYNSGKVSLGLSQLKTLAPKVKTVRIEVEPFIPISLAKQWISEAAKNGFSIIVTYHKATVLGSNDANELQQAANWWKTNYKSLAQSGKFVLNLMNEWGDHTITSSAYAIAVNNALKIVRQVYSGTVIIDAPG

SEQ ID NO: 128073 - protein, 182 aa, Heterodera glycines
  Coding regions on vcDNA: vcDNA=SeqID_54496; Strand=+; Position=1 -248,340-638
MNSPTNFNNFHSTTKCVPLENGSDREKDSTSNNNHKRRKDNVKSELIDNAIGSPKSNKRAFFSADCALNPTALAEMMPSSRLSMGMAGRLRDIVAIFPQNDLASPGKLLFREQMTNSDQRVFSAKGQADVPGMNAKEISFVGREEAAGEGFEYILAIVDRRTGRASEIKRTALINFQLSKER

SEQ ID NO: 128074 - protein, 400 aa, Heterodera glycines
  Coding regions on vcDNA: vcDNA=SeqID_54497; Strand=+; Position=1 -147,413-1121,1168-1514
  Homolog annotation: Hit_ID=NP_507780.1; Match level="QueryCoverage =96%, HitCoverage=25%, E-value=2e-39, Identity=30%"; Hit description =predicted CDS, DNA polymerase type B, organellar and viral family member (5T899) [Caenorhabditis elegans]
MEAFVGWLVFQLPLKYDTYAYSHYGGRFDMVITFRELFRRGFNPEMLRKGNKMYEMKIGAQKKRNPNIIFRDSFNLMPCALGQLVPAYGLDVEEKPFFPHMANRPDNYGRQIFPTPEDYLAQGMMPEKRRQFDNWYEQHRSEPFLLDEALASYCTNDVEILMAALVAFRSEFFSITRRECYVVGVDDRENHGGIDVLKQCMTIASACMKHFRTNHLPENHLAIVPERGYDNAQNQSLLALRFFKWYEEKHNLKLQTAHSAGGEKRVANYSLDAWVEAEKRAIEVNGCVWHGCSKCFPEDNMLLPNGKSAGEVRERDGKRLEFLRKQLGRVDVYWECEIERMLAEDEEMRRAFASYVDDGPLDIRSAFMGGRTGPLKLFHKAQEGERISYFDFTSLYPFIK

SEQ ID NO: 128075 - protein, 91 aa, Heterodera glycines
  Coding regions on vcDNA: vcDNA=SeqID_54498; Strand=-; Position=1-274
FRASCGGGVAATVTRARRAHLRARLVRVAPWRAVAGQRTALGGARVARPFAVQLVVDNDGTDGGQRGQRRRWSTHGTERACVRRHNSCWQT

SEQ ID NO: 128076 - protein, 49 aa, Heterodera glycines
  Coding regions on vcDNA: vcDNA=SeqID_54499; Strand=-; Position=1 -77,123-194
MQEELSEDSDDAINFFEDSIEDIVEKINCSETKIKKWAAQRVNVADAKT

SEQ ID NO: 128077 - protein, 168 aa, Heterodera glycines
  Coding regions on vcDNA: vcDNA=SeqID_54500; Strand=-; Position=1 -297,398-607
MRSKGIPCRKKLDSEDFCVSCVHRAKKPSRNLYLRVVLQDCDDEECEQETTAFSYAAINFLSIASVEAFYNLSENAPNKLESILQSKIDQPLLVKVNIKENNDTAMLDWIISSISVEKPVAVKVLDDKNNDDGVEEEASSSEPPKKRTKNNQVERAIGEDADDIHTIE

SEQ ID NO: 128078 - protein, 140 aa, Heterodera glycines
  Coding regions on vcDNA: vcDNA=SeqID_54501; Strand=+; Position=1 -93,340-669
  Homolog annotation: Hit_ID=NP_704784.1; Match level="QueryCoverage =55%, HitCoverage=6%, E-value=5e-10, Identity=38%"; Hit description =hypothetical protein [Plasmodium falciparum 3D7] emb|CAD51927.1| hypothetical protein [Plasmodium falcipar
MNQAVYNRIVSLPWRQLQMLAKSRGIAANQKKQILIKKLTANFSGTNQQHNTNTNGQNDDGDGTDNEQSFGDGTNGQSDDGDGTDNEQNFGGGGGTNGQSDDGDGTDDEQSFGGGGGDNNVEEEQEGGSNNNSQLSLPDG

SEQ ID NO: 128079 - protein, 183 aa, Heterodera glycines
  Coding regions on vcDNA: vcDNA=SeqID_54502; Strand=+; Position=1 -76,200-322,986-1189,1641-1789
MCQPTHFFLPLFIFSANKLLAENLAEALKCKQGFEMRPMVEQQMDPDECVDVAFPRYCEASICTTADEMPTFASIHWKCVEEKNATECGERMKQIYEKNGDLKNVTCQCHYGEEGEDFGNKNFTLPPPADPADKVPMCKIGMIHSASKRGLIDIGVCKKDHHYCFAASCSIKGKHILSSTCTW

SEQ ID NO: 128080 - protein, 19 aa, Heterodera glycines
  Coding regions on vcDNA: vcDNA=SeqID_54503; Strand=-; Position=1-58
VEHKRQLARWDSNPRPQQS

SEQ ID NO: 128081 - protein, 81 aa, Heterodera glycines
  Coding regions on vcDNA: vcDNA=SeqID_54504; Strand=+; Position=1 -57,349-396,1055-1195
MYTTTTTTTTPTPAPVVATFFPTWAETFGHGLSIKAEGITFHACLRGRKSTKQFVLTGNQCLFNAIGCYFVFCYDGNECFI

SEQ ID NO: 128082 - protein, 113 aa, Heterodera glycines
  Coding regions on vcDNA: vcDNA=SeqID_54505; Strand=+; Position=1 -108,765-998
MVNVKKGTVIRCDPAMRQFLKHLDETRALGRPFIVKAILASFSPTADGNEQSQQQKEQFLRWVRQRLRRENAMPAKDTLQHSDKRHPTDLSVRKQLGRIAKRLRELVHMSLCL

SEQ ID NO: 128083 - protein, 180 aa, Heterodera glycines
  Coding regions on vcDNA: vcDNA=SeqID_54506; Strand=-; Position=1 -117,169-213,352-732
SFFALRTNERHSIDDEFAKNFAEKMDRIYHKMEEQQKQLAINTAEKIVNSDEIQSFVSAATHEKLAFFVCGIAVCLLLLLIKGNADKILTGKFGRRNGKSDDEKEVEEEKRTDEEGMEENCRGGGEIGAREEEPILVANDGEEEEEEEKEEEEDEREKVVGKGMRRRERGGWNGGTFEGN

SEQ ID NO: 128084 - protein, 24 aa, Heterodera glycines
  Coding regions on vcDNA: vcDNA=SeqID_54507; Strand=+; Position=1 -15,168-182,335-349,502-516,669-683
LLIHGLLIHGLLIHGLLIHGLLIH

SEQ ID NO: 128085 - protein, 58 aa, Heterodera glycines
  Coding regions on vcDNA: vcDNA=SeqID_54508; Strand=+; Position=1 -82,284-378
MLQIFLTISFLLIIGSAISNGTDEVKRVEISLRDLVDDAINWAHHIGMAWRADKKFPR

SEQ ID NO: 128086 - protein, 88 aa, Heterodera glycines
  Coding regions on vcDNA: vcDNA=SeqID_54509; Strand=-; Position=1 -264,306-308
MLLLLMFVAGAIPSNKCVDIVGAPAVEAETAPNVVVVIDDEDDDDNEDDDEVPMPQSMTATGGAPERDGGERRPPPPLLAIPLALRNW

SEQ ID NO: 128087 - protein, 161 aa, Heterodera glycines
  Coding regions on vcDNA: vcDNA=SeqID_54510; Strand=+; Position=1 -184,624-924
MAQQQQQQHQQQQLAPPPSTSGSISPNSGGPLQLGAADPSSVESNQSNNVFHHTNMAIGSNANGIANSGGGGLLSPPSRSGAPPVAVIDCGIGTSSSSSLSSSSSSSMTTTTFGAVSASTAGAPTMSTHLLLGMAPATNINNNNIINNNNNNNVAPTVAHN

SEQ ID NO: 128088 - protein, 194 aa, Heterodera glycines
  Coding regions on vcDNA: vcDNA=SeqID_54511; Strand=+; Position=1 -406,447-625
MTKKNLSIKEKRIMLKQFDQIYGKLKTKLNEKLEGKRTKCQKIIATHLGIDISTIYKWKKQLKDGKLIKNQNKDEQKREIVEKYFKIKIKFMQNGKHSRKEWKEFRAKIKQTFCVDYTTIEKWAEKIGINQNISKERKMLTIAEKMEVIKQYYQIKKQNPKLKEDEIAKILNIPKNSLRKYKAEFGIKPKNKLL

SEQ ID NO: 128089 - protein, 248 aa, Heterodera glycines
  Coding regions on vcDNA: vcDNA=SeqID_54512; Strand=-; Position=1 -219,724-951,1007-1120,1494-1679
MNISNGVHYGSASIVDTPSWLLSISLELAILELVVHLMSMLITVFNCIMVFNSGLLHTNLKWVLLAQSVSSFMSELCRFSVMVVQVPSGDIFTRPPYANILGSLYVFSNTYRIFLAYVLLAERTLATVLFRDYEQYDKVWANISWLAITLSLSFVVLITQDSSAHDYNRFTLPSIIGLFVLQIAAIVLSENIRTLKQLRPTFVFYTINVLLIYGIKFLFIFGIGCERRANKNCFYVPNAVARHCKHWH

SEQ ID NO: 128090 - protein, 300 aa, Heterodera glycines
  Coding regions on vcDNA: vcDNA=SeqID_54513; Strand=-; Position=1 -409,490-983
  Homolog annotation: Hit_ID=AAG23159.1; Match level="QueryCoverage =60%, HitCoverage=91%, E-value=1e-57, Identity=56%"; Hit description =polyprotein [Heterodera glycines]
MYGDRIVIPKVCQKKIMDPLHKGHPGIKRMKQLARQYVYWPKLDSEIEEFVQNCQPCQAAAKAPVKTDLHSWPKAEHPWQRINVDYDGPFYGKEFLIVVDAFSKYPESLKCQQNQLPPLSINCVIFLLDTEFQKFWSPYNPMSNGQVERFVDTFKRAFRKLKGEGVPGKDVIETFLVTYRTTPNDSLPNIKSPAEMLLGRKPRTTLDLLKPPLSQPSERDAKMERNFNRRFGTKQRTFQIKDRVYARHRLSHNWRAGLICDCKGVIYGVKFPDGSINLYHANQLRERRNVENLEVSEHFE

SEQ ID NO: 128091 - protein, 139 aa, Heterodera glycines
  misc_feature (10)..(10): Xaa can be any naturally occurring amino acid
  Coding regions on vcDNA: vcDNA=SeqID_54514; Strand=-; Position=1-424
  Homolog annotation: Hit_ID=XP_308192.1; Match level="QueryCoverage =91%, HitCoverage=32%, E-value=5e-34, Identity=55%"; Hit description =ENSANGP00000021557 [Anopheles gambiae]
HSQPLEGSVXPNPKRMGFVKIEKCSFFREQIKYLGQIVDKNGRRPDPCKIHAITEMPPPKDISALRSFIGMINHYQRVRQKMRFLRTPLDDMLKKEWDWNEKCQRAFTKLKEILASDLLLTHYDPKLEIVVAADASDYG

SEQ ID NO: 128092 - protein, 47 aa, Heterodera glycines
  Coding regions on vcDNA: vcDNA=SeqID_54515; Strand=-; Position=1 -101,419-461
MRELGSAETWENTVTSYTTELQYPEASSNYANNCIFKLIFVKIITSN

SEQ ID NO: 128093 - protein, 80 aa, Heterodera glycines
  Coding regions on vcDNA: vcDNA=SeqID_54516; Strand=+; Position=1-243
MKNHQQHTIKRNHRHQGYCILNKEGYYLLYENDCISMGMICYCVRIWKDTTVFNIHERLYCMRMGKRGKERQKENSKGKR

SEQ ID NO: 128094 - protein, 104 aa, Heterodera glycines
  Coding regions on vcDNA: vcDNA=SeqID_54517; Strand=-; Position=1 -49,381-428,702-722,1022-1132,1210-1294
CCCKPIIIKLPPPPVKASHAVAAAANRAVVAAASLAVAADAMMSGMNGGGCGGGASQGVSLSPLHALCSQIPPSQRGPACQQITQHAAAQQFPLSKDIFNRQQQ

SEQ ID NO: 128095 - protein, 116 aa, Heterodera glycines
  Coding regions on vcDNA: vcDNA=SeqID_54518; Strand=+; Position=1 -38,200-260,300-430,578-698
MFRHFQTFIMNIKLLDVCSKYKSISAFSHFVTESQTIHIAISARKHLHIFKYLLGELCEINDCAPITLPENAQAVVWCGVNNLILAFKCEFQFWDMDHFLHRDDLIDEKVTTNLFL

SEQ ID NO: 128096 - protein, 211 aa, Heterodera glycines
  Coding regions on vcDNA: vcDNA=SeqID_54519; Strand=-; Position=1 -37,603-1206
  Homolog annotation: Hit_ID=AAL40415.1; Match level="QueryCoverage =92%, HitCoverage=18%, E-value=2e-40, Identity=45%"; Hit description =endonuclease/reverse transcriptase [Branchiostoma floridae]
EMNFIKEIRKYLAPYVTELFRISFDTGKLPTFWKKSIIIPLFKKDKSCPTNYRPIALTCSLCKILEKFVVRAITSFLLKHDLISVHQFGFVKGRSTVTQLILTLENWFDGIYNGKNIDCVYIDFRKAFDVIPHSLLLYKVHKIGIRGKILNWISDFLANRSFLVRVENSFSSEYKMCSGVPQGSVLGPILFLIYINDLPENSERNFQTLCR

SEQ ID NO: 128097 - protein, 90 aa, Heterodera glycines
  Coding regions on vcDNA: vcDNA=SeqID_54520; Strand=-; Position=1 -31,111-256,585-617,708-770
  Homolog annotation: Hit_ID=NP_500088.1; Match level="QueryCoverage =72%, HitCoverage=14%, E-value=3e-15, Identity=60%"; Hit description =hexokinase (50.1 kD) (4C273) [Caenorhabditis elegans] gb|AAF36071.1| Hypothetical protein Y77E11A.1 [Caen
MGLREIPRPGETGKYVAIDLSGKNLRILMLTLQGKDKEPIIATNNFVVPYPIMKGSGEQLFNFIVNCLQKSPENTIYVTRLPDWDTNLSR

SEQ ID NO: 128098 - protein, 154 aa, Heterodera glycines
  Coding regions on vcDNA: vcDNA=SeqID_54521; Strand=-; Position=1 -139,773-1095
MDADEQQQQQQPQHKLPFSVKHSSCSFSTAAELNYEFAASGTSSSKGKQHQQRAGTKKRKLDWNRRDEDEDYVSRAKLSRHTVPVPSSSSSSKRKQKRSGGGGGRKATAPLAAAETAGMVDEADDDDEEGMAAAMVAAEAEQMLLVEKRRSTRK

SEQ ID NO: 128099 - protein, 196 aa, Heterodera glycines
  Coding regions on vcDNA: vcDNA=SeqID_54522; Strand=+; Position=1 -172,323-487,742-830,960-1124
  Homolog annotation: Hit_ID=AAH67612.1; Match level="QueryCoverage =53%, HitCoverage=67%, E-value=1e-26, Identity=44%"; Hit description =LOC407684 protein [Danio rerio]
MNSNLLLLSIQPNLSTRDKQLKAWGRLVLDYCQANRIYTTDLDEISKSDLFNNRRLNKHVEWKDKDKTRCNIYWRRPEEWGQLLYEWANSIGLLNTVVTLYELTQGEDVAKECSNFLRNSDIVEEGDTVVVYVNAAAQYSVVLWHRRVRLGRLCVRVEDQPEHVDTDFAEEHTDFVHAGHWHHSAAVGREAGRTDL

SEQ ID NO: 128100 - protein, 219 aa, Heterodera glycines
  Coding regions on vcDNA: vcDNA=SeqID_54523; Strand=-; Position=1 -136,188-408,465-594,647-758
  Homolog annotation: Hit_ID=NP_492381.1; Match level="QueryCoverage =88%, HitCoverage=31%, E-value=2e-39, Identity=44%"; Hit description =fibronectin, type III and ion transport protein family member (1J386) [Caenorhabditis elegans]
CLLSRVLRFVRAKFLSHHLLLAFACVLYIFLGALMFQLLEERHFLESKARHLRRVGADSEKYSKARHLRRVGADSEKYAEAVWTEIQKNLQEIPWDEINENKMVAEIRAATEEKFHNYVDTVYVAHRAVRHGFEENPPTNPPTWDFKNSLFFTATMLTSIGYGFVCPSTFEGRLFGVLYCLIGIPLIPLTLVTVANVFLFLFFLNSFASFFLFALPNFS

SEQ ID NO: 128101 - protein, 159 aa, Heterodera glycines
  Coding regions on vcDNA: vcDNA=SeqID_54524; Strand=-; Position=1 -33,249-337,413-563,635-754,1110-1196
MDNVKMDVHLKRDLAIGKRLCFMGIFTFLAETINNKISNILLSAFTGHVASKCVNWLSNAVRRNLRLGEANEPNPTPFLRTLSASELVSLHFQMSEFGISIEQILRFWANTMNVFIDDNNLTAVDRMESQNVKQQLTELTREAILGLLSTKIELVQCEN

SEQ ID NO: 128102 - protein, 247 aa, Heterodera glycines
  Coding regions on vcDNA: vcDNA=SeqID_54525; Strand=-; Position=1 -229,282-577,696-913
ALTDLRLIGTETEEEEVEQSPTEIGYHQRVPIDQREDEAEQSAMEFAPDHRRMSTDQCEDEAEQSSMEIASDHRPIPTDQQKNEASEQELLVDSNPVDIEEEASPMHSPRSRSPFRSAELFPDGEVTTVKQFESVTDPSGDEHMHFFVESSDDKMAPFSQMHGEERPFAPEEVSTVSSPEIDGHVTTEILETEDVRHEVEAVPAQISSERQEYDDIVESEVLHEIEGVPASIPLERPEKDDIVESEE

SEQ ID NO: 128103 - protein, 87 aa, Heterodera glycines
  Coding regions on vcDNA: vcDNA=SeqID_54526; Strand=+; Position=1-264
MELINATLDKLYNNPSSPAAFSGVTALWKEARKKIKQLSKKEVQNYLESHRTYTLMRPRRVHFRRAKTVAAGFMTDVQVDLADKIIF

SEQ ID NO: 128104 - protein, 116 aa, Heterodera glycines
  Coding regions on vcDNA: vcDNA=SeqID_54527; Strand=-; Position=1 -51,107-159,416-662
  Homolog annotation: Hit_ID=EAA20646.1; Match level="QueryCoverage =52%, HitCoverage=12%, E-value=2e-09, Identity=49%"; Hit description =hypothetical protein [Plasmodium yoelii yoelii]
MRTAREELDAEWPDVLRLCELLVREKTAGPAELRGIFGASLWEQNHPGDAEYLLGEEEEEDDDEEEEDEDEEEDADGGDAAPDREEGEAVEENGDEEEGEEDENQQIEFVFKKKTF

SEQ ID NO: 128105 - protein, 135 aa, Heterodera glycines
  Coding regions on vcDNA: vcDNA=SeqID_54528; Strand=+; Position=1 -91,339-456,523-721
MDAKSIDEKMLKKIIDTEKGKIHVLRLEAGELAKSKVFKDRSVCHLLLTIYNTNISKLESLLNSMEKEQGYKLYSIKELKNEEADNEQVEKEEEENEEEEGEKEVNDGLREEEEAGRHYALSLIGQQCQKSYGIK

SEQ ID NO: 128106 - protein, 128 aa, Heterodera glycines
  Coding regions on vcDNA: vcDNA=SeqID_54529; Strand=+; Position=1 -90,166-343,1211-1329
YHPDVTGSNESCAKKYLEIKEAYDVLRDEKQREEHDRWLAAEEVQRQRPINGRQPYVRRQKVYDDLWPNNGTFSDEEIRRVGRIQKKGAALPLDFSETHFCRHITEKKTSEKGLKKECEECRRIDMII

SEQ ID NO: 128107 - protein, 531 aa, Heterodera glycines
  Coding regions on vcDNA: vcDNA=SeqID_54530; Strand=-; Position=1 -108,204-626,850-1077,1148-1276,1455-1584,1903-2227,2281-2386,2435 -2581
  Homolog annotation: Hit_ID=CAE71299.1; Match level="QueryCoverage =98%, HitCoverage=76%, E-value=1e-123, Identity=43%"; Hit description= Hypothetical protein CBG18188 [Caenorhabditis briggsae]
MEKVQFGKELMEECPEIAAKVQERDKLKYQLNILKRANAVPTEGHQTEKKLATDGNKVANNRTVPNGPSGSAHLQIEDFGDSIIERLSDVFAKAVQNVRKSNKIAFIPIFEAYPTLGMDPSIIRVKEANNPKFGDYQFEMVMQISRRLLSEQSVKEPPPVVAKKIVAALEQIELVEKYQLVNAYINVYISRKHLGKRIAEISRKGFSLPKIAKKHVIVDYSSPNIAKQMHVGHLRSTIIGEAIARLLECFGFTVLRLNHIGDWGTQFGMLIAHLKKCFPNYLNETPPIQDLQEFYKQSKVKFDNDPQFKSEAYQCVVALQNFEPDTVKAWKMICDVSRKGKLFFPHECNIPLTVVKSDGGFTYDTSDLATLKQRLSEERADWILYVVDRGQSEHLEVLILKMHIFNYKQWYLFVLKNVFATGKQLKWFDAAQKRVEHVQFGLVLGEDRKKFKTRSGENVKLTELLDEGVRRAEEKLRTKGKEGEFTPQEFREVAESVAYGCIRYADMAQSRTGDYVFSFDRVRFEGDQWGS

SEQ ID NO: 128108 - protein, 94 aa, Heterodera glycines
  Coding regions on vcDNA: vcDNA=SeqID_54531; Strand=+; Position=1-282
VVMEVRPVRCGLFQQTLWAHVKSADIAELLVAGGRVGAVVRAVGDDAVGVMLLGLHVGKLFFRVGGLLLGHMGPNVMHKHHIVPQFLVATLECA

SEQ ID NO: 128109 - protein, 32 aa, Heterodera glycines
  Coding regions on vcDNA: vcDNA=SeqID_54532; Strand=+; Position=1-99
SSMSSVMAENNGNSYNEYSVVDGQQQTEEHQQ

SEQ ID NO: 128110 - protein, 39 aa, Heterodera glycines
  Coding regions on vcDNA: vcDNA=SeqID_54533; Strand=+; Position=1 -87,288-366
  Homolog annotation: Hit_ID=NP_524328.1; Match level="QueryCoverage =94%, HitCoverage=15%, E-value=5e-10, Identity=83%"; Hit description =CG5266-PA [Drosophila melanogaster] gb|AAF54814.1| CG5266-PA [Drosophila melanogaster] gb|AAL39425.1| GM1
MSTERYSFSLTTFSPSGKLMQIEYALNAVKGSAPSVGTE

SEQ ID NO: 128111 - protein, 202 aa, Heterodera glycines
  Coding regions on vcDNA: vcDNA=SeqID_54534; Strand=+; Position=1-611
  Homolog annotation: Hit_ID=EAL50505.1; Match level="QueryCoverage =100%, HitCoverage=25%, E-value=8e-10, Identity=27%"; Hit description= hypothetical protein 21.t00051 [Entamoeba histolytica HM-1:IMSS]
EKKKLKQKSFDEIFGEKGGEKEEERRNELKKREIIAKFYKIKEKIKQKRRKYPRKEWDKIERKIAKKLGTNRTKIYKWIKEFGLQKQIKKSYKSKTDEEKIEIIQKFIGMANEYKQKRKYSPKEWQKIHSEICKKIGVSLSVIKKWKKQFGMSKFITEKEKMEKMKIYWEIKKENPKMSDKEIAKMMKIDRTNISKWKKLFG

SEQ ID NO: 128112 - protein, 102 aa, Heterodera glycines
  Coding regions on vcDNA: vcDNA=SeqID_54535; Strand=-; Position=1 -234,295-368
RSHILPSVNQSSSSSSASSVNKFNNKTFKMSAESPTTSQRRARSRKTKKRAASAGETKPLRRSARIAAQKAAKEKAAKQKARDGSTASTKSAGRGRPSRSPK

SEQ ID NO: 128113 - protein, 56 aa, Heterodera glycines
  Coding regions on vcDNA: vcDNA=SeqID_54536; Strand=-; Position=1-169
LWGTFGRFAASGRALRARFLIFWGTFGRFAASGRALRARLFIFLGIFGRFAASGRA

SEQ ID NO: 128114 - protein, 36 aa, Heterodera glycines
  Coding regions on vcDNA: vcDNA=SeqID_54537; Strand=-; Position=1 -60,410-460
MLSTLVFASTVLIFVLFLLQANEPPDDGPVYDVPAG

SEQ ID NO: 128115 - protein, 192 aa, Heterodera glycines
  Coding regions on vcDNA: vcDNA=SeqID_54538; Strand=+; Position=1-579
MDDFYIVLPSNTPGPGNSTSKFTVRLPETLELGTNWSVALSSIIYPYSFTALGINGQEFIKVWENDSSVPTQVYLPDMNFKTAGGLGNKINEAFTHHYKIKKQRGKREAKAEDTKDSKIDVAKRAAERAGRDVERHFNQINNISNSIQTQLNTLRETNPQILEEPDIKIWFDKMVEMGTEIQTSRNELKSFQ

SEQ ID NO: 128116 - protein, 87 aa, Heterodera glycines
  Coding regions on vcDNA: vcDNA=SeqID_54539; Strand=-; Position=1-264
MVASVFVDDGSERSFIRANVAKQLGLPVIETEECHLTGFGEKEAKRYVSNVVRVGFLGVNGDPYICALNEMEFIVKAMPIITLNSKD

SEQ ID NO: 128117 - protein, 110 aa, Heterodera glycines
  Coding regions on vcDNA: vcDNA=SeqID_54540; Strand=-; Position=1 -113,269-488
MKSKAKGAGAHREVKGQGAECPAEVRGQGRLRAHVGQAENNSSIDQAAHMNEHRNRPSPPKHGPMGTKSAREWRQHQPMHVNVLPQMKEVTAKKEEKEEKKTAHLISPFL

SEQ ID NO: 128118 - protein, 430 aa, Heterodera glycines
  Coding regions on vcDNA: vcDNA=SeqID_54541; Strand=+; Position=1 -143,651-711,753-801,857-1008,1066-1113,1161-1184,1708-1887,2251 -2631,3130-3384
  Homolog annotation: Hit_ID=NP_500372.1; Match level="QueryCoverage =66%, HitCoverage=38%, E-value=1e-54, Identity=38%"; Hit description =OSMotic avoidance abnormal OSM-9, Neuron Specific Serotonin deficient NSS-2, olfactory channel involved i
PAAPLRVGAELVAILCTCWFVFIQQIDELRCHQGIRAYLWNLVSEVTKTTKLIGPFVQMIYTMIAGDLFRFVLISTIFMVPFTETMFFLGKDISTKQYLNESDAEFCPLSYSTSNYDSFFSTFLTLFRVCMNAIFYEELACANYEQMMKTLFVLFTFLMQGQIVMVLERAINAEKLAACQLEYSVQMNVPGREARGLMVIKQTTKTRAHQRKQALSNWKLVGRKVITMAKELGTQSALYLLHSHDRLVANDTVGGGGTSVPRTPYSSTRPYSVFGGSTATLVNHHRLMTSIGKRRAEEEVEERDAKQRRQQQQHEQQHKDQLEQTQSDGDESSVIEHVLQTPSPRKQPRLSIPTMDRHQHQQQHLMMFADQSKLRDVVTHATVNNMKLRRAELEEAQQRHKKPVSAQFLKFLNQFLIPLTDIARRGWTPA

SEQ ID NO: 128119 - protein, 71 aa, Heterodera glycines
  Coding regions on vcDNA: vcDNA=SeqID_54542; Strand=+; Position=1-216
MPSSTQQILDDVEFKEQNKKSVDQINQNAPDLLNSTNDTTGGRKRARRRVRPDLFRAKNSPPTNSSNSDRK

SEQ ID NO: 128120 - protein, 293 aa, Heterodera glycines
  Coding regions on vcDNA: vcDNA=SeqID_54543; Strand=-; Position=1 -162,609-828,1134-1354,1451-1546,1642-1728,1768-1863
  Homolog annotation: Hit_ID=AAH78565.1; Match level="QueryCoverage =80%, HitCoverage=78%, E-value=2e-62, Identity=48%"; Hit description =MGC85450 protein [Xenopus laevis]
MCQQQRPSYPPQYGPSPQPPPYSYPSAGPVEPGQMAVAIVATVVVIQFRVALKEVGSDKDTAVEEENDNFVHVQCAEVLYHPNEIGEEEMLKRSQLFYELMKTRRSVRCFSTKEIPLKILQNIIKTAGTSPSGANLQPWTFCLVRNARIKRAIREVVEEQEQMNYSRRMGAQWVLDVAPLNVNWNKPYLTEAPFLLVVMKHAYQLDHMGDRKPTYYSEQSTSIAVGILLAAIQNAGLVTVVTTPLNAGAAIREILQRPINEKVSLLLPLGYSAEECYVPDIQRKPIEDIMRIY

SEQ ID NO: 128121 - protein, 429 aa, Heterodera glycines
  Coding regions on vcDNA: vcDNA=SeqID_54544; Strand=-; Position=1 -59,112-211,257-300,487-628,1352-1387,1442-1510,1923-2115,2802 -2866,2959-3030,3095-3184,3561-3978
  Homolog annotation: Hit_ID=CAE60310.1; Match level="QueryCoverage =90%, HitCoverage=27%, E-value=4e-48, Identity=29%"; Hit description =Hypothetical protein CBG03901 [Caenorhabditis briggsae]
MTSPPPQQRELAFRRPWDIMVGKTPRNSLAGVSPNRVTFSPFTSFNLTKTKQMTDPTSLLIETIDDLREFSVFIFKKQTHIGQQNKRETLVDAIFKRSMREFHMELCAYTTLVYPTVKKKRRRSDITLHNGHHFNLEYVHIPTYCEICNMNSSKFFGADLSNLLLDDAQTVPVLLNRLLATIEVKALFTEGIYRKSGQLALIKQTRRQIELAEGTRVAHQESVNKMSASNLAVIFAPCIVRRNTSTIHAQEQLMDVQKQAICVQTLIEDKLRHCQETLSQIIELESASEKKHRLSASAAVSTECIAVDDQTRAGTPSATGAGLLLNTSATGDNTTTTTNAHMEQQQQNMETARQLFEEQLDFLDREKARLLQELPPLAPVASSEDLTDEAEREGGGTGTDVTAATNNGGGICGSVQCRRAKSSGRQRSV

SEQ ID NO: 128122 - protein, 127 aa, Heterodera glycines
  Coding regions on vcDNA: vcDNA=SeqID_54545; Strand=-; Position=1-384
MEVEGDEKALGSSVLSVEAQMDPNPMSNSDQVEIENEEVDKGENGQFSKKNSRDSDEEENFGGGKKMVVCQIWEDGVIVIPFGQDERPGFVFVANDLLSEIWETLAVIGFQIQNGSTPKPKRLQLPK

SEQ ID NO: 128123 - protein, 177 aa, Heterodera glycines
  Coding regions on vcDNA: vcDNA=SeqID_54546; Strand=+; Position=1-531
FSAATDIHLAEKGIAAALSSCFLKNRIKMEEFAIETTLHILDNNGRTVVATFEHFLDNKRKFVDLVEFWEEDAAIQARLKGVRKNCANGRILEVNKYVQGGVFQARILLAYQTAKNHDSDGDFEFICEGHEVVLSACESATAMVNRMILFYSNSFSSISSEQSGTGQIWRALLSSSD

SEQ ID NO: 128124 - protein, 125 aa, Heterodera glycines
  Coding regions on vcDNA: vcDNA=SeqID_54547; Strand=-; Position=1 -282,322-417
MPKKYKKAKKDKVGPDLPPAPPPSIEPPAAAIQYEDLTSDEELDSRAAGGTATAHLVDQQMESLLALSPKNNGAMLALSPDSIDRLLEDTNAGESVPITAESIEKALGSTVLKEGGEFAQSFGRK

SEQ ID NO: 128125 - protein, 244 aa, Heterodera glycines
  Coding regions on vcDNA: vcDNA=SeqID_54548; Strand=+; Position=1 -72,331-503,789-936,1087-1215,1245-1457
  Homolog annotation: Hit_ID=NP_496011.1; Match level="QueryCoverage =97%, HitCoverage=63%, E-value=1e-32, Identity=32%"; Hit description =glutathione synthetase (55.4 kD) (2J706) [Caenorhabditis elegans] emb|CAB01655.1| Hypothetical protein M1
MLEILEDVHSGGVKQHITLLTQRAIEVNNIAVSMGGLAQRASVLHRRMLQKTSKTRVIEKIDSVLPENRPIDTLTEGIHNAWLKLDPKEYTLHLDALKVAVVYFRAGYAPEDYPTQTEWEARRTIERSTAIVLDTPGAVERFFKGPADEQKVAAIRHVFAKMWGLDRDDAETNKCLLSVSFRLTKDAITSPQRYVLKPQLEGGGGNHFGEEIVSKLRTLTPAERAAFILMEKIQPLVVKVGVFD

SEQ ID NO: 128126 - protein, 168 aa, Heterodera glycines
  Coding regions on vcDNA: vcDNA=SeqID_54549; Strand=-; Position=1 -47,94-122,172-308,349-405,719-744,858-971
  Homolog annotation: Hit_ID=CAE74830.1; Match level="QueryCoverage =99%, HitCoverage=17%, E-value=7e-46, Identity=61%"; Hit description =Hypothetical protein CBG22668 [Caenorhabditis briggsae]
FTGEITSRLTADTTTMSDTIALNVNISDTIALNVNIFLRNTVQMGFLRNTVQMGGSMLFMMTLCWRLSLVPFIVVPIILVASKIFGIYYDFLSEKAQDAVFLSEKAQDAVAYSNDVAEEVLSTMRTVRSFACEEYECIRFYDKLTDTLLVTKRKAVAYVAYLWVSELF

SEQ ID NO: 128127 - protein, 94 aa, Heterodera glycines
  Coding regions on vcDNA: vcDNA=SeqID_54550; Strand=-; Position=1 -186,403-501
MCSFLCLQLTNAFNARSFIPITWPSKPPTRRSVGAHTRSNTFIARSGRPPRDTTAPMGVEVSKNVRIRIRGPEFTKKGWDLYSMPPNTPRKVLL

SEQ ID NO: 128128 - protein, 47 aa, Heterodera glycines
  Coding regions on vcDNA: vcDNA=SeqID_54551; Strand=+; Position=1-142
MNVLDRVCAPTLLLVGGLDGQVIGMNERALNALVNCKHKKLHIVPGA

SEQ ID NO: 128129 - protein, 61 aa, Heterodera glycines
  Coding regions on vcDNA: vcDNA=SeqID_54552; Strand=-; Position=1 -60,1042-1167
MHMMIFTTIGESSNRINVYVHKNDTKPIGGHAMKLIGWGEESTDKGELVKYWLGVNSWGTK

SEQ ID NO: 128130 - protein, 127 aa, Heterodera glycines
  Coding regions on vcDNA: vcDNA=SeqID_54553; Strand=-; Position=1-381
  Homolog annotation: Hit_ID=XP_320121.1; Match level="QueryCoverage =85%, HitCoverage=60%, E-value=2e-13, Identity=34%"; Hit description =ENSANGP00000018066 [Anopheles gambiae]
MDAQQLQQLLNALQQMVTNAAPQNAAPANLSNANLASSIDARLSAFNYNPEVGTTFESWFKRYGKLIEDDGSTLPEASKVRLLLGKLGEEEYNKYRDTISPTQPDQVNWNDTISHLKSLFAETRSLF

SEQ ID NO: 128131 - protein, 507 aa, Heterodera glycines
  Coding regions on vcDNA: vcDNA=SeqID_54554; Strand=+; Position=1-1524
  Homolog annotation: Hit_ID=CAA84230.1; Match level="QueryCoverage =64%, HitCoverage=60%, E-value=3e-15, Identity=24%"; Hit description =extensin-like protein [Zea mays] pir||S49915 extensin-like protein - maize prf||2111476A extensin-like dom
SLESIIKDGGSHAPIRRKRSAIEPTSPPNARIVPKSRPNVTKKVIVPTSPPRVGQEHEENAEEISNSLTNVTKPPEKQQKIEKQPEVVKPQNEKQPEVVNPKNEQINQTQNISHQNAPSPKPPPPASIPTTKKHEELKSTIDPTPSVSKPPPPLSVSNPVDQNRNVSVNQSVSKKKNIPPPSVSSSSINVPKKQEELKNSNGPTVSKPPPPFPVTSQTTVSPVQQITSAQRNDTKPSSSSLINEEKLKEIGPPPKQRTEKSIVETVSPTPPPAVPTHSNATAKKATSPPRVIATDIIGPPPKQRTEKSLNTKHVQAQLVNEIIPETTKKTTITTTTTTTITEPPKDTIDDFIGQIEKPTKRNNAEQLLAVLFGNDEWKKVNLRILRQIIEGVELQYHPNFERFKAVFTHPRIEYISFSPQLGYVLGFENSQYVRNNEIAKYGSDLRGGFASFAVYAKGLTENMIVGNSLSSLLRVVSVSGAVPGEYTEKIYDSPLYGTCSTKRSIRN

SEQ ID NO: 128132 - protein, 585 aa, Heterodera glycines
  Coding regions on vcDNA: vcDNA=SeqID_54555; Strand=+; Position=1 -240,555-643,952-1492,1533-1910,2363-2872
MDSNQITRILTSSEITSRKFLGCFPCDQLPEPMAIRFPASLIVNLDPHQFPGSHWVAIFVNGLNKKVDYFDSLSLPINELCQSPMTAEGTAFFHLNMLREWYMPKGQQGENYKRKFIEELLREPYNELSPPQKSAKDYVKKLDSEIEHVPKFQWVKNKSRFAIEDVPSDPEGLLIGIFQHCMDESISDSRSRGVEPTHLGCIVSSALLTSDIWIPIRQMTSDTINTILNRFNDVAQSKKQDGVTLWGDPFTVTMTTVNRNGLPAKRQLKGGAARKLTHVHHRVHEQCLIKIENFDGDNYCLFYALQATMIRSVAGLTRQRFYDYMNGNRGFHGRLKSEAVDMMNVVKAPPKQPSYDAERYVPRVIDWWNNVKFAGVWKFKAFIFGATGHYKPLFKYGPEDYVVPIILYFEDGHFNGRGCFIRPLEPNKKKEAVGWRLVTFDVETTQHQAVDPDFPERRKHQVNFVTANVACPSCISSGMWKESMRGKFCNICGFHRTITFSQKPFCETTVDRQTIDRHPLVAFVKWILYKLPKKYDTVVYSHFGGRFDMVLVFRELFMEGLNPSMIKKGNRLFEMKANIDWFTIC

SEQ ID NO: 128133 - protein, 204 aa, Heterodera glycines
  Coding regions on vcDNA: vcDNA=SeqID_54556; Strand=+; Position=1 -261,467-820
MANHPLQKLKDVSIYRKKFFQWSTEWSNQRSKTSDIWSDTSNAFIKLCFQFLSIFFVKQFSLTAHGISKIFVRKSFVLSAAHTENIVDTPTRWNAAYLMMRRIEEQQEALAHYAIQNRKFDFTFDGTESNLMNKLLKVLDPMEQLSRLFCLGTSSISVKYPFTKLTIQNLEQMEFENHDVSEIRDQIVDGLKTKIFGCKDERSK

SEQ ID NO: 128134 - protein, 126 aa, Heterodera glycines
  Coding regions on vcDNA: vcDNA=SeqID_54557; Strand=-; Position=1 -171,246-455
  Homolog annotation: Hit_ID=CAE70637.1; Match level="QueryCoverage =84%, HitCoverage=4%, E-value=1e-09, Identity=35%"; Hit description =Hypothetical protein CBG17336 [Caenorhabditis briggsae]
MTIQDHFEWCDIAEFVLENGDNALRIVTRQNIAILISGQQMAIVKKLIENFVIGGAKRRRFVVAVSSYGTRQPNILSFEAGDYIQLIDQPHSEMPSIGGQWLFGKVGQKEMMKSGSINQSNGSKLC

SEQ ID NO: 128135 - protein, 76 aa, Heterodera glycines
  Coding regions on vcDNA: vcDNA=SeqID_54558; Strand=-; Position=1 -66,113-277
MKQMEQILDANISDFLIYCERNDYFPIQIAFGISFVENLISYTLIIICGYKMALLIKIWTKTELEGNKLTGKLQPT

SEQ ID NO: 128136 - protein, 62 aa, Heterodera glycines
  Coding regions on vcDNA: vcDNA=SeqID_54559; Strand=+; Position=1-187
MGQLNSYFFSPEDHSSSVCAQPVLMEKEEEGEKSMNDLVTASSPTEVRPASPPASSSVSVPP

SEQ ID NO: 128137 - protein, 46 aa, Heterodera glycines
  Coding regions on vcDNA: vcDNA=SeqID_54560; Strand=+; Position=1 -88,492-544
MSNSPEQLGTWFLERCQSHSHLHYVGCENGEYKKCSSDPMSLFPRV

SEQ ID NO: 128138 - protein, 119 aa, Heterodera glycines
  Coding regions on vcDNA: vcDNA=SeqID_54561; Strand=-; Position=1 -306,405-458
MANKLILLPFEHYRGLVAAREGVGVAKGDDDVAEQTNLGFVKRQLETVKRKRTANVSERNVLYNQQLRRYLKLRKEVKDRPLKVQLSNGAQLLNKTVETGVQLPLTVSFVFSKSLMSIP

SEQ ID NO: 128139 - protein, 241 aa, Heterodera glycines
  Coding regions on vcDNA: vcDNA=SeqID_54562; Strand=-; Position=1 -315,374-784
MLKKLPKPFLIVYDDLMGDIDAKKLADLYTKKSHHNNFSVIFLTQNLFDKAMRVPRSNAQYIFLMRAPSDMLSIRNLASQMFPREQGFLMDAYKQACADPYGYLLTTKKRLSLYPKMVKKQMVGQRVLDNYEYLKSLGRTTSHKKRRHLLSSAGCEELLTLVEICLNLLNGSFCLTRKQKQKLLPFANTIRRLARVRSEQSARKLILQQQQPQQEGGSLFAPLLAPILLEAARYLLHKDGQ

SEQ ID NO: 128140 - protein, 165 aa, Heterodera glycines
  Coding regions on vcDNA: vcDNA=SeqID_54563; Strand=-; Position=1 -385,433-545
MPPLTTALSKLLNCKAENLAEYLNNPEAVNKASAYLRGKKLKTTYSNKGGTTKEVEFGNFSKKSASETYAFEGFLGKCLFCKHSLTLESSEVKVHQYFYIKHRIRLLYPQLKCIVEYHSKGHCKYYPLELLAIEDSAEITGEKPTDTNYLDYLGFRSVWQPTPVY

SEQ ID NO: 128141 - protein, 172 aa, Heterodera glycines
  Coding regions on vcDNA: vcDNA=SeqID_54564; Strand=+; Position=1 -46,201-427,477-722
MAPRKQNEQFLDEIQNSDDDVKLVDSQSSHAEERPVLKKRGRKSRWEKLLEDVNNAKKANPAEVEVADVDERKAANVFDYPTIFWKLARPKYGVFTFMCNECRNENFKRGDKRFILNTGSGQEKLEFTQTFCQDCAKLNFDCTDLIMKHQKKDDGPSAQKNGGRNTYFKMEK

SEQ ID NO: 128142 - protein, 515 aa, Heterodera glycines
  Coding regions on vcDNA: vcDNA=SeqID_54565; Strand=+; Position=1 -1237,1917-2227
  Homolog annotation: Hit_ID=EAL49477.1; Match level="QueryCoverage =44%, HitCoverage=49%, E-value=4e-31, Identity=33%"; Hit description =hypothetical protein 42.t00003 [Entamoeba histolytica HM-1:IMSS]
MHHGMIAEMERHLTRKRSIQYPDEGEIVDMEVVEEEEPEEAPLNPLKNRTKLAQLSLKHERDKKEREEEDKRRQQREEQQQRKQQEEQRKQREEQQQRKQQEEQRKQREEQRKQREEQQRKQREEQQRKQREEQQQKQREKEQEKAKKSEADRVAKEKKSEKERLAKEEEERLAKEKAEEERLANVKKEEERLAREKKEKEDVQLAMEAEEGRLAKLKQRELELLKELKPWRGGYMRLVHGKDPTPDVHYLHEKDDYHFVNAVHKYIVRHPELPWDSPEFNPSANIQQNIAEFRKIFEREVFDENYELKTREEKNELIELVKGFRFYFADELGRFTLRIFSDKISHITLTDQLAYVLGYEQQQEIHNEDQAKYAVDLAGGVSHLCIYLNSGIIESMIFGNSFANLLQVIAVEVFVQIHPITSYIDLSKVFVCTEFKLKKIAEDGVVVDVPANAAVGLIQMPGATFIRNLKVHINQREVYDSNQLYSYKVYLDTELSYPAAGKGCLLWRGGLFSRQ

SEQ ID NO: 128143 - protein, 121 aa, Heterodera glycines
  Coding regions on vcDNA: vcDNA=SeqID_54566; Strand=+; Position=1-365
MISNVEIDIELALQSDDFMIHQDTANKDKYTVEIVDCRLIVKTVDLMDGLSLDIARKLDTEPARYGIRKSFMKSLFITGGRYDFSANLFTERCHEGLSLAWCPTRIILAIIRRIPSILITT

SEQ ID NO: 128144 - protein, 26 aa, Heterodera glycines
  Coding regions on vcDNA: vcDNA=SeqID_54567; Strand=-; Position=1-80
MRCASFANNNLSSTESKVVKASTDCA

SEQ ID NO: 128145 - protein, 77 aa, Heterodera glycines
  Coding regions on vcDNA: vcDNA=SeqID_54568; Strand=-; Position=1 -132,231-332
MRDFDFLKDMHCNITEEFRRTVNFIENCYKDGFKQPLILFCQRADYMTHESEENNEKKLELKQVTIEFYFQKLGKLD

SEQ ID NO: 128146 - protein, 453 aa, Heterodera glycines
  Coding regions on vcDNA: vcDNA=SeqID_54569; Strand=+; Position=1-1362
  Homolog annotation: Hit_ID=NP_001004509.1; Match level="QueryCoverage= 99%, HitCoverage=30%, E-value=1e-51, Identity=31%"; Hit description =si:busm1-180o5.3 [Danio rerio] emb|CAD60788.1| novel protein similar to DNA polymerases [Danio rerio]
MADLQKFEDWYNNNYEQCFDLKEKLPEYCCNDVQILIHALVELRREFKQLTQRHGKHGGIDIICQAITIASACVKNYALNHLKPNSLAIVPEKGYTPQQNQIALAIKYLDWYSHINNVNIQTAHSLYGEYVFKREGQIYQVDGYIKGTNGKRDKIIEVNGCLWHGCEECFEEMDDEKMSNGKTLREIREREEKKHEILSRYVDLEVIWEHEINEKLKKDTAMREFFDNWKDRSPIKIRDAFHGGRTGPMKLLHTAKPGQKISYKDFTSLYPWTNFSTDYPLGHPKIISIPPNEQTVNWRSPSDNPYKGLLKVLLLPPNNNINVTVMPIKFDQRLLFPLCEKCAKYITAKYPNGLKDNDYSCPHFNPNDRAFVSTCTHLELNAALEAGYTVRKVFHVLQYDQWSDNVFKSYVSEMMALKIHATGFPSWCSSEEEKSEYIEECWMKFGIHLEKRR

SEQ ID NO: 128147 - protein, 213 aa, Heterodera glycines
  Coding regions on vcDNA: vcDNA=SeqID_54570; Strand=-; Position=1 -237,353-757
MSFQSLGLNPLAFQALRLNSQAFQSLGLNPPTFQSLGLKSPEFQTLGLNPPTFIGIPISGTQPTSISISGTQPTSISISTLGLKSPAFQTLGLNPPTFNDIPITENQATSIPILGLNPPAFQSLGLNSPAFQTMKSPAFQTLGLNPPTFNDIPITKNQPTSISISETQFAGFPIAGTQPTSISISGTQISGIPNNGTQISGILNTGTQPTNFQ

SEQ ID NO: 128148 - protein, 81 aa, Heterodera glycines
  Coding regions on vcDNA: vcDNA=SeqID_54571; Strand=+; Position=1-246
MENGVTKCCYSAIPNNDRTVAENEQGNGREMSSDGDQTGAAKGISMGKGTAAPFRAAERRPIRFANFGMGASLQYSCQFAQ

SEQ ID NO: 128149 - protein, 59 aa, Heterodera glycines
  Coding regions on vcDNA: vcDNA=SeqID_54572; Strand=+; Position=1-297
FLKSAETSTDKWTQRIELGISCTIKILKIRSYNSLFSIHSIFKNIIIFRENCYLFMRFW

SEQ ID NO: 128150 - protein, 71 aa, Heterodera glycines
  Coding regions on vcDNA: vcDNA=SeqID_54573; Strand=-; Position=1 -124,203-294
  Homolog annotation: Hit_ID=NP_506037.1; Match level="QueryCoverage =85%, HitCoverage=15%, E-value=5e-10, Identity=46%"; Hit description =nuclear receptor NHR-116 family member (5M581) [Caenorhabditis elegans] emb|CAB07316.1| Hypothetical prot
MDAAEPIKQKRIYKKQPKTPKKCLICGRGAAFKYYNVQSCNGCKQFFRRIVNSQRTFTCTETNSCILSDGK

SEQ ID NO: 128151 - protein, 82 aa, Heterodera glycines
  Coding regions on vcDNA: vcDNA=SeqID_54574; Strand=+; Position=1-249
MPLAPLLLLLLLFMFLLPLFLLVMALWLCCWYCSRSYDCALLFTDEAGRERLLLGNLLLLLLSQVRDHRLHSQPLQAQPLLQ

SEQ ID NO: 128152 - protein, 66 aa, Heterodera glycines
  Coding regions on vcDNA: vcDNA=SeqID_54575; Strand=+; Position=1-199
QLEQQLLLLAVQDRLAQQFAIGGHAGGIDLQLWQQLTALGLLGGGAGAVGVPPQHQQLHHALLGGE

SEQ ID NO: 128153 - protein, 460 aa, Heterodera glycines
  Coding regions on vcDNA: vcDNA=SeqID_54576; Strand=-; Position=1 -351,932-1345,1855-2472
  Homolog annotation: Hit_ID=CAE72690.1; Match level="QueryCoverage =47%, HitCoverage=36%, E-value=2e-16, Identity=30%"; Hit description =Hypothetical protein CBG19911 [Caenorhabditis briggsae]
MHSTDNNGNGNGNNPSNNTNTIDEGSDDGGHRNGDGTIGAGGEAGTSGRNNAAAGTSYDTAGAVVVGDPQSQQQGTIAPNSVPPHHILAHAVPPPPAAAGGGGQPRDVPPPLLSNSALWQQLTALGLLGGGAGAVGVPPQHQQLHHALLGGEGGAVAAAAAAAATAIAATTAGGGVGNSLEMLQQQFQRAAATMTASSTTTAAATAPSSQLLMLRQHQQQQSAASLIADDPNHHHDQQHYPLYQNGRCAWFNCDQPCDSLPAFLAHLSQCHSAVDDATSSATAQQCHAQIDLVDSLEQRLCLERLRMQAMVAHLRQQQQQQVAKQQAFSPGLVGEEEGTVVAPGAVPATQPQSHHKQEEREEEHEQQQKQQQRRQRHSPPSPSSQNQHHFCTAGGATTATPTLTALDAAQQQRQAIGMPLENIYIKEVGCAACSRISVSAFLGLGPKGGGMKCTLLESRF

SEQ ID NO: 128154 - protein, 325 aa, Heterodera glycines
  Coding regions on vcDNA: vcDNA=SeqID_54577; Strand=+; Position=1 -498,540-840,900-1078
  Homolog annotation: Hit_ID=XP_313035.1; Match level="QueryCoverage =91%, HitCoverage=40%, E-value=1e-67, Identity=41%"; Hit description =ENSANGP00000011760 [Anopheles gambiae]
MCPLSDHSLGMVNHYQQFLKNLRCIRQPLDDLLKQDTDWNWSSECQKAFDQVIGTLQSDQLLTHYDPSQEIIVSADASEHGIGAVISHRYADGSIKAIAHASHSLAPAERNYAQIEKEGLALIYAVQKFHKYLYGRHFILQTDHKPLLSIFGNKKGINPAPPIDCNYQNTSEFGQADALSRLISKTTIEDDEVIVANLMNVETELLNAVVKQFPLNSDQLIVEIGKDEVLKKVMKYLRTQWPTSKNMSLEIIPFQRRREALSIENGSIAPGHPGMKRMKNLARQYVYWPGMDQQIEDTKNPSWMKLIEPPKCPLNRRPPDRYTPS

SEQ ID NO: 128155 - protein, 39 aa, Heterodera glycines
  Coding regions on vcDNA: vcDNA=SeqID_54578; Strand=-; Position=1-119
MRRKPGPGSRDCFEGQEFPEPLEMGPFLETLSDQNSRIS

SEQ ID NO: 128156 - protein, 60 aa, Heterodera glycines
  Coding regions on vcDNA: vcDNA=SeqID_54579; Strand=-; Position=1 -76,133-170,328-573
MQQHTYTEQPQRQNYQYYPNPPPPVVYERRYVERDSGPRCVPCCCCIPCIPIPLCFDCGC

SEQ ID NO: 128157 - protein, 37 aa, Heterodera glycines; identical to SEQ ID NO: 127515
  Coding regions on vcDNA: vcDNA=SeqID_54580; Strand=-; Position=1-117

SEQ ID NO: 128158 - protein, 56 aa, Heterodera glycines
  Coding regions on vcDNA: vcDNA=SeqID_54581; Strand=-; Position=1-171
KINLISLYKYAPLTSCDVERSFSIYKSILTDNRSCLSPEHLEMQLICNANFNNDLD

SEQ ID NO: 128159 - protein, 151 aa, Heterodera glycines
  Coding regions on vcDNA: vcDNA=SeqID_54582; Strand=-; Position=1 -153,818-955,1107-1268
MTICYGGNAVAMSSAVSGSASANAAKVGDGRVECAAESGSKYNGTGTFQWMLLAQRGQIEQFMRDEEDKQMVETIRRTFVEQWPLEEGDDPTRQLIQLAIADPGLYVLKAQNEEGTPNYVDEGLREKLQQFTHEERAAHELMHRIQPVTAK

SEQ ID NO: 128160 - protein, 81 aa, Heterodera glycines
  Coding regions on vcDNA: vcDNA=SeqID_54583; Strand=-; Position=1 -84,175-336
MPLHQNLIIKFSLKIYGYENQNFHINQKHLFIKMDTLPNLDYAEEYGDDGTGRSIELQPTILPTECNLSAANIAEQNTWTM

SEQ ID NO: 128161 - protein, 45 aa, Heterodera glycines
  Coding regions on vcDNA: vcDNA=SeqID_54584; Strand=-; Position=1 -43,453-547
MSLFWPNDYAKWFGSKCQRLPLPLAHCAVGSALSFGLSKIYLIGF

SEQ ID NO: 128162 - protein, 143 aa, Heterodera glycines; identical to SEQ ID NO: 126933
  Coding regions on vcDNA: vcDNA=SeqID_54585; Strand=+; Position=1 -96,135-252,468-685

SEQ ID NO: 128163 - protein, 197 aa, Heterodera glycines
  Coding regions on vcDNA: vcDNA=SeqID_54586; Strand=-; Position=1 -192,247-414,504-736
  Homolog annotation: Hit_ID=CAE66876.1; Match level="QueryCoverage =99%, HitCoverage=67%, E-value=8e-57, Identity=56%"; Hit description =Hypothetical protein CBG12254 [Caenorhabditis briggsae]
MNDAMSLGIHRLWKEYFVQQLNLSKDSTVLDMAGGTGDVAFRIVQEMRKQPIGKGSITVADINDNMLETGKTRATRALSPSDQARLSWVCADAENLQFEDNTYDFYTISFGIRNCTHLDKVLSEAYRVLKPNGVFACLEFGQIENTMLRRIYDIYSFQFIPVLGQLLVGDFNSYKYLVESIRMFPSHEKFAQMINEA

SEQ ID NO: 128164 - protein, 283 aa, Heterodera glycines
  Coding regions on vcDNA: vcDNA=SeqID_54587; Strand=+; Position=1 -207,266-418,1938-2069,2124-2483
  Homolog annotation: Hit_ID=AAH76794.1; Match level="QueryCoverage =39%, HitCoverage=13%, E-value=2e-21, Identity=48%"; Hit description =Polk-prov protein [Xenopus laevis]
MIGSKFIGNKAGMSSIDKEQVARIIAENTSANFEGYEKKRASRIDEQIKRNRQRLDSLTEQQIKQTREELDRIVEDMEKWRRLDRIKVHIDMDAFYAAVECRDNIHLRDVPMAVGSLSMLIKFANFDVVTRCKSVNFVVTAVGQLIPIIEAMLRKEFKERRNMAIRLLGVRLSQLVSADANLGEEAKKGVQLSLAGFMSRRPLANKKRRDEPPEVVELSSSDEMETKEEEGDETMEVKPMPFSEEKEPENGQRKSESPNDGCDKAETSERSRSNGQRMQSSDE

SEQ ID NO: 128165 - protein, 46 aa, Heterodera glycines
  Coding regions on vcDNA: vcDNA=SeqID_54588; Strand=+; Position=1-158
KNKTTEAKITRYFENLKTRCISSQSRTHIQCQFRAVSPFSFAIPPQ

SEQ ID NO: 128166 - protein, 107 aa, Heterodera glycines
  Coding regions on vcDNA: vcDNA=SeqID_54589; Strand=+; Position=1 -120,482-685
GLKCKQGFEIRPLVEQQLEPDECVDVELPRFCEASICTTDEAPNFASIHWKCAEEQNAKECAERMKEIYEKKGELKNVSCQCHYGEEGEDFGNKRFTLPPPADPTDK

SEQ ID NO: 128167 - protein, 459 aa, Heterodera glycines
  Coding regions on vcDNA: vcDNA=SeqID_54590; Strand=-; Position=1-1380
  Homolog annotation: Hit_ID=NP_491240.1; Match level="QueryCoverage =94%, HitCoverage=33%, E-value=1e-124, Identity=50%"; Hit description= zn-finger, CCHC type and RNA-directed DNA polymerase  and Integrase, catalytic domain containing protein
MFPEIVADGLGHCKKVKAHLSLKPNATPIYCRPRPVPFNTKSVVEAELERLQSMNVIRPVEHTNWAAPIVVVKKANGSILVCADFSTGLNSALLLHQHPLPLPEDIFATLNGGRIFSQIDFRDAYLQVELDENSKELCTIATHRGNFQYQRLPFGVKSAPGIFQSIMDSMLAGCAFAVAYLDDVIVVSRSSEEHKKHLQEVFKRIAKFGFRIKPEKCSFFKREIKYLGFIINKNGRRPDPAKIQAIAKMPVPTNLSTLRSFLGMINHYQQFVKNMRFIRQPLDNLLKQDVVWSWSTDCQKAFDQVIQILQSDQLLAHYDPSQQIIVSADASEHGIGAVISHRYSDGTMKAVSHASHSLSPAEKNYSQIEKEGLALVYAVQKFHKYLFGRHFLLQTDHKPLLSIFGNKKGIKACTANRLQRWAIILLGYDFEIEYQQTLSSAKPMCFPDLLRKLRCQKTT

SEQ ID NO: 128168 - protein, 54 aa, Heterodera glycines
  Coding regions on vcDNA: vcDNA=SeqID_54591; Strand=-; Position=1 -82,414-496
MRFLKQQQAQLPNPPKPQQILALSVILANYWLLNAQFNGCVFGIISMIDEDENE

SEQ ID NO: 128169 - protein, 116 aa, Heterodera glycines
  Coding regions on vcDNA: vcDNA=SeqID_54592; Strand=-; Position=1-351
MPKEPSSRAFLFKKWVSNYMNDVYTTDSKIIYCQACQIEVFDTICDIGKILSGQKINFGMPPNLISLYKYAPLTSCDVERSFSIYKSILTDNRSRLSPENLEMLLICNVNLNNDLA

SEQ ID NO: 128170 - protein, 281 aa, Heterodera glycines
  misc_feature (94)..(94): Xaa can be any naturally occurring amino acid
  Coding regions on vcDNA: vcDNA=SeqID_54593; Strand=-; Position=1 -82,689-819,1050-1184,1650-2002,2176-2298,2474-2517
  Homolog annotation: Hit_ID=XP_391871.1; Match level="QueryCoverage =96%, HitCoverage=17%, E-value=3e-39, Identity=35%"; Hit description =similar to L3MBTL3 protein [Apis mellifera]
LPRGASLPSFFSPFTPPTFTIFLCPFFVSDPSILITVKTTRANHRSRVEDALATWASMAGRKGAENTVKISPIDQMPSGTHKVNPQLLISSNAXFSAALCCKMAAELRIALQRSPDFWCHFDDDSFVLLVNLRAFLRQFRPHLDDLYLGRPSTSAPVVLPQLGPSPTLRPLSARKSPFWFGTGGAGICLSALTLRRLRPHQQRGNFQWVCAQLGVPDDVALGFILENFLAIPLTRTDRFHSHLNRMGAIPRSQLSDQVEISTESGPNKEATKEKEDKYLMK

SEQ ID NO: 128171 - protein, 182 aa, Heterodera glycines
  Coding regions on vcDNA: vcDNA=SeqID_54594; Strand=+; Position=1-549
MSTSMLKTAYRGMAMFEGEMAEERAQGNKDCIILTLLCGKILDYFEQQLKEAKMDGKNEKGEKMAKIGKFWKLFTRIFDLFKKKSEMHDKKGILIKLSQLLRYLRGQFGEQKVSNKWQLIGELFEQGFTKLYKENEEFRTHFKRNIIQMIGLFREICEIAEENGEEFFSKQFWTLFGGPFVN

SEQ ID NO: 128172 - protein, 17 aa, Heterodera glycines
  Coding regions on vcDNA: vcDNA=SeqID_54595; Strand=-; Position=1 -9,176-220
MTMLFHWDILFWAFDKK

SEQ ID NO: 128173 - protein, 132 aa, Heterodera glycines
  Coding regions on vcDNA: vcDNA=SeqID_54596; Strand=+; Position=1-399
MTSLYKELLMKSVGKDESRGYNSSQIHILAMLLSYKIQIDFMIGIGKQFEERTEKFEDQLENYMNEFVVERPESGSEEEELCEMHKLAHSIAKNGILREESAKWGKFIEQFVGNATKTPTERVKNAIIIILI

SEQ ID NO: 128174 - protein, 285 aa, Heterodera glycines
  Coding regions on vcDNA: vcDNA=SeqID_54597; Strand=+; Position=1 -54,303-409,493-557,608-755,802-912,960-1119,1166-1236
  Homolog annotation: Hit_ID=CAE70817.1; Match level="QueryCoverage =90%, HitCoverage=10%, E-value=4e-44, Identity=42%"; Hit description =Hypothetical protein CBG17587 [Caenorhabditis briggsae]
RSLAPSMLSSYSTISVPVAPQQPQGQTAQNGTKSGTGKGICSPNSKASCYQVSSLTEASARKLCRKHPQKCISYTRNHIMRTYPGGMYTRNHIMRTYPGGMRIDSSNFNPQQLLEFWQCGLQMVALNYQTADVAMAVNTAMFEQFGVNTAMFEQFGSCGYMLKPRALWDASHPLFGKFNPFSKELSLCPALILQLTIISGELSLCPALILQLTIISGQYVQNPAGPSPASPFLEIEIIGVPADCAKEKSKMVDSISLSPFSLISLSPFSLSLLPLSLSFLSLSSL

SEQ ID NO: 128175 - protein, 33 aa, Heterodera glycines
  Coding regions on vcDNA: vcDNA=SeqID_54598; Strand=-; Position=1-100
QRIETWRKKCQFEAELRTVKTGENVHPNVVANP

SEQ ID NO: 128176 - protein, 109 aa, Heterodera glycines
  misc_feature (103)..(103): Xaa can be any naturally occurring amino acid
  Coding regions on vcDNA: vcDNA=SeqID_54599; Strand=-; Position=1 -150,346-494,1480-1509
  Homolog annotation: Hit_ID=NP_498403.1; Match level="QueryCoverage =100%, HitCoverage=25%, E-value=3e-32, Identity=55%"; Hit description= fibroblast growth factor, human FGF20-like, LEThal LET-756 (49.6 kD) (let-756) [Caenorhabditis elegans]
LLEFLAVAFGLVSIRSVTNRHFLCMDSSGQLYAAPASRYSADCVFMEEMMHNYYNLYSSCVYGSARSPWFVALRRNGQQRRGRHSRRRQKSSHFVIVETDTDXSTPPPP

SEQ ID NO: 128177 - protein, 194 aa, Heterodera glycines
  Coding regions on vcDNA: vcDNA=SeqID_54600; Strand=+; Position=1-585
MKLLPLFFLIVILIIKIDQFGAEKKKLKQKSFDVIFGEKWEEKEEERRNELKKREIIAKFYKIKEKIKQKGRKYSRKEWSKIEIKITKKLGTNRQYIYKWIKEFGLYKFKSKTDEEKIEIIQKFIGMANEYKQKRKYSPKEWQKIHAEICKKIGVSLSVIKKWKKQFGMSKFITEKEKLEKMKIYWKIQREHPK

SEQ ID NO: 128178 - protein, 322 aa, Heterodera glycines
  Coding regions on vcDNA: vcDNA=SeqID_54601; Strand=-; Position=1 -33,79-570,1112-1233,1319-1530,1652-1760
  Homolog annotation: Hit_ID=CAB40405.1; Match level="QueryCoverage =41%, HitCoverage=48%, E-value=1e-12, Identity=36%"; Hit description =putative RanBPM protein [Guillardia theta] ref|NP_113404.1| putative RanBPM protein [Guillardia theta] pir
MVQHEKACEKVFDHPFASSSSAPACAVAAASSAMMPSSCSSAVIGTTHSPSSSFHAAGTNAGAADGGGGTLRRHQSPPLLAHPPPALPPPLLDHQRAQQNCASASAASSSSSSLNPHHHHHVGGVHPSFSSIITTNISGPQIQTQQKQCQNVSPPQALLEAELPFSDSQFDGTVELYYIFSLKDGMCSVFAKHPILLFNNSSDIFYYEISIGNKKNVLLFGFAVKQQKKPLYGDEKGTYAYDNYGNIFINGKQKESNAKYAYGDTVGIGINSATRQIIFTKNGQRLGFSDFFVAPSFVGQLFPFVSLRNSDDKIEANFGSNV

SEQ ID NO: 128179 - protein, 275 aa, Heterodera glycines
  Coding regions on vcDNA: vcDNA=SeqID_54602; Strand=+; Position=1 -143,240-370,435-707,988-1268
MSSNFLENDIDEEIIDSSFDFSRPYGPMHFPDSDLTAPISNEALAEFSAWLSENREGRGGLTPLSDLVRFETSNAETETYPDQPMPIPIHMGNREWNVQGPRMNQGYRGDYWRGQRRMPFPVGGRRGGRHWRGQSGNNRYAAQNGGFEEIVVCKIRFVEGAECIFGVQVGIQGVQNAFVVCKLPDGMRQLFNPAPPPPVFYVFRGPAHLLNDPRLFERVNGGSVIFMPPQNTTLKNMILASPQMPMGLQYDRNGVAIFNPAVPPPGYENLRPPGT

SEQ ID NO: 128180 - protein, 85 aa, Heterodera glycines
  Coding regions on vcDNA: vcDNA=SeqID_54603; Strand=+; Position=1-255
  Homolog annotation: Hit_ID=NP_507146.1; Match level="QueryCoverage =100%, HitCoverage=18%, E-value=6e-10, Identity=39%"; Hit description= glycosyl transferase, family 14 (5Q889) [Caenorhabditis elegans] pir||T21408 hypothetical protein F26D2.
DYVVVELEFAATFSPLNWYCFVVDAASPALFKRRVRALAKCFPNVIMGDERPMKSDGEGMMEAVLDCFERLDAPQRKWEYVTLLQ

SEQ ID NO: 128181 - protein, 42 aa, Heterodera glycines
  Coding regions on vcDNA: vcDNA=SeqID_54604; Strand=+; Position=1 -73,392-447
MPFRLTTAGAVAGQIADVLLALIQASSHQIGFLNSFGSMTVS

SEQ ID NO: 128182 - protein, 105 aa, Heterodera glycines
  Coding regions on vcDNA: vcDNA=SeqID_54605; Strand=+; Position=1 -210,935-1042
MSRLEKIPLSLKSRGFNWVESVELENSLGLFALFRVSSPTTLLVFNDQIGTPLYSCYFVSILYHFMCLTTYALFGNHKNILRKCIIFALAFFAEKESHSEVPFTK

SEQ ID NO: 128183 - protein, 58 aa, Heterodera glycines
  Coding regions on vcDNA: vcDNA=SeqID_54606; Strand=-; Position=1-175
MLHFILTFSQVKQFYRTEGFEFLNRIFQCPAELEQITGLAELQRQADAFQSEVIEMDD

SEQ ID NO: 128184 - protein, 248 aa, Heterodera glycines
  Coding regions on vcDNA: vcDNA=SeqID_54607; Strand=+; Position=1 -79,136-803
  Homolog annotation: Hit_ID=P45441; Match level="QueryCoverage=45%, HitCoverage=27%, E-value=1e-11, Identity=38%"; Hit description =Cytoplasmic RNA-binding protein P54 (Y-box factor homolog) (MRNP3) pir||A41786 mRNA-binding protein p54 - Afri
MQAVTRPPIVLERGVSGRVKWFDFSKGYGFITRDDGGQDVFLHASSIVRKVNMYFVLIEGQRVSRTDFESTEGLGHGESGEYNDPRIQVEFDVIDGEKGREAAAVSGPGGIRVGTAIQYNNTARSQPLPANANNSAGRMFIAGRFRRPVGKVLFGVKMRFFGPLTFTPNKSFFGLSKWTSNGLVCPYKCVLPSADSPPNLFSPSAEQQSQVGRRFGPRGGQWRRRRCKGSAALSVRRHSQRPSHVQSE

SEQ ID NO: 128185 - protein, 81 aa, Heterodera glycines
  Coding regions on vcDNA: vcDNA=SeqID_54608; Strand=-; Position=1 -144,204-538
  Homolog annotation: Hit_ID=XP_397276.1; Match level="QueryCoverage =81%, HitCoverage=3%, E-value=2e-16, Identity=58%"; Hit description =similar to CG8566-PD [Apis mellifera]
FADHSSGTDLDVQFPPHIAKGSEFIFRLTVVELLNVPKEYTDMFCQFNFLHRHDEAFSTEPVKGTAKGEHRTLPYNYVQVA

SEQ ID NO: 128186 - protein, 341 aa, Heterodera glycines
  Coding regions on vcDNA: vcDNA=SeqID_54609; Strand=-; Position=1 -158,254-427,546-635,692-830,938-1142,1244-1295,1344-1473,1517-1594
  Homolog annotation: Hit_ID=NP_524891.1; Match level="QueryCoverage =100%, HitCoverage=14%, E-value=1e-114, Identity=58%"; Hit description=CG5092-PA [Drosophila melanogaster] gb|AAF53237.1| CG5092-PA [Drosophila melanogaster]
MQLFGLVNSLILREAETSRRNLTIQRYSITTLSQSSGLIGWVPHCDTLHQLIKDYREKRKIPISEEHNKMQKVSVDVEKSTLLQKVEAFEEALRTTSGDDLRRMLWMKSPNSEIWFDRRTNYTRSMACMSMVGYILGLGDRHPSNLMLDRLSGKIVHIDFGDCFEVAMKREKYPEKIPFRLTRMLVQAMEVTGIDGNYRITCERVLRLLRNHNDSVLAVLEAFVYDPVLNWRLTQEAGTARRAAGGTHHMPTGALAAPTEDNSDATHLNPQDRHVFQHPHRGLGTSRGDSEAISRVRAKLCGRDFNPCVEISVQEQADRLIEQATLNDNLCQCYVGWCPFW

SEQ ID NO: 128187 - protein, 144 aa, Heterodera glycines
  Coding regions on vcDNA: vcDNA=SeqID_54610; Strand=-; Position=1-435
LTMGTVDESLLQSIEFERIILAPFHVFQGIGNALIKELEASTENAEIANEFFRSIRAWREAFRKKDMTGNSIRKVLIHADQLERCYSAEWPQIICQTLGKFAKIQTFTKVHFYLGFLKIKNKFKAQPLSPRDLDELETSIDQFR

SEQ ID NO: 128188 - protein, 190 aa, Heterodera glycines
  Coding regions on vcDNA: vcDNA=SeqID_54611; Strand=+; Position=1 -78,397-619,1212-1338,1629-1775
DPFISDLPTSSNSFTVQNVNISSPKVLNRFRVPSPTTVGLDEDVSAPVIAAATPSPGENVLPRPSLPIPSPPLRPLSPSPPASPPQQLKRKDADVHSPEGGTPNESPSDLSGDCFSHVMNTTATAFERLMVECEIYGPCWLSIVMVSLIEHNCNLEKSTNFDAKMMLNKRFCVVAKLKKGLTLPFDWTAN

SEQ ID NO: 128189 - protein, 174 aa, Heterodera glycines
  Coding regions on vcDNA: vcDNA=SeqID_54612; Strand=-; Position=1 -50,95-178,212-602
MLKRIGEDKNLAIEVNGCYWHIPEREGESGQTMKVKDFNSLYPSRNMFTNSPVGHPKVILMDKNVHWTAPEHIVDEGVKMERIIKCFVVPPRHCLYDIPVIPMRWNNRTLFSLCLKCAETYPKGLVDADYNCPHFEDAERGNCRVCLPIILYFPSQDSRPQSRTSSWRQRCGYY

SEQ ID NO: 128190 - protein, 62 aa, Heterodera glycines
  Coding regions on vcDNA: vcDNA=SeqID_54613; Strand=+; Position=1 -72,140-256
MAGDPSAQQQQQQPNFPASRISISYSKPFEQQQQTIMSQQHEQRQAIMERIRRRLLSELSLM

SEQ ID NO: 128191 - protein, 20 aa, Heterodera glycines
  Coding regions on vcDNA: vcDNA=SeqID_54614; Strand=-; Position=1-62
RFVPLAICPICLILSIKEPF

SEQ ID NO: 128192 - protein, 235 aa, Heterodera glycines
  Coding regions on vcDNA: vcDNA=SeqID_54615; Strand=+; Position=1 -162,221-554,676-885
MRVPRSNAQYIFLMRAPSDMLSIRNLASQMFPREQGFLMDAYKQACADPYGYLLTTKKRLSLYPKMVKKQMVGQRVLDNYEYLKSLGRTTSHKKRRHLLSSAGCEELLTLVEICLNLLNGSFCLTRKQKQKLLPFANTIRRLARVRSEQSARKLILQQQQPQQEGAREGVGVAKGDEDVAGQTNLGFVKRQLETAKRKRTANVSERNVLYNQQLRRYLKLRKEVKDRPLKVQLSN

SEQ ID NO: 128193 - protein, 154 aa, Heterodera glycines
  Coding regions on vcDNA: vcDNA=SeqID_54616; Strand=+; Position=1 -441,796-819
  Homolog annotation: Hit_ID=CAE66724.1; Match level="QueryCoverage =92%, HitCoverage=30%, E-value=4e-51, Identity=54%"; Hit description =Hypothetical protein CBG12070 [Caenorhabditis briggsae]
MPYCSGKLTVMAPVPVEFETALCDATCREGDTLKLKAVLLGEPMPDVTWFINGKKLEESQNIKIHADAGTYTVTIKVLRGRRIVTECQQTIYCAKDITIDYSGLVVCEALNEFGKASSQATLKVLPRGEPPDFLEWLSNVRARPGSQSFYQNLT

SEQ ID NO: 128194 - protein, 237 aa, Heterodera glycines
  Coding regions on vcDNA: vcDNA=SeqID_54617; Strand=+; Position=1 -86,273-314,404-607,718-893,946-1025,1108-1165
  Homolog annotation: Hit_ID=NP_871811.1; Match level="QueryCoverage =94%, HitCoverage=67%, E-value=4e-71, Identity=60%"; Hit description =putative endoplasmic reticulum protein family member, with at least 4 transmembrane domains, of ancient o
QYSQLFGTDDTSVPTVVSSNGILTQSAPIPSAPYKMGYFGATSYVIGNIIGSYVIGNIIGSGIFITPSTVVRCTDSVALSLLVWVVGALIAFLGSLCYIELGTSIREAGCDFAYICYVKWHSIAFSFMWVSVLMTYPATIAVIAETFGQYLMEGLRHFYAVPAEWAPVAQKCFGIALLWLITWMNFFLITWMNFFAIGKFAARFQIAATVAKLLSCALIIVMGFYHLFFKGADGMLA

SEQ ID NO: 128195 - protein, 62 aa, Heterodera glycines
  Coding regions on vcDNA: vcDNA=SeqID_54618; Strand=-; Position=1 -85,222-325
MTQFLFLNNLIIIFKHLSSPTTHPWANAGNWNETVRHHCLNINAYRICHVIHRFDIRKWHLY

SEQ ID NO: 128196 - protein, 87 aa, Heterodera glycines
  Coding regions on vcDNA: vcDNA=SeqID_54619; Strand=+; Position=1-264
MTIETLSIVYVKSFQKFIVTSIPRNPAGLAKWSGGIPIRDPDEIPIPSNPDEFKKSLGTDPEVGIPNLIPRDPEEIPQDPYPVRSLI

SEQ ID NO: 128197 - protein, 120 aa, Heterodera glycines
  Coding regions on vcDNA: vcDNA=SeqID_54620; Strand=-; Position=1 -96,849-938,982-1155
MEQEAFYTVGEFDRSKIDLNKPAMTVEEYMQQSNEFSQSRSEFECVKVPDDDPLKDVQLPPMNDWMRWCQVCFESRLEGFAIAPENEKRFAHHKGTPPTVSLITSLKDHQVNELIIHQIK

SEQ ID NO: 128198 - protein, 189 aa, Heterodera glycines
  Coding regions on vcDNA: vcDNA=SeqID_54621; Strand=-; Position=1-570
  Homolog annotation: Hit_ID=EAA71282.1; Match level="QueryCoverage =83%, HitCoverage=13%, E-value=2e-10, Identity=33%"; Hit description =hypothetical protein FG03378.1 [Gibberella zeae PH-1] ref|XP _383554.1| hypothetical protein FG03378.1 [Gib
MTVGGGTDQEKETKLAAGSGIDPEKETKLAAGSATDAEKAKKMTAGGGTEAGKGEMTVGGGTDQEKETKLAAGSGIDPEKAKMTVGGGTDQEKETKLAAGGGIDPEETKLAAGSGIDPEKAKKMTVGGGTEAGKGEMTAGSGIDPEKETKLASGSGTDAEKAKKQWPRSQPLEKVKRRIILRNIEGADL

SEQ ID NO: 128199 - protein, 125 aa, Heterodera glycines
  Coding regions on vcDNA: vcDNA=SeqID_54622; Strand=+; Position=1 -220,373-527
  Homolog annotation: Hit_ID=CAE70635.1; Match level="QueryCoverage =63%, HitCoverage=46%, E-value=2e-09, Identity=40%"; Hit description =Hypothetical protein CBG17333 [Caenorhabditis briggsae]
MIALRYTYDKELGRCFMKSAISDSYKHSGMTSGLKANTHAGQGALLRNIRIAGGTASAVVHLPNTEDCMQYCTAYGIFSWSPLPPSSTTTTASSNVGRSASSIVPTSSQQQQQGKWPNANWAIRA

SEQ ID NO: 128200 - protein, 52 aa, Heterodera glycines
  Coding regions on vcDNA: vcDNA=SeqID_54623; Strand=+; Position=1 -75,340-423
MKSGSASANSAIPHNPCHFHFPLVKVQPLQNPPSFIVMNKISFINFLCMQNF

SEQ ID NO: 128201 - protein, 66 aa, Heterodera glycines
  Coding regions on vcDNA: vcDNA=SeqID_54624; Strand=+; Position=1 -102,140-238
MTLVFFVIIWQFFQFSFNQWTKCAKICFMAIFKQFVHVFSSDHLPLLLLPGGQAAQMAHLLAFPNL

SEQ ID NO: 128202 - protein, 129 aa, Heterodera glycines
  Coding regions on vcDNA: vcDNA=SeqID_54625; Strand=+; Position=1 -99,568-793,1854-1918
  Homolog annotation: Hit_ID=NP_509786.2; Match level="QueryCoverage =78%, HitCoverage=13%, E-value=6e-23, Identity=43%"; Hit description =adenylate kinase (80.6 kD) (XL288) [Caenorhabditis elegans] emb|CAA92123.2| Hypothetical protein F13E6.2
MGELLRRKVQQNGENELWAKIGKKMDAGEMIPMRICRELIYASVHERCPNSWGFVVEGFPRTLAQAEDIEAQLGHIDLALLIDCTEQFCKDALRKRYTRDKEEGAERAEIFYDWHTAVPESAVGRFLGF

SEQ ID NO: 128203 - protein, 58 aa, Heterodera glycines
  Coding regions on vcDNA: vcDNA=SeqID_54626; Strand=-; Position=1 -43,205-338
MAAIHQTQQTINGISLLNAFNEIPSTIVGTEFDCAICLDPIPSGTSVKPLPACNVKPI

SEQ ID NO: 128204 - protein, 185 aa, Heterodera glycines
  Coding regions on vcDNA: vcDNA=SeqID_54627; Strand=-; Position=1 -54,100-256,313-482,546-722
MNKLHLILKKISANEPIKNSSHSIEYFANNHEYNLIKYRILSIYHNDPPLSQLLNKLIISVMSVINGIEKDKIDGFGIKILKQRLKFVINFVAKRLQIQFDERSNFDFWSENGQIYLLREMSHFLEKVKICSQNDNKCWHNCTKYHENDKKFNEKKRTKQFLQFVAKTIEICEDGTAKRRKRAIN

SEQ ID NO: 128205 - protein, 107 aa, Heterodera glycines
  Coding regions on vcDNA: vcDNA=SeqID_54628; Strand=-; Position=1 -106,638-855
MHVSGDAKVLNSLCSLETNAFSMQLAVILCFVMMVVKLGTQHFAEWGCDPAPINKTYEGCRPMYPDHYEDENVWKCHCELCDIKSREMCNEHHGFEEFYKKFNSTKK

SEQ ID NO: 128206 - protein, 52 aa, Heterodera glycines
  Coding regions on vcDNA: vcDNA=SeqID_54629; Strand=-; Position=1 -56,212-314
MRDFNGQKMDENSPIMDEREFSLPLGRTKWTSKLRTTEENGQNAVITAIKRN

SEQ ID NO: 128207 - protein, 22 aa, Heterodera glycines
  Coding regions on vcDNA: vcDNA=SeqID_54630; Strand=+; Position=1-67
KLRKFLLVLKVKNIKKSINCHQ

SEQ ID NO: 128208 - protein, 54 aa, Heterodera glycines
  Coding regions on vcDNA: vcDNA=SeqID_54631; Strand=+; Position=1 -120,310-354
MAKHSPQHHHPNQRQNTLEELGEFDERDFVPRSEMLRQNRNFIFNTLYYCRIFL

SEQ ID NO: 128209 - protein, 180 aa, Heterodera glycines
  Coding regions on vcDNA: vcDNA=SeqID_54632; Strand=-; Position=1 -36,162-333,385-522,575-654
  Homolog annotation: Hit_ID=XP_514184.1; Match level="QueryCoverage =81%, HitCoverage=46%, E-value=3e-31, Identity=47%"; Hit description =PREDICTED: similar to membrane targeting translocation system protein like (2A562) [Pan troglodytes]
QLLYVSRNFEINVHSRSAGTPVIEWLAAHGAQNVLLHAFSGNVKNAQKGIEKGFFFSIPPSFTLSKEKEALIQKIPLSQLCLESDSPVLEKEALIQKIPLSQLCLESDSPVLGPVAEERNEPKNIKLSAEFIARIKNVSTDEVIRVTTENAKKLVSTDEVIRVTTENAKKLFSKLKLMEY

SEQ ID NO: 128210 - protein, 95 aa, Heterodera glycines
  Coding regions on vcDNA: vcDNA=SeqID_54633; Strand=+; Position=1-662
LFEYPKRTLEKIDFFVFGAVPPNRCAQIYGETESFGNSFPIACTLILRWIFAPHNCLSTPNGHLKKSIFLFSGQSPRADAPRFMGRPNPSGIASL

SEQ ID NO: 128211 - protein, 499 aa, Heterodera glycines
  Coding regions on vcDNA: vcDNA=SeqID_54634; Strand=+; Position=1-1499
  Homolog annotation: Hit_ID=NP_920205.1; Match level="QueryCoverage =91%, HitCoverage=29%, E-value=5e-44, Identity=30%"; Hit description =putative DNA helicase homolog [Oryza sativa (japonica cultivar -group)] gb|AAP52492.1| putative DNA helica
MHREIRETIHMQLHRCSDSWCGPSDPIYGRCKKGFPAPYSKCTILRPDRPAMYFRPSPTDGGAQLEVNGLIYDNSHVVPYNPYILLRYRVHHNVLFAYGNKANIKYALKYPFKGPGHCYVECKQESGNKIGIDEPAQYAKMNFRGATEAYAIVHSLPFAKLSHQVVKLSIHMPNQQPIVYRAFQLVSKAQQIQQGKLPETQCSAYWKQWQNEWKHDPKLKDMLFEKVPEHFIWAKDKWNKRKYNLTKRPPIGRIVPVPPSDPERFALYSLMRHFPGDPDHLKMVNGLLCTSFTEAAIMHGLLEDDKIWDKTLAEAALSRWPDQMRWLFMSILVYGQPSNAVELWNKYKDQMYFPQGITTPAQRQAAELEALADIDWRLHSCFNLSCVHFSLPDPPNSIAKNTNAAINEFFFGDDDLNLPPGQPNPRPKQITPPPLNSDQQTVFDAVVKAIQSDPRDSTVPRRFFIYGDGGTGKTFLFGQIIRRLRKAPYTYKVLATAST

SEQ ID NO: 128212 - protein, 156 aa, Heterodera glycines
  Coding regions on vcDNA: vcDNA=SeqID_54635; Strand=+; Position=1 -180,384-674
MINKNIKNNIFFILPLEVWSILYIYFQLLNPLTGITNADSLENSFDEFAQLVVQNEKKPKLKELMQKQTDTSEQQEMDKAQLLAKIDEVGEIWGHRTKGRQKKSRLRSFLFINEQRKTDKHLEEASFIQYCQAIRLLLMFFSVNFLLKWFKYQPLI

SEQ ID NO: 128213 - protein, 25 aa, Heterodera glycines
  Coding regions on vcDNA: vcDNA=SeqID_54636; Strand=+; Position=1-75
TCTCGVVVKLSTFHNFSPGFNSPLG

SEQ ID NO: 128214 - protein, 76 aa, Heterodera glycines
  Coding regions on vcDNA: vcDNA=SeqID_54637; Strand=-; Position=1-231
MPGSGPGWIFKNDRVPGPASQNPVNPDNPVNPDFPKNRRAGLPGPGKPGTRPGPVRTLENTLNTKVVFSLLFKTNK

SEQ ID NO: 128215 - protein, 43 aa, Heterodera glycines
  Coding regions on vcDNA: vcDNA=SeqID_54638; Strand=-; Position=1-130
MPSARTFVRNCASHPCRKCRTECALVLSAAAQTFAATCLKMER

SEQ ID NO: 128216 - protein, 125 aa, Heterodera glycines
  Coding regions on vcDNA: vcDNA=SeqID_54639; Strand=+; Position=1-378
MNEIFPLDMRGFGKGVANLAIYGTACALDQMFPVISFFLPIFHFYFIFADFSQPNWPTADFCHFCADRFLFTVFHVAMFARNAWQIIGGIGETIQIRRLECAEKAPANSQNLRRSDQNSPKWINQ

SEQ ID NO: 128217 - protein, 65 aa, Heterodera glycines
  Coding regions on vcDNA: vcDNA=SeqID_54640; Strand=-; Position=1-199
LIEHLKSFGMIPIMFDLDDKEKSYSPKTWWGPTRVDTEFPSTSPSRFSHPRKQGPPQPGMDIKTL

SEQ ID NO: 128218 - protein, 72 aa, Heterodera glycines
  Coding regions on vcDNA: vcDNA=SeqID_54641; Strand=-; Position=1 -6,100-210,1457-1558
MGPELPSNSSKALQESPTLGLNFDVVIDKDQQQMRTVHLSMAHGDDGKVYDAPMVGVTVGLSRSGSSGGLLL

SEQ ID NO: 128219 - protein, 41 aa, Heterodera glycines
  Coding regions on vcDNA: vcDNA=SeqID_54642; Strand=+; Position=1-124
MGATLFATACCCAKRRMEAQVKNGQANNKSEETSILISADQ

SEQ ID NO: 128220 - protein, 186 aa, Heterodera glycines
  Coding regions on vcDNA: vcDNA=SeqID_54643; Strand=+; Position=1 -85,204-313,561-800,861-986
MELRGFNPGEKQEVGVFFYNQAIGYHDLICKKSINESKLLFKILVGKNVLKIILNNQNISLSSTYPKQWGIDVQEDNRTMHGALRANTVLNFTITVKAISDFELILSRKGKKDAEEKALLKHLFKQIMVSEQKQPLPAWATQYVTITYKGMATPKAQVFCVPENRCTMKNGEMAYEYVFNKANSTN

SEQ ID NO: 128221 - protein, 398 aa, Heterodera glycines
  Coding regions on vcDNA: vcDNA=SeqID_54644; Strand=+; Position=1 -276,317-432,483-602,663-734,837-917,986-1078,1134-1210,1343 -1384,1474-1565,1780-1873
  Homolog annotation: Hit_ID=CAE64747.1; Match level="QueryCoverage =96%, HitCoverage=60%, E-value=9e-87, Identity=45%"; Hit description =Hypothetical protein CBG09535 [Caenorhabditis briggsae]
SVSVRLKIFHSLIIGKVLLIFKNISNFRFYRITYSSIVFLQYLTAILFSWSLCWLMTVFELIPKDSVARTDKNATQMAIQNAPWARVPLPGQFGTPNFNIGLFVGFLVSAQTRVPLPGQFGTPNFNIGLFVGFLVSAQTTLFEAVGNFHAVASVSEERPPPSERPPPSHAINRGIMAEGLGCFVSGLVGAGVGITTHAENVGVVGITRVVGITRVASRVTMLFGGITMIAFGVVTKLGAVLSAIPDPLVGVVLSTSMAMVGGVAIANVQSVDLNSTRNVAILGFSIMMGMVVPEFYTRNVVPEFYTRNPVSTGHSTVDQVLKVLLNLPMFVGAFTACVLDNSVGGATRAQRGLRERGVVWERPADGRVYAFPEPLQRFLSALPIVRSLPFRSREKPKK

SEQ ID NO: 128222 - protein, 49 aa, Heterodera glycines
  Coding regions on vcDNA: vcDNA=SeqID_54645; Strand=+; Position=1 -106,455-498
MTFYSKHVAISIKTFMNLKVYISRNDFFVGVRYLKNIRFAHQKISLKSI

SEQ ID NO: 128223 - protein, 61 aa, Heterodera glycines
  Coding regions on vcDNA: vcDNA=SeqID_54646; Strand=-; Position=1 -31,140-313
SGCPGASYTGLNFKRGKSMTALIFWTDKVVITGTKNNSEIEEMYHHILPYLKIAQKNLMRR

SEQ ID NO: 128224 - protein, 314 aa, Heterodera glycines
  Coding regions on vcDNA: vcDNA=SeqID_54647; Strand=-; Position=1 -89,178-243,305-389,650-778,1148-1231,1324-1442,1849-1957,2079 -2094,2151-2398
VNGDAISLENDGQFDGNSETITDQQQQLKEFHEKFAKLETELKMAKLELENKALKLKHQEMIGEQKALKEKVAKIEQKNAIFPNLSTSEEMSVLIARIAELNRAKTTEPSVASCEVFGQDGYGMNDDQFSLEEEEEGKEQQEDRKTPTKDVSEDHLKAILERIGEMEKQQQQQTKGEGNLTKMKFLGFSLGFLKFQENCWNAFACHEDIEISGDKSLIVQNMGNYNVMKKENWGFIFGFAVKQQTKLDETILLEKGTYAFHSDGEAFDSDGELWINGEGKGRNGKYSYGVGDTVGIGVNSATRQIIFTKNGLRL

SEQ ID NO: 128225 - protein, 162 aa, Heterodera glycines
  Coding regions on vcDNA: vcDNA=SeqID_54648; Strand=+; Position=1 -306,370-552
MPWPLSAVALHRFSALALGGRARSANDHQQQQQHNGLREKVGQGRAQFGDRERHAELGKKFSLLKKSTSNDGAAHGMVNFCVIYRPFLVFGSQSVDILLFIRGLLEGHFNAKTMDEYLENGKQTETNSYLLTTHLSLRKLTIQLLTVGEHFGYKFQCEELRK

SEQ ID NO: 128226 - protein, 42 aa, Heterodera glycines
  Coding regions on vcDNA: vcDNA=SeqID_54649; Strand=-; Position=1 -67,223-284
MFLSFPTDHRQQLFPFVSLLSPGTQRNSALRYKNCKFILAIN

SEQ ID NO: 128227 - protein, 215 aa, Heterodera glycines
  Coding regions on vcDNA: vcDNA=SeqID_54650; Strand=+; Position=1 -139,187-695
ALLWADEKCRQNGIDCSGDNRRAVLGPALFQIRFPLIPKEDFSEQIVPSGVLTNDEMFAVLLYHSSREIATECQAPCELKFATIRRNYICKRTFLVKIEQFSALPRASDKNYEPIDSAVVDIKGIRWQLAYSFFLFQVNKKSGYFRLSLTCNQNEKGNTQLRNLKVINCAITNTIKLPIGSAIVGQSREQWHNKKRAKNALSGREMTFFVAAGQT

SEQ ID NO: 128228 - protein, 165 aa, Heterodera glycines
  Coding regions on vcDNA: vcDNA=SeqID_54651; Strand=-; Position=1 -130,1088-1455
MPILLFECVFRFFEKVHFLQANVVKTEQQHQQQHNEEDGQVEYVGQLTRFQNDQNTILGRIVQLETQQQQMVNLGVTGQSDRKIHKNKKMPSPKSADCAIIHKTLFACEWSPCPPPHCTNRWPGPSIAKSFFTILWCQIINKVLASMFFFYFFLKLTFYKRNNLK

SEQ ID NO: 128229 - protein, 36 aa, Heterodera glycines
  Coding regions on vcDNA: vcDNA=SeqID_54652; Strand=-; Position=1 -61,793-842
MADPIDSKYFGFVPATEEQQEPGILKILGLGMGLDN

SEQ ID NO: 128230 - protein, 163 aa, Heterodera glycines
  Coding regions on vcDNA: vcDNA=SeqID_54653; Strand=-; Position=1 -243,515-763
MPPLTVQSVIIFSLADKIKSSQERGRQLVLGRRPWHSKFRPQRHDPPGLSPPLCPICFRAYLSQRQFSVVVPPRPRRQPQPAFWKQMMASFFCFQNLLTIAENFKNLTRGHLTAPPNQQFLWFYKNLSQKAHKFVIFMKIQKLHLYIISLVSGFNNSSKNVKH

SEQ ID NO: 128231 - protein, 185 aa, Heterodera glycines
  Coding regions on vcDNA: vcDNA=SeqID_54654; Strand=+; Position=1 -334,415-638
MTPARDLDSITPALAEQERQRTLVLLGLPESNGFRPSERVQEDRKVAIKILDQLDVEAEPTAVFCLGRYDPQRTTPRPLSGHANTHTTNMWHLGDGSASVLDSVLNRTWPVSPMAPASSQTNGPTPVVEDGPNQEEASDDISKPPEVFDQTILVCYEALNSLPPTDKIVHEMQSLKKQFPHLFNK

SEQ ID NO: 128232 - protein, 44 aa, Heterodera glycines
  Coding regions on vcDNA: vcDNA=SeqID_54655; Strand=+; Position=1 -104,289-319
MPDQMRFGTRKLEEKGGKKERRMNERHLTNGTKKRFLWAFENCI

SEQ ID NO: 128233 - protein, 115 aa, Heterodera glycines
  Coding regions on vcDNA: vcDNA=SeqID_54656; Strand=-; Position=1 -12,259-425,721-842,1975-2021
MGVWKSLPLFGLSRSDVFVSAKINIIRPESAKQLFMTSVSDIDEQQFHSVSEYAQFCVEHYIDLCMVHYVKDFCKNISNTCTNNRRDREEVYGVLEHYFLEEMDSKPQEHIPITV

SEQ ID NO: 128234 - protein, 76 aa, Heterodera glycines
  Coding regions on vcDNA: vcDNA=SeqID_54657; Strand=-; Position=1 -108,742-864
MYEQFTIPLEINNCSISQYQMSKDQKLLSDSNIAPKIFNHCSNKNLLTNCPLTDYPLTDCPSLTDCPSLTDCLLTD

SEQ ID NO: 128235 - protein, 152 aa, Heterodera glycines
  Coding regions on vcDNA: vcDNA=SeqID_54658; Strand=-; Position=1 -131,176-301,360-561
  Homolog annotation: Hit_ID=NP_504650.1; Match level="QueryCoverage =98%, HitCoverage=32%, E-value=4e-37, Identity=53%"; Hit description =epoxide hydrolase (51.5 kD) (5G981) [Caenorhabditis elegans] gb|AAB04970.1| Hypothetical protein W01A11.1
ATKPDTVGVALNDSPLGLLAYILEKFVCWTNPSFLKLADGGLGKKFTRDDLLTIVSIYWFNGNILSSQRYYKEHFASDSNTEKLYRKYVAVPTAYAAFPYDLGGVLPREMVSRQYNLTQMTLFEDGGHFAAFECPKELGEDIIRFAQGLSLD

SEQ ID NO: 128236 - protein, 103 aa, Heterodera glycines
  Coding regions on vcDNA: vcDNA=SeqID_54659; Strand=-; Position=1-311
  Homolog annotation: Hit_ID=NP_504650.1; Match level="QueryCoverage =93%, HitCoverage=21%, E-value=4e-18, Identity=47%"; Hit description =epoxide hydrolase (51.5 kD) (5G981) [Caenorhabditis elegans] gb|AAB04970.1| Hypothetical protein W01A11.1
VDFPLNGFFGRGNPFVDNLSIVPFSVNVSNKELAGLKDRLTKCRIGHEQLEDVHDFEYGFPIGELMEWRDRWLNEYDWREAEKKLNAMGDHFRTQIEGLQVGI

SEQ ID NO: 128237 - protein, 108 aa, Heterodera glycines
  Coding regions on vcDNA: vcDNA=SeqID_54660; Strand=-; Position=1 -47,103-382
MSDNRKEAEEKMAKAIFISGDCWLCVFDLLPPSQLGLGIALISHRFDFYVDEHFKTRKWALKSFRIGSKIEKNGTKKMEIANLRGKALPIPQMQLPRKVSVFKRIEIL

SEQ ID NO: 128238 - protein, 41 aa, Heterodera glycines
  Coding regions on vcDNA: vcDNA=SeqID_54661; Strand=-; Position=1 -43,639-721
MFSDFSWKIGLTGKKIRNRNSRTLLIQKSETRLEAVTLEHR

SEQ ID NO: 128239 - protein, 58 aa, Heterodera glycines
  Coding regions on vcDNA: vcDNA=SeqID_54662; Strand=+; Position=1 -43,505-638
MNCSDAAAAAEDDVCLKFLRFRNLNPTEYPEIRKNLGTRRTRIFEIDADRMCQTKSPD

SEQ ID NO: 128240 - protein, 61 aa, Heterodera glycines
  Coding regions on vcDNA: vcDNA=SeqID_54663; Strand=+; Position=1 -66,501-620
MITGSRCDEERDCYRGEYCGDLKLCCLPRRAAQPDEPSQPVRPQPSPGQRTREPSAAGLKK

SEQ ID NO: 128241 - protein, 33 aa, Heterodera glycines
  Coding regions on vcDNA: vcDNA=SeqID_54664; Strand=+; Position=1-99
MPVQISVPVHCELAGGDGLDIVNLVAGFPLIFT

SEQ ID NO: 128242 - protein, 19 aa, Heterodera glycines
  Coding regions on vcDNA: vcDNA=SeqID_54665; Strand=+; Position=1 -32,411-438
MQVPIMWDFFRKIFNSVKT

SEQ ID NO: 128243 - protein, 232 aa, Heterodera glycines
  Coding regions on vcDNA: vcDNA=SeqID_54666; Strand=+; Position=1 -160,255-409,518-628,686-783,838-923,1033-1056
  Homolog annotation: Hit_ID=CAE64379.1; Match level="QueryCoverage =89%, HitCoverage=37%, E-value=3e-40, Identity=44%"; Hit description =Hypothetical protein CBG09066 [Caenorhabditis briggsae]
FLIHLIPSFLKIYNCSPNKLFAPQSLANFKWKSNGPKTLLCHDHRGGYLDYESSKSKGSEQSAEIPFYAFFHWWHIDIFVYFSHRFVTIPPFAWTNQAHKHGVLILGTFIIEKAEICQQTFSNRETIDRLIASLVDCCVVFKFDGWLINIESEVNSDSVGWLINIESEVNSDSVDNLEYFLFSLRNALHDNVLNCSVLNCSVVWYDSVTTDGKLSWQNALNANNFSKRFELF

SEQ ID NO: 128244 - protein, 65 aa, Heterodera glycines
  Coding regions on vcDNA: vcDNA=SeqID_54667; Strand=+; Position=1 -121,323-399
MGENHFCLQNADLQPFYGCSAAFGKDDGSGTSREGHWRFINFLFATIPIEEKDEKIELRYVHSLH

SEQ ID NO: 128245 - protein, 80 aa, Heterodera glycines
  Coding regions on vcDNA: vcDNA=SeqID_54668; Strand=+; Position=1-243
DGGWNCVQPMEILRRYALSVAIFAPGWICEKFSGQSHRILFDNSFRFWNSLSTFLYPHALRQRNFRTRFCGCHSHRNAPN

SEQ ID NO: 128246 - protein, 175 aa, Heterodera glycines
  Coding regions on vcDNA: vcDNA=SeqID_54669; Strand=-; Position=1 -78,168-280,318-396,443-469,650-761,854-974
  Homolog annotation: Hit_ID=XP_317957.1; Match level="QueryCoverage =93%, HitCoverage=78%, E-value=2e-85, Identity=96%"; Hit description =ENSANGP00000020507 [Anopheles gambiae] gb|EAA13076.2| ENSANGP00000020507 [Anopheles gambiae str. PEST]
LTKAMSSDFGNPLKKFKLVFLGEQSVGKTSLITRFMYDSFDNTYQATIGIDFLSKTMYLEDRTVRLQLWDTAGQERFRSLIPSYIRDSTVAVVVYDITNANSFHQTSKWIDDVRTERGSDVIIMLVGNKTDLADKRQVSTEEGEQKAKELNVMFIETSAKAGYNVKQVDQPNEQQ

SEQ ID NO: 128247 - protein, 36 aa, Heterodera glycines
  Coding regions on vcDNA: vcDNA=SeqID_54670; Strand=-; Position=1-124
FSIIRFLFFAFSRTIIDQINTLLVLTKAMSSDFETL

SEQ ID NO: 128248 - protein, 202 aa, Heterodera glycines
  Coding regions on vcDNA: vcDNA=SeqID_54671; Strand=+; Position=1-609
  Homolog annotation: Hit_ID=NP_001004509.1; Match level="QueryCoverage= 90%, HitCoverage=11%, E-value=6e-18, Identity=32%"; Hit description =si:busm1-180o5.3 [Danio rerio] emb|CAD60788.1| novel protein similar to DNA polymerases [Danio rerio]
MPNGKTLREIREMEEKKHEILSRYVELEVVWEHEINQKLKKNKQMREFFDNWKDRSPIKIRDAFHGGRTGPMKLLHTAKPGQKISYKDFTSLYAFTNFTTDYPLGHPKIISIPPNEQTVNWRSPSDNPYKGLLKVLILPPNNNIKVTVMPIKFDQRFLFPLCEKCAKHITAKYPNGLKDNDYSCPHFNPNEAPSCPLAPILS

SEQ ID NO: 128249 - protein, 74 aa, Heterodera glycines
  Coding regions on vcDNA: vcDNA=SeqID_54672; Strand=+; Position=1-223
MLTYKPKEEFVDANKYSNVVISLFTTSMARLYLYEMLKRVADTPGCEILYFDTDSIIYLHPEDNGPLPTEKGHL

SEQ ID NO: 128250 - protein, 194 aa, Heterodera glycines
  Coding regions on vcDNA: vcDNA=SeqID_54673; Strand=+; Position=1 -36,462-1010
MRSATQFHGILNNDNDSAIPDYAKLLIKQLHSLLATASSLVQSQVTANDAIEEDRRQRTVVITNVPEFQSGKASERGEADRALVNLILDTVDLDQTPVVFRVGMRTPNRARPLKMEFPTRHAARHVLRMKGKALALNALHGARIRESMTKEQLAERRKLIEQCAQKRKEDAGDWIIYANQVILRSDIDTIRKNF

SEQ ID NO: 128251 - protein, 66 aa, Heterodera glycines
  Coding regions on vcDNA: vcDNA=SeqID_54674; Strand=+; Position=1 -16,186-370
MLAVGEKSHCQKMGETKIKINQNDEENVANKLASHRGVRQLDDSSTHSKNYFKKHFPLLFMAMNNF

SEQ ID NO: 128252 - protein, 107 aa, Heterodera glycines
  Coding regions on vcDNA: vcDNA=SeqID_54675; Strand=-; Position=1 -263,918-978
MLHQLVQRQWVRAELSHRLGHLCEKKLQPDCVPSAQGFRVGAMRSAKAKRGKRRMIRESRGEMNSQFEPLVISANCLPIDRYNLFDWSAFMRVMESIIHISKFAFPD

SEQ ID NO: 128253 - protein, 67 aa, Heterodera glycines
  Coding regions on vcDNA: vcDNA=SeqID_54676; Strand=-; Position=1-220
PGLKCPAQAKNFFYFREKIEIFPKKIPVDRARKTMFWKWSSFFWENSLKILKMQKPKKRFLGLARKF

SEQ ID NO: 128254 - protein, 67 aa, Heterodera glycines
  Coding regions on vcDNA: vcDNA=SeqID_54677; Strand=+; Position=1 -109,525-619
MMNKFVILTMAFAILALNFIGIAPAGTAEGQQTSKTGSGISSAHRSDVGTAYAMIANDTTPNDVATF

SEQ ID NO: 128255 - protein, 134 aa, Heterodera glycines
  Coding regions on vcDNA: vcDNA=SeqID_54678; Strand=+; Position=1 -187,872-1086
MAESDEEFYFARHINRMKERDNQSPFLHNTIVNWEKQKPYEWDRQQMRIWVKRHSTNEAANELHPLYPLAKRNATNERLVRNVSHLLMLDAAFDREARELCRQFAARVPLRNWAAIAKNMDDEAIKKFVVRPLK

SEQ ID NO: 128256 - protein, 198 aa, Heterodera glycines
  Coding regions on vcDNA: vcDNA=SeqID_54679; Strand=+; Position=1 -130,711-1177
MLNAVNKLELDRAKECVKGALFIQLFIEQVFSEEQSQKLQEAKDNVDKLKDELAQLERKFQAFKAQQQKAERGAKEVKEAYERRRRTRRGIGKKSGEKVPKSAAKNRGKAKMEEAHDQDDDDDFDDDDGSNNDSESDTTESGGNEEEAESSSAKNKGRSATSKWVDRAVVGRTLAKKPLNGNFLKENIHNFAQNEPNF

SEQ ID NO: 128257 - protein, 169 aa, Heterodera glycines
  Coding regions on vcDNA: vcDNA=SeqID_54680; Strand=+; Position=1 -205,832-1136
MSGITPKRKTKAGKSSKSSKEDEEKHDEMMMASEDEEKMMKKQKQKQWKMPTIQPPPSARRRSSRPRNASSTSSRNTNRQHEPLRQIDEDSREGVHSSDGSGTSAAGAGRRRLTENDNSNSNYYVNEWIDQQPEGYDTYNDRISKLRAKLREAEDEYKKQEKGLKGMLK

SEQ ID NO: 128258 - protein, 25 aa, Heterodera glycines
  Coding regions on vcDNA: vcDNA=SeqID_54681; Strand=-; Position=1 -35,596-638
MSETGSKFGAMTCYISISAKVRRIF

SEQ ID NO: 128259 - protein, 52 aa, Heterodera glycines
  Coding regions on vcDNA: vcDNA=SeqID_54682; Strand=+; Position=1 -144,486-500
MNAELPGTESSSNDSAFSEIELENKIESEIVQKNIRTSKTPLKISTRPTRLN

SEQ ID NO: 128260 - protein, 450 aa, Heterodera glycines
  Coding regions on vcDNA: vcDNA=SeqID_54683; Strand=-; Position=1 -1239,1294-1406
RAYNGLPQHLSNEYAIKFLVRAMGNPELALYLELVRTPGMTLDHFVSLAARAESTQKATQRFSRPDNRERTWRTNTPQHFSQTNNGPSRSNFEERGQQMQKFGTQSNRSWSCFNCNSPGHLARDCPQGKIFRAIERTNSSTTINQQGKQQMGYNRQQMPEPNENPPNRHYQQKNYLKQNCLVLQEEQVHQNNFIVGELKQDLEDFFDEIRKCATEDKNSNFSKVGKVMAVLVEVFGTKTKTMLDGGAQISVIEAKFLYNLIRDKKLDVRNLSVLKAENRISDANGNPLECLGVICLPIKRHENSSEVKVAMHIAKPSIGFDLLFGTNALNELGFKMYDAISDTVIDFEKVNQNKIDSLTVIYKTVLEPRATKVIECGLPDQYEGREVLLTSDQENDQIRLEPTFAIGRCNRFAPNHAISRTIWFSAVAVATTSIDRTPSGPTFEPSAKTE

SEQ ID NO: 128261 - protein, 389 aa, Heterodera glycines
  Coding regions on vcDNA: vcDNA=SeqID_54684; Strand=-; Position=1-1170
  Homolog annotation: Hit_ID=CAE56862.1; Match level="QueryCoverage =77%, HitCoverage=54%, E-value=4e-13, Identity=24%"; Hit description =Hypothetical protein CBG24692 [Caenorhabditis briggsae]
MSFVNYSLDRMEDQVTIAIVERNLFQNISAPPNSNAPISLIDKVHQGVIRLEDATNRSLRVINRRATQNTDAINQTTADMNANMDTITTRLDQLVDKVDTLEWSDTNDNRTSLQGNCTMVRRTVFEPEEDEEILNVLTTIDPFASQLPACRDENLTAFDNWAQKFRDLIEYAGTTWTEKEKLGRLKFSLEGSIRKIFDKLPNNKKDTVDKALDAIREKLDSPERKEMSKRALVTCKQRDSETVREFLSRLSPLVSSVCAGQDETQIQSRLKDEFLERVKPNLTFLIRLTGVTKNQDFEAVFSQAQELELLLTNTNESNISDPLKFAVHALNQAPANASWTNNGDRSSNINSWVPSYPNNVNNRQVRYKERSSSQQQQGFSRGRERSGSN

SEQ ID NO: 128262 - protein, 95 aa, Heterodera glycines
  Coding regions on vcDNA: vcDNA=SeqID_54685; Strand=-; Position=1-657
LFEYPKRTLEKIDFFVFGAVPPNRCAQIYGETESFGSSFPIACTLILRWIFAPHNCLSTPNGHLKKSIFLFSGQSPRTDAPRFMGRPNPSGIASL

SEQ ID NO: 128263 - protein, 49 aa, Heterodera glycines
  Coding regions on vcDNA: vcDNA=SeqID_54686; Strand=+; Position=1-162
STGYREAIPEGFGLPINLGASVRGDCPEKKKSIFSRVRLGYSNNYGEQK

SEQ ID NO: 128264 - protein, 122 aa, Heterodera glycines
  Coding regions on vcDNA: vcDNA=SeqID_54687; Strand=+; Position=1 -93,504-637,763-904
  Homolog annotation: Hit_ID=XP_313061.1; Match level="QueryCoverage =72%, HitCoverage=17%, E-value=6e-19, Identity=52%"; Hit description =ENSANGP00000011669 [Anopheles gambiae]
MRAIGGVLPRRAVDEFRRLGPTICGRHTEPAIVSAVKDHVCAVKLHHDIVVDFGAEFVAKLHKMADEHQFLIVEDRKFADTGKTMEMQLAGGRLPAVADWADLVTAHALPGMASILALKPVH

SEQ ID NO: 128265 - protein, 57 aa, Heterodera glycines
  Coding regions on vcDNA: vcDNA=SeqID_54688; Strand=+; Position=1-173
PTQHRRGADGRRLRGQMCADWARMWGLNWWPDSSVSSGAAERATTQQNSNNFCIGHP

SEQ ID NO: 128266 - protein, 45 aa, Heterodera glycines
  Coding regions on vcDNA: vcDNA=SeqID_54689; Strand=-; Position=1-136
MSKQFLLLALLLLLLPIGTLQECSWDVDLCTGSCSTGCEQLSEPK

SEQ ID NO: 128267 - protein, 125 aa, Heterodera glycines
  Coding regions on vcDNA: vcDNA=SeqID_54690; Strand=+; Position=1-378
MPQHSIIKSLPVPSLPTPKKMPQTIKHRLRRALLGPCFAVVLPPPPPPPPNAVGAKFVPPPVPLMCTCDTVVAIALAPSRLSSRMLAGKDTPALPRRALSTLVRATVYDYELGKRRKLSASMRTE

SEQ ID NO: 128268 - protein, 24 aa, Heterodera glycines
  Coding regions on vcDNA: vcDNA=SeqID_54691; Strand=-; Position=1 -22,245-297
MTYFEYLVADSTIQGNILEVDEYN

SEQ ID NO: 128269 - protein, 371 aa, Heterodera glycines
  Coding regions on vcDNA: vcDNA=SeqID_54692; Strand=-; Position=1 -267,314-479,542-1010,1055-1270
  Homolog annotation: Hit_ID=CAE67008.1; Match level="QueryCoverage =88%, HitCoverage=11%, E-value=4e-84, Identity=48%"; Hit description =Hypothetical protein CBG12408 [Caenorhabditis briggsae]
ATNTDRHSKVNGRPHSAPFDTKVPQGIYRTCNSGERGTLYWTGNWVTFLDSLLQTALLAERADTLRLPTRVRYLRIDPTRHLECVEERDGIQVVELRNDIATNGCIAGGVECCDLTAHTVQRRPQTAGQLFLEKLYFVKHVDNNSLADSPREREILAEYRNLLYSIILNGLRQWSKSGVLAQITNGEQFEHALKLLEGKEDIPTVADEERKRKFLDDSKSVNTRIDFPKNESSLNRCSLVNALDELFNLPTNNPLGEGQDNAKKFEQVAVNKLSAFYKTFDNDRYWSQALLHDRFSKSAQDICMENSATHRNRACGVELSSTDVLKHCVNGSKSHPLLEIEWTCVGPHMEHQLFLEKLYFVKHVDNKSRTV

SEQ ID NO: 128270 - protein, 224 aa, Heterodera glycines
  Coding regions on vcDNA: vcDNA=SeqID_54693; Strand=-; Position=1-675
  Homolog annotation: Hit_ID=CAA24816.1; Match level="QueryCoverage =86%, HitCoverage=59%, E-value=2e-36, Identity=44%"; Hit description =unnamed protein product [Human herpesvirus 4] ref|NP_039875.1| nuclear antigen EBNA1 [Human herpesvirus 4]
MDIFDQILENLNKLYMPKKIPKKNRTGGGANANANVAGGGANANVAGGGGGANANVAGGGAGGGANANVAGDGGGGGANGGNVVGGGANANGANANLAGDGGGANANVPGGGGGANANVAGGGGGANANVAGGGANANVAGDGGGGGANGGNVVGGGGGANANGANANLAGDGGGANANVEGGEGGNNANGANANLAGDGRGANGNVAEGGGANANGTKLLLIS

SEQ ID NO: 128271 - protein, 74 aa, Heterodera glycines
  Coding regions on vcDNA: vcDNA=SeqID_54694; Strand=-; Position=1 -172,871-923
MAQHRLLDQIPELLADVPVPDYCVFGDQPVGEEIGDGARFEPDHELTINAFIGPAGTALEPSISISIWFGHEFT

SEQ ID NO: 128272 - protein, 64 aa, Heterodera glycines
  Coding regions on vcDNA: vcDNA=SeqID_54695; Strand=+; Position=1-234
STFNSQCFAQPSINVHFQLILSIVCFSVRHYPTVTWKKIRNIQEKFQRKNTFYLVIIAIGDNFY

SEQ ID NO: 128273 - protein, 434 aa, Heterodera glycines
  Coding regions on vcDNA: vcDNA=SeqID_54696; Strand=+; Position=1-1302
  Homolog annotation: Hit_ID=XP_320617.1; Match level="QueryCoverage =94%, HitCoverage=47%, E-value=5e-44, Identity=29%"; Hit description =ENSANGP00000024791 [Anopheles gambiae]
MELQSITLGVKLLKYVLQHLKLKPTQTTIWTDSLCSVERIKEHKKCDRFFSNRLAKIRGQFEVKHLVSADNPADVASRGTTPRELSRNLLWKHDPKWLSEEKALWPKPAKVYHPDEEKLRGSAEDEEVKTAAVMNEVPFQPTIDVNRYSSWKKAKTVGAYVLRWIHSVAKNGYNGNLLPILSKMGPKKHGNQDKGVLSVPELCASEHLLIWEAQQQFPTEEKTKENLRVFKDKEIWRCRGRIGEATVKEETKFPIFLPPEARATKLIVLEAHWKMKHPSHSTLLGYIREKHWIPKGRRFIRNTILSERHGCLNCRKERLKPYAYPQMPNLPSERVAMIRPFEKTGVDYFGPLTIKGGVKVYIALYTCLVIRAVHLEVADDCTATEFLRTFRRFSSRRGLPSLMWSDNGTNFIAGAECIKEEWRREILVETSHSG

SEQ ID NO: 128274 - protein, 164 aa, Heterodera glycines
  Coding regions on vcDNA: vcDNA=SeqID_54697; Strand=-; Position=1 -144,420-593,727-900
PRREAGQFQKFCTTFYCGKSKYFIGQLRVNEHSRLWPVVKRKMEISDGLLIMQYNAFKPRREAGQFQNFVPHFTVESPSTLLDNYVSMSTVAFGQLWNGKMGISDGLLIMQYNAFKPRREAGQFQNFVPHFTVESPSTLLDNYVSMSTVAFGQLWNGKMGISDG

SEQ ID NO: 128275 - protein, 76 aa, Heterodera glycines
  Coding regions on vcDNA: vcDNA=SeqID_54698; Strand=+; Position=1-388
GGTVPKFCTTFYCGKSKYLIGQLRVNEHSRLWPVVERKNGNIRWGALFSKNSSFRLTIPPFCALFRFKIESFFLAF

SEQ ID NO: 128276 - protein, 70 aa, Heterodera glycines
  Coding regions on vcDNA: vcDNA=SeqID_54699; Strand=-; Position=1-213
MKRKFLLILKETDENGREKDEGGEEEEDEESDDGNGEEKHPPPPKKARLSTEAEEEVPLPALLLCNYSWH

SEQ ID NO: 128277 - protein, 165 aa, Heterodera glycines
  Coding regions on vcDNA: vcDNA=SeqID_54700; Strand=-; Position=1 -78,131-292,338-456,531-669
  Homolog annotation: Hit_ID=NP_495416.1; Match level="QueryCoverage =96%, HitCoverage=98%, E-value=7e-62, Identity=68%"; Hit description =CYcloPhilin (18.0 kD) (cyp-10) [Caenorhabditis elegans] gb|AAK68671.1| Cyclophylin protein 10, isoform b
MAVTLHTTVGDIKLELFCERCPKSCENFLAHCASGYYDNCIFHRNIKTFIVQTGDPTNRGTGGQSIWDAPFEDELHEDLKYDARGMIGMASNGPNTNRSQFFITYEKQPTLDLKHTLFGKVIDGFDELEELENTKVDARYRPVVEQRIRSVTIHANPIADGAAEQ

SEQ ID NO: 128278 - protein, 15 aa, Heterodera glycines
  Coding regions on vcDNA: vcDNA=SeqID_54701; Strand=-; Position=1 -3,194-238
MNFVSRAICQVMEEK

SEQ ID NO: 128279 - protein, 27 aa, Heterodera glycines
  Coding regions on vcDNA: vcDNA=SeqID_54702; Strand=-; Position=1 -15,68-136
MLVRNMIFIIGLFDLHVPYIIDELLHF

SEQ ID NO: 128280 - protein, 322 aa, Heterodera glycines
  Coding regions on vcDNA: vcDNA=SeqID_54703; Strand=+; Position=1 -130,542-1239,2186-2326
  Homolog annotation: Hit_ID=NP_701073.1; Match level="QueryCoverage =81%, HitCoverage=10%, E-value=2e-13, Identity=24%"; Hit description =hypothetical protein PF11_0213 [Plasmodium falciparum 3D7] gb|AAN35797.1| hypothetical protein [Plasmodiu
MTDLPKERCTSFHSRSPTRANPTRPPGDGLPAACQQPSGATSEELNNLPQNIQNGECFGILIEPEDEEAEIEHYSLHFEIHVKPMGNECQPSQADENDQNPPADQNDQNPPADQNDQNPPADQNDQNPPADENDQNPPADQNDQNPPADQNDQNPPADQNDQNPPADQNDQNPPADAEDNRTIFRKISLKLYRPNMAQVYTVNLGKIDPPELYFNRTIFVAKENDLTNYHALLYALMHKNQEDSDQYYDLLGYVQLIKIKDEEEQEAHASSQSEKKNENHNEKMENEEETEPKECPICYESFDDDDKLAMKLHEDYQANNLN

SEQ ID NO: 128281 - protein, 85 aa, Heterodera glycines
  Coding regions on vcDNA: vcDNA=SeqID_54704; Strand=-; Position=1 -210,718-763
MPKLLTNFCALILICQITFLASTNPLEETPQKSLAKKRLKILVYSPTIGWSHMQFMGSIADTLVGAGHDVKLNEQFGKILCEICR

SEQ ID NO: 128282 - protein, 22 aa, Heterodera glycines
  Coding regions on vcDNA: vcDNA=SeqID_54705; Strand=-; Position=1 -34,92-126
MGVWVRKEKGIVFVHIHKWSSG

SEQ ID NO: 128283 - protein, 311 aa, Heterodera glycines
  Coding regions on vcDNA: vcDNA=SeqID_54706; Strand=-; Position=1 -135,191-617,679-833,890-1107
  Homolog annotation: Hit_ID=NP_586080.1; Match level="QueryCoverage =59%, HitCoverage=27%, E-value=8e-12, Identity=30%"; Hit description =similarity to ribosomal protein L5 [Encephalitozoon cuniculi] emb|CAD25684.1| similarity to ribosomal pro
MLPAPLVGFILLLGHFVFVSVGSNFHVLKKRGYDESESYSSEEEPTYKRHGYGGRFGGKRHRYPPAHGKGHRPSTYDGFPYGDSPLLPQVIAAPPMPFSPLQLPSISKAQSDLGALQVASPVLEGSPPKESPPLDASQPLNGATAIQSPAAAPETNIMNSLAASPPLATPQQLASLWVGGRKKRSFKEPKTKKAKERKAIRENEPQGTETTLAADTEETTEKPTKKAAKEKPKQRMMEEKGEKEAEKKKGGEAGKEGEQVGKTKKKQQQKAEKQEKKRHRKEEEEEEEESLLGKKEQHNAEFKQGGPQFRS

SEQ ID NO: 128284 - protein, 19 aa, Heterodera glycines
  Coding regions on vcDNA: vcDNA=SeqID_54707; Strand=-; Position=1 -21,60-98
MHMPILAALRFTFHFERIS

SEQ ID NO: 128285 - protein, 280 aa, Heterodera glycines
  misc_feature (271)..(271): Xaa can be any naturally occurring amino acid
  Coding regions on vcDNA: vcDNA=SeqID_54708; Strand=-; Position=1-886
  Homolog annotation: Hit_ID=AAK61383.1; Match level="QueryCoverage =100%, HitCoverage=94%, E-value=7e-49, Identity=47%"; Hit description= basic proline-rich protein [Sus scrofa]
PGDCGSPAGPAPPGDCGSPAGPAPPGDCGAGQGPAPPGDCGSPAGPAPPGDCGTGQGPAPPGDCGSPAGPAPPGDCGTGQGPAPPGDCGSPAGPAPPGDCGTGQGPAPPGDCGSPAGPAPPGDCGTGQGPAPPGDCGSPAGPAPPGDCGTGQGPAPPGDCGSPAGPAPPGDCGSPAKPAPPGDCGSPQGPAPPGDCGSPAKPAPPGDCGSPAGPAPPGDCGSPAGPAPPGDCGTGQGPAPPGDCGSPGGPAPPGDCGSSDKDLPLRGNCGXPAKGPAPPG

SEQ ID NO: 128286 - protein, 30 aa, Heterodera glycines
  Coding regions on vcDNA: vcDNA=SeqID_54709; Strand=+; Position=1-91
MEWSKRRDRSVEEAAVLIGTEQSSANLGSD

SEQ ID NO: 128287 - protein, 63 aa, Heterodera glycines
  Coding regions on vcDNA: vcDNA=SeqID_54710; Strand=+; Position=1 -110,159-239
  Homolog annotation: Hit_ID=CAE74862.1; Match level="QueryCoverage =100%, HitCoverage=38%, E-value=2e-21, Identity=66%"; Hit description= Hypothetical protein CBG22717 [Caenorhabditis briggsae]
MGEVRFHSDYVSSNRGITKIIQIVLGFVVCSVLCSNWYGGYSCFGEGRLGYVSGLNFVCLMIN

SEQ ID NO: 128288 - protein, 43 aa, Heterodera glycines
  Coding regions on vcDNA: vcDNA=SeqID_54711; Strand=-; Position=1 -69,373-435
MERHFHVQKAFQKEKHLALFENAWTNVEQIEQEKDAQKINKRQ

SEQ ID NO: 128289 - protein, 79 aa, Heterodera glycines
  Coding regions on vcDNA: vcDNA=SeqID_54712; Strand=+; Position=1 -157,215-453
  Homolog annotation: Hit_ID=NP_509390.2; Match level="QueryCoverage =84%, HitCoverage=31%, E-value=8e-10, Identity=38%"; Hit description =putative protein family member, with at least 3 transmembrane domains (XI852) [Caenorhabditis elegans]
ILFLLNLFNIRPLKLEQLYNVAAALLLLVGIVLLLWYMIQYSYWNIWMIIAAVCVLIIFLLFQWDFKGNRTMSEGHLPI

SEQ ID NO: 128290 - protein, 107 aa, Heterodera glycines
  Coding regions on vcDNA: vcDNA=SeqID_54713; Strand=-; Position=1-324
MLLAMPKAVQLPVKVQNRTEEDKTKGQKDGERRRMGRDKWQKNLTEGKLGKKQGNGTIEETDGTERVVDREKDDRNEQSGTQRQSEHLKGTKKQTVNGKCGTQKPAK

SEQ ID NO: 128291 - protein, 293 aa, Heterodera glycines
  Coding regions on vcDNA: vcDNA=SeqID_54714; Strand=+; Position=1 -22,271-1130
  Homolog annotation: Hit_ID=NP_702063.1; Match level="QueryCoverage =86%, HitCoverage=5%, E-value=1e-12, Identity=21%"; Hit description =hypothetical protein PF14_0175 [Plasmodium falciparum 3D7] gb|AAN36787.1| hypothetical protein [Plasmodium
MKGYAELSAAPHNFLRQRYSLGRFAASYWCLRPPTIFCANPPSFNHWDSTHQHSNQRDSPTNIPINGTQLSSIQSLGLNSPAFNHWDSTHQHSNQRDSTLQHFNHWDSTHQHSNQRDSTHQHSNQRDSTLQHFNHWDSTLQHSITGTQLSSIQSLGLNPPTFQSTGLNSPAFQSLGLNPPTFQSKGLNPPTFQSTGLNSPAFNHWDSALQHSITGTQPTNIPIKGTQPTSISISGTQPTNIPINRTQPSSIQSLGLNPPAFQSLGLNPPAFQSLALNSPAFQSLGLNPLAFNH

SEQ ID NO: 128292 - protein, 87 aa, Heterodera glycines
  Coding regions on vcDNA: vcDNA=SeqID_54715; Strand=-; Position=1 -175,1534-1620
  Homolog annotation: Hit_ID=NP_498808.1; Match level="QueryCoverage =70%, HitCoverage=10%, E-value=1e-21, Identity=68%"; Hit description =GTP-binding protein like (3J337) [Caenorhabditis elegans] pir||S44605 C02F5.3 protein - Caenorhabditis el
IDELIDVIQGNRVYIPCLHIYNKIDQISLEEMERLARLPHSIVISCELSLNLDYMLEKRWQDVERRNNYIFDIYRKQQNVMKEPESG

SEQ ID NO: 128293 - protein, 52 aa, Heterodera glycines
  Coding regions on vcDNA: vcDNA=SeqID_54716; Strand=+; Position=1-165
KFVFNVIKLAKMYCANAKKCCRPLVNHSRAFSIHQWRAFKACRESNWTMAIS

SEQ ID NO: 128294 - protein, 101 aa, Heterodera glycines
  Coding regions on vcDNA: vcDNA=SeqID_54717; Strand=-; Position=1 -150,549-704
MNNNHNDDDDDEAFGGGQAEQAGTARGVQFLRNFATTPTARLHSGEQTCQGYMQKAGGHAEADVQETGGPVCPCVCCADAVEATPARCHGHAVLAAAKAMN

SEQ ID NO: 128295 - protein, 61 aa, Heterodera glycines
  Coding regions on vcDNA: vcDNA=SeqID_54718; Strand=+; Position=1 -75,597-707
MVAHYLESNETFLRNFYYLTVPSMLKINRNRKEGYDYGGYGYCTSHHTQMAVGIIMEFEMK

SEQ ID NO: 128296 - protein, 90 aa, Heterodera glycines
  Coding regions on vcDNA: vcDNA=SeqID_54719; Strand=-; Position=1 -168,315-419
MRKCTPFDRRFSSDCPSLATGSVSQNWPGQNSFYVLMVFIKEYQDIRRSYDHRLPTTKFAIMDLRMRSNCFTLTPSQWDFTRVFMFPIGL

SEQ ID NO: 128297 - protein, 245 aa, Heterodera glycines
  Coding regions on vcDNA: vcDNA=SeqID_54720; Strand=+; Position=1 -336,750-1024,1085-1211
MTIKAFFIFVREIWPIFSENIRHLGFNDGDHLDNLRRQISPTILTDLNQLNSIYSFDRLPSAFGDGFDGPISAGQALSKWLHSPRKDGQPKRLRCYNYNEQANTDWINNFKEHFLRANAISSVSYQIHFSVPAPSMPMVPFELVNEWTKEKLTLAKTNEWDIDWIMKRCKIIGETAAVYWEDGNWDNNCNNVSIRLFICSNCIGPLSPPPKEEDEAGQSSEKGASSADKMSDGQKNKNSDQPQKK

SEQ ID NO: 128298 - protein, 201 aa, Heterodera glycines
  Coding regions on vcDNA: vcDNA=SeqID_54721; Strand=-; Position=1 -16,427-1016
MGGGGGFLAPKNPVSTNERPIFCLVFSDNKVLLSHYDRILFGANLKRDEDDPIVHLLLADVIIFVRWVEEKLGLTRRRSIATKRIEKSWETRIELFEGFYDKIWEEDERKVRQLGEVVTGLLDKLKQCLEKDTTKVLEDELWAQIMEKGNAKTIDMEKRRAYEKWKRSLHWDIIGTLIREEPAFADRMKNGANFTHLLGQC

SEQ ID NO: 128299 - protein, 139 aa, Heterodera glycines
  Coding regions on vcDNA: vcDNA=SeqID_54722; Strand=+; Position=1 -312,737-844
MTRFGPVNQRASISPPRLVAPEFVVLQIGQAAVSSQQSQQIPENVHLINKEEGELSDSGGESSDEIQFVANVPARGQNPSAASEQRRAQSSVPRMAWNRRPPLSPVRITPGGPPQPLFPPIVQPVQPSVPLNVPSPLSV

SEQ ID NO: 128300 - protein, 68 aa, Heterodera glycines
  Coding regions on vcDNA: vcDNA=SeqID_54723; Strand=-; Position=1 -7,495-694
MKTRFGGIADEIGGGGTEKADWGKVEEEFWGKERAEEGKKRRAGGVRPRFEWLECPKNEINSITNKRS

SEQ ID NO: 128301 - protein, 276 aa, Heterodera glycines
  misc_feature (161)..(161): Xaa can be any naturally occurring amino acid
  misc_feature (186)..(186): Xaa can be any naturally occurring amino acid
  misc_feature (202)..(202): Xaa can be any naturally occurring amino acid
  misc_feature (227)..(227): Xaa can be any naturally occurring amino acid
  misc_feature (231)..(231): Xaa can be any naturally occurring amino acid
  Coding regions on vcDNA: vcDNA=SeqID_54724; Strand=+; Position=1 -815,1641-1669
  Homolog annotation: Hit_ID=T02995; Match level="QueryCoverage=100%, HitCoverage=50%, E-value=3e-63, Identity=52%"; Hit description =unspecific monooxygenase (EC 1.14.14.1) - common tobacco dbj|BAA10929.1| cytochrome P450 like_TBP [Nicotiana
MYRPSQTPRLTLSSARVGVARLNTKMDTLSGALPFYRLSKESMKVVVFHWRLAAPTYATPLMILHKVRLESSSTGSSFPAKFAKPVPLAVVSLDSRRDSGNLVDPFVRVGKPTRHLATLRESCYSPVYPRLIKFPWLNIQSTGQKSDTVNVHKDHPSPLFXLDSRIPRVRASSKLVVQRQPKCIPXRAYTQLKRSTSSSHHXSTHHPRKNSTQPRAKAACFTQQPGXPDLXSQFFSRSYESNLPTSLTYIILSTRGCSPWRPAADIATLASYPFRV

SEQ ID NO: 128302 - protein, 74 aa, Heterodera glycines
  Coding regions on vcDNA: vcDNA=SeqID_54725; Strand=-; Position=1 -116,496-604
MAVFDDGIAAGHQQGQPRHQSTATGAEDVLMYDHPFNDGRPLNRKKYSKSGFRGLIFFIAPKTVSNAFCKIKLL

SEQ ID NO: 128303 - protein, 77 aa, Heterodera glycines
  Coding regions on vcDNA: vcDNA=SeqID_54726; Strand=-; Position=1 -146,193-282
DEALHSVWMRLEQLWKTMPDEEQMRKLLEHNFVSNWLLDTGKIDEMKRDREEQQGEIGDQRETDEDSNGEEEQFDFE

SEQ ID NO: 128304 - protein, 39 aa, Heterodera glycines
  Coding regions on vcDNA: vcDNA=SeqID_54727; Strand=-; Position=1 -109,317-327
MSEPMLLFFLKVAAKSNLARIELLNGVVLEKVGVMRSIF

SEQ ID NO: 128305 - protein, 23 aa, Heterodera glycines
  Coding regions on vcDNA: vcDNA=SeqID_54728; Strand=-; Position=1 -21,202-252
MQIVWITRVSAFLCQTFDSKIFR

SEQ ID NO: 128306 - protein, 30 aa, Heterodera glycines
  Coding regions on vcDNA: vcDNA=SeqID_54729; Strand=-; Position=1 -62,729-759
MSGPIWASISDTAKDLLRQLLDINYTVPYV

SEQ ID NO: 128307 - protein, 177 aa, Heterodera glycines
  Coding regions on vcDNA: vcDNA=SeqID_54730; Strand=-; Position=1 -310,483-625,681-761
  Homolog annotation: Hit_ID=XP_316911.1; Match level="QueryCoverage =83%, HitCoverage=14%, E-value=2e-12, Identity=29%"; Hit description =ENSANGP00000006552 [Anopheles gambiae]
ELLDPGKGFYDKDEDKVTLAIDVIVDEPKTEKIISDPNKSNGTLSMEIEKLSEFAREIVWSERKSETVYIKGMPWKILAEIEKKNESTEKWLGFYLLCDASKKDGNWSRKCSGTLRIVSQKNGVEDFKKELDETVFNNESKSWGNNFISFVELMDPSKGLYNKDEDNVTLAIDFTCE

SEQ ID NO: 128308 - protein, 334 aa, Heterodera glycines
  Coding regions on vcDNA: vcDNA=SeqID_54731; Strand=-; Position=1-1004
  Homolog annotation: Hit_ID=XP_425775.1; Match level="QueryCoverage =69%, HitCoverage=24%, E-value=1e-12, Identity=29%"; Hit description =PREDICTED: similar to Ser/Arg-related nuclear matrix protein; plenty- of-prolines-101; serine/arginine rep
MANKFLLVPQEIYRGLTSVSDTGDLNLDAVRHDLNRARGERTNPSTKNVNYNQQLRRYLKMRRDLADRPAKVELTKGISVLMRRGGEDEDGEVVDTTPRPPAPPPPPPSPGRRTPRGPPPPPTGRRSPSGPTPPRPSPPGSPPPRPERPQRPSRASRRGGRLEKWRKSRYNIQQRQPVVRDLLAEAAAAPLPESDDEDDYMLESGFALPAPSQYYGDLPVLPDNANEIEEMDTAQHRIATRRKLQKDEANDNDDDDLRRKRFLVYHRSPPRLTSPPRLKTKIEPRPPPPRPTAKREKQQAKLDWKKNQHPTPAPRAKREPELKLDPRPSTSRQA

SEQ ID NO: 128309 - protein, 477 aa, Heterodera glycines
  Coding regions on vcDNA: vcDNA=SeqID_54732; Strand=-; Position=1-1434
MSMLFMQMIKPSSADDYKLSVMTMNEQLLKKHIVFITIELEKGSISILVADLKYKIEQKIGIPPERQTLRCKKPYGIPCSGEISHNEPVFLSLDEFEISVWNPHKKHTVWVNSADAVRVLKKKIQVVISIDPARQTLYQFDLAELESAIGEKINERVLVDATDEKQEPRKIERAMRNVNGALIDEVASHKTMSEYGIEEKANIYVSVDGFEILVQYEEEKIGKNGVVKLKSNPYYIYRVNSTDTVASLKRTITNQVNNFHPSRAISAYELTVRLGSHYDIALEDNKTMKDCGIGRLGTVYASTFEFEICVWYGGKPYTIVVNKGNTVQTLKQKIKGIIGIPPERQTLRRNLPTAKVLEDNKKTMEFYVIEKGTIVFLALDEFVIHVNYLLEQTHKKGLKLKELKKENTRNVWVNSEDTVAILKHKIDAMMSWIDVFHYEFISGHECLTASGGDENVKTVKQCGIEEGHTFKVKEMKL

SEQ ID NO: 128310 - protein, 123 aa, Heterodera glycines
  Coding regions on vcDNA: vcDNA=SeqID_54733; Strand=+; Position=1 -177,238-432
  Homolog annotation: Hit_ID=CAE63868.1; Match level="QueryCoverage =83%, HitCoverage=29%, E-value=1e-09, Identity=34%"; Hit description =Hypothetical protein CBG08433 [Caenorhabditis briggsae]
MAQNDDGTNGTILSNKSAPNSMDFASLTSENESLLNVLVGCAMMALSSLCLAANSLVVKTIVMDKNLRRQNSYKFMLALCLVDCSQSVVHFITGFFTIDQSNFDQFLSEVIIVYIIIVFSTIP

SEQ ID NO: 128311 - protein, 187 aa, Heterodera glycines
  Coding regions on vcDNA: vcDNA=SeqID_54734; Strand=-; Position=1 -294,348-617
MLKDTIREMSLDDFNRRQIRQLAPSMLNDCQSLISVTFYGPIYPEFPPDDSANASDGQAITKWLFLPRPDNLMKELTICIEDSAVEQQWLAAVEQIKAAFSNASSPVYFDITVYFPPPSSLSAVVPFKLTNEMTGEKLEMYKEDVEEDLSCFSLIRCPIAPDDKREQMIKELDKRWNRINIFLIGDG

SEQ ID NO: 128312 - protein, 303 aa, Heterodera glycines
  Coding regions on vcDNA: vcDNA=SeqID_54735; Strand=-; Position=1-912
MASINDLDYVRDYDYVYDLDFDEVEECVEILDQENERNIRNYDVFEEHNYAKRQRFVDGGPSQGSMNLDAEVAGSSRMTDSQFEDRRLENLRKKRERDRIRWHNKSQESRNVRLEQMRNRNCNAIADESVAQRRMRLEQMRNRNCVAIADESVVQRQIRLEQMRNRNCVAIASASVFERQLRLEQDRIRHRVIRQGVVNVYAAGSHENANEHRLSQMNMRCEFCDALHFVEEKVIGRGNSFKDCCHYGKVFVPEIPEQDFPEELRDLFMKFDARHINVFENIRHLNSSVSNGSMNPLRYRYPE

SEQ ID NO: 128313 - protein, 119 aa, Heterodera glycines
  Coding regions on vcDNA: vcDNA=SeqID_54736; Strand=-; Position=1 -100,648-907
MVTGMPNDGGEFSQSKSPSTPLLSHRQQQYRQEASRDRLNKYASAESSPYQQQQQQRVDDYMTGMATSTTTAFAMNNNGTTTGGGGKASSRRASRDSGELIAGGNLINHFKNLVQVIVK

SEQ ID NO: 128314 - protein, 238 aa, Heterodera glycines
  Coding regions on vcDNA: vcDNA=SeqID_54737; Strand=-; Position=1 -146,542-675,1199-1371,1784-1935,2310-2419
  Homolog annotation: Hit_ID=CAE64723.1; Match level="QueryCoverage =95%, HitCoverage=26%, E-value=3e-44, Identity=47%"; Hit description =Hypothetical protein CBG09510 [Caenorhabditis briggsae]
MGRHDDLWSLFYMLVEFLNGSLPWRRIKDKDEVGRMKEEADIRELLSGNPPELHHFADHLKGLGYSDEPDYELLENCLQVAMKRLGIGINDPFDWENNYVNIHDNNRQTVGLQQAIGDGKMTSKMGGRSHTTAVREHGPAGEKANRGLDTQAPVTDEQMTREDCDEQTGNFYAQNVAAAPHNDSSHGRDEAKPKYKRQEFMRAKIDHPNVQSSAAAISAVNERSKRCPASPPDQWGGR

SEQ ID NO: 128315 - protein, 137 aa, Heterodera glycines
  Coding regions on vcDNA: vcDNA=SeqID_54738; Strand=-; Position=1 -225,541-727
MAKEQKRQTLAELIAMESEAQSLAKGTSMAQLIEMERIDRGEFEQFVGEMNENEYLIGEVFEQQQQNKMAKQHSMNEKKGMFKKMVKMFSKNKDKMKVQEENQLGREVPKFEQFKRDRPGKWHNYGEIAMHIKEGQS

SEQ ID NO: 128316 - protein, 60 aa, Heterodera glycines
  Coding regions on vcDNA: vcDNA=SeqID_54739; Strand=-; Position=1 -170,241-253
MALEICAFDNQPTFTLFLAVVTCSIKIGPDLPIICGWIIVQKRTDDLLPSAFTAAHRSLF

SEQ ID NO: 128317 - protein, 250 aa, Heterodera glycines
  Coding regions on vcDNA: vcDNA=SeqID_54740; Strand=-; Position=1 -8,204-479,535-958,1484-1528
  Homolog annotation: Hit_ID=AAL78214.1; Match level="QueryCoverage =55%, HitCoverage=72%, E-value=8e-11, Identity=27%"; Hit description =putative esophageal gland cell protein Hgg-20 [Heterodera glycines]
MILFISADCWLCVFGLITPSQLGHGIAMISHRFDIYVDEHFKTRRWTLALIQIHSKIGKNGTKEMEIVTDGGEALPIPQIEMPRKVIGFERINIFFIDRNAITFLRRFCQLFTNCPINLTIDPYYNDRILESILRNIWPMLGKNIYGLELSADVFRRLRQFVPSILNDFPSLRVFSISVADHFIEFPAGDNAMASNGQAVAKWLFTPLQSNVPKVFQCALEMDLGNLASNIEDFKAASRAIPGPSDQQQK

SEQ ID NO: 128318 - protein, 179 aa, Heterodera glycines
  Coding regions on vcDNA: vcDNA=SeqID_54741; Strand=-; Position=1 -378,492-593,699-758
  Homolog annotation: Hit_ID=S42136; Match level="QueryCoverage=69%, HitCoverage=8%, E-value=6e-10, Identity=32%"; Hit description=cnjB protein - Tetrahymena thermophila gb|AAC37171.1| cnjB [Tetrahymena thermophila] prf||1922371A cnjB gene
MTSNSTDGWGCNNSGWGQSQAKMTSNSAADGWGCNNSALRPNQAKMTSNSAADGWGCNNSALRPNQAKMTSNSAADGWGCNNSALRPNQAKMTSNSTDGWGCNNNGWAPSQAKMTNSTDGSGCNNSPLMNKLPPIPPSTILFVDGIENKNKKLPLLSVEEYLFADCDPNDSNKVFNPSV

SEQ ID NO: 128319 - protein, 54 aa, Heterodera glycines
  Coding regions on vcDNA: vcDNA=SeqID_54742; Strand=+; Position=1 -40,110-234
MDIMHKAMILACFVFSLLLPFVSTATKVNSWYSNQWWSPAEESGSIEDEKVRKW

SEQ ID NO: 128320 - protein, 289 aa, Heterodera glycines
  Coding regions on vcDNA: vcDNA=SeqID_54743; Strand=+; Position=1 -219,274-372,649-750,1177-1273,1382-1476,1521-1589,2060-2247
  Homolog annotation: Hit_ID=NP_510509.2; Match level="QueryCoverage =97%, HitCoverage=48%, E-value=2e-91, Identity=54%"; Hit description =laminin A (XP714) [Caenorhabditis elegans] emb|CAB05478.2| Hypothetical protein F09B12.3 [Caenorhabditis
MRFFECLISISTFHLSGILTQPVLKLHLMNVMDDYCTGYQTYCSKLKPYLKQNLDFVQQRLANSAADDPYWQGVKRAYLQMTGVWHGFSDAQFNVSIDFSLNPILMLNAHGDFYELETKFNRSKDPRDEATGGRCSGLVKIAPNNADILFSQVTMCGFESLLRVLKLYKFGYDRALYPGHTTTISSYPGLLYSADDFALMSSGLAILETTMKIFNNTLLNEIKPDGVLHCWVRAIVANQMARTAREWCHIFKRFNSGTYNNQWLIVDYNKFKPYTELPDHGLFYVLEQM

SEQ ID NO: 128321 - protein, 148 aa, Heterodera glycines
  Coding regions on vcDNA: vcDNA=SeqID_54744; Strand=+; Position=1 -163,349-416,484-575,2728-2825
  Homolog annotation: Hit_ID=CAE63260.1; Match level="QueryCoverage =87%, HitCoverage=21%, E-value=7e-41, Identity=61%"; Hit description =Hypothetical protein CBG07632 [Caenorhabditis briggsae]
KSLKNKFFKLKFLKPSGATNWFSWKSCPRAKNFARDHTKVDVDSLTKLMRYNDYTRDPYSRCNCTPPYTAEAAISARGDLNPANGISARGDLNPANGTFEIPGMGHVNHAALDYKGTGYKMFKKLQFRAWSGPTYDDVPVFDWLEFDF

SEQ ID NO: 128322 - protein, 197 aa, Heterodera glycines
  Coding regions on vcDNA: vcDNA=SeqID_54745; Strand=+; Position=1 -111,421-903
  Homolog annotation: Hit_ID=CAE56395.1; Match level="QueryCoverage =81%, HitCoverage=21%, E-value=9e-24, Identity=39%"; Hit description =Hypothetical protein CBG24082 [Caenorhabditis briggsae]
MLILIPFKWIGSHFLKNCTFNMVVITSGADFLIKEGQLGHHWYHSMNSTIGMRPVDVTFANAEELRKKLYNEAAKNPRGNPKFHVGDRVRIEKHKHVFQKGYLPRFTNEIFTITEVHSERSPIVYKISDDNNEIIKGWFYANDLCRIFENDNKLYDIERILSKKKRKGVEHALVKWKGYSPQFNSWVPLSSITVKNI

SEQ ID NO: 128323 - protein, 195 aa, Heterodera glycines
  Coding regions on vcDNA: vcDNA=SeqID_54746; Strand=+; Position=1 -74,437-474,604-1081
HKYACSAYELCSDDFNVLKWTAAADVLDKALAINPEDCFTCAAGSSSRWLLCRGLNGRRPPSFSARRPKFHSTRRSEWVQQHCQISGRKCFWASQTLPPPHAVPKTRLMVSHPLEGLHGGVGVGAGLAGEHSLPGQGVFGQQRQGKCGAPFETADRFLPAERKRQGPARGTEGGQGAAQEAREKMTSMKITHRSS

SEQ ID NO: 128324 - protein, 31 aa, Heterodera glycines
  Coding regions on vcDNA: vcDNA=SeqID_54747; Strand=+; Position=1 -91,228-232
MHFIPVEIDLKNWPQLCLKSDKCYIWHRLIA

SEQ ID NO: 128325 - protein, 42 aa, Heterodera glycines
  Coding regions on vcDNA: vcDNA=SeqID_54748; Strand=+; Position=1 -62,472-538
MNLAQILWKIFFRIFNFIIFLPHFLLLVNRLIIIFGESVLKY

SEQ ID NO: 128326 - protein, 62 aa, Heterodera glycines
  Coding regions on vcDNA: vcDNA=SeqID_54749; Strand=-; Position=1 -123,209-274
MEIIFICNKNLKIKSTNCATNGQGTQTVKTADATHDEAGKISRDSSSSSDEDDSTTAASKCY

SEQ ID NO: 128327 - protein, 291 aa, Heterodera glycines
  Coding regions on vcDNA: vcDNA=SeqID_54750; Strand=+; Position=1 -190,235-379,425-704,829-1088
  Homolog annotation: Hit_ID=NP_492946.1; Match level="QueryCoverage =97%, HitCoverage=7%, E-value=6e-48, Identity=36%"; Hit description =DYStrophin related (417.4 kD) (dys-1) [Caenorhabditis elegans] emb|CAB61005.2| Hypothetical protein F15D3.
MEIVRVLESAKDRLIIERAQLCATEMERVLAICKRRKAELQHILEQCRIWEQLRSSIELWLADASDRLCFGLLVVELSDGELTEQLELCEQLVDELNSWKSKLQELNRISNQQLDTHRRDNGHNLSHQSSKLNAQWTKFNDQLRIRRAVLEAAKRSRHDFQTALGHFQQWLNKMNMEMRKLNEETDNLQRLKDTARRREWLAQEKEARVEIDAHREIMESVRRMGRKLMEEQQRELSSSAGEETPPPSGNRTTEQMKSQVEMVENEWQSLLEQAKSVRDRLENAQEECERL

SEQ ID NO: 128328 - protein, 176 aa, Heterodera glycines
  Coding regions on vcDNA: vcDNA=SeqID_54751; Strand=+; Position=1-528
MRKSVGQRNQPNVGSNKRLNQLANDRNKQQQMKPVNIEQQQLVNVMQNNVQQQQKKRLDGHRNYHQNVKRWQATAGENQHVNGKRAKTVNNNGNKRMPKFTEDKKRRLKTVHHVKFDDEKLQHVGNLKHNEDMATKKAENAKKHRHTMPAAKSGDTFTAHEEQPLSLLDNNPPVNE

SEQ ID NO: 128329 - protein, 99 aa, Heterodera glycines
  Coding regions on vcDNA: vcDNA=SeqID_54752; Strand=-; Position=1 -111,675-806,851-906
DVVGIGSGAFANVFRARELITAAPAERYRHVALKRINLSAIEKENQLMYESVLNEVDIFKSLSHTNIVKCFYSFTEVSPHSGVKYLVLVLEYVNGGDLE

SEQ ID NO: 128330 - protein, 107 aa, Heterodera glycines
  Coding regions on vcDNA: vcDNA=SeqID_54753; Strand=+; Position=1 -216,624-731
MSVGLSFPSQRQQQQQQTISNDDNCATLQHSTSIARAHVDSDHFCCCCCSPINTMGFLFYMFVAAVAFGGGAYCGMIYTTKRARASAGGGSKKDKKQKASKSSSGEQ

SEQ ID NO: 128331 - protein, 134 aa, Heterodera glycines
  Coding regions on vcDNA: vcDNA=SeqID_54754; Strand=-; Position=1 -27,96-382,721-811
MGMVNSFKEAFLRATTPVGYTFRLELYDSTEIVTPFEVMNERTNEMLTFEKEGNDEIVDEDSQFTDAVWLLKRCPIGGTATIQWEDRKSDKLNKVDIRLYGNCIGPLSPLKAGQMNAKNHPKMNPEPSGQQKKK

SEQ ID NO: 128332 - protein, 40 aa, Heterodera glycines
  Coding regions on vcDNA: vcDNA=SeqID_54755; Strand=+; Position=1-120
CCASLAANEGGKRLNAVKAKALSRRKSGDIGKSEGIFKFE

SEQ ID NO: 128333 - protein, 89 aa, Heterodera glycines
  Coding regions on vcDNA: vcDNA=SeqID_54756; Strand=-; Position=1 -93,355-382,571-719
MAKKPQERRSQKFFDKIILVGYLIPNFWADEPPQQHPVQSANLQLVRQPTPYPPAGSRLAPVILRRFAPNSKCCQRCTTPDPSIGNAAA

SEQ ID NO: 128334 - protein, 118 aa, Heterodera glycines
  Coding regions on vcDNA: vcDNA=SeqID_54757; Strand=+; Position=1-357
  Homolog annotation: Hit_ID=NP_503721.1; Match level="QueryCoverage =92%, HitCoverage=18%, E-value=3e-11, Identity=35%"; Hit description =transposase family member (5D107) [Caenorhabditis elegans] ref|NP _503720.1| transposase family member (5D
MSNEAEKEFTLAGNPKAPALHVVLDWIHRSWQEISKEVIIKSFEGSVEKENGKIPEFLVCGLTTPLDGTGDEKIACFKPKGAIGSIGTKLLREFRATETMKDGRNDHEEAGLSDDDVM

SEQ ID NO: 128335 - protein, 68 aa, Heterodera glycines
  Coding regions on vcDNA: vcDNA=SeqID_54758; Strand=-; Position=1 -153,1418-1471
MQFRRLITVLQLLLALFVVVLALCANFCYGMEGKNKDLQKTAISNSKQKNSKMMEFSELEQMKTTICL

SEQ ID NO: 128336 - protein, 15 aa, Heterodera glycines
  Coding regions on vcDNA: vcDNA=SeqID_54759; Strand=-; Position=1 -19,366-394
MFFNFLIYLFILCLL

SEQ ID NO: 128337 - protein, 37 aa, Heterodera glycines
  Coding regions on vcDNA: vcDNA=SeqID_54760; Strand=+; Position=1-114
VSTILLLIPFHKLINSVPPSNSESSSPFKLLGIKKSD

SEQ ID NO: 128338 - protein, 130 aa, Heterodera glycines
  Coding regions on vcDNA: vcDNA=SeqID_54761; Strand=-; Position=1 -279,889-1000
LIDIIELTEMRRTHAVLHLVMKKKLLFSGNDQLRIWSYSNAYPINRGKIFEKEIKMDILALKQCLLICPNEWPIHLDGKDQIFFYAKRNGNIKLLGTATVQLLRETYEYNTVIDFSDLAQGARFYKRHEN

SEQ ID NO: 128339 - protein, 134 aa, Heterodera glycines
  misc_feature (14)..(14): Xaa can be any naturally occurring amino acid
  Coding regions on vcDNA: vcDNA=SeqID_54762; Strand=+; Position=1 -106,169-223,625-779,1850-1931
  Homolog annotation: Hit_ID=NP_508843.1; Match level="QueryCoverage =88%, HitCoverage=27%, E-value=1e-35, Identity=59%"; Hit description =tenascin XB XB1 like precursor (45.6 kD) (XF584) [Caenorhabditis elegans] gb|AAB04576.2| Hypothetical pro
NFTLRIKLLKYFHXCEGGVTMACVLGQCECKLGFHWNWNNDHRYPSCERRCTLEEVPVIDRCLKKVELGERCMSSKQCGDAAAECRFGICQCLCTFKQTVSAKLRIRCTNPDDPLGFSNILTRVEQIFQNRQRS

SEQ ID NO: 128340 - protein, 52 aa, Heterodera glycines
  Coding regions on vcDNA: vcDNA=SeqID_54763; Strand=-; Position=1 -119,447-486
MSARKCPLPLIAFSSLTKAGTPLPILEDLLNACQNIAEADVNFSRNNLELVP

SEQ ID NO: 128341 - protein, 46 aa, Heterodera glycines
  Coding regions on vcDNA: vcDNA=SeqID_54764; Strand=+; Position=1 -56,363-447
MLKGCLYVILVLIAVSLIRIATYSQKFSSIGSWEVVKLPKNRVSLF

SEQ ID NO: 128342 - protein, 19 aa, Heterodera glycines
  Coding regions on vcDNA: vcDNA=SeqID_54765; Strand=+; Position=1-61
MIALRLVSAKARLVENGCL

SEQ ID NO: 128343 - protein, 159 aa, Heterodera glycines
  Coding regions on vcDNA: vcDNA=SeqID_54766; Strand=-; Position=1 -253,687-913
  Homolog annotation: Hit_ID=CAD44515.1; Match level="QueryCoverage =84%, HitCoverage=4%, E-value=9e-13, Identity=35%"; Hit description =VAB-10A protein [Caenorhabditis elegans]
MNPIDAIILNAHYGLKHPQTKLNITLNEAIALGLYDPVTRQFLNNNEQMDYWDSLAFHSPNTVHLYVKFGAIKVTPMDLDHALKYFLDRYVGVFRLLEYQISLPEALKYGYIEIRKPQPTFALTLTDCIEQNWINRETGLFIARPEEPHGFGEANAFQW

SEQ ID NO: 128344 - protein, 79 aa, Heterodera glycines
  Coding regions on vcDNA: vcDNA=SeqID_54767; Strand=-; Position=1 -42,504-554,599-678,930-996
  Homolog annotation: Hit_ID=NP_062658.1; Match level="QueryCoverage =74%, HitCoverage=10%, E-value=6e-16, Identity=59%"; Hit description =serine/threonine kinase 23 [Mus musculus] gb|AAD02248.1| muscle -specific serine kinase 1 [Mus musculus] g
GYDASADIWSVACMTGRLLHIPNLKPWSLLEVLTQKYQWPFDQARSFAAFLVPMLNYEPSERATAGQCLEHNWLKNIDE

SEQ ID NO: 128345 - protein, 35 aa, Heterodera glycines
  Coding regions on vcDNA: vcDNA=SeqID_54768; Strand=-; Position=1-104
GTDKCHRTGWCQSTASTTSHCPPPPVPTRRRRRAV

SEQ ID NO: 128346 - protein, 30 aa, Heterodera glycines
  Coding regions on vcDNA: vcDNA=SeqID_54769; Strand=-; Position=1 -50,359-401
MIASAFFRVKRKANKLLNGSKKLYRNPRRE

SEQ ID NO: 128347 - protein, 175 aa, Heterodera glycines
  Coding regions on vcDNA: vcDNA=SeqID_54770; Strand=+; Position=1 -156,643-837,1506-1679
  Homolog annotation: Hit_ID=CAE60739.1; Match level="QueryCoverage =100%, HitCoverage=4%, E-value=2e-36, Identity=45%"; Hit description =Hypothetical protein CBG04423 [Caenorhabditis briggsae]
MLSAGGRAAMLGLEKSPPPVLVTLQVQPGREFSIGAVTLVKEEQWHNDLLGQKPFCVRKNGVCVAQRFPQPSNSIRTEAEKSGKNINSSIAGDKLPFPVAGEPSQMRVMALAGSGAQSTLDIEGVVATPNDYVFVVHYFSPDNPPIVVDVLIQNEHFGDALFHYCPSMSGCRTIV

SEQ ID NO: 128348 - protein, 61 aa, Heterodera glycines
  Coding regions on vcDNA: vcDNA=SeqID_54771; Strand=+; Position=1 -83,406-508
MTLTHKMSSPRNVQVSNLSFFIIQMGLSITNGFRGKFANSLILNTCRTPLSSQENKTYAKK

SEQ ID NO: 128349 - protein, 32 aa, Heterodera glycines
  Coding regions on vcDNA: vcDNA=SeqID_54772; Strand=-; Position=1-248
ADPQNVQPTKCPSFEFEFFYYSDGPKVRQGVI

SEQ ID NO: 128350 - protein, 64 aa, Heterodera glycines
  Coding regions on vcDNA: vcDNA=SeqID_54773; Strand=-; Position=1-194
KFGIPLERQKLAHLYKPDDVSDRTEFSFGDCQTMYFYNIVKGDTIFVSEVFEISVNYQFSIPNN

SEQ ID NO: 128351 - protein, 826 aa, Heterodera glycines
  Coding regions on vcDNA: vcDNA=SeqID_54774; Strand=-; Position=1 -490,530-687,730-2559
  Homolog annotation: Hit_ID=NP_507780.1; Match level="QueryCoverage =99%, HitCoverage=52%, E-value=4e-77, Identity=26%"; Hit description =predicted CDS, DNA polymerase type B, organellar and viral family member (5T899) [Caenorhabditis elegans]
MSHQCGEKFCRLCKQFHVKEEDDENPCSSCFIQPLKQQKIKPYRIIAYDFEATQDKKVGNSFEHEVNFAAATVICTNCINNGEWKNSLEGKQCAICGPNRTITFSPFDYKETTVDQKIVTQQTLREFVQWLLFEQNKKYPTVAFAHFGGRYDMTMIIKEVIAQGVHDPQIIKQGNRLYELKIKDNEHAPLTIFHDSYNLMPIKLSGLIKSFGLKIQDKQHFPHMFNKSSNYENVLTNLPPREEYCPNQKKKTDLQKFNEWYNTNYDQHFDLKEKLPEYCCNDVKILTHALVELRREFKQLTQREGNHRGIDILWQAMTIASACVKNFALNHLRSNSLAIVPEKGYTPQQNQSALANKFLDWYSHINNVHVQTASSRYGEYMFKREGQIYQVDGYIKGTNGQRDKIIEVNGCLWHGCEECFDDMDEETRMPNGKTLGEIRLREQRKHEILRRYVDLEVVWEHEINKQMKRDKEMREYFENWKDCSPIKIREAFHGGRTGPMKLIHTAKPGQKISYKDFTSLYPFTNFSTKYPLGHPKIISFTTNEQTVNWRSPTDNPYKGLLKILLQPPDNNVKVTVMPIKFDERLLFPLCEKCAKVISNKYPKGLKDDNYSCPHVNTNDRAFVSTCTHLELNASLEAGYTVRKLFHVLQYDQWSDNVFKSYVSEMMALKIHATGYPSWCNNEEEKRKFIDECWRKFRIKIEDNKMKADPGKRYIAKLCLNSLWGRFSMRNLLSKAIIDNDECLIRQYSDDKKIELIDVELMDEDNDVYMLTYKPKEEFVDENKYSNVVISLFTTSMARLYLYEALKKVADAPGCEILYYDAASVVC

SEQ ID NO: 128352 - protein, 24 aa, Heterodera glycines
  Coding regions on vcDNA: vcDNA=SeqID_54775; Strand=-; Position=1 -19,395-450
MPTKFAMTYFALVTVIKIIIAALY

SEQ ID NO: 128353 - protein, 179 aa, Heterodera glycines
  Coding regions on vcDNA: vcDNA=SeqID_54776; Strand=-; Position=1 -69,339-394,1048-1462
ISIHIPTIDKFEKNMMINDHVMQDEGRDKFDISNFPNFLGLRRIKNTQMNEEGSRERGSVARMIAMMEKLIFKLTIFWHYAFVPFMHKIELEYGIFSFFYAARDRESHLSPVETCLPKQHFILSSINLLNFNLRRLSPGSSSSPPPSPERKFHDSYYEFKGIKVGQKSQNAYFEKNFSN

SEQ ID NO: 128354 - protein, 30 aa, Heterodera glycines
  Coding regions on vcDNA: vcDNA=SeqID_54777; Strand=+; Position=1-96
SQRRSLKPSGKCFFMLNISKLVRKKRHMPQ

SEQ ID NO: 128355 - protein, 121 aa, Heterodera glycines
  Coding regions on vcDNA: vcDNA=SeqID_54778; Strand=+; Position=1-366
MTHVFFDPESVDWSSFFTSQHGRGQKQYFVGSKYQRGFGFLGNVARFLTPIARNIASSAGHEGLAAGQRVLSDIAQGRDLRDAVREHSRQGLTNLTDKLQQCGKGKKALITNKIENGYLIS

SEQ ID NO: 128356 - protein, 267 aa, Heterodera glycines
  Coding regions on vcDNA: vcDNA=SeqID_54779; Strand=+; Position=1 -474,530-795,852-915
MQSFTWKQKHSIFSYIDHSVIAFLRSNHQIFDKGTNLRLWMSSSQTTDDQPIWEVFVREIWPIFSTNIRHLGFIGDEQLDNLSRLISPAILTDLHQLNSINSGDLLPDVIGDFDGPNATAGQILAKWLHTPRKDGQPKQLRCRDQTSGTVAWVNNFKEGLLRATTSADYKIQFIVAPPSMSMVPFELTNGRTNEKLTMTKSSENAWASQWIIKRCQIGETAAVQWEDENWNDLSTVQFMIFGNNCIGPLSPPEEAGQSSEKGTSSDK

SEQ ID NO: 128357 - protein, 88 aa, Heterodera glycines
  Coding regions on vcDNA: vcDNA=SeqID_54780; Strand=-; Position=1 -135,765-895
MDELGMDVGSMDELGLDELGLDELGMDELGMDELGMDELGLWMSWERNPRREDMSTTQDWPSVWPTAQSFRSSVVPLPVRMGFRRRPE

SEQ ID NO: 128358 - protein, 324 aa, Heterodera glycines
  Coding regions on vcDNA: vcDNA=SeqID_54781; Strand=+; Position=1 -120,397-577,620-750,793-1088,1144-1280
  Homolog annotation: Hit_ID=NP_492006.1; Match level="QueryCoverage =87%, HitCoverage=45%, E-value=9e-65, Identity=51%"; Hit description =asparagiNyl tRNA Synthetase (61.2 kD) (nrs-1) [Caenorhabditis elegans] emb|CAA95808.1| Hypothetical prote
FLRVSVSSKEGQKQWEKPSKSAMKKAISRLEEERRKREKASVAEQQQEMAREKRLEEAKKMQVKLDESLPEAKRTKIRECPALCGQRVKVFAFVHRMRQQRKNLMFLVLRDGSGFLQKNLMFLVLRDGSGFLQCVLNGTLCQTFEALTLTTESSVCVFGQINKLPIGKVAPGGIELTADINKLPIGKVAPGGIELTADFWELIHGSPPGGVDNVLNVEANVDVKLDNRHLVVRGENCSAILRIRAAVTRAMREHFHEAKYMEVCPPTLVQTQVEFSKLFYFYGLIPHGIPSCVFNKKTGTKASIGAGPLVCIFKQGRGYPPPPP

SEQ ID NO: 128359 - protein, 45 aa, Heterodera glycines; identical to SEQ ID NO: 124527
  Coding regions on vcDNA: vcDNA=SeqID_54782; Strand=-; Position=1-138

SEQ ID NO: 128360 - protein, 120 aa, Heterodera glycines
  Coding regions on vcDNA: vcDNA=SeqID_54783; Strand=-; Position=1 -198,457-573,704-751
MDQLSRLYMLGIALCALFLIGCLFNLLMCCLGRRRTAAETGGGSAALQMPFRTKRGRRHHPAQQKVMSAVGGHSSHTTLTSSLYGGVANEAKNGNGSKAQQQQQQNTPRWCPAFTKDCQT

SEQ ID NO: 128361 - protein, 255 aa, Heterodera glycines
  Coding regions on vcDNA: vcDNA=SeqID_54784; Strand=-; Position=1 -204,256-297,714-761,819-879,933-1085,1138-1287,1350-1458
  Homolog annotation: Hit_ID=NP_078944.2; Match level="QueryCoverage =89%, HitCoverage=61%, E-value=8e-25, Identity=32%"; Hit description =multiple ankyrin repeats, single KH-domain protein isoform 3 [Homo sapiens] gb|AAH04457.2| Multiple ankyr
TLTLRFFDLINDGNIQQLRVLIDSLDADELNILLRWTVDPVERDNTRSRSALWSAFLRQHTEIVDLLVLEKGADPDEPVADQNGDGATALMYACYTGNVDIVRLLLTHGANVEQMDFEGYFPLIDAAIGGSLEVCRLLVEEWAADVNQQTVQERYTPVICAASKGHLAIVNFLVEHGADLQHVDVEGHNALMWAVIKGKTEVARHLVAIGADINQRNIEGKRAQDFAEESGNAEMVAIFRTTATDNGRHAAEGTE

SEQ ID NO: 128362 - protein, 33 aa, Heterodera glycines
  Coding regions on vcDNA: vcDNA=SeqID_54785; Strand=+; Position=1-101
MPPLTVQSVIIFSLADKIKSSQELIRVGSFVAK

SEQ ID NO: 128363 - protein, 216 aa, Heterodera glycines
  Coding regions on vcDNA: vcDNA=SeqID_54786; Strand=-; Position=1 -99,324-395,463-553,709-879,1313-1475,1726-1746
  Homolog annotation: Hit_ID=NP_501552.1; Match level="QueryCoverage =96%, HitCoverage=73%, E-value=2e-55, Identity=56%"; Hit description =agpet8 (29.0 kD) (4J697) [Caenorhabditis elegans] emb|CAA92291.1| Hypothetical protein D1046.3 [Caenorhab
GGKETTRQMRWLLAGASAGLAVDLSLYPLDTIKTRMQSKAGFRASGGFRNIYRGAPAVAVGSAPGSALVAVGSAPGSALFFITYCNGKEMLAQRIGTSMPLVDALSATFGELVACLVRVPTEIVKQRSQTSRASGLLQIVTELYRTRGGIRGFYKGYVSTVAREIPFSFIEFPLWEWLKRRVAHRMGHCSPLASAACGSLAGLTAAALTTSICVAQ

SEQ ID NO: 128364 - protein, 170 aa, Heterodera glycines
  Coding regions on vcDNA: vcDNA=SeqID_54787; Strand=-; Position=1 -156,554-772,1155-1292
MSPPPFYIFKSPMVVMRSFDLMRRLINPFNRLWYSWYDSAYDMNKFMDGAVQAALLAALNLRERRFDKFREIATEQLTVYMRQRIPKMPADLLDQRLQFKRHHVVNGFIHTSAYAHRAVHESAFIANIDSLRSYRMTKIVGSIGTTVNRVIPQKSDWGPVDSQSAVIMSQ

SEQ ID NO: 128365 - protein, 123 aa, Heterodera glycines
  Coding regions on vcDNA: vcDNA=SeqID_54788; Strand=-; Position=1 -89,488-647,800-922
MSKLGTAQCFVADPRWEINSDIVWTDDNSGHKPRIEIPPCLYGQQKPWRTEDGTEEAVNECVALSYRPFRKRIEIKLADEGLTDEILDNFTPPIVVSELVANRKDCASMYRIRTNIHKVILKF

SEQ ID NO: 128366 - protein, 41 aa, Heterodera glycines
  Coding regions on vcDNA: vcDNA=SeqID_54789; Strand=+; Position=1 -102,142-165
MPNCPFLYLVWNRSTRSIRPRTEATIDRPTPIKTGQEPEAF

SEQ ID NO: 128367 - protein, 205 aa, Heterodera glycines
  Coding regions on vcDNA: vcDNA=SeqID_54790; Strand=+; Position=1 -46,139-200,853-1065,1623-1919
MHRRSRSRSRSRAPEDHSLIEAFEPAPPMHSRQSLQRHNGPANVMRNSLGQSAPAHRSVQRPTDPRTQAWAPRPNLSANRASDQAMANQRCPDDSVNARTQQIQVGARLATNSTSRIGGQSSQLGPFQQMKMRMNWSMRPPSGLAVSTPVQPRPIGQANNSSTSMLRQFPIRGGRGQPQQQQMRRAPPPGNCDVPSPPQVDIVEQ

SEQ ID NO: 128368 - protein, 158 aa, Heterodera glycines
  Coding regions on vcDNA: vcDNA=SeqID_54791; Strand=+; Position=1 -39,102-305,618-851
MPLADEEDNVLPHSLLPDYENSSENNNPENNNSGGGGGATTTPNAPQRRHVIHSDDSDDDDEDDEDEADDYRGGNSGTHAQPTAKRGRIETTYNFNTTTIVNNSNNDMHLFDMPSTSAAAAAAVAADNEQQQMLAMMPSSSSSSSNWVDTQNALANDM

SEQ ID NO: 128369 - protein, 64 aa, Heterodera glycines
  Coding regions on vcDNA: vcDNA=SeqID_54792; Strand=+; Position=1 -6,436-534,594-683
MKPALRVRPMSLHWSGCTMGPPKAFSAGKAAPKNEVDELKKAEDLEGQKIEEKSPQKAKWEKYL

SEQ ID NO: 128370 - protein, 83 aa, Heterodera glycines
  Coding regions on vcDNA: vcDNA=SeqID_54793; Strand=-; Position=1 -94,403-465,566-660
MRTFSFSKIWPLQIRTNLRNKDTWQPCFRAESLQWLRQYDSGRNRKTLQSSGFDKGTFRAVSGKMHISYIPLDRAGSTCIVNF

SEQ ID NO: 128371 - protein, 195 aa, Heterodera glycines
  Coding regions on vcDNA: vcDNA=SeqID_54794; Strand=+; Position=1 -252,301-361,854-1000,1322-1449
ADAEHPTDAAVVDNFETRARRFFDLINDGNIQQLRVLIDALDADELNILLRWMVDPVERDYTRSRSALWSAFFRQHIDIVDLLVLEKGADPNEPVVGRENDINTNLTPLFVAALHAHFPLCRVLVDRGANVDLGSDFATTPLMMACKRSQMEIGFRFALKNAANEGHLEVCRLLVEEWAADVNQSIIQDRTTALI

SEQ ID NO: 128372 - protein, 71 aa, Heterodera glycines
  Coding regions on vcDNA: vcDNA=SeqID_54795; Strand=+; Position=1 -28,146-333
MVKFIKNFWALIIGVRSSVSLAWSRNCCALEARQQCPLSVPMLSMLIPIVGSNAFVLNIRQRLSVLHTNDA

SEQ ID NO: 128373 - protein, 63 aa, Heterodera glycines
  Coding regions on vcDNA: vcDNA=SeqID_54796; Strand=-; Position=1 -27,296-460
MSHPAIWKGNAERNFDWISSNGGNNRPYLLKEGIIGSVILTFLSFFFVILMIYSVNFQKCFYY

SEQ ID NO: 128374 - protein, 20 aa, Heterodera glycines
  Coding regions on vcDNA: vcDNA=SeqID_54797; Strand=+; Position=1-65
TDQKRTKLCRDTERKRNNLF

SEQ ID NO: 128375 - protein, 114 aa, Heterodera glycines
  Coding regions on vcDNA: vcDNA=SeqID_54798; Strand=-; Position=1 -134,1047-1184,1227-1296
  Homolog annotation: Hit_ID=NP_501209.2; Match level="QueryCoverage =50%, HitCoverage=10%, E-value=8e-10, Identity=48%"; Hit description =putative protein, with at least 6 transmembrane domains (4I264) [Caenorhabditis elegans]
VYKIALYGCDRAVESQDWQHLTIDSILRLTIAAYAFVSLIYIIQRKNGFSCSKTSLHKEQHIWYRLHYGLLKSAIVTCASELIPVLLVAHWIACGQAKKIAQQSLTDRMMNKKK

SEQ ID NO: 128376 - protein, 31 aa, Heterodera glycines
  Coding regions on vcDNA: vcDNA=SeqID_54799; Strand=-; Position=1 -8,112-199
MQTTLFKNSLYFCSTVNTEFIDKSIRFSSNA

SEQ ID NO: 128377 - protein, 127 aa, Heterodera glycines
  Coding regions on vcDNA: vcDNA=SeqID_54800; Strand=+; Position=1 -34,96-445
  Homolog annotation: Hit_ID=XP_522969.1; Match level="QueryCoverage =98%, HitCoverage=77%, E-value=1e-12, Identity=35%"; Hit description =PREDICTED: similar to putative protein family member (XC187) [Pan troglodytes]
MVAATSQRRENSTTVIRSGTKVIKKRTKVIKRGTKVIQRGTSVIKRGTKVKRGIKVIKRGTTVIRRGTKVIKKRTKVIKRGTKVIQRGTKVIKKRTKVIKRGTKVIQRGTSVMRRGTTNGRRGTKMH

SEQ ID NO: 128378 - protein, 96 aa, Heterodera glycines
  Coding regions on vcDNA: vcDNA=SeqID_54801; Strand=+; Position=1 -138,746-898
MRALRLQLPHGAGIVQKSEELGHFSFICRKQCRSTGSKKIGSQNIQLELNHHPSLSDFIAAFTKDIDKQLDIGRAEQLQKSRKRNGTSSIRPQMWW

SEQ ID NO: 128379 - protein, 124 aa, Heterodera glycines
  Coding regions on vcDNA: vcDNA=SeqID_54802; Strand=-; Position=1-375
MEGCSLIESFRHEDLKFGFTKYKTKFYFKNPFIINAEENFKDILTSLIEEKYKNEQGKFRSILKLSFGFESFYCPLRYPSENTAEALFQHVLLKEEQYSLFYPLDGVITLEVTIIPDVYSNSRN

SEQ ID NO: 128380 - protein, 209 aa, Heterodera glycines
  Coding regions on vcDNA: vcDNA=SeqID_54803; Strand=-; Position=1 -102,142-189,332-401,1050-1459
MNTIRDIKNIELVCGSRIFVVRAKIASVGSTEYNACISCRKGKCNCGMEKEKVKNLVGTICTLKVNVSVKEYGAAKRETERAWRDVVVLSDDVSDFAKSSRETLNRAIKSREKAPYANGVRELYLKMSDSIWEIFKFLEQINLESEKAESAWREFERCKTFDQATKLEEQSQNSLTEARRLHFESRRVQSQMLNYENRLQTIVWEHMGI

SEQ ID NO: 128381 - protein, 120 aa, Heterodera glycines
  Coding regions on vcDNA: vcDNA=SeqID_54804; Strand=+; Position=1 -67,416-711
MRILILSIVHTDLSADNDLSADTDNIGKLGRKLYYATVQKQKVCVREHQSDRCDGILCGINQNYGDTAIIKNVKIGGGSTNVCSLFKGNDQQKQPSVIHNYKVGEAGDGKNCVVSGSSSG

SEQ ID NO: 128382 - protein, 56 aa, Heterodera glycines
  Coding regions on vcDNA: vcDNA=SeqID_54805; Strand=+; Position=1-170
MLFLSFPSLVLRQIRPSFCRCFSFLLMLAMLFDLISSGRSLPLGPTNERVFFSNAL

SEQ ID NO: 128383 - protein, 149 aa, Heterodera glycines
  Coding regions on vcDNA: vcDNA=SeqID_54806; Strand=-; Position=1-449
MTFQSLKINPSAFQSLRLNSQAFQSLELNPPAFQSLELNPPAFQTMDLNLRNSKHWDSIHQHSITGTQPTNIPINGTQSTSIQSLGLNPPTFKSLGLNPPTFQSTGLNPPTFQSLGLNPPTFQSTGLNPPAFNHWDSTHQHSNRLDSTH

SEQ ID NO: 128384 - protein, 23 aa, Heterodera glycines
  Coding regions on vcDNA: vcDNA=SeqID_54807; Strand=+; Position=1-70
MIEIISFLVYFVLIFFSPTPDDE

SEQ ID NO: 128385 - protein, 22 aa, Heterodera glycines
  Coding regions on vcDNA: vcDNA=SeqID_54808; Strand=+; Position=1-70
YTFETIGQDKKRMKLMPHETRN

SEQ ID NO: 128386 - protein, 28 aa, Heterodera glycines
  Coding regions on vcDNA: vcDNA=SeqID_54809; Strand=+; Position=1 -28,101-159
MDLKNEVEINIKYKVNILLGVLTNKMKN

SEQ ID NO: 128387 - protein, 69 aa, Heterodera glycines
  Coding regions on vcDNA: vcDNA=SeqID_54810; Strand=-; Position=1-210
MAAIETKNGNIQPNNRQNDSAEFLRFNPPAIFIISSDDEETNGKKGATEGMAPAEGETARKREKGTAEN

SEQ ID NO: 128388 - protein, 37 aa, Heterodera glycines
  Coding regions on vcDNA: vcDNA=SeqID_54811; Strand=-; Position=1 -67,202-248
MAAGCWHNGIRPTDSMNQAIPYSNVLAGRELFRLQMQ

SEQ ID NO: 128389 - protein, 187 aa, Heterodera glycines
  Coding regions on vcDNA: vcDNA=SeqID_54812; Strand=+; Position=1 -58,1129-1218,1386-1459,1509-1524,1568-1671,1725-1783,2785-2946
  Homolog annotation: Hit_ID=NP_492020.1; Match level="QueryCoverage =89%, HitCoverage=68%, E-value=1e-70, Identity=37%"; Hit description =tissue factor pathway inhibitor precursor family member (100.0 kD) (1H712) [Caenorhabditis elegans] emb|C
MAKPFLPNRDQSWRVWLYTAFACIQPPNEGFTPPGGGSSLNHWYHDPITGECRELKYQGYGGNANNFATKDHCESYCKQTCSRGLPLYRDRTMGVKQEPVYCQGADNGCTSPNYVCTAMGTLQQCCPTFSYLISAGEPLKDSSGERNMECSPTGSGTNSCPSTHSCESTTGSTTFGGICCPRTQYVC

SEQ ID NO: 128390 - protein, 450 aa, Heterodera glycines
  Coding regions on vcDNA: vcDNA=SeqID_54813; Strand=+; Position=1 -66,613-715,957-975,1032-1190,1238-1334,1420-1516,1638-1770,2059 -2127,2556-2666,3267-3358,3453-3540,4065-4159,4241-4327
  Homolog annotation: Hit_ID=CAE74254.1; Match level="QueryCoverage =99%, HitCoverage=94%, E-value=0.0, Identity=61%"; Hit description =Hypothetical protein CBG21943 [Caenorhabditis briggsae]
CRKSMKNYFTYGFAKCILYYHSLLSTCQTFSFNGCDGNSNNFATQQDCKDYCRVESCPDGGEVWKEPNGAVRPCTVWKEPNGAVRPCTTNRQCPSTHYCTPVTVFSGTVYQTKSLCCPSKNFVCSQPKDQGVRCSSTRITRHFFNADTKTCQDQGVRCSSTRITRHFFNADTKTCQPFEYNGCEGNRNNRNNFATQKSCQNYCLSEACSPGTVVARDSDSIRLIQCTNPGGTGRVSGGCPDGYSCFSVLLQIQLSDSSATFFKTLCPAGSSPFISALSLQPMQCTPNVDGSCPGNFFCWFSTTTSSVNAFYCCRSPDSIDTGYCPPQLVPVPGEGATPYRYCSPSAPINDGIQGCGINGCGINRHCQYSTTLERYICCGLESDVRLPNCPPQPANLVPVELAGNYRTCNPYARSGTPQACPACPENSACLYTGQDNGFICCRVQLQSSPF

SEQ ID NO: 128391 - protein, 133 aa, Heterodera glycines
  Coding regions on vcDNA: vcDNA=SeqID_54814; Strand=-; Position=1-399
MDNYALAVQLDKEDKWPYFALVHQNLKLNQYPRLGSIISVPKVEKLEYFSSSNYELYSQNPKEESGTIYNIIKSVRNEIKAIDVDFNVYDDESNDSINQRFFPHQIGPDLQNLDLVDEAWAQITGFKIQNPLE

SEQ ID NO: 128392 - protein, 112 aa, Heterodera glycines
  Coding regions on vcDNA: vcDNA=SeqID_54815; Strand=+; Position=1 -34,128-430
MNFYIFFQDFPDLIKYTKLSVSKFEVIILNAEFVRIFMKKCTNSFSSTYFSIFFVVLNLYKGTHPSQNSSTLTQKKQSTSENQSLMIIQNAFNALNFGFDFLDGVAWKKITE

SEQ ID NO: 128393 - protein, 72 aa, Heterodera glycines
  Coding regions on vcDNA: vcDNA=SeqID_54816; Strand=-; Position=1 -179,345-384
MPQVMKKVIFGDNMLKIRDRDFRICSAGLTFSGATGFLAMPLKNRSNRIFKFLDPGPVYGFFEHPAAPIDIL

SEQ ID NO: 128394 - protein, 127 aa, Heterodera glycines
  Coding regions on vcDNA: vcDNA=SeqID_54817; Strand=-; Position=1-383
MALEQRKMYEKRRAERNAEKERMRWELPRGMAPRKVHYATHRGINKRRKWHRGRHLNESQTGRKYRHPRAHDISPLRQPNGATTELLAPSSEMEGQIGNDKQTREESQIKEPVQSQRRTKAKDPLDE

SEQ ID NO: 128395 - protein, 235 aa, Heterodera glycines
  Coding regions on vcDNA: vcDNA=SeqID_54818; Strand=-; Position=1-708
MRKVENLLKGRDGLARPARVHPKAKTLVRAINLLYPLEINPSAEDEVSQIQVTAIMDSPSAVMQGMYLQSVTMESSLPPGTVMQDSQIVTTESSLSPVRGRNERQPRKERIRKRQSTEDVRGKRKPKTNGPYDPLRPGNYRIPRRNPFFPSQVAYNEQTRTYRRRRGRTIDLSGLRKLFAGLGGTEFVRRELQEKANPALREERLRKDKVKFMEDDARRVAESERKAAQEKVEKS

SEQ ID NO: 128396 - protein, 207 aa, Heterodera glycines
  Coding regions on vcDNA: vcDNA=SeqID_54819; Strand=+; Position=1 -93,145-672
MAEHSEDKLDETERIFEIARVMWKAIKKHDKNAVGIVPRLRFIGLVLWHLAVRQSPLIDQQQQQHNGAPLLEFTAKMRPNIDPHDPTEWQTMLWHFDQNLANAAMDAEEGQKEANEGGIEDGKWEGEEEQNDGEEIKLLRELGEKVGQGRAQFGDRERHAELGKKFSLLKKSTSNDGAAHGMVNFCVIYRAFLVFGSQSVDILLFIR

SEQ ID NO: 128397 - protein, 123 aa, Heterodera glycines
  Coding regions on vcDNA: vcDNA=SeqID_54820; Strand=-; Position=1 -67,155-191,252-335,553-622,681-778
  Homolog annotation: Hit_ID=CAE64502.1; Match level="QueryCoverage =89%, HitCoverage=25%, E-value=1e-46, Identity=80%"; Hit description =Hypothetical protein CBG09229 [Caenorhabditis briggsae]
VIAGQVYEWSSNIIPFQIWGGDTKFQNLIRRGIKMWEESWEESTCLRFRENVQATDAIRYVLERGDSCFTEYIGRNGGFQDIIIGSECAEEYEYVVAHETGHALGYWHTHGDQCRKTKIDNCL

SEQ ID NO: 128398 - protein, 196 aa, Heterodera glycines
  Coding regions on vcDNA: vcDNA=SeqID_54821; Strand=+; Position=1 -60,110-166,225-379,448-661
  Homolog annotation: Hit_ID=NP_510258.1; Match level="QueryCoverage =99%, HitCoverage=68%, E-value=2e-24, Identity=34%"; Hit description =SPla/RYanodine receptor SPRY (XO139) [Caenorhabditis elegans] pir||T21094 hypothetical protein F18H3.1 -
DDIVLLKEGTRVCGSGGILGNVPLLQNKSYFQVHINVPLLQNKSYFQVHIHQSGIWGIGLGTRKTDLSKAPIWGIGLGTRKTDLSKAPIADTAWMLLNDGTILMDNEIVGKVEQPIGEGETIGVAGVAFDHVELHFYRGWRADLDWSDKASDVGLVFYPCLCIDENCVLDICFSAAKFSPKAPLGYQEIMSEQTLL

SEQ ID NO: 128399 - protein, 86 aa, Heterodera glycines
  Coding regions on vcDNA: vcDNA=SeqID_54822; Strand=+; Position=1 -33,615-791,1071-1121
MATNRLDVLALDAFPPAVISACVNKFLMQIRDPLIPYSYGKEICALLDRCLAIDGPILEGFAGIVEDLPVHLAKFFLLTMSHACVI

SEQ ID NO: 128400 - protein, 75 aa, Heterodera glycines
  Coding regions on vcDNA: vcDNA=SeqID_54823; Strand=-; Position=1 -60,378-545
MLVFEKNEWLPSASANDTKKQFVLTPVFERTHEKKRTQPSTTVTVQQQLRNTKNKIGQSHGTTTAKSTQQVKLGR

SEQ ID NO: 128401 - protein, 494 aa, Heterodera glycines
  misc_feature (3)..(3): Xaa can be any naturally occurring amino acid
  Coding regions on vcDNA: vcDNA=SeqID_54824; Strand=-; Position=1 -99,158-217,292-326,380-464,515-628,1091-1233,1301-1418,1849 -1910,1958-2032,2223-2299,2403-2455,2515-2587,2907-2961,3015-3080
  Homolog annotation: Hit_ID=CAE65097.1; Match level="QueryCoverage =93%, HitCoverage=97%, E-value=1e-124, Identity=53%"; Hit description= Hypothetical protein CBG09957 [Caenorhabditis briggsae]
VYXQTNSSKVTHVVNLVKRIIAFFFSHVGLCALVIGYAMLGAVVFRAVVIGYAMLGAVVFRAVEGPHERYIQSEITGARYIQSEITGARRHAVDVAWNATFRVNKLDKTEWRRHAVDVAWNATFRVNKLDKTEWERIVYEQTKFFKRRCLWAIHRGYTKFFKRRCLWAIHRGYDGKEFGRAAQWTFTGSFLYSLSIITTIGYGNTSAKTYFGKTLTILFAIIGIPLMLLFLTNIGDVMAKIFRFLYARSIRLKYTIIFLYARSIRLKYTIILWHKRRQAAKIRRANSWVALTRSNRANTLPVNGGFVTGAAADVNELLAARAHLVQLEVKELLAARAHLVQLEVKESVEAQLQRISVPLSLVLLTMLAYLVTGAILFCLWEEWTFLDSFYFCYISLTTIGFGDKFPGEFGDKFPGEAVGSDKEAQEKLVITSIYLLAGMALLAMCFNLAQEEVVNKVAWLANKFRTREEEYEEEVVNKVAWLANKFRTREEEYE

SEQ ID NO: 128402 - protein, 490 aa, Heterodera glycines
  misc_feature (141)..(141): Xaa can be any naturally occurring amino acid
  misc_feature (151)..(151): Xaa can be any naturally occurring amino acid
  misc_feature (477)..(477): Xaa can be any naturally occurring amino acid
  Coding regions on vcDNA: vcDNA=SeqID_54825; Strand=+; Position=1 -67,130-216,265-301,370-592,827-875,963-1027,1075-1138,1470-1557,1609- 1687,1811-1922,1964-2031,2178-2280,2353-2469,2618-2674,2748-2841
  Homolog annotation: Hit_ID=CAE69207.1; Match level="QueryCoverage =100%, HitCoverage=51%, E-value=1e-133, Identity=54%"; Hit description=Hypothetical protein CBG15247 [Caenorhabditis briggsae]
YCGRMDAVKQLLGAAGSEVLGMENLFENLFSETPLMAACTAGRELVCFLMRQPEVDPNYQAQDGHTAVDPNYQAQDGHTALHLHSACFHGHIRVVQYLLDNGADQSLTARAVDSPLINQFGKNYLKLFLKNNFVLNLRIHXLPNQNAIKFXIYNINQPQTPILWAYEKGHDQIVNMIVNMLKYYANRRPDSDACSEYSSGSSSYSGSSSYTPLPSPLGRLRSMTKEKAEILQLRGELRSAHHLSLLDVELKEPIGNGSFGKVYNGSFGKVYRGVYRGKTVAVKRYKVLIFKYFSKVDMFCREVSIVSHLKHTNIVAFIGACMDDPSQFAIITEFASQFAIITEFASAGSLFSLLHVQKRVFEMTLRLCIGVDIARGMKYLHELVERPVIHRDLSHNILLHNNGRAVVADFGESRFAGSHDKRDDNMTKQPGNLRWMAPEVFTQSCRYDHKVDVFSYALVVDVFSYALVLWEIHAAEXTFSQLKPAAAAAE

SEQ ID NO: 128403 - protein, 78 aa, Heterodera glycines
  Coding regions on vcDNA: vcDNA=SeqID_54826; Strand=+; Position=1 -86,158-308
MAHLELKHSTPGFRVKQPWLHTHLEFENSYPGGNFGGNQLLDGSISLSPLYPSQTIDLHVRIASDFHQSFLWLHPAQE

SEQ ID NO: 128404 - protein, 145 aa, Heterodera glycines
  Coding regions on vcDNA: vcDNA=SeqID_54827; Strand=-; Position=1 -183,518-571,1060-1260
MPEDSKTIENKFNELFKNGEQRTFEFQTVFKKELLYVIINNVTVNTQQKRQLPVWAANYIRLEGNVTAFGDPDYLYIDQIFLVKTKMLSKNIKVLNDFTIKLPTLFNYGDSVELYAKREKVAKHEDNNRNNFTFIFMHESLDEIQ

SEQ ID NO: 128405 - protein, 82 aa, Heterodera glycines
  Coding regions on vcDNA: vcDNA=SeqID_54828; Strand=+; Position=1 -87,197-358
MYFLGNLYFEKSNVPGFHAGPGQKPKKIQQIVYFGARLFGFNKNQPSKSRFWMPLKFSRIEPGRVGFLEWSPDFSESQTEYI

SEQ ID NO: 128406 - protein, 82 aa, Heterodera glycines
  Coding regions on vcDNA: vcDNA=SeqID_54829; Strand=-; Position=1 -126,170-292
MNKEEWNNEWKVQKIFREKHDYLKTIKEIDEILDTLKDVNLETQTRKMNQMIMNMKMKTKLKNKKKKRNMKVTMKTNRQNFP

SEQ ID NO: 128407 - protein, 100 aa, Heterodera glycines
  Coding regions on vcDNA: vcDNA=SeqID_54830; Strand=+; Position=1 -150,204-356
MSTSESKNGKNLNSSLNINNLSPTAPDEGDCEMPDERVLHLECFESGDYDMMELYGPDRAKEMLIDLRDYAEAHGMPCKHVKMLLYKLDKGLIKWKGTKP

SEQ ID NO: 128408 - protein, 204 aa, Heterodera glycines
  Coding regions on vcDNA: vcDNA=SeqID_54831; Strand=-; Position=1-614
PPPHPPPPPKRGHRRPPSPPGRAPSPPGSPPPRPQRPPRPTRASRRDGRLEQWEKRRNDIQRRQPVVRDLLAEAAAAPLPESDTDDDYMLESGLALPAPTQYYGDLPMLPYNAQREIEHMDTAQQRIAIRRKLKKDEAYDDDSEHKKYRVHYPPSPPRLPLPPRAKAKIEPPPSRPTAKREPQKPTKLELKPSKFDSDLRPKVA

SEQ ID NO: 128409 - protein, 312 aa, Heterodera glycines
  Coding regions on vcDNA: vcDNA=SeqID_54832; Strand=+; Position=1 -245,286-979
MADAMQDGARWKKAKTAINVLGNLLLAESLDNTSANDTSLKNDTVDIKKEEANVEEEKVQEEPKEKEENKEDLGDIDKTLDEPSLCVKMLNTQAFNDKDIGFKLPFGLIISGPSSSGKTQFLLKFIAESDHLITPRPVSMLYCFGEMNAAVPVLQKAGVDVYAGVPSEELIKRIPKPLLLILDDLMLSIDERYLSDLFTKKAHHHQFAVVFVTQNLFERKIKVARLSAQYLVLMRAPNSLLSIRNIGVQLFPRQLDFFLDAYRKATARPYGYLLIDMHASSDPSLRLRTNIFKDEQEEDEGTVVFIPKNGAA

SEQ ID NO: 128410 - protein, 576 aa, Heterodera glycines
  Coding regions on vcDNA: vcDNA=SeqID_54833; Strand=+; Position=1-1731
  Homolog annotation: Hit_ID=AAF70384.1; Match level="QueryCoverage =64%, HitCoverage=40%, E-value=2e-21, Identity=26%"; Hit description =GABA-A receptor epsilon-like subunit [Mus musculus]
MANKFLLVPQEIYRGLTSMSDTGDINLDAVRRDLDRARVERTHPSRKNVNYNQQLRRYLKMRQELTDKPAKVELTKGISVLLRRGAEDEEGEVVDTPPRPPAPPPPPPPPGRRPWRGPIPPPHPPPPPKRGHRRPPSPPGRAPSPPGSPPPRPQRPPRPTRASRRDGRLEQWEKRRNDIQRRQPVVRDLLAEAAAAPLPESDTDDDYMLESGLALPAPTQYYGDLPMLPYNAQREIEHMDTAQQRIAIRRKLKKDEAYDDDSEHKKYRVHYPPSPPRLPLPPRAKAKIEPPPSRPTAKREPQKPTKLELKPSKFDSDLRPKVAPPPRPKKEPEFPLDPRPSTSRQAVHLPPAPKIIPKPEPTKRPVPYRIPKREPKIVEQQPQPLQQPLPASAVEEEMPTVPPPRRGTKRHYPVNGENDGEVRIRKRVRQPRRVRVQYSPEPGPSTSAQSDEQQQQQQRELFAIPSNQLTMTQRVERLYIKCNHYADRMGVRGNTINTANGKPLAHSNLRMALKYIIDRRAGRPTIKPPGANLLEERLRKDPILYSWTAPPKRPSQSKTTRTERTIKKEFRPKKWS

SEQ ID NO: 128411 - protein, 387 aa, Heterodera glycines
  Coding regions on vcDNA: vcDNA=SeqID_54834; Strand=+; Position=1-1164
  Homolog annotation: Hit_ID=NP_502797.1; Match level="QueryCoverage =91%, HitCoverage=98%, E-value=2e-52, Identity=34%"; Hit description =HASI (4P602) [Caenorhabditis elegans] emb|CAB16520.1| Hypothetical protein Y57G11C.19 [Caenorhabditis ele
MDGSSKENSTEHNHQDGTENQEGISPEKVELINSTLDKLYNDPSSPAAFAGVTALWKEARKKLKNLRKKDVQHYLEGHRTYTLMRPRRVRFPRAKTVAAGFMTDVQVDLADFQALLRHNRGHRYLLVAVDVLSKRLFVVPLKNKRADEMLEAFRQLIDQMPMVPHRIFSDKGTEFKNRLLKEFFDEQEIEKHEPVHSSVKASVAERAIRNVKQRLYRYFAEKETLNWVDAVQKIVDGINNAPSRVHGMRPNDVNFSNAQKVWKRLYGHPTLQKRTPRFRNDQFVRMSREKGQFEKGYLPNYGDEILEIDEVLKAVRPIRYKLRDEHGEKFKGSFYEQELARVRKDAETSYRIEKVYRKRKLSDGSTEMLVKFIGYPNREWINESQLV

SEQ ID NO: 128412 - protein, 140 aa, Heterodera glycines
  Coding regions on vcDNA: vcDNA=SeqID_54835; Strand=+; Position=1-423
  Homolog annotation: Hit_ID=XP_345765.1; Match level="QueryCoverage =47%, HitCoverage=50%, E-value=6e-10, Identity=46%"; Hit description =similar to ENSANGP00000013677 [Rattus norvegicus]
MSKSAVTTVTEWSPFFGNCDKSLACAGTRCRAKAIRSVAVTRIRGDVVVADDANCEEKKYLEERLTFKRRRVEVSGIGDEAEGMALIGDEAEGMAPIGDEAEGMAPIGDEAEKMAPIGDEAEGMAPIGDEAEKMAPIGER

SEQ ID NO: 128413 - protein, 93 aa, Heterodera glycines
  misc_feature (15)..(15): Xaa can be any naturally occurring amino acid
  Coding regions on vcDNA: vcDNA=SeqID_54836; Strand=-; Position=1 -83,127-324
VKTKMCRQWKWTTKXRWDKVHKVVKTLLSKHWLMPTTAQENANDSRTNNTSELASVNRQFAIPSTPSSYLSPIGAIFSASSPIGAIPSASSPI

SEQ ID NO: 128414 - protein, 325 aa, Heterodera glycines
  Coding regions on vcDNA: vcDNA=SeqID_54837; Strand=-; Position=1 -236,326-403,678-855,895-1037,1080-1133,1190-1315
  Homolog annotation: Hit_ID=NP_505916.1; Match level="QueryCoverage =100%, HitCoverage=41%, E-value=1e-48, Identity=37%"; Hit description= involved in lipopolysaccharide biosynthesis (79.3 kD) (5L974) [Caenorhabditis elegans] emb|CAA98537.1| H
TTTSPRIRVTATDRMALARQRVPAHAKLLSQFPKKGDHSVTVVTALLDIGRDRWRQYGRTLRQYHQFMRNLLQLRVPMIVIVDEKSIVIVDEKSAEFVHRERARINWGQWTKVVQLSLDQLPLAIFQKRISLLMDSELANWPSDWDLSMRSHPEATQAEYVVVVNSKPYFLENVQTDNPFGTEFFVWNVQTDNPFGTEFFVWLDAGYGHGDRAIFPPSWEWRPTFPRGKMSVIKLTPPRDLLSRYSLKLTPPRDLLSRYSLKQLYRQDVAVLSGGFLAGDRRAQDVAVLSGGFLAGDRRAVTQLHREHHRMFLELLEKGRVDDDQ

SEQ ID NO: 128415 - protein, 70 aa, Heterodera glycines
  Coding regions on vcDNA: vcDNA=SeqID_54838; Strand=+; Position=1-214
LMEKRMFDYFCQRAAAEWLTNLPSRNLTAKSSKTPTASQHGKTRLRQETREVGGTSLNGNGMQRARNCPI

SEQ ID NO: 128416 - protein, 56 aa, Heterodera glycines
  Coding regions on vcDNA: vcDNA=SeqID_54839; Strand=+; Position=1-282
  Homolog annotation: Hit_ID=CAE60592.1; Match level="QueryCoverage =100%, HitCoverage=25%, E-value=4e-18, Identity=78%"; Hit description= Hypothetical protein CBG04228 [Caenorhabditis briggsae]
VLCLAVAIGHVEMSQDELVSNISLGVNFLVSLLKKNWQNVRSLNIKSTMGPAVRLF

SEQ ID NO: 128417 - protein, 32 aa, Heterodera glycines
  Coding regions on vcDNA: vcDNA=SeqID_54840; Strand=+; Position=1 -63,236-271
MFNFFFLLIFASSAQNSFQQNDDLGSFQIVVK

SEQ ID NO: 128418 - protein, 173 aa, Heterodera glycines
  Coding regions on vcDNA: vcDNA=SeqID_54841; Strand=+; Position=1 -102,262-360,409-442,497-553,710-846,1006-1039,1092-1148
MPLKVPHSPPLQSLVINNSSGAEEARKGMPIAVVNASLSKKVELHKNEQQRPAKKLNHTQAMGHHDKPTNISVANNSSKNNGTSPTNVLVTSKNTTDGDYLRVLFPPSPMPLKVPHSPPLQSLVINNSSGAEEAKKVMPIALVPKTVRVAKKSSMNNGTTLMANALLISKNST

SEQ ID NO: 128419 - protein, 131 aa, Heterodera glycines
  Coding regions on vcDNA: vcDNA=SeqID_54842; Strand=+; Position=1 -92,268-452,799-917
  Homolog annotation: Hit_ID=CAC21848.1; Match level="QueryCoverage =93%, HitCoverage=63%, E-value=2e-13, Identity=37%"; Hit description =hypothetical protein [Globodera rostochiensis]
MLFAESDLFPRFGIVYYETKIIRRQLTFGNGTIGVGLFTSDHFYFYSSGGVVFGHNIGGFGGFPPFGEGDTIGCGVNLTSKEIMYTTNGKRLNTSNMFVVIKDMLLPAVFMHSVGDTIEANFEPNLQLPNP

SEQ ID NO: 128420 - protein, 122 aa, Heterodera glycines
  Coding regions on vcDNA: vcDNA=SeqID_54843; Strand=+; Position=1 -88,821-894,937-996,1085-1231
MKFWRLTFIFIFSFIQKSTSNATTEIQAKYSNFGSVISQFMENREKIDQIFADLKKEKEKRKEQMLSEEEPLQIIRDTITIDYQWNTSDCQSDRMILIPTIIKVKHYGKKKGKSGWKYRKYF

SEQ ID NO: 128421 - protein, 324 aa, Heterodera glycines
  Coding regions on vcDNA: vcDNA=SeqID_54844; Strand=+; Position=1 -237,522-676,943-1078,1123-1209,1265-1429,1473-1667
  Homolog annotation: Hit_ID=CAE67374.1; Match level="QueryCoverage =67%, HitCoverage=14%, E-value=5e-23, Identity=31%"; Hit description =Hypothetical protein CBG12850 [Caenorhabditis briggsae]
MVFRYKKSFHEACRSDFASLGLPLDDCVHSSLLIFNELLRIADYEYEQIRIHHSVDGPIVQLGSRADSIIGQNPIGWLIEAADHFIAINNKFPQALLTLGLLSLNRPLEMRTRIPRIFQILIQHMQTAVNKKKQMPMLDFHCLSLLIQSQKSHLCERVRESLPLMFSTGISEGLIQALHVTIEHIPELPADVFDGLMDHLYQLLMDRPRPSKLAPPTPPPIPIGPIQPKNIPQTQLALKTLGEFNFSRHSLQMFLRYVALGYLTSDSTKIRLTSVFSCGEMLKPFVDIYEHVQTEQKAELYSLIRNVLECLVKTAIVDTGPVIG

SEQ ID NO: 128422 - protein, 16 aa, Heterodera glycines
  Coding regions on vcDNA: vcDNA=SeqID_54845; Strand=-; Position=1-49
EAIPEGFGLPINLGAS

SEQ ID NO: 128423 - protein, 30 aa, Heterodera glycines
  Coding regions on vcDNA: vcDNA=SeqID_54846; Strand=-; Position=1 -20,68-140
MDPTRRGAPGEELSSEDLAALPALPGLLAF

SEQ ID NO: 128424 - protein, 33 aa, Heterodera glycines
  Coding regions on vcDNA: vcDNA=SeqID_54847; Strand=+; Position=1-101
QSNANGRPNVIKIPEGENLIKSIPSGDRAGCRG

SEQ ID NO: 128425 - protein, 153 aa, Heterodera glycines
  Coding regions on vcDNA: vcDNA=SeqID_54848; Strand=-; Position=1 -179,1227-1508
MRDQKERKYGGDGGGAGQMLTLLTSASADAAHVKSLAAGGDSVFAPPGGFGTEGKGKEKSWVCNDVLMDLFPFFGRLQLGLKLALLSPRFNALVDKHFDGKNEFTIWRWIGFRKNNGTAASELSVLIDYANSVQFPWLDLPLPHKIRFKHLQI

SEQ ID NO: 128426 - protein, 68 aa, Heterodera glycines
  Coding regions on vcDNA: vcDNA=SeqID_54849; Strand=+; Position=1-205
MALLGGSPPHCRDHWTKESPSPSVKGQGEPEGPVFRGRRNVMPEGTECGRKWDKGPERTSKRGARSSV

SEQ ID NO: 128427 - protein, 41 aa, Heterodera glycines
  Coding regions on vcDNA: vcDNA=SeqID_54850; Strand=-; Position=1 -110,491-506
MARVEGNFLQNNVTQYISNDLEIASVNTYKINLNNCCFCKK

SEQ ID NO: 128428 - protein, 78 aa, Heterodera glycines
  Coding regions on vcDNA: vcDNA=SeqID_54851; Strand=+; Position=1 -74,133-226,361-429
MACAAIAAHNLGFDNTRVKLIVDPMLHNWHIIECEIGGENGFRTRTRREFAAQHGGRLCTSRPVSTFVSPIFTTDVLR

SEQ ID NO: 128429 - protein, 148 aa, Heterodera glycines
  Coding regions on vcDNA: vcDNA=SeqID_54852; Strand=-; Position=1 -140,475-534,583-723,998-1103
  Homolog annotation: Hit_ID=AAG21338.1; Match level="QueryCoverage =43%, HitCoverage=73%, E-value=5e-10, Identity=50%"; Hit description =hypothetical esophageal gland cell secretory protein 9 [Heterodera glycines]
MMMMSSAAMLFVMITLALISFGCSIGAVKSEGDDESGAVRHSHELISRIKRYGYGYNSYGYGGGCACAPVPVTSSCYSCGSGGGGYGYSSYQPVPPPPPPMQPSYSSCATCGGGSWNNYGSSSSMSVGNGGGYGYGGGMCSVCGRKRK

SEQ ID NO: 128430 - protein, 65 aa, Heterodera glycines
  Coding regions on vcDNA: vcDNA=SeqID_54853; Strand=+; Position=1 -185,250-262
MVDIGEPPSLNTRLVDESPNTKQQIKFLFVPITLANLENGDDHRHHLFAKFVLMIMMMTAFWNIV

SEQ ID NO: 128431 - protein, 52 aa, Heterodera glycines
  Coding regions on vcDNA: vcDNA=SeqID_54854; Strand=-; Position=1 -27,1044-1130,1466-1510
MLLLVLLLLFTLKLPLIVSDQLIFLLISFFSIIKWMGQNFIIQMDPKISRPV

SEQ ID NO: 128432 - protein, 172 aa, Heterodera glycines
  Coding regions on vcDNA: vcDNA=SeqID_54855; Strand=+; Position=1 -175,227-435,549-683
MVTQANRDLLVRQGSQASLVHLVIRARMGHVDRPDQPDQMASQENLANQDKTESLAYSAMDRSRLALRDRKDRPAIQEGTENQDSLAHKAILGSRDSPELEVRQDRLELRENRAAKESPERTAKRDTAIIVLLLALLLAIEQKRKRRREADQSGKPKRNAIKNCFALGLFME

SEQ ID NO: 128433 - protein, 202 aa, Heterodera glycines
  Coding regions on vcDNA: vcDNA=SeqID_54856; Strand=-; Position=1 -207,735-934,2304-2505
MAIAPNSSSTSLLNDSLIHWVVFLNSIELCVLFASFLISAFNLILLSNTALLHPNLKCILLVQSAVIGLYECFRFIFVLSKFVFADAFYHGAVPVQIVQMALIPIRNKMGHVLVAERVFATINFRKYTENRSTTKHHHPMIKRKAVVWLKNFFSFVKPSSVADSSVPIALQNGQSLVDIRGQKLLTESEMQIYFKKLEEAWK

SEQ ID NO: 128434 - protein, 32 aa, Heterodera glycines
  Coding regions on vcDNA: vcDNA=SeqID_54857; Strand=+; Position=1 -5,328-421
MVKSQSEENATGDKSGQIDEVKITSLNIHIPN

SEQ ID NO: 128435 - protein, 108 aa, Heterodera glycines
  Coding regions on vcDNA: vcDNA=SeqID_54858; Strand=-; Position=1-327
MANEITESYAELIDTPPAKVLYCYSEMNQSVIELMKRGIETHNGVPDQALIQNQPKPLLVLDDLMLNVGNDFLDLLFTRGSHNWNVSVIFVTQSLHGRNIKTARANSH

SEQ ID NO: 128436 - protein, 155 aa, Heterodera glycines
  Coding regions on vcDNA: vcDNA=SeqID_54859; Strand=-; Position=1 -69,113-508
  Homolog annotation: Hit_ID=CAF91830.1; Match level="QueryCoverage =99%, HitCoverage=13%, E-value=2e-13, Identity=29%"; Hit description =unnamed protein product [Tetraodon nigroviridis]
MNERIEEISTEIAKSNAFVMEAKEKVKKAQQKLETYNNEVRSQEKQIRVKTAEIEDLKKRVRHLEAKIESKTRDREEALKNAKDFEKRAQQLEKAHNWIAEERKHFAVEGTAYDFRNYSFEMGKREYDERKTRSKDLLRTVNPKAMESLATAEKE

SEQ ID NO: 128437 - protein, 293 aa, Heterodera glycines
  Coding regions on vcDNA: vcDNA=SeqID_54860; Strand=-; Position=1 -315,391-627,682-968
  Homolog annotation: Hit_ID=CAD58848.2; Match level="QueryCoverage =96%, HitCoverage=21%, E-value=1e-37, Identity=35%"; Hit description =SMC2 protein [Takifugu rubripes]
FSKSYAPLTLIRTWTTSLSRSVFNWPEKEGNVRKNWTGLRPGIHSMTVLTLQFQIFLKKFKLRFDYTMPYNGFDRNKVKGVVAKLFKMNEQRYATALEVVAGGRLFHVVIDLFHVVIDKVKTGEDLLKAGLPRRVTMLPLDKISANVLDQRLIGQAKRMVGEENVFFPGELIEYEREIELAILSVFGNCLICGDMDQAKICGDMDQAKQLTFDRAINCRTVTLSGEDFKPTGVLTGGFRKPDASILTALNEISGQYERIRELDHRIGAIESDCSDVVSILEGIFRGTRKTEAP

SEQ ID NO: 128438 - protein, 294 aa, Heterodera glycines
  Coding regions on vcDNA: vcDNA=SeqID_54861; Strand=-; Position=1-885
MRLIRRDIKKRAKFDMFKLKPIARVNKCAISAFFVAGLNDELVGPHHVRALAKAHNGPNQLYQFQGGHNSPRPANFFVQALQFVRVMIGMLPLQLDSPMSSPEKPQRTPVVLHNPLEPGVSIETVHKMTIKELKACIDRAGFSDVTCIEKAELVELVLKLYARWARLNPHEAASHGPATTSSPPVSSHSTNSPTMADLPRSGSTRELDSPSSVDKGRRHSEGSLETVEEFPDVQRAFFPAMTSSCSSIMSDAELTQALGHRTSGEDDEDDDDDDEEDVDGYDEQREESEVEEHV

SEQ ID NO: 128439 - protein, 113 aa, Heterodera glycines
  Coding regions on vcDNA: vcDNA=SeqID_54862; Strand=-; Position=1-339
  Homolog annotation: Hit_ID=AAM33192.2; Match level="QueryCoverage =92%, HitCoverage=16%, E-value=8e-16, Identity=40%"; Hit description =similar to Dictyostelium discoideum (Slime mold). Random slug cDNA -11 (Fragment)
MWSMIKEGYEGLVMTVIRPLRATYTPADLGPKRAMLRDVVMQRTDMKLKNPGGYTLECSWWRPKTDRSEKTPCIVILHGNSSCRLGGLEIVSYAIPAGFSAFALDFSGSGLSE

SEQ ID NO: 128440 - protein, 141 aa, Heterodera glycines
  Coding regions on vcDNA: vcDNA=SeqID_54863; Strand=+; Position=1 -150,339-382,584-812
  Homolog annotation: Hit_ID=NP_006459.3; Match level="QueryCoverage =97%, HitCoverage=24%, E-value=3e-12, Identity=33%"; Hit description =polymerase (RNA) III (DNA directed) polypeptide C (62kD) [Homo sapiens] gb|AAH02586.1| Polymerase (RNA) I
MSIRTIELCVSILEDHFGFYVSAVGAVLLRQQLPFVLLAKELHGRVRPGEMKRSIAILDQHNLLSFESPARAGAVVLYTVLAPRVLNLVRAPRAILTVKTLYSSGAMEAIFEDVLAQGRTSCSQCIRRVAKCMVDNLPMDK

SEQ ID NO: 128441 - protein, 499 aa, Heterodera glycines
  Coding regions on vcDNA: vcDNA=SeqID_54864; Strand=-; Position=1-1499
  Homolog annotation: Hit_ID=NP_920205.1; Match level="QueryCoverage =91%, HitCoverage=29%, E-value=1e-43, Identity=30%"; Hit description =putative DNA helicase homolog [Oryza sativa (japonica cultivar -group)] gb|AAP52492.1| putative DNA helica
MHREIRETMHMQLHRCSDSWCGPSDPIYGRCKKGFPAPYSKCTILRPDRPAMYFRPSPTDGGAQLEVNGLIYDNSHVVPYNPYILLRYRVHHNVLFAYGNKANIKYALKYPFKGPGHCYVECKQESGNKIGIDEPAQYAKMNFRGATEAYAIVHSLPFAKLSHQVVKLSIHMPNQQPIVYRAFQLVSKAQQIQQGKLPETQCSAYWKQWQNEWKHDPKLKDMLFEKVPEHFIWAKDKWNKRKYNLTKRPPIGRIVPVPPKDPERFALYSLMRHFPGDPDHLKMVNGQPCTSFTDAAIRHGLLEDDKIWDKTLAEAALSRWPDQMRWLFMSILVYGQPSNAVELWNKYKDQMYFPQGITTSAQRQAAELEALADIDWRLHSCFNLSSVHFGLPDPPNSIAKNTNAAINEFFFGDDDLNLPPGQPNPRPQPNTPPPLNSDQQKVFDAVLLAIQSNPRDSTVPRRFFIYGDGGTGKTFLFGQIIRRLRKAPYTYKVLATAST

SEQ ID NO: 128442 - protein, 105 aa, Heterodera glycines
  Coding regions on vcDNA: vcDNA=SeqID_54865; Strand=-; Position=1 -11,60-366
MNRRWICADVWMDILPSFDRAQLGLKMALLSDRFDFLVDKHFDGKSELIIWNDITIRKGMEDEEKIGAKAKLFMQIKDNKDKFVEFPMPDHPLPNKIRFMDLMIM

SEQ ID NO: 128443 - protein, 100 aa, Heterodera glycines
  Coding regions on vcDNA: vcDNA=SeqID_54866; Strand=+; Position=1 -255,457-504
MIFGAILLSGLALWWLICFLFLCFFPYCFRPIRRLTTKRRCGTHSGTSNPLADSSILRRPSNTKSGVARPPPSFALPFSRPFAHSSLLTPPCVNRSELFL

SEQ ID NO: 128444 - protein, 76 aa, Heterodera glycines
  Coding regions on vcDNA: vcDNA=SeqID_54867; Strand=-; Position=1 -96,457-591
MRRVDSISLFSEDANYLEFLDTIKYNEEMTVDKLMNLHKLILQKHSPNDEAAGRIRTTEVEVSGEPMLHSDHVPGE

SEQ ID NO: 128445 - protein, 97 aa, Heterodera glycines
  Coding regions on vcDNA: vcDNA=SeqID_54868; Strand=-; Position=1 -253,914-954
  Homolog annotation: Hit_ID=AAC95573.1; Match level="QueryCoverage =89%, HitCoverage=30%, E-value=2e-17, Identity=53%"; Hit description =orf 48 [Ateline herpesvirus 3] pir||T42963 hypothetical protein 48 - ateline herpesvirus 3 (strain 73) ref
MEAKGKEQKAYKMSTKRGTKNGENGQKWHKNWDEEEEEDEEEEEEEEDEDEEEEEEDEEDEEEEEEEEYEEEEEDESSTEEIGTRRKNRTNRKNSNW

SEQ ID NO: 128446 - protein, 95 aa, Heterodera glycines
  Coding regions on vcDNA: vcDNA=SeqID_54869; Strand=-; Position=1-286
  Homolog annotation: Hit_ID=NP_502797.1; Match level="QueryCoverage =89%, HitCoverage=26%, E-value=3e-10, Identity=38%"; Hit description =HASI (4P602) [Caenorhabditis elegans] emb|CAB16520.1| Hypothetical protein Y57G11C.19 [Caenorhabditis ele
MDLCIMDALKDQNDGYRYLLVCIDVLSRRIFTAESESKKNEHMIEAFERVFKKANVLPNKLYSDAGLEFQAKRMLDYWKKKDIIKHVMYSPHLHA

SEQ ID NO: 128447 - protein, 63 aa, Heterodera glycines
  Coding regions on vcDNA: vcDNA=SeqID_54870; Strand=+; Position=1 -132,214-272
NLCHFANQQVKGNLRLSDSHPIQRSLTELGLITYVLESVVYYIAGMIDEELFLMQDIENAIVQ

SEQ ID NO: 128448 - protein, 114 aa, Heterodera glycines
  Coding regions on vcDNA: vcDNA=SeqID_54871; Strand=+; Position=1 -204,507-546,909-1010
TRFAFDPAHFHPNPGDLCEQIWGHGPISECVCHPKDVQAEDDRHPGAGLLGAGHHSLHCGACPSEFRTSRYWSREFHVKTGVCEVMENLLAMTATIARSSRSYAIGLRGADNEV

SEQ ID NO: 128449 - protein, 83 aa, Heterodera glycines
  Coding regions on vcDNA: vcDNA=SeqID_54872; Strand=+; Position=1 -61,296-486
MPVPPPDSAAVGEPDRMTISTFFKGVKNMSKKRRPHPAQLKKSVLLSIANGTENDGGTKSPRHGSMLRRFSRAASFKKARALT

SEQ ID NO: 128450 - protein, 75 aa, Heterodera glycines
  Coding regions on vcDNA: vcDNA=SeqID_54873; Strand=+; Position=1-350
LISSQKSCQFKTAKKAEFSKFFISIFFYSSKFFVIFSRLIEPVKSFRMISRLFDSVKNFKSYIDSKLAQTELARS

SEQ ID NO: 128451 - protein, 68 aa, Heterodera glycines
  Coding regions on vcDNA: vcDNA=SeqID_54874; Strand=-; Position=1 -24,240-422
MILQCRKGYIFVIFRKPIELVKSFRMIPILLDLVNKEKSYDALNLAQTQLARFVYQANVPNFRGGRIN

SEQ ID NO: 128452 - protein, 49 aa, Heterodera glycines
  Coding regions on vcDNA: vcDNA=SeqID_54875; Strand=-; Position=1 -35,276-390
MRPSVKSKAYSIIWPTVAFAAMSFRMADALYGFRLHMVTDGKGAFSNLS

SEQ ID NO: 128453 - protein, 163 aa, Heterodera glycines
  Coding regions on vcDNA: vcDNA=SeqID_54876; Strand=+; Position=1 -80,165-287,1147-1435
MDALENVLQETGRSEGVAAAISTDNGPEEGTPRIEKASAEQTRKEGGGGEAAKETEQQFTNSSEHRLAHCPMRFLDYRTTNGEGNNGGGYRKSRQSAASSSHRTYAIEMLDENMDICVCHREYNHCVANNLDGEIPEIMPGDDLNLLNISHLTEVGWHIPLLA

SEQ ID NO: 128454 - protein, 49 aa, Heterodera glycines
  Coding regions on vcDNA: vcDNA=SeqID_54877; Strand=-; Position=1 -105,421-465
MSNKGMSFLGAAVFSLLFVLMVNENWAASTDDDEEPNYWPQGGVGLTVL

SEQ ID NO: 128455 - protein, 185 aa, Heterodera glycines
  Coding regions on vcDNA: vcDNA=SeqID_54878; Strand=+; Position=1 -183,547-714,1016-1219
  Homolog annotation: Hit_ID=NP_500617.1; Match level="QueryCoverage =100%, HitCoverage=17%, E-value=8e-53, Identity=57%"; Hit description= dehydrogenase, E1 component and Transketolase, central region (115.7 kD) (4F462) [Caenorhabditis elegans
QPTHRPPSSALSAEPFMNATSGVYIEQMYESWQLDRGSVHRSWDAFFTNVNAGAAPGQAFQAPPSVPSLSTVPHATVVPRDMREVQPQTAGQVIPADELTRAINDHLKIQVLIRSFQTRGHNIADLDPLGINSADLDDTIPRELELDFYGFTEQDMDREFLLPPTTFIGGERATLSLREIYKRLK

SEQ ID NO: 128456 - protein, 237 aa, Heterodera glycines
  Coding regions on vcDNA: vcDNA=SeqID_54879; Strand=+; Position=1 -424,922-1211
  Homolog annotation: Hit_ID=AAL78214.1; Match level="QueryCoverage =22%, HitCoverage=27%, E-value=2e-10, Identity=50%"; Hit description =putative esophageal gland cell protein Hgg-20 [Heterodera glycines]
YLDVQVINFLRRNRRLFSTNISLQFNLLITEFRAWQAMARHIWPLLRNGLRTLVSLKRKQLALMRKHVSPTVLFDYPNLVEILTPILPERPTVDNTNYAADTSARDLYMWLHMSRPDGRPKVFKLTKWNNGWDQFVNDLCSSFTAASVPVNYMVLTSFEFNYTRSEEMVNIRTEERLTLMSNVHPNPAVGGVVSLVKILRCPVEFSNAAMVSWLRMARVSNERPPNWVTIGFSDDEI

SEQ ID NO: 128457 - protein, 107 aa, Heterodera glycines
  Coding regions on vcDNA: vcDNA=SeqID_54880; Strand=+; Position=1 -117,498-704
MAPLQDPPTSPDPDTWLLQNLAPLSGTGFLKIQYPVRNPKWKTNAFLAKTEMEERHELEAQLRKIQTQKAAQIECCCLPKSTSAPALLSHKFLNFGIQLQNIGVQFI

SEQ ID NO: 128458 - protein, 46 aa, Heterodera glycines
  Coding regions on vcDNA: vcDNA=SeqID_54881; Strand=-; Position=1 -81,172-231
MRKMKWIKMRKKAFHMKWKLIQGTYRTKNPNNSSSVERVRTHANGH

SEQ ID NO: 128459 - protein, 141 aa, Heterodera glycines
  Coding regions on vcDNA: vcDNA=SeqID_54882; Strand=+; Position=1 -294,445-576
MPGQHNNINEMNCFVTRNIELIIQQQQLKEEVEGLKTEKNRLLMETQRILTDQTKHIEKNDKLMDKCIKLQDKNIELQLQNNNALREHIEIKQNTESLRNYVCIPCGHFALCNRCAEVVAIEGTCPFCREQLDGVFKIFSS

SEQ ID NO: 128460 - protein, 126 aa, Heterodera glycines
  Coding regions on vcDNA: vcDNA=SeqID_54883; Strand=-; Position=1-381
MFVIGQNTPMSCSYLSSSLPFQLSKMELEQFFELPIFHADDSLQSALSPANFVPTDTVPFGPNVDEVPELGPNLHDQVVEVAEDVVSLRILLTPAAKSASTATNNISLSGLGLPRTPMIEHVLMIW

SEQ ID NO: 128461 - protein, 194 aa, Heterodera glycines
  misc_feature (1)..(1): Xaa can be any naturally occurring amino acid
  Coding regions on vcDNA: vcDNA=SeqID_54884; Strand=+; Position=1 -124,169-291,352-474,769-901
  Homolog annotation: Hit_ID=CAE62113.1; Match level="QueryCoverage =94%, HitCoverage=25%, E-value=1e-37, Identity=46%"; Hit description =Hypothetical protein CBG06151 [Caenorhabditis briggsae]
XRFTNATSGQKGISGGEARRLLFASELLNNPQIIFADEPTTGLDSSMAESVISVMRALTLSGRTTTGLDSSMAESVISVMRALTLSGRTIICTIHQPSSEIYQKFDRVMVMFLAQGRLAYFGEPTKATELISRAGNPCPSNYNPADHIIQCLSIEMGRESECQQRVRNICAEWERCAEGAFFHAEVEKRRQCVR

SEQ ID NO: 128462 - protein, 85 aa, Heterodera glycines
  Coding regions on vcDNA: vcDNA=SeqID_54885; Strand=-; Position=1 -133,186-310
MESVETACGQRPFGCASAVHRHPGNDHSAVSSAHHHRLLRRVRHTLAVRRLRLSIAKAFGADNSSNTDKIVNDSKLSNFVNRKNS

SEQ ID NO: 128463 - protein, 275 aa, Heterodera glycines
  Coding regions on vcDNA: vcDNA=SeqID_54886; Strand=+; Position=1 -161,542-777,1282-1451,1508-1729
  Homolog annotation: Hit_ID=NP_502164.1; Match level="QueryCoverage =100%, HitCoverage=43%, E-value=2e-86, Identity=56%"; Hit description= white family member (67.1 kD) (4M237) [Caenorhabditis elegans] emb|CAB05682.3| Hypothetical protein C10C
SLLKRSLIDNWRNPGLTRAKLFQKLIMGVFIGLLYMNTQLNGVGVGNLNGAMFYIIAELTYSTLFGVLTFFPADFPLLAREYHDGLYCSGAYFVARSASYLPLFTIDGILMVTIAYWLIGLVPTVGRFLITLGISFLVEQSAVAFGVMLSAVCPSYPVAVSVAGPILTILSLTGGLYANVGSLPYFISWVQYLSWFRYGFEVQYLSWFRYGFEAFAISQWSGAFGDDEAHVRSVLAAFSFRPEAFYTDLGAMALFIGMFYLIGFFGLLFRVRRAR

SEQ ID NO: 128464 - protein, 450 aa, Heterodera glycines
  misc_feature (22)..(22): Xaa can be any naturally occurring amino acid
  Coding regions on vcDNA: vcDNA=SeqID_54887; Strand=+; Position=1 -85,260-307,385-571,623-815,865-988,1480-1638,1931-2075,2136 -2263,2291-2378
  Homolog annotation: Hit_ID=NP_499356.1; Match level="QueryCoverage =92%, HitCoverage=72%, E-value=1e-72, Identity=36%"; Hit description =flavin-containing monooxygenase (58.5 kD) (fmo-13) [Caenorhabditis elegans] emb|CAB97238.1| Hypothetical
STPSKRCAIVGAGACGLACARXTIQRPYFRPVVIERRQNLGGLWRFLPFPRKVATVMRFLPFPRKVATVMRCTVTNSSKELTAFSDFPPDSQLPNYMRHDKMLAYLAAYARHHNLEQYIQFGKKVTKICRSPNYFGKKVTKICRSPNYAETGQWTVQWENEGNGEHEDTFQCVLVAIGHHAKPNWPNWEGMAQFGGKIFHSHDFRRVRLTIFHSHDFRRVRLTWNKKVNVVVGASDSAADMAVELSRVSKEVLLSTRRGFWVLRKCAEKGLPVDSVLTTRFSALLSRYAPRRFDEWRRVRFLQKGLDHAMYGIMPDISPLVSHFTVNDELPGRMLAGMVTVKPDIGHFTENGIVWADGTRTIVWADGTRTDQVDNVLLGTGYRFDFTLIERGQLLISSIDQSSLYKHMFPLGSSDWNTLAILYKHMFPLGSSDWNTLAIVGIVQAVQNAK

SEQ ID NO: 128465 - protein, 105 aa, Heterodera glycines
  Coding regions on vcDNA: vcDNA=SeqID_54888; Strand=-; Position=1 -183,474-606
KIYWNQFDDARKKQLNEFYAVLAQNRSVDQFFNYFFDQFGLACDQFFHFCQLGDTIMNCCEEIMAFIAEYKPQLAPFPRYYLYPGIWTKMRLNAKHISLFPAKEV

SEQ ID NO: 128466 - protein, 58 aa, Heterodera glycines
  Coding regions on vcDNA: vcDNA=SeqID_54889; Strand=+; Position=1-174
MQIVNSDGNPLPIPQNPLPNKVIGLEGITIDVMPMFRDSIDCDVFEYHRFSPLTPSQM

SEQ ID NO: 128467 - protein, 77 aa, Heterodera glycines
  Coding regions on vcDNA: vcDNA=SeqID_54890; Strand=+; Position=1-234
MPRPRASLGTAAAMPLHQQQKMPQQERAVPAGGDWEGTGAQQQTTTAFCFVPLKRNSGGGTSQSEGEMAAAERKMPI

SEQ ID NO: 128468 - protein, 374 aa, Heterodera glycines
  Coding regions on vcDNA: vcDNA=SeqID_54891; Strand=+; Position=1 -475,522-988,1035-1217
  Homolog annotation: Hit_ID=EAA76228.1; Match level="QueryCoverage =81%, HitCoverage=40%, E-value=6e-13, Identity=25%"; Hit description =hypothetical protein FG09606.1 [Gibberella zeae PH-1] ref|XP _389782.1| hypothetical protein FG09606.1 [Gib
ANVAQHPPMVQPPQHRPPASHPMLSHKLEFPSPTHASPASVVHVVTHHQPQFFGPSHNNSLNANPMNNGTTPPAIFDFQTQQFREFDFMNSPEDPMPSSESGGYGGDGTAYGRVPMGGYHHHHQLHAHLHGGEHIAYAEGDGCAVNEVTAVQHHQRHYAYQQQCPCKECFAACRPPPPPVTHPPYPPPPLPSSAAAVDQANAQHYAMCTYDNSRKGMASGCCQRAEAVQQNQQQQQQQQRQQQHLYEAPMAVQQTQQQHFREEQHGQHQHVLVQHHPQQHQQPPHFHPQLQQQMQAVHHGEMEIGHGNGGAMHQVVHHGHPNENEAQRVGPPSGGHLSAGMLEDIELDEVSSTFSDLKMSGGREGDGAGGGTSR

SEQ ID NO: 128469 - protein, 50 aa, Heterodera glycines
  Coding regions on vcDNA: vcDNA=SeqID_54892; Strand=-; Position=1 -35,215-332
MRCEGGEQLRKRSAFVRIASAAPTASVASKRHRRMGRRVVIRRAKNSYLI

SEQ ID NO: 128470 - protein, 165 aa, Heterodera glycines
  Coding regions on vcDNA: vcDNA=SeqID_54893; Strand=-; Position=1 -85,138-302,361-387,485-676
  Homolog annotation: Hit_ID=XP_320814.1; Match level="QueryCoverage =98%, HitCoverage=46%, E-value=3e-45, Identity=54%"; Hit description =ENSANGP00000004790 [Anopheles gambiae]
LLPDFSFSVEQVGVLCEILQRHNLFDRLAQFLAQFLWTIPPVDEYRFSEGVLKAQAVISFHRHNFKELYAILQSHNFSPENHAELQVLWMHAHYSELWMHAHYSEAEKIRGRELGAVGKYRIRRKFPLPRTIWDGEETSYCFRVRSWSSNKNWRDQIALPSRRGP

SEQ ID NO: 128471 - protein, 653 aa, Heterodera glycines
  Coding regions on vcDNA: vcDNA=SeqID_54894; Strand=-; Position=1-1960
  Homolog annotation: Hit_ID=EAL49477.1; Match level="QueryCoverage =99%, HitCoverage=70%, E-value=1e-88, Identity=30%"; Hit description =hypothetical protein 42.t00003 [Entamoeba histolytica HM-1:IMSS]
EKENKEDDREKDLLKGRERSEEEKKEPKEEKVKNEKREGEKDVEAKDREKKKEQEEKRDISVKEKKRGPKAEKGEKERENEREEKKEAKKEKEETKEATETDGESEQKKLKEEKREPKEAKRENERQRESEMKLKEKGEKETGKGKEAEMEEVKKAEKETKKGVVKKCKEEEKKEKEEKEANEERVVLTETGTAEDEQSEKKAKNEAKKEAKRQGTTESERDMRISETSSEEEEAVPSSGGRSEKEEIRTKKDEQNEAKKSAEKEEKKRKTEEERVGTEHKEETEVGGRKKQRDEKKEEKGNREEKKDEEKEEGRKRHHDEKKAEEEKMKKHREEKKDHFEMDELKKWKNEHGFVSDEEEKGGRAALKEKLTRKELEEMKMNAGNEEENKVRRKLKEEEKEKKAEGKEEAVNSSNLASEKVKEEKEEEETKKETLKKEEKKEEEKKKRKEEQKEERGENEEERKKDKGKDNKDKRDEKKTEEEKKDKEEAIKKEEGKRDVKEEINREGDEEKSNNERKGKKEREGEGEGKSKLEEDKQKKNNEETRKRENEEEKKADEEAREREGKKTDSEETGKKGKEEEKRDKEETLKKEEEKRDSEETGKKGKEEEKRDKEETLKKEEEKRDSEETQKKGKEEEKRDKEETLKKEEEKGD

SEQ ID NO: 128472 - protein, 75 aa, Heterodera glycines
  Coding regions on vcDNA: vcDNA=SeqID_54895; Strand=+; Position=1 -52,610-785
MRVTVCLTARNKGQNSSLCGLTTPLDGTEDEKIACFKPEGAIGPIGIKFLREFRGNQTMRDGRNDQEEAAYLMMM

SEQ ID NO: 128473 - protein, 25 aa, Heterodera glycines
  Coding regions on vcDNA: vcDNA=SeqID_54896; Strand=+; Position=1-75
MRELLFKTANQEQHTFTLEVEENET

SEQ ID NO: 128474 - protein, 95 aa, Heterodera glycines
  Coding regions on vcDNA: vcDNA=SeqID_54897; Strand=+; Position=1 -246,300-339
NDLAGADDGEMLVQPMHMNDHPAAAQAGYVNDHAAHHHHHHHHQHHQQQNGMLIDHNVWQQILAPVQQQIQLTAQDYPAIRRLMALGFPRNLCIE

SEQ ID NO: 128475 - protein, 65 aa, Heterodera glycines
  Coding regions on vcDNA: vcDNA=SeqID_54898; Strand=+; Position=1 -100,161-258
MGKTCIFRLKERENEILRLRKSPNRRHSPQHRKRNIYPSLNGNTPITSLSFLGCGAMSTPNDEVS

SEQ ID NO: 128476 - protein, 195 aa, Heterodera glycines
  Coding regions on vcDNA: vcDNA=SeqID_54899; Strand=+; Position=1 -24,424-682,862-1166
MKKPAVVEAFQFIKIEFVADEKERLFQVVSQLNSERRSIIHRAIASYFGVDEKFGANLVKDGATDHEQFCGKLNAMVDQLIDYTDAAKVAVAGDFLHQQGQCAYRSLADMNQISNLKAHISELSAQNLTQQAQIGAQQVQIDGFHAQVGNQQNRLQAQVIAQQNLIGDQHNQIGGLHVQVAAQQQLDRWPSGPNW

SEQ ID NO: 128477 - protein, 67 aa, Heterodera glycines
  Coding regions on vcDNA: vcDNA=SeqID_54900; Strand=-; Position=1-205
LMEKLKNFTLDDLFKVLALPDKEFEEWLRELKLLHTTRFCDCGNEMSYKWIKDRNQPLWNWPAYEYN

SEQ ID NO: 128478 - protein, 47 aa, Heterodera glycines
  Coding regions on vcDNA: vcDNA=SeqID_54901; Strand=+; Position=1 -69,310-383
MDYAADKLTETREYGKYSTDKQTKIMARRIEKKKKNAFLTTLSPNLG

SEQ ID NO: 128479 - protein, 222 aa, Heterodera glycines
  Coding regions on vcDNA: vcDNA=SeqID_54902; Strand=+; Position=1 -97,256-338,407-605,1001-1290
MIPVITPGFTESNSTYLLNWHTAKIIKNALDDAFKLFHSSKSGNEKLSMLFEQQIKFHEKYSQYFAITCVASDSNMFNEFCGFVVTRIRIQLTRLTDCRRDYVDFCHVLLLNGCPPYTAQKYTKMYAGVPKLILYFAFFPFSSSKIFYKTWLVSVKMKNNTQIQSQKSNVGGQLQFEFDGTKNSKTFRQKQYKQGTDETDNQRDFVNLESEYIGKQIVDDLI

SEQ ID NO: 128480 - protein, 51 aa, Heterodera glycines
  Coding regions on vcDNA: vcDNA=SeqID_54903; Strand=-; Position=1 -19,499-635
MILIVCVTFVIESTHTTERDTKTECGHKARKAAMEAECEQIMRGKSNKKLN

SEQ ID NO: 128481 - protein, 50 aa, Heterodera glycines
  Coding regions on vcDNA: vcDNA=SeqID_54904; Strand=-; Position=1-156
LHRIAEKIRDQFPNVDRLIAKTKAVFVKAPYRVKKFGNVSHMQFQPINLK

SEQ ID NO: 128482 - protein, 58 aa, Heterodera glycines
  Coding regions on vcDNA: vcDNA=SeqID_54905; Strand=+; Position=1-309
FGPRGRLGPNPKIEKCAFLKIKILKTKPEGSLATWHKLGLINIRSFFTILLIPNPIIF

SEQ ID NO: 128483 - protein, 329 aa, Heterodera glycines
  Coding regions on vcDNA: vcDNA=SeqID_54906; Strand=-; Position=1-990
MAINLQDKRGLLNQILGEADITVTTSGLTISGPRLSSPRFVPFDESGRCKSCKGTEVEVDIMVTKEGITIWCTRIARVQFVPFDIIYDLPGHCFFRVKNKARVFNIPYGDLPAVTYPNQEALMEQQQLLQQQQQNDLRQKANTALDLVESGLLADSLREDEVQKAELKRKAKVALDLIDAGLTGDALHEEGQRWKKAKTALSVLGNMLLADSLPEKKTAELPLPPAEKIESLPLPPLEKMKTPPLPPTLPPSSKMESDEQQFYDSISAATTMMDTSMQQAPLKRKQPTPKGKTNGMKKSAEEVQNLGDIDKTLDEFFESVNAATNNLSI

SEQ ID NO: 128484 - protein, 306 aa, Heterodera glycines
  Coding regions on vcDNA: vcDNA=SeqID_54907; Strand=-; Position=1 -183,938-1171,1259-1351,1448-1541,1591-1651,2123-2269,2319-2426
NNHYQTSGEIVFTISKFKAFSEGRGPHYFYSDKVFINGMPWKIAIKHAKKGSLGFSLCIYEDCVQNVLQLAKDFDLSAVEINRCRGQILFKVTEFRSLEINKEVKSEEVSIGGMPWQISIHRNAIDYLFYQVSSRGIYDWNFEAAIEFGTVSATKSDEWLMRRGNLESFNPANGVVYDEKEDAITLKAEIIVKAELKKPIIEFQAEDKLMVNGQVVNVNKYEKLMNDMVHGIPVEEYFPVLIISLKNSKSMKKHRRKIILRKFMSIKVNMHLKFDAELMDELKSTSEKKKVIRKKVTRKGVIEKKK

SEQ ID NO: 128485 - protein, 103 aa, Heterodera glycines
  Coding regions on vcDNA: vcDNA=SeqID_54908; Strand=-; Position=1-312
MGTIIFFFENYKGIKCTIRNFLNNSSNIGTTKVKLYRTVRQKRSGTERTNERVDRVAAERVQCQQGGHNFLCFSTVALALAHWLRSGRKGSGASAFFGHLPPL

SEQ ID NO: 128486 - protein, 44 aa, Heterodera glycines
  Coding regions on vcDNA: vcDNA=SeqID_54909; Strand=-; Position=1 -34,618-718
MAAVPSPAAAVSGGEVVAEPTGDARTPAANSTIQGMAKAKFTKK

SEQ ID NO: 128487 - protein, 191 aa, Heterodera glycines
  Coding regions on vcDNA: vcDNA=SeqID_54910; Strand=+; Position=1 -292,351-526,581-688
  Homolog annotation: Hit_ID=XP_448713.1; Match level="QueryCoverage =68%, HitCoverage=98%, E-value=2e-44, Identity=69%"; Hit description =unnamed protein product [Candida glabrata] emb|CAG61676.1| unnamed protein product [Candida glabrata CBS1
MSDNRGASVASTGTTNSQESQVASPVKAGKATTKTTASGKGGKAKADGKVKAGGKGAKKAGGKGGKVKIAASGSKNTRSARAGVAFPVGRIHRLLRHGRHAQRIGAGAPVYMASVLEYLAAEVLELAGNAARENKKLRITPRHLQLAVRNDEELNKLLAEVTISRGGVLPNIHTELLSKMQQKKQQNDDSQ

SEQ ID NO: 128488 - protein, 124 aa, Heterodera glycines
  Coding regions on vcDNA: vcDNA=SeqID_54911; Strand=-; Position=1 -165,299-508
MQYNAFKPRREAGQFQNFVPHFTVESPSTLLDNYVSMSTVAFGQLWNGKMGISDGLLIMQYNAFKPRREAGQFQNFVPHFTVESPSTLLDNYVSMSTVAFGQLWNGKMGISDGVRSFLKIPLFV

SEQ ID NO: 128489 - protein, 76 aa, Heterodera glycines; identical to SEQ ID NO: 128275
  Coding regions on vcDNA: vcDNA=SeqID_54912; Strand=+; Position=1 -81,222-508

SEQ ID NO: 128490 - protein, 61 aa, Heterodera glycines
  Coding regions on vcDNA: vcDNA=SeqID_54913; Strand=-; Position=1-183
MQEHLPPADASFELRASYNEAKSVADGHVTEKQLLDVPAQMTKEVLAMLEEKQSLRFLSKE

SEQ ID NO: 128491 - protein, 65 aa, Heterodera glycines
  Coding regions on vcDNA: vcDNA=SeqID_54914; Strand=-; Position=1 -72,166-291
MSTQFLIGDVIWVKRGSGVQWPALIKNVSALEVTYVEFPIVSGDLQQKAEIKTVTKFGVSSEIKH

SEQ ID NO: 128492 - protein, 74 aa, Heterodera glycines
  Coding regions on vcDNA: vcDNA=SeqID_54915; Strand=+; Position=1 -85,224-363
MKYAFYYSIIFSAFSNLHVKAFPPKDKEGTSNGKIVNSLADQMKEVLDKGEYSDVHFLVGKDDKKEASQKKQKP

SEQ ID NO: 128493 - protein, 101 aa, Heterodera glycines
  Coding regions on vcDNA: vcDNA=SeqID_54916; Strand=+; Position=1-306
MGLFSFALADCLATFHTFAILFDCETPVPFDEQHKRYVFEHRDKPRLIYVSEDGSAIQVDGVVKQGKFVMSIETMYLDKRNGVDHFCTFLRTFGICFLMCH

SEQ ID NO: 128494 - protein, 60 aa, Heterodera glycines
  Coding regions on vcDNA: vcDNA=SeqID_54917; Strand=+; Position=1-240
LLSVFVQIHPITSYIDLSKVFVCTEFKLKKIAEDGVVVDVSANVAVGLIQMPGATFIRNL

SEQ ID NO: 128495 - protein, 174 aa, Heterodera glycines
  Coding regions on vcDNA: vcDNA=SeqID_54918; Strand=-; Position=1 -46,201-427,477-728
MAPRKQNEQFLDEIQNSDDDVKLVDSQSSHAEERPVLKKRGRKSRWEKLLEDVNNAKKSNPAEVEVADVDERKAAKVFDYPTIFWKLARPKYGVFTFMCNECRNENFKRGDKRFILNTGSGQEKLEFTQTFCQDCAKLNFDCTYLIMKHQKKDDGPSGQKNGGRNTYFRWKSDL

SEQ ID NO: 128496 - protein, 165 aa, Heterodera glycines
  Coding regions on vcDNA: vcDNA=SeqID_54919; Strand=+; Position=1 -385,431-543
MHPLTTALSKLLNCKAENLAEYLNNPEAVNKASAYLRGKKLKTTYSNKGGTTKEVEFGNFSLKSASETYAVEGFLGKCPFCKHSLTLESSEVKVHQYFYIKHRILLLYPQLKCIVEYHSKGHCKYYPLELLAIEDSAEITGEKPTDTNYLDYLGFRSVWQPTPVY

SEQ ID NO: 128497 - protein, 137 aa, Heterodera glycines
  Coding regions on vcDNA: vcDNA=SeqID_54920; Strand=+; Position=1-414
MLKKLPKPFLIVYDDLMGDIDAKKLADLYTKKSHHNNFSVIFLTQNLFDKAMRVPRSNAQYIFLMRAPSDMLSIRNLASQMFPREQGFLMDAYKQACADPYGYLLVTLHANTDNLLRLRTNIFPDDKEKIVFVPKNG

SEQ ID NO: 128498 - protein, 285 aa, Heterodera glycines
  Coding regions on vcDNA: vcDNA=SeqID_54921; Strand=+; Position=1-857
  Homolog annotation: Hit_ID=XP_320617.1; Match level="QueryCoverage =84%, HitCoverage=28%, E-value=2e-39, Identity=38%"; Hit description =ENSANGP00000024791 [Anopheles gambiae]
MKYPGSEPGTPISTTRRTVLSSVASLFDPLGLVCPATLKAKLFFQKLWDDNHEWDTPLSREEAREWEHILASWEGESNVIPRGVTAGRGHPLQLHVFTDASEIAYAAAAYIRTGGESGCSSRLIMAKSRLKPKKAATTFTIPRMELMGILLGVRLAAFIEKQLHHPIAGQHIWSDSMIALHWVRTASAQPQFVANRLFEIRKATATTFHYIRTNENPADLATRGEVPTLLQHNDQWWNGPQWLRGPRTEWPSELEFQPDQEGLPSPAGQEEGQSAFIVRKKHPQA

SEQ ID NO: 128499 - protein, 127 aa, Heterodera glycines
  Coding regions on vcDNA: vcDNA=SeqID_54922; Strand=+; Position=1-384
MPTKILLSNNKVLINYALHKAFAILTNWLCLLRSPCVTEKTVLVFGVFGLVTVVVVGIVLFIFQICCILSPKFEYISNGNGRRFGTPFALGDQFVEQLLPIVVAQRHNHFVNVANKNKMMGGGIPAV

SEQ ID NO: 128500 - protein, 107 aa, Heterodera glycines
  Coding regions on vcDNA: vcDNA=SeqID_54923; Strand=-; Position=1 -63,950-1169,1630-1670
MNVNHWEGLDAGMITFKDGNEVLGAATVEVLRRQPPLDPLYTFFNRDFYYCSDDDDGKWVIREICLNNDDDKCVNYEANYRSEDGQSFIRKDRLGKLEICTFIDFSE

SEQ ID NO: 128501 - protein, 331 aa, Heterodera glycines
  Coding regions on vcDNA: vcDNA=SeqID_54924; Strand=-; Position=1-998
  Homolog annotation: Hit_ID=NP_001004509.1; Match level="QueryCoverage= 99%, HitCoverage=22%, E-value=3e-32, Identity=28%"; Hit description =si:busm1-180o5.3 [Danio rerio] emb|CAD60788.1| novel protein similar to DNA polymerases [Danio rerio]
LEAGYTARKVFHILQYDQWSNNVFKSYVSEMMALKIHATGFPSWCESEEQKSEYIEECWGKFAIKLDKEKMKSEPGKRYIAKLCLNSLWGRFSMRNLLSKAIIDNDESLIHQYTEDKKIELIDLEMMDEDNDVFMLTYKPKEEFVDENKYSNVVISLFTTSMARLYLYEALKKVADTPGCEILYFDTDSIIYVHPEDNDPLPTGKGHLGELTDEKPDHDILEFISAGCKNYGLKLQRKDNGEICFDLKIRGFTLDEQTVQKIHYDTVKEQILRYGSDDPADPIIVTYPHFIRPNLIQGKVFTHSLTKHYQPIFTKGIINDSFQVLEFGYRK

SEQ ID NO: 128502 - protein, 91 aa, Heterodera glycines
  Coding regions on vcDNA: vcDNA=SeqID_54925; Strand=+; Position=1 -162,386-497
  Homolog annotation: Hit_ID=CAE72119.1; Match level="QueryCoverage =89%, HitCoverage=20%, E-value=8e-10, Identity=38%"; Hit description =Hypothetical protein CBG19214 [Caenorhabditis briggsae]
MYFTLKIIKSEKGEGEKGDEELIPIGSPVCKKPRDAGHRCHGRAGGPIAAKNLKWYFDTETFECLAFSYNGCGGNGNHFDSPADCCDKCKL

SEQ ID NO: 128503 - protein, 396 aa, Heterodera glycines
  Coding regions on vcDNA: vcDNA=SeqID_54926; Strand=-; Position=1 -67,117-524,601-810,871-973,1073-1250,1302-1367
  Homolog annotation: Hit_ID=CAH92476.1; Match level="QueryCoverage =97%, HitCoverage=60%, E-value=6e-66, Identity=40%"; Hit description =hypothetical protein [Pongo pygmaeus]
LLLFSRLKINTWKISSANKRFEICSSYPQYLIVPASVSDDEICSSYPQYLIVPASVSDDELKQMRLGRIYYRFPTLVWRCPKNGAVLLRSSQPSIGFFGMSNEYIYPFLYTFNLKQRHASLREDSSGHFKWSLFHFTVSFSIFSDVNMKFLIVDARSYTAAWANRAKGGGFEGADSYANAEVSYANAEVVFMGLANIHNIRYSFYQLRSLMNACGGDPNNYFQSLQSTLWLQYICQLFSATERCLHSLLQEGVSVLVHCSDGWDRTTQIVSVLVHCSDGWDRTTQIVSLCMIIADPFYRTFEGFEMLVQRQWVEFGHKFSDRGGVLNGDDNEKSPVFLQFLDCVYQLWTKNPDQFQFNRRYLMKLVQHTFSGLFMKLVQHTFSGLFGTFIFNSLKE

SEQ ID NO: 128504 - protein, 164 aa, Heterodera glycines
  Coding regions on vcDNA: vcDNA=SeqID_54927; Strand=+; Position=1 -219,564-708,873-1004
YLHQVVVSPAWNEPQYFMAGCLMDNCTTIYQKKGVNVVITRFSWNDHDYLGFRLPHLHEAIKRNRDQIFAEMSKKFKLNGGTADLRSIMALNLRSTFTETVYSKDMWQNFVLVHNRKFFNLACTIPLGIAGVELQGLHAYDNQTELFNSQFFTVANRYKLILML

SEQ ID NO: 128505 - protein, 84 aa, Heterodera glycines
  Coding regions on vcDNA: vcDNA=SeqID_54928; Strand=+; Position=1 -96,1209-1302,1359-1420
  Homolog annotation: Hit_ID=NP_503108.1; Match level="QueryCoverage =82%, HitCoverage=34%, E-value=5e-18, Identity=52%"; Hit description =putative mitochondrial protein family member of bilaterial origin (4S373) [Caenorhabditis elegans] emb|CA
MDSGQRRRVNGPALNGSLELEAIAAVHELASQKVILLMLDHPYTLELTMKGWRVCSTHTDCMNGDYHNVALHTRYFQNAKELLK

SEQ ID NO: 128506 - protein, 89 aa, Heterodera glycines
  Coding regions on vcDNA: vcDNA=SeqID_54929; Strand=+; Position=1 -126,380-523
MFVARSQCCAPVTNSLKISRSFAVPWRQFFDKLKADRINAQVKHKPLDDDHKRYADDEWHWMPTGESDIQNQATVTFLSRTLKKEKLVR

SEQ ID NO: 128507 - protein, 126 aa, Heterodera glycines
  Coding regions on vcDNA: vcDNA=SeqID_54930; Strand=+; Position=1-661
LFEYPKRTLEKIDFFVFGAVPPNRCAQIYGETESFGSSFPIACTLILRWIFAPHNCLSTPNGHLKKSIFFVFGAFPPNRCAQIYGETESFGNSFPIACTLILRWIFAPHNCLSTPNGHLKKSIFLF

SEQ ID NO: 128508 - protein, 119 aa, Heterodera glycines
  Coding regions on vcDNA: vcDNA=SeqID_54931; Strand=+; Position=1 -99,163-423
MAKSEDPAHLERASRMMEVGQSHWKALLKGEELSVRKCRQRPTAKSFSQLSSDSLNTSQFYQLIAKHFCEGFPQQICLEVNYSDEDYLMEGANDYVDTYFDDGDGYDDETNALEEEGTY

SEQ ID NO: 128509 - protein, 268 aa, Heterodera glycines
  Coding regions on vcDNA: vcDNA=SeqID_54932; Strand=-; Position=1 -434,802-928,981-1226
  Homolog annotation: Hit_ID=CAE71741.1; Match level="QueryCoverage =51%, HitCoverage=26%, E-value=2e-26, Identity=41%"; Hit description =Hypothetical protein CBG18725 [Caenorhabditis briggsae]
RVVEIDETLVVKRKYGVGRVLEKQEVWLFGGVERDSNWERVFMVPVESRGAARLLPLIQQYILPGTTIVSDEWRPYRGIPNLPQNYVHWTVNHSQNFVNPANRLAHTQNVESMWKKLKRNFKQQFGNKTETYDTYFPEFGVSVSAFLDEQPMVRTLLSKKTKAHLLLHHFVPFARQHGFLGLLDEQGDEALHSVWRRLEQLWKTMPDSEQMRQQLEHHFVSNWLLDTGRLDELNTNTNNPRGVGSPFSVLTSCCSADAAAARIHSQLP

SEQ ID NO: 128510 - protein, 441 aa, Heterodera glycines
  Coding regions on vcDNA: vcDNA=SeqID_54933; Strand=-; Position=1-1326
  Homolog annotation: Hit_ID=XP_319741.1; Match level="QueryCoverage =81%, HitCoverage=78%, E-value=3e-38, Identity=28%"; Hit description =ENSANGP00000006515 [Anopheles gambiae]
MSADQIKQLLEAMRVQSDAIQLLMGQAPQNATSLNHANLASSIDGRISKFNYDAETGNTFEQWFKRFGVLIEEDGKDLPESTKVRLLLGKLGDEEYGKYRDSISPTQPDKVNWVDSITKLKGLYAETRSLFVRRYECFKIRQQPSQDISSLVAHINASCENANLSPTKEQLKCIILVIALNDEHHDLRQKCLKMLEDAEKTGTDITLQKVEEELKAIQIVKESALSLLTQPVSTSAIQLRPQQWRETSKGKHKAKPGPKWPHHEPAPKSPHHAPSPKQKSDDKANRGHPSHPCASCGSNDHWRSDCKFANAFCNKCNRQGHIAIVCRQRSSNTAHKFQNRSFHTVVAKSQCMVIGTTQGRWWKIPVTINGTNLKMNGDSGAQATVISFKTWIKLGQPKLSPTHRNPQLQWHRIFNRRKISLHRQLLRSAIQNTDRLRQPVT

SEQ ID NO: 128511 - protein, 24 aa, Heterodera glycines
  Coding regions on vcDNA: vcDNA=SeqID_54934; Strand=-; Position=1 -16,335-393
MKYNQEIALIVITCAVTFTIVGAP

SEQ ID NO: 128512 - protein, 125 aa, Heterodera glycines
  Coding regions on vcDNA: vcDNA=SeqID_54935; Strand=+; Position=1 -123,164-319,363-461
MHRDGVKARHAGNGGEISIFGDKKLKIDCIIGAQKRIIEFQGCAFHGCNTCYKGYMIQANGFTAEQNYDRTQRKMEKLRIAGKKMRYTVEEVWECDVRKMFYKKSAFYDTQMVKFFNTLLVNRTY

SEQ ID NO: 128513 - protein, 115 aa, Heterodera glycines
  Coding regions on vcDNA: vcDNA=SeqID_54936; Strand=+; Position=1 -49,91-268,311-379,424-475
MSKEYADSEILEVVCAGPKQYALKLKNKNGELWYKTKIRGMTQNKNNKIDYEEFKDMVLNYQEEKKILFKHPNKFGPTREGYVISRNVTKDYRPIQKKGIILNDENLSVLPFGCW

SEQ ID NO: 128514 - protein, 152 aa, Heterodera glycines
  Coding regions on vcDNA: vcDNA=SeqID_54937; Strand=-; Position=1 -90,348-438,492-626,675-817
  Homolog annotation: Hit_ID=CAF92976.1; Match level="QueryCoverage =88%, HitCoverage=26%, E-value=4e-12, Identity=34%"; Hit description =unnamed protein product [Tetraodon nigroviridis]
MSSNLLGRFKLMLSTGDGADVHFLVGKEKELLKAHKCVMMFASDVFGSMFRFDDKNAKTKTSADCPHVIEVTDVEAEAFKVMLSFIYAEDLSELNGQNAMAVLYAANKYNVSLLVKALLAFPINELSNVFLAFDEARLLNENVQIEIYTKYF

SEQ ID NO: 128515 - protein, 97 aa, Heterodera glycines
  Coding regions on vcDNA: vcDNA=SeqID_54938; Strand=+; Position=1 -46,127-374
MAIKIAEYGNYNNKREVDLDFNDVKCELKGLNDLITLLLLNTTNHGSSHHNDGKQDWASSWRARASGTPGAAVAEFAAAIGAVPYNRPAPGVSARWC

SEQ ID NO: 128516 - protein, 295 aa, Heterodera glycines
  Coding regions on vcDNA: vcDNA=SeqID_54939; Strand=-; Position=1 -372,500-765,963-1211
MLTHHRNDHQNSGQQHSVDESEEERETDALPQQQWHIERDAKIAFVALAQLHRRTTASCAGTTTAGGASAVSIITRSEQSAFSNFVKQQQTPQQHNHQHRHVQQQSSLVQQQHQAASVRQQQRQPGMVLLATHQQVPSSSTAVISSSVPSASSSSVAAATVVVHQQQMPHSNVPAIGGGGGGGILMNNNTSYCWSNNKFSNDNNNLTNNTNSRTFAQLQHHHQQHLSSSSSVGGATTPLFLHHQHQRALTPGAGLLYGTAPMAAANSATAAPGVPEARARQLLAQSCLPSLWCEE

SEQ ID NO: 128517 - protein, 20 aa, Heterodera glycines
  Coding regions on vcDNA: vcDNA=SeqID_54940; Strand=+; Position=1 -13,363-412
MASFELMHHESLDSCSAKII

SEQ ID NO: 128518 - protein, 122 aa, Heterodera glycines
  Coding regions on vcDNA: vcDNA=SeqID_54941; Strand=-; Position=1 -54,275-434,676-830
  Homolog annotation: Hit_ID=CAE66717.1; Match level="QueryCoverage =92%, HitCoverage=44%, E-value=1e-31, Identity=61%"; Hit description =Hypothetical protein CBG12063 [Caenorhabditis briggsae]
IAELDSYMYQSVGSEGIKFYADALGLPLFQRKISGRPKCVESNTYVQDEEDEVEDLYHLLKTVKEWDPEIRGVSAGAINSTYQKLRVEHVCERLGLVPLCFLWELDQLQLLDAMVSEWCCTK

SEQ ID NO: 128519 - protein, 100 aa, Heterodera glycines
  Coding regions on vcDNA: vcDNA=SeqID_54942; Strand=-; Position=1 -63,362-507,772-864
  Homolog annotation: Hit_ID=NP_502084.1; Match level="QueryCoverage =91%, HitCoverage=7%, E-value=4e-32, Identity=71%"; Hit description =DEAD/DEAH box helicase and helicase, C-terminal (4L900) [Caenorhabditis elegans] emb|CAA92767.1| Hypotheti
MLDVNKKVPEFDALRDNMAKQYPFELDPFQQQAIVRMEQGASVFVAAHTSAGKTVVAEYAVALCKLHRTRVIYTSPIKALSNQKFRDFRLHFGDVGLVTG

SEQ ID NO: 128520 - protein, 19 aa, Heterodera glycines
  Coding regions on vcDNA: vcDNA=SeqID_54943; Strand=+; Position=1-60
SPGTAASDASAHVAVHLTV

SEQ ID NO: 128521 - protein, 229 aa, Heterodera glycines
  Coding regions on vcDNA: vcDNA=SeqID_54944; Strand=-; Position=1 -56,582-828,1194-1218,1273-1380,1462-1620,1996-2020
  Homolog annotation: Hit_ID=NP_498847.1; Match level="QueryCoverage =98%, HitCoverage=27%, E-value=1e-40, Identity=41%"; Hit description =lmbr1 (83.5 kD) (3J463) [Caenorhabditis elegans] gb|AAK21441.1| Hypothetical protein R05D3.2 [Caenorhabdi
GFLIGPRRVKFSKKGLFCGGFKCYFCIFRVWICCCSLSVSIGAVTLLPFSVLGSEVLERYPDNFYLKWLNASLINSLWNYVFMLSNVSLFALLPFSYFFIESQGFSTAALRRPLIARFYETVVRRPLIARFYETVVVCALVIIVLVGIADMFYSHLFLPLSLLSLSLSLLSLLSLSLSLSTPLLYSFASLFGVSLLLLSVPLGFAKLFDLFSEMLITQKTTTIAATNDH

SEQ ID NO: 128522 - protein, 43 aa, Heterodera glycines
  Coding regions on vcDNA: vcDNA=SeqID_54945; Strand=-; Position=1-181
LTDYELIGVTFFTMENRHLGIDTHTQSFFLAIFCHNIVCVGKI

SEQ ID NO: 128523 - protein, 121 aa, Heterodera glycines
  Coding regions on vcDNA: vcDNA=SeqID_54946; Strand=-; Position=1-363
QKQLRSAQACAWAAKETEQVVMTQRWPGIRASRTWEEPSRRWTQLRGQCTGTHTSTPDFPVRTLPQAKGLRALMSRVFSNASTLVPRQGVPIHELIGLVNHGNTPLTRIPTPPPTLGSASP

SEQ ID NO: 128524 - protein, 17 aa, Heterodera glycines
  Coding regions on vcDNA: vcDNA=SeqID_54947; Strand=-; Position=1-66
HKHLFDLFYHIQNLIKI

SEQ ID NO: 128525 - protein, 32 aa, Heterodera glycines
  Coding regions on vcDNA: vcDNA=SeqID_54948; Strand=-; Position=1-97
MKSWFLVLVLLLAFCLVVRLVICLVKCINCCC

SEQ ID NO: 128526 - protein, 62 aa, Heterodera glycines
  Coding regions on vcDNA: vcDNA=SeqID_54949; Strand=-; Position=1 -70,190-308
MPSSPMPFSLFVVLFLFVPFLPGCGEPSVAHYFECCGDNGAGRHTKLAHDKCFVALFGFFVP

SEQ ID NO: 128527 - protein, 52 aa, Heterodera glycines
  Coding regions on vcDNA: vcDNA=SeqID_54950; Strand=+; Position=1 -41,205-322
MHSVVHIHQLCPNRNLGLEGTWSPINKKHYEGTKLMVRQFLLFVFRVLISAL

SEQ ID NO: 128528 - protein, 121 aa, Heterodera glycines
  Coding regions on vcDNA: vcDNA=SeqID_54951; Strand=-; Position=1 -233,754-785,945-1045
MTRTKTLKKILRKNAVINEYLFLCQIFVPIFGTLALFDGCITGASKNCTANVKIDYDEIFQLSKCFWGERRRTAFKGTIQIKASVDGYEPKFGLGKCTHFLKSDQDGSAESLLILLCGYMD

SEQ ID NO: 128529 - protein, 22 aa, Heterodera glycines
  Coding regions on vcDNA: vcDNA=SeqID_54952; Strand=-; Position=1 -55,437-450
MPSCGNKYYDHVKHCAMVCPFL

SEQ ID NO: 128530 - protein, 30 aa, Heterodera glycines
  Coding regions on vcDNA: vcDNA=SeqID_54953; Strand=+; Position=1-92
MLDQRMIRVIANDQRRRVIDHRERVIANVI

SEQ ID NO: 128531 - protein, 70 aa, Heterodera glycines
  Coding regions on vcDNA: vcDNA=SeqID_54954; Strand=-; Position=1-213
MRAFVSHCGFNSVNEAVQFGVPILAIPLLADQLYNAIMARVKGIAVQLDVGQLNGDGAEQLLVDGLDKAN

SEQ ID NO: 128532 - protein, 143 aa, Heterodera glycines
  Coding regions on vcDNA: vcDNA=SeqID_54955; Strand=+; Position=1 -79,474-617,1255-1461
  Homolog annotation: Hit_ID=NP_506478.1; Match level="QueryCoverage =97%, HitCoverage=24%, E-value=6e-32, Identity=51%"; Hit description =RNA helicase (5O490) [Caenorhabditis elegans] emb|CAB04518.1| Hypothetical protein F58E10.3 [Caenorhabdit
MADNEVKLSGHSLTGPVTSFQESTFPAPIVAQLSSVFSAPTAIQAISWPVALAGKDLISIAKTGSGKTLGFTLPAIVHVLNNQRPQQQRRPGEGPAVVVLLPTRELAQQVETVAREYGQLMRLNVVACYGGASKWPQMGALKR

SEQ ID NO: 128533 - protein, 75 aa, Heterodera glycines
  Coding regions on vcDNA: vcDNA=SeqID_54956; Strand=+; Position=1 -166,432-493
MAMVGGTVCPRGRHLWRWWQQILLYGINHWAAACADRGTLLHVFQRRTARKYARRAKNFEKLVPGVFFGHNFVQT

SEQ ID NO: 128534 - protein, 139 aa, Heterodera glycines
  Coding regions on vcDNA: vcDNA=SeqID_54957; Strand=-; Position=1 -102,368-685
  Homolog annotation: Hit_ID=NP_500613.1; Match level="QueryCoverage =72%, HitCoverage=22%, E-value=3e-14, Identity=35%"; Hit description =putative membrane protein, with a coiled coil domain (61.9 kD) (4F445) [Caenorhabditis elegans] gb|AAB941
MPDLLVSIEQFWLSDYWKALKPTELLLFYLFPVTSKEQVAKQKSGIWLCRASLLIDMSESAEEYPTEEETSPEVLFEHDVFVGAEKVQLYYEITVQRENQLKMSTGPREMPKREKGGDNPQNVILANPIPKMAFRQSEI

SEQ ID NO: 128535 - protein, 38 aa, Heterodera glycines
  Coding regions on vcDNA: vcDNA=SeqID_54958; Strand=-; Position=1 -100,271-287
MVIKSATTVIRRSTTVIRRGTPVIRRGTSVTKRELGLF

SEQ ID NO: 128536 - protein, 74 aa, Heterodera glycines
  Coding regions on vcDNA: vcDNA=SeqID_54959; Strand=-; Position=1 -50,99-273
MLFTGIDRLIVLIFGEIQNKRKIRLYLTTIIFICSIFCIDLCYTFYQNIELYGDQMITGNYIDFFMVFQNNLLS

SEQ ID NO: 128537 - protein, 54 aa, Heterodera glycines
  Coding regions on vcDNA: vcDNA=SeqID_54960; Strand=-; Position=1 -33,84-215
MAKLDNYDNDTFYLAFKDAHPSWSLIGCAAIFGITASFGILFHLSVIFVTIKTK

SEQ ID NO: 128538 - protein, 33 aa, Heterodera glycines
  Coding regions on vcDNA: vcDNA=SeqID_54961; Strand=-; Position=1-131
KRSSDLMYYFIKCKFFFFIHSFVSFFSHNHYMI

SEQ ID NO: 128539 - protein, 167 aa, Heterodera glycines
  Coding regions on vcDNA: vcDNA=SeqID_54962; Strand=-; Position=1 -70,768-1020,1311-1491
MRQTLAFFLHLFVFVAYLANGGFVFTQCFSFKKLIYKSNSTGLKCKQGQESQPISRNFIMANSSCPDKEAKYCVAATCTIGLRGQNDTVFCNCHLKRMATVSLQLGHRFGAIMWFCHQIKNVEQCEERSKKYGLSCKCHFGEEGQDHGNEQFTLPPPIPIDQNEKGI

SEQ ID NO: 128540 - protein, 42 aa, Heterodera glycines
  Coding regions on vcDNA: vcDNA=SeqID_54963; Strand=-; Position=1 -64,128-192
MLRNQMLRLIFEEENYSQCFIVAINLHFSAFSLMGYHKWRKV

SEQ ID NO: 128541 - protein, 85 aa, Heterodera glycines
  Coding regions on vcDNA: vcDNA=SeqID_54964; Strand=+; Position=1 -154,427-530
MSEEMRQRFKNVLCKCQIGEPYKDMTNDMPKMTLPPPKPTSPPTPTTTEPPIDGLFTDRLSTDGLSGEPAGPGMSVLCRYIKTIK

SEQ ID NO: 128542 - protein, 37 aa, Heterodera glycines
  Coding regions on vcDNA: vcDNA=SeqID_54965; Strand=+; Position=1 -43,649-719
MRGGASYEIHTNERVAFGTIGRLTAVPISFCFTMLIG

SEQ ID NO: 128543 - protein, 34 aa, Heterodera glycines
  Coding regions on vcDNA: vcDNA=SeqID_54966; Strand=+; Position=1 -32,76-148
MTELFEEACPSYPLKPREFMTELLKEEYRKNSIL

SEQ ID NO: 128544 - protein, 117 aa, Heterodera glycines
  Coding regions on vcDNA: vcDNA=SeqID_54967; Strand=-; Position=1 -99,257-445,613-678
MQNKRKINGNIQVVKYLKNNLNMKHLFKKQFEQRKLEKTGRTRCAVNRRWNNNKQFSEAMDLEKNQHSNGTCRDSVHESGHIICYWFLQYAGEFTSNLKIVIIIFLQEIFFAKSTLY

SEQ ID NO: 128545 - protein, 18 aa, Heterodera glycines
  Coding regions on vcDNA: vcDNA=SeqID_54968; Strand=-; Position=1-57
YREAIPEGFGLPINLGAF

SEQ ID NO: 128546 - protein, 150 aa, Heterodera glycines
  Coding regions on vcDNA: vcDNA=SeqID_54969; Strand=-; Position=1-661
LFEYPKRTLEKIDFFVFGAVPPNRCAQIYGETESFRNSFPIACTLILRWIFAPHNCLSTPNGHLKKSIFFVFGAVPPNRCAQIYGETESFGNSFPIACTLILRWIFAPHNCLSTPNGHLKKSIFLFSGQSPRTDAPRFMGRPNPSGVASL

SEQ ID NO: 128547 - protein, 43 aa, Heterodera glycines
  Coding regions on vcDNA: vcDNA=SeqID_54970; Strand=+; Position=1 -43,838-926
MNMRKDVKRTITLIAFFGVDGAGPDGLLQTPSAAHVSPPTRPN

SEQ ID NO: 128548 - protein, 103 aa, Heterodera glycines
  Coding regions on vcDNA: vcDNA=SeqID_54971; Strand=+; Position=1 -133,203-381
MQNEKHSRKEWKESNAKIKQMFGIYYRTIEKWDKKIGLNQILSKGQKHYTFAEKTEKIKQYYQLKNQNPKLNDRQIAEILNITKRSLERYKSEFKRKSEGVTD

SEQ ID NO: 128549 - protein, 187 aa, Heterodera glycines
  Coding regions on vcDNA: vcDNA=SeqID_54972; Strand=+; Position=1-562
MKILLIFLLLCALIFKKAINQIEAGKIIQEKSFAEIFGQRWDDGAEENICQNDQIIHGEIADQNNQFGQNVRQFDQIFDKNVEVKEEESEEMSTDYDELGDQLPMPTNNGQIYDQIRILNDKQKREIVEKFHKIKEKVKQMGKKYSTKEWKKIERKITKKLGVSQKKIYKWKREFGLIKNRYSDEER

SEQ ID NO: 128550 - protein, 67 aa, Heterodera glycines
  Coding regions on vcDNA: vcDNA=SeqID_54973; Strand=+; Position=1 -93,370-480
MALEPIKLTHLSVLNAHLILLREFTRMNVYKIIVDLVHGPGADKAYTFITVKCTFNSFEGIYAYECL

SEQ ID NO: 128551 - protein, 30 aa, Heterodera glycines
  Coding regions on vcDNA: vcDNA=SeqID_54974; Strand=+; Position=1-95
LGDHLKAILERIGEMEKQQQQQTKGEEKLK

SEQ ID NO: 128552 - protein, 123 aa, Heterodera glycines
  Coding regions on vcDNA: vcDNA=SeqID_54975; Strand=+; Position=1 -14,72-295,414-547
  Homolog annotation: Hit_ID=CAC21848.1; Match level="QueryCoverage =85%, HitCoverage=50%, E-value=3e-09, Identity=37%"; Hit description =hypothetical protein [Globodera rostochiensis]
MKEIGWGIFGFAVKQQTKLDGSIRCEKGIYAYESDGDIRINGKGKGTNAEYSYGVGDTVGMGVHLASRQLFFIKNGLRLDNSDFFVDPSFADGSFHPFVSLRAFGDKIEANFGPNFKFDLATL

SEQ ID NO: 128553 - protein, 174 aa, Heterodera glycines
  Coding regions on vcDNA: vcDNA=SeqID_54976; Strand=-; Position=1 -133,378-524,579-614,662-713,786-814,1115-1153,1434-1453,1503-1571
MAIGNGYHNISLEQDTRIRYNYAHGMVDELDWQRIKTDQCSGNIDGGPDEEGRQLDQLIAKQRAAKWPQAPPPKFEFLSEESDVQLSELKCENVYDMRSYLNKAEVREALHVSPNAHQWAECGGIHNYKTQYEGVEFHVKKVLKAVRGAGHMVPQKKGFELLHVIEAFMEGKII

SEQ ID NO: 128554 - protein, 160 aa, Heterodera glycines
  Coding regions on vcDNA: vcDNA=SeqID_54977; Strand=-; Position=1 -161,250-344,412-638
MAKNVHKNSTMIWRGLKLRTVPMQKDQNIGSIIIFESSIASQKQLNVFNYFKQKYNLSAGQRNFSVLFASNQIAEPFTRFSLEENDFDGRAIQNDFLRSNGPSFLSDYADLWLLGLDMLPMAHQTEQREQLKMELFISRSSKCFMEAWVEKQLDQKGPVF

SEQ ID NO: 128555 - protein, 58 aa, Heterodera glycines
  Coding regions on vcDNA: vcDNA=SeqID_54978; Strand=+; Position=1 -60,112-225
SSKIFALFRPVIPKFFQFCECLNLIYEQQNSSLIHSVYGPSVLEMGSSERLMLVCEFG

SEQ ID NO: 128556 - protein, 116 aa, Heterodera glycines; identical to SEQ ID NO: 127487
  Coding regions on vcDNA: vcDNA=SeqID_54979; Strand=+; Position=1-351

SEQ ID NO: 128557 - protein, 87 aa, Heterodera glycines
  Coding regions on vcDNA: vcDNA=SeqID_54980; Strand=-; Position=1 -72,124-251,416-478
  Homolog annotation: Hit_ID=NP_766028.1; Match level="QueryCoverage =88%, HitCoverage=7%, E-value=4e-18, Identity=57%"; Hit description =syntaxin binding protein 5-like [Mus musculus] dbj|BAC28964.1| unnamed protein product [Mus musculus]
MPMDEGALPSVTVMRAKGSLTVLEMDHPIVSMLPLHASPYASAAQHPHAMAVLLRNDLLVVDMQAQGYPCFEVPHPMDLHESPVTMI

SEQ ID NO: 128558 - protein, 42 aa, Heterodera glycines
  Coding regions on vcDNA: vcDNA=SeqID_54981; Strand=+; Position=1-126
MVNCCIGRVREGSQRVRTASNISFILGVILPHCTSFFGLITQ

SEQ ID NO: 128559 - protein, 80 aa, Heterodera glycines
  Coding regions on vcDNA: vcDNA=SeqID_54982; Strand=+; Position=1 -16,297-523
MCRAVDGLCANSGDCPNKFLCATFADSKLSANSSKTGYCIPGIIIGKIVKNNGNFQPDCSPAPQGAQKCSGLNGIYYVDN

SEQ ID NO: 128560 - protein, 235 aa, Heterodera glycines
  Coding regions on vcDNA: vcDNA=SeqID_54983; Strand=+; Position=1 -635,999-1071
MSASPAPPNVPDLSEFPPLEKLTLEDVRKKNKIASASPSGNSNISKETCSSAISVDLVASASQITWGGEKGNSGQEKGEKNQKLNKNVASASPRDYEKFANQGFDKNPDEMAEEMMEEFSSFNVRENEEKIVEYLVCQVEENIVIGGKLRTMANNGWPHFVAISNEVAEKAREFKKKLQMGDIVGVKKFEWKNDYRYLAKRETDKSHFNKMCCLSQIDPPFFSRGPLGFKPNEFV

SEQ ID NO: 128561 - protein, 225 aa, Heterodera glycines
  Coding regions on vcDNA: vcDNA=SeqID_54984; Strand=+; Position=1 -141,183-242,300-476,1031-1054,1354-1509,1896-2015
  Homolog annotation: Hit_ID=NP_500975.1; Match level="QueryCoverage =79%, HitCoverage=58%, E-value=4e-34, Identity=67%"; Hit description =kv4.3 potassium channel (4H148) [Caenorhabditis elegans] gb|AAK68591.1| Hypothetical protein Y73B6BL.19 [
MHEKAEQTAKSHQSNSAASSQCLSKFGIGYLAKKEGFPILAIICTAKAKELVVDHVGDVRLVINVSGRRFETWKYTLERFPETLLGSSEKEFFYDESAGEYFFDRDPELFRHILAFYRTGKLHYPKQKLWTAFEFFVLDTACVIIFTVEYMLRLFAAPDRCKFVRSIMSLIDVIAILPYYIGLGLQVTETKFTSIPAAFWYTIVTLTTLGYGDFVPHTVHAEFVH

SEQ ID NO: 128562 - protein, 238 aa, Heterodera glycines
  Coding regions on vcDNA: vcDNA=SeqID_54985; Strand=+; Position=1 -214,601-1103
MNMYQQHHHHHVNQLKYTDINKQSNQLYSCTTATTSVTTPHCNGDDDDDDNGDVEEGIGIPMRQSKGNFRNANSSPSPPVRIVVSEENDEYEPTQQQKGNGQDEAGEGHQHYHQQQWHGHDENDGDELLGDEAADNERRKSSTEEDEGEEMEDKTEEERTRRRKGRRDSSNDNGTTEMPGTESVGKSSRSRSSTSARDNRCSPTAAAGRRRRKRRGWAQKRGKAQAEEEEEEECMSTL

SEQ ID NO: 128563 - protein, 152 aa, Heterodera glycines
  Coding regions on vcDNA: vcDNA=SeqID_54986; Strand=+; Position=1 -156,480-782
MDQFLATKCKFEKEKIMSKMNEKIREEKYGQIIGQLKQLRLSELQFGRQKENREIRPSELNKELAKLNEPKDNLIVMEKLFDLAWFLCAKLKHDEKRYELARSKTIWRMIDWNYYEELEWKLCKTRELIRKILVKEFQVPKSIHSAINRLID

SEQ ID NO: 128564 - protein, 144 aa, Heterodera glycines
  Coding regions on vcDNA: vcDNA=SeqID_54987; Strand=-; Position=1 -203,1434-1665
MLFRSARSVGQHCAAGGGAIGAEGGRQAVRQGHAAIARRGQLRGGRAVPSFGHRLFLLQRALLRNGKACLFLEPSACQWPMLSAVGRWRTVRQRFAVPRTAGRSGTDLPERRVQPNRPKLGADGGAAGIPSALLIENNKCIFNL

SEQ ID NO: 128565 - protein, 33 aa, Heterodera glycines
  Coding regions on vcDNA: vcDNA=SeqID_54988; Strand=+; Position=1-101
MRRNNALLFLLYGVGLSALLVELVDAYLYGGNI

SEQ ID NO: 128566 - protein, 102 aa, Heterodera glycines
  Coding regions on vcDNA: vcDNA=SeqID_54989; Strand=-; Position=1-309
MHTLMVPFQEKFSRLCSLEHAHHEHMERIRALNADGEWKLNMEMREPGQKLARRIQEFDTVLLTAMKKMDPNPVAIYLVGDDGLESNLCQCFSNKNTRRATL

SEQ ID NO: 128567 - protein, 75 aa, Heterodera glycines
  Coding regions on vcDNA: vcDNA=SeqID_54990; Strand=-; Position=1 -128,326-425
MYKKQAPFTGKFDKHFVAGGKYTCVCCGAALFVSEQKFNSGCGAKCDAHLGHVFGEFYYYEIVNYPLNICKFIKT

SEQ ID NO: 128568 - protein, 62 aa, Heterodera glycines
  Coding regions on vcDNA: vcDNA=SeqID_54991; Strand=-; Position=1 -28,72-262
FSGNKYRKIVTRNLCQSKLCTQKTKEEMGQAELVIIIINQYGQSLVANSVGQPRSLRVADVP

SEQ ID NO: 128569 - protein, 254 aa, Heterodera glycines
  Coding regions on vcDNA: vcDNA=SeqID_54992; Strand=-; Position=1 -5,111-270,313-560,611-779,824-1006
MIDIKLTIVIADAVRNVNGKSVWTLVGSDGYDFINITMWGSNYEKMAREFGQEFKQKTYVFNTWGVQKVIPNFNYGNVDYELIAKEGSTITLITAEQYQILSIKTTNYFTFLREKFALDNDGFFPTPIKKMRAGEQFVEIECELFELKPVRTVMAKGNEARVIDAMINEGNNKTQLTAWNILADFLEYILQDKKGYVLKLQGLLTKKGFPVQNISFVFTNTSRIGFAEKQRPEKIPLKLAELTEGLCECNFKKF

SEQ ID NO: 128570 - protein, 126 aa, Heterodera glycines
  Coding regions on vcDNA: vcDNA=SeqID_54993; Strand=-; Position=1 -98,141-216,279-377,503-610
  Homolog annotation: Hit_ID=NP_446020.1; Match level="QueryCoverage =92%, HitCoverage=80%, E-value=1e-42, Identity=50%"; Hit description =phosphate cytidylyltransferase 2, ethanolamine [Rattus norvegicus] gb|AAC28864.1| CTP:phosphoethanolamine
MVKSTANANGTTEFGGPKEQVVKHNYRVWCDGCYDMVHFGHANQLRQAKQMGAYLVVGVHNDEEIGKHKGPPVFNEKERYRMVRGIKWVDEIVEAAPYVTTLKTLDENNCDFCVHGGIYLFFVKIP

SEQ ID NO: 128571 - protein, 39 aa, Heterodera glycines
  Coding regions on vcDNA: vcDNA=SeqID_54994; Strand=+; Position=1 -104,905-920
MRTRPIWQVKQRLMTTQKVRCRDETNQHCLPRGTRIFIK

SEQ ID NO: 128572 - protein, 287 aa, Heterodera glycines
  Coding regions on vcDNA: vcDNA=SeqID_54995; Strand=-; Position=1 -303,598-1020,1435-1572
  Homolog annotation: Hit_ID=CAF98474.1; Match level="QueryCoverage =74%, HitCoverage=44%, E-value=6e-12, Identity=27%"; Hit description =unnamed protein product [Tetraodon nigroviridis]
MPIFRAIRSASRSRSVDTNSRTGSPASPRRARSGSANSRRSSSAGRSRSAGSRRRSRSSSSQSVATNSSLGGGAGAGDDRSSLEREKSLDYSDIVTTVAQRRKEQKQRELSHSPTPPPLKKSKKAVLKRLKKGKKDKDRHRDHQQHRCSSKKKVKQYGKQQQQLKPKQHQPQQQNMTSPHSSSGSSPEARHRHRTEESDVEMASDEEEQQQQTEHEQQQEMNTKSSSKTKQKHQQIAVGGKKSSFVNRFLPAGAGAGTVTGGTPSIDGSSVKTTVTSAELRRRHNCA

SEQ ID NO: 128573 - protein, 20 aa, Heterodera glycines
  Coding regions on vcDNA: vcDNA=SeqID_54996; Strand=-; Position=1-60
GLLGSWVRAPPGELPFMFYK

SEQ ID NO: 128574 - protein, 134 aa, Heterodera glycines
  Coding regions on vcDNA: vcDNA=SeqID_54997; Strand=-; Position=1 -249,365-519
  Homolog annotation: Hit_ID=CAE69143.1; Match level="QueryCoverage =94%, HitCoverage=12%, E-value=3e-09, Identity=32%"; Hit description =Hypothetical protein CBG15173 [Caenorhabditis briggsae]
MSNQEWTASHVVQFKVQKLAFVSPCENYALFEMIKKGQLERRIGANESLKSIVLGRWMTDGVEEQQKDNFLLLKKDPHPFQPQSGRAFAEDLKLAEPGSRTFKTASLRIEDGVHVCHYSRGMKRQCQWKVDEVL

SEQ ID NO: 128575 - protein, 20 aa, Heterodera glycines
  Coding regions on vcDNA: vcDNA=SeqID_54998; Strand=-; Position=1-61
AEVQSKGEQNEEGDRRLLCQ

SEQ ID NO: 128576 - protein, 170 aa, Heterodera glycines
  Coding regions on vcDNA: vcDNA=SeqID_54999; Strand=-; Position=1-513
MPMPNSNDGPYESERKGIKNIGIAIICTKLSQPKADNEADLHRQMFITDVILRNSELLCTSIAKFDSFLLRLRKFGPKLAALSDLISSTSSNDTSTSPDDPHQLLQFRAKELLDLFPIVLEMYEQELSFKRDSVVDLAVFDDKDLFTAIISAWKHGIYIEPAIVSLLYPF

SEQ ID NO: 128577 - protein, 93 aa, Heterodera glycines
  Coding regions on vcDNA: vcDNA=SeqID_55000; Strand=+; Position=1 -53,949-1177
MKDRRTTEKRNGANGKEGTACFGFAIKNTRNLAGSFFSEATAYAYGSKGKFYVDGTKTFANPTNAFATGHTVGCGVLANRELFFTRNGLCLGW

SEQ ID NO: 128578 - protein, 19 aa, Heterodera glycines
  Coding regions on vcDNA: vcDNA=SeqID_55001; Strand=+; Position=1-59
TIENFLESNMENLKMLVHI

SEQ ID NO: 128579 - protein, 84 aa, Heterodera glycines
  Coding regions on vcDNA: vcDNA=SeqID_55002; Strand=-; Position=1 -38,616-832
MTWTQEKSRPGSSLCSVSATHKQIPLNIFRCSSRSKRYFIRVAKSNTNSGPKFASISSPDSSKVTNGKRNAQSADREIENAVES

SEQ ID NO: 128580 - protein, 349 aa, Heterodera glycines
  misc_feature (5)..(5): Xaa can be any naturally occurring amino acid
  Coding regions on vcDNA: vcDNA=SeqID_55003; Strand=-; Position=1 -96,138-277,969-1056,1209-1279,1329-1441,1503-1637,1811-1908,1999-2186
  Homolog annotation: Hit_ID=CAE70655.1; Match level="QueryCoverage =93%, HitCoverage=28%, E-value=1e-97, Identity=59%"; Hit description =Hypothetical protein CBG17362 [Caenorhabditis briggsae]
SFNTXGLYFLHTSLIKYHGFLCLQNCLVDSNWNVKLTNFVTEQIIGDKLRHNELDSNWNVKLTNFVTEQIIGDKLRHNELKYMTESRLKSHKKAKKVVKDDEKKKYIQQAPEIIREFISTKHLPPGSPASDMYSLGMVLYQILFKLEPFYERNMQPKKIMERIIMERIALANEDDQIIRPTFPKQQVSAIEEAYNFQLLSALEACWLEALEACWLEIPEMRPNIKRMKTMVNSNLKSTGSGSLVDQMMKMMEDYTTNLEQLVKERTQLLEEAQQQADRLLKNMLPQSISIAEDLKAGRPVLPQYYSNSTVLFSDIRGFTRIASTSTPIQVRHFERSKRFGKMSIKFDPL

SEQ ID NO: 128581 - protein, 190 aa, Heterodera glycines
  Coding regions on vcDNA: vcDNA=SeqID_55004; Strand=-; Position=1 -114,377-517,777-942,1138-1287
MPRASADRRPDAPRGGRAGAPDACQGGASGPTAAASAPDEQRAKIVDELGAQNAAELDQVQTEANNAQMRLTEMLKKAAETHRKLEDERNQLFEKHKLLEDNLEAYKRRFVAQLQRAMDTRCSQMGKGLRNAFADIVGQMDTDTAASTTARPLPLSDQFANDDDCSVLIGFDSSSPRRGNGSADLFNSSA

SEQ ID NO: 128582 - protein, 68 aa, Heterodera glycines
  Coding regions on vcDNA: vcDNA=SeqID_55005; Strand=+; Position=1 -135,200-229,463-502
MLSSATDQILRRHLLPVKPESEMSPEERAEKKKAEIEAEFARYKLARKLRVKQQQESGGAGDEAAAAQ

SEQ ID NO: 128583 - protein, 116 aa, Heterodera glycines
  Coding regions on vcDNA: vcDNA=SeqID_55006; Strand=+; Position=1 -273,526-603
MSSFSWICNDIWMDILPFFCRPQLGLELALISPHFDVLVDTHFDCQSELKIWRSFKIYKRQQFVYEGIHTSTRKRKMIDVEGAPHLLVTILVGRHNKQFPCHEMPNKIRFCFLQIK

SEQ ID NO: 128584 - protein, 39 aa, Heterodera glycines
  Coding regions on vcDNA: vcDNA=SeqID_55007; Strand=-; Position=1-119
MGKNATQIRSGVPFVVSAFASDALAKSAQCHQCPRPNRC

SEQ ID NO: 128585 - protein, 51 aa, Heterodera glycines
  Coding regions on vcDNA: vcDNA=SeqID_55008; Strand=+; Position=1 -92,148-211
MPRSTEQHPKHCSVHRRFGDRCAVGSASFKKPNGAFFQFPWRFASFYYERL

SEQ ID NO: 128586 - protein, 48 aa, Heterodera glycines
  Coding regions on vcDNA: vcDNA=SeqID_55009; Strand=-; Position=1 -42,348-452
MSILCYSLIVSRELAGEYVFFSPEIAHPSFPPSGAAHPVKNARDIFSQ

SEQ ID NO: 128587 - protein, 41 aa, Heterodera glycines
  Coding regions on vcDNA: vcDNA=SeqID_55010; Strand=+; Position=1 -57,452-520
MLLLRGRALCAVAVATLAKVNEGKKKSRLSKGTKNVKFYYF

SEQ ID NO: 128588 - protein, 165 aa, Heterodera glycines
  Coding regions on vcDNA: vcDNA=SeqID_55011; Strand=-; Position=1-498
  Homolog annotation: Hit_ID=NP_701342.1; Match level="QueryCoverage =92%, HitCoverage=10%, E-value=1e-11, Identity=32%"; Hit description =MAEBL, putative [Plasmodium falciparum 3D7] gb|AAL10509.1| erythrocyte binding protein 1 [Plasmodium falc
MNKKGRLNEPKEKNGKIYESHSFLKMELLSKEEEESLKRLKRKLEHQLLRVQQSLTESEKWKSGTSDIQWDHRSGKKMKEETTKKGEEMKEKEEEKKGREGKEKETEKKKEEMKQKDETETKRSLSVGTTKDDEISIVDSEERERDAFENPPKPTNERLHFGSRL

SEQ ID NO: 128589 - protein, 205 aa, Heterodera glycines
  Coding regions on vcDNA: vcDNA=SeqID_55012; Strand=+; Position=1 -111,157-333,400-627,672-772
  Homolog annotation: Hit_ID=AAH44356.1; Match level="QueryCoverage =97%, HitCoverage=39%, E-value=3e-86, Identity=78%"; Hit description =Rrm1 protein [Danio rerio]
AFSEVISDLYHYVHPKNKRQMPMVSKKTYDIVMANAQALNSAIIYDRDFSYTYFGFKTLERSYLLKIDGKVVERPQHMLMRVAIGIHYEDITAAINTYNLMSERWFTHATPTLFNAGTCRPQLSSCFLLTMVDDSIEGICTTLDRCALISKSAGGIGLNVHCIRAQGSYIAGTNGTSNGLVPMLRVFNAMAKYVDQGGNKVNLAT

SEQ ID NO: 128590 - protein, 294 aa, Heterodera glycines
  Coding regions on vcDNA: vcDNA=SeqID_55013; Strand=-; Position=1-882
  Homolog annotation: Hit_ID=NP_494149.1; Match level="QueryCoverage =99%, HitCoverage=18%, E-value=2e-25, Identity=34%"; Hit description =predicted CDS, putative protein of ancient origin (2C297) [Caenorhabditis elegans] gb|AAF39854.1| Hypothe
MTKEKTEIYLEYDRNRKKPRAIMSEEEKVIERIITANAVQSHRERMKCSEGPIYLKAGEYMVSNVEVFRLSDFKLKCNHCPAIHFYEEQNNTKGVNEFLGCCNYGKSSNLEDMLLDYPMELRLLFQPEFDQIDSTNMRNFHKDFIKNIRILNSSFSCASLGCMRFKFPDKNIPIFKIQGNIYHSYNTFAQPNNYDELPTNGQLYFVDTEQAIDIRTNAISNKISSDKNNNIIAIISYIELYLRENYIYSQSYKMMKDVSEEAAEQSEDIPDIMMLFGIREGVDLRRYNIPKRNE

SEQ ID NO: 128591 - protein, 164 aa, Heterodera glycines
  Coding regions on vcDNA: vcDNA=SeqID_55014; Strand=+; Position=1 -241,704-957
TARWLTTVQSLEKELATVELAMLLTLPSSLKNKVKCLKDLHRKNNLYSDTVKNEFLSQFKSPWTNPWRQPDFMHSIRAKTGRNVLSNVVINLKNIFTEEMINLKIENNDQLGPDENRIVHRKVFFSLYLAMNKREFDEIRNQKLDEARNKATSYLIECLSALHS

SEQ ID NO: 128592 - protein, 78 aa, Heterodera glycines
  Coding regions on vcDNA: vcDNA=SeqID_55015; Strand=-; Position=1 -107,530-646,810-822
MAQRSAEEVPLLEHQENFIAAFLLGTQQNDWDEPAFKLSLALCAGDLWAGGLETLVATLNWAVLYMLNYPDVQQRQIR

SEQ ID NO: 128593 - protein, 104 aa, Heterodera glycines
  Coding regions on vcDNA: vcDNA=SeqID_55016; Strand=+; Position=1-315
MSNLNPGNWWYYFERQGKATAKCKADGCSYSKALNASLSTTVLTFHLKNHHPELYKQREDFVQAEKQKTEKKGQSGIIFLIKSAARNGIPRGILRDPSENPEKA

SEQ ID NO: 128594 - protein, 232 aa, Heterodera glycines
  Coding regions on vcDNA: vcDNA=SeqID_55017; Strand=-; Position=1 -195,289-589,646-848
  Homolog annotation: Hit_ID=CAE68594.1; Match level="QueryCoverage =87%, HitCoverage=36%, E-value=2e-42, Identity=46%"; Hit description =Hypothetical protein CBG14465 [Caenorhabditis briggsae]
MSDCNCSAVVCLTNSHCSSPSAPPVVRTSYGDVIGILRRLDSGVQVEVFLGIPFAKPPIGQLRFEKPVPPSPWLSSPLRAFAFGPAAIPLNPENSESIPFSEDCLQLNIFRPALSASAPLPVMFYIHGGGFAEGSARQYGYDGWAENFAPQGILVVTVQYRLGPFGFLSFGRGSVLPGNLGLWDICQALRFVHNEIRAFGGDPGRVTAVGLSAGGAAAAFMALSPHSRGGKH

SEQ ID NO: 128595 - protein, 78 aa, Heterodera glycines
  Coding regions on vcDNA: vcDNA=SeqID_55018; Strand=+; Position=1 -42,619-717,882-977
MAFPYLVNVPLIEEKAAIREHFTEGVLNELEMRFNVGLTFHPLPLHIQWDVCMVTFFATLDAWDGFMSEVSDLLNEVS

SEQ ID NO: 128596 - protein, 285 aa, Heterodera glycines
  misc_feature (283)..(283): Xaa can be any naturally occurring amino acid
  Coding regions on vcDNA: vcDNA=SeqID_55019; Strand=+; Position=1 -781,1536-1621
  Homolog annotation: Hit_ID=AAG45420.1; Match level="QueryCoverage =92%, HitCoverage=65%, E-value=7e-47, Identity=37%"; Hit description =vegetative cell wall protein gp1 [Chlamydomonas reinhardtii] sp|Q9FPQ6|GP1_CHLRE Vegetative cell wall prot
NPIMPNPMFPNPMVPNPMSPNPSNPMVPNPMFPNPSNPMVPNPFFPNPSNPMVPNPMFPNPSNPIMPNPMFPNPMVPNPMSPNPSNPMVPNPMFPNPSNPMVPNPMFPNSSNPMMPNPMFPNPMVPNPMSPNPMVPNPMSPNPSNPMVPNPMIPNPSNPMVPNPIFPNPMVPINPMVPNPMIQNPLNPMVPNPILPNPSNPMVPNPVFTNPMVPNPMIPSPSNPVVPNPMFPNQMVPNPMIPNSMSNAMPPNQWMVPTMPAPAIWATMKNAATKKFMPCRFRXIS

SEQ ID NO: 128597 - protein, 35 aa, Heterodera glycines
  Coding regions on vcDNA: vcDNA=SeqID_55020; Strand=-; Position=1 -49,101-159
MAGAGIVALPTAIIKSGIGPGLLMNVALTCKNISF

SEQ ID NO: 128598 - protein, 276 aa, Heterodera glycines
  Coding regions on vcDNA: vcDNA=SeqID_55021; Strand=+; Position=1 -41,475-755,972-1176,1414-1514,1571-1624,2072-2215
  Homolog annotation: Hit_ID=CAG31279.1; Match level="QueryCoverage =93%, HitCoverage=41%, E-value=3e-48, Identity=42%"; Hit description =hypothetical protein [Gallus gallus]
IENLFKKLLDFSSVSSYSGRCLGRGAFGQVFVCLNVDTGEQLVVKKVPLGHTNSRHRRVLATLENELNALGSLRHAHIVNYLGVVQRKDCVHIFMELMAGGSLKDQISEYGALGEPVTIRFTAQILDGLAYLHARDIVHRDIKPANILRHTHAHVKIADFGAAKFLQAICSDQGSFQGTPHYTAPEILRADNCRQFEPRSDIWSVGITVVVVEMMTTMTPWAGIDPAAVHLRIVFARPDLSSLPDGLSTALRASIEAMLNSEPDQRPQAVKLLKMP

SEQ ID NO: 128599 - protein, 83 aa, Heterodera glycines
  Coding regions on vcDNA: vcDNA=SeqID_55022; Strand=-; Position=1 -15,488-724
MTKIAELLDPSKGFYNKDEDKVKLVIYVIVDEAKTENSDPNPTAHFRWKLKNYRNLHKKSTVYIKRMPWKIWAEIKMKALRNG

SEQ ID NO: 128600 - protein, 107 aa, Heterodera glycines
  Coding regions on vcDNA: vcDNA=SeqID_55023; Strand=+; Position=1 -117,164-302,862-929
MGKRTGGAPRGPKIVPNACTSPERKKRQTKHYNKLNRPKITVSSSAPNVPPIIRSLEGERSYRVKAVLATYTHSNNRIGYYVDWLRHSVQKSILEAPAPEESDSEDE

SEQ ID NO: 128601 - protein, 94 aa, Heterodera glycines
  Coding regions on vcDNA: vcDNA=SeqID_55024; Strand=-; Position=1 -39,212-311,365-510
MPKVMSLLLTPNYPKDESATKKRKVEDRELWKLAKGKFLLTTYLCHDDWNRLYNNQQKVKRLEGDRFAFGFEMCEECVWANCRATDLLAPLKKK

SEQ ID NO: 128602 - protein, 580 aa, Heterodera glycines
  Coding regions on vcDNA: vcDNA=SeqID_55025; Strand=-; Position=1-1740
  Homolog annotation: Hit_ID=NP_494149.1; Match level="QueryCoverage =73%, HitCoverage=28%, E-value=9e-54, Identity=32%"; Hit description =predicted CDS, putative protein of ancient origin (2C297) [Caenorhabditis elegans] gb|AAF39854.1| Hypothe
MVRKKQIFSVDVQTPSSTPPTFSDVRPVLNIGFNEPIRKNHLPGSKLPKKTVERMPTNLLCLDEVDDDFFRQSTSQSAMRKNKERNERTVEKTELERHLNRQRMATKRNQMTVEEIELERSLNKERMTTKRNQMTVEEIEFERILNKEKMTAKRNQMTVEEMKLEREMSKVRMASKRSEMFLEEIENEKISNSVSHVFSRKRERNFDGLYYLAAADPKKANLYLLGDFNFKCTKCDSLQFPEEKSVVKDCIFFSCCKGGRLLNLLECVSKYPEEMKALFFEENPFYSNFITNIRRYNSMFACASISCFRFKFQSPGPPCYKIQGQIYHKFNQNAMPKDNEIPTNGQLYFIDSEEAIDIRSENNKECRSDIIEFLENLLRKLNPFAQSFLMMKEVYEREENNCKENGLKMPNINLVFSLKENCDKRRYNIPRCNEVGAIVVCDANDEIPPARIVVYPKGEKQLKNIYPLDKCVDQMCYPLLYPMSSEGFNVNIKDLNGKKISLCDYTKFLLFFRENGIFFPHFYAKKLFQQWLVDQAAKIEWDRLEYIRTHQMELCSSNYLNVEDFLKNRASKTGAEIKKK

SEQ ID NO: 128603 - protein, 26 aa, Heterodera glycines
  Coding regions on vcDNA: vcDNA=SeqID_55026; Strand=-; Position=1 -31,81-130
MTTCHLEMVPPKKLWGSDCDQTYEKV

SEQ ID NO: 128604 - protein, 51 aa, Heterodera glycines
  Coding regions on vcDNA: vcDNA=SeqID_55027; Strand=+; Position=1-153
NFLNFLNFFEFLKIPGWSRFPVPKKNRGPGPGFSGPGKSRSRFCPKFPVPL

SEQ ID NO: 128605 - protein, 136 aa, Heterodera glycines
  Coding regions on vcDNA: vcDNA=SeqID_55028; Strand=-; Position=1 -112,153-231,288-345,925-951
  Homolog annotation: Hit_ID=CAE67028.1; Match level="QueryCoverage =77%, HitCoverage=18%, E-value=5e-21, Identity=45%"; Hit description =Hypothetical protein CBG12429 [Caenorhabditis briggsae]
SGTAFTAPRCSNRFSWLYRVRPSVLHRPFRRLEGNGRSFTNDFSQFAPNPNQMRWKPHPMGNGRSFTNDFSQFAPNPNQMRWKPHPMPNSHKSSTLQGLYTVCGAGHPHKSSTLQGLYTVCGAGHPNGFEGYGVHS

SEQ ID NO: 128606 - protein, 70 aa, Heterodera glycines
  Coding regions on vcDNA: vcDNA=SeqID_55029; Strand=-; Position=1-212
MQSRKQGNLKLGGVLINSVNQPKRLIECPIKMNGNSVEFALDSGAEVVVINEETHEGIGKPKLSPCNVEA

SEQ ID NO: 128607 - protein, 103 aa, Heterodera glycines
  Coding regions on vcDNA: vcDNA=SeqID_55030; Strand=-; Position=1 -130,413-503,625-715
  Homolog annotation: Hit_ID=NP_506290.1; Match level="QueryCoverage =66%, HitCoverage=19%, E-value=5e-21, Identity=69%"; Hit description =ODoRant response abnormal ODR-3, heterotrimeric G protein alpha subunit family member, possibly N-myristo
MGGMLASCQSEEVRDQISKSKAIEKQLSSDRRMASNIIKLLLLGAGECGKSTVLKQMQILHSNGFTEEEINERSDFNGSHSQGHGLGAAHSVGRRQQRGDPID

SEQ ID NO: 128608 - protein, 29 aa, Heterodera glycines
  Coding regions on vcDNA: vcDNA=SeqID_55031; Strand=+; Position=1 -45,710-754
MNIIQRFSLQFVWLFANIEHLRLFIDTKD

SEQ ID NO: 128609 - protein, 52 aa, Heterodera glycines
  Coding regions on vcDNA: vcDNA=SeqID_55032; Strand=-; Position=1-156
LNDEEKTIVTSTQPPFNKITVNLQCAWNSYGQRVWSKTGVDGYPNRVIQVEK

SEQ ID NO: 128610 - protein, 94 aa, Heterodera glycines
  Coding regions on vcDNA: vcDNA=SeqID_55033; Strand=+; Position=1 -140,177-321
MDQYYNAELMAFGHIGLAVDRENDQQTVQNELISALSEALGRRQRKKTISNDSATHFDLAKFKAVSAAFRQKNVAKTIADAMKEIEKEIGKQKK

SEQ ID NO: 128611 - protein, 21 aa, Heterodera glycines
  Coding regions on vcDNA: vcDNA=SeqID_55034; Strand=-; Position=1 -3,109-171
MIFCRSNADFLKLSWEPWLYL

SEQ ID NO: 128612 - protein, 97 aa, Heterodera glycines
  Coding regions on vcDNA: vcDNA=SeqID_55035; Strand=+; Position=1 -177,232-348
MHNFRELIFTKKFYNSEKLVLRPPQIDAFWVHFTRHYKGRDKPVQLSTDYLTILHLSKDIEANSTKGYNDKLLTQFDGQLGNGSAFLNDSKIIKVQK

SEQ ID NO: 128613 - protein, 71 aa, Heterodera glycines
  Coding regions on vcDNA: vcDNA=SeqID_55036; Strand=+; Position=1-216
MSEANLQQQTHGPIAGTDYDSADEYVVIEQEEETDLEKNSTLPETVATNTNSTPSDVQSVAASVGTFGRGR

SEQ ID NO: 128614 - protein, 84 aa, Heterodera glycines
  Coding regions on vcDNA: vcDNA=SeqID_55037; Strand=-; Position=1-376
LNRRKKPTWKRTQLCRRRWLRTLIRLPVTCKVWQHQSALLDAVADIGNGLDGAKLSGFVCFPTECNERLELFAKWLQSSIFGSF

SEQ ID NO: 128615 - protein, 51 aa, Heterodera glycines
  Coding regions on vcDNA: vcDNA=SeqID_55038; Strand=-; Position=1-153
MDDGDGVEQHQSTDGQGLMNTSSDEKQPQITITVMSDGGVKVTDVCGTEYM

SEQ ID NO: 128616 - protein, 96 aa, Heterodera glycines
  Coding regions on vcDNA: vcDNA=SeqID_55039; Strand=-; Position=1 -179,260-371
MDLLRELLKDHEIEPEPETIGANAQNAIKLVPISEEMLRRRAHDEEASNGEPQAVRCATQEYYKPLFVCSFCIPIALFDLLLGFFMYLIRPGTAAV

SEQ ID NO: 128617 - protein, 54 aa, Heterodera glycines
  Coding regions on vcDNA: vcDNA=SeqID_55040; Strand=+; Position=1-164
LLSIVKRNVDRLHQLCNEWINTGHFSSIPDHYRLLYAFCCAVRAKLSYLLKDYF

SEQ ID NO: 128618 - protein, 42 aa, Heterodera glycines
  Coding regions on vcDNA: vcDNA=SeqID_55041; Strand=-; Position=1 -83,130-175
MWRLNRMIIERKQHYPDLDTVFRKYSHEIFFEVAKTKQLREH

SEQ ID NO: 128619 - protein, 365 aa, Heterodera glycines
  Coding regions on vcDNA: vcDNA=SeqID_55042; Strand=-; Position=1-1097
MQRLEFEDGSESNMDPANEGHRNGAQHDENVQDGDGPVASTNEEQQKIARVNEATRGSNMATGVATNQQGMLPFPSRNLRSVSIPVRTARDRIERASGTLAARIAEAREVIDQDLTEGEAGYQAARLLAMERGLKEATQIFQGHFEIGMAAAGAEPAGHQDFFYDLLTAPLPAATKELQLRNHPTPAELLQIADEHIGDLRTMRRALEDEEEAIARSRLSGSFGTNNSHPVGDDPPPLENRNIEECERSFQVAAKRWQNGGQGVQQHNRRPMGRVATPVMSNLDGIFQRRAKVPSVASMRVTNTAREWINRNRDEMGAFPPATAHRPALMQPKIEKQQAHVNDDYRERQTYPIRRHARDEGEHDR

SEQ ID NO: 128620 - protein, 51 aa, Heterodera glycines
  Coding regions on vcDNA: vcDNA=SeqID_55043; Strand=+; Position=1 -80,1895-1970
MPKGKELGSGGLGENDEGCQERKGVKRFAATAAILVLVPTNAGSAKNLAMR

SEQ ID NO: 128621 - protein, 127 aa, Heterodera glycines
  misc_feature (77)..(77): Xaa can be any naturally occurring amino acid
  Coding regions on vcDNA: vcDNA=SeqID_55044; Strand=-; Position=1-567
  Homolog annotation: Hit_ID=NP_493879.1; Match level="QueryCoverage =93%, HitCoverage=25%, E-value=2e-17, Identity=38%"; Hit description =transposase family member (2B289) [Caenorhabditis elegans]
FRAESSKRKRLEGGGRKVPNRNFEEAVFQWVSELREKKVRVTRSMIAAQAIKMSAAYEDMENFAVKFRKIFEHFSLXASKGWLEKFMHRHKFSLRRPTTVAQKEPDTYKNIIINFILYIQQLIHKNK

SEQ ID NO: 128622 - protein, 395 aa, Heterodera glycines
  Coding regions on vcDNA: vcDNA=SeqID_55045; Strand=+; Position=1 -775,821-1231
MDDFYIVLPSNTPGQENTTSKFTVRLPETLELGTNWAVALSSIIYPYSFTALGINGQEFIKVWENDISVPTQVYLPDMNFKTAGGLGNKINEAFTHHYKIKKQRGKREAKAEDTKDSKIDVAKRAAERAGRDVERHFNQINNISNSIQTQLNTLRETNPQILEEPDIKIWFDKMVEMGTEIQTSRNELKSFQEEVDKAKNITLEHVEKNDLKKAKKSADVAKGIARQAKTKYTSTLEEYNDKSEKGFSGMVVRLNEALEAEKGPQKRERLANEDVQFNYDSIDQKFIVYLSSAVTHIDLSKHLAYVLGFKNTRLFHAEEATYMPDLTGGVRQLYIYAPNLIENTIIGNQMAPLLRIVNVVDDPGSISEVIYSTEYFHRLQSKRISEITIEIHTPF

SEQ ID NO: 128623 - protein, 451 aa, Heterodera glycines
  Coding regions on vcDNA: vcDNA=SeqID_55046; Strand=-; Position=1 -452,532-739,783-1343,1388-1456,1694-1759
MENYKLIDERSTICEKFGFTKNIMEFRINPDVRRPDETMRDAIDTMIKAAFKTTEERMKRKVRMFGVAITGAGLASPVWVPYRAYPQNNADVIMQEINKLGQSGEGDENKKTLLLSEPIMMKITCVTMPSGEGPRNVHKFDFGFKEHQRIKISNVDKFCLFYALVASKLYLEVHRNIFNRFMNNIVRQREAAYGLLRNCGIDINEYSYGVEHLSGVQNYWDEIYPGKYRVVAFEKSADPRKSIRVLWKGPMGREKVVPIFLENGHWDGLKKYVCFFNRGRKFCVECECFYDQDVYHTMDCRARCYYCNRAGGMPCQKESGVKIECPKCRRYFYNWECYTYHQGHQTCKLWRRCVICDKTYRFNPKKDHECGETYCQLCSVSHDPKRGCYIMPIEEKEDKDVYRIVVWDSETSQDSIYKGDQKEHVINYISAFWLLLPLPYPGKPRSRLLMD

SEQ ID NO: 128624 - protein, 273 aa, Heterodera glycines
  Coding regions on vcDNA: vcDNA=SeqID_55047; Strand=+; Position=1 -363,688-1146
MTHVFFNPDSIEWSTFLASQQEGRGEQQYFVGTRYQRGGGLLQNVARFLMPVASNLLSSASKEGIAAGTRVLGDLSQGKALKESLETHAKQGFENLAGKLQQCGKGGNYGADGRRGQRVSKELLPLSALNQTGPYLFRLFSDSQYCDLSKTYMYLLTSIERKNAAGEWVPTDDAIEEDKHVGVIQNFGSSFVRSLKVNISGVEVFDSSIYYHYRAYIMQELGYSHEIRKAFHEAGCYYPDENSQDNYSNKGFTSRAQRFSNGKQCETMVKTQL

SEQ ID NO: 128625 - protein, 18 aa, Heterodera glycines
  Coding regions on vcDNA: vcDNA=SeqID_55048; Strand=+; Position=1-56
MEHDFIFKIFPNRYALFT

SEQ ID NO: 128626 - protein, 175 aa, Heterodera glycines
  Coding regions on vcDNA: vcDNA=SeqID_55049; Strand=+; Position=1 -515,1287-1300
  Homolog annotation: Hit_ID=XP_522969.1; Match level="QueryCoverage =99%, HitCoverage=77%, E-value=3e-15, Identity=30%"; Hit description =PREDICTED: similar to putative protein family member (XC187) [Pan troglodytes]
VIRRGTTVIRRGTTVIRRGTTEIREVSTVIRRGTQEIRRVIRRGSTVIRRGTTEIRRVIRRGSTVIRRGTTEIRRGTTEIRRVIRRGSTVIRRGTTVIRRGTTEIRRGSTVIRRGTTEIRRVIRRGSTVIRRGTTEIRRVIRRGSTVIRRGTTEIRRGTTEIRRGTRVIRRDFLE

SEQ ID NO: 128627 - protein, 194 aa, Heterodera glycines
  Coding regions on vcDNA: vcDNA=SeqID_55050; Strand=-; Position=1 -273,709-979,1181-1221
MMNTNNFLIVFCCLFLLVQFPQFVYTVGINTVCFRYGSQFRVQVFYNGNCEFWQYTNPLPNGQQQCLSVQSTIWNRMDTNAFVEFRNDSGQVIGTATVHELRFSTSNPPTLNFEWEKKVCFWRPMNVSVYSDQQQITTIQTMTDYFDHTNCMEIDPNQLVIGLVNPNPQISFFEQNHQNRVTFLMKIKKNCLLE

SEQ ID NO: 128628 - protein, 64 aa, Heterodera glycines
  Coding regions on vcDNA: vcDNA=SeqID_55051; Strand=+; Position=1 -151,789-832
  Homolog annotation: Hit_ID=NP_502084.1; Match level="QueryCoverage =95%, HitCoverage=4%, E-value=2e-20, Identity=80%"; Hit description =DEAD/DEAH box helicase and helicase, C-terminal (4L900) [Caenorhabditis elegans] emb|CAA92767.1| Hypotheti
MRLTGAQEGIIVRCIQRLDEVCKDVRKAARIVGDPALFEKMGETSAAIRRDIVFAASLYTTEEE

SEQ ID NO: 128629 - protein, 47 aa, Heterodera glycines
  Coding regions on vcDNA: vcDNA=SeqID_55052; Strand=-; Position=1 -46,156-213,630-669
MLFHWERFAENLKEMGIFANLGDHFLRHNSTFCSLLPFLILTFLETK

SEQ ID NO: 128630 - protein, 108 aa, Heterodera glycines
  Coding regions on vcDNA: vcDNA=SeqID_55053; Strand=+; Position=1 -147,1088-1267
MLSSDTEQITHGSLGFHEKSLILAVCPPWMNNSSLKRSILVRFASTHPVFVIPCLLPCHVPHNRSVCCENGFCVQKVGIRSRRLNVPQAHGHVVGGTQQMTRQIVVPG

SEQ ID NO: 128631 - protein, 217 aa, Heterodera glycines
  Coding regions on vcDNA: vcDNA=SeqID_55054; Strand=+; Position=1 -156,1148-1643
  Homolog annotation: Hit_ID=XP_318187.1; Match level="QueryCoverage =97%, HitCoverage=26%, E-value=2e-50, Identity=46%"; Hit description =ENSANGP00000016242 [Anopheles gambiae]
IIRVPKIACDLSLAKNGVSKNRNYAQKAPQTILALPIPSTIAFIHPIMSAKIQQNLDEESKHLCGINTHRGLFQCQRLPFGVKSAPSIFQHLMDQIVSGIPGAFAYLDDGIIASKTLDEHISSLYKLFKRIQEFGLKIQWEKCKFLQPELLFLGHVISAKGIRPDPGRSEAIRQMPPPHDLSTLRSFLGALNYYGRFIKSMREIREPLDQLLRKDVK

SEQ ID NO: 128632 - protein, 90 aa, Heterodera glycines
  Coding regions on vcDNA: vcDNA=SeqID_55055; Strand=-; Position=1 -85,532-719
MPRGAADGDERAIVRTVQRCAGEALVECGRGWTLSNPQQFRDIDAPAQVAKATKFVKLAGIGSYFEVENNEKISYVIYFGLSGTGTGTDR

SEQ ID NO: 128633 - protein, 145 aa, Heterodera glycines
  Coding regions on vcDNA: vcDNA=SeqID_55056; Strand=-; Position=1 -74,1070-1142,1243-1325,1853-1928,2042-2173
  Homolog annotation: Hit_ID=NP_508588.1; Match level="QueryCoverage =64%, HitCoverage=15%, E-value=5e-23, Identity=60%"; Hit description =chitinase (66.9 kD) (cht-1) [Caenorhabditis elegans] gb|AAA83586.1| Chitinase protein 1 [Caenorhabditis e
MTDGFFADPSSCQHFYRCVGPMAYRAINPADLPSDKQPNGMYARVNGLKAFDPVLKTLLSFGGWSFGTRLFREMTSKKASRKSFIDSAIAFVRKHGFDGIDIKVFKKKHKLISLGTERRRSERSVFKRKAASADHCCGCGGDGKH

SEQ ID NO: 128634 - protein, 231 aa, Heterodera glycines
  Coding regions on vcDNA: vcDNA=SeqID_55057; Strand=-; Position=1-696
MKRTNASNITPPRAKRSMAPPLDLDPNTVALAEQERQRTLVFIGLPESNAIRPSERVQEDREAATKILDHLEVEAQPTAVFRLGHYDPQRTTPRPLKVVMPTTTHQHMALGGWKRERARLRSLQNLNRLFVRPALTKEQLKEEYEARVQKRQQNPAPVAPAMQPRQTNVPTPVKENGPSQKEASDDISKPPEVFEQTILVCYEALKSLPPNDKIVHQIQSLEKQYPRLFNK

SEQ ID NO: 128635 - protein, 304 aa, Heterodera glycines
  Coding regions on vcDNA: vcDNA=SeqID_55058; Strand=+; Position=1 -124,176-616,695-1044
MGKRNLPRKLNCKKALKERENKREERKAQTAKAMKARWAKKTAPPPNPNAETPQQDEAGPSTSAAPTEEAMEPPPPTPGLVPTPDMDEEILEYGVLLSSTPATPIGDLVPFPSTPTAPMDTGEMTPPPLAIDERSPRIEQLEKQLKDRDDTIQFLREQVRNREALISDLRRQLEQCAAPPTATPTTSKTTPNRGRPRKAIDELQRSSRKRLTEQILDAIDRDRSRSASRCSLERIHREVRHKYGHYTPKKTPAKKGKDEMEANDGLLLMTQLGTQKAYQRMKATLRLIHKKFDILPPLKKVHLG

SEQ ID NO: 128636 - protein, 211 aa, Heterodera glycines
  Coding regions on vcDNA: vcDNA=SeqID_55059; Strand=+; Position=1 -123,1242-1445,1648-1956
  Homolog annotation: Hit_ID=AAG00551.1; Match level="QueryCoverage =95%, HitCoverage=50%, E-value=1e-12, Identity=33%"; Hit description =retinitis pigmentosa GTPase regulator [Homo sapiens]
MQAHDSDDSGIEEPDNVQGVVQEGQEGQGVVQEGQGEELVEVGQIDFDIGELAAQVDNVQDDHALLQNQVVNLNNQVVNLNNQVVNLNNHVGALLNLATQQQGQISQLQAIGQAAAGSQQQEEKSGKEKPKEGEDEEEAGGITVAEDKEEAEGEKNVPEGEDEEEAEGEKTVAEGEGEDEEEAGGEKTVAEGEDEGTSDGEPKTKHPRLQF

SEQ ID NO: 128637 - protein, 16 aa, Heterodera glycines
  Coding regions on vcDNA: vcDNA=SeqID_55060; Strand=-; Position=1-49
EAIPEGFGLPINLGAS

SEQ ID NO: 128638 - protein, 30 aa, Heterodera glycines; identical to SEQ ID NO: 128423
  Coding regions on vcDNA: vcDNA=SeqID_55061; Strand=+; Position=1 -20,68-140

SEQ ID NO: 128639 - protein, 111 aa, Heterodera glycines
  Coding regions on vcDNA: vcDNA=SeqID_55062; Strand=+; Position=1 -113,167-227,750-911
  Homolog annotation: Hit_ID=NP_510163.1; Match level="QueryCoverage =95%, HitCoverage=35%, E-value=1e-21, Identity=45%"; Hit description =receptor 7 family member (XN634) [Caenorhabditis elegans] emb|CAA15513.1| Hypothetical protein C53C7.1a [
MMLFGLIYSTIIVTSILGNLLVIISVFRYRSLQSVRNMFIVSLSVSDIVVSIVSGTITGVSLCFSTLTLSAISIDRFRLIVTPLRQSIQKRCACRIVALNTAISLIISYDN

SEQ ID NO: 128640 - protein, 92 aa, Heterodera glycines
  Coding regions on vcDNA: vcDNA=SeqID_55063; Strand=-; Position=1 -145,214-347
MKTNDEMVQIFKWMNGVSDIQYTRIGSTHIRFEEGDEWSLSTLKLFKNETKNKANKKLKKNKGQFEMSLSREFVEWLLNDLEVSIMLDKLNL

SEQ ID NO: 128641 - protein, 117 aa, Heterodera glycines
  Coding regions on vcDNA: vcDNA=SeqID_55064; Strand=-; Position=1-351
  Homolog annotation: Hit_ID=S08405; Match level="QueryCoverage=88%, HitCoverage=8%, E-value=7e-11, Identity=37%"; Hit description =hypothetical protein 2 - silkworm transposon mag
MGLKIDLNRAFGIPTIRAVENKKELEACLAQYPEVFQDGVGRCKKIASLKFKEGCQPKRCKPRLVPFSLRNEVEKVLDQWQAEKIIEPVATSEWATSLVMVPKANGKLRLCFDYKVT

SEQ ID NO: 128642 - protein, 139 aa, Heterodera glycines
  Coding regions on vcDNA: vcDNA=SeqID_55065; Strand=+; Position=1 -42,162-359,401-577
MTFGGKNGERDNAKVFLHRFLFVIFFPSCQTILSLLLDIMSHFKVKIKDRMEKQFFGIITGQLLRRLPEQKEHMLKNAFTSFYKTTLDYVAKWFRTERYPDHIQWLLLTDRQLVHENLIELASTFCPDLSDTLFDEISQ

SEQ ID NO: 128643 - protein, 15 aa, Heterodera glycines
  Coding regions on vcDNA: vcDNA=SeqID_55066; Strand=+; Position=1 -9,162-200
MSRSPNNACWAMRND

SEQ ID NO: 128644 - protein, 258 aa, Heterodera glycines
  Coding regions on vcDNA: vcDNA=SeqID_55067; Strand=+; Position=1 -348,646-1076
AISNGTNGITATPRGSRDESATTKRRRIAARDDSAARKEEQLQQQSQQHTVATSAAIVTAGGDAGGTATTVAALQQQTTIVYGSAMEAKTSLNATQQQQQHTQQKPQQQQQMVVDDLPTLRRELERPPAIVNAAAAAMAVAGTASVPSSSSSSSSSPCVGQAATVPSTATTAQQQHNHHQQSLPLSSLHSQQQQQQRVSSSSTSSLSSLRELLARPPILHVVVQQQHHHQQTHVASTGAADVAAFVEEQPLNLCVRDQ

SEQ ID NO: 128645 - protein, 102 aa, Heterodera glycines
  Coding regions on vcDNA: vcDNA=SeqID_55068; Strand=-; Position=1-309
MYLIKFILPISLCTTLKVFYLTAFFGIQSYLCEEVLFRYAVALFVDGVPRVVFGLQNWHKELVGQIAAGGRGRGSAEEDGTAGTLPEGNAAPLSVANDDDED

SEQ ID NO: 128646 - protein, 130 aa, Heterodera glycines
  Coding regions on vcDNA: vcDNA=SeqID_55069; Strand=+; Position=1 -329,516-579
MLTKAFISCRKRHVPVVHLRATHIHSDSGRVGAVVVQRTACQLPHSGASRLLACRVAHLPAAASFRTTRRCGQPTDGRPSDAAVANANSAAKSAASRPAQVAETVQITTQIFLGNIKYYLLSFDTLTFLF

SEQ ID NO: 128647 - protein, 133 aa, Heterodera glycines
  Coding regions on vcDNA: vcDNA=SeqID_55070; Strand=+; Position=1 -141,1147-1407
MAKEPGTGLLGKCVLCLLLNAVFVLALFLAFLIGHFAADAHFPHSNKSLERRRQRVPSLSEVYPPLLDGGDPMADEADDPMPLSAATAAHQFGNGPVMHRSAGIASQNVPLIPLPKTVMPRHYNVEVIRKQNI

SEQ ID NO: 128648 - protein, 142 aa, Heterodera glycines
  Coding regions on vcDNA: vcDNA=SeqID_55071; Strand=+; Position=1 -337,409-500
MCRPKKRQLLQLFLLLFCYLIDGHQLGPVQVIENNLEQTEEVKAKNIEMAQQIVEIREKNVNGNIENELLEVCNLLKCPSENVDKFLKNQLKKLHPDKVGAENAKLGAEATIVINKLRQFVIENTRKGLYHYRHRIVEILAF

SEQ ID NO: 128649 - protein, 80 aa, Heterodera glycines
  Coding regions on vcDNA: vcDNA=SeqID_55072; Strand=+; Position=1-244
  Homolog annotation: Hit_ID=XP_522969.1; Match level="QueryCoverage =96%, HitCoverage=11%, E-value=9e-09, Identity=38%"; Hit description =PREDICTED: similar to putative protein family member (XC187) [Pan troglodytes]
GTSVIRKGTSVIRKGTTVIRRGTTVIRRGTKVIKRGTTVIKRGTKVIRRGTTVIRRGTKVIKRGTTVIKRGTKVIRKVQQ

SEQ ID NO: 128650 - protein, 178 aa, Heterodera glycines
  Coding regions on vcDNA: vcDNA=SeqID_55073; Strand=-; Position=1-534
  Homolog annotation: Hit_ID=AAO51818.1; Match level="QueryCoverage =87%, HitCoverage=81%, E-value=4e-27, Identity=42%"; Hit description =similar to Kaposi's sarcoma-associated herpesvirus (KSHV) (Human herpesvirus 8). ORF73 homolog [Dictyostel
MSEANVLDKIEKKLNYEARMCKELKEIGLQPHHQHRLEEARQKFAKGECLTQCELTLLFMEQQERLRQKRFRQQQQLQQQPPQQQQPQQQQQPQQQQQPQQQQQPQQQQPPQQQQPPQQQQPPQQQQPPQQQPPQQQKPPQQQPPQQLSEILHESCRSLEQQHQQQQNVQRLEQLRQL

SEQ ID NO: 128651 - protein, 86 aa, Heterodera glycines
  Coding regions on vcDNA: vcDNA=SeqID_55074; Strand=+; Position=1-261
FLFIKNTLLIDSDRIEQWKEEMNLVFFAVEMTFAPLIGGNVLDRSELLKQTAQQQNIVCLIKEKAERLDLKQIVWLTNATIASRQV

SEQ ID NO: 128652 - protein, 82 aa, Heterodera glycines
  Coding regions on vcDNA: vcDNA=SeqID_55075; Strand=-; Position=1-259
HYDALVSKRKMEKKFFKKIFPYILVISFCFWWGAWNSGIMRTRPIWQVKQRLLTSQKVRCRDETNQHCLPRGTRHGPPKEWI

SEQ ID NO: 128653 - protein, 69 aa, Heterodera glycines
  Coding regions on vcDNA: vcDNA=SeqID_55076; Strand=+; Position=1-210
MEGGGGEETRHRGGGGTNADNEEEKEVDTGKHCCRAEVGPDDGWKGCGVRRGDAERKDWAQRPGGKEDE

SEQ ID NO: 128654 - protein, 79 aa, Heterodera glycines
  Coding regions on vcDNA: vcDNA=SeqID_55077; Strand=-; Position=1 -42,181-378
MSARVGIHHTLCLNVLKPFLIFTNQLSQRDESLSSVISVYKCLQNYLRVNGEENESILSLKNVIKDGLESRMREHQSKM

SEQ ID NO: 128655 - protein, 19 aa, Heterodera glycines
  Coding regions on vcDNA: vcDNA=SeqID_55078; Strand=+; Position=1 -22,247-284
MLNYLFRGYQHLHVTVKIA

SEQ ID NO: 128656 - protein, 93 aa, Heterodera glycines
  Coding regions on vcDNA: vcDNA=SeqID_55079; Strand=+; Position=1 -212,441-508
VFLVYTGLVLFVYLATDSFQNNAPFVFTIPVVVLGWFTLWTRMPRRTRILTAVSFFTLALALYSWSMFPKNQFAYLLSFYKSLRKWWIALAIS

SEQ ID NO: 128657 - protein, 145 aa, Heterodera glycines
  Coding regions on vcDNA: vcDNA=SeqID_55080; Strand=-; Position=1-438
MSLGIEAETESPKTRESCTSLTCHFEHWPISANWQAENDHRNQRENAFPQLKKNNAILSSWQALYFVMFQWDCNCGQSVEKDESGGQIVCLESVTGEEKRQSADHPIGEQRINGKKDAAEQRGQAVAVERVEQVQQILRGNSQRN

SEQ ID NO: 128658 - protein, 132 aa, Heterodera glycines
  Coding regions on vcDNA: vcDNA=SeqID_55081; Strand=+; Position=1 -114,174-458
MNKLKFNQQQNTPTNFERKLFIYALATFCGHALIACLLICIYIASNALNVQMVLALYTHYPWVLDTGSVILSSWLLLWAGDSFRDQLLRDYRIPRIRFEIRANNRVVSVKRPIEQTNGIKGHEKLRKMPTVA

SEQ ID NO: 128659 - protein, 194 aa, Heterodera glycines
  Coding regions on vcDNA: vcDNA=SeqID_55082; Strand=+; Position=1 -338,952-1100,1148-1243
  Homolog annotation: Hit_ID=CAG11346.1; Match level="QueryCoverage =39%, HitCoverage=11%, E-value=3e-12, Identity=43%"; Hit description =unnamed protein product [Tetraodon nigroviridis]
EYSNQIVLTENQLQPISQSAEEGEEEEEEVVVEEEGHQNSEEHQQEEDEQQNRVIVNRRPSVQIGTMPNQQMADGQREEKPTAEKKQTQKKAMKPKNTKYPFRAKLFSKILNNQNFHINSTLRQHIRTVLNLQCVKEHDFCGPPLIDHTGFTYNPELLMREKLYYFNFAVPDFGTVSAKSILDICKVIWFSLKH

SEQ ID NO: 128660 - protein, 447 aa, Heterodera glycines
  Coding regions on vcDNA: vcDNA=SeqID_55083; Strand=-; Position=1 -663,744-1421
  Homolog annotation: Hit_ID=AAA93301.1; Match level="QueryCoverage =38%, HitCoverage=46%, E-value=5e-23, Identity=35%"; Hit description =HASI
MPSKTKKRKSNKAEEDNERKRIKIGSRKRDLLAVAAAAPLPVDDDFELSQQSGTSAQVHPPGPPLPSKTKKRKSNKVEEDNERKRTRIGTRKRLSSPNVTKNQPKRQKNPVGEVLSEEQRHQFAEDQHLFTIPNSQLTNEQKRRRLQFVFNRNPVKYGVHGDTVLNNAGNPITDSSVAQALDYIIERRAGRIPQFRQPPGTKLIRDRINSDLILRTWTAPPRNEAGERQGTRRNDTSVSNEGRQAEVDGTVSNRNGNPHQKPTSQTTKMEKSIENVLERLYNDPKSPAAFAGVDRLWLEAKKELGNKIPKRDVKHYLEGHRTYTLMRPRRINFPRAKTTAAGFMTDCQVDLADFQALSRHNSGNRYLMVVIDVLSKRIFVTPLRTKKSDDMVEGFKRVFSTMPMKPHRIFSDKGTEFRNQQMKKLFDEEEVEKYERTHSEKKAAWPN

SEQ ID NO: 128661 - protein, 39 aa, Heterodera glycines
  Coding regions on vcDNA: vcDNA=SeqID_55084; Strand=+; Position=1 -24,541-626,781-790
MGQLLPLLVFVTGGQPPSYCIWCLALGIILLFAWLICKF

SEQ ID NO: 128662 - protein, 163 aa, Heterodera glycines
  Coding regions on vcDNA: vcDNA=SeqID_55085; Strand=-; Position=1-492
  Homolog annotation: Hit_ID=XP_309989.1; Match level="QueryCoverage =69%, HitCoverage=41%, E-value=2e-18, Identity=40%"; Hit description =ENSANGP00000015194 [Anopheles gambiae] ref|XP_319667.1| ENSANGP00000022407 [Anopheles gambiae]
MPAEQSTELKDILQAIHSLLQKSTQPNVPSQNSEMDLFCKLSAQIAEFVYTPDDNHTFEQWFERFGTFIADEGKNLPEASRVRLIINKLGAEEYRRYTESIQPTAPEKIGFGETIHKLKAIFPESKSLFVRRFECFQLKCADNDALSFAATVNPMADRAKIGF

SEQ ID NO: 128663 - protein, 78 aa, Heterodera glycines
  Coding regions on vcDNA: vcDNA=SeqID_55086; Strand=+; Position=1 -47,216-405
MDCGGETAQWQLHLARIIHGFKMETINIWWRMKCLGRWSFFSNYAGLKGAHWPKRGEERGKSMSEKADDSCPAAAEWP

SEQ ID NO: 128664 - protein, 31 aa, Heterodera glycines
  Coding regions on vcDNA: vcDNA=SeqID_55087; Strand=-; Position=1-95
MLAAAAPFKLLTPLPLLTPLLLSTLPVGLYE

SEQ ID NO: 128665 - protein, 191 aa, Heterodera glycines
  Coding regions on vcDNA: vcDNA=SeqID_55088; Strand=+; Position=1 -218,474-831
SIPTALFNYGHSNHHYQHQHKQLNQQRHHRIATPSASSCSDNANATAVVGVPSQNHPPHQRSNSALTPSPVNSSYSPTGSVESSSGVSSGSGVSSLNGAAAANMMTSLPMHHHHQSQQHVTVKTEPGMAPASTADISANIVATPSTSESSDGSGSGTTPRTTTAPPAPLIGGEVARAGAESAKAQWTATLR

SEQ ID NO: 128666 - protein, 188 aa, Heterodera glycines
  Coding regions on vcDNA: vcDNA=SeqID_55089; Strand=+; Position=1 -238,532-857
  Homolog annotation: Hit_ID=CAA73551.1; Match level="QueryCoverage =91%, HitCoverage=21%, E-value=5e-15, Identity=32%"; Hit description =STATa protein [Dictyostelium discoideum]
MSQMVASSPLLLALQQQHHHHQQQQQQQQQSPFLSAALNAMSSFAASPAAMVAASSPLAHAAVWHHLASNMFNNAFSPSLNSLSNNNNNNNNSTNNISQLLSSAGGGGDNSPSSVANSVSNTTTNGNNDTTAATQQLQANKTNNNNSLYSQLQNALTTPTIVHNHHQQQQQQQAVRTPQLSNSAMLSA

SEQ ID NO: 128667 - protein, 82 aa, Heterodera glycines
  Coding regions on vcDNA: vcDNA=SeqID_55090; Strand=+; Position=1-332
RDSNVPLRPKNFSISGKKSKFFRKKYQSIELEKLRFGSGLRFSRENSLKNHKIKKPENRFLGLTRKILKIFEILKSGKIELI

SEQ ID NO: 128668 - protein, 389 aa, Heterodera glycines
  Coding regions on vcDNA: vcDNA=SeqID_55091; Strand=-; Position=1 -147,206-343,411-488,600-822,886-1039,1093-1343,1439-1617
  Homolog annotation: Hit_ID=CAH92685.1; Match level="QueryCoverage =68%, HitCoverage=67%, E-value=6e-26, Identity=32%"; Hit description =hypothetical protein [Pongo pygmaeus] emb|CAH92586.1| hypothetical protein [Pongo pygmaeus]
MKDKAKELAQNWVSANFKLFNSKNCGTKVWEKITANEGLPGRGGEYNAQINVGTTLGVLLDILVTYGGKLNLGIDGSNCEQKDFEIEPRKFPNEASEYRSKQLAAAQKKVDTINKSQKYWKAVIYEPFALLTDAELKKLDGVFPPIYGPQNQQLKTLETLNIETQYSNDNDLPRQFDAREKWPDCADIISTITDQGLCGCCWAVASASTLTDRICIARLKKGQKTSHYGGSYISAQFTCEFTPGSDGCKGGWPSMAWKFFHKETVSGSNYEMYDGCRPWTIDPIFAGTFFERLPILTMEYLFVGPEASWKTKRPNCKKECRIGWHQTVENEMADTPTVIGHECWIGWHFGNEQKMMREIMVNGSITASYAVYDDFQITMAADINQIYVV

SEQ ID NO: 128669 - protein, 428 aa, Heterodera glycines
  Coding regions on vcDNA: vcDNA=SeqID_55092; Strand=+; Position=1-1285
  Homolog annotation: Hit_ID=CAA82797.1; Match level="QueryCoverage =67%, HitCoverage=41%, E-value=9e-18, Identity=23%"; Hit description =gag protein [Ascaris lumbricoides]
MIEKKLTPGFLRTILTKKGEDPARWNTTKFRDVLNEAVRKETQIQEVMGEYGHSQQHPQQRPQAQRPNFSASKFRDRAPIPQQRERTFITSAVDDNHKRLINRQPQHRPQQQRPRAPQPQQRNLRTFNNQRQFPTQRTNATNNQRQFPTQRTNAINNQGQFPTQHANATFNQRKPPSPCIFCDNDHWNEECRKYSTIQQRREVLRTKALCFKCLKSNHQASNCPQPKRCFKCKQPHPTALCYADEKPPNQITAAMLGQTQQNVSITTQDGSNEPTASTSQMCNAVNGSDTRALLMTATSTVFNPAQPHLSMTAAIFIDPGSHTSFISAKAAQLLDLPVVHTEECHLTSFGEREPKRYISDLVKLGFLCTSGEKLIFNLNAMKFLVNDMPMIQLSELDKSELRQQKLNPPHEQRQPDIMLRIDVWHELP

SEQ ID NO: 128670 - protein, 99 aa, Heterodera glycines
  Coding regions on vcDNA: vcDNA=SeqID_55093; Strand=-; Position=1 -34,662-927
MVRMTKKTTKKNRHPDWDNRTLLEWFSEKRWTDEDNFPPFSEKHLQIIDQAVAEMKLLIRYAQLFGSDPSRIVFQPSLARGLDYYTGIIFEVVMKGHII

SEQ ID NO: 128671 - protein, 34 aa, Heterodera glycines
  Coding regions on vcDNA: vcDNA=SeqID_55094; Strand=-; Position=1-103
YCKDYSTHFPHLIISHWPLSIQSHLSIFTRFSFS

SEQ ID NO: 128672 - protein, 330 aa, Heterodera glycines
  Coding regions on vcDNA: vcDNA=SeqID_55095; Strand=-; Position=1 -32,79-354,415-841,983-1240
  Homolog annotation: Hit_ID=AAL78214.1; Match level="QueryCoverage =45%, HitCoverage=79%, E-value=1e-10, Identity=27%"; Hit description =putative esophageal gland cell protein Hgg-20 [Heterodera glycines]
MKKLHIHKKKIFISSDCWLLVFDLLEPSQLGLGIALVSHRFDFYVDEHFKTRRWALKAMEIKAKFEADGTNGWEIVNCDGKELPTPQKALPKKVVGFEAISINYIDQNAITFLQRFRQLFASSPINLFIYTDDDRTLEFILRKFWPMIAKNICAIQLPRYALSRLRRFVPSLLNDCPSLRVVNSNYADGFFAKFPCDDSAMASDGQALAKWLFTPRPDNVPKVFKCWLHPWWYGNLSSRIGAFKAAFANASSPVSFIVVIWRPPASVDPNLAFDLTNEVTQEQLTLKWMNDVGRFLLIRCPIVRDMDKWAKWEKEAIDWQFNGQWNRIDI

SEQ ID NO: 128673 - protein, 153 aa, Heterodera glycines
  Coding regions on vcDNA: vcDNA=SeqID_55096; Strand=+; Position=1 -204,417-674
MIARNICAIQLPGCFVPSILNGCTSLRVVNAYSDGFFAEFPADDSAMASDGQALAKWLFIPRPDNVPKAFANASSPVSFIVVIWRPPASVDPNLAFDLTNEVTQEQLTLKWMNDVGRFLLIRCPIVRDMDKWAKWEKEAIDWQFNGQWNRIDI

SEQ ID NO: 128674 - protein, 446 aa, Heterodera glycines
  Coding regions on vcDNA: vcDNA=SeqID_55097; Strand=+; Position=1 -47,107-382,440-866,1009-1143,1544-1594,3207-3365,4807-4959,5241-5333
  Homolog annotation: Hit_ID=AAL78214.1; Match level="QueryCoverage =33%, HitCoverage=78%, E-value=8e-10, Identity=26%"; Hit description =putative esophageal gland cell protein Hgg-20 [Heterodera glycines]
MSDNRKEAEEKMAKAIFISADCWLSVFDLLPPLQLGLGIALVSHRFDFYIDEHFKTRRWALKPMEIKAKFEADGTNGWEIVNFNRKPLPIPQKALPKKVVGFKRISIKHIDQNAITFLRRFRQLFASCPINLVIYTDDDRTLEFILRKFWPMIAKNICAIQLPRYAFHRLRRFVPSLLNDCPSLRVVNSNYADGFFAEFPADDSAMASDGQALAKWLFIPRPDNVPKVFKRWLPPWWYGNLSSRIGAFKAAFANASSPVSFIVVVWISAPLAFPAQFDLTNEVTQEQLTLKWMNDAALIGAVGPITVTPISKAFVARAVAKANKESNNTYQFVDLDVINVMVEPREEVYLYEVTILAGQTNCAKNALIARAIDKMNRESIKPFLYMPVNKILTVNTMHGNNYVMKMVVGESKCVKKEPLQPPPKIDYTNCEAKADPAAPKQALINS

SEQ ID NO: 128675 - protein, 80 aa, Heterodera glycines
  Coding regions on vcDNA: vcDNA=SeqID_55098; Strand=-; Position=1 -168,292-366
MAQQPTNIGTPYRLKNEKEKGKCRQEIKWTKRTEAFLKALSGTKIQWRMENNEKWLNMCTSQNSTNDISFDASRSVRHGS

SEQ ID NO: 128676 - protein, 41 aa, Heterodera glycines
  Coding regions on vcDNA: vcDNA=SeqID_55099; Strand=-; Position=1 -31,88-182
MQSKKKRRKLWFCHGKNAKKESKTNDEWKIMKSGGGATTFI

SEQ ID NO: 128677 - protein, 22 aa, Heterodera glycines
  Coding regions on vcDNA: vcDNA=SeqID_55100; Strand=+; Position=1 -30,325-363
MYGLFIAIQKKLFQWRNKMGKL

SEQ ID NO: 128678 - protein, 82 aa, Heterodera glycines
  Coding regions on vcDNA: vcDNA=SeqID_55101; Strand=+; Position=1-343
PFLSLLSCSSSSFLSCSSSSSFPDFLPLPSFCSSSDCFPQPLLPLFVIRQNSRVMQITVNSQMVKRVQPNHLIWSSLEWEIE

SEQ ID NO: 128679 - protein, 99 aa, Heterodera glycines
  Coding regions on vcDNA: vcDNA=SeqID_55102; Strand=+; Position=1 -58,421-483,528-706
MNASIALVPALASAIVPAPHPNSSPVIGLKMLQRNPFVDYEYLDDEKAAILGDGGKKTEGRGEESSVEETQLPEQYLDEEEEGTAIVCCPFSVKPKQQI

SEQ ID NO: 128680 - protein, 127 aa, Heterodera glycines
  Coding regions on vcDNA: vcDNA=SeqID_55103; Strand=+; Position=1-384
  Homolog annotation: Hit_ID=XP_223980.2; Match level="QueryCoverage =41%, HitCoverage=4%, E-value=2e-09, Identity=56%"; Hit description =similar to RPGR-interacting protein [Rattus norvegicus]
MKKCFYESALRTIDYLEAEFDQMKKEDDKMKGEREEEGKGKKKENEREKEKEETKKEEEEEEEEEEDGGSTFAIAKPPIIFVNDLTKKHPNINDEFTPTDGERKRWKKNGGGEKGVQRGKRREGKKE

SEQ ID NO: 128681 - protein, 404 aa, Heterodera glycines
  misc_feature (242)..(242): Xaa can be any naturally occurring amino acid
  Coding regions on vcDNA: vcDNA=SeqID_55104; Strand=-; Position=1 -274,327-439,488-568,611-727,1462-1608,1771-1809,1858-1935,1992-2108
  Homolog annotation: Hit_ID=CAE64156.1; Match level="QueryCoverage =99%, HitCoverage=72%, E-value=2e-71, Identity=41%"; Hit description =Hypothetical protein CBG08775 [Caenorhabditis briggsae]
IADLTKFVDVFAAWQNHTFGFRLYGMCQVQNSIFSHSNFLDVHWTFRRKSFVDDKLATFREFLDKTQYTEDNVASYEWIFGKDFISPGGIEENRRVLRRGIEENRRVLRRFRRLRPGQKMLDIGVGIGGGARQAAREFGLQVLGCDLSSNMIQHEFGLQVLGCDLSSNMIQHAFERNQRDKDHRVEYQIADAMVYRYEDHRVEYQIADAMVYRYEPNSYDIVFSRDCIQHIQVTERCFVRFXTWLKPGGQLLLTMYGKGHGVLQPKFHEYVRKRQYMLKTLDEYRETAHGAGFTNIFTENMTPRLREILEMERSRAIANGFTENMTPRLREILEMERSRAIANGDEFVKRFGKTLYDKLLEGWMDRFGKTLYDKLLEGWMDKLQFIDDDNQNWLLLRAEKPVHP

SEQ ID NO: 128682 - protein, 52 aa, Heterodera glycines
  Coding regions on vcDNA: vcDNA=SeqID_55105; Strand=+; Position=1 -63,785-880
MSKHGNYNTENVENRNSDSKKQTRKVNNRAVHQSLMKKEKMEQQQKLMKSVK

SEQ ID NO: 128683 - protein, 45 aa, Heterodera glycines; identical to SEQ ID NO: 124527
  Coding regions on vcDNA: vcDNA=SeqID_55106; Strand=+; Position=1-138

SEQ ID NO: 128684 - protein, 80 aa, Heterodera glycines
  Coding regions on vcDNA: vcDNA=SeqID_55107; Strand=+; Position=1 -113,252-360,621-641
LCGAFEHVPKHYFFPSVHDAVLCAQQMGGFIAPSIHMSVSLNGCRDLITLSNAASNHDITLNTETSGQSSANIPMLISPN

SEQ ID NO: 128685 - protein, 46 aa, Heterodera glycines
  Coding regions on vcDNA: vcDNA=SeqID_55108; Strand=+; Position=1-139
MVQYKLYYFDLRGLGEPIRLLLHYVGQQFEDIRFKDFEEWEKMYKP

SEQ ID NO: 128686 - protein, 47 aa, Heterodera glycines
  Coding regions on vcDNA: vcDNA=SeqID_55109; Strand=+; Position=1 -103,259-299
MPIEKDQNSVLNDRTYFKTVNDLTITKGHLFTYKELDRDPGQDFPGF

SEQ ID NO: 128687 - protein, 180 aa, Heterodera glycines
  Coding regions on vcDNA: vcDNA=SeqID_55110; Strand=-; Position=1 -198,491-542,602-659,835-949,1287-1352
  Homolog annotation: Hit_ID=AAH82658.1; Match level="QueryCoverage =92%, HitCoverage=7%, E-value=1e-40, Identity=49%"; Hit description =Unknown (protein for MGC:82480) [Xenopus laevis]
NNNNNSYAKHHRFMPKWCKVDDLGRPTPPPRHGHRAVTIKGLMLVFGGGNEGIVNELHVYDTSTNTWCVPDLRGHRPPGFAAYGMVTNQSKVFIFGGMIEYMVTNQSKVFIFGGMIEYGRYSNDLYELQINRWEWRKLNIQILEGQPKHPCPRLGHTFTPVNKQIFTTCDKKKISEAPNN

SEQ ID NO: 128688 - protein, 122 aa, Heterodera glycines
  Coding regions on vcDNA: vcDNA=SeqID_55111; Strand=-; Position=1 -61,274-350,721-813,1227-1361
  Homolog annotation: Hit_ID=NP_498689.1; Match level="QueryCoverage =63%, HitCoverage=31%, E-value=2e-10, Identity=44%"; Hit description =metaxin 2 (3I852) [Caenorhabditis elegans] gb|AAA28180.2| Hypothetical protein ZC97.1a [Caenorhabditis el
MADLSFVLEQRPNAEFMSPTGEVPFLRLQNTLVAEFFPIVDLVGKKGIRPSNTLSAAEQADIQAFCSLIEETLRNAEVRQRLLVAFELAAADAQTARNAQLFGGHRLDGPSNGQSGGAMRQM

SEQ ID NO: 128689 - protein, 209 aa, Heterodera glycines
  Coding regions on vcDNA: vcDNA=SeqID_55112; Strand=-; Position=1 -168,230-277,449-610,662-845,898-964
  Homolog annotation: Hit_ID=NP_741561.1; Match level="QueryCoverage =92%, HitCoverage=42%, E-value=3e-67, Identity=59%"; Hit description =tumor differentially expressed 1 like, possibly N-myristoylated (50.0 kD) (5H541) [Caenorhabditis elegans
MTSFFLLFMLLMLGVKSSRDGRAPIQNGFWFFKYLLLGLLIFGFFYLRDGGWATPMMWIGMLGAFIFILIQLVIIVDFAHGLAENWVSTYEENESRWCFAGMIFFSLLTYALSIASTVFMFLYYTSGASCALPKFVISFNFVLCFVISVVSLLPKVQERMPNSGLIQASMMSLYVCYLTWSALTNNPDKECNPSLIPRHNSTGDAGGNS

SEQ ID NO: 128690 - protein, 45 aa, Heterodera glycines
  Coding regions on vcDNA: vcDNA=SeqID_55113; Strand=-; Position=1 -27,390-500
ISSVLFSEKVLPSDLKNPPSSDKVPALTVGAHEFTCHVMPYLHIQ

SEQ ID NO: 128691 - protein, 172 aa, Heterodera glycines
  Coding regions on vcDNA: vcDNA=SeqID_55114; Strand=+; Position=1-519
MTDEEISDHYLKFLNLKNNLNDKTMNRSNQFKQKLTTASFYRQIVEFFKQHRTPNGKNEILNAKFKQFDGLISEFSQFSLFNNCKLWVFWRELVQLLKPDSSTNNDLENKVKNCEKIVNCFGQGWYTVKSDEYCNLYLQHFQQSHFEMLSHLLPNESERLPAYKIKLHILSS

SEQ ID NO: 128692 - protein, 358 aa, Heterodera glycines
  misc_feature (5)..(6): Xaa can be any naturally occurring amino acid
  misc_feature (17)..(17): Xaa can be any naturally occurring amino acid
  misc_feature (21)..(21): Xaa can be any naturally occurring amino acid
  misc_feature (219)..(219): Xaa can be any naturally occurring amino acid
  misc_feature (355)..(355): Xaa can be any naturally occurring amino acid
  Coding regions on vcDNA: vcDNA=SeqID_55115; Strand=+; Position=1 -151,219-289,354-422,658-753,887-960,1020-1158,1387-1456,1663 -1763,2267-2450,2572-2642
  Homolog annotation: Hit_ID=CAE58696.1; Match level="QueryCoverage =82%, HitCoverage=67%, E-value=5e-65, Identity=46%"; Hit description =Hypothetical protein CBG01876 [Caenorhabditis briggsae]
MGVEXXSPGAIIEEVRXLEFXIFSFKLSWLLNGPLSLLLVLSGIVLNALCVIVFVVIVFVRFRRSTTPIIHYYLSLAGWHSALLFNAFLLYCLPTMLWGSVVSSGPYVHLYPPTYALANATHTGTVWIILALTLDRYLALCMPFKHRIFSKRSRVKRLVVGLSIGALFFCLRVKRLVVGLSIGALFFCLPRFFEVQTAVECYALDGGAAALLSSAHAFXNQLYRTIYHILLGSAFVTILPGVLTFVLTLRISIALGEARHRRKRLSHCCAHLHSKLNFYLNLKNHFFRKEHRANVMLVVIIVKFLISDILPTVLDVFETVNLNIKYVYVKILKHFITKNKLFFCYLKNQFSLFLXTTK

SEQ ID NO: 128693 - protein, 81 aa, Heterodera glycines
  Coding regions on vcDNA: vcDNA=SeqID_55116; Strand=+; Position=1-246
MDAVDRCAISRTKDICTDLRECVTPIAEMMAAPIVVDLLRGPPLLVFKELKAKGRDAFFDCLGVLDFLTFILFFIFVWHYV

SEQ ID NO: 128694 - protein, 34 aa, Heterodera glycines
  Coding regions on vcDNA: vcDNA=SeqID_55117; Strand=+; Position=1-102
MYAPFLVIVGGVVVGLLLLILIISYLVYRLKKRD

SEQ ID NO: 128695 - protein, 87 aa, Heterodera glycines
  Coding regions on vcDNA: vcDNA=SeqID_55118; Strand=-; Position=1 -324,492-989
IIFIPKIFFWVFGAVPPNRCAQIYGETESFGNSFPIACTLILRWIFAPHNCLSTPNGHLKKSIYFCFRGSPPEPMRPDLWGDRILRE

SEQ ID NO: 128696 - protein, 39 aa, Heterodera glycines
  Coding regions on vcDNA: vcDNA=SeqID_55119; Strand=+; Position=1-155
WKKIPEGENLIKSIPSGDRAGCRGVSSAGSLHHGTEPFG

SEQ ID NO: 128697 - protein, 29 aa, Heterodera glycines
  Coding regions on vcDNA: vcDNA=SeqID_55120; Strand=+; Position=1 -3,141-225
MVKEFDGRLNTLLAQANHYSVPTLHGIMS

SEQ ID NO: 128698 - protein, 91 aa, Heterodera glycines
  Coding regions on vcDNA: vcDNA=SeqID_55121; Strand=+; Position=1 -83,448-499,1844-1928,2133-2188
MCRVGQLRQLMKGLKCQKPIGPGNNTDCAIHLIYFSYVCYYMRIWVEALDDKLGTLLAKVAHERRNTLYCAIIRFEPVGGDGFFAWAGLEP

SEQ ID NO: 128699 - protein, 45 aa, Heterodera glycines
  Coding regions on vcDNA: vcDNA=SeqID_55122; Strand=-; Position=1-137
MAAGPFCTNAAHRRPAENVAGYGEQMHCPHCCYCDHWYCEVVPAY

SEQ ID NO: 128700 - protein, 349 aa, Heterodera glycines
  Coding regions on vcDNA: vcDNA=SeqID_55123; Strand=+; Position=1-1050
  Homolog annotation: Hit_ID=CAG11601.1; Match level="QueryCoverage =66%, HitCoverage=24%, E-value=3e-09, Identity=23%"; Hit description =unnamed protein product [Tetraodon nigroviridis]
MSNSFFVFLPSNVTDYPDNQPNKFRVRLPKPLHFNGSWVCGLHSISYPYSWSTIGTLDDQWIDIHFTDRRASDEDRQRVIRVPVPRASHSKVEQLRDFLTVTLRNHSGAKLLPLPREEEENRNRTKPLGSPPPLKREKRAAPVINESGKQLDSPLLYDGNDQGGIDESPPHHEEEEEGTIQESPPHHEEEEEEGAIQESPPHYEETPKETVKTPVTPKVPTPPPVISPTKPSIVKTPAPPSDTTTSPPTTVKPPVTVPPPITKHNNAVRSSSHKAKDRASTNRATNNYPSSKHKTNNRPTADRKAKDRPSTSRTGNNHPSSKYTTNNHPFPDRKANNTDPSTASNKKSS

SEQ ID NO: 128701 - protein, 26 aa, Heterodera glycines
  Coding regions on vcDNA: vcDNA=SeqID_55124; Strand=+; Position=1-79
MASKIETKKQQVKLPHEGHLYTFDKM

SEQ ID NO: 128702 - protein, 44 aa, Heterodera glycines
  Coding regions on vcDNA: vcDNA=SeqID_55125; Strand=+; Position=1-131
YGTERLPVSDIFGVGIPTSEIFDEKSEIFLIFFFQKTSKFCTIS

SEQ ID NO: 128703 - protein, 28 aa, Heterodera glycines
  Coding regions on vcDNA: vcDNA=SeqID_55126; Strand=-; Position=1-84
MFNYFIPFFIIISNPFLFLFPFTNANPS

SEQ ID NO: 128704 - protein, 209 aa, Heterodera glycines
  Coding regions on vcDNA: vcDNA=SeqID_55127; Strand=-; Position=1-630
MLISFVKSDQKMQISEYSKQKYEAHLGIVHFMRKNWQCDKIEEKFEEYERTECQKYRKYFNILYECMYREYAGIPTVKPKFIFKKEIEIEGPLIYAANCLATISQFYFKKWVGQNYGYKLNEFFDDNFELKLLDVERLNYEVKLVNEPKLPINEMILQLAIDTANEWQTNESLDGILRENFGKKLEEMLKKAEKGKNKRKMAMMRMMMK

SEQ ID NO: 128705 - protein, 233 aa, Heterodera glycines
  Coding regions on vcDNA: vcDNA=SeqID_55128; Strand=-; Position=1-702
MGRIVELQRSHGEIRNAKIRLATGKVLSRPLNRLYPLEVTSSAEQDESHQQLTNPPLEEHHNRTQTADSSPICQLRDRRNSPGPTHSMVTRSKTKALASVLSILMCLFFGASQTNASSTTKPKRGNGLPIRCRGCELTCTKTGVDILIPNGIAKFLLCCADGTQCITQSGVRKSFHRLPKEHLLFDYDCEAMYWTKRGNKKLEASNVQAEMLASSSIVGYALNDWQIPIVDLT

SEQ ID NO: 128706 - protein, 140 aa, Heterodera glycines
  Coding regions on vcDNA: vcDNA=SeqID_55129; Strand=-; Position=1 -128,163-223,285-385,619-751
MVLTILAIFCLAFVHIGISGKYDKSDEHNGKYGAGPPNLHQFLCYNKQIGQKSCDNQFCECMERATAGKKRCSIWEGPGFCRHYRLYGESAYRAAAPPFWSSCGTVLNSEKYLGCPCGTYKTWERCGFLYLGYRYLCYSC

SEQ ID NO: 128707 - protein, 54 aa, Heterodera glycines
  Coding regions on vcDNA: vcDNA=SeqID_55130; Strand=-; Position=1 -155,414-423
MVAIPLVNLKMLSILLANGMGMVAIPLANGMGMVSIIGFITIRRDSEAFPKRTE

SEQ ID NO: 128708 - protein, 112 aa, Heterodera glycines
  Coding regions on vcDNA: vcDNA=SeqID_55131; Strand=-; Position=1 -35,292-436,495-655
GRLAKCGESNEAPLEAKGRPRPAMLQIHTVQPFQSAEKVKSPAPNAAADEAFLGQMREKKKVAGLIARFNAFAPTTATAVNNENAAGGGGSNSKKIGGAEPGKVGELRQKFN

SEQ ID NO: 128709 - protein, 60 aa, Heterodera glycines
  Coding regions on vcDNA: vcDNA=SeqID_55132; Strand=+; Position=1 -63,106-225
LREFVDGADFMERIQQIIREEVKALQVKAKRVDKREIEEERASPAFSFRLHMNFTKLFGF

SEQ ID NO: 128710 - protein, 65 aa, Heterodera glycines
  Coding regions on vcDNA: vcDNA=SeqID_55133; Strand=+; Position=1 -33,117-281
MGCAAAKTQFAALEDCLKGPAQYFNDISQRSSSRSANDDDEQDEEMAKMRALNEVCRQRAEEQNS

SEQ ID NO: 128711 - protein, 187 aa, Heterodera glycines
  Coding regions on vcDNA: vcDNA=SeqID_55134; Strand=+; Position=1-561
  Homolog annotation: Hit_ID=NP_055023.1; Match level="QueryCoverage =87%, HitCoverage=13%, E-value=9e-09, Identity=24%"; Hit description =dentin sialophosphoprotein preproprotein [Homo sapiens] sp|Q9NZW4|DSPP_HUMAN Dentin sialophosphoprotein p
MTTNDTDKRTTDETEENKMMTNDTDKRTKNDLDKGTTDVSDKKTTDDMEEDKMTKTKNGRDGTSTIFVNTMENDEKSPSSSSSNSSSSSNYQNMDAHPAMDEKQDEEEDEDELPSPASSNERRDDNGIFCSSTTMKNNNETSPPTSSSSLVTDRKNISIPSSASSSSALALVNDDGRKMGAQLVVPA

SEQ ID NO: 128712 - protein, 172 aa, Heterodera glycines
  Coding regions on vcDNA: vcDNA=SeqID_55135; Strand=+; Position=1 -26,199-538,1276-1425
MPRFSTCSGTARVTVNVRLADLTEQEAEREREEAVRERQLDQQHHNQQFEVQQDEPSAQLEADEEEEQDSAVDDRHQSRMSPQHTAQRQRHNNFDRDSDNNRRAHAVPTLALDGTGAKQPLQIEFAVEEGIAGFVGVDANTGRLFVGPWLLRDRFEEIRFSVAAQHPSGQVL

SEQ ID NO: 128713 - protein, 361 aa, Heterodera glycines
  Coding regions on vcDNA: vcDNA=SeqID_55136; Strand=-; Position=1 -99,217-429,474-632,1001-1339,1817-2092
  Homolog annotation: Hit_ID=NP_503136.2; Match level="QueryCoverage =90%, HitCoverage=17%, E-value=8e-12, Identity=23%"; Hit description =putative protein, with 2 coiled coil-4 domains (5A595) [Caenorhabditis elegans] gb|AAD14762.2| Hypothetic
MALFLHWEFAESHLDVGTIIYQLRTRFARFKVQFKKNSVFNSVQKEVSKELRCKAQTKIEGMLLKCKVHFCLALRFNDSPKDVAWLSNYFLAKIGEKLGEQPEKVLDLYYHCALALEEEGIQYLTKINRVKQVIMDDSPVRFGLRHFGYFDTVICQETYFEPLEIHYKVHAYALRYLKALNSSSFPPRTSAQCATDLANIHAYLTLFRYHGVQRRCLEDSHWSVSEFYDKQSILDKSALDKNNRQISEQPKSIDGRQLTAEMDNGEIEDVVHSLCCASELQHEIVRMCRTAFDIILLRFPHYKAYFRVARAFFDEKNFARSTDILFDKLFLTGRKQRCNNFLEVQWKMWMNPMYFCSFLSK

SEQ ID NO: 128714 - protein, 509 aa, Heterodera glycines
  Coding regions on vcDNA: vcDNA=SeqID_55137; Strand=-; Position=1 -156,512-700,849-1117,1221-1636,1790-1901,2052-2301,2480-2616
MRQSLMSDEPNAMTLLEQIATTETEISENQNAMERGDTDEQQPQNNESHNEQATIWDRQGVSMSQESEAAAGTTAMPETQDEISLRRSTRLFDDLDYFGNSNKQRQTQANDSRMDALTLMGFDEQELEEHQASVSNHRQSMQFMPDAINSPQQLSSVDELFVKLIDETSFETTKFPDVLYTFLAWVAFEQQPFVVLTLEQVEAYRDVYARWSSLFCLSNCSFTESDLAIHQLAAELGSHRALSILQAFYGRLLLQQKQKATAHASNGKTIPIRENAEENGNVTEYQFHRQTSVDDDGHAQQKLLLTSDNDALFRWVFHRIQAEQRQTRQTVAGNNNNNSRSPTVIGRNESINKNDDNHLGQPKDCSELSTIRRQLEVRYKWLIANLLPDELSLPNSEAFHFIHTYTQLTSALALMEPEWALLSHAEFDLSCLTVRNLKELLRKRVRQFQLQQIDYLIEAKRYEELKNVLLHQYDWTSDSEDAHIKQKLLMIQCIRETDNSLLDIGEWIS

SEQ ID NO: 128715 - protein, 272 aa, Heterodera glycines
  Coding regions on vcDNA: vcDNA=SeqID_55138; Strand=-; Position=1 -106,267-478,958-1233,1401-1625
MFPPILTNRTLNSTNSTPLNDDDGLQQHSHSLSPISQSVAVNVHTDSSLAASTVKEASNTQFKLFYTCPDCPRDQSPVRSECSDYVDDDWSSIEDGDNPRTSREAQEAEIEDKYRSALNFLQEGNIERAVSIFSALLVHPVMSKYHIADWSTFDWQKSMTAGDGTSSQRIVPNMAKLYFNINLAMSGLAKDPFQFYVQALSIRPDFKDLWFNCGQCAIRRRDWRSAAFCMTQCEDEFRALEALLLVHYFNNDYLSNLQFCEKKNWVKFIYIF

SEQ ID NO: 128716 - protein, 189 aa, Heterodera glycines
  Coding regions on vcDNA: vcDNA=SeqID_55139; Strand=+; Position=1-570
RLIEPVKSFRMISRLFYSVHNFKSYIDSKLAQTELARRSWPDGVGQTELARRSWPDGVGQTELARRSWPDGVGPFGVGSDGVGPKTELAQTELARRSWFRRSWPDGVGQTELAQTELAQTELAQTELARRSWPDGVGSDGVGPKTELARRSWLRRSWPKTELAQTELARRSWLRRSWPDGVGQTELAQT

SEQ ID NO: 128717 - protein, 81 aa, Heterodera glycines
  Coding regions on vcDNA: vcDNA=SeqID_55140; Strand=+; Position=1-484
FFAYQIFAINAHLFKKYSILLKCSVFCYILRIAVHLKASVIEQISQISRKVQAVAVKIVYIKTMAIRISALGPFSKLMCFY

SEQ ID NO: 128718 - protein, 51 aa, Heterodera glycines
  Coding regions on vcDNA: vcDNA=SeqID_55141; Strand=-; Position=1 -53,505-607
MANWQMRERTKAGTMYKCRKLLLVKGKAHANANGNGNEQFDEPLKSKFDMI

SEQ ID NO: 128719 - protein, 295 aa, Heterodera glycines
  Coding regions on vcDNA: vcDNA=SeqID_55142; Strand=+; Position=1 -391,443-493,543-608,661-718,772-956
  Homolog annotation: Hit_ID=NP_506118.1; Match level="QueryCoverage =89%, HitCoverage=55%, E-value=4e-54, Identity=43%"; Hit description =putative protein family member, with at least 5 transmembrane domains (5M911) [Caenorhabditis elegans] em
VEKYILSLKFKFRLAICPSPLSQYEMYTLARFLFLSLSSVLALFGAAANAMLFVLFSSRAASNTPATLYPRVLALLDASICAGYILLFGADAAVIYLRIRPLFLLYHLYIVPAFVLSRICQLAIPYMLIFATLERLVWISSGKILIFATLERLVWISSGKISLLRRMYSVSLLRRMYSVKGRHITVVISSFLCAILRLPTYWCAILRLPTYWATTVHEYPQCDDFFRTKTAGPACDDFFRTKTAGPADWVMNSRFFYVYDFHLLSIAQTVFPFFVLVAFNLVCSRLFLFLSPLPF

SEQ ID NO: 128720 - protein, 348 aa, Heterodera glycines
  Coding regions on vcDNA: vcDNA=SeqID_55143; Strand=-; Position=1-1045
MQNQPPKHPSLFSIDQILSAPSKKPRRGFLINELLGEVLQEGGSSSSSSSSKSAKDYVKKLDSTIEHVPRFQYSKVKSRFSIEDVPAANPEGLLAGIFQYCLDAAMEESRGRGIEPTHLGCMISSSLLTGGDIPIPVRQITDNTVNTILNQFTKVAQSKQQQNVTLWGEPFTVVVTTVDRTGLPGRRVLKGGARRSLAPVHHKVTETCLIKVQTSQRKNNLSENFVKICNPDGHCLFYALQATMVDKTCGWPRWRFYDYLHSRRGQQGCLRRDALQLMQQIGVQTGRNTYDAEICVPRVVDHWNNTQQQQRFAVFIFGSSGQYKPLYKYINDHYDTPIVPYLNNQHFD

SEQ ID NO: 128721 - protein, 297 aa, Heterodera glycines
  Coding regions on vcDNA: vcDNA=SeqID_55144; Strand=+; Position=1-893
  Homolog annotation: Hit_ID=NP_510849.1; Match level="QueryCoverage =98%, HitCoverage=21%, E-value=6e-84, Identity=49%"; Hit description =predicted CDS, zn-finger, CCHC type and RNA-directed DNA polymerase and Integrase, catalytic domain conta
MELDEESKHLCGINTHRGLFQCQRLPFGVKSAPSIFQHLMDQIVSGIPGAFAYLDDGIIASKTLDEHISSLYKLFKRIQEFGLKIQWEKCKFLQPELLFLGHVISAKGIRPDPGRSEAIRQMPPPHDLSTLRSFLGALNYYGRFIKSMREIREPLDQLLRKDVKWEWTDEQQTAFKKAKEIMLSDLLLTHFDPSLPIVVAADASKDGIGTTISHIFPDKSEKVIEHASCTLNDAQKNYSQIEKEALALVFAVQKFHRMLFGRKFTLLTDHKPLLAIFGSKKGIPIYAASRLQRWALI

SEQ ID NO: 128722 - protein, 21 aa, Heterodera glycines
  Coding regions on vcDNA: vcDNA=SeqID_55145; Strand=+; Position=1-65
MAISFFSWGFDRKLGTNICLL

SEQ ID NO: 128723 - protein, 19 aa, Heterodera glycines
  Coding regions on vcDNA: vcDNA=SeqID_55146; Strand=+; Position=1-59
TFAFSSLALPNTHTIFEML

SEQ ID NO: 128724 - protein, 19 aa, Heterodera glycines
  Coding regions on vcDNA: vcDNA=SeqID_55147; Strand=+; Position=1-59
TFAFSSLALPNTHTIFEML

SEQ ID NO: 128725 - protein, 19 aa, Heterodera glycines
  Coding regions on vcDNA: vcDNA=SeqID_55148; Strand=+; Position=1-59
TFAFSSLALPNTHTIFEML

SEQ ID NO: 128726 - protein, 19 aa, Heterodera glycines
  Coding regions on vcDNA: vcDNA=SeqID_55149; Strand=+; Position=1-59
TFSFSSLALPNTHTIFEML

SEQ ID NO: 128727 - protein, 19 aa, Heterodera glycines
  Coding regions on vcDNA: vcDNA=SeqID_55150; Strand=+; Position=1-59
TFAFSSLALPNTHTIFEML

SEQ ID NO: 128728 - protein, 74 aa, Heterodera glycines
  Coding regions on vcDNA: vcDNA=SeqID_55151; Strand=-; Position=1 -128,879-926,1080-1128
MAKGMTMEMATEMAMEMATEMEKARGMATEMAKGMEMEMATEMEAYKAKESQANSDERITLTPVDFVDGEESYY

SEQ ID NO: 128729 - protein, 54 aa, Heterodera glycines
  Coding regions on vcDNA: vcDNA=SeqID_55152; Strand=-; Position=1 -50,291-404
MGVEPRQKSQRMNQIRLMVLCLVKHWRQVAYLMKDGLLLIVVENIIDLTAARLQ

SEQ ID NO: 128730 - protein, 94 aa, Heterodera glycines
  Coding regions on vcDNA: vcDNA=SeqID_55153; Strand=-; Position=1 -80,231-294,581-676,1220-1264
MDVYREMRAKEKCKGKTICLCEAKNFPQSYLKGVCCVVWGQECDCCKTDPEVLQQSTVLSRRMFLISFSILILSLGSASKVREFRNLVTFLLHD

SEQ ID NO: 128731 - protein, 233 aa, Heterodera glycines
  misc_feature (233)..(233): Xaa can be any naturally occurring amino acid
  Coding regions on vcDNA: vcDNA=SeqID_55154; Strand=-; Position=1 -132,177-277,328-376,457-528,573-657,712-812
  Homolog annotation: Hit_ID=NP_500802.1; Match level="QueryCoverage =98%, HitCoverage=97%, E-value=5e-38, Identity=41%"; Hit description =putative protein of eukaryotic origin (4G158) [Caenorhabditis elegans] gb|AAF60946.1| Hypothetical protei
NPMNKWRLDLCGSAGSRTCAAADQSLNPPGYNPGLSTTQQNESANRAEQQQQHLLSKRAWDLTTQQNESANRAEQQQQHLLSKRAWDLALQPVKSLPMNMFMMYMAGNTISFMMYMAGNTISIFPIMMVVMMAWRMVVMMAWRPMKTLMSVNAAFKPLEQEHVGSLWIHQEHVGSLWIHKIVFALGNLCAIALAVYKCHTMHTMGLLPNHASDWLDFVPPLERAQYALFNDIX

SEQ ID NO: 128732 - protein, 758 aa, Heterodera glycines
  Coding regions on vcDNA: vcDNA=SeqID_55155; Strand=-; Position=1 -139,183-462,514-1165,1272-1344,1391-1570,2322-2729,2989-3172,3267 -3431,3874-4069
  Homolog annotation: Hit_ID=NP_506376.1; Match level="QueryCoverage =18%, HitCoverage=51%, E-value=2e-44, Identity=65%"; Hit description =nadh dehydrogenase (26.2 kD) (5O106) [Caenorhabditis elegans] emb|CAB01203.1| Hypothetical protein F53F4.
ISIDPVPKVCHYFHFHSVWLIFVDFVLLLLVAFFILFLSKAKNDSKKNGKKGPQMDQMLVDETLNNSSLPDIGKNEAKFRANEAMVRDEQGQLSFSQRFVDGLTRQISPLFLLFAYFGCVLSFYPLAEMDESDLLSAQINCSLSALSNDRWKGNEHLENCRAIPRIPFWHYANSLAVVFHLALTLCVVSYYLTKLHKSKNDEKAKSGEEAEDDDNKNEFEMDTLENGEREERRRTNGPRTNPSSSDSNCRASVADSMYSNGYAAIDCMGWPMGTELMIHSLASTTNSILHNVGRNRRRKLSSLEGARGRHRSRVERGQLSSLRQNGPNDGPLGMHAATPSLYSESLSAEYELRNQQLLPVAAPTPPAPVIIVHHWHQYCPTDGVHSPQNCGSHQPNEGGGRTEFAMGKENEINGPEGNSGTNGMEEGTEKVKEEEEETTSEAHGLQVHRDNERNNPNTPFQFTEANLAKITVLLNNFPEGHKGAALIPVLDLAQRQHGWLPISAMHEVARVLGRPTFTLQLVNCFLEMPRMRVYEVATFYTMFNRDPVGKYFLQVCGTTPCMLRGAEAIIEAIEKKLGGQATFARAEERPFSRRAPRQTNDADGDTAGARLWASAGIVKIDVERLKRRNRLPSLFGTQTIKRISLKFLLKILMEAEADFDSGLLSTEVSHRRRSASVSEDYSVQKTNDDATECELITVFLKLGYYSDRFIPAFIHACNSEKPHHRDPEITRGYWARTNAITSMVVQFVQALSVPIVSD

SEQ ID NO: 128733 - protein, 62 aa, Heterodera glycines
  Coding regions on vcDNA: vcDNA=SeqID_55156; Strand=-; Position=1-186
MGFIIDDMNKCLYRKDLLMCLELSDEAKKTFQIVEKYREDVGTAYRNAYTQSDLGIGELVDK

SEQ ID NO: 128734 - protein, 25 aa, Heterodera glycines
  Coding regions on vcDNA: vcDNA=SeqID_55157; Strand=+; Position=1-76
MASKAFGVAFVWRQPNGGQMVLLRF

SEQ ID NO: 128735 - protein, 491 aa, Heterodera glycines
  Coding regions on vcDNA: vcDNA=SeqID_55158; Strand=-; Position=1-1475
  Homolog annotation: Hit_ID=NP_496808.1; Match level="QueryCoverage =55%, HitCoverage=11%, E-value=8e-38, Identity=37%"; Hit description =integrase, catalytic domain containing protein family member (2N547) [Caenorhabditis elegans] emb|CAB0249
MPPLPSMRVKPANPFEFVGLDFAGPTPSRLSDGSLTKAYLVIITCFVTRAVYLEATTDLSAPSFINVLRRFFSRRGRPRRILSDNAPTFVQTSKALDILTGPSAETDPVTFAARRGIQWDFIPAYCPWMGACYERLIGLVKSCIKRTIGRRILDYDDLSAFLAEIEASVNSRPITWVSDQPDSAKPLTPKDLIQPGLLNDLDIVDSDLDYDDCLSGPERLAALWKAYREAADHFWLKWSHEYLLAIRERAAWTHKGPRLRTPATPHIGQVVIVETPEPAPDATVPIPSDQSPSDSKNVEMSVHEMPPVPSLSGEPTISKHSGMLTRRKSRLFAIPPTTTMTIATLVTLLWVQASPAQGIWPFDPDRPESPLTSNCVGNHVNCTRKGVKISSNPAVQKVTICCSNACFDRLAASEISYELSSDLLVNEYVCSATFGLSSTRSCTAEIACPAVNECELIDCSICIDRPANWRCNPRLSLVLLLVIGSLISCLI

SEQ ID NO: 128736 - protein, 388 aa, Heterodera glycines
  Coding regions on vcDNA: vcDNA=SeqID_55159; Strand=-; Position=1 -240,290-352,400-464,511-657,730-790,844-926,1271-1339,1440-1592,1641- 1679
  Homolog annotation: Hit_ID=NP_506353.1; Match level="QueryCoverage =99%, HitCoverage=71%, E-value=1e-104, Identity=51%"; Hit description= rhodopsin-like GPCR superfamily (5O12) [Caenorhabditis elegans] emb|CAB01134.1| Hypothetical protein C56
ICSDLQHEDYSPLYAWFNYIVIIIMLPSLSAFGVITNVVNVFVYSRSRMRNSSNTYLLYLACSDFFVVITGLFIFWVDSARSYIPQLVQSPYTTVRSYIPQLVQSPYTTVYTLPFGYMAQSCSIYFTVAAAFDCYMAQSCSIYFTVAAAFDCYVCVCWRSNAKRHCTVKRAQRIVGCYVCVCWRSNAKRHCTVKRAQRIVGCIVLASVLYNSLRFPQFNLRHCIHEGSKEMIVEICPTEMIVEICPTTLFFNINTVYNVYLYMIVMTLLYLYMIVMTLLPFSWLLILNVLIIWCKSTLAQFPPLPKATPGSDETITMIMVVVLFLCCNTLALIVNLIETFFEPDALLLNLLSDASNFLVIFNSSVNCVIYLIFNSLIFNSDYREVFLF

SEQ ID NO: 128737 - protein, 46 aa, Heterodera glycines
  Coding regions on vcDNA: vcDNA=SeqID_55160; Strand=-; Position=1 -134,179-212
RSSILPFPLQVYYSLFTSLLSVCLGKTSINGLMHRSRMFIFSPLPS

SEQ ID NO: 128738 - protein, 96 aa, Heterodera glycines
  Coding regions on vcDNA: vcDNA=SeqID_55161; Strand=-; Position=1-291
  Homolog annotation: Hit_ID=AAG00551.1; Match level="QueryCoverage =93%, HitCoverage=35%, E-value=1e-09, Identity=40%"; Hit description =retinitis pigmentosa GTPase regulator [Homo sapiens]
MKIAVGKEERRKRKRGKGKIRRKKEGEKEEEKDDNSIGEGGESEEKERKRKNSKKEGEKEEEKDENSSGEGGETEEKERKRKNSTEEGGGERGGKG

SEQ ID NO: 128739 - protein, 32 aa, Heterodera glycines; identical to SEQ ID NO: 126386
  Coding regions on vcDNA: vcDNA=SeqID_55162; Strand=-; Position=1-96

SEQ ID NO: 128740 - protein, 191 aa, Heterodera glycines
  Coding regions on vcDNA: vcDNA=SeqID_55163; Strand=+; Position=1 -35,445-901,966-1049
MSDHPDAALADLYVDLEVITFLQCLQRVLNLGTALQFTIHSKDVRCWALMSQRIWPLIAHAVTTLHDMKDVDFALLRRHVSPNVLFDCVKLRVITNTHMFPVQPPSSAVHINELLQPPATFNEKPKHQLLRWLHTPLPDGSPKILTIRKWRRAHWSTLTSSLRTYFEAPSAIAVNYVVACHRASRRNIEGR

SEQ ID NO: 128741 - protein, 178 aa, Heterodera glycines
  Coding regions on vcDNA: vcDNA=SeqID_55164; Strand=-; Position=1-535
MADSWQTETKDSDEGGDRTNSAHENESGNENWRLSAYQTQSTEEVPLPDDLSAIPVPTEQEMNPAWLKAQEALRSIGGRPDQHQQQHEQPQQFEGGSYEAAAALYGWPPTMGSSFNSYYHHQQQHMAYQDQQYQQPQQQQYRPQRPQYRQQFRPKLTGGGGAYNSNGRPVPLAQVSVP

SEQ ID NO: 128742 - protein, 474 aa, Heterodera glycines
  Coding regions on vcDNA: vcDNA=SeqID_55165; Strand=-; Position=1 -812,857-1466
MRVIRTPPLTRTRALNHGIVVDRDGNAHRTGNFEAFGNRPNSPLASNENESIANGNDVNDLERTANRRLIGVGMELSANDEQLEYEEMDADNEQNANGVVLQQNLRENVGNQVWGEQIGGVVEVGTVNANANDGPIFSTPHDSRDFGLLQRDLRLHFSENLSLIPDRNQRRDMNVMQNQQTGHSRNNFTAIERPQPNSYRMNQQLYENAPGNAERYRPLQGVRPVVAENQHHLVRQNPPPHAYAHNDDYYAQRFKAQNPQQAPQFQITTRISQSTPDWVFDGMMAQAIRSLDSFSYTMTLNSIPNLDGTSGSDAVNAFFKQFDVATEEWPEHKRLRALRSKCFGKAERAYNSAIAENPHEYQLIRRIIIRQLDDTDAKQLTSFDQLMRGIRRRPNESVDELGNRISGLVRRAYPGLTEQQYDDYSIMHFIRAISNPELAITLEMTRRPGATFDEFIAQAARAEATQSAARNSFR

SEQ ID NO: 128743 - protein, 397 aa, Heterodera glycines
  Coding regions on vcDNA: vcDNA=SeqID_55166; Strand=-; Position=1-1194
MDVKKFGNPLYTIDEETYLQFFKENLLLILDSARKNAEISRAETKNRYDLRPNVSMNKFAVRDRCMVIYPGSKSKTQHKKLHWNHFGPYEIVKTLESSASVVPVDKKSAEPITVPIERLVRVPIGVPDISTLPHGKNPYRNILATILLASLKLSKLDTKGIFGQFEPLLQTQFGENSLKSSEKIVVNQLGTTDNLGERKMQQRQQKENDGLSWTMKCEGETHEFCGKILCGELDPVLDAKTEPGNVEIGTPLQALLSLFILRSGATVSSSAAKNLVQLILGTEPGMELVVYEGVRKDNVRAGIFPNHEDVERVWILWCEKCAVAKKLLQSSGFDQIRVEKRCKNSTENSELLQVVVPEAVSKLPDTERDGWGSLLEETGWTLEKVRAQVIHRCRIFV

SEQ ID NO: 128744 - protein, 411 aa, Heterodera glycines
  Coding regions on vcDNA: vcDNA=SeqID_55167; Strand=-; Position=1 -42,252-1442
  Homolog annotation: Hit_ID=NP_498959.1; Match level="QueryCoverage =55%, HitCoverage=10%, E-value=1e-27, Identity=32%"; Hit description =zn-finger, CCHC type and RNA-directed DNA polymerase  and Integrase, catalytic domain containing protein
MSELPNLCTHPKTPFGVPKRLHSDQGKEFVNETLNGISAILGIEKTTTAGYDPQANGAVERANQTLINMLKKSTSSHWSWDERLPFVMFSYNTTPSEVTGYSPFHLMFGKIADFPGEMDVKKFGNPLYTIDEETYLQFFKENLLLILDSARKNAEISRAETKNRYDLRPNVSMNKFAVGDRCMVIYPGSKSKTQHKKLHWNHFGPYEIVKTLESSASVVPVDKKSAEPITVPIERLVRVPIGVPDISTLPHGKNPYRNILAAILLASLKLSKLDTKGIFGQFEPLLQTQFGENSLKSSEKIVVNQLGTTDNLGERKMQQRQQKENVGRSSPAMKCEGETHEFCGKILCGEVGPVLDAKTEPGNVEIGTPLQALLSLFILRSGATVSSSAAKNLVQLILGTEPGMNWVVYEG

SEQ ID NO: 128745 - protein, 79 aa, Heterodera glycines
  Coding regions on vcDNA: vcDNA=SeqID_55168; Strand=+; Position=1 -45,350-493,1059-1109
MSVRKCRSANVALRLFGILNTFKNNLQMLQMLFKRLRRDQNIIKINEDKIIDQIFKKTRHESLILLYHPARAGLTTRQA

SEQ ID NO: 128746 - protein, 289 aa, Heterodera glycines
  misc_feature (287)..(287): Xaa can be any naturally occurring amino acid
  Coding regions on vcDNA: vcDNA=SeqID_55169; Strand=-; Position=1 -813,2781-2836
  Homolog annotation: Hit_ID=DAA04499.1; Match level="QueryCoverage =96%, HitCoverage=20%, E-value=2e-65, Identity=44%"; Hit description =TPA: pol polyprotein [Schistosoma mansoni]
SMMLQDYLSRGLIRPSKSPWASPIVLVPKRDGSLRFCVDYRGINSVTVKDAYPLPNIDYILLALGGKKYFSTLDFLSGYWQIKMDEKSIEKTAFVTEFGLHEFTVLPFGLCNAVATYQRFMSRLFEDLINDFVFVYLDDILVASETFEQHLKHLKIVFERIQDAELKLKIEKCRFSAEELPFLGHVLTRQGLKMNADKIRPVIELPIPTTKKQLHSFLGFMTYYRKFIYGFGEIAAPLFHLLKKNTPFVMGEKEKLVVDKLKEKLLQDVVRAMTKWTESGGAGQKEXDE

SEQ ID NO: 128747 - protein, 88 aa, Heterodera glycines
  Coding regions on vcDNA: vcDNA=SeqID_55170; Strand=-; Position=1 -182,318-402
MPNCLAVVLLPPSNVNGIYKGTRALTYEVDTVGPYHISSLMITKNTRLNLYLARNIRAIMLMILIGLVIIAFVTFCLLLSFISFRGIF

SEQ ID NO: 128748 - protein, 157 aa, Heterodera glycines
  Coding regions on vcDNA: vcDNA=SeqID_55171; Strand=-; Position=1 -38,290-725
MFKSSGKMVFWQRYTSNFLRDIALDSPVERLYGAHRGRQNGQFGRSKPSMAGPLNGHLLAFSDARVPIEDGIELGKCYWGEEAQEPGTIWPHLAKVPSVVAVDSLSGPARLSFVDVEKVLIEMRKRYPKHLVFLGTCVLEYAEVSQWDFLCGEMEMF

SEQ ID NO: 128749 - protein, 31 aa, Heterodera glycines
  Coding regions on vcDNA: vcDNA=SeqID_55172; Strand=-; Position=1 -19,894-970
MESLINIQLIDPSVANLTQLKPEANMKKCGI

SEQ ID NO: 128750 - protein, 129 aa, Heterodera glycines
  Coding regions on vcDNA: vcDNA=SeqID_55173; Strand=+; Position=1 -130,694-953
  Homolog annotation: Hit_ID=NP_500150.1; Match level="QueryCoverage =100%, HitCoverage=20%, E-value=3e-14, Identity=34%"; Hit description= SUMO/Sentrin/Ubl1 specific protease and SHQ1 protein family member (4C733) [Caenorhabditis elegans]
MPKKTPGEHFARLEMLTELLRPQEPNAQRMVEELDGGADELGGDNDSIDCFAQQSLPEDGPTTSSSAATALFGYGFGWQRHGVLGRLLADIGQGELPIDLEDPDGTPIDDRLECLHAFDADHFRPEHYL

SEQ ID NO: 128751 - protein, 160 aa, Heterodera glycines
  misc_feature (2)..(2): Xaa can be any naturally occurring amino acid
  misc_feature (149)..(149): Xaa can be any naturally occurring amino acid
  Coding regions on vcDNA: vcDNA=SeqID_55174; Strand=-; Position=1-494
  Homolog annotation: Hit_ID=AAP92584.1; Match level="QueryCoverage =78%, HitCoverage=25%, E-value=2e-35, Identity=63%"; Hit description =Ab2-057 [Rattus norvegicus] gb|AAP85373.1| Aa1262 [Rattus norvegicus] gb|AAP85367.1| Aa1011 [Rattus norveg
DXQMSFFMIRCGAWPFLVRGAICLVYSDNERDSSLLNSWLIASGHNFLEGFSVFSRTKLSNNRSVMPLDVRGCTRATLAKSACLPSPKGVGKPVKICRDWDRTLQLLSVNEEFLVGASHQLALNTSLPFVHTARRCPGLSHFEKFGDGXCSGRSVCRLEP

SEQ ID NO: 128752 - protein, 53 aa, Heterodera glycines
  Coding regions on vcDNA: vcDNA=SeqID_55175; Strand=+; Position=1-160
MIQQQVHLQLPCYDFCPVQATAIKSVPVCIPTEAGTLTVPEFLEMAQSRAATG

SEQ ID NO: 128753 - protein, 51 aa, Heterodera glycines
  Coding regions on vcDNA: vcDNA=SeqID_55176; Strand=+; Position=1 -104,136-184
AGPGILGKTGTGTCRDLRSRDRDLDFCSGPGTGTNREFLKIQKNSKNKKNS

SEQ ID NO: 128754 - protein, 229 aa, Heterodera glycines
  misc_feature (181)..(181): Xaa can be any naturally occurring amino acid
  Coding regions on vcDNA: vcDNA=SeqID_55177; Strand=-; Position=1 -207,438-623,858-916,1074-1173,1284-1379,1452-1486
  Homolog annotation: Hit_ID=CAE74609.1; Match level="QueryCoverage =67%, HitCoverage=28%, E-value=2e-35, Identity=47%"; Hit description =Hypothetical protein CBG22398 [Caenorhabditis briggsae]
LIFSLRLVIFNSISQQLRGVSSNASAFQQVSSTSLLSVTKKTPEQLRAESEECYKRLDLTFQNAEEAFKSKTNSELVRAQLVFAFCQNNWIVQNNMSLMRLARKMLGKRAFNALMRSTFYGHFVAGEDIGEVSKTATRLQRFGVKCILDYSVESDISEEEAKEKAVEGLDEEETQPLPPVXAVNAELVDQTHKQFTVHKEFGDRREHVVSARTYFYENENVNFCDFFTF

SEQ ID NO: 128755 - protein, 152 aa, Heterodera glycines
  Coding regions on vcDNA: vcDNA=SeqID_55178; Strand=-; Position=1 -117,263-397,477-676,1055-1061
  Homolog annotation: Hit_ID=CAE62053.1; Match level="QueryCoverage =78%, HitCoverage=94%, E-value=3e-20, Identity=41%"; Hit description =Hypothetical protein CBG06071 [Caenorhabditis briggsae]
RKIILMKPDQKSAKNTATAEDQQQINRFARLHKAYSAAKEKLISLDNDVNNLNDASDEILLMDDEAAADSIPFLVGSVFVHFDQDTVNGRLELLKVSTQAEMDALRSQVGTMERELGELRAVLYAKFGDNIHLETEEDEESGDATRRNGRYV

SEQ ID NO: 128756 - protein, 15 aa, Heterodera glycines
  Coding regions on vcDNA: vcDNA=SeqID_55179; Strand=-; Position=1-45
MPPCPPCMPTFCPPP

SEQ ID NO: 128757 - protein, 385 aa, Heterodera glycines
  Coding regions on vcDNA: vcDNA=SeqID_55180; Strand=-; Position=1 -340,639-1456
  Homolog annotation: Hit_ID=CAC83675.1; Match level="QueryCoverage =75%, HitCoverage=55%, E-value=4e-12, Identity=26%"; Hit description =mucin 5 [Homo sapiens]
MNAALEQLFQAAGMDSSALMMGLGSMATAPPPKPAAPSSSLQQHHQQHHSQQKSIVTSAAANMRHHHSSAAGATATASSSVVSAGGSSTTGAVSAVGTTPTKTVLTKVETAKTISLPLVTSMTDGITTQLKQQQHRATESPARKLGMSSIGGAGKGLKLNAVLEKLNASSSSSSTAPPATTNSSVATTPTIPTVTVPLPPTTPTIATVPPLPSSSTTVADVVVDTVPSSSTTTTEKQAEAAAADIVESAAPAVVQQQQTDQKDDDNDRTTTEPEEPKQQQQQVETVVAANVEADQQQQEQKAAIAVPPETVTAPKSGTECDGDDHEHDNDDGGGKHGQEEEEEDKQSSSSKLVMADDNDDDDEEEEEKEKKNNSADDGEKKNDGK

SEQ ID NO: 128758 - protein, 84 aa, Heterodera glycines
  Coding regions on vcDNA: vcDNA=SeqID_55181; Strand=+; Position=1-650
STGYREAIPEGFGLPINLGASVRGDCPENKKIDFFKCPFGVLKQLWGAKIQRRITVQAIGKLFRKDSVSHKSRRIGSGGLPRNK

SEQ ID NO: 128759 - protein, 193 aa, Heterodera glycines
  Coding regions on vcDNA: vcDNA=SeqID_55182; Strand=+; Position=1 -101,150-248,358-420,464-598,676-861
  Homolog annotation: Hit_ID=NP_499298.1; Match level="QueryCoverage =88%, HitCoverage=28%, E-value=2e-46, Identity=50%"; Hit description =FtsH protease (3L509) [Caenorhabditis elegans] emb|CAA88955.1| Hypothetical protein M03C11.5 [Caenorhabdi
FHEAGHAIVAHFSDHSNPLHKVTIIPRGTSLGHTSQLPDKDRHQETKAQLLAQLDVTMGGRVAEELVAERMVKLFGMSDRAGLRDFTVEPIESEQGFCVERGPSTSETIDREIENLLQQSHERVKELLTKRKKEHHLLAEALLEHETLSKNDIEKLLKGEKVMKPPPTPPKGQKHKGRTLAIGKKAKDEGGRA

SEQ ID NO: 128760 - protein, 52 aa, Heterodera glycines
  Coding regions on vcDNA: vcDNA=SeqID_55183; Strand=-; Position=1-267
NAQKNNVTPSGSEPAPSPLKMMPQNPQSHRDSEVLTMSKVKSDHVFVISVIK

SEQ ID NO: 128761 - protein, 45 aa, Heterodera glycines
  Coding regions on vcDNA: vcDNA=SeqID_55184; Strand=-; Position=1-448
RLGYSEAIPEGFGLPINLGASVQGDCPENPKKNFLDKNYLNELTR

SEQ ID NO: 128762 - protein, 43 aa, Heterodera glycines
  Coding regions on vcDNA: vcDNA=SeqID_55185; Strand=+; Position=1 -52,316-395
MEKACNIWRDFIDFSALGKLCSDWPPFNGSMSVKMQWEKSKSK

SEQ ID NO: 128763 - protein, 195 aa, Heterodera glycines
  Coding regions on vcDNA: vcDNA=SeqID_55186; Strand=+; Position=1 -75,522-699,1023-1166,1682-1872
MWCHWMANGKGLLIQRWAVFANYQREPYIPFMEKACRLCGSAVTMLFFIFLIIATLFDLIVYRMFVIRVFYASTFSMPFSRLLIQCFPIGFDDGALKIPATKKQKCERICKEQRQTIKCINPNIKLRLYEQLDFFVISRNTIGSPADAQLRRCYSLRLQPVQQQSLPTIRCRKVQQQTVLKCFRKMSDDKFLLWF

SEQ ID NO: 128764 - protein, 275 aa, Heterodera glycines
  Coding regions on vcDNA: vcDNA=SeqID_55187; Strand=+; Position=1 -162,964-1075,1494-1613,2163-2248,2993-3075,3294-3558
MSIFYYYHLIIFMAIIHGQMAAPIVAESYSSAKQQRTEFNYQQKLQSTHPPTMNNHFNNTAFVRSPIIRRPSFANDPPIISSIDARPMTIASKEWKQALFGRGGLLTEIFNFVNDKRKEDLAKKQAAPNLNGKPESLGEMFGSNKAQKGGTSRVEIGENVRKNFREGTCWFLRKMNGFLPRRLMTQKRQPSHSPGKSWDFHTIPNPNNKCGGADFYLKFQQFVLTPVFERTHEKKRTQPSTTVTVQQQLRNTKNKIGQSHGTTTAKSTQQVKLGR

SEQ ID NO: 128765 - protein, 141 aa, Heterodera glycines
  Coding regions on vcDNA: vcDNA=SeqID_55188; Strand=+; Position=1-426
MARQFDQHHGSKSVEFLPKDPVLLLNFNRGKRFWLNGTIIERLEKSPTYRVHVPALGRNVHRHANQLRRRYPLEEDGNDTIRIPPQAQEEQDRDPSPIREPPPQPPPIRRTQAKRRSPSPPLAPRRSQRQRKAPIRFSPNP

SEQ ID NO: 128766 - protein, 189 aa, Heterodera glycines
  Coding regions on vcDNA: vcDNA=SeqID_55189; Strand=+; Position=1-569
MDNEKSREKAAVVIPHNSRNSFTKKVSAPEGSADSGIGGFSSGENSGGSGPNEGNYHRLWIKEDFEEQLGKETHRQIETTASDHWPKERGETDQTQRVDRIETSQKGRGPTVETFQGERAETDQTQRGKKVESDQARRGHGIDTDHRGMGQRVETDQDERAEIDQGERPEIDQGKRAETDQDERAGTDQ

SEQ ID NO: 128767 - protein, 121 aa, Heterodera glycines
  Coding regions on vcDNA: vcDNA=SeqID_55190; Strand=-; Position=1 -148,240-418,893-931
MVFLIIFGQGFQIQASPIKNVGMPKNCETFFFALVNDRDLVYAILASNSDYLRFLCDYLSLIQCEGGVVQLVSEEEMANNVSAGVEMGSIFEFATSPKMEKLKLIIYQNRFFYEENDEKAL

SEQ ID NO: 128768 - protein, 183 aa, Heterodera glycines
  Coding regions on vcDNA: vcDNA=SeqID_55191; Strand=-; Position=1 -106,156-601
MKATSAMLKLMFSFLFIIMMDFTTEQKILMGECQKDFFATVHRLQEMAPAFFAGTQTQMKNGKFLEKAFDTLCCITIKAKKDAMKRDELAEIIGEFEANQRNFCQQLKKGQNIWEALESSAGNAIVTAARNVKVNPQTYEEGFRKLTKLKIVSPENQTAIGTFVKHCIAALKIFREFITGIVN

SEQ ID NO: 128769 - protein, 107 aa, Heterodera glycines
  Coding regions on vcDNA: vcDNA=SeqID_55192; Strand=+; Position=1-321
MNCTATAKTIGMRAGVEVQLGKPHNHDPSPTRCEAAKINRSVRNTALSSRGNMPRTVVNECLAGASNEVIASLPLILSMEKAVSRVRHAAGGQFQIPKTLADIEIPA

SEQ ID NO: 128770 - protein, 47 aa, Heterodera glycines
  Coding regions on vcDNA: vcDNA=SeqID_55193; Strand=-; Position=1 -109,291-325
MYLQNLTISGKLGDSQRINLFWPQFTALNTYTNDINSDSALGLSSLD

SEQ ID NO: 128771 - protein, 768 aa, Heterodera glycines
  Coding regions on vcDNA: vcDNA=SeqID_55194; Strand=+; Position=1 -74,187-657,1115-1322,1366-1926,1973-2234,2274-2592,2641-3049
  Homolog annotation: Hit_ID=NP_507780.1; Match level="QueryCoverage =61%, HitCoverage=36%, E-value=4e-47, Identity=27%"; Hit description =predicted CDS, DNA polymerase type B, organellar and viral family member (5T899) [Caenorhabditis elegans]
MSFKRVNSFQPTVPLAKKWDFRSIGNNFAEEMENYKLMDYQSTTCEKFGFTKNITEFRVNPDVERPDEAMKDAIDNMIKVALKTTEEKMKRKVRMFGVAITGAGLAFPVWVPYRAYPQNNADVIMEEINKLGQSGDGDENKKMLLLSEPVTMKITCVTMPSGEGPRNVHKFDFGFKEHQRIGITNADKFCLFYALVASKLYLEVHRNIFNRFMKNIVRQRDSAIELLHNCGIDINEYSYGVEQLPNVQKYWDEIYPRKYRVVAFEKSADPRKSICVLWKAPMGREKVVPIFLENGHWDGLKNYVSFFNRGRKFCIDCECFFDKDVKHTFECRARCYYCNKVGGVPCQKESGVKIECPKCHRYFYNWECYNYHHGHQTCKLWRRCVICDKTYLFNPKKEHECGETYCQLCSVSHDPKRGCYIMPIEEKEEKDVYRIVVWDSETSQDTIYKGDQKEHVINYISVRVTCTECCDDKNRTNCKICGEERIKDWSEAEGHEPTKDFVEWILTAFTNYDTYIFAHNAGRFDGHFVFNYLCRTGKNPLPLINGLKIYEFKVQNSKKHSKLIWRDSCLLMPVKLESLKATFNLDCEDKPFFPYYYNKKENYGIRLEHLPPMEDYSPGSMNKDKFIKFEKWYNENKETPFYLDEELKNYCRNDTEILLLSIIEFRRILINDITKGFDPLPRSCTNAGVAMNIFKAMFLLTEQLSIVPEKGYERCDRASVMAIKYLEWRSKQDGIEIRHAGNGREVKVGKYKLDGFIANNGARDKYIE

SEQ ID NO: 128772 - protein, 43 aa, Heterodera glycines
  Coding regions on vcDNA: vcDNA=SeqID_55195; Strand=+; Position=1-131
PPIGLGLCGKMSPGGNIKGLRPSHRHGFVRETPVRNRALSGSY

SEQ ID NO: 128773 - protein, 451 aa, Heterodera glycines
  Coding regions on vcDNA: vcDNA=SeqID_55196; Strand=-; Position=1-1353
  Homolog annotation: Hit_ID=EAA21657.1; Match level="QueryCoverage =74%, HitCoverage=14%, E-value=1e-09, Identity=21%"; Hit description =hypothetical protein [Plasmodium yoelii yoelii]
MLAKSVEISVKKARTDQRHEPRRQETIGRNTEAIGSDRRKNGNGKQPEIILLDDDDEMEDKQKIVINLDDDDDDEEMVDQQAKTNDQTPRATEDGNAMAIVPFNFGDDLLEVLNTDPTFWDEELFPPIQQNEKTQKETDGPSNANIKNDNNDKEVIDIEDDDETANQTDKNDNSYNQLMIMGNSEAPIPINSMPSKQSEKTDSKSKQKKDAKTVPKKDAKTVPKSGENQIGKMDALKLIRQQNANAAQAKRTSKTNSNGRENVNVLMPKADEIKGMPSNSKSTPKSAAQVEKANHNQQQSAKRPQTERESSVMPSSSTGQNANAVSKASEVHALKMCVGHSSNAVQQQMLIEDVVGTVCTESIRAFGQNAIDFGFMANEVFKLTFKAKNGEKLANEINASKGKFSVTKLIKDMGEKLKYCRLLGRILDEIFEENAKFSAKILEELPRKGGK

SEQ ID NO: 128774 - protein, 28 aa, Heterodera glycines
  Coding regions on vcDNA: vcDNA=SeqID_55197; Strand=-; Position=1-85
MHKMHRISTPVIQPNPSFSGCELADEPN

SEQ ID NO: 128775 - protein, 75 aa, Heterodera glycines
  Coding regions on vcDNA: vcDNA=SeqID_55198; Strand=+; Position=1 -87,403-477,849-914
MSWIAGQAGLSRDFFLNFKLRKQKIQTINISRSLGPEFGGSIGLILYIANTVNATMNCVEPPEAIVRNAAYIPYG

SEQ ID NO: 128776 - protein, 114 aa, Heterodera glycines
  Coding regions on vcDNA: vcDNA=SeqID_55199; Strand=-; Position=1-342
  Homolog annotation: Hit_ID=CAE67424.1; Match level="QueryCoverage =59%, HitCoverage=8%, E-value=4e-15, Identity=58%"; Hit description =Hypothetical protein CBG12912 [Caenorhabditis briggsae]
MSNAEKPSQRVYPHPAVSQPPQDNDKEQQQSEQQQKEEQKQQQPNEREKSADQRETKAANDRKMMHQPGLKLDQYRKQLAAMKTKGAAPTRDWSPQETLLLLEGLEMFKDDWNQ

SEQ ID NO: 128777 - protein, 22 aa, Heterodera glycines
  Coding regions on vcDNA: vcDNA=SeqID_55200; Strand=-; Position=1 -33,348-383
MSGSEFNGVSMQLLNPAALYFY

SEQ ID NO: 128778 - protein, 143 aa, Heterodera glycines
  Coding regions on vcDNA: vcDNA=SeqID_55201; Strand=-; Position=1 -177,429-573,1193-1233,1890-1957
MWGTLILVKLNRFQKQITDALAPFTVTMHYQPTNNSMNHYQRTNPIERVCRQQAADGHLVVKTRLQSSHGHEMRRQVQLERLQRWTSSTSSISSATTTTAASNSTATVTPMDVVKIRLQSQDAFVKIVRIEGLRSLWSGLSPT

SEQ ID NO: 128779 - protein, 701 aa, Heterodera glycines
  misc_feature (655)..(655): Xaa can be any naturally occurring amino acid
  misc_feature (670)..(670): Xaa can be any naturally occurring amino acid
  misc_feature (677)..(677): Xaa can be any naturally occurring amino acid
  Coding regions on vcDNA: vcDNA=SeqID_55202; Strand=+; Position=1 -339,659-1402,1795-2412,2669-2932,3467-3527,3609-3685
  Homolog annotation: Hit_ID=AAF76983.1; Match level="QueryCoverage =98%, HitCoverage=97%, E-value=1e-112, Identity=40%"; Hit description= fibroin heavy chain Fib-H [Bombyx mori] sp|P05790|FBOH_BOMMO Fibroin heavy chain precursor (Fib-H) (H-fib
GAGRGGLAATGDGSDGAGKGAGRGGLAAAGEGSDGSLVLSAGSGGEGKGAQRGGLAAAGEGKGAERGGLAAAGSGKGAPACTSMSRDPHAEVKGVSWCVACTTHDTNFSSRRGAGRGGLATAGEGSDGSLWLSAGSGGSGKGAERGGLAAAGEGSDGSLGLSAGSGGSRKGAGRGGLAAAGDGSDGAGKGAERGGLAAAGSGKGAERGGLAAAGEGSDGSLGLSAGSGGSRKGVHRGGLAAAGSGKGAGRGGLAAAGEGSDGSLWLSAGSGGSGKGAGRIGLAAAGDGSDGAGKGAERGGLAAAGEGSDGSLGLSAGSGRSRKGAGRGGLAAAGEGKGAERGGLAAAGSGKGAPACTQRASVKGAGRGGLAAAGEGSDGSLWLSAGSGSGKGAERGGLAAAGEGSDGSLGLSAGSGGSRKGAGRGGLAAAGDGSDGAGKGAERGGLAAAGSGKGAGRGGLAAAGEGSDGSLVLSAGSGGEGKGVHRGGLAAAGEGKGAERGGLAAAGEGSDGSLGLSAGSGGSRKGAGRGGLAAAGEGKGAERGGLAAAGSGKGAPACTQYGAGRGGLAAAGSGKGAGRGGLAAAGEGSDGSLGLSAGSGGSGKGAGRIGLAAAGDGSDGAGKGAERGGLAAAGDGSGGAGKGAERGGGGGRGCXCAFGRDGRSGRSGGXRSSGQRXRSSGQRPMGESSTGRPVLNTGTRR

SEQ ID NO: 128780 - protein, 1087 aa, Heterodera glycines
  Coding regions on vcDNA: vcDNA=SeqID_55203; Strand=+; Position=1 -52,1158-1354,1410-1690,1747-1846,1894-1986,2038-2217,2540-3113,3164 -3490,3760-3913,4502-4907,4955-5392,5445-5729,5784-5960
MQQLTFPPPNDPGRFRPAKFVPAPATATGFVGPARRLARPRSPTPTGVRVAASPVRSYRPKDILAPPNLPKDIDLGIFKKPIAGRDWSEDCATCAAFMGAMSEHIDTCALARLRHLIKEMKKFAAGAKDNLAHSRGVGIALQVPKPWPVAEEDGWTGVTIPGCEEKSPVAEPAIAELRKPKKQKLPKVVPDKRQPWLCNNDGRPIPGLAPVAKQLPVAPLRKLPTDMPRPKNVYHTIVKGKAVASIKLLELSKIDKPRVPIGYAPIARAEKPALQNRPVLNAVPKPVLREPSEEMFVVVGQLTKPLPSKPRAVVASAPGIPNKLRFEAPRLSEEPNWRLFVGTGSRRNNITTTPNAPKLPILQKTYAEAARTPKEATKKPLSATARSFTLGDFFISKGVRGASKADRCALTTAEAAPKRQRGGGRESSRSATPTGNEEQHAFLLDCFQRSPTQKEEAFKALKKQFKKTVSPRTYGRWWQNFCDGKLTLSQRGRTSERSQSVRESVSPAQSVQLEEQHQVPQELEAAGNPTYDSELIRTQTSSATNEEQHAFLLDYFQRSPAQKQEAFQALKQRFKNVVSPQTYGRWWSNFLKGQLTLRQRGNTPSSKQSRSSRGQFGKSRKCVFCTIPLNDADGYAMLNCGHSCHFDQPFAECQICGVQNAAPLPAVPKPRGIVGGRPLKNAKAASPTESIPSTVDTTTAAASDVSANESQALTDSHLMPPPSLAPRRSTRISRQASIASNRPSAVAPKPIAPVTHCCGTIQSAHFGYGCGSKKANHLPSYYNSLRDQAQHNCPHCNALLLASEAVGPTAYSKCCAKGRVNLADRYKALRARPAELDNILQNPAGQYKGWRDSLFRHVLRYNNNLAFGNINITRSEERIDLHRIVKCNNMINYMLWDFNPPDGGKPHLHGQLFTIPPADARTRLGEISREHSLDEQLMAALYGVLLANHKLAVVYETAAETYRQLPEEDRMQFRMLLVDTNKRGTERRLDAKDAPAPDNLHVDDRANLRHIHPGRLETETDAGSRLVAQIFLDCGANVMPPSVYDVVLTGRATTKIVHMKWWNRNIDPANFPLIFSFGQFGYGRVFL

SEQ ID NO: 128781 - protein, 234 aa, Heterodera glycines
  Coding regions on vcDNA: vcDNA=SeqID_55204; Strand=-; Position=1-705
  Homolog annotation: Hit_ID=AAG23159.1; Match level="QueryCoverage =45%, HitCoverage=45%, E-value=2e-27, Identity=60%"; Hit description =polyprotein [Heterodera glycines]
EFVKENGINHLFSAPYNPMSNGQAERFVDTFKRACRKLKKEGAKNVVNTFLTSYRTTPNDSLPNGKSPAELFILRKPCTTLDLLRAKPSPPLIRDEAMEKQFNRRYGAKPRKSCLGDKVFARHRQSQSWRAGIVSQCQGVIYEVKFPNGTSNRFYANQMTARHMDHQGNDELNIFNDAFGLPLAQLDGPNEAALPAVQQAAPAQETDEAITERSPVCVGRPHRNRRPPLRYTPS

SEQ ID NO: 128782 - protein, 288 aa, Heterodera glycines
  Coding regions on vcDNA: vcDNA=SeqID_55205; Strand=-; Position=1-867
  Homolog annotation: Hit_ID=XP_308192.1; Match level="QueryCoverage =81%, HitCoverage=60%, E-value=7e-69, Identity=54%"; Hit description =ENSANGP00000021557 [Anopheles gambiae]
MRFLRQPLDELLKQDVAWVWSSECQNAFDKIIEVLKSDQLLTHYDPEKDIIVSADASDYGIGAVISHRFQDGSLKAIAHASCSLSPAEMNYSQIEKEGLALVFAVQKFHKYLFGRHFVLPTDHKPLLTIFGNKGIKAYTANRLQRWALILLAYDFEIEYQNTSDFGQADALSRLIAKAPVPEDEFIVVTITESANLATVNAFTAQFPIVHEDIVNATKSHNLLQEINGFILNQWPNKANICQRTFYNSIEGEKRCHSKTDASCTPTGLSSQHRLRRKCLKCYIVDTRA

SEQ ID NO: 128783 - protein, 520 aa, Heterodera glycines
  Coding regions on vcDNA: vcDNA=SeqID_55206; Strand=-; Position=1 -424,492-997,1075-1707
  Homolog annotation: Hit_ID=NP_491240.1; Match level="QueryCoverage =98%, HitCoverage=41%, E-value=1e-93, Identity=38%"; Hit description =zn-finger, CCHC type and RNA-directed DNA polymerase  and Integrase, catalytic domain containing protein
MNALQLGGISVNALNQPSRLVEAPVDVNGKPIDFVFDPGAEITVIDEEAHLQIERPRLIQCSESAKYHDVTECTLLGKGFATFTFGGRTHQGQFYVTKKGSLNLLGIDILDAFGLLDTFRAKAKMAMKVNVVQAERKDRMKKGLGHCTKAKAHLELKADAVAVYCRPRPVPFNTRLIVEAELDRLLAQKVINPIDHTRWAAPIVVVKKANEAACVCADFSMGLNNALLLNQHPLPLPEDIFTKLNGGKIFSQIDLKDAYLQVELDEKSKELCTIATHRGFPIFSLTIWGKISARNFPIDHGFNFGRLSIRRIGNFGFLIKPDKCSFNQKQIKYLGFVIDKNGRRPDPSKIKAISEMLVPTNVSELRSFLGMINHYQQFVKNMQFLRQPLDELLKQDVAWVWSTDCQNAFNKVIEVLKSDQLLTHYDPEKDIIVSADASDYGIGAVISHRFPDGSLKAIAHASCSLSPAEMNYSKIEKEGLAIVFAVQKFHKYLFGRQFVLQTDNKPLMTIFVTKRASKRG

SEQ ID NO: 128784 - protein, 214 aa, Heterodera glycines
  Coding regions on vcDNA: vcDNA=SeqID_55207; Strand=-; Position=1-645
  Homolog annotation: Hit_ID=XP_319741.1; Match level="QueryCoverage =68%, HitCoverage=35%, E-value=8e-19, Identity=33%"; Hit description =ENSANGP00000006515 [Anopheles gambiae]
MAANPTIDELTKLLAKQQKLVEQLLNAQQTNVAPTQTAQLPALSNMECFDLDDHSGKNIESWIDRFVLALDCSSPNIQDQLKVKLVLTKLSEGAYNEYSKFCLPKKPTDLDFLETSAQLKCLFAKPQSVWIDRYECDDEDFRAFVNRHKRLLRDFEFKKLNEEQFNCLMLLIALKSPRDAELRKRIFGKLTTDGDKANVRQCRQRFADVPVDNC

SEQ ID NO: 128785 - protein, 98 aa, Heterodera glycines
  Coding regions on vcDNA: vcDNA=SeqID_55208; Strand=+; Position=1 -196,1462-1562
MSYSYSATPKSLKQIRFPAFYELFRLLDNSWVFTLLDNSWLGQFVAWTKRGLDNSWLGQFVAWTLYSGLEFMKTHSDPKTALFYFNLYGLLDSDYQDI

SEQ ID NO: 128786 - protein, 75 aa, Heterodera glycines; identical to SEQ ID NO: 124542
  Coding regions on vcDNA: vcDNA=SeqID_55209; Strand=+; Position=1-225

SEQ ID NO: 128787 - protein, 194 aa, Heterodera glycines
  Coding regions on vcDNA: vcDNA=SeqID_55210; Strand=-; Position=1 -571,1352-1365
  Homolog annotation: Hit_ID=NP_996669.1; Match level="QueryCoverage =90%, HitCoverage=75%, E-value=1e-15, Identity=31%"; Hit description =similar to Hypothetical protein CBG21647 [Homo sapiens]
MKRYKCDLKRYKSDLKRYKSDKRGTKVIRRGTKVIRRGTTEIRRGTNLMKRYKCDLKRYNSDKRSIKVIRRGKKVIRRGTMVIRRGTKVIRRGTMVIRRGTKVIIRGTPVIRRGTMVIRRGTKVIIRGTTVIRRGTMVIRRGTKVIIRGTTVIRRGTMVIRRGTKVIIRGTAVIRRGATVIRSGTTVIRREFLE

SEQ ID NO: 128788 - protein, 228 aa, Heterodera glycines
  Coding regions on vcDNA: vcDNA=SeqID_55211; Strand=+; Position=1-688
  Homolog annotation: Hit_ID=CAG83749.1; Match level="QueryCoverage =87%, HitCoverage=31%, E-value=3e-18, Identity=39%"; Hit description =unnamed protein product [Yarrowia lipolytica CLIB99] ref|XP _499823.1| hypothetical protein [Yarrowia lipol
CTSSHHCSTSSDHCLPLLITVVPLLITVAPLLITAVPLIITFVPLLITIVPLLITVVPLIITFVPLLITIVPLLITVVPLIITFVPLLITIVPLLITGVPLIITFVPLLITIVPLLITFVPLLITIVPLLITFLPLLITFILLLSLLYLFKSHLYLFIKFVPLLISVVPLLITFVPLLITFVPLLSLLYLFKSLLYLFKSHLYLFIKCVPLLITFAIPNCFGSKLHNP

SEQ ID NO: 128789 - protein, 164 aa, Heterodera glycines
  Coding regions on vcDNA: vcDNA=SeqID_55212; Strand=+; Position=1 -361,496-630
IHILFNFMTTQNSDEEIGAEALQNGQNNGGGGEEAGATAVNDGETIAGEVEGNKVKELKAKEGEEEKAVDNGDESVEDDRAFGTKTPPASQLRQTPPLSASIRAPTVRKRCSAVFGARTSHTSTSGGGGGGLSALTSAMLGKKPRKQSVLDNAQSGWRSFVQEE

SEQ ID NO: 128790 - protein, 485 aa, Heterodera glycines
  Coding regions on vcDNA: vcDNA=SeqID_55213; Strand=+; Position=1-1458
  Homolog annotation: Hit_ID=NP_920205.1; Match level="QueryCoverage =96%, HitCoverage=30%, E-value=1e-38, Identity=28%"; Hit description =putative DNA helicase homolog [Oryza sativa (japonica cultivar -group)] gb|AAP52492.1| putative DNA helica
MLQTHHNWEYAYGQSTNLKYALKYPFKGASFSYLRCANENKTNVDEPAYYARMLYRSPVEAFSRIMSFRYAIMSHNVIPLSIHLPGQQKIYTRPGLEAQQIAEMLQNGQLQLPDTALTAYWKHWRADPTLKNILFENMPEKFSFNKKNKIWKPRIISKDPKRMANRRPCIGRIYPILPRAQELFALYLLTRHFPGDPDHLKKVGEHQCETFLESARLRGLIKDSDVWIRTLQEGANSLTPAQMRQLLASILIFGNTENCVLDGSMLWNRFLTHMYDSRCSETEKARRIDQALSLLERLLVRLGKQCSDFGLPTPLNSIVNDPDRGVNDFFFPENIADDEQDESVDTSAFEHAKLNDEQQHFFNRIRDVAATMPSNSSKRLFFLSGDGGTGKTFLLNYVLYHMRRLRKKVIATASTGMASTRFYSGGTTVHSAFRFGINVEVGQLPTIPFDSYFGRRITEADIIIIDEITMLEKVVLENIDKLCRT

SEQ ID NO: 128791 - protein, 120 aa, Heterodera glycines
  Coding regions on vcDNA: vcDNA=SeqID_55214; Strand=-; Position=1 -264,305-403
MPTLQAEQHPPPLSPQTNNVQQQQPTVPSPLNERQQSVQPTQGEHPQIRANAILQPNVVQAQQQQQQSHQFLALDHDNDDQLLNQIFLDLTTTAEMEPIALDNSNNNNMVVNDFWFCLFV

SEQ ID NO: 128792 - protein, 2013 aa, Heterodera glycines
  Coding regions on vcDNA: vcDNA=SeqID_55215; Strand=-; Position=1 -220,303-6124
  Homolog annotation: Hit_ID=NP_490700.1; Match level="QueryCoverage =14%, HitCoverage=36%, E-value=5e-37, Identity=31%"; Hit description =RNase H integrase-like protein family member (1A698) [Caenorhabditis elegans] gb|AAK68496.1| Hypothetical
MGIAVYQKATTNYAKAECNLIFAKSLVKPLKLVNHDATIPKLELQALTLGVKAVKFIQTQLQFDDDQVIFWTDSIDYFGPLKVKRGTEIVKIYVALFTCLVIRAVHLEIAEDYSAEAFVRTFRRFVSRRGLPMLIMTDQGTNFVAGSKVIQQHWTDTLLPEHVQQQMAQQGVTWRFNTAHAPWKGGTWERLVGITKNALRRTIGKNLLPLDEMHTLICEIETIVNHRPLTFESDQEPYVSLRPINFLIPYNQTETNFPVINEDHQDPDYEPTSNSRNHLVTMLRKTSNMLDRFWTTWRNDYLLSLRESDRTKSATGPLYPKEGDIVIVGDDDLPRSLWCLARVLKILRGQDGKIRTAIIEINGQQKARAINPLYSLEIPEITESDSELIAPLMASEDVLSLVGSDEEPQMPDNFKIPKKKNVIKRSQRFITGRNHGLREVTQSAKDNDPVEGLLYAKRPDNKLKLFKDGTLKVLLESITLFKREDGKKMADGLLELYGKIPMPEWDKRLRECEEKLRKMDETREKKDKERQKQRTEKRRIEEEKQMETKKRKAAKEELIDRSDPAVERKKHDEHRIRWAAQRKAAVDELRQRIKLRKKQWSVVDIEKEMKETEKDDEEHLRELAKSGSKEAARAMEAKPSLRQQNNVQLIKKQQRMSDFYPTDGEKVLAYCERRYGTNLMASWRRNRVQTELKELLENERITLQHVNGQPALLHRITEHKKGLCGEFVIGKICSWQYLDEIEFKVAADPEEEQLAMKEKSPTPEVVVIDEDDPEREASIEPQFITERAGHTPPLLFRHPSPEPQQFMKHRAAHTPPPPPVQLQPAQLPTEAPIEADIVEEYHAAKSKEEKYVDFNIFTECDDTHISCARNATYGRIAEAANREKIEEFANCRARTLFDTIMLNWLNCNLNRPGNEIWTIHEQHTQSFDSSEESAKFFYEQQIVKSQRDIGRDKHLKEAIEIWRSSCDNFREITDQSAWTQLKFKPIKSADQQTTEFDKWIERINQRSCEITARDRAKKQFPDHIYFNVRTILIGDNTAEAFQHHFPNSRWYTHFPDQRLRLTTGPQVKNVIFTYEATEEDMIKQLAPLLHRFKDDDIEVTLILSKEDNAEWLWHKRELIRLTKHLDTGFFVFNKRIGEAKELANRIKMTMDEPMQLNDEPTTSPAIETRGRKPTRKRITVGQRMINALMFISLFILLASSTAFANPIRQKRFGGVGVWHGSNLAKHLWPRNTDIEQRTSKLAPSVQRYIQRVLALNATATPPAKQFATTTAPPTTRKPNTTTTRATPTTKATPRTTITGRTWHTTVQPTTQIVPKTTTQRPITTRSKFLPSSNLLDNEIPQAPDYYLALRKKGKKTNNVQSAPQLARSAQRKGDPINKNGMDVFWCGDRGSTLWELKGSENSPFCRPPPVLTAHWTPLTIDLYTKIHRPDQVHSAWHCAVKRTTEQYYTNLLGDRFITINKTMMAVSRTLCKQMALHQICPLAKTEMTISGNNTWSTNDELEVNFPGPIEGLFKGLQRSTSTNCFAQPATLFIRRHNLQLTSPIHHVDHCAYTTEFCQLSDNSSLIWNANCSDNNCHACDFNHAEEISGEFTKIPGQTSAIWISDDRQKALTFTDTQPLEACDGKLIVLSEQNFGIRKEQYERIMNGYYKRAKRYVEPEQLASQLSAAQISTNMALSQLYLKECQRNFRVANPTLQARKLLNRENLQARWIGETTIEVFPCINVSLTNISYRATKDCYKFIPVRIHLPNADRDAFLDAEMRILSFTSHIASCSHLRYHYLQLQKNPNAWLKIDTNTGIAKQLPPTAVQELYETVINRSDSDFDLNPLIFHQWQLDNDTDNAMFPHIDEFADLEVFKDKLEQHKSGRAQALGALQDGIEGWTLKLVKDWLNELVNWWIRIACAYATFLMIRDLIIPCALAYLLNPIRITFMSLIGFRPKRQPIRQRRDQFEEIVPLHRLSTPPKRPSLRQRADRPFTPIHLDLDAKSATFRSRASSVTLDTPFGRSRPMKLADD

SEQ ID NO: 128793 - protein, 68 aa, Heterodera glycines
  Coding regions on vcDNA: vcDNA=SeqID_55216; Strand=+; Position=1 -120,176-262
MFLLQNSVNKMLFSAEKLQIRTDFPRGFEKQYAILGQIMRNALHVDSEKRTFDGNGQLLKLAANLISH

SEQ ID NO: 128794 - protein, 143 aa, Heterodera glycines
  Coding regions on vcDNA: vcDNA=SeqID_55217; Strand=-; Position=1 -141,225-344,404-574
  Homolog annotation: Hit_ID=AAC48327.1; Match level="QueryCoverage =76%, HitCoverage=23%, E-value=1e-39, Identity=70%"; Hit description =beta-1,4-endoglucanase-1 precursor [Heterodera glycines] gb|AAC15707.1| beta-1,4-endoglucanase-1 precursor
MGVDQGGYLTTESTQYKLVTTVIEAAISLGMYVIVDWHVSATYTTQAVAFFTKIAKAYGSYPHILYETYNEPLALSWTSDLVPYHKKVIAAIRKYDTKNVIILGTPNWSQVKINNNCIQFIVKRTFERTWTLPLPIQLVATRI

SEQ ID NO: 128795 - protein, 76 aa, Heterodera glycines
  misc_feature (5)..(5): Xaa can be any naturally occurring amino acid
  Coding regions on vcDNA: vcDNA=SeqID_55218; Strand=+; Position=1 -121,165-292
EQLRXQCQMYVEVTSAQTMLSFSGTTMNNWKTILLGTLGESTRTIISSHFDGAEERRLRQFATNTNKEQKINWIII

SEQ ID NO: 128796 - protein, 212 aa, Heterodera glycines
  Coding regions on vcDNA: vcDNA=SeqID_55219; Strand=+; Position=1-639
MADDDLEDKYVALKAKVQDLEDRLANRVPNYLPPGVKIPKYDASGDFFKFLKEFNVLATASNWHPPDCVRFLPLFLEGEAKEIYQNISADKKTNWRTLTSEIAELTKKLDGPMWARKMLNKTKMGINGSVTEFANKIRELVEQASPDPNYTVEARESESVHYFLNGLPTKLKRKLFFMEKPDSLIEAIAQAKKVIQVNEEIEKDEKGDEMKQ

SEQ ID NO: 128797 - protein, 190 aa, Heterodera glycines
  Coding regions on vcDNA: vcDNA=SeqID_55220; Strand=+; Position=1-571
MTFLTISMFLCSFFGTISGQYQLCSDRVPTTPIWLPNVTECSVPEYQKADERKVTLFLPVQIPKQFPVYNCYQKMMKICTGNFLFFWKDIKSQDSYVKGVSHRACQGFKDNMGHTMKRLTENLWTTERPSKVEYAWIGERCETTVNDFIEKGQGGILDFYLVTSFGHNFNPYNGWEEGQKWTFIWEIPEP

SEQ ID NO: 128798 - protein, 152 aa, Heterodera glycines
  Coding regions on vcDNA: vcDNA=SeqID_55221; Strand=+; Position=1 -75,137-254,311-401,445-616
  Homolog annotation: Hit_ID=CAE67304.1; Match level="QueryCoverage =98%, HitCoverage=13%, E-value=1e-36, Identity=50%"; Hit description =Hypothetical protein CBG12757 [Caenorhabditis briggsae]
MVIIETDHAAFTEKAKRRRREEMANDLIEMAKDSEEKALAEEMAHSLRNYEPDESIFGAPRAQYGKWASAVRLLVPKTGQTLCQYELPEGEAAFCIELVQFRSQSDSTFVLVGCAVGLELRPKRSHGGCVYTFLLTANGTRFEFIHRTATSA

SEQ ID NO: 128799 - protein, 124 aa, Heterodera glycines
  Coding regions on vcDNA: vcDNA=SeqID_55222; Strand=-; Position=1 -90,252-536
MGPIPSGRVERPIDEANEWKTDGTLRNAKSVPILRLFVPKNGSPNHHNHLTLLLIQTEHLVIDGIISVKSGTEEGQWMRRHFGGRKEGKAEGGGGTEAEEKHGKGKGIEKEQPSFIIYKEKATD

SEQ ID NO: 128800 - protein, 149 aa, Heterodera glycines
  Coding regions on vcDNA: vcDNA=SeqID_55223; Strand=+; Position=1 -171,434-628,1355-1436
  Homolog annotation: Hit_ID=XP_308965.1; Match level="QueryCoverage =73%, HitCoverage=25%, E-value=7e-36, Identity=62%"; Hit description =ENSANGP00000020214 [Anopheles gambiae]
FAFSMLFLRFRPSPSLRFSLFPPSKMPPHPLSLLRATFYTYYPIDDQMFGLDEEQRQLRQLVFRLAQRELAPFASEIDRQDQFTMLREFWRLLGQNGLLGVTVPAEFGGSERNYFDHCIVMEELSRASGAIGLSYGVHSNVCIDQIRRH

SEQ ID NO: 128801 - protein, 133 aa, Heterodera glycines
  misc_feature (124)..(124): Xaa can be any naturally occurring amino acid
  Coding regions on vcDNA: vcDNA=SeqID_55224; Strand=+; Position=1 -159,222-318,387-505
  Homolog annotation: Hit_ID=NP_800128.1; Match level="QueryCoverage =99%, HitCoverage=32%, E-value=4e-36, Identity=59%"; Hit description =putative acyl-CoA dehydrogenase [Vibrio parahaemolyticus RIMD 2210633] dbj|BAC61961.1| putative acyl-CoA
KMNARKTADGSHFVLNGTKFWITNAQDADVLVVFAKTNSAKAKHGITAFIVEKEEFTGFWPAQKLDKLGMRGSNTGELVFENCQVPAENVLGENVLGKEDCGVYILMSGLDSERLIFAAAPLGXRKICASFVV

SEQ ID NO: 128802 - protein, 192 aa, Heterodera glycines
  Coding regions on vcDNA: vcDNA=SeqID_55225; Strand=-; Position=1-579
PSTSNKRPKIAHPQQNAELLEQIYFLLRRKEKFVKIYMRHWIVIDNDAKAFFSVVKEFLDEMPTEIKNLYKNEIENLKIKIDEELAKHKYLNKKEKNKKKLNKIQQKTAAACGGKVEKIELEKTEMDKMEEALNQDDKTFFKYHCQLISRSSDHLKFVLEKLSNSDDFEPISSIKMNIGMQIDQTYSEAFIK

SEQ ID NO: 128803 - protein, 47 aa, Heterodera glycines
  Coding regions on vcDNA: vcDNA=SeqID_55226; Strand=-; Position=1-142
MAFLEAFAHFPNYEFIWKVELSDEDAKVFAKYKNVNPVKWMDQKSLL

SEQ ID NO: 128804 - protein, 226 aa, Heterodera glycines
  Coding regions on vcDNA: vcDNA=SeqID_55227; Strand=+; Position=1 -91,133-221,262-462,502-801
MNKRLPNELIWEIVAAIPIMYIFGGVAKKPGATRPPSGITVVNRAFEIFRSKRHFYFLKIIDLARNFERLCALRKLPCGELFIQFGFIQFGFENELEDAKCFADFLVYLYYGRSGPTVTTRVVTYSAPIKIGELFGAILTHVLGSANPLTMKKRTAGGYLLRQHFPRLLQLSATEMASGGIGQLVRSDGMEMYRLMNPHHKGDVGQLIIIETSQHPGSYYFNFSIE

SEQ ID NO: 128805 - protein, 337 aa, Heterodera glycines
  Coding regions on vcDNA: vcDNA=SeqID_55228; Strand=-; Position=1-1015
  Homolog annotation: Hit_ID=CAE56208.1; Match level="QueryCoverage =91%, HitCoverage=76%, E-value=6e-46, Identity=32%"; Hit description =Hypothetical protein CBG23832 [Caenorhabditis briggsae]
VEPLLREAKKVNNQMSRKDVVEYLATQRTYTIHRQAKRRYKQLPTLASGLHTEWQADLSVFDKLSRENHGYKYLLICIDTLSRQLFVEPEKSKKSSDMVAAFERFFKRSKYKNVKNFFMYTSPRIHAGMAERANRTIKERLYRYFTERGTQKWVDVIQQIVHGINHSYNSSIKMRPVDVNFENAEKLRKKLKQNAIGGTAEAAAAKRKQPQPRFKVGDRVRIEKYKHVFQKGYTGRFTNEVFTVAEVHTDRFPVTYRIRDDDGSLIKGRFYANDLCRVLVRKNDDDDDDDDDTLYDIEKVVRKRKKQGVEYVLVKWKGYSQRHNSWIPASSMTWKNI

SEQ ID NO: 128806 - protein, 102 aa, Heterodera glycines
  Coding regions on vcDNA: vcDNA=SeqID_55229; Strand=-; Position=1 -91,273-490
MLALFVIYVYLTASFTHISLAKIRTESQIKESEFDAFFVADEIKLINSHRNSAIAAQLKTAKAGFQRTINLIDTMLGEWYVLHCMSAYFSYWPEFRVGSIVL

SEQ ID NO: 128807 - protein, 39 aa, Heterodera glycines
  Coding regions on vcDNA: vcDNA=SeqID_55230; Strand=+; Position=1-117
FLRLFPSSSSSTLSATNEQSQIAPSQQLLFSAYRNLGLL

SEQ ID NO: 128808 - protein, 45 aa, Heterodera glycines
  Coding regions on vcDNA: vcDNA=SeqID_55231; Strand=-; Position=1 -52,104-189
MTFRKWKREMLATKYYKKHNTNEDKLQKMKQYLKLKKEIQKLMIK

SEQ ID NO: 128809 - protein, 105 aa, Heterodera glycines
  Coding regions on vcDNA: vcDNA=SeqID_55232; Strand=-; Position=1 -68,128-377
MWRKIAGYCVVVVVAFGAGIGVWYLRKMMRKREEEEEQEDEAPPGDEAPPGDEAPPPPEDEEDAENDGGQVEEEEDDGGPDQQQQQPKKKALAEFITQQTTGGAN

SEQ ID NO: 128810 - protein, 67 aa, Heterodera glycines
  Coding regions on vcDNA: vcDNA=SeqID_55233; Strand=+; Position=1-351
QMVRQSSFYYMIVGNLIVIAVFADRALTRRYFGKKMEPMALPSWNAFVKTELKEGRELTMPISDDGN

SEQ ID NO: 128811 - protein, 159 aa, Heterodera glycines
  Coding regions on vcDNA: vcDNA=SeqID_55234; Strand=+; Position=1 -115,210-228,329-674
MLISKDVLVIQGHFLFPRKRVKFQGRPWHPRTNGSPAIRYFQIFKFSHFMSYSSRKVVTLFILSQGAFFIDVFIGYKLLQKHESARHWLYSNCPNILLAYYNTRDHYSDKGQLPGTEQRKEDVKRWKLAAAIENEGQQKEQHQKTRKGKSADSTKGEAQ

SEQ ID NO: 128812 - protein, 173 aa, Heterodera glycines
  Coding regions on vcDNA: vcDNA=SeqID_55235; Strand=+; Position=1 -172,325-645,846-874
MPTNWPPHGIDDSEQLQHLRTDANNVYFAKILEFDDEEEEEDSTGRAVGRTTPQGARVTAYIEHIPRGEQAKPMQPQNGAVDHPHFGEEEEAKKDKQLLDDSSAAEDDDYFEDDDENDDLYTDESTEGQHDIRHRISNKSPGSARPIATNEASRGLADLSSKTRERQKNKYKQ

SEQ ID NO: 128813 - protein, 119 aa, Heterodera glycines
  Coding regions on vcDNA: vcDNA=SeqID_55236; Strand=+; Position=1 -221,274-412
MNSVLEGIYNGVPMVCVPFFGDQFYNAESLARQNIGLVVDREQDKKAVQQQLTVALAKALGQNELLDDKLNKEFNHPEDKIDLVKLEKVTYEFRHKDIAKTLSDVMKVIDEELKEERAA

SEQ ID NO: 128814 - protein, 44 aa, Heterodera glycines
  Coding regions on vcDNA: vcDNA=SeqID_55237; Strand=-; Position=1 -11,395-518
MTNLGESARIFSDWLNDAKAHLEVRLLVELLFAHAQATRIRTTY

SEQ ID NO: 128815 - protein, 63 aa, Heterodera glycines
  Coding regions on vcDNA: vcDNA=SeqID_55238; Strand=+; Position=1 -85,130-236
MGNANYCQDEQNDFFVALFGWSLKFAELAIFAKFGILRQMALTNKGPGLIFVANRYLIKLGNH

SEQ ID NO: 128816 - protein, 49 aa, Heterodera glycines
  Coding regions on vcDNA: vcDNA=SeqID_55239; Strand=+; Position=1-147
MAVAKLYAILARQKSSSDYDGEDGQLMDDIDYEKVATNPMIDAAAKQFM

SEQ ID NO: 128817 - protein, 39 aa, Heterodera glycines
  Coding regions on vcDNA: vcDNA=SeqID_55240; Strand=-; Position=1-118
MTKPNADLLGVTQNTRRGLLDDGLYSADIQSLIPWKRGL

SEQ ID NO: 128818 - protein, 148 aa, Heterodera glycines
  Coding regions on vcDNA: vcDNA=SeqID_55241; Strand=-; Position=1 -205,315-556
MAEKQAIGLMKKMEANRNVQLSENAKNITKLKEIIEKNKNSSNFKKLTKDQLKNIVYLKFGEMAKQMKGHGIPYNKQRSKRAVDSSPADQLMLDVDLVTTCILLIAYTMVMFYLIHFHRTDQLFFHIIFLVFCDNFIANCLLFQAKPW

SEQ ID NO: 128819 - protein, 96 aa, Heterodera glycines
  Coding regions on vcDNA: vcDNA=SeqID_55242; Strand=+; Position=1-415
FWSCHSPFYCLIKIARNPSNYLHPFPNLFLISPTLRGPQMAPFGQSVPCLFLIKCAHSLLISAISPFFSSSNCPNLFWSIVFWLFLLISVTPPHLY

SEQ ID NO: 128820 - protein, 106 aa, Heterodera glycines
  Coding regions on vcDNA: vcDNA=SeqID_55243; Strand=+; Position=1-321
MALEEDEDLQRMIDQGPGEQRQQPKQRDGQQQQEGERQGKGVTRRKTADEVVKSKHNFKTKLPQVLRKKRNKKIEKAVGLERELEELKRRRRYDQKPEGREKILET

SEQ ID NO: 128821 - protein, 52 aa, Heterodera glycines
  Coding regions on vcDNA: vcDNA=SeqID_55244; Strand=+; Position=1-158
EKVHFACGEQDQRLENEGEAISRGEEEEDEEEVEGGQSSDSSYVKVIAFADG

SEQ ID NO: 128822 - protein, 30 aa, Heterodera glycines
  Coding regions on vcDNA: vcDNA=SeqID_55245; Strand=+; Position=1-92
SCALYESNQLKILGFYTITLFMFEQTLSFW

SEQ ID NO: 128823 - protein, 19 aa, Heterodera glycines
  Coding regions on vcDNA: vcDNA=SeqID_55246; Strand=-; Position=1-58
SGLGEARLCTRSRSRRRSP

SEQ ID NO: 128824 - protein, 136 aa, Heterodera glycines
  Coding regions on vcDNA: vcDNA=SeqID_55247; Strand=-; Position=1-411
MAPAFFAVTQTQMKNGKFLEKAFDTLCCITIKAEKDVMKRDELAEIIGEFEANQRNFCQELKKGQNIWEALESSAGNAIVTAARNVKVNPQTYEGFRKLTKLKIVSPENQTAIGTFVKHCIAALKIFREFITGIVN

SEQ ID NO: 128825 - protein, 686 aa, Heterodera glycines
  Coding regions on vcDNA: vcDNA=SeqID_55248; Strand=-; Position=1-2061
  Homolog annotation: Hit_ID=NP_491240.1; Match level="QueryCoverage =99%, HitCoverage=54%, E-value=1e-137, Identity=39%"; Hit description= zn-finger, CCHC type and RNA-directed DNA polymerase  and Integrase, catalytic domain containing protein
MPSPKDISSLRSFLGMVNHYQQFVKNMRFTRKPLDDMLKDDIEWKWTEERQKAFQKLKEVLTSELLLTHYDPKFDIIMAADASELGIGAVISHKFPNGQSKAIAHASRSLTPAEKNYSQIEKEGLALIFAVQKFHKMIYGRHFTLQTDHKPLINIFGSKKGIRQCSANRLLRWSLTLLAYDFDIEYVNTNEFGQADALSRLIAKEFECDDERVIAACNIDEDLGTVLDMAKQILPIKFENLVSESKKDKTMQIVMKFVRDGWPDERKLTPQSEEIELFGRRKADLTILKDCLMYGERIVIPEKFRTKILTLLHKGHPGIKRMKQLARQYVFWPKLDQRIEEFVKNCAPCQLAAKAPTKTDLHSWPKSTRPWQRIHADYAGPFFGKEFLIVVDSYSKYPEVFEMATKSAAATIERLRYLFTRHGIPETLVTDNGTQFAASEFAKFTEANGIAHLFSAPYNPMSNGQAERFVDTFNRAFRKIKGEGVPNKEIINTFLVTYRTTPNDSLPDEKTPAEMLLGRKPRTTIDLLMPPLPQPTERDTKMEHHFNRRFGARPQKFVSNKPVWARHRLSQNWRAGTICDCSGVIYTVKFPDGSTNRFHANQLRNRENTENGHEPLAILNEAFHLPITAPNVGIVGQDLEPRPDPINDGHQDEIEPEQAPRSPTPPQQAPRRSGRNRRAPDRYSPG

SEQ ID NO: 128826 - protein, 103 aa, Heterodera glycines
  Coding regions on vcDNA: vcDNA=SeqID_55249; Strand=+; Position=1 -53,138-294,899-1000
MATVLSKDLLNKWSCSVCTFDNWPTAPKCTICGRLRSGGSANESEVRQIQQQKQQKAQQLNIGRTGRQRSFALSANGRKQQQHKDDADDEQHHHHKHSDQDDE

SEQ ID NO: 128827 - protein, 46 aa, Heterodera glycines; identical to SEQ ID NO: 127617
  Coding regions on vcDNA: vcDNA=SeqID_55250; Strand=-; Position=1 -86,246-300

SEQ ID NO: 128828 - protein, 58 aa, Heterodera glycines
  Coding regions on vcDNA: vcDNA=SeqID_55251; Strand=+; Position=1 -23,429-582
MTTKFRTPKQLDMHGGNANLADITHGISADSNFNFMVGHNHWRQMVILHNRKWFAQVE

SEQ ID NO: 128829 - protein, 265 aa, Heterodera glycines
  Coding regions on vcDNA: vcDNA=SeqID_55252; Strand=+; Position=1-798
MSNDAFIAFCKTEIREKRETPKIEPKRKERPVKQKVQLKSEINKKENVLKTKEQNATVSVLPKSTVKLVKDSQQKMSNPIKILPQSTQSTVITTSKPQVKLSTTVMPVTTSTTPKPITVQRVITSTSYPNVNYDGHFETISVKRPQNERIYQAKGREFKNFGSRSESTTTKKPITVTKVGTNIPKNLTVSKPVKIHKIERPVGVNCDTNKNLTITQKPKNGVKKSHPRAGVQKNCYHNHNHFNGKAHGNKYFCHYDFYKSHAKCE

SEQ ID NO: 128830 - protein, 136 aa, Heterodera glycines
  Coding regions on vcDNA: vcDNA=SeqID_55253; Strand=-; Position=1-409
MPAFLRSVLFLCPSFFPLFLPSNGQKPNKIQQIGTPCTNYYDGKTDYGCDEKSEKLRIFVVADAGGKEDENKKHSPTKGQQSVAKLMAELAEKEGLNLMLNLGDNFYENGVTKDTVNELFKTVGLASAECREKGVP

SEQ ID NO: 128831 - protein, 282 aa, Heterodera glycines
  Coding regions on vcDNA: vcDNA=SeqID_55254; Strand=-; Position=1-861
  Homolog annotation: Hit_ID=XP_311331.1; Match level="QueryCoverage =100%, HitCoverage=100%, E-value=5e-34, Identity=36%"; Hit description=ENSANGP00000001657 [Anopheles gambiae]
SSSNQYCTSSNHYCIFYHFCTSLNHICTSSNHCSSSFNHCCASFNHYCTSFNHSCTSFNHSCTSFNHCCTSSHCCTSSHHCCTSSHHCCASSNHCSSSFNHCCTSPNHCCMFLHCCTSSIYFCTSFNHRCTSSHHCCASSNQASCTSSNHSCTSSNHCSSSSVVCSYHCCTSSIYFCTSFNHRCTSSNHRCTSSDQCCTSSNHFCTSSNRCCTSSNHCCTTSNRCCTSSNTSSNRCCTSSNHCCTSSSCCNHSSNRCCTSSNRCCTSSNHCCTTSNHCCTSS

SEQ ID NO: 128832 - protein, 244 aa, Heterodera glycines
  Coding regions on vcDNA: vcDNA=SeqID_55255; Strand=+; Position=1-735
MARILKLQRGRDGETRSTLILLNGKGKWRATNQLFPMEVQSEIPETQLIAFIMDIDMDSVSLPGSEDEASERSAPKFKIPKKRRAFLRPIGQQHSPLQGPRRKKMELGDSGLRKLFAAISEEQGGSKATTNAITESRQMEKAPEHVRKEHDKEMARRQREKVQRIPTEEIRQKLAALPHITVSSENAETQRKERKENEVRRKNNQQSTSEGWKQLAKQLDYDLMDEPDEPALERRKATEEQSVK

SEQ ID NO: 128833 - protein, 60 aa, Heterodera glycines
  Coding regions on vcDNA: vcDNA=SeqID_55256; Strand=-; Position=1 -102,1408-1488
MSNFLNHTLSSSSTILSAAAAGANETTERFRLALFSLTTDDEEDDEEEGKNGRRSAAGIA

SEQ ID NO: 128834 - protein, 86 aa, Heterodera glycines
  Coding regions on vcDNA: vcDNA=SeqID_55257; Strand=-; Position=1 -124,318-454
MSTTEFEIILTPNLSVFMPKLTLYLPKFNDLGWQWLRFRMEATPQLDERGQRTTEEEKAFCTHTLASSRDLLLNNVIDKSGTKDRK

SEQ ID NO: 128835 - protein, 58 aa, Heterodera glycines
  Coding regions on vcDNA: vcDNA=SeqID_55258; Strand=-; Position=1 -162,592-606
MIDKTVDAAAKTVDAAAKSAAKTVDAAAKSAVKSVDAAAKTVDAAAKTVDAAAEDKVN

SEQ ID NO: 128836 - protein, 256 aa, Heterodera glycines
  Coding regions on vcDNA: vcDNA=SeqID_55259; Strand=-; Position=1 -188,373-544,594-681,751-869,923-1015,1534-1642
  Homolog annotation: Hit_ID=EAL50742.1; Match level="QueryCoverage =42%, HitCoverage=97%, E-value=1e-13, Identity=36%"; Hit description =hypothetical protein 17.t00039 [Entamoeba histolytica HM-1:IMSS]
MRSAAAKRAAAGAKGGADESDEQRRLEKIMEEDDDEEDEDEEEENMESLSEDDDEEEEEDEESDEDEEEDEDVSEVGMITAEDDDDEAQHIRVRTQQQQVQPEDEDFMRDFDRLMVESLQSAPATLHGPMSDLAVPPLVRQKFERKLKFADPTEPTTATPIDRPASPAGVLTPSHGVSSVVRQQQHHQETPRMALMLRASAAKGGGSGGAMAKAGGVQLKVTLAMNERISADEEAERRRQIQQKLFTYQQQSPTGG

SEQ ID NO: 128837 - protein, 84 aa, Heterodera glycines
  Coding regions on vcDNA: vcDNA=SeqID_55260; Strand=+; Position=1-254
FCFKVVTKILRLHYCLMRKKNILFYPEIRSMFSDEDEEEDEDVSEVGMITAEDDDDEAQHIRVRTQQQQVQPEDEDFMRDFDRL

SEQ ID NO: 128838 - protein, 85 aa, Heterodera glycines
  Coding regions on vcDNA: vcDNA=SeqID_55261; Strand=-; Position=1 -67,1140-1330
MSVIMQVMHDKSSNIEDARQKVDYETREAWSEHIEVLDEFPEDVENLVDDVLNTWRKGEHFPKGLAEAHERVAEVEQFYKAKVRC

SEQ ID NO: 128839 - protein, 43 aa, Heterodera glycines
  Coding regions on vcDNA: vcDNA=SeqID_55262; Strand=-; Position=1-131
MSTLMTHPDNCRMGIWGGLAQWKEILSGMRGKDNTKVEMEIRE

SEQ ID NO: 128840 - protein, 92 aa, Heterodera glycines
  Coding regions on vcDNA: vcDNA=SeqID_55263; Strand=+; Position=1 -212,580-646
MHSNFNVQCLANCFDCLAFLLKLTFQTVPFCAGARMASSSSGQVEHGTGKAQIVRTLVLISDLHFRNILMGFWFTWHCIATDQKDNREDGEQ

SEQ ID NO: 128841 - protein, 253 aa, Heterodera glycines
  misc_feature (227)..(227): Xaa can be any naturally occurring amino acid
  misc_feature (233)..(233): Xaa can be any naturally occurring amino acid
  misc_feature (238)..(238): Xaa can be any naturally occurring amino acid
  Coding regions on vcDNA: vcDNA=SeqID_55264; Strand=-; Position=1 -64,120-329,453-674,733-939
  Homolog annotation: Hit_ID=AAP30755.1; Match level="QueryCoverage =99%, HitCoverage=99%, E-value=1e-87, Identity=71%"; Hit description =putative gland protein 29D09 [Heterodera glycines]
MSSLLLSIFSIVFLVCCNAMPNFPCFPCCPGSQQVVSVMSKYIGTFSAAGEESTVCSMTKSTVDGLKSDLSSRGGCPSGGEAQIVDEIDRQLRNIAKMEITYEDECPYNLGFARAMFDLAAAAAGHAGTGTEWHSLKSQFEQESQTIKAISQALNIEVTVHFGHPSKGNSAHQNVPSPSHVITNPGNSAHQNVPSPSHVITNPGQQSSVPWKGRRTVVIRFRLLRKXKKGINXKENSXYRKHFVDYMKNIYLF

SEQ ID NO: 128842 - protein, 48 aa, Heterodera glycines
  Coding regions on vcDNA: vcDNA=SeqID_55265; Strand=+; Position=1 -72,348-422
MINRGNDTDEWAVQKGDERGIVAEVFVSNFRNEVKVNNDSIKDHLNYF

SEQ ID NO: 128843 - protein, 241 aa, Heterodera glycines
  Coding regions on vcDNA: vcDNA=SeqID_55266; Strand=+; Position=1-726
  Homolog annotation: Hit_ID=CAE62857.1; Match level="QueryCoverage =70%, HitCoverage=33%, E-value=1e-11, Identity=30%"; Hit description =Hypothetical protein CBG07036 [Caenorhabditis briggsae]
MRTEDQQLFFAGGEGAAAAEESGGTKNDGGGRETDEDEESDSSDHNHHDQQGQRRGKKKRQRKQQRREAAAARRLEEEEREQQRQDGEEQAQREEETGDGDERARCVAAEEKENNNSGNNSCGGREGECYEIAVATEEAESGNITVKKEAETAKKRKKGKRTDEQQRKTAAAAGGHEEQQSKGPVHCECTRCGAEFESKTKLHAHLRDSGHATLKTVADKIGAAAADSATDSGGRRRRKKK

SEQ ID NO: 128844 - protein, 139 aa, Heterodera glycines
  Coding regions on vcDNA: vcDNA=SeqID_55267; Strand=+; Position=1 -57,568-856,1374-1447
MQMSSTSACEQKSFPVDQKNKTTGTKRTRTIETITVAEETDKNEEKVDNSFDKKKRKSAKQRVPTNPTKLAPSTAENGTEEKGKQKRNQKQGQVEFDYEMRRVLPPQNLEVTVKNASRLPEGSHFCEQSANFQCEPSHS

SEQ ID NO: 128845 - protein, 190 aa, Heterodera glycines
  Coding regions on vcDNA: vcDNA=SeqID_55268; Strand=+; Position=1 -149,324-425,1106-1427
MRRWSAAPSSPVGPPQSGSISNSLATRSFVIGCTMTRDGVRRKGKAANLRWRTTLAQGIQKTIGSLNGTKSTSSAFDRLEKTKRDWLMALHCHRYSGDGWAYEAPLPDWATTEIEADSDPQQGEEEENAMNGDGTDNQQKQRRSSSTTTTPATTKTTAGEETVPKSVAPPTAMTEEEDEELVPKNAQNAL

SEQ ID NO: 128846 - protein, 141 aa, Heterodera glycines
  Coding regions on vcDNA: vcDNA=SeqID_55269; Strand=-; Position=1 -280,654-799
MIQRTEKGTAILLEASKKEAERAWKEVSVLVEEADDYSKSARGALNRAIKSREKAPYAPGVREWFVKMSDCIWEIYTVLDKINAESERVETMWLALPLRLPQENTIDVLLEQPIFSNFFPLDDTVIFEIIIVSLNVKNDDN

SEQ ID NO: 128847 - protein, 102 aa, Heterodera glycines
  Coding regions on vcDNA: vcDNA=SeqID_55270; Strand=+; Position=1 -136,632-804
MAPFLWSIPLLAIVCFLSVGITAPNSDNEQPNDGATTAVEQKHIENEEKEVQIGNHLDKKEVEKGKEEEEEDDDCKKKKYKKKKGEEDKKKKDKKREKRRRR

SEQ ID NO: 128848 - protein, 78 aa, Heterodera glycines
  Coding regions on vcDNA: vcDNA=SeqID_55271; Strand=-; Position=1 -169,293-360
MSSNSATTTTSTDNGISLVEADERGAEGGEGDDQLTINSLSSSLSSSTATTDTEGEMIQDIQFEGFFGPKMIIFSFPI

SEQ ID NO: 128849 - protein, 276 aa, Heterodera glycines
  Coding regions on vcDNA: vcDNA=SeqID_55272; Strand=-; Position=1 -7,230-539,887-1400
MAVWRCVIVGSAVSIKTLNEVIETSFLINGNDDQLFDEQTNAELIRCHEYFLKTSILDTLDMILSNFVELILLIGFTNVHNFLKKNFKKKPNVFWNSLKESIDNISFETRIVPEIMCQTVTGTQDNRSSCASSSKSSRPMFDDSDGGGAHGLKLFQSCLFHHDQYDRWERLYNEEQRREFLEIEEEQIWREMPKRKKIMAQAERVGAALLYTMIHMEMSKLFESKQVKSESSSWSAKSARAMSQLREKLKRVEKPAVSRRANSVFSSRKQPELDGP

SEQ ID NO: 128850 - protein, 79 aa, Heterodera glycines
  Coding regions on vcDNA: vcDNA=SeqID_55273; Strand=+; Position=1 -99,1199-1292,1344-1390
MNKGTVEKCIGRVGGVHQDGATTDGVERWTAKMITQLKAACQGVVDACCESNSASAEAFAFLTNHVMTLNSMVLGGMPE

SEQ ID NO: 128851 - protein, 21 aa, Heterodera glycines
  Coding regions on vcDNA: vcDNA=SeqID_55274; Strand=+; Position=1 -30,297-332
MEESNGQIMMISSQVIDIGLF

SEQ ID NO: 128852 - protein, 182 aa, Heterodera glycines
  Coding regions on vcDNA: vcDNA=SeqID_55275; Strand=+; Position=1 -134,340-397,568-921
  Homolog annotation: Hit_ID=NP_872170.1; Match level="QueryCoverage =70%, HitCoverage=11%, E-value=5e-15, Identity=36%"; Hit description =ankyrin and patatin family member (5V188) [Caenorhabditis elegans] emb|CAD54162.1| Hypothetical protein W
MTALHFAVSRRNLQITRLLLCLGADPNVANAHGDTPRHLAAKLNEVDLLKSLIICDARRCPLTKVGCVSGCVNEKQLHELKRTSTSSMQSSATGNTTSTSSTASSSSSSSSTTSAVASATAAAAAATAPPAQPATSSQPAAGASTTAPKPASYTSVTVEDFENRAFDKEHFRFNKLLDIQHN

SEQ ID NO: 128853 - protein, 90 aa, Heterodera glycines
  Coding regions on vcDNA: vcDNA=SeqID_55276; Strand=+; Position=1-355
MFEYPKRTLEKIDFFVFGAVPPNRCAQIYGETESFGNSFPIVCTLILRWIFAPHKCLSTPNGHLKKSIFLFSGQSPRTDAPRFMGRSNPS

SEQ ID NO: 128854 - protein, 53 aa, Heterodera glycines
  Coding regions on vcDNA: vcDNA=SeqID_55277; Strand=+; Position=1 -96,581-646
MPQTATMRAIVIIGLVSRHVVGTAAALCQWWSYALSTEDKHVVAEKTQISVSN

SEQ ID NO: 128855 - protein, 40 aa, Heterodera glycines
  Coding regions on vcDNA: vcDNA=SeqID_55278; Strand=+; Position=1 -83,170-209
MQWMAFNLQEIRLAICGSKTPLGRFAAETCSETHQMLIKS

SEQ ID NO: 128856 - protein, 43 aa, Heterodera glycines
  Coding regions on vcDNA: vcDNA=SeqID_55279; Strand=-; Position=1-298
CFAVPRPGRQWIALNLQEIRLAISGCKKLLGNELFFEVSQTPY

SEQ ID NO: 128857 - protein, 45 aa, Heterodera glycines; identical to SEQ ID NO: 124814
  Coding regions on vcDNA: vcDNA=SeqID_55280; Strand=-; Position=1-471

SEQ ID NO: 128858 - protein, 88 aa, Heterodera glycines; identical to SEQ ID NO: 124691
  Coding regions on vcDNA: vcDNA=SeqID_55281; Strand=-; Position=1 -96,135-305

SEQ ID NO: 128859 - protein, 193 aa, Heterodera glycines
  Coding regions on vcDNA: vcDNA=SeqID_55282; Strand=-; Position=1-582
MKEKRIQQEKNRFMRKDVKAVARAEAKRAKEKTKTAQTEEQDKCETRKDWEERRMKTHAERMEWLKKAPTAQRERNSTQSDPRRHSISPIRTEEGEVEIVAEIRGERPMPNQFGKRKRPNYSISPDRRWKQGRERSRSPVSQFPRNRRRLPYSISPIRRPHQEEVQLVEPAPSVEIIRTVAVKPRMKSPTDAA

SEQ ID NO: 128860 - protein, 109 aa, Heterodera glycines
  Coding regions on vcDNA: vcDNA=SeqID_55283; Strand=+; Position=1 -48,484-765
  Homolog annotation: Hit_ID=NP_730569.1; Match level="QueryCoverage =98%, HitCoverage=39%, E-value=4e-27, Identity=56%"; Hit description =CG4365-PB, isoform B [Drosophila melanogaster] gb|AAG22178.1| CG4365- PB, isoform B [Drosophila melanogast
MHHALNERLAALPDETLVYCGHEYTVANLRFARTMEPSNEAIHQKLDWAQGQREADRWTVPSTIGEEKRHNVFMRVHCSAEVQQRCGTGTDPVAAMGRLRELKNAFKEK

SEQ ID NO: 128861 - protein, 116 aa, Heterodera glycines
  Coding regions on vcDNA: vcDNA=SeqID_55284; Strand=-; Position=1 -23,82-409
  Homolog annotation: Hit_ID=AAV34698.1; Match level="QueryCoverage =88%, HitCoverage=32%, E-value=9e-09, Identity=35%"; Hit description =IC5 [Globodera pallida]
MKVFKLKSFVTIGFATKEVPLDGSIGQILNSYGYRSDGSFGCNGINRPCKMPMSLFGSSFSPVAMQSADVEMAYKSSEFSTGDVVGCGIFLDTRLIFLTKNGQRMGGPIKMKKQIN

SEQ ID NO: 128862 - protein, 60 aa, Heterodera glycines
  Coding regions on vcDNA: vcDNA=SeqID_55285; Strand=-; Position=1 -65,112-231
ALVTSSGDHSPPAVVSAKVAKEVPNSQQQNGWDAKVCHKDIEIIGEKQLTINCKGNRFGI

SEQ ID NO: 128863 - protein, 289 aa, Heterodera glycines
  misc_feature (5)..(5): Xaa can be any naturally occurring amino acid
  Coding regions on vcDNA: vcDNA=SeqID_55286; Strand=-; Position=1 -349,649-792,841-938,1065-1152,1196-1310,1796-1849
  Homolog annotation: Hit_ID=NP_506373.1; Match level="QueryCoverage =97%, HitCoverage=31%, E-value=3e-50, Identity=40%"; Hit description =p-type trefoil domain and Glycoside hydrolase, family 31 precursor (5O96) [Caenorhabditis elegans] emb|CA
TKKSXLTFIIVPFPFLSQANPKFGNYSTKNICVVLFQIHSKLINCLQYNPTVPMCYYPPNKGYTIQSNVPGNLKLKSSNTLNNPYSRPNLDIEVQYQKMGDGIYVRIGTEDRYELRNPSNFEQVISSNSLSFELGNANEPFSFKIQRNDSNKRIWDTSIGGLVFGDGLVFGDQFIQIATFLSSDRLYGLGENMHHELKHDFSIYKTWSAFSRDQGNEYYVPGSYNGYGVHPFYVGVHPFYVGLEPSGKAHGVLILNSNAQEYVTGPGPHFVYRTIGGHLELFFPGPNGG

SEQ ID NO: 128864 - protein, 40 aa, Heterodera glycines
  Coding regions on vcDNA: vcDNA=SeqID_55287; Strand=-; Position=1-168
FALILTYYIEKTAILINFTSTFETFFPLFSPLFREFFAPI

SEQ ID NO: 128865 - protein, 36 aa, Heterodera glycines
  Coding regions on vcDNA: vcDNA=SeqID_55288; Strand=-; Position=1 -71,412-451
MFCANLWCRCFCFCCAAFLAISDHMPSLQLNMRDHY

SEQ ID NO: 128866 - protein, 88 aa, Heterodera glycines
  Coding regions on vcDNA: vcDNA=SeqID_55289; Strand=+; Position=1-267
MFGIMCRPVLFMVCACFVLFFVHITQPELFMPNHAPTDENEIPNIGKAEPDAIGRFGHEHPRNSDTETEKPAHGFDIGPEFSPVLAFE

SEQ ID NO: 128867 - protein, 146 aa, Heterodera glycines
  Coding regions on vcDNA: vcDNA=SeqID_55290; Strand=+; Position=1 -110,229-261,311-330,643-706,748-962
  Homolog annotation: Hit_ID=NP_498863.1; Match level="QueryCoverage =99%, HitCoverage=23%, E-value=3e-35, Identity=53%"; Hit description =GTP-binding protein LepA like (3J519) [Caenorhabditis elegans] gb|AAA28191.2| Hypothetical protein ZK1236
KSTLADRFLQLTNVISTESDAQYLDKLEVERERGITIKAQTCSMFHKDFMLNLVFEVKRSLITCDGAILLVAANEGIQAQTLFNFHSAFENNLSIIPVINKIDMKANIAKVEEELQQSFGFHAVEIFKVSAKTGRNVPKLLEAIIQ

SEQ ID NO: 128868 - protein, 301 aa, Heterodera glycines
  Coding regions on vcDNA: vcDNA=SeqID_55291; Strand=-; Position=1 -169,227-298,357-517,569-690,739-800,856-1082,1138-1230
  Homolog annotation: Hit_ID=CAB40412.1; Match level="QueryCoverage =98%, HitCoverage=60%, E-value=6e-92, Identity=58%"; Hit description =hexokinase [Haemonchus contortus]
ASGVVGENVVHMLRDAFKRRGDVDIDVVALLNDTTGTMLACSFIEQHCYVGVIVGTGCNAAYMERLENVPKLKGIVNSAEDGLPAEMCVNTEWGGFGDDGALDQFLTIYDQQLDQQSLNPGRQRFEKTISGMYMGEIVRLALEDLARRGLLFSGDFTRISERGCISTKMVSDIEGFMHSTDGNPFAKVGEMLRAIGISNSSAADCANVAYVSSLIGTRAAHLCACGLAAILNRMQRPRVTIGVDGSVFRFHPTFKFNLDQKIKALLAVKCEFFMVLSEDGSGRGAAVAAAVALRMNRLVGA

SEQ ID NO: 128869 - protein, 18 aa, Heterodera glycines
  Coding regions on vcDNA: vcDNA=SeqID_55292; Strand=+; Position=1-58
NLVLQYPNEAHIDELKGI

SEQ ID NO: 128870 - protein, 46 aa, Heterodera glycines
  Coding regions on vcDNA: vcDNA=SeqID_55293; Strand=+; Position=1-141
LNDIGLYHDSAPHRSMWELKPEYRNYSKQLAKNVEQKMQQQQQKDG

SEQ ID NO: 128871 - protein, 146 aa, Heterodera glycines
  Coding regions on vcDNA: vcDNA=SeqID_55294; Strand=+; Position=1 -93,288-375,439-645
  Homolog annotation: Hit_ID=XP_392858.1; Match level="QueryCoverage =86%, HitCoverage=54%, E-value=1e-24, Identity=44%"; Hit description =similar to ENSANGP00000020929 [Apis mellifera]
MFSLFRGAYGEMTRKEEYFVALFGLDGAGKTAYVERLKAHFDRHYRCRNLAKLSSTVGLNHVRVPLAGAVLNVWDLGGVRVPLAGAVLNVWDLGGQAELRPLWHSYLAECHALIFVVDSSDVQRLPEVCSALGGGTEKAKKWGGGG

SEQ ID NO: 128872 - protein, 30 aa, Heterodera glycines
  Coding regions on vcDNA: vcDNA=SeqID_55295; Strand=-; Position=1-91
MTVVIGNAMCYWLVGIITVFLAVNDVTMVY

SEQ ID NO: 128873 - protein, 256 aa, Heterodera glycines
  Coding regions on vcDNA: vcDNA=SeqID_55296; Strand=+; Position=1 -187,239-390,445-876
  Homolog annotation: Hit_ID=CAE61684.1; Match level="QueryCoverage =65%, HitCoverage=49%, E-value=2e-14, Identity=29%"; Hit description =Hypothetical protein CBG05629 [Caenorhabditis briggsae]
MPSKEKVGTKRDGRIDLLILLKAIEYLRHILDNSFRIRRLDLNIQVSTELVVNDILDVLNGHAKVQLEELFVRRRYVGSKFSGLVPLIRSNAKTLKQIGKIGLGEAIKALSDEIHLERLSLINFDLVEQDQRLDSEELAQNSRFYIRRLAGIGTTFDHLSYTCFTGFEITKMPALNMLRQCKVCHSKSTFAVTAILLMPFAGQKSSSDDAKRRGHQRPGTPSPAVADDAANSIGRRNGRVVGETVVAVSRPGGARN

SEQ ID NO: 128874 - protein, 203 aa, Heterodera glycines
  Coding regions on vcDNA: vcDNA=SeqID_55297; Strand=-; Position=1 -232,395-510,560-717,792-897
  Homolog annotation: Hit_ID=NP_956607.1; Match level="QueryCoverage =97%, HitCoverage=20%, E-value=2e-35, Identity=42%"; Hit description =similar to chromodomain helicase DNA binding protein 1-like [Danio rerio] gb|AAH50498.1| Similar to chrom
YICEQLDGTVSQPDRQKAIQNFQRPDSDVFAFLLTTKAGGLGLNLTAADTAIFLDWDFNPQNDKQAAARCHRIGQDKPVKIIRLVAKHTVEELIKQRAAKKLKLSENVLGTDEKEGPSLMFDLSKLLLEGLTDLEKEQKKHTQFHILTDKQLEERLGRTDQNGHWQIKDEQIEDEAEGRTLYMFEGYDYSEQRAAAEKAGIAL

SEQ ID NO: 128875 - protein, 215 aa, Heterodera glycines
  Coding regions on vcDNA: vcDNA=SeqID_55298; Strand=+; Position=1 -9,276-911
MQKPFTRHKTTGENPALNIYIYWRGNQNSFRGRQFGGYVQRNPNFIPLGQNRTWNGNFGNNTGRFENFRPQRGNFGNFRGNSRGRGSERQKYKINAISDEAAQPSVSNSRRSLTPTMTFLTISMILCSFFGTISGQYQLCSDRVPTTPIWLPNVTECSVPEYQKADERKVTLFLAVRMPKQFPVYNCYQKMMKICTGNFLFFWKDIKSQDSYVKG

SEQ ID NO: 128876 - protein, 1237 aa, Heterodera glycines
  Coding regions on vcDNA: vcDNA=SeqID_55299; Strand=-; Position=1-3714
  Homolog annotation: Hit_ID=EAA65151.1; Match level="QueryCoverage =37%, HitCoverage=41%, E-value=7e-18, Identity=25%"; Hit description =hypothetical protein AN0646.2 [Aspergillus nidulans FGSC A4] ref|XP _404783.1| hypothetical protein AN0646.
LMPKNQKSKRFSKKSSSASAALSSPPALLDISALPNPVYEDISSPEGSVITGAVVANTIVSTIEPNLDNAVLTTLSPEDVDRIFADDPGMAEEVGRTDRVSEIGPQIKSMLDNSAFGPSVMNETRALGTNESTFEEIAVSSGALETMGAMISVLSVQGEEERLIERAIEVIEETQKMKGSFGQMIMKEMENEGEKGEEEANRDLGPSVMDVVEIERSQGVNYVLEVDQDGIEVFKEKNPLGKRRRNLSEDENGKDMENEGDDGGSGRKMVICQITDKMAIAIRFGGKMKGPDIIGIPESFELGVQLRLGDIVFVTSYAPIERFPDWLSNAFKINAEAEAMTVSSVLQNSLEKCIGIVMSMVRENKDVPRAVDVAFPESQVLQRLYQHQLDSTIDLAKIKPGVLINVTFVRIHRPSDIAIGPKGIYITPADFEGVSERELVVHQPCIGTGISGFVNGYEFPFSTSTDLKLCEHGIAAAVSGALLKAKAEMEEFTIHTALFVLESGKDNIVVTFEHFVQEKRKFVNLTKIWEIDAAVTAKLKGAKKPCAVGRILDVHKCVVQEMFVLQAKVLLMFQLARKYDAEGDFERLAEGHEASITPSESFQALELRVERFYGHMFSCMSSGSDGTSRIWKILLAQNNVENEDTSSEVLARIERHPALRKLEGGQIRTAELMLDNVPRVVAQQAPPGSGKTYTLAAIVAALMSNPKNKILCLAPLNVAVVKMCEELVGALQTEGCDEVPLALFSGNGKGKYRDYLDKIAGNLLESVVTSEDFWKKLEQKEKREVHRYLRDVRKRPRIAKEALIAEYVLNLDRRRVLCCTLGFAEQIGRLICERNIVVLDEAGQGPFVQVCSTLSALCEIKKVLVTGDRYQLAVNMQSVPEPVRVGFGFDTVLINLDKAKAVDRTTLLTNYRSHWQIVACVEHMAYKPHGERLQPGPGSFRMLIDFWKMPVAESPLLLIHQESLMEPELTSFSATNSGQTRTVLDLLALLDGFPGSIRIISFYAGQAAQIGTELKEQGFSRSIVSATADAMQGHEADITIVTTTVTKQQQFSNWQRANFSKDRKSEFWGDAQRVNVALSRGKHGLIVIGDFLELGGSPIWSRFLNKAIEFTVVTSPSVVKSIKSPSSSYVRGLLVDDSGESVQNYRFHADWLAPGRSSSTAAVLSRNGRPLNNLNRPNNLNFQNSPINQSRDISNPPLPSRHVQREFSRTRAEIRCWRCNQPGHVSTRCTNPPARQN

SEQ ID NO: 128877 - protein, 355 aa, Heterodera glycines
  Coding regions on vcDNA: vcDNA=SeqID_55300; Strand=-; Position=1 -704,2817-3180
  Homolog annotation: Hit_ID=NP_500013.1; Match level="QueryCoverage =42%, HitCoverage=10%, E-value=4e-40, Identity=50%"; Hit description =predicted CDS, polyprotein family member (4B673) [Caenorhabditis elegans] gb|AAC02594.1| Hypothetical pro
MTAFLAKLRIDASIVPLKNEKSEVDPSFNIDFSKSVAEGKDLDSLKKLVEEFSDIFSKSQYDLGSFTGGEHHFVTTTGTPISSAPRRMPYKYSDELKKHISKLLAAGVMIESDTPWVTPFVVVQKKDGGIRPCLDFRKLNDVMVPDRYPLPRLDAIMEKIGNCNFYSSLDLSSGYFQIKLSDESSWKCGVITEDCVYQMLYMPFGLKNATAAFSRAMTTVLLGLEDCALSYVDDVVVELNGVHATIISCISPNQPPKKVHVNQIKKCFELMGPPCTSPKTPNDEQIVPEKLAVDDEEEVQSNEPSEADNSNQESSESTVTNRQNVTNQTVADISGDKRYSLRNRLAITKPKRFTE

SEQ ID NO: 128878 - protein, 596 aa, Heterodera glycines
  Coding regions on vcDNA: vcDNA=SeqID_55301; Strand=-; Position=1-1791
MDDGMNISVIDKNFWAGKTSVRVPDMERAQVELKNFEEAVNRCLRNINRRACANTKALNDMANQVNSNLSVLQTQLNSLTDINPTARNSLAFTTPRERSTSRNPQHGTSNNSSNSSEDGDEPELGALNTLTGVSGQLEVFGDESVVAFDQWSERFSDYVGALGRNWTEDEKVARLKMSLVGTPRQLFKQLSQNETAKLDTAITALRRKMDSPQRRELTKRTLAQCKQRENETISEFIKRLTPLVEIVNSSLNDSQRKEKICEEFLDRIRSDIGFLIRLVGLNSAKDLDQVKAQAEELEALLAAEKGTISDTLRGTVMALNNQRQVHTDQRPDQSPPHRFSRANTTPLGNRHSSRGYSNGRGRGGYRNRTPSRNRWSSYHQQMQSQRRWSNRPVCHYCGRTGHIASFCRTRQEEMAHRFSRPNHNFRNNGARFDDQRRTNSSQEQLRNVTVLDSDALIRAIANLSVNESRPSGVTVKNEGAGTLKTLAVVETPKKTEEPKSDPNPVPGTSSDSLVPIRIRSWEGIAPKISKFSKFTMIMVMLLTMVIPNMCQINLAIPMPKGPMMCQTQLVGHLWALPSFLPVQPSGLTLLRHQSEV

SEQ ID NO: 128879 - protein, 16 aa, Heterodera glycines
  Coding regions on vcDNA: vcDNA=SeqID_55302; Strand=+; Position=1 -40,509-519
MGKRGKKNRKMRGGMV

SEQ ID NO: 128880 - protein, 905 aa, Heterodera glycines
  Coding regions on vcDNA: vcDNA=SeqID_55303; Strand=-; Position=1-2718
  Homolog annotation: Hit_ID=NP_920205.1; Match level="QueryCoverage =94%, HitCoverage=57%, E-value=5e-94, Identity=31%"; Hit description =putative DNA helicase homolog [Oryza sativa (japonica cultivar -group)] gb|AAP52492.1| putative DNA helica
MHREVRELMHMQLHRCSDSWCGPRDPNFGRCKKGFPAPYSKCTILHPDRPALYYRPSPTDGGAQIEVNGLIYDNSQVVPYNPYILLRYRVHHNVLFAYGNKANIKYALKYPFKGPGHCYVECKEESGSKIGIDEPAQYAKMNFRGATEAFAVVHSMPFAKLSHQVVHLSIHLPNQQPVVYRAFQQVSKAEEIQRGELPETPCSAYWKQWQNEWQHVPSLKDMLFEKVPEQFRWAKDRWLPYKRKPAKRPPIGRVVPVPPTDRERFALYALMRHFPGDPDHLKLVNGQQYNTFTEAALQHGLLEDDQIWHKTLGEAALHRWPDQMRWLFVSILVFGQPSNAIELWDKYKDQMYNPQGITSAAIRQARELQALADIDWRLHYFNLSCVHCGLPDPPNSKAKNTNLAVEEFFFGDDGLNMPPGQPNQRPQQNTPPPLNNDQQKVFDAVVRAIQSDPKDQTVPRRFFIFGDGGTGKTFLFGQIIKRLRKPPYTYKVLATASTGCAAILLPYGKTAHSTFRLGREVSLDKLPSIPLESFFARRIREAQLIIIDEITMLHNTVIEVIDRVCKEMAIPQHKDLLFGGKTVIFSGDFKQSLPVVPHEGLTAQITACFQTSPLFCQFTTMKLTINQRLGQGQQAYLQMCRQIGLGETGEHFWIPPQFLVKSREELIDFVYPDFQRLLGNDKELLNRLILAPHIDTCDEINEIMMANVPGQVREYLSSDKPLDERPLDIDEIELEVAALNRRTDSGMPPHRLRLKVGSVVVLLINKSDKEGLINGTRIVLEELGDDRLVGRVINSNAVGGQVKFFIERTRNVYEDKTPGGLKYERLQFPIKPAFAMTILKGQGQTISTVGIDLERDVFSHGQLYTAFSRATDWNNVRVYAPRRETDAQDRVKVLNIVATKMLNLQ

SEQ ID NO: 128881 - protein, 483 aa, Heterodera glycines
  Coding regions on vcDNA: vcDNA=SeqID_55304; Strand=-; Position=1-1450
MPSKQKNQRKKKQERYRGQMELSVSPDRSPVPDGSADENGVASHPGNTTPNIGALQLSTPVSSIGSKRRSIHPKTGAEPFMASQHSASSADIQSTSATQNDESSPRNKKGKIDNFDRPMSALEAIALTPVSTQMNRGGRPSKKRGGHAGSGRSKANDSMSESSSMDLSSEATTSVALLPNVPEKINFSTVAINFATSRNMACKIRRWADVGLYERDGETSQGPRSGPRFIETCWNDLTQFLNDAFVVEYLAYLASISQRKVVVVDPVVWQMGIDRVMQYKKMTFGYDPNVPAEVILLPVHFPGHWTLIIHDVQFGTHFADSLPTPYGRLDPQLTDKIRKIISDILPSTVLTGIFNAVNLTVQHDGNSCGYFVCLYAESWLMNNRTFVLPDLSINYEKRRILWHINELYGTDNVPYHPREGVPTPCPIVYRHADEVQSTSKAAEPMKIDEHDDIMIIEPQTSGQAVNTVLTQAQVAGENQVDTL

SEQ ID NO: 128882 - protein, 325 aa, Heterodera glycines
  Coding regions on vcDNA: vcDNA=SeqID_55305; Strand=+; Position=1 -101,187-446,496-630,892-932,989-1099,1229-1319,1379-1474
  Homolog annotation: Hit_ID=CAE65834.1; Match level="QueryCoverage =96%, HitCoverage=36%, E-value=1e-50, Identity=37%"; Hit description =Hypothetical protein CBG10959 [Caenorhabditis briggsae]
RTSAGEMPAHLLDEAVARQISASAVFPLINAHLSNDSVLDVSQNDSVLDVSQHMPFFQILLELCAALASVPALLPKIVLPQDAHGKSIAKQLIPQFRNNLNNYPTLMSGISEADLSFMDFIRKVNDYSEVIIRLAVIIRLARQFERQIPAEKRVKTSHSHRYFTRIGADRVRRLRNASATYREVLRELQMSTYRLLNDAGKLVHGFSFKRELRSVLLNDAGKLVHGFSFKRELRSVNPFSSSNKDRTKRIAKELASMHNSLPLNASNAIFVCMDETRCDILKVLVTGPDDTPYVLVTGPDDTPYENGLFEFDVFFPSNYPQQPPK

SEQ ID NO: 128883 - protein, 58 aa, Heterodera glycines
  Coding regions on vcDNA: vcDNA=SeqID_55306; Strand=-; Position=1 -107,242-311
MRWRPDTEYMVGLANYQGMSMVKMNFFLDWVVGDKNFIGQGPAPPPIPFSSPSFNVAC

SEQ ID NO: 128884 - protein, 55 aa, Heterodera glycines
  Coding regions on vcDNA: vcDNA=SeqID_55307; Strand=-; Position=1 -136,199-230
MDLILATDWMNNAYPEMEQDKANMSPKEDPSWISLIDEEEKREPINVKCRNNNFN

SEQ ID NO: 128885 - protein, 104 aa, Heterodera glycines
  Coding regions on vcDNA: vcDNA=SeqID_55308; Strand=+; Position=1-312
MEETFDHTDVQFRHPFTMIVSGSTRSGKSEWIMRLLRNLNKIISVPIERVLYCYGELNPNILNLQRNGRIDNITVTVHNGVPTEYYIKGNAKKEKLLLVLDDLL

SEQ ID NO: 128886 - protein, 111 aa, Heterodera glycines
  Coding regions on vcDNA: vcDNA=SeqID_55309; Strand=+; Position=1 -136,202-237,294-457
MVKHVLLEYDTVVWLDTSVVFHKNDFKRFFEPMQNGKIGTVQIPSFALHTMNMSTHPGMYEYLPMYTNFEPNRTYELIGTYKPIIKTDPPQFETNFVIMHKSEQTRQVMKW

SEQ ID NO: 128887 - protein, 41 aa, Heterodera glycines
  Coding regions on vcDNA: vcDNA=SeqID_55310; Strand=+; Position=1 -37,359-450
FKVANPSFHHLTEIENSPFEIAHRIQFIHLHSLFFVTVSKS

SEQ ID NO: 128888 - protein, 17 aa, Heterodera glycines
  Coding regions on vcDNA: vcDNA=SeqID_55311; Strand=+; Position=1-53
MALLCAAEPDCMVPIGQ

SEQ ID NO: 128889 - protein, 116 aa, Heterodera glycines
  Coding regions on vcDNA: vcDNA=SeqID_55312; Strand=+; Position=1 -166,263-447
  Homolog annotation: Hit_ID=NP_495940.1; Match level="QueryCoverage =99%, HitCoverage=14%, E-value=1e-55, Identity=92%"; Hit description =voltage gated CLC-type chloride channel subunit (88.2 kD) (clh-5) [Caenorhabditis elegans] emb|CAA92728.2
MAGLAVSLVRTFAPYACGSGIPEIKCILSGFVIRGYLGKWTFVIKSVGLILASASGLSLGKEGPMVHLACCIGNIFSYLFPKYGLNEAKKREILSASAAAGVSVAFGAPIGGVMFR

SEQ ID NO: 128890 - protein, 108 aa, Heterodera glycines
  Coding regions on vcDNA: vcDNA=SeqID_55313; Strand=-; Position=1-603
  Homolog annotation: Hit_ID=CAE59800.1; Match level="QueryCoverage =100%, HitCoverage=13%, E-value=1e-52, Identity=89%"; Hit description= Hypothetical protein CBG03262 [Caenorhabditis briggsae]
KYGLNEAKKREILSASAAAGVSVAFGAPIGGVMFSLEEASYYFPLKTMWRSFFCALVAGVILRFVNPFGSDQTSLFHVDYSMRWTFMELIPFAMLGIFGGVLGSLFIW

SEQ ID NO: 128891 - protein, 174 aa, Heterodera glycines
  Coding regions on vcDNA: vcDNA=SeqID_55314; Strand=+; Position=1-525
MYGIVVSGKRLPRRDAYGTVGVGQTNANGADEGGGVVLHDFPETNALTDNERNGKMEIVKLRIQSLSAVDISDDFDQCECNTTPVVDAALSQPVFQQRQNNFQNSLAHFLDKFGQTSDGHLTKNVNEKHLEYQNWTHALADDRRLHLTDSEASAQTLASSCREECAVYWQQLPV

SEQ ID NO: 128892 - protein, 129 aa, Heterodera glycines
  Coding regions on vcDNA: vcDNA=SeqID_55315; Strand=+; Position=1-534
  Homolog annotation: Hit_ID=NP_497509.2; Match level="QueryCoverage =100%, HitCoverage=7%, E-value=3e-42, Identity=64%"; Hit description =yeast translation activator GCN1 like (3D287) [Caenorhabditis elegans] gb|AAK29920.2| Hypothetical protei
LPGVIRITESPTTQPHIRDGYIQLYIYLPMAFGDRFIPFLSKIIPSILKALADETEYVRESALIAGKRLITASSTHARKLLIPQLQSALIHENWRIRQASVKLLGDFLFFVSGVSGKMTSETTGEDDTM

SEQ ID NO: 128893 - protein, 167 aa, Heterodera glycines
  Coding regions on vcDNA: vcDNA=SeqID_55316; Strand=-; Position=1 -224,268-548
  Homolog annotation: Hit_ID=NP_497509.2; Match level="QueryCoverage =77%, HitCoverage=7%, E-value=1e-41, Identity=65%"; Hit description =yeast translation activator GCN1 like (3D287) [Caenorhabditis elegans] gb|AAK29920.2| Hypothetical protein
TIFNCLSVICQALADETEYVRESALIAGKRLITASSTHARKLLIPQLQSALIHENWRIRQASVKLLGDFLFFVSGVSGKMTSETTGEDDTMGSEAVNKAIVRSIGQRSRDELMAGIYLARYDVVLAVRQAASHVWKVRANIVFTLSFLLYKNGKIVRKTYSIILSFC

SEQ ID NO: 128894 - protein, 424 aa, Heterodera glycines
  Coding regions on vcDNA: vcDNA=SeqID_55317; Strand=-; Position=1 -339,389-517,563-840,886-1005,1059-1162,1217-1362,1428-1583
  Homolog annotation: Hit_ID=NP_497509.2; Match level="QueryCoverage =93%, HitCoverage=34%, E-value=1e-103, Identity=40%"; Hit description= yeast translation activator GCN1 like (3D287) [Caenorhabditis elegans] gb|AAK29920.2| Hypothetical prote
MSRGFLCFHVYWSPQLGLASLADCVCSSAEVVRLVRLIVSEGLADRSEKCRDIMRTAATIAIEKAIPSSLPSIFFQFKHGSHCVDELFPILENELSQMGVAEKKKGPSEEIERNDNLRQGLVVLIGKLAQFLQGDDSKVRKIVARLIETLSTPSQPVQEAVAACLPALMPSLRADAKALMENLFLLLTNAEQYGERRGAAYGIAAIVKGLGVVTIKEMNVSERLKELLAQKQNALHREGALLCIEMFCSTLGKLFEPYLIHLLPNLLNMFNDTNEAVRRAADDAARAMMRFLSAYGVKLLLPSLLKGLDDDSWRTKCASAELLGAMSNCAPRQLSTSLPAIVPKLCETLTDTHNKVQKASERALKQIAKVIQNPECLAISSHLIQALVDPPGKTTSCLQTIVNNKFVHYVDSPSLALMVPFQSI

SEQ ID NO: 128895 - protein, 154 aa, Heterodera glycines
  Coding regions on vcDNA: vcDNA=SeqID_55318; Strand=-; Position=1 -167,215-389,477-599
  Homolog annotation: Hit_ID=XP_321391.1; Match level="QueryCoverage =86%, HitCoverage=5%, E-value=1e-12, Identity=30%"; Hit description =ENSANGP00000008519 [Anopheles gambiae] gb|EAL38547.1| ENSANGP00000029378 [Anopheles gambiae str. PEST]
MSSRNQANSVPASLWDKCVQNLAKINVNDYLNISEHEIKIFETPDGKLYNEEVIERNMEFYDTKNVRRDPSYRTFKEQIEALEALNERAKKNREKGILSEKQKKAVEQELKIEREIRSRLKKLHDSFEETIKSLFIACKKEPKVSLIAVISVNL

SEQ ID NO: 128896 - protein, 78 aa, Heterodera glycines
  Coding regions on vcDNA: vcDNA=SeqID_55319; Strand=+; Position=1 -54,109-289
VNCLINNCTTSMPPLFPEKVESIRHLSTKSWEATFTKDYLSNEGQLRFLSRMCYLAMAHYLLYRGVLPKGVFKRRKLE

SEQ ID NO: 128897 - protein, 66 aa, Heterodera glycines
  Coding regions on vcDNA: vcDNA=SeqID_55320; Strand=+; Position=1-262
LVQFAPPPFRNFFCVFKSHKNTLWGFRVADHESGAHLDHFLIPDPNSNKKSKIQIFDFHIFGSNFV

SEQ ID NO: 128898 - protein, 204 aa, Heterodera glycines
  Coding regions on vcDNA: vcDNA=SeqID_55321; Strand=-; Position=1 -74,119-397,446-707
  Homolog annotation: Hit_ID=AAL78214.1; Match level="QueryCoverage =88%, HitCoverage=95%, E-value=3e-13, Identity=27%"; Hit description =putative esophageal gland cell protein Hgg-20 [Heterodera glycines]
MVCCFTFLWHHWDRFKKRRIHKKKIFISADCWLSVFELLPPRQLGHGIALISNRFDCYVDEHFKTRRWSFGYVQIWRCKKETNGTKEMQIFNGRGEAMEIPQKSVPKKVIGFQHLLISYIDRNAIEFLRRFSSVFANYGINLSVQTKNDRLFERFLLNVWPLLKDEIRVILLWPMDLNRLRRFGHSAILTDCPSLRVVFDAICL

SEQ ID NO: 128899 - protein, 175 aa, Heterodera glycines
  misc_feature (134)..(134): Xaa can be any naturally occurring amino acid
  Coding regions on vcDNA: vcDNA=SeqID_55322; Strand=+; Position=1 -183,462-591,842-1060
  Homolog annotation: Hit_ID=NP_741444.1; Match level="QueryCoverage =82%, HitCoverage=84%, E-value=7e-13, Identity=29%"; Hit description =putative prenylated endoplasmic reticulum protein (20.1 kD) (4I429) [Caenorhabditis elegans] gb|AAM75374.
LEAGLGSFRIDAKFGHAQSSLVNKIPPIVPICLPADEHCVPYGVCEAAVCLVGLLRANNAVIRTCGNEALGCQRNLDRWAHICSCEEHFCNTFLFLRLDKKKMPGGILPLFPWHSLFAVELNSSNFACHSHFPXQMATNGPSRTNMLTLLLVIVPLSVGAAAVVVVAINYYCHLC

SEQ ID NO: 128900 - protein, 380 aa, Heterodera glycines
  Coding regions on vcDNA: vcDNA=SeqID_55323; Strand=+; Position=1 -1027,1406-1520
  Homolog annotation: Hit_ID=CAA82797.1; Match level="QueryCoverage =82%, HitCoverage=55%, E-value=1e-17, Identity=25%"; Hit description =gag protein [Ascaris lumbricoides]
MQELMQELQINEKQKAADVLIPILRDKIEALEEKLDITHNTDGDTTSGIGPLSRSVPMRKNLPKTELKRFDGSPSQWIPFWDYFRTIIHEDSHVPKIDKFSYLDSCIEGKASAIIQGIPISESGYDDAIDLLLKTYGETKRLIRTLNRELMSLPISESFEDDESLYLKSEKIFRQLISMNQNVEDGMYYSNLEGKMSPEVLDKYCVIKDAEDNDDWDTSKFRNAFSRALDQIKHRQELRKNVIEPKRDKHELTMSFTAFSKNDKYQGRNKFPQRNSDQSPPRGRKFEPRKFRDQRHDNSDSSVSHSPMRDRRNSPYPKRDWSSSPEREKWKKDEQRKCQLCQENPRQRKRILVFMDDGSQKTYISTKLAQILGLKPIGNQ

SEQ ID NO: 128901 - protein, 275 aa, Heterodera glycines
  misc_feature (270)..(270): Xaa can be any naturally occurring amino acid
  Coding regions on vcDNA: vcDNA=SeqID_55324; Strand=+; Position=1 -47,869-1144,1289-1478,1608-1755,1852-2018
  Homolog annotation: Hit_ID=NP_477351.1; Match level="QueryCoverage =83%, HitCoverage=27%, E-value=5e-65, Identity=50%"; Hit description =CG5216-PA [Drosophila melanogaster] gb|AAF53248.1| CG5216-PA [Drosophila melanogaster]
SRMLFAICFLNSTFLNCGSGAEEFSPDAQCAQQWKPNESLFVVQQLARQGLGPRQILATLYPRYCSTISDDIPDEWIMQLLRELCEHRTRQKLSNYNTFEDAVELFRKSKRILVITGAGVSVSCGIPDFRSENGVYARLKKDFPELPTPTAMFDIDFFRQNPRPFYNFAREIFPGQFRPSLSHMFIKFLDDEKKLLRNYTQNIDTLERIAGISNLVECHGSFARATCLDCKHQVDAEEIRGDVFAQVSQFASDNYMDLGFSRALEDKNHXLSESP

SEQ ID NO: 128902 - protein, 225 aa, Heterodera glycines
  Coding regions on vcDNA: vcDNA=SeqID_55325; Strand=-; Position=1 -490,943-1128
ARNDDNLRWSTNAIDAGLCSLKPRRCRAKTEVPTESAIVQHLWSTNAIVAGFCSLKPRRCRAKTEVPTESAIVQHLPPSLIPMPTNTKNKMDKSPKQNGTTADDENGHRNRRLLPNELIFELVLCVPSTKWPGRQLLLTSSLVYRIIADSKKTQNWRKPLPIMMFPLIPRWHSYSGLFLSELSGHYNRYMHLSTDEETHVESKTFAVVITIDPAHLPEGRTVQMA

SEQ ID NO: 128903 - protein, 221 aa, Heterodera glycines
  misc_feature (180)..(180): Xaa can be any naturally occurring amino acid
  Coding regions on vcDNA: vcDNA=SeqID_55326; Strand=-; Position=1 -163,458-606,716-914,1092-1252
  Homolog annotation: Hit_ID=XP_311714.1; Match level="QueryCoverage =93%, HitCoverage=29%, E-value=3e-72, Identity=64%"; Hit description =ENSANGP00000013624 [Anopheles gambiae]
KLKWCLRIDPKGLDEESKDYLSLYVLLVQCNKTEVRAKFKFSILNAKREETKAMESQRAYRFVQGKDWGFKKFIRRDFLLDEQNGLLPDDRLSIFCEVSVVADTVNVTGQSNMMQFRVPPCRLSDDMGILFEKGFFADCVLSSGNKEFPVNFSSLSALVPAQSLLFDNENEIKKIKKIQXSDQSERLLKTRSNTAYTGLATRSNRIFPTGTGFTDYSDLKM

SEQ ID NO: 128904 - protein, 38 aa, Heterodera glycines
  Coding regions on vcDNA: vcDNA=SeqID_55327; Strand=-; Position=1 -36,100-180
MRINSQINKRKSFKIMFFVILLVCQTSLGIGKMMAGFL

SEQ ID NO: 128905 - protein, 64 aa, Heterodera glycines
  Coding regions on vcDNA: vcDNA=SeqID_55328; Strand=+; Position=1 -58,187-246,281-357
MAFLLKFVLLLSIMAIFCDYVVKQKVDETKVERKEEEGKGASEMNKGKSIVMADSKKEGENIVN

SEQ ID NO: 128906 - protein, 102 aa, Heterodera glycines
  Coding regions on vcDNA: vcDNA=SeqID_55329; Strand=+; Position=1 -201,257-361
MPVQKPLKLAVQKTVQRALKLAVQDPLAVLNQHKLEAQKAFKLAVHERKRPNYLQLLALLISMLSTNQKKRKNQANSNRVRPEAKINANSSDSMLLLEKREE

SEQ ID NO: 128907 - protein, 30 aa, Heterodera glycines
  Coding regions on vcDNA: vcDNA=SeqID_55330; Strand=+; Position=1-90
MLQSIQPQYAPLRIMTRFAQHQQTRRDSDG

SEQ ID NO: 128908 - protein, 121 aa, Heterodera glycines
  Coding regions on vcDNA: vcDNA=SeqID_55331; Strand=-; Position=1 -184,211-352
  Homolog annotation: Hit_ID=EAK91016.1; Match level="QueryCoverage =91%, HitCoverage=90%, E-value=2e-26, Identity=62%"; Hit description =hypothetical protein CaO19.6835 [Candida albicans SC5314]
MVRLVFRPYTQVRRSICTSESLRTSTRVSSGFILLRNSSPSFGSQRIRSVSAPSHAIETGLWITHQLRKKPSLSLITHQLRKKPSLSLRLWVLHPMTCAYAKLLGPCFKTGRTDDRLLHRE

SEQ ID NO: 128909 - protein, 23 aa, Heterodera glycines
  Coding regions on vcDNA: vcDNA=SeqID_55332; Strand=+; Position=1-69
MKPEETLVEVRSDSDVQIDRLTW

SEQ ID NO: 128910 - protein, 150 aa, Heterodera glycines
  Coding regions on vcDNA: vcDNA=SeqID_55333; Strand=-; Position=1 -70,824-885,934-1057,1108-1146,1283-1354
  Homolog annotation: Hit_ID=CAE67502.1; Match level="QueryCoverage =99%, HitCoverage=77%, E-value=6e-47, Identity=63%"; Hit description =Hypothetical protein CBG13012 [Caenorhabditis briggsae]
KSGLQFAQVAEFSLIQQTLTDNRSAHIVTGSHFSQVFRLGFKLRLICKARGDPRPKIKWFLICKARGDPRPKIKWFKEGMEMQPKRNAHYYEKPLGKDEIWSKLEIDPATMGDQSKLEIDPATMGDQGIYACVANNQHGVMAKNFKAEYR

SEQ ID NO: 128911 - protein, 174 aa, Heterodera glycines
  Coding regions on vcDNA: vcDNA=SeqID_55334; Strand=+; Position=1 -216,281-453,501-634
  Homolog annotation: Hit_ID=NP_729620.1; Match level="QueryCoverage =100%, HitCoverage=52%, E-value=7e-29, Identity=40%"; Hit description= CG32066-PC, isoform C [Drosophila melanogaster] ref|NP_729619.1| CG32066-PB, isoform B [Drosophila melan
ERALFFELEAVLQFAQRSADCLAIYGAGASAEVRAALQNCDDADIQNASFAIVRQFVRRIRKYFETAQRIEKVVPELLWELCSGPLPPVEQLDSAQALCKQLARLIDFVFHFDTMKMNTPAMQNDFSFFRRVISRSEAAAREAETDCSLELANTISLFLASPTPMLNALTNATA

SEQ ID NO: 128912 - protein, 119 aa, Heterodera glycines
  Coding regions on vcDNA: vcDNA=SeqID_55335; Strand=-; Position=1 -92,328-467,724-849
  Homolog annotation: Hit_ID=CAE64801.1; Match level="QueryCoverage =94%, HitCoverage=16%, E-value=1e-42, Identity=71%"; Hit description =Hypothetical protein CBG09594 [Caenorhabditis briggsae]
ALNKILSHPTMPVSIAAGEDRKIRFFDNNTGKLISAPMAHVEGVSTLAIDPNGLYMLSGSHDGSMRLWNAEKRVCLQEIAAHRKKFGAGVMAVAFHPSRQLIGSSGADSLAKVGIVIGY

SEQ ID NO: 128913 - protein, 18 aa, Heterodera glycines
  Coding regions on vcDNA: vcDNA=SeqID_55336; Strand=+; Position=1-3,38- 91
MEEISDQIAVVDQKISEK

SEQ ID NO: 128914 - protein, 175 aa, Heterodera glycines
  Coding regions on vcDNA: vcDNA=SeqID_55337; Strand=-; Position=1 -264,965-1032,1220-1414
  Homolog annotation: Hit_ID=NP_498328.1; Match level="QueryCoverage =99%, HitCoverage=26%, E-value=7e-39, Identity=53%"; Hit description =mevalonate kinase (64.1 kD) (3H214) [Caenorhabditis elegans] gb|AAF60558.2| Hypothetical protein Y42G9A.4
ALDLLETTDQQQQPCHDDRGSATPRDNASPPPSPSAFSHPRPSQLQSSNWASGGVAGTAPPTPATIIGPCPLLDSKRKSVSNSVLSVWDLLAVKVTVRFKLPSCVGLGSSGAYCVCIAAALLQTAGLIPPPSVSAESDELTWDESVLDIIRKWSSAAESLIHGRASGLDAAICTY

SEQ ID NO: 128915 - protein, 132 aa, Heterodera glycines
  Coding regions on vcDNA: vcDNA=SeqID_55338; Strand=-; Position=1 -117,266-544
MYVEAVVGLLLVASVVVVGREQQQPFNATVSPPQVPSERVGTVEVEVFLDLEVVSIEAEVALVDFDVGTVEVLVVELVVEVGAVEVVPVVDVGAVEVVLIVEVGALEVVPVVDVGAVEVVLIVEVGALEVVP

SEQ ID NO: 128916 - protein, 130 aa, Heterodera glycines
  Coding regions on vcDNA: vcDNA=SeqID_55339; Strand=+; Position=1 -340,501-549
  Homolog annotation: Hit_ID=EAK90389.1; Match level="QueryCoverage =100%, HitCoverage=31%, E-value=8e-24, Identity=40%"; Hit description= cryptopsoridial mucin, large thr stretch, signal peptide sequence, transcripts identified by EST [Cryptos
TSTTGTTSKAPTSTISTTSTAPTSTTGTTSKAPTSTISTTSTAPTSTTGTTSTAPTSTTSSTTKTSTVPTSKSTRATSASMDTTSRSRKTSTSTVPTSTKTIQNPNLVQRTHSSTTTTLATSRSPTTAST

SEQ ID NO: 128917 - protein, 24 aa, Heterodera glycines
  Coding regions on vcDNA: vcDNA=SeqID_55340; Strand=+; Position=1 -48,495-521
MEQWTCESAASIGLCKLNYIRLYI

SEQ ID NO: 128918 - protein, 89 aa, Heterodera glycines
  Coding regions on vcDNA: vcDNA=SeqID_55341; Strand=-; Position=1 -66,342-481,1006-1069
MKKDVVSALVRPIIRHSFSTAKPIEFVMPTVFYAATEGLSSTMTLTNALESNDPLTKVLLSNAMPFFVRCFSFRTRPLPSSSDCCAAFL

SEQ ID NO: 128919 - protein, 254 aa, Heterodera glycines
  misc_feature (155)..(155): Xaa can be any naturally occurring amino acid
  Coding regions on vcDNA: vcDNA=SeqID_55342; Strand=+; Position=1-793
  Homolog annotation: Hit_ID=EAK90389.1; Match level="QueryCoverage =99%, HitCoverage=31%, E-value=3e-45, Identity=43%"; Hit description =cryptopsoridial mucin, large thr stretch, signal peptide sequence, transcripts identified by EST [Cryptosp
KNATTTTRMLPRATTTNRMTKNAFTTNRMTKNATTTTRMTKNATTTNRMTKNATTTNRMTKNATTTNRMTKNATTTNRMTKNATTTTRMTKKSTTTNRMTTTTTNRMTKNATTTTRMTKKATTTNRMTKNATTTTRMTKKSTTTNRMTTTTTTLXLKNATTTNRMTKNATTTNRMTKNATTTTRMTKKCTTTNRMTKEATTTNRMTKNATTTNRMTKNAMTTTRKKNATTTNRMTKKSTTTNRMTKESTTTNRM

SEQ ID NO: 128920 - protein, 176 aa, Heterodera glycines
  Coding regions on vcDNA: vcDNA=SeqID_55343; Strand=+; Position=1-531
  Homolog annotation: Hit_ID=AAP92535.1; Match level="QueryCoverage =60%, HitCoverage=50%, E-value=2e-11, Identity=33%"; Hit description =Ab1-042 [Rattus norvegicus]
MFGKRAKSQKVKSHVDGQTENVHFRDSRHFMYGQKNQIISFFGIKKTKCSFVSASASDSNCGRYHCDSFRRPQNVGTGNTQMESDTQWGDDRRRKCHEHKWGRSQKLTNTARERRKLGGRKRRRRRRKERRRRRKRRNEKEEEEEKMRRRRRGGRGGEEKEEEEENEEEKEEEEEK

SEQ ID NO: 128921 - protein, 68 aa, Heterodera glycines
  Coding regions on vcDNA: vcDNA=SeqID_55344; Strand=-; Position=1 -169,326-364
AECHRRKNQSPLFCVQRVAHRRAAAATFCAGQVSTASSATTIFGTVLLSPIFVPVIIVIINRLRWPTL

SEQ ID NO: 128922 - protein, 210 aa, Heterodera glycines
  Coding regions on vcDNA: vcDNA=SeqID_55345; Strand=-; Position=1 -128,652-1156
MISQVVSVVPALRRHKLVEQALRRHKLVEQRKVAKPKTVEGRRLERDGKLADARAKFGQLLALCPDHQGALDGIARLDKNDDNIGGTDIELVELSDDEHTDHDDDNGNNDGHNSGPLNNSDRRKRRQSENGTNRRHSAAGENGRKSQNGCQTEGGAGRVKRRETMSEEEAQRNRQKLAEMEAFIAKLKGAGGGGGSGTAKVTGAGGSEKR

SEQ ID NO: 128923 - protein, 24 aa, Heterodera glycines
  Coding regions on vcDNA: vcDNA=SeqID_55346; Strand=+; Position=1-178
NNNNNNNNFLIFFLITHDIIPWLN

SEQ ID NO: 128924 - protein, 93 aa, Heterodera glycines
  Coding regions on vcDNA: vcDNA=SeqID_55347; Strand=-; Position=1 -198,523-545,880-938
GCRARFGCARCVQMWSDRSPAIRRDALLVLVNFQLQLFAGGRNGHDGGSNGWGKRNFGAQPHRRTERREERDHQTLTAYVVADVVKALGPVKW

SEQ ID NO: 128925 - protein, 176 aa, Heterodera glycines
  misc_feature (172)..(172): Xaa can be any naturally occurring amino acid
  Coding regions on vcDNA: vcDNA=SeqID_55348; Strand=+; Position=1 -259,318-567
  Homolog annotation: Hit_ID=NP_502152.2; Match level="QueryCoverage =90%, HitCoverage=31%, E-value=2e-40, Identity=51%"; Hit description =cytochrome P450 family member (4M169) [Caenorhabditis elegans]
NPSVCGCDPTEHFGIEQLGRLSFLECCVKEILRLYPSVPFVARRLGSDTIIGGNKIPANTQVLLNIYLIHREPEHWPNPELFDPDRFSRENMKFSRENMKGRHPYAFVPFSAGSRNCIGQRFALLEEKTMLVWLLRNFRIESLLRRDQMGLKPELILRPSVKISLKLTPRLXLFES

SEQ ID NO: 128926 - protein, 152 aa, Heterodera glycines
  Coding regions on vcDNA: vcDNA=SeqID_55349; Strand=+; Position=1 -116,257-330,451-575,653-728,779-815
  Homolog annotation: Hit_ID=CAG11763.1; Match level="QueryCoverage =93%, HitCoverage=40%, E-value=9e-38, Identity=54%"; Hit description =unnamed protein product [Tetraodon nigroviridis]
LDDFADAEKIGEGTYGIVFKVRMRANGETKALKQIRLNSGNDGVPSTCIREISLLKELSHPNIDFLRVAFSEGRRLFLVFEYIDQDLKMLLERLSPRSVPINYVKSFVWQLSFVWQLLQALTYCHTHRVVHRDLKPQNLLVNLLVKNDGTIK

SEQ ID NO: 128927 - protein, 60 aa, Heterodera glycines
  Coding regions on vcDNA: vcDNA=SeqID_55350; Strand=+; Position=1 -143,619-658
MEIGAANVRQPIELFPKRTERRIFRENVTMFLTRKRTTGAFQLSLLLRRVERERDLNTDN

SEQ ID NO: 128928 - protein, 74 aa, Heterodera glycines
  Coding regions on vcDNA: vcDNA=SeqID_55351; Strand=-; Position=1 -174,386-436
MSSSSSSISVSVQHQQNPTHQQQMMVHNNANDDANSANANFAAVLGTGGGEGAWAQLWVMCDNFWSIFGTFLSR

SEQ ID NO: 128929 - protein, 365 aa, Heterodera glycines
  Coding regions on vcDNA: vcDNA=SeqID_55352; Strand=+; Position=1 -62,545-750,797-861,1164-1617,1873-2183
  Homolog annotation: Hit_ID=NP_705507.1; Match level="QueryCoverage =89%, HitCoverage=15%, E-value=5e-11, Identity=24%"; Hit description =hypothetical protein [Plasmodium falciparum 3D7] emb|CAD52744.1| MAL13P1.310 [Plasmodium falciparum 3D7]
MSIYRALTVCIKNAISEFNKRFSPSKIHSSEKVHELQRSIFTKLITCTVNKANKHHGTTNDDFLSKLHFDVLAQICEADDQMKEIVLKNKKHLKDFMNANWYKKLSGLLEKEDEYFSVSESFNESDGSENEIFDDPSETIIEENENSKNLMEKHSIKNMNFEFGEKSAEKCENKNFKNNLTTTKMDEKNSDDEFLALNSENEEQWTKKKEQQNKKAKNINVRKNKNNNNSEKEMTEQKRKGKNGKNKLEENDENLNLNKKNYDLLDESIFKKIFENFLEKHWEPQSMEKQCLEYLGTIALFARAIQAKMNFIEQMSKHWANKSVNGIAKKWEHFIFNEEILFEFEQFVQIKLYFLQNQLDEYAFE

SEQ ID NO: 128930 - protein, 18 aa, Heterodera glycines
  Coding regions on vcDNA: vcDNA=SeqID_55353; Strand=+; Position=1 -44,479-491
MYSSLIIYQLFKSNVILK

SEQ ID NO: 128931 - protein, 164 aa, Heterodera glycines
  Coding regions on vcDNA: vcDNA=SeqID_55354; Strand=-; Position=1 -275,403-624
AEAAGIGEVFLFRRATALAISYRMLYLDEDEAQLCKQQQQCSSIDGTETGGAGAETAALIIPLDSSSDSDKQQSWGEKFVAILFICEYCIELSVYDFHHHHLARLISSKMLILTDPTAQTDLINTFLRRHLTIFRFKLFKLLTAGMPKQIAAIVPTIKKHIGAH

SEQ ID NO: 128932 - protein, 112 aa, Heterodera glycines
  Coding regions on vcDNA: vcDNA=SeqID_55355; Strand=-; Position=1 -95,1407-1515,2644-2778
  Homolog annotation: Hit_ID=NP_505820.1; Match level="QueryCoverage =33%, HitCoverage=3%, E-value=2e-10, Identity=65%"; Hit description =aminopeptidase (5L577) [Caenorhabditis elegans] emb|CAB63366.1| Hypothetical protein Y42A5A.1 [Caenorhabdi
MPLLPIAVLLLSYLLLPSPNDRSERMIGQQDKGWSLSLFERTPKMATYLLALTVSDFKHKETNYKDVTWFGDLVTMEWWDDLWLNEGFATIMGMKAADYAENSTSRTVKRRF

SEQ ID NO: 128933 - protein, 266 aa, Heterodera glycines
  Coding regions on vcDNA: vcDNA=SeqID_55356; Strand=-; Position=1-802
  Homolog annotation: Hit_ID=NP_702063.1; Match level="QueryCoverage =98%, HitCoverage=5%, E-value=4e-19, Identity=20%"; Hit description =hypothetical protein PF14_0175 [Plasmodium falciparum 3D7] gb|AAN36787.1| hypothetical protein [Plasmodium
ISISGTQSTNIPINGTQPTNIPIIGTQSTSIPITGTQFSYISITGTQPTNISLGLNPPTFQSLGLNPPTFQSTGLNPPTFQSLGLNPPTFHSTGLNPPAFQSLGLNPPTFQSLALNSPTFQSLGLNPPTFQSLGLNPPAFQSLGLNPPTFQSTGLNPPVFQSLGLNPPTVQSTGLNPPAFQSLGLNSTAFQSLGLNPPTFQSTGLNPPAFNHWDSTLQHFNLWDSNLRHSKQWTQISGILNTGTHSTHQLSMTFQSLGLNPPHFNL

SEQ ID NO: 128934 - protein, 26 aa, Heterodera glycines
  Coding regions on vcDNA: vcDNA=SeqID_55357; Strand=+; Position=1-123
LNGFTNLRFGFHISFVKLSNFYLKKS

SEQ ID NO: 128935 - protein, 110 aa, Heterodera glycines
  Coding regions on vcDNA: vcDNA=SeqID_55358; Strand=+; Position=1 -197,441-576
MHLHIFDSHANEDRMCNENNGQTKGGERKRQTKCDFDQLRSFGVVHGEITRNGPYRTIQQQTVTKSRQIFEREERLPNGQTFHGSVQRNHKQQKKKGQDIIIKNGQNQNL

SEQ ID NO: 128936 - protein, 368 aa, Heterodera glycines
  Coding regions on vcDNA: vcDNA=SeqID_55359; Strand=-; Position=1-1105
MRNRSNNEPSPPKRRRMPNILKSGSNNNNNNNGKRRNFRHYVRALNTDVAFNKKFRLMNAKSTFMIQTLPSNPESLLRVIFGHCIQSSLDEAQRRGIEPSRLGATITSQLLDPDIWIPIRQITPNTVDTILNRFLDVAQSKSREGSLWGAPFSVIVTTLDTVNLPQRDTITGRGSEHRTLKGAYHIIKEKNLLRIRNNNNSYCLFYALEISRIYHCMVMPKQTFSNYINKMHSQQQDAERLMLDAGIPLNQERYDAEVWVPRVVDHWNAVYPELKFKVFIFGTTGQYRPKYKYGPEEFLTPISLYYNNDHFDGIRCGVGTAIFGRDYYCFACELPFKNADTHKSSCILNCKECGRIGAGRPCRDDGFK

SEQ ID NO: 128937 - protein, 202 aa, Heterodera glycines
  Coding regions on vcDNA: vcDNA=SeqID_55360; Strand=+; Position=1-607
SKSREGSLWGAPFSVIVTTLDTVNLPQRDTITGRGSEHRTLKGAYHIIKEKNLLRIRNNNNSYCLFYALEISRIYHCMVMPKQTFSNYINKMHSQQQDAERLMLDAGIPLNQERYDAEVWVPRVVDHWNAVYPELKFKVFIFGTTGQYRPKYKYGPEEFLTPISLYYNNDHFDGIRCGVGTAIFGRDYYCFACELPFKNADT

SEQ ID NO: 128938 - protein, 29 aa, Heterodera glycines
  Coding regions on vcDNA: vcDNA=SeqID_55361; Strand=-; Position=1 -76,998-1011
MIRRGAKVTKRGATVIRRGATVIRREFLE

SEQ ID NO: 128939 - protein, 111 aa, Heterodera glycines
  Coding regions on vcDNA: vcDNA=SeqID_55362; Strand=+; Position=1-336
MKKHFGFSLFSVGIAAGLMPMLFMLMIMPSSTDGHEVFVMTMDEQLLEEHGDLLTIELKKGASAIYVATLKRKIAEEIDSFHSIRTIYAHQLTIRLDMVAIMTLRLMTTKQ

SEQ ID NO: 128940 - protein, 57 aa, Heterodera glycines
  Coding regions on vcDNA: vcDNA=SeqID_55363; Strand=-; Position=1 -66,286-393
MSVPLKVSNDDEDSLAVLAVVQDRRRKLMNQGPDHSILVFEKATKCNSCFLKEDPLP

SEQ ID NO: 128941 - protein, 455 aa, Heterodera glycines
  Coding regions on vcDNA: vcDNA=SeqID_55364; Strand=-; Position=1-1365
  Homolog annotation: Hit_ID=NP_495557.1; Match level="QueryCoverage =87%, HitCoverage=31%, E-value=3e-65, Identity=37%"; Hit description =zn-finger, CCHC type and RNA-directed DNA polymerase  and Integrase, catalytic domain containing protein
SEEDVVVAFASSNDVFDVDEAATNYVHLTTLEQLPVEAEEIRDQTAADDLLQQVFSYVRNGWPQKCPTNELMPYFVRRNSLAFVGGSFLTGNRVIIPLTTLHFAHPGVVRMKALARKHVYWPGLDHEIEVMVKSCLDCQLAAKLPQKAPLRPWPIPEEVFGRIHIDFAGPCHDGNTYLILVDALLKWPEITQMRTTNAAATIDMLNKIFHRYGAPKELVSDNGPPFSSYEFRQFCKSKGTKHTFSPPYQPHCNGQAERMVDTFKRQAKKNSTSKKQNWISGFLFAYRTTPNNILNGFSPAELFLGRSPRTPLSILAPSQQQNKPEQNRQYQDGMKKQYDSHHGTKDRQFVPGNSVLALNYGKHSKPSWLEGKILSGKGLIWKVNIPTLGITVTRHVNQLRSFVPYQAGKVQNDQIHQPELIHEQNLPAEPDELSPQTPKTVRCPPTPRPVRERRP

SEQ ID NO: 128942 - protein, 94 aa, Heterodera glycines
  Coding regions on vcDNA: vcDNA=SeqID_55365; Strand=-; Position=1 -221,619-681
MALAWPKYWHCMVKTMPNWHGQWHIDMAKTMQIDDSSFYFLNLRDLLAFATEPVQCTLDKLYEQFEPDDAGGPLMFFRAFLGPRNSRLAFSLIS

SEQ ID NO: 128943 - protein, 24 aa, Heterodera glycines
  Coding regions on vcDNA: vcDNA=SeqID_55366; Strand=-; Position=1 -44,451-481
MPMYSNASAAAYAQCTRRCLWPFD

SEQ ID NO: 128944 - protein, 39 aa, Heterodera glycines
  Coding regions on vcDNA: vcDNA=SeqID_55367; Strand=+; Position=1 -25,584-678
MGKIGTGKFSDGHLKAILERIGQLEKQQQQQTKGEEKLK

SEQ ID NO: 128945 - protein, 56 aa, Heterodera glycines
  Coding regions on vcDNA: vcDNA=SeqID_55368; Strand=+; Position=1 -69,304-403
MENDQKNILERIFSELEKQTKKKKAFQEELEKKVTERIVAVQSKVDKMEMAHQQQK

SEQ ID NO: 128946 - protein, 140 aa, Heterodera glycines
  Coding regions on vcDNA: vcDNA=SeqID_55369; Strand=-; Position=1 -159,332-481,722-835
  Homolog annotation: Hit_ID=CAE58573.1; Match level="QueryCoverage =95%, HitCoverage=34%, E-value=3e-23, Identity=46%"; Hit description =Hypothetical protein CBG01738 [Caenorhabditis briggsae]
MLGIFVYGSLADYRRFVADHPTFVRDQLRVEDEQTLETKMKQLTLILLAEKAQHIPLTTLVNALDISDRDHLEEFIVDAIHANAIQGKINELDDQLMVSFYQQRVFQRAQWEQLHVRLGALLENARWFRDNMQSVVAVEE

SEQ ID NO: 128947 - protein, 264 aa, Heterodera glycines
  Coding regions on vcDNA: vcDNA=SeqID_55370; Strand=+; Position=1-797
LTSTFVGAVLWFLEQRTAFRLTTVFSACIDELCRQHKSPGAASRYRFLLWATVPSASLRRRASLSTRWGSFTSIGHVDQTVGWKRRRRTLHREPRELDVYELQRRGGLRKVKSASSRRWSFLNRTISPCSGASSPGLPSGSISPSPSDIVENGITPEAEENALNEAIAANSHDSTATTMAGGSSSSASGYCSNISGASACTRLSASFTEPEDPSAPFDPPPPTPHPRGPNSLVVMPRNHPPTFTFDRNVLEQNELDGDDERAKK

SEQ ID NO: 128948 - protein, 109 aa, Heterodera glycines
  Coding regions on vcDNA: vcDNA=SeqID_55371; Strand=+; Position=1 -47,196-478
MRKFELSTFCSNPGSGWLCNDIWMDILPLFRRPQLGRKLALLSPRFNALVDKHFDSKNELTILKQIRIDKMKTMPKLCVVKRGIGIFKQFPIPDHPMHNKLRFSKLQIK

SEQ ID NO: 128949 - protein, 49 aa, Heterodera glycines
  Coding regions on vcDNA: vcDNA=SeqID_55372; Strand=+; Position=1 -50,775-874
MACACTWIQEKYRAGSRISILSKLVVMPHCRNTSSKSKTFPTKAEQDVW

SEQ ID NO: 128950 - protein, 72 aa, Heterodera glycines
  Coding regions on vcDNA: vcDNA=SeqID_55373; Strand=-; Position=1 -152,705-771
MTEEEEEEGEDSAKEEDENDEAAKWDEKSATPDSFMGFIIASSSSSEEEKKILRIFGLMESGKYCFNIPFLH

SEQ ID NO: 128951 - protein, 248 aa, Heterodera glycines
  Coding regions on vcDNA: vcDNA=SeqID_55374; Strand=-; Position=1 -133,183-350,693-1138
MFKYPTIVLVLITFIILHIAVPSAESFINLSAVGDFFANLWDSRADNCFYAARYHGNVSDQFHEKVKYWEIEDVQNVSDRRISKDCSGSFYGCQTHACIDAKGNPVFVFNLCASSAAASGENNTGHCSHPELEELCAMEGGKSKCAICENGMCNEANIELQNVMGLDINGTIGTAVVENGTKSAKTGETGGDTTDDGNSATTDANGNGGDATTDKNSGAMIRAGIFSGEKNSIRGLRRGFFRGEKTPI

SEQ ID NO: 128952 - protein, 61 aa, Heterodera glycines
  Coding regions on vcDNA: vcDNA=SeqID_55375; Strand=+; Position=1 -126,1104-1163
  Homolog annotation: Hit_ID=XP_395127.1; Match level="QueryCoverage =67%, HitCoverage=13%, E-value=3e-13, Identity=85%"; Hit description =similar to CG5885-PA [Apis mellifera]
MNRILSDDKKMSKKEKDERILWKKNEVGDYEATLFAIFYNNLGTKIRKKPENEIPNTEIYI

SEQ ID NO: 128953 - protein, 24 aa, Heterodera glycines
  Coding regions on vcDNA: vcDNA=SeqID_55376; Strand=+; Position=1-75
RQPTFGDLFKIVWKSFFESIVDQR

SEQ ID NO: 128954 - protein, 45 aa, Heterodera glycines; identical to SEQ ID NO: 124814
  Coding regions on vcDNA: vcDNA=SeqID_55377; Strand=+; Position=1-574

SEQ ID NO: 128955 - protein, 866 aa, Heterodera glycines
  Coding regions on vcDNA: vcDNA=SeqID_55378; Strand=+; Position=1-2601
  Homolog annotation: Hit_ID=CAA82797.1; Match level="QueryCoverage =74%, HitCoverage=89%, E-value=5e-51, Identity=25%"; Hit description =gag protein [Ascaris lumbricoides]
MQMDSLRDSSNAWIELLGRLIGDDKDNGEKEYVKFDKNEKIADRYDAATTKLRDLRDLEATLSAAAKLHRGRADREAKADQLANPQQQAPMLPAMAAPMTVPTFTAPLYQFQPIQLDKFFGQKRKWPEFYESFKSAIGSQSISKAQKLNLLRNLLGGEARELIAGFRLEDANYETVLQLLKDTYGAPEEHIRSLHFELANLKPCRSLRETKDFLLQLERLTRELNNAGEDIEGPQVFLMLEKKLTPPFLRSILTKKGEDPANWTTTKFRDVLTEAVRKEVQIQEVMGEYGHHYVQPKAEVVSAAPVQAPRTPNQRSRRPNQPMALRDMTFIASSLDEGHKHQGYVSQQHTQQAKKHCQQMRNQVQSLKKGPPYPCIFCNSNHWHDECQNVDTLNQRISIVREKKLCFKCMKPNHRASNCARPSKCYHCKRRHPTALCRDQYKAKNGINTPSTSCSEEKPNANDGKRSTVIEQQQMCNAIQSKETRALLMTTKATIFNPSRPSLSMMGTIFIDPGSHRSFISSSAAEQLDLNVLSTEECYLSSFGEREPKRYISDRVAIGILCPDQDRFIFNLNALKFLLNDLPVLQLNALDNDELQQKKLSLPNESRQPDILLGMDVWHQLNVQPIEQLPSGFTICQSKIGNIISGTGRIELKQPSNISFVLMVNNDESPQSSKAAQRQKNIQQKEKDELRRHQRNKLLSSIATLRSRRKRESAPISSKSIVIDLSSDSDASGIEIIQNPVRDRQAKSPNEHSTAPIPMAVQRLTPTRKSSSVAKRPAFSSSKQPKGKVANPAQTSQTNELNRKMKALSPTASGSGANHHCVATLARSSDSTTVIDKGSQQNCPNMSSATISKTPCQQHSSEKTLN

SEQ ID NO: 128956 - protein, 254 aa, Heterodera glycines
  Coding regions on vcDNA: vcDNA=SeqID_55379; Strand=+; Position=1-765
MTNHEAQLWSTNDELEVNFPGPIAGLFKGEQISTATNCFAQPATLFVKRHNLQMFSPVHQVQNCQYATEFCQLPDNSTLIWKSTCNGNECQTCDYEKAEVINGKFTAAYGESMATWISEDHQKALTFAKNAPELIACDGTRIVMSEQNFGIAKEQYDDIVTTTTRWKRGIRPEQLASQLSASQVANRRIHHALAKKPDRRSNHVVDSSRLRLFNLPHAARHCSPMHSGVFTQSHPSDSSQPRWSTPAVDIPTHR

SEQ ID NO: 128957 - protein, 39 aa, Heterodera glycines
  Coding regions on vcDNA: vcDNA=SeqID_55380; Strand=+; Position=1 -79,334-374
MFSVRFFAFLLLLAVLCFSLVECGLIGFFWTTDKSLRVK

SEQ ID NO: 128958 - protein, 85 aa, Heterodera glycines
  Coding regions on vcDNA: vcDNA=SeqID_55381; Strand=-; Position=1 -227,710-740
MAPPSTNEQSLRQLMHSLQLLLRGKGARKVTIQPWLAVAGEQPEQHEEDEKKQNGAKRAGKSDGQTKRGEEDEFAIDLSVVQKNP

SEQ ID NO: 128959 - protein, 289 aa, Heterodera glycines
  Coding regions on vcDNA: vcDNA=SeqID_55382; Strand=-; Position=1 -83,130-289,345-623,665-739,787-1058
  Homolog annotation: Hit_ID=CAE70332.1; Match level="QueryCoverage =74%, HitCoverage=44%, E-value=5e-39, Identity=36%"; Hit description =Hypothetical protein CBG16865 [Caenorhabditis briggsae]
MCTESTGGWTNWTNFPGFIKERMTIENNYAKQLERWNDEWNHYSEKHLPDGSMKRSFTLILDESKELTKVHSSVKERFNDEVLKTIELFKRDNYHRSTFRGFKEAKEMEDEFEKAQKQWKKLFDRVEVTKRTYHSAARTEKSMYIQYMNTKTDNAQTDGTEAKARERFEKCHKEVTRARTAYEQILKEITAYNGIYMENMAFVFEKCQQMEMKRLRFILEMLSGMQKILVDLVNPPKSVESLALLWVFLSQITLQTRPIALQTSSTLSQHDRCDYWRRFEAVVSPPWRG

SEQ ID NO: 128960 - protein, 268 aa, Heterodera glycines
  misc_feature (168)..(168): Xaa can be any naturally occurring amino acid
  misc_feature (264)..(264): Xaa can be any naturally occurring amino acid
  Coding regions on vcDNA: vcDNA=SeqID_55383; Strand=+; Position=1-833
  Homolog annotation: Hit_ID=XP_320889.1; Match level="QueryCoverage =100%, HitCoverage=33%, E-value=6e-45, Identity=36%"; Hit description= ENSANGP00000012033 [Anopheles gambiae] ref|XP_313651.1| ENSANGP00000013044 [Anopheles gambiae] ref|XP_31
TYNKNRRAKNPKLNTIVISVARINKNGSSKIIRISIIMDGKTIKFIADSSDINIIDEIAYKCIGSPPLGESDEEGIFFDGRRCQFIGKGFATFKFKGIEVKQPFYVAKAGALNLLGAATMDKFGLWEIPINQITSKNNETKIREAIKELPSKFEQVFSEGLGLCTKMXASLMLKSDIKPVFRRARPVPYSALPIVNNELERLEKINVIKPVEHTEWAAPILVVKKANGSTRLCADFSTGLNDCLQLNKHPLPLPSDIFSTLNGXKFFS

SEQ ID NO: 128961 - protein, 180 aa, Heterodera glycines
  Coding regions on vcDNA: vcDNA=SeqID_55384; Strand=+; Position=1-543
  Homolog annotation: Hit_ID=NP_495557.1; Match level="QueryCoverage =74%, HitCoverage=11%, E-value=8e-15, Identity=36%"; Hit description =zn-finger, CCHC type and RNA-directed DNA polymerase  and Integrase, catalytic domain containing protein
MVDTFKRAFSKIKGEGCQETLSKLFLLTFRTTPSENLNGKCPAELFLGRRPRIALDLLRPPIRPTEKDLKMEAQFNRRHGARFRSYNVGDQVFARHKKGEDWRAGKISERNGVIYAVNFTDNSTGRFHANQLHARAIGDEDIPHPLDAIAADQRCAAAARRACPTLSRTPTEASCAFGYC

SEQ ID NO: 128962 - protein, 37 aa, Heterodera glycines
  Coding regions on vcDNA: vcDNA=SeqID_55385; Strand=+; Position=1 -89,274-298
MTNEIFIFPGFTAPIALTLYKIVSRRIQHMYIKLRSL

SEQ ID NO: 128963 - protein, 127 aa, Heterodera glycines
  Coding regions on vcDNA: vcDNA=SeqID_55386; Strand=-; Position=1-384
MTFQSLKLNPPAFQYWDSILRHSNLWDSNLRHSKHWDSTHQLSMTFQSLGLKPPAFQYWDSTHQHFNLGDSTESPAFQTLGLNPPAFQSLGLNSQAFQSLELKSLAFQTLGLKSPAFQTLGLKSAAF

SEQ ID NO: 128964 - protein, 76 aa, Heterodera glycines
  Coding regions on vcDNA: vcDNA=SeqID_55387; Strand=-; Position=1 -17,125-236,285-386
  Homolog annotation: Hit_ID=NP_499836.1; Match level="QueryCoverage =86%, HitCoverage=9%, E-value=6e-16, Identity=57%"; Hit description =tyrosinase family member (77.8 kD) (3O835) [Caenorhabditis elegans] emb|CAB04594.1| Hypothetical protein K
MPENRKVEVALRQVDPTVAIPYWDSTLEAALPTPADSHLFTPEFMGSTDSAGNLVTGIFAGWRTLDVRATQISLDH

SEQ ID NO: 128965 - protein, 43 aa, Heterodera glycines
  Coding regions on vcDNA: vcDNA=SeqID_55388; Strand=+; Position=1 -25,337-443
MSMNVARREKVGPGLNSVLDLDLGFLVKIQENPGLGKVWVTEK

SEQ ID NO: 128966 - protein, 190 aa, Heterodera glycines
  Coding regions on vcDNA: vcDNA=SeqID_55389; Strand=+; Position=1 -192,830-1069,1478-1620
INIWNKSCRALHYLMEATAPMATSTDEGGSPRANMEEGLLSLPRDSVTLSVPSSRLKMPRRSKEDRLLSALGPFIYLFLPKSSHPIKSPNLFKKMFFVRQLESLAFHRDPFNRPELVHTLRGRELVLFVLLYAIGVIAIVFIFECTMPVFWINDQSRAEQRRRAAIVVRSAQKVMLDREMPSSIGPLRKT

SEQ ID NO: 128967 - protein, 234 aa, Heterodera glycines
  Coding regions on vcDNA: vcDNA=SeqID_55390; Strand=+; Position=1 -55,388-556,827-1015,1063-1185,1233-1283,1789-1812
  Homolog annotation: Hit_ID=NP_501272.1; Match level="QueryCoverage =87%, HitCoverage=63%, E-value=3e-37, Identity=37%"; Hit description =haem peroxidase family member (4I514) [Caenorhabditis elegans] gb|AAB03144.2| Hypothetical protein C46A5.
RYEPSPLMFSERIDGILRFLLRQPGLMPGLHMSGELRDKLFRQGGPHGLDLAALIVQMGRDHGLPGYTRVREACQVKSFDDAEIVVEPKRILPILARHFRRVQDVDLFLLGLAERPRRGALVGPTFACLLTAQFQRTKRADRFWYGHRMDPTKRADRFWYGHRMDPWAFTEQQLAELGRTTLAQLICANSEVVREVQPRAFELPDNYESVREVQPRAFELPDNYESNGFICSSI

SEQ ID NO: 128968 - protein, 372 aa, Heterodera glycines
  misc_feature (275)..(275): Xaa can be any naturally occurring amino acid
  Coding regions on vcDNA: vcDNA=SeqID_55391; Strand=-; Position=1 -142,209-255,310-428,587-771,891-917,964-1052,1112-1354,1443-1581
  Homolog annotation: Hit_ID=CAE63039.1; Match level="QueryCoverage =90%, HitCoverage=32%, E-value=5e-38, Identity=33%"; Hit description =Hypothetical protein CBG07306 [Caenorhabditis briggsae]
HHFQMPFQLIMLMFALISPFHFVSSRFFDLDGIWHFSSQNWSKFSGNVPGDIYADLFTNGFIEPGDIYADLFTNGFIEDPLFDPLFGNGDGFCRWVPRHRWIYERNSNFRTKRTRREESFTDLSGIDSPASVLLNNRTIAQLDNQFVSNSVDVWSDVLRENILRIEFESPVEEANFRAEKYEAFHGHKLPPQCTPPQCTPPIYNGECHVQFLRKMQANFGWDWGPSFPTVGIWRPIRLEFFDFPTVGIWRPIRLEFFDLLSIRRFSPVISLGNGXKIPKKFYCDFTISLDVCDFRPPFFDLCRRPSNFHQIELNRTRNGQSLDSLKMLDSLKMEIPAKSVQLWHPIGYGNQSMYTLEVKRKWVKFGHKVEIS

SEQ ID NO: 128969 - protein, 105 aa, Heterodera glycines
  Coding regions on vcDNA: vcDNA=SeqID_55392; Strand=+; Position=1 -66,131-279,326-425
MDSSSPHANAVTKISADVLKMNFMKKTITRIERQKKQNERERTKEQISAGKLEVLPPRHYPTVEHIDDDPNITLGGVMTEWRYSVLMDNLRFGRFSFKGQNPEVE

SEQ ID NO: 128970 - protein, 47 aa, Heterodera glycines
  Coding regions on vcDNA: vcDNA=SeqID_55393; Strand=-; Position=1 -71,122-194
MANFLYIYSSLRILPQSVSSAFSIVHCQRNISIDNKCHQQNQATKGR

SEQ ID NO: 128971 - protein, 121 aa, Heterodera glycines
  Coding regions on vcDNA: vcDNA=SeqID_55394; Strand=+; Position=1 -89,1714-1990
MQFHERRRNGIEDEEEEEEEEREEEGEKRRTGVNPTHPNPTHPYPTHPYPTHPYTQLIHTQLIHSTIRVVAVAFNATTKTVQPKNTTTKTVQPKNTTTKTVQPKNTTTKTVQPKNATTETA

SEQ ID NO: 128972 - protein, 212 aa, Heterodera glycines
  Coding regions on vcDNA: vcDNA=SeqID_55395; Strand=+; Position=1 -174,297-500,542-699,745-845
  Homolog annotation: Hit_ID=CAE68915.1; Match level="QueryCoverage =99%, HitCoverage=39%, E-value=1e-55, Identity=50%"; Hit description =Hypothetical protein CBG14894 [Caenorhabditis briggsae]
MQELTDVEILHESEDGAKLLVDELIKGHVVETLVQQPLVKLNEQIQDEADAVYNAMNVLLDFHPQANDLCVSQGLFDWLMVRATKRKVFDANKLFASQLFAMLLQSCESARKRLTEKRDGIDMTLRALAVYKRHNPGSPDEHEHMENLFDALCAALMYVPNRQVFLDGEGLQLMILMLKEKKMSREGALKVLSHATAIPDGGPNCDKFVEIY

SEQ ID NO: 128973 - protein, 121 aa, Heterodera glycines
  Coding regions on vcDNA: vcDNA=SeqID_55396; Strand=-; Position=1 -69,828-1124
MTIQFDQNCPPMLKRMCFNGVEQFSFLLYKWCRFCVRRGPSESAFGAIRAESEVRPFAEGWRRRGDIKKTKKIMVAAACAWRIIIVDNCGGTRARNASVSGLEDFIRPDDADNKVSSPLLR

SEQ ID NO: 128974 - protein, 23 aa, Heterodera glycines
  Coding regions on vcDNA: vcDNA=SeqID_55397; Strand=-; Position=1-70
GVATAGEEVEETIFSLTIEKKEF

SEQ ID NO: 128975 - protein, 50 aa, Heterodera glycines
  Coding regions on vcDNA: vcDNA=SeqID_55398; Strand=+; Position=1-291
TVGVNSVWPTPSQQCSKSYNFFLCWPNFTIMVSFESPRCLEDIYKLFLSD

SEQ ID NO: 128976 - protein, 67 aa, Heterodera glycines
  Coding regions on vcDNA: vcDNA=SeqID_55399; Strand=-; Position=1-204
MPSMEPAKFGIGIVQRKMPKMEDNTDLNKIMTTNRHGGIGGDANANTTDGGRIKQWKRMAKANENGA

SEQ ID NO: 128977 - protein, 232 aa, Heterodera glycines
  Coding regions on vcDNA: vcDNA=SeqID_55400; Strand=+; Position=1 -339,763-1087,1707-1743
  Homolog annotation: Hit_ID=CAE58408.1; Match level="QueryCoverage =89%, HitCoverage=16%, E-value=2e-50, Identity=43%"; Hit description =Hypothetical protein CBG01538 [Caenorhabditis briggsae]
NFAGKRGGRSRLLQNTPTHSLTDVPPPVSSARILECNQTDPLVTITFDHLEPEDRTKPVEEFWLRYTVDQDVDQGKWHVYPVPVKAFQHEVIGDSLRQVNGRLSIMLKPFGTYAFQLIARNAIGDSAAYNIEGVCQTAQQAPSRNPSGVRVIGTQPDNLIIYWDPMGREEWNGEKFAYKIFYRRMDEDGAWKEVVVEDPFADQFTIDLGDNARAWDAYEVAVRAMNGRGLSK

SEQ ID NO: 128978 - protein, 167 aa, Heterodera glycines
  Coding regions on vcDNA: vcDNA=SeqID_55401; Strand=-; Position=1 -223,327-451,569-721
MFLISIALAFSIQFLSSVADPENQLGFKCTNVSNSQNYGCSVEGNVLRFFVIGDIGGEEYTVEGKQQQCTVEGHGTVADCEKNPTVVKYYRPTVAQKAVAKAMDSLATSNGVTPRKDFTKVFASKKSKKELYKIASGEMAPHFLLNVGDNFYDEGVTKEDVAERFEQ

SEQ ID NO: 128979 - protein, 124 aa, Heterodera glycines
  Coding regions on vcDNA: vcDNA=SeqID_55402; Strand=-; Position=1-375
MLFPQLISDHKFWPIKELMNPKNDFYEKNVDKVTLAIDVTLNDEKTQEKFISDPNKSSGTLSMEIENLSEFEREVIGSERRSETWHIKGFSWKILAKIEKKNENTDEKWLSFFILCNAPKEGAS

SEQ ID NO: 128980 - protein, 131 aa, Heterodera glycines
  Coding regions on vcDNA: vcDNA=SeqID_55403; Strand=+; Position=1 -75,305-625
MRRELEQQELELFMLCSRLVRQFCEIDHKISAEDRKNFFGRYCEVTTWMEHNAGAPAVEVTQQKEAFEHLYQSIIDGASGNDYVATTGCVAGTSSANEVAVTGCLPGNSKKDEKGNVETKKRKRESDENEE

SEQ ID NO: 128981 - protein, 118 aa, Heterodera glycines
  Coding regions on vcDNA: vcDNA=SeqID_55404; Strand=+; Position=1 -72,136-169,214-257,556-648,743-856
  Homolog annotation: Hit_ID=CAE58942.1; Match level="QueryCoverage =87%, HitCoverage=11%, E-value=3e-18, Identity=46%"; Hit description =Hypothetical protein CBG02210 [Caenorhabditis briggsae]
KSPIVVAGGGLVGLSVAYGLAKRGAKEVFLFERHCIGAHNSTRISTGMINNPCFYTDRSLQSVVRKSHELYAELDNRGTLGFTRCGRVYLASSDDTAIQARRMFSRLSADPANSAAEL

SEQ ID NO: 128982 - protein, 181 aa, Heterodera glycines
  Coding regions on vcDNA: vcDNA=SeqID_55405; Strand=+; Position=1 -47,150-191,256-320,394-588,741-868
  Homolog annotation: Hit_ID=NP_492730.2; Match level="QueryCoverage =100%, HitCoverage=18%, E-value=2e-59, Identity=60%"; Hit description= FAD dependent oxidoreductase and glycine cleavage T protein (94.9 kD) (1L16) [Caenorhabditis elegans] em
VDVEVEYSLRHCGYYALRHLRIEKFYVYWGQDIDSMTTPVECGRQDIDSMTTPVECGRVFRVDFEKEFIGKEALKEFIGKEALNRQLERGVSKRFVQLLVDGHDMDRDPWPHGDEPIYRDGTLAGWTTTAAYGFTLGCQVCLGYVQNEQFGVSSDYLLRGSYEVELAGKRFPCRINLHSPS

SEQ ID NO: 128983 - protein, 40 aa, Heterodera glycines
  Coding regions on vcDNA: vcDNA=SeqID_55406; Strand=-; Position=1 -90,811-843
MAGKAAEELLVGHSYGHGGDLVAARPVAKEQFPPLGIVYE

SEQ ID NO: 128984 - protein, 154 aa, Heterodera glycines
  Coding regions on vcDNA: vcDNA=SeqID_55407; Strand=-; Position=1-464
MPSLTYIYEIFDPLDASWPVQVSKCQSLCSAVGARRVQPNEKRLAGSCAFPIIWPDQIGEQLTGINGVGIQISENSWRNETAQFVQAFAPPKGQVANARLKDGPNFTCHHLPNCAFINQRQEQIGAFVEDLLVATEKSDHRVVDVTEKWTLFMS

SEQ ID NO: 128985 - protein, 290 aa, Heterodera glycines
  Coding regions on vcDNA: vcDNA=SeqID_55408; Strand=-; Position=1-873
  Homolog annotation: Hit_ID=XP_344686.1; Match level="QueryCoverage =92%, HitCoverage=97%, E-value=3e-20, Identity=23%"; Hit description =similar to gastric mucin [Rattus norvegicus]
GLNKTVPPSNIAPFLKGLNKTVPPSNIAPFLKGLNKTVPPSNIAPFLKGLNKTVPPSNIAPFLKGLNKTVPPSNIAPFLKGLNKTVPPSNIVPFLKGLNKTVPPSNIAPFLKGLNKTVPPSNIAPFLKGLNKTVPPSNIVPFLKGLNKTVPPSNIAPFLKGLNKTVPPSNIVPFLKGLNKTVPPSNIAPFLKGLNKTVPPSNIAPFLKGLNKTVPPSNIVPFLKGLNKTVPPSNIAPFLKGLNKTVPPSNIAPFLKRLNNRAPGALFEEVRYMKCKIIFWILLNKENGGD

SEQ ID NO: 128986 - protein, 39 aa, Heterodera glycines
  Coding regions on vcDNA: vcDNA=SeqID_55409; Strand=-; Position=1 -51,99-165
LYPKRSAEHVGQESTDKKMSTKIPKLQGEILCHHLSGGT

SEQ ID NO: 128987 - protein, 95 aa, Heterodera glycines
  Coding regions on vcDNA: vcDNA=SeqID_55410; Strand=-; Position=1-819
LFEYPKRTLEKIDFFVFGAVPPNRCAQIYGETESFRSSFPIACTLILRWIFAPHNCLSTPNGHLKKSIFLFSGQSPRTDAPRFMGRPNPSGIASL

SEQ ID NO: 128988 - protein, 69 aa, Heterodera glycines
  Coding regions on vcDNA: vcDNA=SeqID_55411; Strand=-; Position=1 -33,87-182,424-504
METSYVIVNGKTVTEDSAKSENSLPWITSNGWSGINFVENKFEKTTNTQNVASSIETYATVLSRKPVSK

SEQ ID NO: 128989 - protein, 59 aa, Heterodera glycines
  Coding regions on vcDNA: vcDNA=SeqID_55412; Strand=-; Position=1 -88,133-226
ISSQSQNTSQGKALQKSPPGLTFVDPKELTMSQYKRADFPPVERPKGYSQFSTQPTEKV

SEQ ID NO: 128990 - protein, 61 aa, Heterodera glycines
  Coding regions on vcDNA: vcDNA=SeqID_55413; Strand=-; Position=1 -67,434-552
MNSNFGRALFIQHSPAEVSKQTLKSAKKIQKGFLLALAHFVFVSKKSDGWRATIAERHLRR

SEQ ID NO: 128991 - protein, 78 aa, Heterodera glycines
  Coding regions on vcDNA: vcDNA=SeqID_55414; Strand=-; Position=1-9,86- 266,368-414
MTRIVSNVKDSKLGKDAIQQLKVATETAERVAQQVGEMQAYKQVSYMAKEIDRLADVRMYKRPGSAELNLMGEKIKHN

SEQ ID NO: 128992 - protein, 752 aa, Heterodera glycines
  Coding regions on vcDNA: vcDNA=SeqID_55415; Strand=+; Position=1 -1348,1389-1723,1769-2110,2157-2390
  Homolog annotation: Hit_ID=NP_001004509.1; Match level="QueryCoverage= 82%, HitCoverage=41%, E-value=8e-74, Identity=31%"; Hit description =si:busm1-180o5.3 [Danio rerio] emb|CAD60788.1| novel protein similar to DNA polymerases [Danio rerio]
MKESVSAALLTHTVDEPCYIQPIDDGSVRQRASIAVDNDDSDDDEDDDDLPLRLCFFDAETSQDTPLQLNNRTVQKHVPLLIVAEVICERCLQAGISVNDGLGRRAPGCVCMTGMVRGQLFRQWSSPPFANAPGDNSASPVGAPAFNQRRFFFHSFDNDGNDPVDQFLDFLLHHGPKKAHTVCIAHNGGKYDFHLVLEALHRRNRPPKHLCTTGLKIYSMRLSGRHQRRVTFKDSINYFFCALDALVKSFDVPDHLATLKPFFPYLYIRRQHLSQRLINLPAQEFYAPDTMKAEKRAQFLRWHAENNGNGFQLREQLIMYCVNDVAILRESVIRFRQLIADNTQGLDPFLHASTAAGLALATFRRCFLPANRLVHSPEGGYLRGRRASAESQRYIRFFELEHPEAQVQCASWSVGEAHIEDSGYRVDGLWRRDAPLRPLAIEWLGCYYHGCRVCFPDRQQQLAAGRTAEDLYERTERRLFELEHDHGCDLHVVWACQWAERLRHDPNLKRRYDAVFVPCPLDPRNDALRGGRTEPFKLHHVCSDDEEIMCIDIVSLYPYVMKANRFPVGNPRVLTREVLLRPPTVPLPWNAPENNIFRGLLLARVLAPRNIRVPLLGYRTKDGRFTFPLCAWCADRRQQRPCRHDDDKRSWVTAYTHVELNKALQLGYVVTDLFEVWDYEEWDGTLFSSYVNTFVGLKVQATGWPEGCVTDEQQKAFVDDFERTEGIRLDSTKMEFNPGLRLIAKTLANSLW

SEQ ID NO: 128993 - protein, 183 aa, Heterodera glycines
  Coding regions on vcDNA: vcDNA=SeqID_55416; Strand=+; Position=1 -254,308-605
MGGPCVAEGEALGQMKREHTDRRIVEFVAGGPKNYGIRHTARDGTDERANLKIRSFRLSYTAQQLLTFEAMKNLTLATYNIDGPIDDALDNDDLYVYGGGEHRAIRVNFPQIDRNVYADLYTQEAHKDYRPFYAKGRVRPGMQTRPFGYLEDDGQPNEGQRTHRRKRNLVEQDPTQPGHSGWF

SEQ ID NO: 128994 - protein, 53 aa, Heterodera glycines
  Coding regions on vcDNA: vcDNA=SeqID_55417; Strand=-; Position=1 -40,446-567
MTLTPQLCEPRVKNFNGFNSCYRLDKQRLSRNGFRGRQQREQRANEKARGGGG

SEQ ID NO: 128995 - protein, 1058 aa, Heterodera glycines
  Coding regions on vcDNA: vcDNA=SeqID_55418; Strand=+; Position=1 -393,711-986,1042-1672,1741-2765,3077-3925
  Homolog annotation: Hit_ID=AAA93301.1; Match level="QueryCoverage =31%, HitCoverage=90%, E-value=4e-52, Identity=37%"; Hit description =HASI
MDAFQQFKREDVQFRHPFTMIVSGSTGSGKSEWIMRLLRNVDKMISTPVERVIYSYGELNTNVMNLQRAGKVGNVPVTVHSGVPRAEQVRECAKKEKTLLVLDDLVVGMSQQYLDALFTRGSHNWGVSVILTLCNAKKANALIRDASDEQLLCLVEICLNILKGRVPLRPRHLNKLKAHAQVLRRLARTRCSRSAKKVLLQHGDGLPAIVGLIASIALPLIADHTKRYLLVPEEIYQSLAAPPPSDGTPIGLVRTRIKQIKNDDAINEAERAVKYEQEVKRLNKLTKDEDERPVGVKLENLSDVVDAMPKPVNVTRPIVVSTRRHLKVGRARKENVEQLEDTDDDDDYQNPRSSSSNKRQPTQTEILKLIYKNAQSLGVSEEGQVLRAGGRPFITSSVDDIVSHLFNKDKRGQNKEPTAFKEFVERARQNPLLTIIMDLKKLRLLEFLYKDLSSPVAFTSVEPLLREARKSQPKINRTDVQNYLTSQRTYTLHRQAKRRYRRLPTLAPGLHTEWQADLAIFDRFAKQNHGFKYLLVCIDTLSRQVFAEPVKTKTSANMIIAFDRIFKRSKYIPWKVLTDQGKEFTARAVQQFFRTKDVEHFCMLTSPQFHAGMAERANRSIKERLYRYFTERNTYKWIDVVQDIVRAINHSPNSSIGMRPADVNFKNAEALRQKLHNAAENVVRRQPRYRVGDRVRIEKYKHVFQKGYLPRFTNELFTVVEVHTERSPVVYRLRDDHNEIISGWFYANDLCKSLEDKQQNMYEIEKILKKKKQNGIEWQTGNTVRIEVPPSNVTNPHELSKNLYRLLGEGSDPLAKKVRSTQNSFMLLINKARRWAREEYIKRKTKEKRSVRDEELLLQAMLTDTGTLVDLNSVAQGFLTREKSAATSNVPLRMPADDTNSYQEKLDEYFSKLSDKNLNILDELGMTKLNAEIKNLTEEERVILEATKEMGTEAWIQAYREIRLVCQFNYDVHRNRFVLNTDPRYVKKVKVSPQLAYILGFNNTEFIQSENEARFMPDMSGGVSSFHVYTPDLIEPMMIGDVTAPVLRIVTIRGNPDQ

SEQ ID NO: 128996 - protein, 161 aa, Heterodera glycines
  Coding regions on vcDNA: vcDNA=SeqID_55419; Strand=-; Position=1-483
SNTNNKVTSTKAPAPPPPPSATTSATLKVTQSQHAIAAINPKVTQSQQAAATSATVTVKKATATAKPTPSPSPPVAPATATTKAAKASPVVHKEFNENAAGVDVLDIMLGGSKQSVVSGEEKKQQQPPKTNVSVGRPLMSPPATESKDVLDIILGEPKQSV

SEQ ID NO: 128997 - protein, 776 aa, Heterodera glycines
  Coding regions on vcDNA: vcDNA=SeqID_55420; Strand=-; Position=1 -123,481-1654,1867-2900
  Homolog annotation: Hit_ID=NP_502797.1; Match level="QueryCoverage =44%, HitCoverage=94%, E-value=5e-51, Identity=33%"; Hit description =HASI (4P602) [Caenorhabditis elegans] emb|CAB16520.1| Hypothetical protein Y57G11C.19 [Caenorhabditis ele
MANKFLIIPEVLYRGLTSASSTGDITLDAVRQELDRTKMKKEQHLQHPQPEQQQQQAQLGRNLLVEAAAAPLYDNDDDDYMLEDGYTLPAPSQYYGEPMLPDYEDEIDEMDTARFSFASRRKMTEENGDGEKTKKKNKIYYSPPSSPKWEQTRRRQPLLTYERTGPPPPPRPTPKRESKQELNQQQQTPTLRQIIPPAPPPQGKREPKYEQVHDSPPPPPPPAPAQIKREPKYEQVHEFPPYPPPPQIIKREPKQELSQQASTSSKLSIPEREPKKEPQQQQQQQQQLQQQEQSTSNQPFEGEEEEADEAPTLPRTKRNGIKHQGKKSGKRRVRPERRKGRARVEYSPTPKFYNVPSTSAQKDDSKKYGKLFSIPPNKLTMKQRVERILIKCNHYGERMGVSGNSLINEETGKPYPRSNVSMIIKYIIDKRAAFAGVSRLLEEAKKRISDIHRSDVVNYLEGHRTYTLLRPRRVHFPRSKTVAAGFMTDVQVDLADLQSLSRHNKGYRYLLVAVDVLSKRLFVVPLRSKRADEMLLAFKQLVEQMPMTPHRVFTDKGTEFRNRMLKEFFEEHDIAKHEPVHSAVKASVAERAIRNVKQRLYRYFAQKETLNWIDVVQRIVDGINRAPSRVHGMRPIDVNFSNAQKVWHTIYGDMYSPMRKLEKRTRFKENDYVRMSREKGQFEKGYLPNYGDEILEIDDVLHHVNPVRYKLRDEKGEQFKGSFYDQELARVRKDAETSYRIEKVVRKRKRADGSTEMLVKFIGYPEREWIHESQIV

SEQ ID NO: 128998 - protein, 167 aa, Heterodera glycines
  Coding regions on vcDNA: vcDNA=SeqID_55421; Strand=-; Position=1 -210,258-485,535-600
MQWIAADICTCPQNLYCLRTLNYLKPLLCIHKSVLNFTQFLAEGVQQPKQQTSELQSVLLLFVIGVLVLQLMQLCLLMNHRPRTMSRRRIRSRAPFQNGAENIGAHRLARFPPLQQQCRPQPLIIDVRPPAQPNAEQQQQQHHDRVDSERSSVSDNESFHSIVENEC

SEQ ID NO: 128999 - protein, 39 aa, Heterodera glycines
  Coding regions on vcDNA: vcDNA=SeqID_55422; Strand=+; Position=1-120
LPAIIDAARSKDRLLGILRSSSVLRAKIVRWKVKYMIKA

SEQ ID NO: 129000 - protein, 76 aa, Heterodera glycines
  Coding regions on vcDNA: vcDNA=SeqID_55423; Strand=+; Position=1 -116,451-565
MPLFGGKFRRGMVTRNAPYNSHTSSRLILANALTLSTIAQPKAKQLIKGWEKYERFCKFPPLLGFLCFYFVNMTYC

SEQ ID NO: 129001 - protein, 180 aa, Heterodera glycines
  Coding regions on vcDNA: vcDNA=SeqID_55424; Strand=-; Position=1 -77,128-272,320-382,438-519
  Homolog annotation: Hit_ID=AAT73712.1; Match level="QueryCoverage =99%, HitCoverage=17%, E-value=5e-38, Identity=46%"; Hit description =guanylate cyclase-like protein [Caenorhabditis elegans] sp|Q6DNF4|GC36_CAEEL Soluble guanylate cyclase gcy
QFGFIHESIRLLMIRMFGDDFWREALQKAGFESGKENIVNQHYPDSEALQKAGFESGKENIVNQHYPDSETYAIVESVSALAKMSREEVWELYGAFLVEYTMEIGWDQLLRTMSVEYTMEIGWDQLLRTMSPDLKGFLDNLDSLHYFIDHVVYGFLDNLDSLHYFIDHVVYKGNLRGPFF

SEQ ID NO: 129002 - protein, 141 aa, Heterodera glycines
  misc_feature (5)..(5): Xaa can be any naturally occurring amino acid
  Coding regions on vcDNA: vcDNA=SeqID_55425; Strand=-; Position=1 -183,231-321,369-388,451-516
  Homolog annotation: Hit_ID=CAE60636.1; Match level="QueryCoverage =95%, HitCoverage=23%, E-value=2e-32, Identity=54%"; Hit description =Hypothetical protein CBG04280 [Caenorhabditis briggsae]
KAIRXLSDHLSANYRVKDDTSPFVKKILKAHVRVLLYYGDTDMACNFLLGQQFTAQLGLKRSINKQPWKVARQIARSINKQPWKVARQIAGFKTIYARGFLTFLTVRGAGHMRGAGHMAAPQWRAQQMDYAFSQFLLNHPI

SEQ ID NO: 129003 - protein, 183 aa, Heterodera glycines
  Coding regions on vcDNA: vcDNA=SeqID_55426; Strand=-; Position=1 -43,290-594,675-878
MLDAFTTDSDVDTISPGSSLAATDPIQLGPTDQTKSVLATKIVLLYPETFEYFSVIRQNEFEFGDEELARNLKIEFNEMVEKVKDLRERTLPSEQRPKHPMIWLKDVLFMSPEQIKIIVAQQRAKTWCGSSVCCSTECCLTTNIPWTIGEPKRRFGHGIHNGLAWNRWPIKMSKRCDLLMNNI

SEQ ID NO: 129004 - protein, 65 aa, Heterodera glycines
  Coding regions on vcDNA: vcDNA=SeqID_55427; Strand=-; Position=1 -85,455-567
MIKFFFAISFLLVIGTHLNNGTTDVKNIVETFVQDDTDLNELVDDAIIWAHYIGMVTRADKTKTR

SEQ ID NO: 129005 - protein, 41 aa, Heterodera glycines
  Coding regions on vcDNA: vcDNA=SeqID_55428; Strand=+; Position=1 -48,107-181
MSMFFSTKGQHQFLSATKINVQNALNANLFILFANRKVGDE

SEQ ID NO: 129006 - protein, 115 aa, Heterodera glycines
  Coding regions on vcDNA: vcDNA=SeqID_55429; Strand=-; Position=1 -22,360-682
  Homolog annotation: Hit_ID=AAN32891.1; Match level="QueryCoverage =86%, HitCoverage=20%, E-value=6e-46, Identity=91%"; Hit description =secretory protein 5D06 [Heterodera glycines]
INTPNYDVNFSPSMKIPFLEPIIEKYVDEYKKSRQLFAECMQKILRKSKNPNQTVKIIEFKKTIEKEMNDLLKHTDLPPDQLIDLLNTREWLLSMKKDIGKCKNSPTSSLNAKGR

SEQ ID NO: 129007 - protein, 176 aa, Heterodera glycines
  Coding regions on vcDNA: vcDNA=SeqID_55430; Strand=-; Position=1 -58,153-340,608-895
  Homolog annotation: Hit_ID=CAE61940.1; Match level="QueryCoverage =77%, HitCoverage=5%, E-value=6e-47, Identity=61%"; Hit description =Hypothetical protein CBG05938 [Caenorhabditis briggsae]
RCVVEEGKGTIQSPPKTFRDCLFRICSVNRYAAQKQYWAEQKKARMGETVDEEMLEKLKVAAEKEREQNELEYSKMLGSVVQLLHVKSNKFLTMQKNSPARQERNAMRVYLDRIGNEGSWFCVDIVYKHVSLGDNVRKRREVKGNGRLGERDGLIRLIIRGRGEVIKHWIGEGGCF

SEQ ID NO: 129008 - protein, 50 aa, Heterodera glycines
  Coding regions on vcDNA: vcDNA=SeqID_55431; Strand=+; Position=1 -66,140-226
MGWFTYIYDGWRAHKIIIHGKTQNDDPQMWGEIFSKEILLQCATDREFCT

SEQ ID NO: 129009 - protein, 92 aa, Heterodera glycines
  Coding regions on vcDNA: vcDNA=SeqID_55432; Strand=-; Position=1 -114,161-322
MSHSQSEKSLDQQFDCCECVVDDLLKGRLGDSQFAQRNNVLRDCIQSLQSVAKTIDGLSLFSANDSVEELPTNSLRFLLVPAYLATALQEIG

SEQ ID NO: 129010 - protein, 283 aa, Heterodera glycines
  Coding regions on vcDNA: vcDNA=SeqID_55433; Strand=-; Position=1 -47,101-209,429-788,1317-1458,1514-1628,1677-1755
  Homolog annotation: Hit_ID=CAI20897.1; Match level="QueryCoverage =97%, HitCoverage=40%, E-value=5e-26, Identity=38%"; Hit description =novel protein similar to vertebrate ADP-ribosyltransferase (NAD+\; poly (ADP-ribose) polymerase) (ADPRT) [
MDYGTDIEECTDEFKRLFEEKSLNTWESYIAGNFKKNPSGMDIVEVDFADKKIDLTKMPLGRLSRSHVLKAYKVLTELQQILERKEDGKAQPTSRGVFVDFTNRFYTLIPHATGLKSPPILDNLNVLKEKCGMLDNLLEIEIAYNLLKSEEKEPKDKDAFDLHYEKLNCKMEVSKSANYCYVINGEGLLLLCEVALGEIQEEKDAKELRKPKRGKHSVKGVGGTVPNPSEFEQLDGATVPCGKAIKSGAEGHSLLYNEFIVYDESQIRLKYLVRVKIKNTPLL

SEQ ID NO: 129011 - protein, 202 aa, Heterodera glycines
  Coding regions on vcDNA: vcDNA=SeqID_55434; Strand=-; Position=1 -153,516-581,717-853,899-1046,1312-1414
  Homolog annotation: Hit_ID=AAM75364.1; Match level="QueryCoverage =74%, HitCoverage=14%, E-value=3e-13, Identity=29%"; Hit description =ADP-ribosyltransferase (NAD+; poly (ADP-ribose) polymerase) [Homo sapiens] emb|CAI12102.1| ADP-ribosyltran
MTIEHAKFRVIEVLQMQKQHCKRGPSCFKQSILLPPRMFSFTWNFSKKCGRKQSELLWNTRIALRENLDSSEMEELLQANGNFKPKKGGAEAMLDKLVDFVVFGVPQPCPQCNGPLNYSTTTHSYKCYGTLSEYTRCLYTTRTPERRPFFIPKQMKSGNKFLKTLKTALLPARLYPAAALTEEIIVKPKAFKSLNAAERATN

SEQ ID NO: 129012 - protein, 19 aa, Heterodera glycines
  Coding regions on vcDNA: vcDNA=SeqID_55435; Strand=-; Position=1-57
MENEDETPKEPPYGAEYQK

SEQ ID NO: 129013 - protein, 55 aa, Heterodera glycines
  Coding regions on vcDNA: vcDNA=SeqID_55436; Strand=-; Position=1 -3,481-531,651-764
MAILKNLFAYLENYLIVVLSASLPLEKIGTVLVSVRCFCVICAVTTTENLLFRVS

SEQ ID NO: 129014 - protein, 46 aa, Heterodera glycines
  Coding regions on vcDNA: vcDNA=SeqID_55437; Strand=+; Position=1 -122,656-674
MCESVQKDKIKRKRNLTSTGQKGIVSFCISFWHETRNFIHFKIFFS

SEQ ID NO: 129015 - protein, 473 aa, Heterodera glycines
  Coding regions on vcDNA: vcDNA=SeqID_55438; Strand=+; Position=1 -119,351-517,623-858,1014-1148,1214-1241,1293-1337,1400-1592,1777 -1963,2016-2327
  Homolog annotation: Hit_ID=CAE61014.1; Match level="QueryCoverage =77%, HitCoverage=97%, E-value=4e-56, Identity=35%"; Hit description =Hypothetical protein CBG04752 [Caenorhabditis briggsae]
MPQLNCTASATITSSAHSRHHIDVPPEPKAKHDKRKTSNGVCYQQTPTDETFGASQLEKLAELRKELGDELLQETTLLNDNLSLIRWLTGWNNKIDEIVPRFRRAASVFRCLNLNQFVIEDIDDLNDFSRGVSAGSEYYPGGVLGYDREGNVVSLQCMGLSHPKQLAKCGRVSDLIKIQERKLGRKLGLKVIIDLDGFNTDHLSTIALKVYGNVLVTMQELFPDLLRQVFVINAHYLVKTAYNIIKPVLSEQSREKVVFLGSDFHGVLARDIGPENLFIRWGGTRTPTRGHTEGGTLRMGGVPPESLRYCAKNNPDHIDDEELIKLNVPARQRREVEVEVPEPGPHSIHWLFHTNGDLAFGIHRSDDQMEVWPTFHLLTDYVPEYGKVRVEGGVRYKLVFDNSGGTFFSREVKYGLRVKKVEESEEEEREHGAKEAEKTNGVTARGEERQSVARDTEEEKENTIRDGEGKAKN

SEQ ID NO: 129016 - protein, 179 aa, Heterodera glycines
  Coding regions on vcDNA: vcDNA=SeqID_55439; Strand=+; Position=1 -143,195-323,385-478,542-715
  Homolog annotation: Hit_ID=NP_495256.1; Match level="QueryCoverage =93%, HitCoverage=17%, E-value=2e-23, Identity=31%"; Hit description =transducin protein (103.2 kD) (2G563) [Caenorhabditis elegans] gb|AAK31492.1| Hypothetical protein F13H8.
MEAIEIVRNERMSREAEDDHKRHPLLMGYSAGAEHRFIADGMQKIRHSHLEKSLMTLPFTFVPDLLKEMGKCVRSNYKSDLAERVILFLTRIHHNQIIHSLELLSLIDDLRTVLPKHIADTLNCVGLNIAALKFLQMRLESRQNAKMFVAPRAENNEKASKKKKQRRKVKEIAFVSSVI

SEQ ID NO: 129017 - protein, 184 aa, Heterodera glycines
  Coding regions on vcDNA: vcDNA=SeqID_55440; Strand=+; Position=1 -274,339-619
MDEMLKRYLKFAIKFMAKRQRISEQKLKLQGIGKLQALKALIKFYVHEKCEKEQANDGQQPSKSKWERLLPLLTTVVEDEEDGTNANFALEFDTKKKKKKTGGGRRRRRKKRELAAFALILCVALAVAILLLALNCKSVGLCLANRSGAQTQRQYSNENEAAVGVEATEEARVTTLFELLQSNG

SEQ ID NO: 129018 - protein, 95 aa, Heterodera glycines
  Coding regions on vcDNA: vcDNA=SeqID_55441; Strand=-; Position=1 -96,135-252,293-366
MPKQNEIVLKYSFLDLTWFLDIEAVFYAISKTKKCLVVKTIFHISLHNFVSSARIETGIRPLERAARALQEEIRINSPMWPNFRPPATAPCFSQF

SEQ ID NO: 129019 - protein, 300 aa, Heterodera glycines
  Coding regions on vcDNA: vcDNA=SeqID_55442; Strand=+; Position=1 -55,111-772,835-1020
MRIFICFSALFLSICAFFDFKPIFAYDPLEFFDYLIECDPKAKILTKVRNDFSEGVEVSQNDAKELAKYLSSEKGNKTFGEVILSEASKYDKKREQMDSESAQNAKTPGKATENAKKDQKAQAKMKTAQKSSRRTNRLETSLMGSPKRIGNAIKEHVKKFLSQGDDIWALMVKVSKMYEQYEEMCKEIAEETIKNLIKQQKVREKCFRQHPLIMLIDLFKPHLEIAHDLSSKIMRKRTQMRKSLQIIAKIFSEYYEEEWEKLKNEIANIRLEELKMLSEKMDEFGKKFWEEIQKAEKRKE

SEQ ID NO: 129020 - protein, 916 aa, Heterodera glycines
  misc_feature (242)..(242): Xaa can be any naturally occurring amino acid
  Coding regions on vcDNA: vcDNA=SeqID_55443; Strand=+; Position=1 -256,308-358,423-582,685-754,869-955,1028-1255,1345-1451,1512 -1662,1710-1837,1886-2173,2219-2372,2432-2475,2519-2623,2729 -2834,2892-3005,3121-3215,3265-3319,3377-3556,3685-3727
  Homolog annotation: Hit_ID=AAG23826.1; Match level="QueryCoverage =97%, HitCoverage=70%, E-value=0.0, Identity=85%"; Hit description =guanylyl cyclase [Heterodera glycines]
ISGCFSGTQYFVYNLSIVSFSFIVVFEECLMSVAAGYAFDLLDGQQVDLFIAPPCTDSAQVALFVSTFYNIPSITWGQNSDSSFNSQSSQSNYPTLLSALPNYADFGQIIFGQIIISLCIFFKWSVMALIYQLSETGQCASFQQDLQIAINSNDKCDISYREEVKISSAGTSDAQYTISQIQSRARIVILCFDEFVQLRNFAAKLQEGGLDSADYVYLIYLIPGLTMDDSIESVNCVFYKIXICVCFFSVFNLLFVLGGSKATAWWVDPNPTIQSAAYRIAQRSLYLMLDIFNKVATSGQVGNGTSFDQEVIRQVTQWPFFCTDCDQSLQASASSYAPLLHDSFYLYAMALSKAAKIAGALSPSVYRNGQLIRSQTANLSFEGMTGSNKFGSDGLRNFMTGSNKFGSDGLRNFIYLVSMYSSLNGDLTSYVWLQMNDAGVNSSWINATAEKLIWSSRNSSWINATAEKLIWSSRNGVKPLAVPLCGFDGNGCHMDFFTEYRGYVIAAGCLLLLILGSFAFGIYWLFQSKAREMERQNRLWQIAYSTLTPAGTKKKMMESKKMMESVRSLQSSTSSQFTRDSSHSHVSIKHNFNGIVYIMNGERVIGIQHSVGIRLSPQDMAELRTGIRLSPQDMAELRTMRLLDGMRLLDGDNVNRFIGLSIDGAALLSLWRYCSRGPLSDVISGSSSLTMDGFFIYSLVRDVAEGLRFLHASSIGWWHGNLRSTNCLIDDRWQIKLSEFGLRFFRAHEKREAKDLVWTAPELLRDNDIVGNKFGDVYSFSIVSSEIVNMKPIWEQDEAKGNVEIVNMKPIWEQDEAKGNVEVVRTGGKRAFRPKLEPSSQDLVRTGGKRAFRPKLEPSSQDLSPALLHLIKDCWDESPAERPKMETVTALLQSMNTGRCRNVPFSFFYFFGVYAF

SEQ ID NO: 129021 - protein, 265 aa, Heterodera glycines
  Coding regions on vcDNA: vcDNA=SeqID_55444; Strand=-; Position=1 -360,412-828,952-972
  Homolog annotation: Hit_ID=EAL51907.1; Match level="QueryCoverage =98%, HitCoverage=19%, E-value=7e-09, Identity=26%"; Hit description =Viral A-type inclusion protein repeat, putative [Entamoeba histolytica HM-1:IMSS]
MSVKNKNEIEQTLGNLIEFIKKNETFCEVKYLEMATKELEAVKKGKDGDKGIRIKQILQNRIMDTKLSILAKELPTKREMFENAKIGDIELAIFMPDFHAELSQAGQTNSYWANESDQIMKDYLQKAEELFRLANELIKPLKKIAGEQMEELIKRLEPEISKLISLIDDKENSEELSEKLEKRVDKIKEIGSKAMEIVLTMDTPKKEKICKTAEEMEKAIKELEKNTGKSDKVKAKMRKLKKLLENDKKQFVERPYKMERKRKGF

SEQ ID NO: 129022 - protein, 241 aa, Heterodera glycines
  misc_feature (10)..(10): Xaa can be any naturally occurring amino acid
  Coding regions on vcDNA: vcDNA=SeqID_55445; Strand=+; Position=1 -117,161-242,358-543,605-679,724-818,940-1041
  Homolog annotation: Hit_ID=AAG23826.1; Match level="QueryCoverage =95%, HitCoverage=18%, E-value=1e-102, Identity=86%"; Hit description= guanylyl cyclase [Heterodera glycines]
YRILLGRFNXILSFILFNYFFKDVVSFTTIASKCSPLQVVNLLNNLYTLLDVVNLLNNLYTLLDSIIAEFDVYKVETIGDGYLCVSGLPHRNGHEHAQHIAKMSLAFMRNLGSFTIPHLPTERLRLRIGIHTGSTVAGVVGLSMPRLSMPRYCLFGDTINTAARLESSSKPMRIHIMRIHISTTTNHFLVNVLGGFVTQARGEILVKGKGVLETFWLLGLEGDPAVMRMLHSSDGNNATME

SEQ ID NO: 129023 - protein, 44 aa, Heterodera glycines
  Coding regions on vcDNA: vcDNA=SeqID_55446; Strand=+; Position=1-132
MRLNFNHQSAKLPSKLINDCPHGRQQFGITKDGKRSNLASLSAG

SEQ ID NO: 129024 - protein, 80 aa, Heterodera glycines
  Coding regions on vcDNA: vcDNA=SeqID_55447; Strand=+; Position=1 -190,755-807
MVDSITYRLSEVYLLWRDAKQELIDTILEGVTVGLNKNIIRFFCEIELAYTALGNTWQIIEKTENLRKAPKHRKKNIYSN

SEQ ID NO: 129025 - protein, 131 aa, Heterodera glycines
  Coding regions on vcDNA: vcDNA=SeqID_55448; Strand=-; Position=1 -90,188-343,436-585
  Homolog annotation: Hit_ID=NP_871792.1; Match level="QueryCoverage =74%, HitCoverage=16%, E-value=3e-10, Identity=34%"; Hit description =calcium-activated SK potassium channel and Calmodulin binding domain containing protein family member (75
MIIENEFVYAGHSSVCVLMKLIILLSTVCLIFMNANSAEDWQIALTFRKSMQIVVEIIACAICPLPMQIDVFVSTVNSDGHTVPMRMPLDVLFSICKFPSNSFFIQMIVFQFHYSNVLPTVLAVSGDASPL

SEQ ID NO: 129026 - protein, 122 aa, Heterodera glycines
  Coding regions on vcDNA: vcDNA=SeqID_55449; Strand=+; Position=1-369
MLSMEMVATKDDEDGEGQQLQQIEEEDNDNADILTHYIKPERNLWLLKRRPTVGGGKWQKQWAQWEAEAIGWNWTNAWNVIEVANEEDVDVIEDGNEHLDMDEVTYEGEAMDEIDEMDGTDG

SEQ ID NO: 129027 - protein, 112 aa, Heterodera glycines
  Coding regions on vcDNA: vcDNA=SeqID_55450; Strand=+; Position=1 -84,147-401
MERNKRKFAKIVSSLKKDGIEISESATDTLFVSNSSHLVGVPFESLELLFRRFDLHCAFTVYPTNKSYSLVHFSEVNLAIAARNALNGTKPKDFPSENAAQIHLFFVRQSGV

SEQ ID NO: 129028 - protein, 56 aa, Heterodera glycines
  Coding regions on vcDNA: vcDNA=SeqID_55451; Strand=-; Position=1 -109,423-482
IDISAEKWLMHYEADSLAKLENPPSLADGINRELERHMVQACLLLASKIEEEPRKP

SEQ ID NO: 129029 - protein, 68 aa, Heterodera glycines; identical to SEQ ID NO: 127362
  Coding regions on vcDNA: vcDNA=SeqID_55452; Strand=+; Position=1-412

SEQ ID NO: 129030 - protein, 72 aa, Heterodera glycines
  Coding regions on vcDNA: vcDNA=SeqID_55453; Strand=+; Position=1 -46,115-287
MAESKVLYYTNICTDGQSESNPMPFGGGFSFTTTVPPAANGPFQFGAAPPVANGNVFQFAETTDCKAIITFC

SEQ ID NO: 129031 - protein, 118 aa, Heterodera glycines
  Coding regions on vcDNA: vcDNA=SeqID_55454; Strand=+; Position=1-357
MRNGSEVIDGNERIWWQKVLGQGTAENDRHGESAEAYQKQRDGLIVRQNGRKRAQGWTARKMGKKGTKGQKEKEKAKRKKRKGQKEKAKRKSLKGQKQKEKAKRKSLKGQKEKRKGKA

SEQ ID NO: 129032 - protein, 205 aa, Heterodera glycines
  Coding regions on vcDNA: vcDNA=SeqID_55455; Strand=+; Position=1 -147,204-332,1121-1462
LPSVPHQNGVSSDGFGPGQMAILATERLDNTLAERESEQWPLEGLDPQLCNGQTFIGEQFFEGKRTDGNAKFGGEAKVTKDNQRRSGKDETKVQHPLISSYLRCYICRIAMRLNAADRAPHWKCLNDWLQTYAQQPVNPVTHQRLNAFSSDLFAWPRHGMGRPMRRVQRRLLLGFAPVVGVLPFARTACRCAAANAQRIAPPLFG

SEQ ID NO: 129033 - protein, 272 aa, Heterodera glycines
  Coding regions on vcDNA: vcDNA=SeqID_55456; Strand=+; Position=1 -635,692-833,1287-1329
EFAGVALILLGFSFRVDSFVAFFLDTFDGLSLSTTLFTHILQLGTDFLATLVHIPLEQQHQSEEEDEETDESRRLPLKHFRRFLHFVLSFWHSVSPSFAPSPPLSHHSLNLPLSTQFDFVRLLVRCLQYLCIIWPTVHRTFLPSAADQSPLIEDEEIVQQLMEQQQNQLQLDEDKAEQSQFNVTLLRNVCTQCAEKIADALKPFLVNENASDEMGLAGVELLELLAQFGPADVEEGNGDASAVVLPGVLLTLAKTIYKHFDALRAIDSFSHF

SEQ ID NO: 129034 - protein, 161 aa, Heterodera glycines
  Coding regions on vcDNA: vcDNA=SeqID_55457; Strand=+; Position=1 -252,388-620
MTFVGTENVQNARPQQRSAFLHFGEQCKAVQNQQLLSMAMAFDKHSDTEQSLLQLPFHVRGILHRPRRMDKLKEWVKVELAFWEVLLSTENHFQLSLVSTSSLSPHEIAFSIGWDLSRPQPTISEALSHIGFKEWPKAFTSTASDIERKDNENEETEEDDG

SEQ ID NO: 129035 - protein, 163 aa, Heterodera glycines
  Coding regions on vcDNA: vcDNA=SeqID_55458; Strand=+; Position=1 -190,506-807
MVKIKSKGNWGAFERSRLLETQNDKPRNWHFGGRTARATARLKTPSANQRERPTEKDSFVGYGRLCGDWNGNAGDEFRMPNGGQTENAKEFHQAYSLVDGEGEEDGECEDSAILDKFHSEKTEENETNEPKQQKDSEEKPKMEQIGEEKQRKTKRKTEKSRIL

SEQ ID NO: 129036 - protein, 131 aa, Heterodera glycines
  Coding regions on vcDNA: vcDNA=SeqID_55459; Strand=-; Position=1 -88,422-630,672-770
MARTTMSFLFNPLNEDQREEMCETWLYTFILFDSIESIQEHIEKAIAPAAGAHEIEEWMSNLDLAAVSKMFRINVIVCELVKKEVYRWQMYSPADLETSLSNVSQKKSSPSIFLYFHGQHFELIKQPQKIN

SEQ ID NO: 129037 - protein, 17 aa, Heterodera glycines
  Coding regions on vcDNA: vcDNA=SeqID_55460; Strand=+; Position=1-55
YREAIPEGFGLPINLAH

SEQ ID NO: 129038 - protein, 52 aa, Heterodera glycines
  Coding regions on vcDNA: vcDNA=SeqID_55461; Strand=-; Position=1-5,61- 214
MLPLPTAPHRPRLLSVISRPSRIGEEPPLMIHEAAVLSSLTIFPIILAFPKR

SEQ ID NO: 129039 - protein, 135 aa, Heterodera glycines
  Coding regions on vcDNA: vcDNA=SeqID_55462; Strand=+; Position=1 -231,401-577
MSLDTWVGRYPETYGYFDGGKIYGHNTGFFDGFPEFSSGDVVGCGVDCATHEIIYTKNGERLSECGKRREREKGGEKLAKKPYLTCCVNNSSDSMFETKNSTKPRLDPPETQEIETEKIRDPRLFNKFFVHFKID

SEQ ID NO: 129040 - protein, 469 aa, Heterodera glycines
  Coding regions on vcDNA: vcDNA=SeqID_55463; Strand=+; Position=1 -148,357-424,629-1277,1317-1611,1665-1914
  Homolog annotation: Hit_ID=NP_702308.1; Match level="QueryCoverage =80%, HitCoverage=44%, E-value=9e-22, Identity=24%"; Hit description =hypothetical protein PF14_0419 [Plasmodium falciparum 3D7] gb|AAN37032.1| hypothetical protein [Plasmodiu
MLICVGRHLKSANRRDEIMAKLHLEKMMAILEEENDETDGPFKGILINHKESFGTILNKDGIQKINEWLNLETKYFSLNEKFSSAASSSDDEQRFKDANYDEQIDEDNESNNPNDSDKLERNKQKEMENSRENLKNENFEMNYFMGGQNQEENKCKKEKCKWSKKESEKMEKEKRNGKKETEREENSEEKEEKENKGMERKENSEQIGEKQNEKKRWREKEEIKRKKLLEKKEREKEERSKKWMEKEKEERVIKRKKNLRKSEKGENYRFLSKESVKAMKQIKIENYSDLLNEKYLAKFYDKFLLNELEEENCVIYLHVAAFVRAIHSKSKFIKIRTKNHETKISKSFEEKWRTFAKNAMPTEGEQMEIELQKLFSLDIALNEIIYGPIEQKQMEKAIEMLEEKRKGKSKNKLGTYKRGEIENILEQLHLQIFGILCAKKLTNFVENEKIIIGERIKLIMRKENGEKEF

SEQ ID NO: 129041 - protein, 106 aa, Heterodera glycines
  Coding regions on vcDNA: vcDNA=SeqID_55464; Strand=-; Position=1 -174,225-371
MEQMAFYNSGSSTSSHSSDYADGLGPLGGGVPVGVRTRLASQDTANKMMVFDPANVYSRPAQAEVPRCIFSGIPVRIPAFVFYFIVPKVIAHRYLLITLFTTDIEK

SEQ ID NO: 129042 - protein, 158 aa, Heterodera glycines
  Coding regions on vcDNA: vcDNA=SeqID_55465; Strand=-; Position=1 -199,778-899,996-1151
MGKLRDWTSGSYVQNVLFGVSEQCPGSAKLLGAEGGAAYIIDEDSASDSFGGWDAANGGGVAVQPIGYSNAINDDPSGGAADHPLYSGIDSVYSTAGGLSVLALVVLVGWRISRWRMLSELARHTSSGMCKIIFRGQANSPKKYFRWRKHLLFLFSVT

SEQ ID NO: 129043 - protein, 116 aa, Heterodera glycines
  Coding regions on vcDNA: vcDNA=SeqID_55466; Strand=+; Position=1 -67,1108-1391
MAFLLPICLSYGIPQWSVPVLSNFVALFGAVNPDKPLTDEKVKIYFFCYLYFSPSLLMSMLWWCHDLMRNPDFLCTKMSEGHYPFSYKSIEKGQISNFLHVFILFFLLKELFLIGN

SEQ ID NO: 129044 - protein, 34 aa, Heterodera glycines
  Coding regions on vcDNA: vcDNA=SeqID_55467; Strand=-; Position=1-3,96- 197
MHVPGDFDNDRSRQGLISTLWTRQRVISTAPINF

SEQ ID NO: 129045 - protein, 44 aa, Heterodera glycines
  Coding regions on vcDNA: vcDNA=SeqID_55468; Strand=-; Position=1-135
VLSSPWRRHSIFLGSHAIAASEEFEKCCVNGMNLAEYLSRIDGE

SEQ ID NO: 129046 - protein, 36 aa, Heterodera glycines
  Coding regions on vcDNA: vcDNA=SeqID_55469; Strand=+; Position=1-110
WTPLMYAAYLGHRELCQLLVLRGADVEAANERNQTG

SEQ ID NO: 129047 - protein, 215 aa, Heterodera glycines
  Coding regions on vcDNA: vcDNA=SeqID_55470; Strand=+; Position=1 -537,631-705,833-868
MDIVHVVTSQQRQTQHYATPPMVQRYNMWHFAIFTNAFSFPVKPLYTPYLYAAMAPPHPQYNPYAYYYAPVAAPSAASSSSSAVPPFLHHPPPPHVHLMPAPPPPPAMFAPLSANSAAGTSAANNTASTSNYNNATGTSNFGFDCPPVDSNPSRWSAETLCRWLTAAGLADCAQRLLNEEVDGACLLLFTPINYQNLGLKLGPMYLRQFTFADNR

SEQ ID NO: 129048 - protein, 219 aa, Heterodera glycines
  Coding regions on vcDNA: vcDNA=SeqID_55471; Strand=-; Position=1 -657,785-787
MKGVGAERCRKFKNAMDTQMKRFSENLWATEKPEKIEYAWAGERCETTVNDYLEKGQGGILDFSLITSFGYKLNPYNGWEEMQRQTFLWEIPEPSENYWATHFPVGDFFSEITDDAIVVESEQSVFFFEKETAEEREGIIGVPEEAYKMSNDVFILIHSLSKKQKREIMEKVEVSKKGRPFKQKAQLKQKNVQKQQNESILVNSNSTSSQNVLNVTTIM

SEQ ID NO: 129049 - protein, 183 aa, Heterodera glycines
  Coding regions on vcDNA: vcDNA=SeqID_55472; Strand=-; Position=1-552
  Homolog annotation: Hit_ID=EAA42263.1; Match level="QueryCoverage =86%, HitCoverage=87%, E-value=2e-34, Identity=48%"; Hit description =GLP_49_96114_97016 [Giardia lamblia ATCC 50803]
MGSTRVSNNPKFGFNSQRCAHNLNVTFHYITLHYITLHYITLHYITLHYITLHYITLHYITLHYITLHYITLHYITLHYITLHYITLHYITLHYITLHYITLHYITLHYITLHYITLHYITLHYITLHYITLHYITLHYITLHYITLHYITLHYITLHYITLHYITLHYITLHYITLQTQICL

SEQ ID NO: 129050 - protein, 65 aa, Heterodera glycines
  Coding regions on vcDNA: vcDNA=SeqID_55473; Strand=+; Position=1 -40,106-263
MLARKFRGIQGSQSWAKYYRIVERVRPPPISKVGVGSLLLRRSWVRIGWVLIATDWFRLTVGGAP

SEQ ID NO: 129051 - protein, 500 aa, Heterodera glycines
  Coding regions on vcDNA: vcDNA=SeqID_55474; Strand=-; Position=1-1503
  Homolog annotation: Hit_ID=XP_320617.1; Match level="QueryCoverage =60%, HitCoverage=36%, E-value=8e-38, Identity=34%"; Hit description =ENSANGP00000024791 [Anopheles gambiae]
MFDAKPTEKLQDLVTQAKTIFEAAGMKLREFYGSNIEELKKLQPDDLTKDLEDNKVLGIRWKPKHNRLIFKLPIFEGKITKRTILSQIAKVYDPLGLMSPVLLPAKLILQEVQNLNPKWDDELPANINKDWFKLMAQWLDRGEAITIEFPRHIQAIDSVEFHCFCDASKYGMGIAVYQKAKTIIRKDECNLIYAKSLVKPIKVAAHDDTIPKLELQALTLGVKAVKFIQAQIKFADHQVIMWTDSQCSVERLRENKRQDRFVANRLQKIREANFQVRHVRTDSNPADMASRGADPQCLRTSLLWRFGPIWLSKADKWPESNVIYRPRDEFKEVEKPPIVDIPEQPIQAVHSFIASVMEDSVSLAGSDDESQQPRPKKKFKIPKRRSALLRPIGQQQSPLQGQHKRRKQLQDSGLRKLFQAISDQQGSSKATTKAIEESREVQKAPRHEQIEHEQRMVKKSQQEANRHLQPEKRQQKEIQEVPHSTTEEQQRETKRQFIKV

SEQ ID NO: 129052 - protein, 223 aa, Heterodera glycines
  Coding regions on vcDNA: vcDNA=SeqID_55475; Strand=+; Position=1-669
  Homolog annotation: Hit_ID=CAD32253.1; Match level="QueryCoverage =96%, HitCoverage=12%, E-value=2e-25, Identity=31%"; Hit description =gag-pol polyprotein precursor; hypothetical protein [Drosophila melanogaster]
IEENLYVDNIMFDAKPTEKLQDLVTQAKTIFEAAGMKLREFYGSNIEELKKLQPDDLTKDLEDNKVLGIRWKPKHNRLIFKLPIFEGKITKRTILSQIAKVYDPLGLMSPVLLPAKLILQEVQNLNPKWDDELPANINKDWFKLMAQWLDRGEAITIEFPRHIQAIDSVEFHCFCDASKYGMGIAVYQKAKTIIRKDECNLIYAKSLVKPIKVAAHDDTIPKL

SEQ ID NO: 129053 - protein, 1050 aa, Heterodera glycines
  Coding regions on vcDNA: vcDNA=SeqID_55476; Strand=-; Position=1-3151
  Homolog annotation: Hit_ID=NP_494191.1; Match level="QueryCoverage =82%, HitCoverage=83%, E-value=1e-43, Identity=23%"; Hit description =peptidase family A16 (2C417) [Caenorhabditis elegans] gb|AAB71060.1| Hypothetical protein R52.2 [Caenorha
MAAPIQQKLGAALKVLSRSRTAAELNIQADQAASNLENALNFEIQLEKVQKDAKTMDIFLDDVREALTAWADLLRKLPALERDPAEADFNKFEKKERINDKVDEAALKLRDLRDLIGTLTFQARLFRSKADKEERDAQAAYAQATQHTAQQQTTKTPSFTPPFYQFQPIQLDKFFGNKRKWPEFYESFKSAIGTHALSKAKKFNLLRNLLGGEARELVAGFRLEDNNYDTALQLLKDTYGAPDEHIRALHFELANLKPCKNLRDTKEFLLQLDRLTRELNNTGEDIEGPPTFLMLEKKLTPGFLRTILTKKGEDPARWNTTKFRDVLNEAVRKETQIQEVMGEYGHSQQHPQQRPQPQRPNFSASKFRDRAPIPQQRERTFITSAVDDNHKRLINRQPQYKTQQQRPRAPQPQQRNLRTFNNQRQFPTQRANATNNQRQFPTQRANAINNQRQFPTQRANATNNQRQFPTQRANAINNQRQFPTQHANATFNQRKPPSPCIFCDNDHWNKECRKYSTIQQRREVLRTKALCFKCLKSNHQASNCPQPKKCFKCKQPHPTALCYADEKPPNQITSAMLGQTQQNVSITTQDGSNEQTASTSQMCNAVNGSDTRALLMTATSTVFNPAQPHLSMTAAIFIDPGSHRSFISSKAAQLLDLPVVHTEECHLTSFGEREPKRYISDLVKLGFLCTSGEKLIFNLNVMKFLVNDMPMIQLSELDKTVLRQQKLNPPHEQRQPDIMLGIDVWHELQVQPIEKLPSGFTLCRSKIGKILSGSRRIEMHQTPNVTFVMSVHGTEQEEANQSVTFESTKEETEVFTIEDDFKKDEQLNNFFGLNLIGMDDTSTPIDQDHVMIHFKKNLTFVNNRYQVALPWNDRVDALPSNIHQAKARLVSLIKRLRSLNLIDKYQAILDEQVQNSVIEYIGPPESPSSAWPVHFLPHRAVIRADKATTKIRIVMDASAKPKNCPSAPSLNDCLYTGPQLLKNLTGILLRFRRMEHVILADIEKAFLQLSIRHTDRDACRFIWLNNPETAELNPISHSELRLYRFCRVSF

SEQ ID NO: 129054 - protein, 180 aa, Heterodera glycines
  Coding regions on vcDNA: vcDNA=SeqID_55477; Strand=+; Position=1 -442,582-681
  Homolog annotation: Hit_ID=CAA82797.1; Match level="QueryCoverage =79%, HitCoverage=22%, E-value=3e-13, Identity=34%"; Hit description =gag protein [Ascaris lumbricoides]
ETARLARLNRHTHVSSPTLPQQGGQRRTGRSSSSFKSAIGTHALSKAKKFNLLRNLLGGEARELVAGFRLEDNNYDTALQLLKDTYGAPDEHIRALHFELANLKPCKNLRDTKEFLLQLDRLTRELNNTGEDIEGPPTFLMLEKKLTPGFLRTILTKKGEDPARWNTTKFRDVLNEAVRK

SEQ ID NO: 129055 - protein, 341 aa, Heterodera glycines
  Coding regions on vcDNA: vcDNA=SeqID_55478; Strand=-; Position=1-1026
MALSQLYLKECQRNVRVSNPTLQARKLLKRENLQARWISETTIEVFPCVPISLSNISYRTTKDCYKFIPVTIHLPNATRDAFLDPEMRILSLISKIASCSPFRYHHLQVQQNPNLWVRIDSRNGNVQRLAQTVIHELYDTILNKTDNDLDLHPLIFHQWQLDNDTDFASLPHIDEFEDSEEFKNKLEEQTTQRAEALGALPGGIEGWTIKWLQERLQEAIQWWISLASAYSTFLLCRDVILPCLIAYFLNPIRITLMTLIGFRPKNQPTPQIQPQYEDMPLREMPSTPIRRKRRQLPEQSTPPIRLDTTTGTASFRTRARAHSATEDTLFGRLRPMKLADD

SEQ ID NO: 129056 - protein, 17 aa, Heterodera glycines
  Coding regions on vcDNA: vcDNA=SeqID_55479; Strand=-; Position=1-54
PVNSCIGCKCRRCCTPN

SEQ ID NO: 129057 - protein, 35 aa, Heterodera glycines
  Coding regions on vcDNA: vcDNA=SeqID_55480; Strand=-; Position=1-105
MPMSKAKLCNSVLNTSRNECLSTFFAPGNTVSRIN

SEQ ID NO: 129058 - protein, 80 aa, Heterodera glycines
  Coding regions on vcDNA: vcDNA=SeqID_55481; Strand=-; Position=1 -161,485-566
MPAMSAAASEADLRNDLMRLIIGEEHLLKIKAQYLDERTALNLRRPVNYIEVEHVRHFEKRPGHGCTARKIFLIFMRFVK

SEQ ID NO: 129059 - protein, 20 aa, Heterodera glycines
  Coding regions on vcDNA: vcDNA=SeqID_55482; Strand=-; Position=1-61
MNAAHVECQRLVTGLKRRAA

SEQ ID NO: 129060 - protein, 218 aa, Heterodera glycines
  Coding regions on vcDNA: vcDNA=SeqID_55483; Strand=-; Position=1 -43,1862-2476
  Homolog annotation: Hit_ID=NP_510671.1; Match level="QueryCoverage =83%, HitCoverage=18%, E-value=3e-39, Identity=46%"; Hit description =predicted CDS, endonuclease/exonuclease/phosphatase family and RNA -directed DNA polymerase (XR69) [Caenor
SYSNFSLFRFVLITNHLFKVLKFNGCYKTFFVLLKNNKISEYQFGFVRNRSTTSQLITVVEDWYEAIINGKNVDCIYIDFQKAFDSVPHNLLLYKLEKIGIKGKLLMWIKGFLSNRTFRVKIGDSLSSSKKVTSGVPQGSVLGPLLFLIYINDLPDALPSGVKIKLYADDVKLYICYKARADTEIMHKALHNLFEWANKWQIKVSIQKSFVLYLGSNN

SEQ ID NO: 129061 - protein, 81 aa, Heterodera glycines
  Coding regions on vcDNA: vcDNA=SeqID_55484; Strand=+; Position=1 -148,194-288
MNQQQVIKTKRNNEKLEYDGALYVLHKFSDDRLKKFWRCEFHGPSDKCKGRLHTDLNNVVQKVVGVHSCDMNAAHVECQRL

SEQ ID NO: 129062 - protein, 22 aa, Heterodera glycines
  Coding regions on vcDNA: vcDNA=SeqID_55485; Strand=+; Position=1-67
MRKLQFVGPELLLIRMEQPKGD

SEQ ID NO: 129063 - protein, 314 aa, Heterodera glycines
  Coding regions on vcDNA: vcDNA=SeqID_55486; Strand=-; Position=1-942
  Homolog annotation: Hit_ID=CAE56861.1; Match level="QueryCoverage =70%, HitCoverage=14%, E-value=8e-18, Identity=25%"; Hit description =Hypothetical protein CBG24691 [Caenorhabditis briggsae]
MEDKTLLMWDTNTTRACEFSKIGTWKGLQLDNIWISDEVSFRLTFLNNTKKVNSCGLNLIKSEEGFAVQDLPSDDSNKSSKRSRKTRSLESWVTESEMNSKLGYLDEQVREMLTLSFSQTIKSICDYMLETRRWAATALLSDPTTFARKLFQSGKLVAKVAGPELIKVWPCIELQAHDYKFAKIGNSADSEFECFDKIPIKFRVKDNKRMAFIDPRTMILSSDARLAPCSEYRKQLIFVRGSLYEVDQIDAQVKQVNANRIDGFSLNLSLAPTYARHSFLHLALVNVSDFIGQFYDANFARESELTFQLKSEDT

SEQ ID NO: 129064 - protein, 123 aa, Heterodera glycines
  Coding regions on vcDNA: vcDNA=SeqID_55487; Strand=+; Position=1-371
  Homolog annotation: Hit_ID=CAE56861.1; Match level="QueryCoverage =97%, HitCoverage=7%, E-value=9e-12, Identity=29%"; Hit description =Hypothetical protein CBG24691 [Caenorhabditis briggsae]
NNCQFKAGQCEMEDKTLLMWDTNTTRACEFSKIGTWKGLQLDNIWISDEVSFRLTFLNNTKKVNSCGLNLIKSEEGFAVQDLPSDDSNKSSKRSRKTRSLESWVTESEMNSKLGYLDEQVREM

SEQ ID NO: 129065 - protein, 167 aa, Heterodera glycines
  Coding regions on vcDNA: vcDNA=SeqID_55488; Strand=-; Position=1 -127,183-461,691-786
TELAELKTKSDKLTSELSAVKTFARKFRDERNKLELEKKELEADLKSKNEELVRLREQSAASALETTAAALSADTSAAGEPRSPVPPTLSGTVPGAIAAGALSAIRAAVGAGEGGGAGADNSLRRRMDQLMKEKQELLDKVKKLEEHNKVLQRELDESNEKVTRMDM

SEQ ID NO: 129066 - protein, 92 aa, Heterodera glycines; identical to SEQ ID NO: 124679
  Coding regions on vcDNA: vcDNA=SeqID_55489; Strand=+; Position=1-819

SEQ ID NO: 129067 - protein, 107 aa, Heterodera glycines
  Coding regions on vcDNA: vcDNA=SeqID_55490; Strand=+; Position=1-324
MEEFVGIYQFHCHPNFSGVSGLYPLQFSSRGRISDRKKGRLMLDIEKFSEFAQLSAGSCKRFLEDYVYIGGLPWIIMAKINTQIESTEKWMDFFLWCIGPKQGRIEM

SEQ ID NO: 129068 - protein, 687 aa, Heterodera glycines
  Coding regions on vcDNA: vcDNA=SeqID_55491; Strand=+; Position=1 -1900,2079-2182,2478-2537
  Homolog annotation: Hit_ID=NP_001004509.1; Match level="QueryCoverage= 91%, HitCoverage=42%, E-value=5e-71, Identity=30%"; Hit description =si:busm1-180o5.3 [Danio rerio] emb|CAD60788.1| novel protein similar to DNA polymerases [Danio rerio]
MTIASACVKNFALNHLKPNSLAIVPEKGYTPQQNQSALAIKYLDWYSHINNVNIQTAHSRYGEYVFKREGQVYQVDGYIKGENGKRDKIIEVNGCLWHGCEECFEDLDDETKMPNGKTLGQLREREVRKHEILSRYVDLDVIWEHEINEQLKKDKQMREFFDNWKDHSPIKIRDAFHGGRTGPMKLLHTAKPGQKISYKDFTSLYPWTNFSTDYPLGHPKIISFRLNEQTVNWRAPSDNPYKGLLKVLLLPPNRNINVTVMPIKFDERLLFPLCEKCAKHITNEHPNGLKDNDYSCPHFNPNDRAFVSTCTHLELNAALEVGYTVRKLFHVLQYDQWSDNIFKSYVSEMMALKIHATGFPSWCSSEEEKKEYIEENRHRFGILLDNEKMKAEPGKRYIAKLCLNSLWGRFSMRNLLSKAIINNDESLIRQYTDDKKIELVDLEMIDDDNDVFMLTYKPKEEFVDENKYSNVVISLFTTSAARLYLYDALKKVADTPDCEILYFDTDSVIYVHPEDNDPLPTGKGHLGELTDEKPDHNILEFISAGCKNYGMKLQRKDTGEIEHDLKIRGFTLDAQTVQKIHYDTVKDQILRYGSEDPPDPIIVTYPHFIRPNLIQGKVYTHSLTKHYQPIFTKGHPSEMKVDELFIIVMRSLVRECLDWGPKGEAVPWVEKCIIKHINMYAELSNGR

SEQ ID NO: 129069 - protein, 89 aa, Heterodera glycines
  Coding regions on vcDNA: vcDNA=SeqID_55492; Strand=+; Position=1 -129,613-753
MCKLMFEMEVRAHMDSVAVRASPTAVSFLTEFNAKLAEQQQGKKCETHLIVSYFNELFNVWEPVIEPVLHKDKGWQNWKLALKVLSFFH

SEQ ID NO: 129070 - protein, 195 aa, Heterodera glycines
  misc_feature (178)..(178): Xaa can be any naturally occurring amino acid
  Coding regions on vcDNA: vcDNA=SeqID_55493; Strand=+; Position=1 -199,261-327,413-493,561-761
  Homolog annotation: Hit_ID=AAH83050.1; Match level="QueryCoverage =65%, HitCoverage=63%, E-value=1e-29, Identity=52%"; Hit description =Unknown (protein for IMAGE:7012320) [Xenopus laevis]
KKFSNDSSHFLSLKNTFKTFNIFFAGRQFLTIAVNFLALVVLYMLYLLFGRWAQLACNITGFLYPAYYISIKAIESHQKEDDTQWLTYWVVFALLNVVEFVVFALLNVVEFFSNTILYYFPFYWLMKCCALLLWLYLPSTLGAQLLYTRIIRPFHLQQHKNIDSMYNKLAGGEPFSKXNYLNLQISLMVNGTMCQ

SEQ ID NO: 129071 - protein, 164 aa, Heterodera glycines
  Coding regions on vcDNA: vcDNA=SeqID_55494; Strand=+; Position=1 -171,313-519,610-723
  Homolog annotation: Hit_ID=NP_506382.1; Match level="QueryCoverage =95%, HitCoverage=20%, E-value=4e-48, Identity=61%"; Hit description =leucine zipper-EF-hand containing transmembrane protein 1 (87.3 kD) (5O143) [Caenorhabditis elegans] emb|
MTVQFFSQEQQYKRQLKAKNETAKFLQDSLEEIALARQEQGHAHGAQAIEFAQFLKKVRTGEGGYVNNQELFKFSKLFEDELTLDNLSMVHLRALCRLLGIAQFGTPEILRFRLRMKLRELKADDQLIEREGGVEVLSAQELQAACRARGMRALGLSEERLRQQ

SEQ ID NO: 129072 - protein, 122 aa, Heterodera glycines
  Coding regions on vcDNA: vcDNA=SeqID_55495; Strand=-; Position=1-369
MVMEREIWALLHNLVLAEDPSNAATYLIDEWSQKFGKMHKLLANCGSYDNTDPYDEAMRGLLMVVMDKEKIPIKKLDECRAIVPTLMANAAHRHVGQFANGSERADKSLFRQDFFGRRVQMK

SEQ ID NO: 129073 - protein, 1173 aa, Heterodera glycines
  Coding regions on vcDNA: vcDNA=SeqID_55496; Strand=+; Position=1 -103,160-240,299-529,584-658,1607-1848,1892-2255,2343-2948,2990 -3312,3591-3792,3835-4388,4431-4552,5589-5707,5854-6352
  Homolog annotation: Hit_ID=NP_001004509.1; Match level="QueryCoverage= 58%, HitCoverage=54%, E-value=7e-46, Identity=29%"; Hit description =si:busm1-180o5.3 [Danio rerio] emb|CAD60788.1| novel protein similar to DNA polymerases [Danio rerio]
MGNFRLGILTQTEHTTQIHLQNRATIPPPSAKCAGRSCPTSSTTDTTDRRAAICQPTTKCAGNSCPTDASTVAAERHAANSPSTAKCDFNLDQIVVAFSQSLGVSSGNSCSTNSTGIRRTAICPSAAKLAVSSTRKRSGNPTTATTAPAERRATIRPPTAKRTGLFYALEIARSYQLIGKSITENKFRYLMKTEKKQREMAIELMEKAGISTDDKAFGTQHLEAVQKYWDREFPDMFRIVAFEMKTGLRPIFKGEGVRKHEVCVIREGNHWEGIKSVSWFFGVRNFCVGCEVTYDRPERHRMECKERCKKCCRMGFGFPCANVCEEMHCGECNLKFYNPECFEAHKKAACNEYKKCEKCGEVYQTLRPQKAYRIVAYDLETTVDGGEHRPNLVSAARTCNICAGEERECEICEGPSKITWSVADGFDPMSEFVVWIMGFQRFETIAYAHYAGRFDSHFVLSELTKKEIATELMMADLKIYQIKAGRVYFRDFWMLSQNKLADLPKTLGLKTAAKLYFPHKYNKNENFGKRLSNLPPLEDYCPDSMKEEEAAKLESWHNENFQKEFELGEQLKTYCENDVEILMESILKFRRLFLGITGDLDVIKDSVTIAGVVMKIFRAKFLKDRHIPIMPEGGYERAENQSKIAVKYFEWLAQKKGVKVRHACNGGEVEFGGLKECDVREELKKNKEMKKFFESVPDKGPINPRDAYAGGRTMPFCLYAKATEEIEISMFDIISLYPFVNYDTPYPVGVPKIVVSRNFNVNWTAPDDVPYDGLLKVKVIPPKNLLYPLLPVHIDEMLLFPNCWSCARRAKNEFMMTKDVKKCNHRPTQRAFLGTFTSIELRKALELGYRIVGFYRAYHFEQFDSQLFKGYVRMFLKIKVEASGWPAEVKSEDEKRAFIEMYKAKYDISLDYDKIGFNPGLRMIAKLGLNSLWGKFSMRNTLSNTEIVGSMERWMELGRDNTIDLGARGPLLQCSVRPSDHPCPPLPTIESRHCFQGVHAQAAIIWGIKMYSFQKYFEEALEKEDFFWQKNRAEVEALLIEASNYKIIIHRDNESRYSDYIATYRRTPLFCFCMIERNLRFFYDTGTGTPIGRVTTVLHVTVEASYTGEGFISPMFSFWFYWEGRSQTTNESFTSRLYLYTVSMLRAMGKAWGRELLLNPVEVLIDMFYQRID

SEQ ID NO: 129074 - protein, 168 aa, Heterodera glycines
  Coding regions on vcDNA: vcDNA=SeqID_55497; Strand=+; Position=1 -152,218-496,557-632
MAPLTMDQMQLLAKLWSNGFTLRAKMANRSDCIAIIILVHRISNGSTTSKSATTSVSYNIQLYFHVNTIPTEPFELVNKRTNEKLTLKQEIDEFDVNVYNWLLQRCPIGETARVPAIKWGDSLNPSANLNSIRFDLWSFDKSIEPLSPPTEEEKEEEEADKSNGNVVC

SEQ ID NO: 129075 - protein, 235 aa, Heterodera glycines
  Coding regions on vcDNA: vcDNA=SeqID_55498; Strand=+; Position=1 -161,328-392,517-563,610-684,745-818,911-972,1038-1194
  Homolog annotation: Hit_ID=CAE75111.1; Match level="QueryCoverage =93%, HitCoverage=21%, E-value=2e-57, Identity=52%"; Hit description =Hypothetical protein CBG23036 [Caenorhabditis briggsae]
IPIIYIAYESVQILDRPRTQRLFTFDHSYWSHDGFRVSNDGHLVPETRDYADQKRVFDDLGAQVLRNAWAGFNCALFAYGQTGSGKSYSMVGLGKNRGLVPGLGKNRGLVPMICDEMFHSIEAEKKKYIQFKYIQFKVTVSMFEIYCEKVRDLLSANPTNKGPIKVREHPKNGFYVEGLSSWPVEGLSSWPVASYRAVEKLLNEGTRARTIAATVSNGKRERERRKWSSTNREKK

SEQ ID NO: 129076 - protein, 20 aa, Heterodera glycines
  Coding regions on vcDNA: vcDNA=SeqID_55499; Strand=+; Position=1-65
TDQKRTKLCRDTERKRNNLF

SEQ ID NO: 129077 - protein, 91 aa, Heterodera glycines
  Coding regions on vcDNA: vcDNA=SeqID_55500; Strand=-; Position=1-339
FEYPKRTLEKIDFFVFGAVPPSRCAQIYGETESFRNSFPIACTLILRWIFAPHNCLSTPNGHLKKSIFLFSGHVPPNRCAQILWGDLIFPE

SEQ ID NO: 129078 - protein, 198 aa, Heterodera glycines
  Coding regions on vcDNA: vcDNA=SeqID_55501; Strand=-; Position=1 -187,237-378,427-529,582-744
  Homolog annotation: Hit_ID=NP_502882.1; Match level="QueryCoverage =74%, HitCoverage=28%, E-value=1e-17, Identity=34%"; Hit description =DNA polymerase like family member (4Q408) [Caenorhabditis elegans] emb|CAB60306.1| Hypothetical protein Y
MQPGAKKRTKRKNAENTHGEAMECEEEEEDAVDEDAENNWMLGYEEAGEKPESVTTYAYAHAGSRYDHVLIYGEMLRMGVRPELIRQGNHLLEMKTRKTGVYTTTVFRDSYKLIPIKLANFVKTFGLEIEGVENKKYFPHKFNKAENYGTVLDTLPPIENYYPGGLFPAERAKFEQWYDENRETGFELSEVIADYCKT

SEQ ID NO: 129079 - protein, 150 aa, Heterodera glycines
  Coding regions on vcDNA: vcDNA=SeqID_55502; Strand=+; Position=1-453
MAEAAIRQLSDVFQQFLTAQQANAAAPAQPIPMPNLANFDCFGLGDHGESDIEGWLERFALALDCSTPNLQDDLKVKLLLTKLSETAYAEYSKHCLPKKPTEFDFAKTSEMLLSLFAKQNQCGSADMSAYGLKSKTRRNFAASSTATKGC

SEQ ID NO: 129080 - protein, 982 aa, Heterodera glycines
  misc_feature (440)..(440): Xaa can be any naturally occurring amino acid
  misc_feature (773)..(773): Xaa can be any naturally occurring amino acid
  Coding regions on vcDNA: vcDNA=SeqID_55503; Strand=+; Position=1 -310,345-1308,1370-2712,2743-2943
  Homolog annotation: Hit_ID=XP_318550.1; Match level="QueryCoverage =99%, HitCoverage=99%, E-value=0.0, Identity=43%"; Hit description =ENSANGP00000020240 [Anopheles gambiae]
MEVTIWVNDIPIKFVLDGADLTVLDEVAHKAIGKPRLTHCNEQAVYHDGTSCKLLGKGTARFSFGGKTINGQYYVTKKGSLNLLGIDMLDAFGLWTLSEGKLTKKSPILQQETTLAALQTKFKKSPILQQETTLAALQTKFPLVFAEGLGHCTKAKAHLELRPEAVPVYCRPRPVPYNTRLVVEEELDRLLEQKVIKSVDHTHWAAPIVVVKKANGSARICADFSTGLNNALLLHQHPLPLPDDIFAKLNGGIFSQIDLKDAYLQVELDEKSKEVCTIATHRGNYQFQRLPFGVKSAPGIFQSIMDSMLADCPFATAYLDDVIVVSRSSEDHQKHLEEVFKRFEKFGFRVKPEKCFFCQDQIKYLGFIIDQDGRRPDQTKIQAISEMPVPTNVSEVRSFLGMINHYQQFVKNMRFIRQPLDELLKGQSVAMVGRLSKCLXEVVSADASEHGIGAVISHRVSADASEHGIGAVISHRFSDGSLKAIAHASSSLSAAEKNYSQIEKEGLAIVFAVQKFHKYLFGRHFVLQTDHKPLLSIFGNKKGIKACTANRLQRWAITLLGYDFEIEYQNTADFGQADVLSRLIAKTPVPDNEVIIANIRESNETGVLNFVTKTLPLDHRDLANAAKSDQVIKNVKKFVCSHWPTKNKMAADIVPFHRRRHALTIEDECLLYADRVVIPASLQKDVLQLLHRGHPGMKRMKALARQYVYWPGMDEQIENFVKMCNECTMEAKMPVKSELHSWPKADGPWKRVHLDYAGPFMGKMFLIIVDAYXKWPEVFEMRSSNSAATIDKLRSLCASYGLPEILVTDNGTQFASKEFKEFVTENGINHLFSAPYNPMSNGQAERFVDTFKRTCRKIKGEGASEMLTTFLATYRTTPCEGKCPAEMFLRRKPRTTLDLLRPTMEKQFNRRHGAKTMEKQFNRRHGAKPRSFAVGDKVLARHRLSQPWRPGKITKCKGVIYDVEFFDGKFGRFHANQLLVRS

SEQ ID NO: 129081 - protein, 34 aa, Heterodera glycines
  Coding regions on vcDNA: vcDNA=SeqID_55504; Strand=+; Position=1 -93,665-676
MPIHKFNFLICHGNISSKFNCDNLPFITIESRSN

SEQ ID NO: 129082 - protein, 205 aa, Heterodera glycines
  Coding regions on vcDNA: vcDNA=SeqID_55505; Strand=-; Position=1 -87,129-246,460-871
TIVHLLSIREWLVSPVSLIIDGFFSIVDREMQEAWKLLNIRVPSLKDICTKSISENEKALEEFRTFPYESFYWNKNRKDLKKRMANASPYSVAVHKDNNHPFSSIPKSRRFRKNLFSFLIRDGDYRLSWDFFKHISRRIHCPVTKFYRYINGLVQIVSTDKKKPRIFIYFYQEGEGKYRAPSSYQGWLMRTEIDFDEIITTYLVK

SEQ ID NO: 129083 - protein, 71 aa, Heterodera glycines
  Coding regions on vcDNA: vcDNA=SeqID_55506; Strand=+; Position=1 -140,519-592
MAKMPTVVSKITKYYLKFCIFKATIEPKNTKRDGRAAENEKTWICENCKKINGRLNKVCFECATKRPLKMA

SEQ ID NO: 129084 - protein, 24 aa, Heterodera glycines
  Coding regions on vcDNA: vcDNA=SeqID_55507; Strand=-; Position=1-73
CTCGVVVKLSTFHNFSPGFNSPLG

SEQ ID NO: 129085 - protein, 360 aa, Heterodera glycines
  Coding regions on vcDNA: vcDNA=SeqID_55508; Strand=-; Position=1 -47,110-385,434-854,900-1192,1245-1290
  Homolog annotation: Hit_ID=AAL78214.1; Match level="QueryCoverage =40%, HitCoverage=77%, E-value=2e-11, Identity=27%"; Hit description =putative esophageal gland cell protein Hgg-20 [Heterodera glycines]
MSDRRKEAEEKMEKAIFISADCWLCVFDLLPPRQLGLGIAMISHRFDYYVDEHFKTRKWALKIIEIRSKIGENGTKEMAIVNSNCESLPIPQIQLPKKIIGFKSISIYFIDQNVIAFLHRFRQLFAACQINLDIYAHNDRISEFILHNIWPMIVKHICAIQLSDEVFYRLRKFVPSILDDCPSLRVISAYYTGFFAEFPCNDSVAASDGQAVVKWLFTPLQSNVPKVFKCWLYMDAWTWPSNIEPFKTAFSNASSPVNFIVVMCFIPTSFPDFVVPFDLINELTREQLALKRTDDYSNRFLLVRCPIARDESKWTKWEKEAIDWQFYEQWNIIDIRINDEGEIGDGLLNANPGPSDHQQK

SEQ ID NO: 129086 - protein, 102 aa, Heterodera glycines
  Coding regions on vcDNA: vcDNA=SeqID_55509; Strand=+; Position=1 -82,703-929
MSLWMTLPGKMCSVMSGSNVAASRRITGNKRFLRSVTINPAVEKSRSLSVDVAGAEKYFFDSLDSETKCLLHTEAQQLFCFAKNDQAFGRWMTNAADRKIAT

SEQ ID NO: 129087 - protein, 182 aa, Heterodera glycines
  Coding regions on vcDNA: vcDNA=SeqID_55510; Strand=-; Position=1-549
MNQLHNFTAKKLYEKLALADDQFDEWLVELGLLHGRRTCPQCGNEMGRCQPRPNQHYGKWRCKNAQCNRPEMGYLVGTFFAGSHLAIKQVFSLSYFWAQELGTQDQMMREIDIGGFVNCLVEVTQITMIGPQTVVDWRNFFATFVPGMCRIGIVINFNRILGHNRNRIIVIGFCLEIRLLHP

SEQ ID NO: 129088 - protein, 111 aa, Heterodera glycines
  Coding regions on vcDNA: vcDNA=SeqID_55511; Strand=+; Position=1 -205,740-870
MQVNPQNIISLLQKHFSNNFNDSTISPVEIEMANNFISIIERCLKNEEEIEIVEDLAFDENADKKFKFTSYLGTEAYSAARKKIWQYNPGVVYPPTKFHLEVPPSPEHSPL

SEQ ID NO: 129089 - protein, 272 aa, Heterodera glycines
  Coding regions on vcDNA: vcDNA=SeqID_55512; Strand=-; Position=1 -154,1467-1739,4553-4683,5644-5721,6703-6884
  Homolog annotation: Hit_ID=NP_704715.1; Match level="QueryCoverage =100%, HitCoverage=31%, E-value=1e-31, Identity=35%"; Hit description= ATP-dependant RNA helicase, putative [Plasmodium falciparum 3D7] emb|CAD51858.1| ATP-dependant RNA helic
ILWSDLTSMVLKMKSIPSISEHLGDLRFRDQPPKAAIGSALKNLYFLGAIDERVSLTQIGNHMANLPVDPQMARALIASKDYDCIEEMLSIAAIMSTQQPCIIRPKKIDRSRFMKAMEQFANYHGDHITMMNVYNKFMSCKKVNTSEEERKKWCNQNFVRFDALNEATLIRKQLSDKIKEPTRRNMMQFANPNSPEYFKNIKQSLLHGYFMQIAQRDGERGRLFKPIVDRDMSITFDKFTFVHPESTLVIYHQLVETKNAVTMRTVTWIDKK

SEQ ID NO: 129090 - protein, 45 aa, Heterodera glycines
  Coding regions on vcDNA: vcDNA=SeqID_55513; Strand=+; Position=1 -93,211-255
MVDRSLLQKGKKCFPQKVQFEHKRPGLISTREFSQRRLSEPTDEP

SEQ ID NO: 129091 - protein, 98 aa, Heterodera glycines
  Coding regions on vcDNA: vcDNA=SeqID_55514; Strand=-; Position=1 -111,843-905,1821-1940
  Homolog annotation: Hit_ID=NP_956318.1; Match level="QueryCoverage =98%, HitCoverage=11%, E-value=4e-18, Identity=41%"; Hit description =DEAH (Asp-Glu-Ala-His) box polypeptide 16 [Danio rerio] gb|AAH45393.1| DEAH (Asp-Glu-Ala-His) box polypep
YLSAPVEDALEAAATAIIQIHVEKQYGDILVFVEGEEEIEKVCDKVKERLRELKRSDLRKCVIATNIAESSITIDGIVYVVDSGLAKHLKYDTKKGIT

SEQ ID NO: 129092 - protein, 49 aa, Heterodera glycines
  Coding regions on vcDNA: vcDNA=SeqID_55515; Strand=-; Position=1-228
VGVNSVWPTPSQQCSKSYNFFLCWPNFTIMVSFESPICLKDIYKLFLRD

SEQ ID NO: 129093 - protein, 54 aa, Heterodera glycines
  Coding regions on vcDNA: vcDNA=SeqID_55516; Strand=+; Position=1-385
ELLVLFDSSMCLLLICKISKIFVKFQKSYGQKELKSPVIRTFFALILLCINKNF

SEQ ID NO: 129094 - protein, 34 aa, Heterodera glycines
  Coding regions on vcDNA: vcDNA=SeqID_55517; Strand=+; Position=1 -61,121-164
MADPIDSKYFGFVPATEEQQEHTLKRGNMPKGTK

SEQ ID NO: 129095 - protein, 118 aa, Heterodera glycines
  Coding regions on vcDNA: vcDNA=SeqID_55518; Strand=+; Position=1 -150,595-658,1001-1143
MGICQTGNSADVFCLGQFVPSAAVLSSSSIGAAAGDRQQKGRQQQQNTAMANVVKTEQQQQHNEEDGQVEYDQLTPTIPSLFGEDTNRLDVRQQQQMCHVDQLMKTCESIGGHRFMHN

SEQ ID NO: 129096 - protein, 86 aa, Heterodera glycines
  Coding regions on vcDNA: vcDNA=SeqID_55519; Strand=+; Position=1 -130,1131-1261
MKHFNCWDYEARSFDYPYYGSYDLELIDAKNLTICYTRRKYNNVTANMFISFPTDHRQQLFPFVSLLSPGDQIDANFGPNFLFANT

SEQ ID NO: 129097 - protein, 267 aa, Heterodera glycines
  Coding regions on vcDNA: vcDNA=SeqID_55520; Strand=-; Position=1 -92,281-701,812-950,1169-1320
  Homolog annotation: Hit_ID=AAL78214.1; Match level="QueryCoverage =34%, HitCoverage=47%, E-value=4e-11, Identity=40%"; Hit description =putative esophageal gland cell protein Hgg-20 [Heterodera glycines]
MALGAGQRPLRRPGEHAAAAEAVVFGGVSHQYLDAEVINFLQRFRRLFNTYISLKFTIPITEFRAWQAVARHIWPLLKNGLGTLVNVKRKQLALMRKHISPTFLFDCPNLVEIVSPVLPERPTVDNSAAPETSSRDLYMWLHTTRVDRRPLVYKLLKWNNRWDQFVNELMMSFNTASVPVNYMVFTSFEFIYTRREQMVNMLTEERLTMLTNVHPKRDRCLRIVLRPCRETDRAENRSNAQTVDQQQMSPKHNQWPLGWNYLIIIFS

SEQ ID NO: 129098 - protein, 133 aa, Heterodera glycines
  Coding regions on vcDNA: vcDNA=SeqID_55521; Strand=+; Position=1 -85,243-559
MSSLSIKFVNFFLFPLTILLAQCSNSPDGFGAKLEAKIHKLPSSADVPMNASLLELLDQFETIEFDGTVKGKVRCGFGLNQCMKMECTLDAYSINNMEFNEGFVVGDFLTLTQNPQGCRFTLALFGAKSHHIY

SEQ ID NO: 129099 - protein, 59 aa, Heterodera glycines
  Coding regions on vcDNA: vcDNA=SeqID_55522; Strand=-; Position=1-253
NGAMVGWTVGNHFGTFALILAVGILHGKRQHFKLKIKTTFNVFPLFALSESNSDSRLKF

SEQ ID NO: 129100 - protein, 256 aa, Heterodera glycines
  Coding regions on vcDNA: vcDNA=SeqID_55523; Strand=-; Position=1 -33,292-339,603-1291
  Homolog annotation: Hit_ID=NP_608540.1; Match level="QueryCoverage =99%, HitCoverage=63%, E-value=1e-28, Identity=31%"; Hit description =CG2839-PA [Drosophila melanogaster] gb|AAF51469.2| CG2839-PA [Drosophila melanogaster]
MHGGKRPSGQVINKYLRVQDKQSGEQVRDRRGTERGRGIERGRGSGRETKRGTEKEIEEEQKVEKDQKEKAEEEQKGEQKLEEEEKVEEEQKGEQEEGQKRNRKRKRKWKRNRKWKRKWKRNRKRKRNRKRNRTGTESGRGSERESGRGTERGTEIGRGRESGRGTERGTGRGTEEEQKEESGRGTESGRESGRGTERGRGTEKEIEQEQKVEEDQKEKAEEEQKGEQKLEEEEKVEEEQKGEQEEGQKRNRKRKR

SEQ ID NO: 129101 - protein, 70 aa, Heterodera glycines
  Coding regions on vcDNA: vcDNA=SeqID_55524; Strand=-; Position=1 -13,154-353
MIYPGLKNDYIIKTAYCSTNVRFHSFFIRTSRLYRSLPKEARLLNSTEFAKLLDTYDIDVLLLKPPHLIQ

SEQ ID NO: 129102 - protein, 195 aa, Heterodera glycines
  Coding regions on vcDNA: vcDNA=SeqID_55525; Strand=-; Position=1 -76,148-218,868-939,1019-1188,1238-1436
  Homolog annotation: Hit_ID=CAE60539.1; Match level="QueryCoverage =73%, HitCoverage=17%, E-value=1e-21, Identity=36%"; Hit description =Hypothetical protein CBG04166 [Caenorhabditis briggsae]
MDKVTPNFKEEKRTNAIVVPPKDAIVKRNNKTAVIAHLHVFYQKWALFVKGFVTQTEEGGKAAEISLNYPNINPHFHGVNFAKNNLTTKITNIASVEMVALQYRAERTLLGLSSDEMKQYLIRVSKFFENEFRSDLIHVMSISQSYVEAEFVRASLSMLPYLGFGFAVMAFCTAISIPLSAAYFQQATVHKAFTH

SEQ ID NO: 129103 - protein, 134 aa, Heterodera glycines
  Coding regions on vcDNA: vcDNA=SeqID_55526; Strand=+; Position=1 -117,528-816
YNSYWQNASTPQPAHHYYTGGTGSLVYSTISGDAHSICSSNADVSARLSTRTHQLSSSLILVPTPPATHYQHHHHYPNHHHQQQITVDPSYNNNIVSMSSPSGTGAIGGGGGGHIGIYHQANSSKKEQFSICDR

SEQ ID NO: 129104 - protein, 18 aa, Heterodera glycines
  Coding regions on vcDNA: vcDNA=SeqID_55527; Strand=+; Position=1-56
MEEMPVVPINASWKILKT

SEQ ID NO: 129105 - protein, 28 aa, Heterodera glycines
  Coding regions on vcDNA: vcDNA=SeqID_55528; Strand=+; Position=1-86
QRLLIRLQRTTNDRQRDKGKKKGGGGRN

SEQ ID NO: 129106 - protein, 97 aa, Heterodera glycines
  Coding regions on vcDNA: vcDNA=SeqID_55529; Strand=+; Position=1-291
MSINLHDKKSLMDNILPVVEINQTTNGITVSSERIAIPRTIQFDILGKCRECKSTECETEWCVSKEGVTIWCTRFKISPRFVPFDVIYDLSGYTFFK

SEQ ID NO: 129107 - protein, 66 aa, Heterodera glycines
  Coding regions on vcDNA: vcDNA=SeqID_55530; Strand=+; Position=1 -143,555-612
MRTIILKKCCWLTIGCDFISEVLNLSVGHSTFCSLSRNSLLQLWRPLLNPNKREAMKHARSHHWTF

SEQ ID NO: 129108 - protein, 26 aa, Heterodera glycines
  Coding regions on vcDNA: vcDNA=SeqID_55531; Strand=-; Position=1-259
TQITNTNVYQKHDTHNCVTLNSNNKH

SEQ ID NO: 129109 - protein, 18 aa, Heterodera glycines
  Coding regions on vcDNA: vcDNA=SeqID_55532; Strand=-; Position=1-55
KFAFLELGFESNIKINKF

SEQ ID NO: 129110 - protein, 26 aa, Heterodera glycines
  Coding regions on vcDNA: vcDNA=SeqID_55533; Strand=+; Position=1-82
VADYLRCFINGRFKDEIKYENVNVLL

SEQ ID NO: 129111 - protein, 111 aa, Heterodera glycines
  Coding regions on vcDNA: vcDNA=SeqID_55534; Strand=+; Position=1 -93,1137-1379
MAGILSIFSSFLEANGLGGPDFWGRSILVMQITVHLVLIASILLQLVQMLFVGQAGTEFFIWCWYLSACVTFTLYQAMSVFSVICLFTSEPMFWTTFNLFLANSFLNRLVF

SEQ ID NO: 129112 - protein, 15 aa, Heterodera glycines
  Coding regions on vcDNA: vcDNA=SeqID_55535; Strand=-; Position=1-54
GYRNIKILKSGSFCA

SEQ ID NO: 129113 - protein, 70 aa, Heterodera glycines
  Coding regions on vcDNA: vcDNA=SeqID_55536; Strand=+; Position=1 -88,418-542
MAQIHFKIFLIFSLITFSQCRINSEPSEKEGPSSIGGIQNATSDHRSAAAASDHHASSCDGFGWTLNKGK

SEQ ID NO: 129114 - protein, 27 aa, Heterodera glycines
  Coding regions on vcDNA: vcDNA=SeqID_55537; Strand=+; Position=1-83
MHRSHQSHGIIMGIRENDMSGDAKSDR

SEQ ID NO: 129115 - protein, 104 aa, Heterodera glycines
  Coding regions on vcDNA: vcDNA=SeqID_55538; Strand=-; Position=1 -39,525-800
MDTDTGWINDFKQTFVRATTSARYTIQFEVPTSVPIGPFELVNERTQEKLTLCKTSEDLWAIQWVMKRCPIGETAMIQWEAPQNSATNLNNVNIYLCCVSCTKW

SEQ ID NO: 129116 - protein, 144 aa, Heterodera glycines
  Coding regions on vcDNA: vcDNA=SeqID_55539; Strand=+; Position=1-435
MQFSSVEHLRLTLNSLIREVYQQQQFSSGHDRASRTKRQVTDLFFHENPVDYWEKIGELRTKQEQFEKEVKQEESELSADTTDVERKKLLQSELPLKRIRMQRKKYELEELERAAERRDQESPENEQRKISDFSNIIPKIITKN

SEQ ID NO: 129117 - protein, 223 aa, Heterodera glycines
  Coding regions on vcDNA: vcDNA=SeqID_55540; Strand=+; Position=1 -57,277-889
MSKYIGEKDINKIRQLNTEKIEQLQAKAVGLKDNASFEKQIERAKQLIEYRRKRFAALEFEAKKRDEQQQFVAAAANTITAPTASALIGREALKKRTGISASTDGEVGDKADVGPQTATTTTHGEVLKEKILEQQKHTDKDDKADVGPQTATTTTHGEVLKEKILEQQKHTDNDDKADAGPQAATTTHGEAVREKILEQQKSTDDDDKAAVGQQTIPTATKTH

SEQ ID NO: 129118 - protein, 304 aa, Heterodera glycines
  misc_feature (231)..(231): Xaa can be any naturally occurring amino acid
  misc_feature (255)..(255): Xaa can be any naturally occurring amino acid
  Coding regions on vcDNA: vcDNA=SeqID_55541; Strand=-; Position=1 -163,293-498,800-872,926-1038,1140-1214,1257-1351,1591-1650
  Homolog annotation: Hit_ID=AAG23825.1; Match level="QueryCoverage =98%, HitCoverage=22%, E-value=1e-119, Identity=76%"; Hit description= guanylyl cyclase [Heterodera glycines]
RQMNAGRSINLMDHVFGMLEQYANKLEENVHERTRELEEEKRKSEILLYRMMPRQVADRLKLGQSVEPEHFECVTVFFSDIVKFAELSNQMRPLQVVNLMNELYTIFDAIIDEHDMYKVESIGDGYLCVSGLPNRNGNLHAKQCADMALKFLKALETFRISDALKFLKALETFRISDHSFERIRLRIGLHSGPCVAGVVGLAMPLAMPRYCLFGDTVNTASRMESSSSPNXIHISKETYMLLHNNFDGYAVEPNXIHISKETYMLLHNNFDGYAVESRGEVIIKGKGVMETFWLLSNAEIRSNN

SEQ ID NO: 129119 - protein, 101 aa, Heterodera glycines
  Coding regions on vcDNA: vcDNA=SeqID_55542; Strand=-; Position=1-305
MSNNASDEQKEQKKGDDIDQNDGHLTADDRSGLKKIKEINRKREKEKDLKNIGDGSGEKDKQKEEKAAVDGSQKTAQRIGQSEQKWGEIGGERKRQKQTAD

SEQ ID NO: 129120 - protein, 42 aa, Heterodera glycines
  Coding regions on vcDNA: vcDNA=SeqID_55543; Strand=+; Position=1 -6,266-388
MQVFLFYISYLFFLLVQYFGYQRFFNALQKDAKSFADIKAFN

SEQ ID NO: 129121 - protein, 88 aa, Heterodera glycines
  Coding regions on vcDNA: vcDNA=SeqID_55544; Strand=-; Position=1 -210,552-608
MIDEYMTKTIVTNVKSPFRLRSKFIKFLLDQATVEHVRRLISERGIHSERQRIARVVVLEQLRLELEDRNLYTAPFSCEYYKQAKRHC

SEQ ID NO: 129122 - protein, 19 aa, Heterodera glycines
  Coding regions on vcDNA: vcDNA=SeqID_55545; Strand=-; Position=1 -42,205-222
MPIYRFSWSLIANPTKNEK

SEQ ID NO: 129123 - protein, 83 aa, Heterodera glycines
  Coding regions on vcDNA: vcDNA=SeqID_55546; Strand=-; Position=1 -60,107-295
MHFVLIEGQKASHPSQMLCDLEFDIIDGEKGREAAVVSGPGGIRVGTAIRYNPQQQLAAGKDFKRINASAGGSRLPPRPPVAK

SEQ ID NO: 129124 - protein, 20 aa, Heterodera glycines
  Coding regions on vcDNA: vcDNA=SeqID_55547; Strand=-; Position=1-61
SLAPKKLAQIGVKHLPVRGD

SEQ ID NO: 129125 - protein, 72 aa, Heterodera glycines
  Coding regions on vcDNA: vcDNA=SeqID_55548; Strand=+; Position=1 -119,237-336
MRMQSPIINRGRRKTKLAFKSLVPSSFVTYRTFISFCIFRISTVGLSTVKLSSQGLSTKAYAIVCMKVVIVF

SEQ ID NO: 129126 - protein, 124 aa, Heterodera glycines
  Coding regions on vcDNA: vcDNA=SeqID_55549; Strand=-; Position=1 -15,427-786
MRQRMDFHFQPIFSESEKMYAHFYMDPLKELYRIKNAKIGGSAQRGLLAQQIINQISTKVKEMDQRLKILLPIFGFENLEMPLFSIEQEGKFAEDPFFNISRHTSNFWTMTEALVLILKRRRWR

SEQ ID NO: 129127 - protein, 204 aa, Heterodera glycines
  Coding regions on vcDNA: vcDNA=SeqID_55550; Strand=-; Position=1 -306,1557-1865
MPFSIKPSGLFWHRRVLVETTNEGTGGNYHALLYAIVRENRRAPQQNGGGGGNGQSGGNGGDQQNNANANDRNDLAAAEKRELLGYSPLIKDKEDMAEAVPNCKFTVKKVVKTAVYANKEKDKDKDKNDDKDEDKDKDKDEDDCPICFNEMKVNEEQIQVHEHEVKSKTRAGIYAGGDINLPAGLSNERYQGWHGIPISNVFGV

SEQ ID NO: 129128 - protein, 322 aa, Heterodera glycines
  Coding regions on vcDNA: vcDNA=SeqID_55551; Strand=-; Position=1 -129,416-569,612-739,783-1339
  Homolog annotation: Hit_ID=XP_526203.1; Match level="QueryCoverage =77%, HitCoverage=17%, E-value=4e-29, Identity=34%"; Hit description =PREDICTED: similar to KIAA0800 protein [Pan troglodytes]
MELAEGILINDIQVQRLALEVLTNCLCGPTNQGDADCEFCLMYVLTTLLHKQQPATEADSIRELACRALNGIARFEPIRQILSKLPIIANNELITLIQSPILLEKRIEHSRFCEQARQLIECVSQTKLQDFAIGMTQEHLWRAAVVAKTHIKFNEKELLQLIYQHLSDIGFKRTAKQLQMEGELPNVPASRIPSTPASLPGFVNCICLSNVSEIHLIKPRQNEAAFANVLARRISKADAPISHPQPFTPRPQSVSSSKQITSGSRLPLKLLSSAHNTLSTGSSNFSVASNLSQQTPIANVNNAFSLKMRPPKSLSEIVINYF

SEQ ID NO: 129129 - protein, 16 aa, Heterodera glycines
  Coding regions on vcDNA: vcDNA=SeqID_55552; Strand=-; Position=1-49
EAIPEGFGLPINLGAS

SEQ ID NO: 129130 - protein, 50 aa, Heterodera glycines
  Coding regions on vcDNA: vcDNA=SeqID_55553; Strand=-; Position=1 -76,194-270
MDSVRDDEKAGAAEDGGSDNAECRCCLIYVYAHAFLLAFHLCHHCLIHYN

SEQ ID NO: 129131 - protein, 141 aa, Heterodera glycines
  misc_feature (12)..(12): Xaa can be any naturally occurring amino acid
  Coding regions on vcDNA: vcDNA=SeqID_55554; Strand=+; Position=1 -89,318-401,466-574,1181-1303
  Homolog annotation: Hit_ID=NP_491258.1; Match level="QueryCoverage =90%, HitCoverage=45%, E-value=3e-41, Identity=63%"; Hit description =dauer or Aging adult Overexpression DAO-8, FK506 Binding protein family (29.9 kD) (fkb-5) [Caenorhabditis
FSHPMGYDLHFXPYSFTLGMHQVIEGMDRAMTGMCIGEKRRVTIPGKLGFGDGGRKRDGIKSDQDGIKSDQVLHYIVQLVDLFRPTPGPRWREEDGLEIEVTHKIEESACRRSAPGDTIHQHYTLNLADGTFIDSSFSRSK

SEQ ID NO: 129132 - protein, 469 aa, Heterodera glycines
  Coding regions on vcDNA: vcDNA=SeqID_55555; Strand=-; Position=1-1408
  Homolog annotation: Hit_ID=XP_479365.1; Match level="QueryCoverage =40%, HitCoverage=12%, E-value=3e-11, Identity=26%"; Hit description =helicase-like protein [Oryza sativa (japonica cultivar-group)] dbj|BAD32013.1| helicase-like protein [Ory
MTFGYDPNVPAEVILLPVHFPGHWTLIIHDVQFGTHFADSLPTTYGRLDPQLTDKIKNIISDILPSAVLTGIVDVENLTVQHDGNSCGYFVCLYAESWLMNNRTFVLPDLSINYEKKRILWHINELYGSDNVPYHPREGVPTPCPIVYRHTDEAQSTSKAAELMEVDEYDDIMIIEPHTSGQAVDAILTQAQVAGENQADTLGLVSESCIPQEPIAQADDVIFIRPKTPPRRSMRVQKRLSASVSRSPSPAPKRPPPANSLGVATPITRRCSAFHKGWQCAAAAAKHFPEYCDSGKLGDKKCADCGAHLFSHEDSSICCRKGRVVLPMLNPHPDELKQLIVGNKQSREGKEFVRHMSRYNNLFQFASVSAGNKPSPAGGPMAVILNGEFHRRISSMQAGTTQIPGFGQLYILDPVEAMEQRRNNPRFTGEKITNEDEFVQGHQLNEQTLEILEQMIQVHHPAAQAYKQA

SEQ ID NO: 129133 - protein, 104 aa, Heterodera glycines
  Coding regions on vcDNA: vcDNA=SeqID_55556; Strand=+; Position=1 -132,192-288,765-849
GAAVVKVSKRQAVDEGLRKYRKRVKEQQAKEKKQKEKKPPPNSTNDAAGGNSTGNNHHGSRPAPAGGPDDPSPDEPVSNASDGAAPAGDDVSIPREEINEMKHA

SEQ ID NO: 129134 - protein, 67 aa, Heterodera glycines
  Coding regions on vcDNA: vcDNA=SeqID_55557; Strand=-; Position=1 -28,224-399
MQFLPNSGKVKFLVEKAGADLEIRDASGRTALMGAAFEGQADIVQYLVSKKARTDWKDENGSGRIIR

SEQ ID NO: 129135 - protein, 59 aa, Heterodera glycines
  Coding regions on vcDNA: vcDNA=SeqID_55558; Strand=+; Position=1-322
FLGPGVVWAPTQKYKNVLFLKIKILKTKPEGSLATWHKLGLINIRSFFTILLIPNPIIF

SEQ ID NO: 129136 - protein, 54 aa, Heterodera glycines
  Coding regions on vcDNA: vcDNA=SeqID_55559; Strand=-; Position=1-166
SRAGPGILGKTGTGTCRDLRSRDRDLGFCPGPGTGTNREILKIQKNFKNLKKNS

SEQ ID NO: 129137 - protein, 599 aa, Heterodera glycines
  Coding regions on vcDNA: vcDNA=SeqID_55560; Strand=-; Position=1 -1087,1332-2041
  Homolog annotation: Hit_ID=NP_507613.1; Match level="QueryCoverage =96%, HitCoverage=27%, E-value=4e-45, Identity=25%"; Hit description =predicted CDS, RNA-directed DNA polymerase  and Integrase, catalytic domain containing protein family mem
MAKPNDCGPAAFHFGKQSRLQLHVFCDASEHTFAAAVYIRSETADGSEANLIFAKNRLRPRTANQRFTIPRLELLAILVGIRAMRFAEKELLRPIDERHLWSDSQIALSWVKSDEPKAQFEQRRLVEIRQGPPTIFHFVRTDQNPADVATRGCTPAELRTRHIWWKRPEWLTSPETEWPDELTFATPADSPSADPPFEESETKTLMAKQSPLPPPLIDPARFSTMLTLLGTTILVLQFIGRRRPKWLRSGTSSIPRSGPPTGDSFRAARTFLIRQDQRSSPDGYDKHPTVFNEDGLLCLKTRLLHANGPPTLASPVLLDRHSSLTRLIVQEIHADLRHAGVDWTLTEFLSRYWMPQARRTIRAPSFINVLRRFISRRGRPKRILSDNAPTFVQTSKALDILTGPPSETDAVTFAARRGIQWDFIPAYSPWMGACYERLIGLVKSCIKRTIGRRILDYDDLSAFLAEIEASVNSRPITWVSDQPDSSKPLTPKDLIQPGLPNDLEIVDSDLDYDDCLSGPARLAALWKAYREAADHFWLKWSHEYLLAIRERAGWTHKGPRLRTPTAPHIGQVVIVEEDLRPRNLWPMGIVVALNGSLPN

SEQ ID NO: 129138 - protein, 140 aa, Heterodera glycines
  Coding regions on vcDNA: vcDNA=SeqID_55561; Strand=+; Position=1-515
MAKQSPLPPPLIDPARFSTMLTLLGTTILVLQFIGRRRPKWLRSGTSSIPRSGPPTGDSFRAARTFLIRQDQRSSPDGYDKHPTVFNEDGLLCLKTRLLHANGPPTLASPVLLDRHSSLTRLIVQEIHADLRHAGVDWTL

SEQ ID NO: 129139 - protein, 115 aa, Heterodera glycines
  Coding regions on vcDNA: vcDNA=SeqID_55562; Strand=-; Position=1 -149,278-326,548-588,657-727,856-894
  Homolog annotation: Hit_ID=CAE58782.1; Match level="QueryCoverage =89%, HitCoverage=18%, E-value=9e-23, Identity=48%"; Hit description =Hypothetical protein CBG01980 [Caenorhabditis briggsae]
NITARWDGLPMPKQPTLLEGDDVGTLLTSQLNEEDEAKTGLNCPQKVLKLIKIMVPHVVLVAVLIGAGILQALETRTELMARSRKLIRLDQLIENFTESSWHIDYMISVAAEVDD

SEQ ID NO: 129140 - protein, 36 aa, Heterodera glycines
  Coding regions on vcDNA: vcDNA=SeqID_55563; Strand=-; Position=1-109
MEESPELLNKSVGGLAEFDFSLCERNHALKRQMDGE

SEQ ID NO: 129141 - protein, 69 aa, Heterodera glycines
  Coding regions on vcDNA: vcDNA=SeqID_55564; Strand=-; Position=1-210
MTLYASHDILRVPSHFTRPNNTLRVPSHFTRPITLYASHHILRVKKCFSNRQSETLYLPNSLIVLACIL

SEQ ID NO: 129142 - protein, 89 aa, Heterodera glycines
  Coding regions on vcDNA: vcDNA=SeqID_55565; Strand=+; Position=1-345
AKKRYLFFIFIIFWFKNILNTFLYFERLLLIQNFFKFPKIRNPAQDPADFKCRICRINPAGSCPVKNFEFQSCNRIRKFEISGLYIHYG

SEQ ID NO: 129143 - protein, 76 aa, Heterodera glycines
  Coding regions on vcDNA: vcDNA=SeqID_55566; Strand=+; Position=1-228
LFKMTGLSENVAFSRFVSEFGGRCKELKIANEFARDPSRANKYTRTLKDGKGSWQLCVDFSKNLIDDDIFHQLISV

SEQ ID NO: 129144 - protein, 43 aa, Heterodera glycines
  Coding regions on vcDNA: vcDNA=SeqID_55567; Strand=+; Position=1 -52,359-438
MIHVLIHGHDLRVNLRSFIIHVSIYGLKHVSIHGHDLLVNSRS

SEQ ID NO: 129145 - protein, 182 aa, Heterodera glycines
  Coding regions on vcDNA: vcDNA=SeqID_55568; Strand=-; Position=1 -165,440-613,747-956
MQYNAFKPRREAGQFQNFVPHFTVESPSTLLDNYVSMSTVAFGQLWNGKMGISDGLLIMQYNAFKPRREAGQFQNFVPHFTVESPSTLLDNYVSMSTVAFGQLWNGKMGISDGLLIMQYNAFKPRREAGQFQNFVPHFTVESPSTLLDNYVSMSTVAFGQLWNGKMGISDGVRSFLKIPLFV

SEQ ID NO: 129146 - protein, 76 aa, Heterodera glycines; identical to SEQ ID NO: 128275
  Coding regions on vcDNA: vcDNA=SeqID_55569; Strand=+; Position=1-391

SEQ ID NO: 129147 - protein, 244 aa, Heterodera glycines
  Coding regions on vcDNA: vcDNA=SeqID_55570; Strand=+; Position=1-735
MKFENNATAVFPNSGTASEAKNERASEFSQKGKFSETKRSHWTDSDQKSMTKEKWKKVERAPRNIAPKVDFRIKRNCDEKNHNFGPKEQVGKNFEVKKGSGENSGKSGRIFSCKNSEVQLGTIEILEGRKEFERKRLKLGRNSQREKIGRNVSLDGNGPRTNYGTNLNSFRQNCVFWPRRANADQMSRETLPFDRGWVELTASCPDSTSTYADRQPMMCGLRCNGSELIPNGPHLSTAGCGMCS

SEQ ID NO: 129148 - protein, 917 aa, Heterodera glycines
  Coding regions on vcDNA: vcDNA=SeqID_55571; Strand=+; Position=1-2754
MANLRTPPLTRQRALNFGIALDNTGNQISAQFNPNLGQNRSFSPELGHVEMVGNDGVSEYGEDFDDEQNLRSRLLAMTMNISNPAVNVPDENAQNQRMAMNAPLVNSGILRVNNRNVGVNGLGETRERFLSNNFELGVSNLNNAGLVPTYPPDHESTPVSALRGEIRAFGNLVENRRHENELLAARNDAQYTQPRVDGVHPVFVRQMAVHSQLTALRLSANHQAHVATSSIEPLARNAQVDNIGCNNNPQRQMENLQQNLHRQMVRNGENFEPGNHNYGCEERNPNAEQNINPRPNSQHFHVANQNHPYVNDIPDTQRNEMHDMILAQAIKSLNNFSYSMALNSLPELKGSSGADGVRSFFRHFDVATDEWPEAKRLSALRSKCLGRAERAFNVAVANNPFSYDSVKRAMINLLEETDARQMSAFEELMSGVYRRNNERINDLADRVSSLVRKAYPGLLEHLYDDYSIRHFIRALQNPELALTLELARRPSMIFDEFVALAARAEATQKASKLAMQRPNYFARFNSNFQTPQYNQRPMQHFRQENFPQPYNQQQNRPNCYNCGKFGHFARQCTEPQRNQGTPNNNSSASNFVGQNFLVEQQKKPPQQNQNLFVGGISMSPADVEKLFGKDGTENETKNLNKVSIGRIMALKVSVCGLTAKAMLDGGAQISMFSSKFFAKLLAEKRIGTEQLRPSRHNTRVIDINGNAVECIGIVSLPIVRKGKCVWIRFHVSHASFGYEFVFETNALARLSFKLFDEANDELVSFSEVNNVERNSVHVIYHTTIPSRNKNLVHSAQQMKFKSNATAIFTNSGTKSEVENKRTSEFCATKSGHRPSFRQKWKKVEWTPKNIPPKVENRIIRNCDEKGHKKFSPKEQLGKNFEVRKGGGENSEKCGRIFLGKKSEVQLGTIEILEGGEE

SEQ ID NO: 129149 - protein, 95 aa, Heterodera glycines; identical to SEQ ID NO: 128210
  Coding regions on vcDNA: vcDNA=SeqID_55572; Strand=-; Position=1-662

SEQ ID NO: 129150 - protein, 64 aa, Heterodera glycines
  Coding regions on vcDNA: vcDNA=SeqID_55573; Strand=-; Position=1-911
PIPSFMRHQLHSFLVLPNCLKCIPKNALKMIKPVFSRISCQYFPIRNDTVNSFASLIHSCFASD

SEQ ID NO: 129151 - protein, 41 aa, Heterodera glycines
  Coding regions on vcDNA: vcDNA=SeqID_55574; Strand=-; Position=1 -36,82-171
MPINFVLNDFLSRLLNTQQDKMPLFLNLRTKKNSFKWKSNG

SEQ ID NO: 129152 - protein, 87 aa, Heterodera glycines
  Coding regions on vcDNA: vcDNA=SeqID_55575; Strand=-; Position=1-823
IIFIQKIFFWVFGAVPLNRCAQIYGETESFRNSFTIACTLILRWIFAPHNCLSTPNGHLKKSIYFCFRGSPPEPMRPDLWGDRILRE

SEQ ID NO: 129153 - protein, 31 aa, Heterodera glycines
  Coding regions on vcDNA: vcDNA=SeqID_55576; Strand=+; Position=1-93
MGANIQRRIKVQAIGKLIPEGFGLPINLGAS

SEQ ID NO: 129154 - protein, 122 aa, Heterodera glycines
  Coding regions on vcDNA: vcDNA=SeqID_55577; Strand=+; Position=1-369
MARFLIQNPQHQQVCGAQQLVSLVVGGTVCESHRLRVGRCSRVVVDFSDNSSGGSFCAANAGGRAKMKKMFVTGGDGTEQQQDDTITDEQQQQEDEDDDDDDEDEFRILSAHRKQRKEKLLI

SEQ ID NO: 129155 - protein, 79 aa, Heterodera glycines
  Coding regions on vcDNA: vcDNA=SeqID_55578; Strand=+; Position=1 -57,284-466
MKKGVQNSIYALKFFDLVKKILEPGAGPDPVQDFAGSQSAILHFLENAEFAGLIRPDPVLQKFLNSNPATIRKFEISGL

SEQ ID NO: 129156 - protein, 487 aa, Heterodera glycines
  misc_feature (19)..(19): Xaa can be any naturally occurring amino acid
  misc_feature (21)..(21): Xaa can be any naturally occurring amino acid
  misc_feature (83)..(83): Xaa can be any naturally occurring amino acid
  misc_feature (179)..(179): Xaa can be any naturally occurring amino acid
  misc_feature (218)..(218): Xaa can be any naturally occurring amino acid
  misc_feature (240)..(240): Xaa can be any naturally occurring amino acid
  Coding regions on vcDNA: vcDNA=SeqID_55579; Strand=+; Position=1 -72,250-547,650-1008,1282-1647,1700-1837,2114-2145,2189-2307
  Homolog annotation: Hit_ID=NP_497232.1; Match level="QueryCoverage =92%, HitCoverage=81%, E-value=1e-17, Identity=33%"; Hit description =BRICHOS domain containing protein (3B279) [Caenorhabditis elegans] gb|AAA64509.2| Hypothetical protein C0
KRVEQIEIIERTVEESRRXSXESALVNFQPQSSVRTSSERILFPDPEKRFQLTSERDAGRDSSLLYSPSGNRFGIKLQFSFIXGQNSFIVREAPLQQSTPERNQQTHKNGLTISRHGYDADEVRTEAWGRRAVPSYGTPPRREDTATKSILKTVPPMASPEGTVGENSWRKSPASVEGXAEGRERKGTDYNNRSVQRKDSYRRMQVKQEGSQHHFTEXVNGRKKGEGKETDGRRRRTDKXGGESVELAKKLIRFPPQRRRMDPPPRLSAVPRPASAAARPAPPLAACLFASPPSLHLRLLALPSAVRRVPRRNGGGTSAQQPSRLFVHLNSPAQAHFELIGNPPFKSNSFTAVDFDTGFVAIADHGFVAIADHALTDEQGTHTTCFVMELDRSAMPDMDVLQDALSNTYSEVHSQFGWQEYWQYVAEEVDSSFVLQKFRDRIDDCQWQYVAEEVDSSFVLQKFRDRIDDCQKATKWYRLKHTVYTRG

SEQ ID NO: 129157 - protein, 137 aa, Heterodera glycines
  Coding regions on vcDNA: vcDNA=SeqID_55580; Strand=+; Position=1-414
MGKIRSANGPIGRTLALPKAYGTKDAKGRGGKLGELAKGRGRRTKAAAEEEEKRRRGRIEKTIGNSMRMVVKGRERESEGETDRESEGETDRESEGETDRESEGETDRESEGETHRSLATNRYFHYAKSKLYKMPMP

SEQ ID NO: 129158 - protein, 117 aa, Heterodera glycines
  Coding regions on vcDNA: vcDNA=SeqID_55581; Strand=-; Position=1 -138,267-482
MPTTSTATLLDTSATTSSNTAMESDSDEEQFPPPPPIDGTIGTANESHPFRAMLPPPSLPSIVFPRNLAPPPPPKRSEETRLQMAEQNPFEMREAQSELMAELQQRQRMRTKESAEK

SEQ ID NO: 129159 - protein, 41 aa, Heterodera glycines
  Coding regions on vcDNA: vcDNA=SeqID_55582; Strand=+; Position=1-126
LTDILASAKSAIKLWSQAANEAELQLIIERKLTEETFSAYT

SEQ ID NO: 129160 - protein, 147 aa, Heterodera glycines
  Coding regions on vcDNA: vcDNA=SeqID_55583; Strand=-; Position=1 -106,302-639
MVAGVQQQKIAAKTSNNTRPKTAAVMLIMRIKAHLMEHVRHIVLMSLRSLQIASPDSFLDGTIQQIRNGHPLEMALGPPKMALAQKLSQIECHGSGKRDQNRICLTMERPKTTKYSPKSLTKPSANCVAVFGQTALTLAFILKTNII

SEQ ID NO: 129161 - protein, 95 aa, Heterodera glycines; identical to SEQ ID NO: 124528
  Coding regions on vcDNA: vcDNA=SeqID_55584; Strand=+; Position=1-650

SEQ ID NO: 129162 - protein, 152 aa, Heterodera glycines
  Coding regions on vcDNA: vcDNA=SeqID_55585; Strand=-; Position=1 -246,313-527
EVIGLPFIDHSFFVSSMAFSSVFCRSPSLLSLLPILLLIIAQFVNGMDFDEFELPSDRLDAFQKRRARELFGKRSAPPPAAVANYERHSRRTRELFGKRAAAVEPFTEAEEGENSGESQKAIHWQRQRVAKFAYYSSSPMLFLMLFLLGQFH

SEQ ID NO: 129163 - protein, 39 aa, Heterodera glycines
  Coding regions on vcDNA: vcDNA=SeqID_55586; Strand=+; Position=1-168
KWDNLNLIGNVPPLRRSIQKIFVCLHSILIHFSHKNVLI

SEQ ID NO: 129164 - protein, 34 aa, Heterodera glycines; identical to SEQ ID NO: 124987
  Coding regions on vcDNA: vcDNA=SeqID_55587; Strand=+; Position=1-104

SEQ ID NO: 129165 - protein, 63 aa, Heterodera glycines
  Coding regions on vcDNA: vcDNA=SeqID_55588; Strand=+; Position=1 -104,457-544
MEAVHNETPSGMPTHKLTIKVNKILFDYCLTNKSRTRFTMRINHKKNSFSQLMNINQQIILNI

SEQ ID NO: 129166 - protein, 374 aa, Heterodera glycines
  Coding regions on vcDNA: vcDNA=SeqID_55589; Strand=-; Position=1 -17,203-307,364-639,691-1105,1158-1420,1599-1647
  Homolog annotation: Hit_ID=AAL78214.1; Match level="QueryCoverage =39%, HitCoverage=78%, E-value=8e-18, Identity=33%"; Hit description =putative esophageal gland cell protein Hgg-20 [Heterodera glycines]
MSSEILWCAVFLLLLVGCATILFWFFLDNAKKRRRPHKKEIFICGDCWLLVFDFLAPSQLGLEIALINRRFNCIVDEHFKTRKWKLGEMRIFHKIGENGTQQMQIVNSDGNPLPIPQNPLPNKVIGFKRITILYIDQNVIAFLRLFHRFFAFSSIFLFITENVRILDFVLLNVLPMLRDSIRLMLLNTIAFRRLRQLAPSLLNDCPSLHTVLFEDSIFPEFPPDDSANASDGQAVTKWLFTPRSDGVPKLLQCSVNSTDEQWSSTMEHFKAAFSNASSPVTFRIHFLMSSPLDFIVPFDRINEVTEEKLTLKQSSANDFLLIRSPIGWDNRNWKNLRDEIIARTNPIDIRVKDGGYDDGLLDDASPGPSDQQKK

SEQ ID NO: 129167 - protein, 35 aa, Heterodera glycines
  Coding regions on vcDNA: vcDNA=SeqID_55590; Strand=-; Position=1-4,62- 165
MGHCRHQRTKKKKKRVKATMKCSRRLPDQVDQRNE

SEQ ID NO: 129168 - protein, 58 aa, Heterodera glycines
  Coding regions on vcDNA: vcDNA=SeqID_55591; Strand=-; Position=1 -83,187-282
DEQFGELRAEIGKIKEQQSTMMSTIMQLQMLLLQKKNENRQEFTESADHSLISAIGVQ

SEQ ID NO: 129169 - protein, 169 aa, Heterodera glycines
  Coding regions on vcDNA: vcDNA=SeqID_55592; Strand=+; Position=1 -220,282-571
MPVDSVADRMRNIKSADLIVWMQWFQSAHKGKAGHSIKREFIWLYARVFYDRYGNGFDKYFEAEFSRIEVLMEKITQMHTDATAAFALQKGICCELPEKWRTIINQGTMNESILEVIESDEGKERKMGTNEFVQQLHFDVIREFCQNIDQTEELVQRKIGNIIKSKLKL

SEQ ID NO: 129170 - protein, 62 aa, Heterodera glycines
  Coding regions on vcDNA: vcDNA=SeqID_55593; Strand=-; Position=1-196
FSSNGMPICWKFFLICPLFIIPSNFVDNLCSVLTLKNLKKFSVTCQKLYNFNLLFIIFPIFL

SEQ ID NO: 129171 - protein, 95 aa, Heterodera glycines; identical to SEQ ID NO: 124528
  Coding regions on vcDNA: vcDNA=SeqID_55594; Strand=+; Position=1 -338,505-982

SEQ ID NO: 129172 - protein, 147 aa, Heterodera glycines
  Coding regions on vcDNA: vcDNA=SeqID_55595; Strand=-; Position=1 -41,665-755,1627-1697,1869-1991,2045-2162
MFGFNYLPIFPQITQDQLQKQMLEYKFGWILDKVQKNRGKMPSVGTTKIPQYVFPVNQVMANNNELQSFLLSLCCNWQIVTLAPGLPTPVRQAAELAKRGRANFNELKRSTPKFIPRVEDTDQINYTVLNNRLCYNGHILADTRFNA

SEQ ID NO: 129173 - protein, 269 aa, Heterodera glycines
  misc_feature (2)..(2): Xaa can be any naturally occurring amino acid
  Coding regions on vcDNA: vcDNA=SeqID_55596; Strand=-; Position=1 -24,646-823,1207-1338,1393-1550,1597-1744,1845-1910
  Homolog annotation: Hit_ID=CAG90751.1; Match level="QueryCoverage =98%, HitCoverage=62%, E-value=2e-42, Identity=39%"; Hit description =unnamed protein product [Debaryomyces hansenii CBS767] ref|XP _462255.1| unnamed protein product [Debaryomy
RXITKFFSLGVKLEQLYKSWSSRDKHFARFLTERREMLQGIRILRQEPVETLFAFICSANNNVPRISKMVEKLCQFYGDSVEVNAQRFYDFPSVTQMAAHLNCMEQTLRDAGFGYRAKSIVKTVEMLADGKLGFGYRAKSIVKTVEMLADGKLGNSAYLWLHSLRNLPYHEAKLALMKLPGVGPKVADCICLMALDKVADCICLMALDKHQVVPVDRHVFNLATEIYTPTFLKGCKTLSTAIYGQIGAFFVDLHGDYAGWAHSVLFSTL

SEQ ID NO: 129174 - protein, 172 aa, Heterodera glycines
  Coding regions on vcDNA: vcDNA=SeqID_55597; Strand=-; Position=1 -250,589-740,787-900
  Homolog annotation: Hit_ID=NP_507469.1; Match level="QueryCoverage =44%, HitCoverage=21%, E-value=2e-10, Identity=51%"; Hit description =diacylglycerol O-acyltransferase 2 family member (5S141) [Caenorhabditis elegans] emb|CAB04533.1| Hypothe
MPFNCEFAGGVCAEIGQVLAVWLFQWMFIDFAFVGTALFLLLLLHRSLWPLALLYFCWYCYDFNTPKKGSRHFRWLRNLHLWKRVISSSAASIGHSLSLAPGGNAVGIVPGGVAEICFSQMDEGLHKLKLANRKGFVKLAIKNGADLVPVYHFGEQQLMRLAILPALLDNIQ

SEQ ID NO: 129175 - protein, 192 aa, Heterodera glycines
  Coding regions on vcDNA: vcDNA=SeqID_55598; Strand=-; Position=1 -75,139-328,401-446,504-672,831-899
  Homolog annotation: Hit_ID=CAE72112.1; Match level="QueryCoverage =100%, HitCoverage=36%, E-value=1e-63, Identity=62%"; Hit description= Hypothetical protein CBG19205 [Caenorhabditis briggsae]
FSWFFPEKDRREDPQTLRMFSTIQVFTACFVFTACFAGFAHGANDVSNSISPLVALLSVWHNGSVEQSEQTPIWLLLFGVSAICAGLWLLGHRVIETVGQKLSHVNSCSGFTIGFTIEFGAAVTALLASKLGLPISTTHCLVGSVVAVGSIKSGEGINWRIFASIATSWLVTLPVSAAVSAALMFIMKTFLL

SEQ ID NO: 129176 - protein, 174 aa, Heterodera glycines
  Coding regions on vcDNA: vcDNA=SeqID_55599; Strand=-; Position=1 -150,213-312,360-463,616-681
  Homolog annotation: Hit_ID=NP_505371.2; Match level="QueryCoverage =93%, HitCoverage=26%, E-value=1e-31, Identity=50%"; Hit description =phosphate transporter family member (52.9 kD) (5J620) [Caenorhabditis elegans] gb|AAA92320.2| Hypothetica
SPSPSSFVPTFSAPFDGAALSLFQNAFLWALIVGFLLAFVLGFGMGANDVANAFGTSVGSNANAFGTSVGSNVLTLRNAFILATIMETLGAVLVGYNVTDAMRKEVVNIDLYMDHPLVGYNVTDAMRKEVVNIDLYMDHPNQFLLGQLAILGGSVWLLTATLLRLPVSTTHSIV

SEQ ID NO: 129177 - protein, 64 aa, Heterodera glycines
  Coding regions on vcDNA: vcDNA=SeqID_55600; Strand=+; Position=1 -121,879-952
MGQWRQLEFDFRTGQPDIEQIVAGWDPADNGLQMKISLRAEAMALSDALATSKLIKCCMIGPSN

SEQ ID NO: 129178 - protein, 322 aa, Heterodera glycines
  misc_feature (307)..(307): Xaa can be any naturally occurring amino acid
  Coding regions on vcDNA: vcDNA=SeqID_55601; Strand=+; Position=1-981
  Homolog annotation: Hit_ID=XP_320889.1; Match level="QueryCoverage =99%, HitCoverage=41%, E-value=1e-62, Identity=40%"; Hit description =ENSANGP00000012033 [Anopheles gambiae] ref|XP_313651.1| ENSANGP00000013044 [Anopheles gambiae] ref|XP_314
IMVPIQINGHKIELAADSCSHLTIIQRPMWLSLGGPKLIKSGKIVGSFSGHKLCLLGQFKCSVEFKGVQIAPFEQATEQPIATTLSSIFNRKLWQLQFPMPQGLAEQLKNAFPQVFAPGIGRCSKMKAILHLKPDASPIFCRARPVPHDVQDAVDKELDRLLEMDAIRPVDFSRWAAPVLDVRNKNGAVRICIDFSTGLYDALELHPLPRTDDIFHALRGSKIFSQLDFRDAYLQLELDDKSKTLVGINTHRGLFQFQRLPFRVKSAPSIFQKTMDQLTAGINGVFTYLDDVIIASRNENEYRFLLXTMVNAVSQVGWKAKF

SEQ ID NO: 129179 - protein, 162 aa, Heterodera glycines
  Coding regions on vcDNA: vcDNA=SeqID_55602; Strand=+; Position=1 -318,364-511,1231-1253
MGLKHRMDAKIDASGNVKRFSWDESRELVLSTILDPRFKLSFLNAEKHDRYKIWLTNEAENVQNGSSEFHDLFSRCEQNIATECGLDITAQPLPSPETLNNRQKAEVEVNDYLHDKKIPIDSDPYGYWTGDNAVKWPLLTCLAHRFLSAPATSAETKKCIYL

SEQ ID NO: 129180 - protein, 201 aa, Heterodera glycines
  Coding regions on vcDNA: vcDNA=SeqID_55603; Strand=+; Position=1 -127,375-492,536-668,752-840,892-1027
MWEWSVIFTDCAVNAVLDLSFLHLCNLRYNNIGSERQMIQRRGRARHKHSLSILLALDTGIEQREFSNMRKEAMASERADYHPKTMNPAPHLAWMLIFKVYFIQIQQMMRCIEDMQEQDEQTLRRSIEEKAIELAELRNDEKMKEENKRAQLMGRRFDLRCACGTVICCSDRVRSVMGTLFVCCDPKVWKRSKHTLTRAPT

SEQ ID NO: 129181 - protein, 25 aa, Heterodera glycines
  Coding regions on vcDNA: vcDNA=SeqID_55604; Strand=+; Position=1-78
TWTFRGSAVEAKKEANGKEKNWAYN

SEQ ID NO: 129182 - protein, 240 aa, Heterodera glycines
  Coding regions on vcDNA: vcDNA=SeqID_55605; Strand=-; Position=1 -264,610-1068
MFFLKLFLLSFLVIGGQCCCCLSKEEKQQMDASRRVVEEVIKDIIRLTNEAKDFSFSAHNTMVEAQIIKDRNSGKSEIIFWHEKLLNGKNRKIKNRKANSILLEAAKRETERAWRDVVVLSDDVSDFAKSSRETLNRAIKSREKAPYANGVRELYLKMSDSIWEIFKFLEQINLESEKAESAWREFERCKTFDQATKLEEQSQNSLTEARRLHFESRRVQSQMLNYENRLQTIVWEHMGI

SEQ ID NO: 129183 - protein, 104 aa, Heterodera glycines
  Coding regions on vcDNA: vcDNA=SeqID_55606; Strand=-; Position=1 -261,546-599
MYSFKKYFETALEKEDFFWPKNRAEVEAMLIESSQYKVAIHRDYESPFSGYIEMHEHTSAFCFTMVERDMRIFYDSGAGTPMGRYTLRIAWLLVVALSGPSKSL

SEQ ID NO: 129184 - protein, 357 aa, Heterodera glycines
  Coding regions on vcDNA: vcDNA=SeqID_55607; Strand=-; Position=1 -202,246-799,843-1160
  Homolog annotation: Hit_ID=NP_001004509.1; Match level="QueryCoverage= 99%, HitCoverage=24%, E-value=6e-52, Identity=33%"; Hit description =si:busm1-180o5.3 [Danio rerio] emb|CAD60788.1| novel protein similar to DNA polymerases [Danio rerio]
ECDVKAELKRNRAMKRFFDAVPDKGPINPRDAYAGGRTMPFCLYAKATEEVEISMFDIISLYPFVNYDTPYPVGVPKIVVSREFDVNWTVPDDVPYDGLLKVKVIPPKELLYPLLPMHIDNMLLFPNCYTCAKKTKKEFVLAKDVKKCNHRPERRALIGTFTSIELRKSLALGYRVIGFYRAYHFEQFDSQLFKGYVRMFLKIKVEASGWPSEVRNEEEKRAFIEMYKAKYNIWLEYDKMVFNPGLRMIAKLGLNSLWGKFSMRNTLSVTEIVNNLERWTELIKDDTIEFKRPIEINEGVMRAIYQKKQEFIKEHKVSNIILSLWTTSAARVKLYEYMEQVYREEGSKLLYCDTGGH

SEQ ID NO: 129185 - protein, 70 aa, Heterodera glycines
  Coding regions on vcDNA: vcDNA=SeqID_55608; Strand=+; Position=1 -83,161-290
MLFDLISSGRSLPLGPTNERVFFSNALRNHKNILLQLRTVPAPMLGLKKRRPKFGRIVGKKYRNCSLFSI

SEQ ID NO: 129186 - protein, 48 aa, Heterodera glycines
  Coding regions on vcDNA: vcDNA=SeqID_55609; Strand=+; Position=1 -126,247-267
MTAYNEYSKHRLPKKPTDFDFAKTPEMPEKLVCIASVSVDQPDRIRQD

SEQ ID NO: 129187 - protein, 53 aa, Heterodera glycines
  Coding regions on vcDNA: vcDNA=SeqID_55610; Strand=-; Position=1 -52,95-204
MIEDITGRSHVKEICFYTKDGGDRKIGRSRKAMAIVLMYGLMNGKSLELFLCS

SEQ ID NO: 129188 - protein, 72 aa, Heterodera glycines
  Coding regions on vcDNA: vcDNA=SeqID_55611; Strand=+; Position=1 -87,500-632
VDDVQARCDELNLQFVHRFGVMPDQHLVNLGIDLLVGLGLSMDYGKLAITHKGKMAKWLTEEEIQIEMEDSY

SEQ ID NO: 129189 - protein, 64 aa, Heterodera glycines
  Coding regions on vcDNA: vcDNA=SeqID_55612; Strand=+; Position=1-196
PSCGCVNERIRRVDAAIVVGHAKGSGRDLKANATDLKQQFSHHFCVSLFTKKSDLLNPEDFKVL

SEQ ID NO: 129190 - protein, 91 aa, Heterodera glycines
  Coding regions on vcDNA: vcDNA=SeqID_55613; Strand=+; Position=1 -92,197-380
MAQKAVHSIQETQSVLNYGGVVRHHGWKVKFKIVSDQIQAAPQQHIPPMAPIQIDQTPVRDQTPVRDRTPEPVKSPRPQRQRKKPIRYSPG

SEQ ID NO: 129191 - protein, 92 aa, Heterodera glycines
  Coding regions on vcDNA: vcDNA=SeqID_55614; Strand=+; Position=1 -66,378-429,487-647
  Homolog annotation: Hit_ID=NP_740934.2; Match level="QueryCoverage =85%, HitCoverage=24%, E-value=5e-18, Identity=54%"; Hit description =zn-binding protein, LIM (1O974) [Caenorhabditis elegans] emb|CAC48121.2| Hypothetical protein Y105E8A.6 [
MEVSGRIEVEPQETWLNLRLKSVSTEDLKKELGRVKDDQRQNAYQDTLAALVYDVNATAEVLRRGSLKRKKPKSHEVRFLSARYSCTDRHVQ

SEQ ID NO: 129192 - protein, 142 aa, Heterodera glycines
  Coding regions on vcDNA: vcDNA=SeqID_55615; Strand=+; Position=1 -337,394-487
ISKKSKFLTICVGHGYGFIRATTSSASYQIQFTVHAPTEIVPFEYVNERTNEKLTLEKAENNDESMDEEDDDEWDERWIMKRCQIGETTAALNQNSGNLNNVSFTFYGNCIGPLSPPAEDEEAGQSAGKESTYCDMDGLIWK

SEQ ID NO: 129193 - protein, 243 aa, Heterodera glycines
  Coding regions on vcDNA: vcDNA=SeqID_55616; Strand=-; Position=1 -430,502-761,1223-1265
FIDHSVFAFIRANKQIWDKGTNLNLYVPYSHNAKSVQQIWNDFVREIWPIFAPKIHHLNFADSHHLDNLRRRTSPTILTDLNQLNSINSNRLLPDAIADDGPNATAGQALSKWLNTPTKNGKPKQLSCDYTSKTKRMITNFKEAFLRANSSSASYEIRIKYFKSKQIGPFELVNERTNEKLTLAKETEYKWYKKWIMKRCQIGQTATVRWDDKKTNKLNNVRLHLHYQFGCLFVSFSALKSVP

SEQ ID NO: 129194 - protein, 85 aa, Heterodera glycines
  Coding regions on vcDNA: vcDNA=SeqID_55617; Strand=-; Position=1 -170,227-314
MLTLTKENSDENVDEENDNGWEERWIMKRCQIGKTIQWDDKKTNNLSKIGFTLYEFGPLSPPKAGQMNAKNRLKMNAGPSGEQKK

SEQ ID NO: 129195 - protein, 390 aa, Heterodera glycines
  Coding regions on vcDNA: vcDNA=SeqID_55618; Strand=+; Position=1 -15,377-447,504-782,838-1276,1338-1618,1683-1770
  Homolog annotation: Hit_ID=AAL78214.1; Match level="QueryCoverage =47%, HitCoverage=94%, E-value=2e-14, Identity=30%"; Hit description =putative esophageal gland cell protein Hgg-20 [Heterodera glycines]
MLNHELIVGLILTFGKRQSHRVTMKMNRRWICSDIWMDTLPFFDHAQLGLKLALLSPRFNALVDKHFDGKSELTLLGPIAICKDIVTEVPKLCVFIGANSVEFPLPDRPLPNKIRFNDIRIVYINHSVLTFLRANQQIWDKAISLDLYVTSAHNAKKVQQISNDFAREIWPIFAPNIRHLNVYDVQHYHKLRRHISPTILIDLDQLNSINSNHLLPGAIADDGPNATAGQALSKWLHTPTKNSQPKRLSCCEYAHTSETKGWVNSFKEAFLCATVSSASYLIRLALYESTEIEPFELINERTNEMLTLEKEENNDENVDEEYGYKWHERWLMKRCQIGKTIQWEDKKTDNLNNVIIAFYGFGPLLQPQPGQINAKDLLEMNPGPSGQPKK

SEQ ID NO: 129196 - protein, 33 aa, Heterodera glycines
  Coding regions on vcDNA: vcDNA=SeqID_55619; Strand=-; Position=1-117
SSHAPFCEIFAFKWLFLLVLKCPFSLGLSCPSA

SEQ ID NO: 129197 - protein, 76 aa, Heterodera glycines
  Coding regions on vcDNA: vcDNA=SeqID_55620; Strand=-; Position=1-230
MGEKREEKGEEKEQQKREETGKMGEKREEMRERGGKEQQKEPQRKKKQETTTTKAEKNTRGQNGGPTEGQKGPNSK

SEQ ID NO: 129198 - protein, 220 aa, Heterodera glycines
  Coding regions on vcDNA: vcDNA=SeqID_55621; Strand=-; Position=1 -444,497-712
MLDELSQQCRTERQMPKKDKLPEKEVSKEQTTTIVFNFQQTKSPARNESPDLDELEAVQMALENRVPPVAFRLQQIQNRLNAISSQLSTSARDRYQQRIQLFVNDFNECAKMVKAKKRAMEERLADQTRISGQMEELEFWCDETEALVEFDEPLGALNMAKLEKHTEKVRERHESVDAKMNSFRNLDKMKDKFVALDNVEQQAKHEVRRSVALLGKRMSD

SEQ ID NO: 129199 - protein, 72 aa, Heterodera glycines
  Coding regions on vcDNA: vcDNA=SeqID_55622; Strand=+; Position=1 -99,222-341
MTKQHEDNTLGLRCRLKMNDAQLQTLGKTIQGKDDEIKELKAMCEELMQKKGIMDDDEDEEEEDDDGEMDGE

SEQ ID NO: 129200 - protein, 242 aa, Heterodera glycines
  Coding regions on vcDNA: vcDNA=SeqID_55623; Strand=-; Position=1 -364,419-708,769-844
YIDHSVLTFIRSNKPIWDRMGTKFEFFAKSIRQLGFTSGDAFDNLRRLISPTILTGLDQLNSIDSNELFPDGIADDGPNATAGQALVKWLHTPSKNGQPKRLYRNNYFGPQNLEWVNNFKETFISATTSVSYNIQLYFHVNTIPTEPFELVNKRTNEKLTLKQEIDEFDVNVYNWLLQRCPIGETARVPAIKWGDSLNPSANLNSIRFDLWSFDKSIEPLSPPTEEEKEEEEADKSNGNVVC

SEQ ID NO: 129201 - protein, 198 aa, Heterodera glycines
  Coding regions on vcDNA: vcDNA=SeqID_55624; Strand=+; Position=1 -259,489-772,969-1023
YCVTVNCHDERATVAKTLEYNITKDSKDGLWTTFSEGGKSFERVLFDFNEEKCKDYSIFIKTKKLEIENKKLLENEHYSLLGILAKDYVHVNKKAESNGRTEFNITCKYFFVNFTPVLTRKEEFYEIKVYCNDKQQQNLVYHSDIQCGKDGCQRIILADEQKCQTNVYDVQVWRWSERWTREKLVLLSQEAHIFQTFI

SEQ ID NO: 129202 - protein, 419 aa, Heterodera glycines
  Coding regions on vcDNA: vcDNA=SeqID_55625; Strand=+; Position=1 -203,275-315,367-390,441-527,620-721,771-820,897-1014,1141-1214,1264 -1364,1420-1487,1537-1670
  Homolog annotation: Hit_ID=NP_740940.1; Match level="QueryCoverage =98%, HitCoverage=39%, E-value=1e-100, Identity=52%"; Hit description= sodium potassium-transporting ATPase family member (1P30) [Caenorhabditis elegans] emb|CAD21662.1| Hypot
GLRPITEEFRKECQIAWDHFGSEGRRVFAFAKKLFQAPQNTKFTAQSDNYPQDGLTFLGMAAITDPPRNETANETAAAIQQCKDAGIKVFMITGIKVFMITGDHPTAASADHPTAASAVASQIGLFGLQNDMVMDIKKPQNDWAIVLQNDWAIVLGESLAQMSPAEWDRLLAHRYIVFARTTPEQKLLIVEECQKRGTTPEQKLLIVEECQKRGETVAVTGGGVNDAPALAKANIGIAMGVNGSDIARRAADIVLTDDNFASIVKGIEEGRLLFDNLRLSIAYTLAHLWPEVLSIAYTLAHLWPEVCPIILNFTLGMPLGLEPLQILILSIDLASELPPAVSLAYESPERDIMKIPPRNRNAELVSSRLLLYSRDIMKIPPRNRNAELVSSRLLLYSYLFSGTFITLGCIGAYLSVYWY

SEQ ID NO: 129203 - protein, 48 aa, Heterodera glycines
  Coding regions on vcDNA: vcDNA=SeqID_55626; Strand=-; Position=1 -25,319-440
MLKNAQAETGRAEVGLEDVSYVFGANGINSKFDVPPISHLLFAFCFSN

SEQ ID NO: 129204 - protein, 52 aa, Heterodera glycines
  Coding regions on vcDNA: vcDNA=SeqID_55627; Strand=+; Position=1-206
LSQNKQQTVETTTNKSKSRGNHTDRKSMHSRASFLRCIVKTAKLFIFRLIYI

SEQ ID NO: 129205 - protein, 64 aa, Heterodera glycines
  Coding regions on vcDNA: vcDNA=SeqID_55628; Strand=+; Position=1 -3,401-592
MISSKKTLNIVLSLAHLMPLISEFCLRRYAALVVFIVFFFEPMYELAMPLDISSAVLINHIYHF

SEQ ID NO: 129206 - protein, 314 aa, Heterodera glycines
  Coding regions on vcDNA: vcDNA=SeqID_55629; Strand=-; Position=1 -50,99-201,253-415,465-679,723-871,916-1180
  Homolog annotation: Hit_ID=NP_507780.1; Match level="QueryCoverage =94%, HitCoverage=19%, E-value=6e-28, Identity=32%"; Hit description =predicted CDS, DNA polymerase type B, organellar and viral family member (5T899) [Caenorhabditis elegans]
MKARKTGVYTTTVFRDSYKLIPIKLANFVKTFGLEIEGVENKKYFPHKFNKAENYGTVLDTLPPIENYYPGGLFPAERAKFEQWYDENRETGFELCEVIADYCKTDVQILAHGMVKMRQLFLSETRHDITDSVTIPSGCMKYWVQLAHHDKERVAIIPHLGYEKRGKQSSIARKYLKWRAEEELRENGRVLRHVESPGGEFKFGNYSLDGMMERPDEDKNLAIEVNGCYWHGCPSCFPDDAAIVGGGETAGALRARDAKRTRDIAREFEVEVIWECHLNAMLEDNPAMKAYFDNCPDSGPIDFHDAFFGGTFSI

SEQ ID NO: 129207 - protein, 68 aa, Heterodera glycines
  Coding regions on vcDNA: vcDNA=SeqID_55630; Strand=-; Position=1 -54,107-259
MPDERVLHLECFESGDYDMMELYGPDRAKEMLIDLRDYAEAHGMPCKHVKMLLYKLDKGLIKWKGTKP

SEQ ID NO: 129208 - protein, 46 aa, Heterodera glycines
  Coding regions on vcDNA: vcDNA=SeqID_55631; Strand=-; Position=1 -111,656-685
MSKKGHKQFLEYVVSIFSSHNFSEHCQRCWQYSSLIEVYRITHHSY

SEQ ID NO: 129209 - protein, 244 aa, Heterodera glycines
  misc_feature (138)..(138): Xaa can be any naturally occurring amino acid
  misc_feature (163)..(163): Xaa can be any naturally occurring amino acid
  misc_feature (179)..(179): Xaa can be any naturally occurring amino acid
  misc_feature (204)..(204): Xaa can be any naturally occurring amino acid
  misc_feature (208)..(208): Xaa can be any naturally occurring amino acid
  Coding regions on vcDNA: vcDNA=SeqID_55632; Strand=-; Position=1-739
  Homolog annotation: Hit_ID=T02995; Match level="QueryCoverage=97%, HitCoverage=43%, E-value=4e-57, Identity=55%"; Hit description =unspecific monooxygenase (EC 1.14.14.1) - common tobacco dbj|BAA10929.1| cytochrome P450 like_TBP [Nicotiana t
TPKWTPSGALPFYRLSKESMKVVVFHWRLAAPTYATPLMILHKVRLESSSTGSSFPAKFAKPVPLAVVSLDSRRDSGNLVDPFVRVGKPTRHLATLRESCYSPVYPRLIKFPWLNIQSTGQKSDTVNVHKDHPSPLFXLDSRIPRVRASSKLVVQRQPKCIPXRAYTQLKRSTSSSHHXSTHHPRKNSTQPRAKAACFTQQPGXPDLXSQFFSRSYESNLPTSLTYIILSTRGCSPWRPAADIG

SEQ ID NO: 129210 - protein, 97 aa, Heterodera glycines
  Coding regions on vcDNA: vcDNA=SeqID_55633; Strand=+; Position=1 -82,212-318,824-874,1404-1455
  Homolog annotation: Hit_ID=CAE56377.1; Match level="QueryCoverage =81%, HitCoverage=8%, E-value=5e-21, Identity=60%"; Hit description =Hypothetical protein CBG24054 [Caenorhabditis briggsae]
MYSEYTNNYKAAIQMFEESMRRKRNFEELVKRAEQWEECEHLSMVSHLICPVQRVMRYQLLLREYQRHLSSTDPDWEDTEVTPTRELLTKARLWKCT

SEQ ID NO: 129211 - protein, 237 aa, Heterodera glycines
  Coding regions on vcDNA: vcDNA=SeqID_55634; Strand=+; Position=1 -120,170-253,557-707,1430-1520,1578-1845
SCKGHEDKCQNWGYLNPNDCTKCHCPDGYGGQNCKELEENLNCEDLSGIARELVANKSAVFSKTKAKCAKLCCAASLTDLNANEYKNWIAAEKPDMDIVISACLSPKWTVPSTVFELTSIQFQIKGSRHECLLTQKIFDTIGLGLRLIKADAGTVSFWGYSKPETKEIIRVDEVHCLTYETAGVPKRFKSLQVEEQPPMKKLNPSPFLAMLHHLSMCSCHLLAIHERRGKSVISGSV

SEQ ID NO: 129212 - protein, 97 aa, Heterodera glycines
  Coding regions on vcDNA: vcDNA=SeqID_55635; Strand=-; Position=1 -67,146-372
MLLLPDPPLPLLLLQTLLLLLLRSDISHRKHNTLPRGRVCLHKSRPPHPNLPVSGGRVFICRRVGCANTRIGRCCAWLNMKWGTDEIIKDPGVHKKK

SEQ ID NO: 129213 - protein, 238 aa, Heterodera glycines
  Coding regions on vcDNA: vcDNA=SeqID_55636; Strand=-; Position=1 -62,206-860
MGILETKPPKQEGMALLGANRHKHLKLLMNCLSAQIVISLVNWLIKCLWTANERKLSDSNCGNVLLWVAINERMGSVGQGNICRPEGRQNAKNPPKIGSAAATASANSTMISNEGEAGGESAEAAATSELIGTTPAKASAKRSSNGSTPKGKCQSKSGGGKSKGNGSNEQQHSDDTKVENERATASTTSSTKNNNNFTSSLGTVGGTAPAAMAPFLAAMNPAGYGRGTIGRGFIGWGA

SEQ ID NO: 129214 - protein, 124 aa, Heterodera glycines
  Coding regions on vcDNA: vcDNA=SeqID_55637; Strand=+; Position=1 -153,216-374,563-717
FCGEHSAASRSQDGRFAPVFNFLGDIRPLRGLRTGASRPFFNFVWDIRPLRGLRTGASRPFLNFLGDIRPLRGLRTGASRPFLIFCGTFGRFAASGRALRGRFLILWGTFGRFAASGRALRARF

SEQ ID NO: 129215 - protein, 248 aa, Heterodera glycines
  Coding regions on vcDNA: vcDNA=SeqID_55638; Strand=-; Position=1-748
QSDESDHFAGKIQFKGHIKETQDKVTKVIILLGRYNSKDIIKENQDKVTKVIILLGRYNLKDIIKEDQDKVTKVIILLGRYNSKDIIKEDQDKVTKVIILLGRYNSKDIIKEDQDKVTKVIILLGRYNSKDIIKEDQDKVTKVIILLGRYNSKDIIKEIQDKVTKVIILLGRYNLKDIIKETQDKVTKVIILLGRYNSKDIIKENQDKLPTVSPANFDIFQFPTHNKRTPSVALDYVPIKNSSMGLGI

SEQ ID NO: 129216 - protein, 145 aa, Heterodera glycines
  Coding regions on vcDNA: vcDNA=SeqID_55639; Strand=-; Position=1 -70,384-751
  Homolog annotation: Hit_ID=XP_416807.1; Match level="QueryCoverage =54%, HitCoverage=11%, E-value=1e-14, Identity=45%"; Hit description =PREDICTED: similar to SH3-domain kinase binding protein 1; c-Cbl -interacting protein [Gallus gallus]
MITPTTTTMVLEGAEVPNSQKAKEFAKVLYNYEAANSDELSLSEGTVVTVVSRHCEEEDWFIAEHDGRRGLFPDNFVRFLDQGQMQVECGGRMYFMFFKFRLPQMLNRRLCRRNPPNLAQLPTLRPMRCKMPLFLRSVREILSML

SEQ ID NO: 129217 - protein, 254 aa, Heterodera glycines
  Coding regions on vcDNA: vcDNA=SeqID_55640; Strand=+; Position=1 -144,204-287,329-406,480-818,928-1047
  Homolog annotation: Hit_ID=AAA27901.2; Match level="QueryCoverage =79%, HitCoverage=34%, E-value=3e-25, Identity=30%"; Hit description =Hypothetical protein B0303.9 [Caenorhabditis elegans] sp|P34260|SLP1_ CAEEL Protein slp-1
MNVSDEEIHFSRTVRHLNQRLFFGLLSQFSGNIAIVWDGKAMTTQFDMIVTPKLLQEHNVTKNYKLELVAQPDTQHVVYLIYATRQSVLLLMRNWLHQLPDDDLRLHHVVFIPDASLTLRQQLREDQRVWDRLQSVDSLPLHWFPTEQHKLLTMELPQLVAQLVLNGDWNFLFRCATAIRQLEQLITGSDGALTMRCKGEWSARIVDMCRKIRDDHPRVAGGERNCGRGPMGGPVESDVSTIDFRRSMRRVVGH

SEQ ID NO: 129218 - protein, 220 aa, Heterodera glycines
  Coding regions on vcDNA: vcDNA=SeqID_55641; Strand=-; Position=1 -514,594-742
MLLTNPNEFSNEKQRYLFELSIYSNEIWHRFLAQRHFANIAIQFWHSKTNFLVEKWTEIENKQIINEKDEQLKMELHEMLSNFSTDYKRNFENFGWKIFGEILYRNWLARTLLSNARLSEEWNKLNKDSQTKAITVIFAAVNENRKSKDGKRKNMLKYMEKWRKTLEQLKLDKSIFDDFVEKKYLIGQMPAYWRAHIEYIQEINCDIMSNFPEAVKYIFI

SEQ ID NO: 129219 - protein, 70 aa, Heterodera glycines
  Coding regions on vcDNA: vcDNA=SeqID_55642; Strand=+; Position=1 -84,1101-1229
MTLAKVRRRWPIGFWAHYIFARWSQRPKIIFNQKAKTMATRKVKNSKADLGLLMLYAVKGDGKQELFGCA

SEQ ID NO: 129220 - protein, 75 aa, Heterodera glycines
  Coding regions on vcDNA: vcDNA=SeqID_55643; Strand=+; Position=1-229
DSSKDQNQQQQNENDEFKQYMDSVFAAIRRLLMGPGRRMTCQNLAMRQLASSILGPMASAEDIYEPTELAKLALN

SEQ ID NO: 129221 - protein, 172 aa, Heterodera glycines
  Coding regions on vcDNA: vcDNA=SeqID_55644; Strand=+; Position=1 -60,367-749,983-1059
VTLLGDPTHQRTLHALLLGLLDTLSEMLHMFRDLLLRCPVPAEWCRPSPLFPLINMCHHFRRQSLRRIQLRLFAKHLRMSAALCRRDFGTPAHFDAAIWCECILSCVALAKCCATTTTQKSTMMAHNAEAEDNGTTHSDYEEGEEEKVLCDQQIDNSEGEQKLGKYATEILR

SEQ ID NO: 129222 - protein, 109 aa, Heterodera glycines
  Coding regions on vcDNA: vcDNA=SeqID_55645; Strand=-; Position=1 -233,987-1083
MGRPFLPLAFSLVLLLLAVVISTNCANASPIVGEEQPMAPEQKATKGTNDGQMGDDNRTNRRNNSKSLDRELDSLTLLLLPRHTDIHHNHPILRKKRKESNVMRIKETK

SEQ ID NO: 129223 - protein, 129 aa, Heterodera glycines
  Coding regions on vcDNA: vcDNA=SeqID_55646; Strand=+; Position=1 -22,113-292,373-560
  Homolog annotation: Hit_ID=NP_477144.1; Match level="QueryCoverage =96%, HitCoverage=6%, E-value=8e-16, Identity=34%"; Hit description =CG10379-PA [Drosophila melanogaster] gb|AAF56191.2| CG10379-PA [Drosophila melanogaster] pir||T03284 myobl
MAELFTQGEHWELAIETNRELANIYETATFDFAKLADLLARNAALYDKVTKTLRMESHYFMIAFYGKSCPSHLVTLKFVARGRPLEQWGCFKQRFVANFSDFKFVDTLDNCEETYREMNGKFLQATEKF

SEQ ID NO: 129224 - protein, 165 aa, Heterodera glycines
  Coding regions on vcDNA: vcDNA=SeqID_55647; Strand=+; Position=1 -16,126-253,779-984,1036-1182
MGPVVTNDKLTETAAMVGEGFAQSLVNLAGMIRGIVQADVGGGIRNYQSERAQANALFHNSLAGSFMEHRQRVEHWLGPVKSVLPEKTSIYMLEATAAAAVETMTSLSHAVTDGSGGRNQSAQQLSAVSSTPPPQQKLTRMTSLHENGMTTTNNNMMMVYPTAAA

SEQ ID NO: 129225 - protein, 62 aa, Heterodera glycines
  Coding regions on vcDNA: vcDNA=SeqID_55648; Strand=-; Position=1-190
ETKKKLNNPRETKKKRKKPRETNKKRKNPRETNKKRKKPRETNKKRKKSEGDQQKAEESQGD

SEQ ID NO: 129226 - protein, 129 aa, Heterodera glycines
  Coding regions on vcDNA: vcDNA=SeqID_55649; Strand=-; Position=1 -141,484-565,653-819
  Homolog annotation: Hit_ID=NP_509002.2; Match level="QueryCoverage =99%, HitCoverage=30%, E-value=3e-37, Identity=51%"; Hit description =innexin, putative gap junction protein, embryonic membrane protein, forms connexin-like intercellular cha
MPMEFKGGWEQYAEDYCFIQNTYYVAPEEEIPAEINERDERQFGYYQWVPIVLALQAVMFYLPNWIWKTLHQQSGVDLETAISDARALRSMHSDKRSQEMGKLVQYLNETLELHEVRRTPRYCMFTVGC

SEQ ID NO: 129227 - protein, 126 aa, Heterodera glycines
  Coding regions on vcDNA: vcDNA=SeqID_55650; Strand=-; Position=1 -165,312-527
MRSVRTSIRRKTSAGRQRHRLRPRIDTETALLDGRNSASGAMSRISNYQSVVLQQDFNEHGAKPRSRINTAYDIILITCDHKNEKSAHAKRHISLPDIVIDAATPKMDEKSTAEGDERQKFIKNSK

SEQ ID NO: 129228 - protein, 31 aa, Heterodera glycines
  Coding regions on vcDNA: vcDNA=SeqID_55651; Strand=+; Position=1 -66,945-974
MTHGQWIKYLYKFSLIIFTFHQHNRIINKEH

SEQ ID NO: 129229 - protein, 129 aa, Heterodera glycines
  Coding regions on vcDNA: vcDNA=SeqID_55652; Strand=+; Position=1-390
  Homolog annotation: Hit_ID=CAH80563.1; Match level="QueryCoverage =95%, HitCoverage=71%, E-value=3e-24, Identity=40%"; Hit description =hypothetical protein PC107372.00.0 [Plasmodium chabaudi]
MRGREKGRKRRGREKGRKRRGREIGRKRRGREKGRKRRGREKGRKRRGREIGRRRRGREKGRKRRGREKGRKRRGREKGRKRRGREKGRKRRGREIGRRMRGREKGRRRRGREKGRKRRGREKGKWLIN

SEQ ID NO: 129230 - protein, 87 aa, Heterodera glycines; identical to SEQ ID NO: 129152
  Coding regions on vcDNA: vcDNA=SeqID_55653; Strand=+; Position=1-1124

SEQ ID NO: 129231 - protein, 88 aa, Heterodera glycines
  Coding regions on vcDNA: vcDNA=SeqID_55654; Strand=+; Position=1 -29,618-759,946-1041
  Homolog annotation: Hit_ID=CAE73733.1; Match level="QueryCoverage =72%, HitCoverage=24%, E-value=2e-14, Identity=56%"; Hit description =Hypothetical protein CBG21259 [Caenorhabditis briggsae]
MRNSCQPMSNLWPDYVRQRLQSTYAYLAGSLALTAAVGVAAARSPGILALTSAPSLLVWFGSLAAIIGSGLVGSLWHFWCGFGSPLFC

SEQ ID NO: 129232 - protein, 33 aa, Heterodera glycines
  Coding regions on vcDNA: vcDNA=SeqID_55655; Strand=-; Position=1 -50,156-207
MNRSESFRLLSSVDSCRSDGFQTSGAYSNNGLT

SEQ ID NO: 129233 - protein, 148 aa, Heterodera glycines
  Coding regions on vcDNA: vcDNA=SeqID_55656; Strand=+; Position=1 -72,482-856
  Homolog annotation: Hit_ID=NP_503064.2; Match level="QueryCoverage =71%, HitCoverage=17%, E-value=6e-10, Identity=30%"; Hit description =alpha amylase, catalytic domain containing protein family member (69.3 kD) (4S215) [Caenorhabditis elegan
MAATDGMVEDGKVGNDLESAKFTKIFTLAYKDSESKNGFGDFEVIEKKLDQMKGIGVNAIWPTPVLKYYKNALGPEAIEKLEVSDQLGGAEGFKKLIKRAHDNQIKVIVDLPLTVNAKGNWANKTSDTKSGRGRYPMLTKHSFKMVLP

SEQ ID NO: 129234 - protein, 93 aa, Heterodera glycines
  Coding regions on vcDNA: vcDNA=SeqID_55657; Strand=-; Position=1 -131,693-843
MRRPTEEVQMETKTEEQMRKEAEELWEQQRREELNEALNKKYTELLKQLDFPEGKFSLFFMGYKDLDEIPSDDAAQKKFALSTHSTIELTQSY

SEQ ID NO: 129235 - protein, 85 aa, Heterodera glycines
  Coding regions on vcDNA: vcDNA=SeqID_55658; Strand=-; Position=1 -133,868-919,1302-1373
CKCSATLRIVPQKSGTEDLTGQIDHHSFNNKSNSWGFPYFITFAIKLVKSFQMVPNLSGFDQKLKEGRGKNNDDLQQESDDGDGD

SEQ ID NO: 129236 - protein, 77 aa, Heterodera glycines
  Coding regions on vcDNA: vcDNA=SeqID_55659; Strand=+; Position=1 -78,140-295
MAPRRKRKAAQLVGQDEAVVNGPSAQLPTNDGQQLASAAPVTNNGTVQQAENDGTDAVAAAAAIDGTGGQVQFLYFR

SEQ ID NO: 129237 - protein, 45 aa, Heterodera glycines; identical to SEQ ID NO: 124527
  Coding regions on vcDNA: vcDNA=SeqID_55660; Strand=-; Position=1-138

SEQ ID NO: 129238 - protein, 66 aa, Heterodera glycines
  Coding regions on vcDNA: vcDNA=SeqID_55661; Strand=+; Position=1-492
IIFIQKIFFWVFGAVPLNRCAQIYGETESFGNSFPIACTLILRWIFAPHKCLSTPNGHLKKSIFLF

SEQ ID NO: 129239 - protein, 111 aa, Heterodera glycines
  Coding regions on vcDNA: vcDNA=SeqID_55662; Strand=+; Position=1 -40,510-658,749-793,1357-1455
ITYFIIEEKMDGSDFIRSVFTVSASVSFVLGILFNTFMAWMIIKKTPAPMLIYSKILMAPCIIDIFLSLCAFIVQPIPRWPSAGPAQILDQFDHRLSADCPCAAPLSVRLS

SEQ ID NO: 129240 - protein, 46 aa, Heterodera glycines
  Coding regions on vcDNA: vcDNA=SeqID_55663; Strand=-; Position=1 -50,407-497
MNLYIFLSALIAFLLIRKEWKKIYAEINKKNGVGQRSIDKWKKQFG

SEQ ID NO: 129241 - protein, 30 aa, Heterodera glycines
  Coding regions on vcDNA: vcDNA=SeqID_55664; Strand=-; Position=1-90
ETEWPDELTFATPAYSPSADPPFEKSETKT

SEQ ID NO: 129242 - protein, 788 aa, Heterodera glycines
  Coding regions on vcDNA: vcDNA=SeqID_55665; Strand=+; Position=1 -828,876-2414
  Homolog annotation: Hit_ID=NP_509552.1; Match level="QueryCoverage =87%, HitCoverage=38%, E-value=1e-69, Identity=28%"; Hit description =reverse transcriptase RNase H-like protein family member (XJ813) [Caenorhabditis elegans] gb|AAA85753.1|
MQQFSNTVRQLPSGRYSVRLTWREPRPPLPSNWAIAYRRLLSTTKRLQCAPELLDRYSAELTRQMDADIIELTGRDDDEHFLPHHAVINPKKLRIVIDASAHAKGTPSLNDCLHRGPVLLPDLCGILLRFRSASMPVLADVQGAFHAIEVEPEDRRFCKMLWLKNPARPVSGDNLLVYRYKRLVFGATCSPFILAAVLLHHFERHDHPFAKELAANMYVDNLLIECETEEEAIDKSSIAKQILKDADMNLREFLSHSPNVMGRIPEDDRLDKTPAKSPKRHRHHCYTAFSPEHHCQHVRPAWTRRAMSSARQTALPTAMGRMNRLGRPPPRCRAATWSQTLSLWQHQTLVIPRHSILGKHSRLQLHVFCDASEHTFAAAVYIRSETADSSQANLIFAKNRLRSRTANQRFTIPRLELLAVLVGIRAMRFAEKEFRRPIDGRHLWSDSQIALSWVKSDEPKAQFEQRRLVEIRQGPPTTFHFIRTDRNPADVATRGCTPAELRTRHIWWKGPEWLTSPETEWPDELTFATPAYSPSADPPFEKSETKTPVYLEATTDLSAPSFINVLRRFISRRGRPKRILSDNAPTFVQTSKALDILTGPPSETDAVTFAARRGIQWDFIPAYSPWMGACYERLIGLVKSCIKRTIGRRILDYDDLSAFLAEIEASVNSRPITWVSDQPDSSKPLTPKDLIQPGLPNNLEIVDSDLDYDDCLSGPARLAALWKAYGRPPTISGSNGVMSTSSPSESAPDGLIKVPAFELPPPPTSAKWSSSKRTSAPGIYGRWASSLH

SEQ ID NO: 129243 - protein, 82 aa, Heterodera glycines
  Coding regions on vcDNA: vcDNA=SeqID_55666; Strand=+; Position=1 -186,331-393
MAIKYGPKIAKYGHKMAKIAKYGHKWQKCQNMDINFSKLSAKFLQIYWLKLHMRYISKFFDSRKINNKSEIFAFLLIFDIIY

SEQ ID NO: 129244 - protein, 51 aa, Heterodera glycines; identical to SEQ ID NO: 124998
  Coding regions on vcDNA: vcDNA=SeqID_55667; Strand=-; Position=1-155

SEQ ID NO: 129245 - protein, 279 aa, Heterodera glycines
  Coding regions on vcDNA: vcDNA=SeqID_55668; Strand=+; Position=1-839
  Homolog annotation: Hit_ID=EAL37100.1; Match level="QueryCoverage =99%, HitCoverage=46%, E-value=1e-18, Identity=23%"; Hit description =similar to formin-2 [Cryptosporidium hominis]
SLGLNSPAFQSLRLNPPAFQSLGLNSHAFQSLRLNPPAFQSLGLNSHAFQSLRLNPPAFQSLGLNSPAFQSLRLNPPAFQSLGLNSPAFQSLGLNPPAFQSLGLNSHAFQSLGLNPPAFQSLGLNSHAFQSLGLNPPAFQSLGLNSHAFQSLGLNPPAFQSLGLNSPAFQSLRLNPPAFQSLGLNSPAFQSLRLNPPAFQSLGLNSHAFQSLRLNPPAFQSLGLNSPAFQSLRLNPPAFQSLGLNSHAFQSLRLNPPAFQSLELNSHAFQSLRLNPPAF

SEQ ID NO: 129246 - protein, 101 aa, Heterodera glycines
  Coding regions on vcDNA: vcDNA=SeqID_55669; Strand=+; Position=1-306
MASGFGMFLFVKFGQFFLKTFAVWALPVVIIWTICVVALRRQFSLISTNWFQSIHLVCRPLRLVMVLMCQIQQFLLAKHCPNGCTLREKMANPSDFVVAEI

SEQ ID NO: 129247 - protein, 144 aa, Heterodera glycines
  misc_feature (121)..(121): Xaa can be any naturally occurring amino acid
  misc_feature (128)..(128): Xaa can be any naturally occurring amino acid
  Coding regions on vcDNA: vcDNA=SeqID_55670; Strand=-; Position=1 -69,2039-2137,2238-2292,2344-2528
  Homolog annotation: Hit_ID=NP_505989.1; Match level="QueryCoverage =81%, HitCoverage=14%, E-value=3e-25, Identity=50%"; Hit description =prestin family member (84.4 kD) (5M359) [Caenorhabditis elegans] emb|CAB04606.1| Hypothetical protein K12
LQKTLTNSRDGVDPNYSRTEDGIFSEKASSIFFGHFIIDCSGFTFVDCMGVNALKEIFIFTEMREQRVLVYFAAAKAPVRDLFPVRDLFEKCGFFRYVQKHNFYPTIRDAVAIARKRRNAXAEKINKXLKCEIMVKEGEGSLKI

SEQ ID NO: 129248 - protein, 41 aa, Heterodera glycines
  Coding regions on vcDNA: vcDNA=SeqID_55671; Strand=+; Position=1 -11,383-497
MAFCSLLRLSLMALGKSDTGKSDTGKSDTGKSDTSGKSDTA

SEQ ID NO: 129249 - protein, 111 aa, Heterodera glycines
  Coding regions on vcDNA: vcDNA=SeqID_55672; Strand=+; Position=1 -213,834-954
MTMSVLMNGTESVPLSLAVDLRQEKAFDIGVGVSKSPDHSEEFLPVEADVPNVENNDFSSKTILCEQHTGGESNDDELDNDQPQKSTANAKKKRGTKRRHMPSVAATKCLS

SEQ ID NO: 129250 - protein, 28 aa, Heterodera glycines
  Coding regions on vcDNA: vcDNA=SeqID_55673; Strand=+; Position=1-84
TKTVTVRWKCCTNVRRVAKMCTELMSAL

SEQ ID NO: 129251 - protein, 61 aa, Heterodera glycines
  Coding regions on vcDNA: vcDNA=SeqID_55674; Strand=+; Position=1 -114,447-518
MEQQNDDCIERKSSMVLQEYSVIESEESMLDPHVKPKASALWQNVSSEGQFEETLTHPLHN

SEQ ID NO: 129252 - protein, 129 aa, Heterodera glycines
  Coding regions on vcDNA: vcDNA=SeqID_55675; Strand=+; Position=1 -108,204-330,407-561
MFYQEQQIMKVFAKLESFSCLMFFKKGDSVETNNFTIDFNSKNKYANINDADAKQIIDDNLNLDFGAQQSRIFRNIFQKLEGPSDGASSSPASDENKNKQKGKIISSLLSLGGKNKEKKNRQPNVIDFI

SEQ ID NO: 129253 - protein, 95 aa, Heterodera glycines
  Coding regions on vcDNA: vcDNA=SeqID_55676; Strand=+; Position=1 -175,1155-1267
MAAWHFEKLLRDFSFQISSPENDKKISVNNRSLPQQNDTFLQIEQCVREMLLEKESRRDYFGSSFVKMTIDVSLLLYSDTMPKFALRVISQQMLS

SEQ ID NO: 129254 - protein, 205 aa, Heterodera glycines
  Coding regions on vcDNA: vcDNA=SeqID_55677; Strand=+; Position=1 -398,704-923
  Homolog annotation: Hit_ID=XP_514634.1; Match level="QueryCoverage =74%, HitCoverage=17%, E-value=5e-10, Identity=27%"; Hit description =PREDICTED: KIAA0406 gene product [Pan troglodytes]
MLLPFQVCPRFPLIFAELVSRCFSLQIILPQIRSVVAELLLWLDRSDQKRIIILAKALRAYLSALNEWFPNLKPLVTNLSKTNEKYANLEETEGEKDGHGEEEGAEKVDGHKKQWEGDPNYPLVKDVVSILNRTKHFIASANLPLLLIVLDVLRLSLLFVRDYEDELLPMIHQNWMGLIRLFKIGTAGHLLDSQKLIMIKAIEVN

SEQ ID NO: 129255 - protein, 359 aa, Heterodera glycines
  Coding regions on vcDNA: vcDNA=SeqID_55678; Strand=+; Position=1-1079
  Homolog annotation: Hit_ID=NP_920205.1; Match level="QueryCoverage =94%, HitCoverage=22%, E-value=5e-28, Identity=28%"; Hit description =putative DNA helicase homolog [Oryza sativa (japonica cultivar -group)] gb|AAP52492.1| putative DNA helica
MNFRGATEAYAIVHSMPFARLSHHVVKLAIHLPNQQPIVYRAFQLVSKAQQIQQGELPETQCSAYWKQWQNEWKNDPKFKDILFEKVPERFRWAKDKWVLYKRQQIKRPPIGRIVPVPPSDPERFALYSLMRHFPGDPDHLKMVNGLLCTSFTEAAIMHGLLEDDKIWDKTLAEAALSRWPDQMRWLFVSILVYGQPSNAIELWNKYNDQMYNPQGIITLAQHKVAELEALADIDWRLHSCFNLSCVHFSLPDPPTSIAKNTDAAIEEFFFGDDDLNLPPGQPNPRPQPNTPPPLNSDQQKVFDAVLLAIQSNPRDSTVPRRFFIYGDGGTGKTFLFGQIIRRLRKAPYTYKVLATAST

SEQ ID NO: 129256 - protein, 83 aa, Heterodera glycines
  Coding regions on vcDNA: vcDNA=SeqID_55679; Strand=+; Position=1 -157,207-301
MRLLPFCFFLLLPLLLCFFLFTFGSSSPIVDSEMFLPPRFYRTIWPINAKRSPSIGLSLAEYMAAGNQGQEQFHFIPGSGRRK

SEQ ID NO: 129257 - protein, 78 aa, Heterodera glycines
  Coding regions on vcDNA: vcDNA=SeqID_55680; Strand=+; Position=1 -34,803-1005
MRRKKVPQKEKWSELLRNDSLGFTFRKKWDAVSVLASIRNRMLAMSMSAFKKIMMFSPNLNSSISDEETMEKIKSYRA

SEQ ID NO: 129258 - protein, 57 aa, Heterodera glycines
  Coding regions on vcDNA: vcDNA=SeqID_55681; Strand=-; Position=1 -58,217-332
MAEDDDEDVQEEAGKDVQTGFKQKAKKVKKTLAKVLAQRAKKPGELPAAIIGDDVLV

SEQ ID NO: 129259 - protein, 192 aa, Heterodera glycines
  Coding regions on vcDNA: vcDNA=SeqID_55682; Strand=+; Position=1 -105,149-622
MIPNPLCTDWMRGEQLLTGYVERGDLVEIRRGSYMHWAVFIGHISGQPLVIHISTESSDMGISTKKEFVRKMAKGCAAIVMLLTSICSTLQRLVLSLRFSFLNLFKVRSDPFLNVISTDFCRVNNCLDANRRPFPPSIIVERALTKASYAYLIMFNLLQILFSLELVGIISSKTTVNTLLNGVVMLFEKASR

SEQ ID NO: 129260 - protein, 33 aa, Heterodera glycines
  Coding regions on vcDNA: vcDNA=SeqID_55683; Strand=+; Position=1 -75,185-220
LAFLKINCCQSLHHVFKASLRKGCSYGRFGDLA

SEQ ID NO: 129261 - protein, 245 aa, Heterodera glycines
  Coding regions on vcDNA: vcDNA=SeqID_55684; Strand=-; Position=1 -487,544-792
MRRKSAGLSLLLLKHSRRSHEQLQIPNASAQALLRVPPVYTQQKGSAVPSFASSSVPYAQQQQQRQYPQNSVQSSPHSHSLSAAYAHPQPLFVPSSSSPPFQPLQIRPQQSPAAIPSVRHSSVPRGDDVDRANASPKNKIPPAVCAVFSVLEVLFGVVSLFVGALNANPYNCLIQPNVPIYLILSGILLIINGAARLFLSLSASPTDSTKRRDTRQMRHSHGRRPALTYAVEGIGLFAILVVLIL

SEQ ID NO: 129262 - protein, 95 aa, Heterodera glycines
  Coding regions on vcDNA: vcDNA=SeqID_55685; Strand=-; Position=1 -154,821-954
MCSELDTDADSGDQSDGRNRVQLDARKAHEAGQLHGHAGHNAGDLCCLGINVEYFIFRIIIVHQKERKTYANSQHQVVVQVQILLPKGESDALKK

SEQ ID NO: 129263 - protein, 164 aa, Heterodera glycines
  Coding regions on vcDNA: vcDNA=SeqID_55686; Strand=-; Position=1 -112,639-1018
MGQMQLLAKHWPNGCKFREAMESRSNWVAVLLRQKSSETLLKRSWQTAYEVAKSIFRQANGGPFFETTKIEVLAPPVGPEDDGKMYGESGSAAILIALYALASGLFVKKNIAVSAVIKKNKQIGKVGGLRYKVMAAAKARKTTGVLSTENKTEFMKFEKKVKKH

SEQ ID NO: 129264 - protein, 112 aa, Heterodera glycines
  Coding regions on vcDNA: vcDNA=SeqID_55687; Strand=-; Position=1 -22,558-703,809-979
MPSNVMIQYDNKFVPIEQKYLSCQNVPNGGIGYNCEFSLDNLEVDEESSKLSIWANFNYFTIFVLPALRGAKKTGNFVGDGWRKLKNIEEQFLLGRKFLDKICRGWPEKFQK

SEQ ID NO: 129265 - protein, 51 aa, Heterodera glycines
  Coding regions on vcDNA: vcDNA=SeqID_55688; Strand=+; Position=1 -43,585-632,1458-1524
LFVTANSSCAPKSENALVNGQTVMDVIYLRNNFLARNVTESCPPNKDCQIT

SEQ ID NO: 129266 - protein, 41 aa, Heterodera glycines
  Coding regions on vcDNA: vcDNA=SeqID_55689; Strand=-; Position=1-124
MARKDFRFPTFLGSEFRLPKFLMKSRKFFNFFLKPVSFVQF

SEQ ID NO: 129267 - protein, 172 aa, Heterodera glycines
  Coding regions on vcDNA: vcDNA=SeqID_55690; Strand=+; Position=1 -211,619-795,1148-1278
MERNSKNNFLKRLDKKLLPGYIIEINGKLTKSLDENLPITISLLSQTDDPKFAEIEHIIKCKEETGVKCPAFCPLQLVFFWNSSSAAVQLNVFALNGIENINISTNKDLPQFPHTAGKEIKLRIHIAHTKYLLTEHGLSEEIPFGDEEKRALPPWLVEFIHVIYKIIGTFLF

SEQ ID NO: 129268 - protein, 300 aa, Heterodera glycines
  Coding regions on vcDNA: vcDNA=SeqID_55691; Strand=+; Position=1 -106,434-594,729-913,962-1161,1207-1355,1416-1515
  Homolog annotation: Hit_ID=CAE59659.1; Match level="QueryCoverage =87%, HitCoverage=48%, E-value=4e-78, Identity=51%"; Hit description =Hypothetical protein CBG03077 [Caenorhabditis briggsae]
SGLGFFFSTTFVMSNQQNGDVAVPAAVAPNEQPNQSERFHDFDNVESLFWHEHDLVYGDWTSGAIGDGSRQKAVTMMPTPEVLQRNGSLHQLNKFKKKYYQKTANLLTGKTGQSELDRQKAEEGVKFDILNYWHPNITVSLVTDFSAWTRGQLPAPFDEAVKFDPASNRYYPIVFFNSYWNLATEYQPVNDTVPALNLTVTFAPLSLFKWQLYASQQMRGKWAQMFGGEIFEESDADQDAIKQALIETSPVLLGITVVVSILHTVLELLAFKNDIQFWRTRKSLEGLSVRSVLFNIFQSL

SEQ ID NO: 129269 - protein, 30 aa, Heterodera glycines
  Coding regions on vcDNA: vcDNA=SeqID_55692; Strand=-; Position=1 -23,84-153
MWINPHNEFSCAAAPAITAEIGTKRSLTKK

SEQ ID NO: 129270 - protein, 63 aa, Heterodera glycines
  Coding regions on vcDNA: vcDNA=SeqID_55693; Strand=+; Position=1 -108,2068-2151
MCGSGAKKVWTQQRLTRWKGGIVNNELITKLKAYWSVIIDKYSSVRNLEYPIKITILILSAFV

SEQ ID NO: 129271 - protein, 133 aa, Heterodera glycines
  Coding regions on vcDNA: vcDNA=SeqID_55694; Strand=-; Position=1 -114,165-316,526-663
LVIKKLQSKKGAQKRWNKWEERKAQTAKARQAYLAKRTAPQPDTDAEMPQPSEEGPSTEAPARDNDGRPTSTPSPMTPQEMDVPSVEMVGRYAHLGTPEKVVEKLVKHVTLLNALHYRGVENSQENGNKYPNF

SEQ ID NO: 129272 - protein, 119 aa, Heterodera glycines
  Coding regions on vcDNA: vcDNA=SeqID_55695; Strand=-; Position=1 -273,655-738
MGDLETTLSTTPTAPMDTGETTPPPLAIDERSERIEQLEKQLKDRDDTIKFLREQVRNREALISDLRRSVICVGSWTSTLYHRWHHQRAAKAQPLSPGDLDGLETAVYQFKAFLDEQPM

SEQ ID NO: 129273 - protein, 126 aa, Heterodera glycines
  Coding regions on vcDNA: vcDNA=SeqID_55696; Strand=+; Position=1-381
MERHNKKQQANIGQLIKENCDWLCALARTKSAKKCNKMIKKANTEQLLSLVEICLNLVASRFRLTTRQKKRLLPHVDTVRQMSRARSERGARRVLVQKGAGFGGLFAAVLTPVLIELAKSVMTKNA

SEQ ID NO: 129274 - protein, 209 aa, Heterodera glycines
  Coding regions on vcDNA: vcDNA=SeqID_55697; Strand=+; Position=1-627
  Homolog annotation: Hit_ID=CAB62280.1; Match level="QueryCoverage =35%, HitCoverage=87%, E-value=4e-20, Identity=56%"; Hit description =hydroxyproline-rich glycoprotein DZ-HRGP [Volvox carteri f. nagariensis]
MSDTSDINLDAVRHDLNRDRGERTNPSAKNVNYNQQLRRYLKMRRDLTNMPTKVEMSKGISVLLRRGGEDEDGEVVDTPPRPPAPPPPPPPPSGKRPPRGPNPPAPPPPPPPGRRPPRPPSPPSPPGSPPPRPQRPPRPCRAAAPSRRGGLIEQWRKRQYDIQQRRPVVRDLLAEAAAAPLPESDDEYDYMLESGFALPAPSQYYGDLP

SEQ ID NO: 129275 - protein, 46 aa, Heterodera glycines
  Coding regions on vcDNA: vcDNA=SeqID_55698; Strand=+; Position=1 -10,59-189
MLAGLYLYLEGLQKLATFQYQLCPVQSPLNNSLGFDLSAGWPADLL

SEQ ID NO: 129276 - protein, 78 aa, Heterodera glycines
  Coding regions on vcDNA: vcDNA=SeqID_55699; Strand=+; Position=1 -65,159-330
MSLMSNLIRIFRLMIKAIQHIWRKKTRNEIEIDHLNKFNLMKKELRKENVYKNLTTTQLESEFTKKFNLKTNWKIDEK

SEQ ID NO: 129277 - protein, 122 aa, Heterodera glycines
  Coding regions on vcDNA: vcDNA=SeqID_55700; Strand=+; Position=1 -240,322-450
  Homolog annotation: Hit_ID=AAM52759.1; Match level="QueryCoverage =81%, HitCoverage=12%, E-value=1e-09, Identity=34%"; Hit description =SD04548p [Drosophila melanogaster]
MESVAHDYTFCRGRFQSVNYDTYGQDEIPIPLATLIDDYVKRETIQDWKCPKCGRSPGRKELKFHSLPDVLIFHLKRFELLNDGIASKIESRVQVPLEGLDMGPYVFNPDVRANTLPKVPSN

SEQ ID NO: 129278 - protein, 80 aa, Heterodera glycines
  Coding regions on vcDNA: vcDNA=SeqID_55701; Strand=-; Position=1 -72,137-307
MPKFWFPSTILEINTVKISKHKSQIMVYSYIYGTAISTAFAFYKIDEVASFCAVPFAVWTGLYCLLLNYFHDKQKQDKEE

SEQ ID NO: 129279 - protein, 49 aa, Heterodera glycines
  Coding regions on vcDNA: vcDNA=SeqID_55702; Strand=-; Position=1 -136,1142-1155
MMRKGTTVMRRGTKVIKRGTILIKRGRTVIRRGTTEIRRGTNLIREFLE

SEQ ID NO: 129280 - protein, 100 aa, Heterodera glycines
  Coding regions on vcDNA: vcDNA=SeqID_55703; Strand=-; Position=1 -112,174-364
MLFFNLPPKTLLLALVMLLSSKRSQSISNLQKMHSKTDYFKLATELVDSSSSFNEIIKAGKIDGSNFEIGWWEKRAFGILCVAKFGFKMDENLENYTKTL

SEQ ID NO: 129281 - protein, 166 aa, Heterodera glycines
  Coding regions on vcDNA: vcDNA=SeqID_55704; Strand=-; Position=1 -266,1450-1683
  Homolog annotation: Hit_ID=CAE73170.1; Match level="QueryCoverage =60%, HitCoverage=4%, E-value=7e-27, Identity=55%"; Hit description =Hypothetical protein CBG20566 [Caenorhabditis briggsae]
VFCAINELGQTKRVDEALCGQSLEEKPVAREECVNEEKCTGTFFTGPWSNCTAKCDGGTQTRTVVCLNYDKKPVPEWCDEKEKPAEQQDDAEEAAPPSKEMCAIETVGTKEKLQIPCAEAAAVTETMNETVQLIKLASADETAPEAKETNATAEEAAPVEKPCSKT

SEQ ID NO: 129282 - protein, 36 aa, Heterodera glycines
  Coding regions on vcDNA: vcDNA=SeqID_55705; Strand=+; Position=1-108
RLELNKFKKRARSARQSKTTFEKRARSARTMPRSGR

SEQ ID NO: 129283 - protein, 70 aa, Heterodera glycines
  Coding regions on vcDNA: vcDNA=SeqID_55706; Strand=+; Position=1 -12,46-246
MPTNGFLGSLISDHNPGSDQRDRSLHEVYMDNELTGFLYQGYPHCQGAHEDTYHSYKFSYFTYIFLLKFK

SEQ ID NO: 129284 - protein, 352 aa, Heterodera glycines
  misc_feature (3)..(3): Xaa can be any naturally occurring amino acid
  Coding regions on vcDNA: vcDNA=SeqID_55707; Strand=-; Position=1 -110,169-260,312-449,557-644,782-1132,1191-1259,1306-1351
  Homolog annotation: Hit_ID=NP_497970.1; Match level="QueryCoverage =81%, HitCoverage=20%, E-value=8e-65, Identity=47%"; Hit description =suppressor of G protein S defect SGS-1, Adenylyl CYclase (acy-1) [Caenorhabditis elegans] emb|CAA84795.1|
HVXEIGSDAGHSTVSMADRLDTAISHHHNAASLTRFDTDHTDHRDFDQRLAQVIHGANGTFAKGFWLHQKSLNRWTLNFNQKDIENSLNRWTLNFNQKDIENEYRAHFAAGDSSERHSAIRSTANGLKKHKQLASAAAESKQQQRSRRPRYRYSGVFIDIFVATASVFLTGKIRLGMAPFGRRLLAMFASLCLAVVVLIGLPLLSRRPLLPCLHQWAPRHIVGAFLIALPVGIALFNVPLCTSTNPASSCAFQIGNFRLLYSFTMLLALFAHCNFSQLGAWPKTCQAIGVGLIFLQLGAWPKTCQAIGVGLIFLLSTWFCQQQLDHIRHLNDVLSTWFCQQQLDHIRHLNDV

SEQ ID NO: 129285 - protein, 67 aa, Heterodera glycines
  Coding regions on vcDNA: vcDNA=SeqID_55708; Strand=-; Position=1-489
FILFKRARSARLSSTKFKNELEAPVRAQQSLKRKARLSTKFKNRRQAPVQAQQRNFLRKITRFQKFF

SEQ ID NO: 129286 - protein, 114 aa, Heterodera glycines
  Coding regions on vcDNA: vcDNA=SeqID_55709; Strand=-; Position=1 -31,67-380
MGNDPIDQMNELKKNQTDQQKRETVKKFDAIKEKLREKGEYKGKDQSKIERKIAKLLGTNRQLIQKWKNELNLKKTNRMKKSFYDEKKLKLIERIDEFKWPRKTERICQGIAHS

SEQ ID NO: 129287 - protein, 360 aa, Heterodera glycines
  Coding regions on vcDNA: vcDNA=SeqID_55710; Strand=-; Position=1 -47,102-377,429-852,902-1185,1230-1281
  Homolog annotation: Hit_ID=AAL78214.1; Match level="QueryCoverage =46%, HitCoverage=90%, E-value=7e-19, Identity=34%"; Hit description =putative esophageal gland cell protein Hgg-20 [Heterodera glycines]
MSDNPKEAEKEMEKAIFISADCWLSVFDLLPPFQLGLGIALISHRFDYFINEHFKTRKWKLGEMKIQRKTGEKGAKGMEIVNSDQKALPIPQNPLPNKVIGFKSISIDFIDQNVLIFLRHFHRFFASCTTTLNIFTVNVRISKLIVLNIWPMLKDTIRGMALDTVNLRPIRQLAPSMLNDCPSLRVITFYGPISIEFPPDESANASNGQAVTKWLFLPRPDKLPKELTICIEDSAVEQQWLATVQQIKAAFSSASSPVNFVITVYFPPSSSLSAVMPFKLTNEFTGEQLALSKEDGEEDFSGFSIIRCPIVPDDKRQQQMIKELDKRWNRIDIFIIRDDGVGDGLLDGSPGPSGDQKQQK

SEQ ID NO: 129288 - protein, 239 aa, Heterodera glycines
  Coding regions on vcDNA: vcDNA=SeqID_55711; Strand=-; Position=1 -369,1302-1652
  Homolog annotation: Hit_ID=AAC60129.1; Match level="QueryCoverage =84%, HitCoverage=74%, E-value=4e-09, Identity=32%"; Hit description =antifreeze glycopeptide AFGP polyprotein precursor pir||T44768 antifreeze glycopeptide AFGP polyprotein pr
MMASAVGPISRLPPAAVAACASAAADNGSGGLLAAVAATAAAAAAAAMFAPPTDAIAGNNATTPATTMVPPRSSAATVATPAAASLLVAAMNAAAFARQQHHHHQQRQWAEAAAAATIAKPITAQVLMVAPVAVKLAAALYKVKRRQPPQNYRHRRRHATAAATVGRRLRQSTGAAAAVCGDPFMPANEGRPSVANKLVSVVVAGGRSRPWGHKQQQQQTTSCRRPSSVRLSSSNRRRR

SEQ ID NO: 129289 - protein, 132 aa, Heterodera glycines
  Coding regions on vcDNA: vcDNA=SeqID_55712; Strand=+; Position=1-399
MDSARNADGVAQCRNGGLAAMKPCWGGGADDTAGVTVVAGGVMPASASFASSKLLLPNAQVGCRKAAIWDAFVRELWPIFETSIHQHLNFAGHKHFDILRRLISPTILTDLNKLNSINSDDLFPDGIAADDE

SEQ ID NO: 129290 - protein, 82 aa, Heterodera glycines
  Coding regions on vcDNA: vcDNA=SeqID_55713; Strand=-; Position=1 -126,200-322
  Homolog annotation: Hit_ID=BAD12172.1; Match level="QueryCoverage =92%, HitCoverage=29%, E-value=3e-11, Identity=46%"; Hit description =14-3-3 c-2 protein [Nicotiana tabacum]
MDIATSKIAAINPTRLGLVLNYSVFLADLLKSVNEARNLAKKAIDLAEAEIASMTVPLDDDASINLQTLRENMELWTPARPR

SEQ ID NO: 129291 - protein, 274 aa, Heterodera glycines
  Coding regions on vcDNA: vcDNA=SeqID_55714; Strand=-; Position=1 -99,195-494,556-679,976-1139,1216-1353
  Homolog annotation: Hit_ID=AAR85527.1; Match level="QueryCoverage =95%, HitCoverage=92%, E-value=1e-49, Identity=40%"; Hit description =14-3-3b protein [Meloidogyne incognita]
MTDEPETKDQLIYLIIVCEKARRFDDMVEAMKKLIKLDPNLGLEDRVSLALAYRGAMSSRRSSWRTLVSIEKRTGPEMNERQHQVVPPSIFGGPGGTFSVKNVTDPFFPQTQVMESYRKHVQNELVTICQELLTCINEMLLPKATDPEPKVFYLKMKADYYRYMAEVATDGDRSGVVELAKGAYQEAMDIATSKIAAINPTRLGLALNFSVFNFEILKSVDEARKVAQKAIDLAEAQIATLTVPLADDASINLRMMRENMELWTPEGGSHTKTT

SEQ ID NO: 129292 - protein, 280 aa, Heterodera glycines
  Coding regions on vcDNA: vcDNA=SeqID_55715; Strand=-; Position=1 -505,546-883
MSIEFKHFFFSALFLHLICVSHQITAEKECQEYENEFMGSFNGFSNASEFVSFNKFTKECFSLWFCEKTKFVYPKNGKDIDATISEIMTKIHKKYCEEIGKGQNIENTLNKMENETENLIKNLKKDPKLQEKVQNMVEMELSKNRKLNEKIQNAMERRKVNSFYDLLNAAFQTFFGNCKNCSIMPQKELSGRRKRRMAKHEMGNTSNTANEQNNFSIAGQNLVTQPTVVHNSNETGLELVTHSSDDNDHQNGGTNRGFFECRTPTTKSEFVSDSSNFAGR

SEQ ID NO: 129293 - protein, 441 aa, Heterodera glycines
  Coding regions on vcDNA: vcDNA=SeqID_55716; Strand=-; Position=1 -15,175-1318,1350-1516
MVDAKHSSVSGKAERAFSAAAVNRPAKFDAIRSEMESLLDEWDCTAIQAFNELWDGPKRRPGENLEEFAERVYQLVLCAYPGLPLDLYNDYAAKHFIRALENAKISIALEMARRPGLSYDSLVALAVRAEIAQKAAKSIAENENAHIARSFKPNKVEKTTTDWEKFYVRPTNKSVCYNCRKIGHIARNCKVKFTWKKCGFEQNNSNMNFQKENQRIRTDNLPRAKIFPKVSAPKRAKDGRNERNLSQKPIESADASTIFAGLFASFLVVANAFSNVKAKTHSRRISSTASSSSKLPALWNPLNVAFEKLRKRENSKENGINSKVKTPKGNGQLRTIVFSKAGEELADSTGPTTKLLKADTERKLSAVDGTITNKSASSYAIRPVQNCQIMMLVCATADCPSLLPLLEAECPADGFEALRTSLCRGRGCHIIVDLNYFGVLF

SEQ ID NO: 129294 - protein, 22 aa, Heterodera glycines
  Coding regions on vcDNA: vcDNA=SeqID_55717; Strand=+; Position=1 -37,442-473
MCKMGLKKTLIKDLYIDVGIEE

SEQ ID NO: 129295 - protein, 118 aa, Heterodera glycines
  Coding regions on vcDNA: vcDNA=SeqID_55718; Strand=-; Position=1 -196,463-623
FKAGVIGFNGKWAADQTSLYGDIDESSEHRNNKIWTRAIKTPMWQIVKYADDNVQYIFYGVKSCESMVKCRGCRLDKCLVAGMDPTLINVPPSDKFKQFLTELEKRKLSAMLTHSEKN

SEQ ID NO: 129296 - protein, 48 aa, Heterodera glycines
  Coding regions on vcDNA: vcDNA=SeqID_55719; Strand=+; Position=1-146
MRRLRCSTNAPASGPMCVLNCSHIAKAVALVCHGGTSGRKITCIRLDY

SEQ ID NO: 129297 - protein, 32 aa, Heterodera glycines
  Coding regions on vcDNA: vcDNA=SeqID_55720; Strand=-; Position=1 -47,293-344
MQDLSLAMSLKQWRTIVKDPNLAMSFKQWRPM

SEQ ID NO: 129298 - protein, 22 aa, Heterodera glycines
  Coding regions on vcDNA: vcDNA=SeqID_55721; Strand=-; Position=1 -20,105-153
MAYRMPRPLHKCDKCVIINLIK

SEQ ID NO: 129299 - protein, 371 aa, Heterodera glycines
  Coding regions on vcDNA: vcDNA=SeqID_55722; Strand=+; Position=1 -902,1154-1323,1503-1546
MKFDGSFTKDVCVQYRKYLDILYEYLYHVHAGHSVTRPTFIENAALSRYNRDLIEFLISLSTISKFYLFDSEFALSSVTDREEIKIFCKFELENENCLEYHHGLAYNEKEFNKKKRQKIDSEIRAKFELLMEKHFNKLWENAKLKNGNKNSDRMSISLAKTMPSDYAVHIYDTFLGMPIYDFDTLVSEECAKNMGLIFYIENQMEDEALINFVKTGGSKMTNIEIAEDIEDFYEAVEMHLGLLLLMRNNWHCANAKVANAENECQKLRYFVEIFYQYLFREWCGIAAVKPMLQTNNDFEIKPVILSVEDILSSFNQISMYFFGANSSADKNKFAHLLGELATYKLLNEHELDYNGTPGTCFELHPDFISRE

SEQ ID NO: 129300 - protein, 113 aa, Heterodera glycines
  Coding regions on vcDNA: vcDNA=SeqID_55723; Strand=+; Position=1 -95,414-660
MFCESLVRCARSRGVQMELPKRGIDHFDDTSLEFVREQFKLFSKHLVRFVIFFAPAKDASHAGDVHHTFKLQGIKQGKSNFFLLIVVMFKTQNFRKFNSKNIGRNFSILRNIN

SEQ ID NO: 129301 - protein, 370 aa, Heterodera glycines
  Coding regions on vcDNA: vcDNA=SeqID_55724; Strand=+; Position=1 -104,215-373,401-571,656-806,913-1020,1065-1151,1218-1463
  Homolog annotation: Hit_ID=XP_315798.1; Match level="QueryCoverage =97%, HitCoverage=88%, E-value=1e-104, Identity=54%"; Hit description= ENSANGP00000018739 [Anopheles gambiae]
GQQLLESTLRNVLDQQSLRWIFVGGKGGVGKTTCSCSLAVQLAKYRRNVLIISTDPAHNISDAFNQKFTRSPTKVNGFDNLFAMEVDGNLGDEDDKCTHNLGDEDDKCTHLPICIHLIHCFRFSADIFSIGKNFLADFAAGLPGVDEATSFSQMIKLIRSMDLIRSMDFEVVLFDTAPTGHTLRLLQFPTVIEKGLSKFLKAKTQFMPIVSQMMAPMLGLPDSTLDSTTDKLEETLQVVRQIKDEFRNPDLTTFVCVCIDLTTFVCVCIAEFLSMYETERLVQELAKQEIDVHNIIVNQLLFPDKNSDGSVSCKKCLCRFKVQQRYLAQITELYEDFHITKLPMLDEEVRGPEKIKQFSERLITPYSSAV

SEQ ID NO: 129302 - protein, 201 aa, Heterodera glycines
  Coding regions on vcDNA: vcDNA=SeqID_55725; Strand=+; Position=1 -136,188-399,891-1148
  Homolog annotation: Hit_ID=NP_496093.1; Match level="QueryCoverage =69%, HitCoverage=24%, E-value=3e-27, Identity=45%"; Hit description =natural killer cell-specific antigen KLIP1 like (2J994) [Caenorhabditis elegans] emb|CAB16487.1| Hypothet
LPLLVDIVKHRHELNSKSTAIHALLISPGQTRIFDKFEEVPNYALECSATENVVVLFPSKNSQSIAQFVRENGPLHRIVVLDSTWNTVGQLRNMANIAKLPMVHLRQYTTDYWRPQNGLSADHLATIEAIYYACVESQEAEREWRRTEERRRMGEGEEKEVRENGGSEEKAEEEQHRLDKLLFWFYFFRKMVPARIFRMKK

SEQ ID NO: 129303 - protein, 104 aa, Heterodera glycines
  Coding regions on vcDNA: vcDNA=SeqID_55726; Strand=-; Position=1 -96,167-354,525-555
  Homolog annotation: Hit_ID=XP_413919.1; Match level="QueryCoverage =71%, HitCoverage=12%, E-value=2e-16, Identity=60%"; Hit description =PREDICTED: similar to MAP kinase kinase [Gallus gallus]
MEKNGTEEEQTADDLTPKTMAIFELLDYIVNRPPPVLPRGLFSDQFVDFVNRCLRKNVAERATLALLATDAFYKRHERMEETAEFAAWVRSVIEHRNSNALLMG

SEQ ID NO: 129304 - protein, 170 aa, Heterodera glycines
  Coding regions on vcDNA: vcDNA=SeqID_55727; Strand=-; Position=1 -300,424-634
  Homolog annotation: Hit_ID=NP_491087.1; Match level="QueryCoverage =99%, HitCoverage=33%, E-value=4e-30, Identity=46%"; Hit description =MAP kinase kinase or Erk Kinase, Dual specificity mitogen-activated protein kinase kinase, involved in ra
MSSKRRNPLNLSLPPTVNEEGAVGADGAWVGGQPPTEGVGTEGTADASLDSKLRSLNLSGSQQQRMYEWITLKKQASDTAYWKWVNVGERKGTNWRKDNAIGELSDDVLERICDLGHGNGGVVHKMRHTKSGGGVVLARKLVHLEVKPSVRNQILKELEVLHKCNSPYIV

SEQ ID NO: 129305 - protein, 73 aa, Heterodera glycines
  Coding regions on vcDNA: vcDNA=SeqID_55728; Strand=-; Position=1-218
LQNGKKNGAIAGICQRQKLEESGQWATDLTAQKRALFAVRFRFRQCGRVGTRIGLPPAVTARKGKSRQKVAVA

SEQ ID NO: 129306 - protein, 107 aa, Heterodera glycines
  Coding regions on vcDNA: vcDNA=SeqID_55729; Strand=+; Position=1 -57,443-513,578-773
MSELSGDVLRKWNVLQSVPPSPSLANVKIGNKMQCMAKNICDINEMWKGAKLTKRFEIRKKCEEMVKNWEQMTKEISTEYENADNKNSALNKNGQVFLADFISARIH

SEQ ID NO: 129307 - protein, 127 aa, Heterodera glycines
  Coding regions on vcDNA: vcDNA=SeqID_55730; Strand=+; Position=1-384
MLGKRQFVLINHVIIIHFTLIKMLDTILTKPYIKVPVSPQNPSVQEDILSGVGLGMSFGAFGGGSFGLVLLGIAGGHYGALMNEQYTNCQTLVRACICNKATCVLNADERCLLSFLFYFFNEKIYLK

SEQ ID NO: 129308 - protein, 117 aa, Heterodera glycines
  Coding regions on vcDNA: vcDNA=SeqID_55731; Strand=-; Position=1 -73,946-1133,1294-1385
MLSFIYTDDISGLNGGNAMAVLYAGPYGILTAEELAGIKQYHSQSKMCGTPGFLLNYPLLFPSHQRNLSFEKIVMDIEKVSEFAAESTIRNCAELMKTKIVIANGRRQPFEVFRNYS

SEQ ID NO: 129309 - protein, 103 aa, Heterodera glycines
  Coding regions on vcDNA: vcDNA=SeqID_55732; Strand=+; Position=1 -97,528-742
MEMISEVNYVGQWTVSQWNGTEFAAPIMTKNCGTTFVRRGTTVMRRDTIVIGRGTKVIGRGTKVIRRGTTVIRRGTTVMRRDTIVIRRGTTVIKREETLKYND

SEQ ID NO: 129310 - protein, 27 aa, Heterodera glycines
  Coding regions on vcDNA: vcDNA=SeqID_55733; Strand=-; Position=1 -49,623-655
SCGCGRKHRLNLLPIVDTCVLKMIHAS

SEQ ID NO: 129311 - protein, 41 aa, Heterodera glycines
  Coding regions on vcDNA: vcDNA=SeqID_55734; Strand=+; Position=1-128
DDHSRKSSQIFEEGVRVGFAGDQGHTQTQHGNANVNRLSDC

SEQ ID NO: 129312 - protein, 73 aa, Heterodera glycines
  Coding regions on vcDNA: vcDNA=SeqID_55735; Strand=-; Position=1 -54,371-538
MASSRPGQFTHKNYPLRYALGLTKDVLKERKVVRIDIANDNEFLRAADILDNTRPSTFRSMKTGRGWPNEPTL

SEQ ID NO: 129313 - protein, 137 aa, Heterodera glycines
  misc_feature (91)..(91): Xaa can be any naturally occurring amino acid
  Coding regions on vcDNA: vcDNA=SeqID_55736; Strand=+; Position=1 -129,190-476
  Homolog annotation: Hit_ID=NP_497582.1; Match level="QueryCoverage =84%, HitCoverage=33%, E-value=4e-31, Identity=54%"; Hit description =transfer protein (3D660) [Caenorhabditis elegans] gb|AAK68521.1| Hypothetical protein Y54F10AR.1 [Caenorh
YPLRYVSFRGRGGNVINANLVVFFFSRKVPAFLRTIMPRGSTTLHERSWNAFPYCKTVVTNPDYMKDNFLIRIETMHLSDRGTTKNVWMEXHHHYKDVLKERKVVRIDIANDNEFLRAADILDNTRPSTFRSMKTGR

SEQ ID NO: 129314 - protein, 48 aa, Heterodera glycines
  Coding regions on vcDNA: vcDNA=SeqID_55737; Strand=-; Position=1 -68,337-412
MRKVSSREEIVQQRVKVANAKNDRIVMPLTIEEYQIGQLFSVAEASRQ

SEQ ID NO: 129315 - protein, 150 aa, Heterodera glycines
  Coding regions on vcDNA: vcDNA=SeqID_55738; Strand=+; Position=139 -181,247-476,691-870
MSLQYVGIAAVILGTAIALFQTVSLSTRRQIAAQNGRSSSSGSKRQSKSPSSAKTLAHKIAATVIAEKSLSSIPDNEILQLMDIGFQLLDEVLLRHPHRTAAAQAPTAAVPFAVPRRLRGPRRVQSGSHCAARLAEDPLLGQDHSAAWEP

SEQ ID NO: 129316 - protein, 54 aa, Heterodera glycines
  Coding regions on vcDNA: vcDNA=SeqID_55739; Strand=+; Position=1 -156,386-394
MTVVQIVQEHQNRPLCFATLSFCEQLPALFGETTHLIIDEAGQAPYVQSLNLWI

SEQ ID NO: 129317 - protein, 100 aa, Heterodera glycines
  Coding regions on vcDNA: vcDNA=SeqID_55740; Strand=-; Position=1-437
SKPRKKWSSKNRNYAQKASQTILALPIPSTIAFIHPIMSAKIIRVPKIACDLSLEKNGLSKNRNYAQKASQTILALPIPSTIAFIHPIMNAKIIRVPKIA

SEQ ID NO: 129318 - protein, 117 aa, Heterodera glycines
  Coding regions on vcDNA: vcDNA=SeqID_55741; Strand=-; Position=1 -255,771-869
MCTFCFIFVLSSFATCATDESNSNLAQRQNDQQFAIAEADPSATTVSSPHCPSCSDKSSASTMAQNGAYPTTEDRTKEFWTTDGTDDLCADHVSYLEPQTRTRTKSLKRFVHNISNF

SEQ ID NO: 129319 - protein, 41 aa, Heterodera glycines
  Coding regions on vcDNA: vcDNA=SeqID_55742; Strand=+; Position=1 -49,464-540
MGKLKNERSLNFMVKKRPAKEGIPFFIADWIIGEKELPTLD

SEQ ID NO: 129320 - protein, 351 aa, Heterodera glycines
  Coding regions on vcDNA: vcDNA=SeqID_55743; Strand=-; Position=1-1054
  Homolog annotation: Hit_ID=NP_001004509.1; Match level="QueryCoverage= 99%, HitCoverage=23%, E-value=6e-36, Identity=29%"; Hit description =si:busm1-180o5.3 [Danio rerio] emb|CAD60788.1| novel protein similar to DNA polymerases [Danio rerio]
MRDQLAIVPECGYDTTNTQSLIALKFLDWYAKKNGVSIQTAHSPDGEKKIGQYTVDGYIASTDTVIEVNGCHWHAHDHPRHRFQPQTVMANGKTAQRIREDDARRMVFITSQVQQVLVFWECEINAEKRNNDEMKRAFAQYKDSGPIRLKDCYHGGRVGPQRLHYEVPEGWRMKYYDVRSLYPHTNAVTAYPVGHPTRVNIIGEAEQAVDWRRADQVPIRGILKVFVVPPHHVDVPVLPVKFDQRLLFPLCRTCALQHPHGSVNEDYECTHREDDERGWVSTVTSIELEEALRNGYRCTAYYRSVEWDDTQWSDRVFRGYVAEFMAMKTHASGFPDEIGTTKEDQQQFIEE

SEQ ID NO: 129321 - protein, 74 aa, Heterodera glycines
  Coding regions on vcDNA: vcDNA=SeqID_55744; Strand=+; Position=1-225
MPLNQQMKNYNSNHLTKYLEKNGKKKKKNKMKRKSSKKEENIHEKNGNKIMPKFAKKLGTNRTKIYKWIKEFGL

SEQ ID NO: 129322 - protein, 251 aa, Heterodera glycines
  Coding regions on vcDNA: vcDNA=SeqID_55745; Strand=+; Position=1 -97,608-782,911-1085,1274-1339,1394-1636
MRQNGGYLNPNDCTKCHCPDGYGGQYCDALEESAKLCCPRALTDLNGNEYKNWIEAEKPDMDIVISAHLSPNWTVPSTVFELTFESGKEKFKCVKIENLYAEKRNPGTGTLRCYNPTKNQYYNCSCNGDKKCLAEEKWAHDRFLCPIIQVNGIQIQIDYRYNWTRLDVDCYKAEGGTVSFWGYSKPETKEIIRVDEIHCLTFEAAGVTPPSQKRFKSLQVEEHLSMKLNPSTLLGNASSLIHVFVPFVGHP

SEQ ID NO: 129323 - protein, 54 aa, Heterodera glycines
  Coding regions on vcDNA: vcDNA=SeqID_55746; Strand=-; Position=1 -71,398-491
MQTTNDERKAKTQQWKSTNSCSLSVIIWFKFSLSWENHGREVRASPLLYGPDTV

SEQ ID NO: 129324 - protein, 860 aa, Heterodera glycines
  Coding regions on vcDNA: vcDNA=SeqID_55747; Strand=+; Position=1-2583
  Homolog annotation: Hit_ID=XP_320889.1; Match level="QueryCoverage =88%, HitCoverage=90%, E-value=1e-142, Identity=36%"; Hit description= ENSANGP00000012033 [Anopheles gambiae] ref|XP_313651.1| ENSANGP00000013044 [Anopheles gambiae] ref|XP_31
MASKEELKTILEAQQKQFLELMKTLMSKNEAPAHSDLFSKLNSQIPDFRYDPENDSTFSLWYERYGQFVEKDGQALSDDMKVRLVLGKLSATDFIRYEQQVLPKKTAELSFQETITNLKALFSDTKSVFVRRFECFQLTCSPGQDVLDFGATVNAKCERADMNLSKEEIKCLIFVTGLGEMHRDLRQECLRQMEKARKVTPPRDIKLEALLEECRSIQSLQHSAAALANPGQVHAIPSKPKILSDGRAKNWQSNSKNWPSKPIQFQKFSGNNSYGRNNGFQNKLVKPQDKNVEQQKCKRCGRAHLLKECRYPVDVQCFGCGQRGHIKTNCPSSAKSNSIGVASIFSVANSKRGWIWTELVVNGHPINLAADSCSDLTIIQRPVWISLGEPKLEGAGRLVGSFSGHKLKLLGGFKCKVVFRGVELNLFCSVADTDAPSIMGLDWIEPFERHTQMPIATTLKVVSAGNSGPVSCTIQSSDPTQLAKEVRAKFPKVFQPGLGRCTKMRAKLHLKENAKSVFCRARPVPHGVQEAVDREIDRLLEIDAIRPIDFSKWAAPVLAVRKKNGAVRICIDFTTGLNEALELNRHPLPRTDDIFHSLRGSKIFSQLDLRDAYLQLELDDESKTLVGINTHRGLFQYQRLPFGVKSAPSIFQKVMDQLTSGISGVFVYLDDLIIASPNMAEHLLVLEKLFSRIQDYGFRIQLDKCHFVQRELKFLGHIVSADGIRPDPSRSAAIREMPPPHDLGTLRSFLGAINYYGRFIKEMRAIRAPLDLLLKKETPWDWGPTQQNAFEQAKRLLQSELLLTHYDPEKPIIVAADASQHGIGATISHKFPDGSEKVVEHACRSLTSAERNYSQIEREA

SEQ ID NO: 129325 - protein, 46 aa, Heterodera glycines
  Coding regions on vcDNA: vcDNA=SeqID_55748; Strand=-; Position=1-138
QNAISSDLPLQFPHQFPSNFRPFASFLSPILSSQCPSSVSSLFFSL

SEQ ID NO: 129326 - protein, 140 aa, Heterodera glycines
  Coding regions on vcDNA: vcDNA=SeqID_55749; Strand=-; Position=1-424
DEFGGMEENCVMEGPGLGFNCGGIEGDEFGGMEENCVMEGPGLGFNCGGIEGDEFGGMEANCVREEVGMAFEWEGIEDEEFGGRDANCVREEVGMAFEWEGIEDEEFGGRDANCVRKGVGMKFKGGGIEDEEFGRREEEG

SEQ ID NO: 129327 - protein, 97 aa, Heterodera glycines
  Coding regions on vcDNA: vcDNA=SeqID_55750; Strand=+; Position=1-294
MTFQSLGLNPPAFQSLGLNSPAFQSLGLNSPAFQSLALNPPTFQSLGLKSPALQTLGLNPPTFNDIPIAGTQPTSISISGTQFSCISITGTQPTNFQ

SEQ ID NO: 129328 - protein, 92 aa, Heterodera glycines
  Coding regions on vcDNA: vcDNA=SeqID_55751; Strand=+; Position=1 -271,1242-1249
  Homolog annotation: Hit_ID=B44982; Match level="QueryCoverage=47%, HitCoverage=45%, E-value=7e-11, Identity=68%"; Hit description =collagen COLA4 - pig roundworm gb|AAA29370.1| collagen
MCPVLHRQAHPDVPARSDPLAHLDRPERKVRENPLGYIKAFMHLSSTTGKLGESGPQGPQGDQGNPGPYGKPGALGAQGPPGQPGAVGSCAH

SEQ ID NO: 129329 - protein, 25 aa, Heterodera glycines
  Coding regions on vcDNA: vcDNA=SeqID_55752; Strand=+; Position=1 -30,251-298
MNFRAVFCFSENANIFYYLIIIFGI

SEQ ID NO: 129330 - protein, 171 aa, Heterodera glycines
  Coding regions on vcDNA: vcDNA=SeqID_55753; Strand=+; Position=1 -175,334-451,537-678,898-978
MSHNQPKKAKYEQAQEKEDKAPLTDDAEKKEAKADKASLTDDAEEKKQKMTEKEITVLRLHMYFFKKVRTKLYTVIMRTNQLLQHQQKCLCRKMAPVLRFHYHLMRDEEENIFDIEVALAAIIGEEKIFGHHFDGSESDIEQATRNLKAMIEEEGSNNFGCMRDFSVNFSH

SEQ ID NO: 129331 - protein, 49 aa, Heterodera glycines
  Coding regions on vcDNA: vcDNA=SeqID_55754; Strand=+; Position=1-416
IFYRFLNVWIFFGLPKLHRTWLFLFSFKSPQIFLQLNYAILSLFPENLA

SEQ ID NO: 129332 - protein, 94 aa, Heterodera glycines
  Coding regions on vcDNA: vcDNA=SeqID_55755; Strand=-; Position=1-418
FEYPKRTFEKFDFFVFGAVPPNRCAQIYGETESFGNSFPIACTLILRWIFAPHNCLSTPNGHLKKSIFLFSGQSPRTDAPRFMGRPNPSGIASL

SEQ ID NO: 129333 - protein, 43 aa, Heterodera glycines
  Coding regions on vcDNA: vcDNA=SeqID_55756; Strand=+; Position=1-180
MFGFFFGLPKLHRTWLFLFSFKSPQIFLQLNYAILSLFPENLA

SEQ ID NO: 129334 - protein, 89 aa, Heterodera glycines
  Coding regions on vcDNA: vcDNA=SeqID_55757; Strand=+; Position=1-466
LFEYPKRTLEKIDFFVFGAVPPNRCAQIYGETESFGNSFPIACTLILRWIFAPHNCLSTPNGHLKKSIFLFHKYFFRKCSKAHQILFTS

SEQ ID NO: 129335 - protein, 157 aa, Heterodera glycines
  Coding regions on vcDNA: vcDNA=SeqID_55758; Strand=+; Position=1 -325,375-523
MGRHRRYPMKKTAKNTNQAQKIERLSFDTDQTPLQTPKDSRKNKFSILEHRDLEKSPYRNMNKKPSNSMLEEQPTTWKEQMLKKLTDEVAQQKNKIQKRNKKPKNRLLEETQKLGYHHMPWESAKTLIYRIQQDQNKAINEELLKVGNWIFCFYPSF

SEQ ID NO: 129336 - protein, 80 aa, Heterodera glycines
  Coding regions on vcDNA: vcDNA=SeqID_55759; Strand=+; Position=1 -93,141-290
MDSADRRSPTPDMELCELSSWYDILQDDDDNILNWFTPVTARDVCQEVLAFAQERRMPFEKIVKWKQILDKICAQIAQNK

SEQ ID NO: 129337 - protein, 90 aa, Heterodera glycines
  Coding regions on vcDNA: vcDNA=SeqID_55760; Strand=-; Position=1-271
MTRANDLLIICLIIFVVPTGVLDADDALSVFVSYSNSGYTNAKFSIHPRVMQNTGGSRGRLTLDIENFEDFLMEDEGKRESVIRVIRGLP

SEQ ID NO: 129338 - protein, 58 aa, Heterodera glycines
  Coding regions on vcDNA: vcDNA=SeqID_55761; Strand=-; Position=1 -99,479-556
MSELVAECLQFDFSEIPNIFAVYSECLKLKGPNAIRWAQNQCQEKEDEQNASHWISAE

SEQ ID NO: 129339 - protein, 77 aa, Heterodera glycines
  Coding regions on vcDNA: vcDNA=SeqID_55762; Strand=+; Position=1 -192,650-691
MALNTSNLMFLIATGFVGGLSKKLFVFIRFTFLARPLFASSEIRRSNAPEMPHKICLWARTCLKEYVHQRNEKGLFT

SEQ ID NO: 129340 - protein, 110 aa, Heterodera glycines
  Coding regions on vcDNA: vcDNA=SeqID_55763; Strand=+; Position=1-333
MRLDLAPNAHGNDWPYAELKSAVSSANFLERPRPTKRAISDAIISAIPTTSFLSSPSAFDAGLLLSPLPVTNRIGHLLREFSDRQKAICAQHFGIGTVLGNKVGSIVIDN

SEQ ID NO: 129341 - protein, 38 aa, Heterodera glycines
  Coding regions on vcDNA: vcDNA=SeqID_55764; Strand=+; Position=1-116
MILSMIFHQVLGFFQNFKKLNERKNSWTDGGENCILLS

SEQ ID NO: 129342 - protein, 63 aa, Heterodera glycines
  Coding regions on vcDNA: vcDNA=SeqID_55765; Strand=-; Position=1 -134,983-1040
MSSSLDVFKLTDDDAMKFLLCESHIGTKKDGLPNGALCVEASIRRSPLTSVPRQSLAVSRPAL

SEQ ID NO: 129343 - protein, 49 aa, Heterodera glycines
  Coding regions on vcDNA: vcDNA=SeqID_55766; Strand=-; Position=1-149
VNIDHRPQTQKCLKTVRIDVKRFEMCWKNRIRGALALFQDEKCRKWSAK

SEQ ID NO: 129344 - protein, 44 aa, Heterodera glycines
  Coding regions on vcDNA: vcDNA=SeqID_55767; Strand=+; Position=1 -65,123-192
MQKCKKKLVKIKNGKCKNILKRQKENLVDDKPGLGSVLICQICF

SEQ ID NO: 129345 - protein, 149 aa, Heterodera glycines
  Coding regions on vcDNA: vcDNA=SeqID_55768; Strand=+; Position=1 -61,107-136,178-240,307-366,2337-2381,2429-2482
  Homolog annotation: Hit_ID=AAP30775.1; Match level="QueryCoverage =99%, HitCoverage=63%, E-value=5e-41, Identity=63%"; Hit description =putative gland protein G32E03 [Heterodera glycines]
MRAILFLAMVCLVMAVILETANSKAVKNKNSKAVKNKKVKGTITTPAKGKAAPKGAAKGGKVKGTITTPAKGKAAPKGAAKGGIIKKDAKSKGKGKKDAKGKKDKKAKPAKGKGVPKNDNKSPAAKANDKKSPNKSPAAKANDKKSPSK

SEQ ID NO: 129346 - protein, 26 aa, Heterodera glycines
  Coding regions on vcDNA: vcDNA=SeqID_55769; Strand=-; Position=1 -72,150-158
MSIIDSFVVPYPISSGILVNQFLLAL

SEQ ID NO: 129347 - protein, 136 aa, Heterodera glycines
  Coding regions on vcDNA: vcDNA=SeqID_55770; Strand=-; Position=1 -82,167-258,368-514,558-647
MEKVDVDTQTDDGTEGMEITDDEKIILTVKEASRAVVAHESVWSDPVEMAYARNGKGETRRRKHCEKLGGKHQQLEDVEFCLAAKLGVEIVLKRTIASDEDITEATNTVGTWSKDQAHIARKQEFVVGTVMMVFWV

SEQ ID NO: 129348 - protein, 50 aa, Heterodera glycines
  Coding regions on vcDNA: vcDNA=SeqID_55771; Strand=-; Position=1 -55,469-566
MFMNCLKCWFHCLITKIKFRKLFVLTPLFITRNHYFGASPLKKTILEVGH

SEQ ID NO: 129349 - protein, 119 aa, Heterodera glycines
  Coding regions on vcDNA: vcDNA=SeqID_55772; Strand=+; Position=1-360
MASVRHRNPMAVLVVVLSSSLFSPAFALAPLRQCAASLECATGGRLATLHNGGEPALVACQQFRVRHQLLHHCALPLPSWNPRGVEVDLGFVDVANLGEKTIIYGKNRFFFSIAQFNRS

SEQ ID NO: 129350 - protein, 51 aa, Heterodera glycines
  Coding regions on vcDNA: vcDNA=SeqID_55773; Strand=-; Position=1 -87,176-241
MNYDELSILKEETVVKTNGESFTDGQQMKELREKFEKMELILKNTKLELKN

SEQ ID NO: 129351 - protein, 90 aa, Heterodera glycines
  Coding regions on vcDNA: vcDNA=SeqID_55774; Strand=-; Position=1 -196,944-1020
MAPWHSKMRKHCEWKNVNGPKFELTKQREKWGKIGKESEKAGGEVSAKMKTKVNSKINGKAAGQKEMNYDELSILKEETVVKTNGESFTD

SEQ ID NO: 129352 - protein, 31 aa, Heterodera glycines
  Coding regions on vcDNA: vcDNA=SeqID_55775; Strand=+; Position=1-93
AIWSDNLEILLTGCVRTECLFSVAKTTQSFA

SEQ ID NO: 129353 - protein, 52 aa, Heterodera glycines
  Coding regions on vcDNA: vcDNA=SeqID_55776; Strand=-; Position=1 -50,134-242
MVGQLGDFVDGLCEDGVSIEVIEQEMASFFGKTLETELNLEPKVVLKSQPAT

SEQ ID NO: 129354 - protein, 42 aa, Heterodera glycines
  Coding regions on vcDNA: vcDNA=SeqID_55777; Strand=+; Position=1-126
MRECWISVPVIQNIFDEGGRENNFNKERNGKGVHVSSSLILL

SEQ ID NO: 129355 - protein, 50 aa, Heterodera glycines
  Coding regions on vcDNA: vcDNA=SeqID_55778; Strand=-; Position=1 -107,734-779
MWITVRTPNSFGNKRILEICPGKFTQAFSESTLYGSESAEEVAAATQIAR

SEQ ID NO: 129356 - protein, 121 aa, Heterodera glycines; identical to SEQ ID NO: 128908
  Coding regions on vcDNA: vcDNA=SeqID_55779; Strand=-; Position=1 -184,211-352
  Homolog annotation: Hit_ID=EAK91016.1; Match level="QueryCoverage =91%, HitCoverage=90%, E-value=2e-26, Identity=62%"; Hit description =hypothetical protein CaO19.6835 [Candida albicans SC5314]

SEQ ID NO: 129357 - protein, 104 aa, Heterodera glycines
  Coding regions on vcDNA: vcDNA=SeqID_55780; Strand=+; Position=1 -153,677-836
  Homolog annotation: Hit_ID=NP_609026.1; Match level="QueryCoverage =49%, HitCoverage=10%, E-value=5e-13, Identity=60%"; Hit description =CG9523-PA [Drosophila melanogaster] gb|AAF52381.2| CG9523-PA [Drosophila melanogaster] gb|AAM11387.1| LD4
MNWVLLRAGFPPVSIPVEQRHRYYHVLREANDGDLRPFIRFIAELTDRTLESLIAGSVSSVCEIGDDCSASSSSSSSSSAGGGDAIDATTNGPKEGEEEALDAN

SEQ ID NO: 129358 - protein, 130 aa, Heterodera glycines
  Coding regions on vcDNA: vcDNA=SeqID_55781; Strand=+; Position=1 -162,213-272,371-541
KAELSEHYKFNLTRLTDIDVIAKKDYPFSVSFNRLNTSNFKKASVPSWAVNFIRLKGEHIKLLDRPSVLNEEKKQILWGYAKQLSMTIVVVVVFVVYSSFIITPFIKKNNNLNLTASLDTVLNYGDEVFL

SEQ ID NO: 129359 - protein, 138 aa, Heterodera glycines
  Coding regions on vcDNA: vcDNA=SeqID_55782; Strand=+; Position=1 -130,453-526,892-1101
MPKCAVSAQKSAEITEAECTGIHNFKIIFQFLYYPKTIIFDRFVGDTLLLLEFDLSKPNISCKNYLHENHDFSIGPESTHKLNKYGQHFHLLINATAKHFAIRIDQVGFQLDCKYGISKKFSYDKYYIYPPWAVDKIQ

SEQ ID NO: 129360 - protein, 58 aa, Heterodera glycines
  Coding regions on vcDNA: vcDNA=SeqID_55783; Strand=-; Position=1 -90,259-345
MEFLNEIHGISWPLFELNGLGRLDIVLFPSVGMEVNVKNTLQLYYVSPLLKGVSYNYT

SEQ ID NO: 129361 - protein, 124 aa, Heterodera glycines
  Coding regions on vcDNA: vcDNA=SeqID_55784; Strand=-; Position=1 -160,467-678
  Homolog annotation: Hit_ID=NP_065919.2; Match level="QueryCoverage =79%, HitCoverage=12%, E-value=4e-10, Identity=36%"; Hit description =dipeptidylpeptidase 10 isoform 1 [Homo sapiens]
MTLLKHKFSQSPQLKELSVASPQERNWRGIATALLVIVAMCSIIALAVLVLTPPLLDADQPQKRVTLADVLTHRFLNSVESLEWLDSRRLLVKEAESVRVLELNEGAENGGPIGWTWKTLPGDL

SEQ ID NO: 129362 - protein, 297 aa, Heterodera glycines
  Coding regions on vcDNA: vcDNA=SeqID_55785; Strand=-; Position=1 -196,371-601,652-808,857-966,1019-1216
  Homolog annotation: Hit_ID=NP_506383.1; Match level="QueryCoverage =78%, HitCoverage=24%, E-value=3e-22, Identity=34%"; Hit description =RNA helicase (5O149) [Caenorhabditis elegans] emb|CAB03153.1| Hypothetical protein F58G11.2 [Caenorhabdit
MVAGREEAEERRVVVLEEGPMQLVGYLSVVIWIIFNFIPQNSVQETVAVLDMVPIQLVCHSRKFESQNGGLGNARPNAENNGRGRESYGDRRGGGRGSEGDGGERFGRGRGVRGRPEFGERPPNHSQRGPFANGGDERFPRDEQGLSRPRHTYKKRSIECLYEEDFLVSERYVDIRDEDEDLAVFGHNEKFTSYETWKDFNLEPKLVDNINRCKYVLPRKIQSYTFPLIRDGYDVKAHAETSSGKSAAFLLPIIDRIMKLKKECAFKSKRGCPYALILSSARELVIQVYEQARKLCD

SEQ ID NO: 129363 - protein, 329 aa, Heterodera glycines
  Coding regions on vcDNA: vcDNA=SeqID_55786; Strand=+; Position=1 -120,674-1303,1374-1520,2176-2266
MDPPPSHPKNQQTQSANAFSANAAPAPLLTYGRGIFGFIFHAEVVDQQCYQQQSADSVGYGPLVPAAFVSVPLEQQQQASQKGAVTSSAAKPLPQQHFVPPPPSFYTAGNRSSNAAAAALLGVVPPPPMLPPSVGGSAVVGPPPPTAYATQQQQSINAVTSSSAKLLPQQPPQPFYAAGNYSSKAAAASMFGVMPRPPMLCPWGGGSAVIGPPLPAAYAAQQQQPIDPMPSLSSTLDYGQQQHSSFQHQQMVGPTSSTADLHQKLFVPTAEDLSDSMIYPFDVTHLFCREKTSEILDPQLDEGLKKAKQQVSSVANAQSSDEQRRKLLT

SEQ ID NO: 129364 - protein, 182 aa, Heterodera glycines
  misc_feature (13)..(13): Xaa can be any naturally occurring amino acid
  Coding regions on vcDNA: vcDNA=SeqID_55787; Strand=+; Position=1 -222,348-449,530-742
  Homolog annotation: Hit_ID=NP_741917.1; Match level="QueryCoverage =98%, HitCoverage=45%, E-value=2e-72, Identity=77%"; Hit description =UNCoordinated locomotion UNC-9, OPUS protein, innexin family member (45.2 kD) (unc-9) [Caenorhabditis ele
PYYDPIPLKVSHXYFCHFVLAPVHSLFPSQGIHVQSLVQMACDSRLLDADSRQRAMQTIATNVEEALHVKHQALGGNRFRMLNMIICTRSSGAAVTFLYISVKMLYTVNIVVNIVGQIFLLNTFLGNRSRWYGLQVLNDLMNGHEWEESGHFPRVTLCDFEVKVLGNVHRHTVQCVLMINMS

SEQ ID NO: 129365 - protein, 94 aa, Heterodera glycines
  Coding regions on vcDNA: vcDNA=SeqID_55788; Strand=+; Position=1-657
SVHLNNFYPKNFFWVFGAVPLNRCAQIYGETESFRNSFPIACTLILRWIFAPHNCLSTPNGHLKKSIFLFSGQSPRTDAPRFMGRPNPSGIASL

SEQ ID NO: 129366 - protein, 45 aa, Heterodera glycines
  Coding regions on vcDNA: vcDNA=SeqID_55789; Strand=-; Position=1-135
EKGHKTDNVALAEQRQSVTKRVRGSQQKLSLIHADLELLSVRATD

SEQ ID NO: 129367 - protein, 123 aa, Heterodera glycines
  Coding regions on vcDNA: vcDNA=SeqID_55790; Strand=+; Position=1 -113,467-540,618-802
MIVVTIRTKLMRSAVEHHDHVPSPSFAATTGAVFRTPRSAMGPSNALTDLTNRSAPRANVWTACANVRTAHAFRTTNGAIVAATVPMRRTSATAPTIRTVASAPSTNLSAPTVCAFRASSCGF

SEQ ID NO: 129368 - protein, 202 aa, Heterodera glycines
  Coding regions on vcDNA: vcDNA=SeqID_55791; Strand=-; Position=1 -237,412-783
  Homolog annotation: Hit_ID=CAG77941.1; Match level="QueryCoverage =87%, HitCoverage=28%, E-value=7e-11, Identity=30%"; Hit description =unnamed protein product [Yarrowia lipolytica CLIB99] ref|XP _505134.1| hypothetical protein [Yarrowia lipol
MQQHPMHHHPHYQQPQFAYPPPPLSAPNAGTGAHMQQQPTPPPQAAQLHAMAASATPTGLFIYATNFGTFQQAAAAMGPPNELIGPMPGQHQQHPMHHHPHYQQPSFAYPPPPLSAPTVSTGGAHMQQQQTPPPQTAPPTHHQHVMPTALFGYNPNIGPFHPPPAMGPTVEQPHQQVFFFSFSRIQNKCFEEKNKKNLKTAE

SEQ ID NO: 129369 - protein, 110 aa, Heterodera glycines
  Coding regions on vcDNA: vcDNA=SeqID_55792; Strand=+; Position=1 -83,148-397
MALSSLIELGKNRQQTQRDEAENGIDNDDCRFDGSVAVSSPSVISSTFAATPANCSAETFQSHANGTHNVTTIKTEDNESGDELPPQGNAKKQTNEGILNAKQKIRIPLF

SEQ ID NO: 129370 - protein, 135 aa, Heterodera glycines
  Coding regions on vcDNA: vcDNA=SeqID_55793; Strand=-; Position=1 -38,349-472,512-757
MGHVVFINKFEKYSNLVADYNGYSIFEDLQLGDPTFKDPTFETNSMTINQGDLWPNLINKITQIGELYRSAKLFENPSAVTQQLFAKLNLPNGNWNPGSKDWWTRYSGVILNILDIWGTHGMPEIACLLGVSVTI

SEQ ID NO: 129371 - protein, 94 aa, Heterodera glycines
  Coding regions on vcDNA: vcDNA=SeqID_55794; Strand=+; Position=1 -214,291-361
MCKFASFLVIFFAVFLLFAKGDAMKLKSTKDWIKKKFSSTSSPFSSQSVSSSSFHNPLIESSFSFNPPEEKAITAAHFFQKLLGTGTDIICDSR

SEQ ID NO: 129372 - protein, 87 aa, Heterodera glycines
  Coding regions on vcDNA: vcDNA=SeqID_55795; Strand=+; Position=1 -103,1207-1349,1420-1437
MVIALLLSSALRLLSMLRVLTLPFRLLSANLPSECLKIFSLLVRLIEHVKSFRVIPTMLYLDVKEKSYRGKRAGAETQAPKRKIFVF

SEQ ID NO: 129373 - protein, 271 aa, Heterodera glycines
  misc_feature (263)..(263): Xaa can be any naturally occurring amino acid
  Coding regions on vcDNA: vcDNA=SeqID_55796; Strand=+; Position=1 -28,275-409,457-548,611-773,876-1041,1753-1872
  Homolog annotation: Hit_ID=CAE66740.1; Match level="QueryCoverage =96%, HitCoverage=62%, E-value=8e-63, Identity=49%"; Hit description =Hypothetical protein CBG12090 [Caenorhabditis briggsae]
FHYCTKINANDILINEVIKRFTPNPVLVIIQASQGRQDLALPTDAYVEVQEVHNDGSPPVKTFEHVPSEIGAEEAEVHNDGSPPVKTFEHVPSEIGAEEAEEVGVEHLLRDIKNQTAGTLDIKNQTAGTLSQRIAKSVDGIRGLENHLAGFTSYLHRVASRELPINHAIIFLIQEMEMLNLLPEVLSPDFVDAHNVQTNDHLMCVYIGSMVRTIIALHNLIDNKVRKGDEAQKVAEKSAKEKTVKETEKNEANDKEIVKNTKXLYDHFAGK

SEQ ID NO: 129374 - protein, 48 aa, Heterodera glycines
  Coding regions on vcDNA: vcDNA=SeqID_55797; Strand=+; Position=1 -134,170-182
MVDELTSSTKIDRNKNSYGIEDLIVIQNYFDTKFPNRFLIVAFSRNMG

SEQ ID NO: 129375 - protein, 102 aa, Heterodera glycines
  Coding regions on vcDNA: vcDNA=SeqID_55798; Strand=-; Position=1-309
NFILYLYQLMHFLQKFGITTGIPQKTGIATGIPKNPGITTGILKSPKLRLGSHKRPGLQLGSRKIQGLRRGSLNPRNYDWDPTKDRDCNWDPAKSRDYDGDP

SEQ ID NO: 129376 - protein, 288 aa, Heterodera glycines
  misc_feature (43)..(43): Xaa can be any naturally occurring amino acid
  misc_feature (66)..(66): Xaa can be any naturally occurring amino acid
  misc_feature (105)..(106): Xaa can be any naturally occurring amino acid
  misc_feature (120)..(120): Xaa can be any naturally occurring amino acid
  misc_feature (165)..(165): Xaa can be any naturally occurring amino acid
  misc_feature (173)..(173): Xaa can be any naturally occurring amino acid
  misc_feature (193)..(193): Xaa can be any naturally occurring amino acid
  Coding regions on vcDNA: vcDNA=SeqID_55799; Strand=+; Position=1 -42,641-1477
  Homolog annotation: Hit_ID=AAG37886.1; Match level="QueryCoverage =98%, HitCoverage=71%, E-value=6e-57, Identity=50%"; Hit description =transposase [Tn10 delivery vector pHV1249]
LIFLKIMIFDFYFFPPTIHVSLLKKLLVPSPVLLVMQRTTTSXLDRNLPSKAEIISLLAVRSRMAXDHALRRNFLGADRCLAMYMRPRDTITMVGGYCSDIRESXXNMWLLCPRSLDIRXGTLNEKPCPVSEHCSFRAHDQFLELAWKISTVLTPPLIVQDAGYXVTCHVSRXKLSSYWLRRVKRVLLHVHQXAKTWPAIRRLHDMPRHSNTLTIERLTISNPISCTILLYKSRSKGRKARSTQTHCHHPSPKIYSASGKEPWVLATNLPVEIRTPQQLVIYSKGMQI

SEQ ID NO: 129377 - protein, 47 aa, Heterodera glycines
  Coding regions on vcDNA: vcDNA=SeqID_55800; Strand=-; Position=1 -47,83-179
MLTIFARQGPTILTEKQLRNSRSRIPSAFSSSFPVLVNFLKKWEEVH

SEQ ID NO: 129378 - protein, 62 aa, Heterodera glycines
  Coding regions on vcDNA: vcDNA=SeqID_55801; Strand=-; Position=1 -168,728-748
MAIKLASFCPIFLFLLLLPILSTFSLSPKLNSSVADAVVSCGVPPLNKNFTRFDYLVYLSKY

SEQ ID NO: 129379 - protein, 18 aa, Heterodera glycines
  Coding regions on vcDNA: vcDNA=SeqID_55802; Strand=+; Position=1 -27,79-106
MDKQMSLIIDGEKKDTFG

SEQ ID NO: 129380 - protein, 143 aa, Heterodera glycines
  Coding regions on vcDNA: vcDNA=SeqID_55803; Strand=+; Position=1 -96,466-542,609-670,725-754,808-896
  Homolog annotation: Hit_ID=NP_493429.1; Match level="QueryCoverage =100%, HitCoverage=6%, E-value=5e-42, Identity=62%"; Hit description =predicted CDS, mechanosensory transduction channel NOMPC (1O503) [Caenorhabditis elegans] emb|CAC14420.1|
GRTPLHEVAKLGDEKMLKIMWKMNADANIRDKEDKTPLHVAAERGHTQVVETLIDKFGSSIRARTKDGSTLLHLVSAEGHADTALAFLKEGHADTALAFLKRGVPLYMPNKSGARGVPLYMPNKSGAVSLHKAAAAGYNEVVK

SEQ ID NO: 129381 - protein, 505 aa, Heterodera glycines
  misc_feature (491)..(491): Xaa can be any naturally occurring amino acid
  misc_feature (501)..(501): Xaa can be any naturally occurring amino acid
  Coding regions on vcDNA: vcDNA=SeqID_55804; Strand=+; Position=1 -153,734-796,841-926,1175-1223,1548-1682,1735-1863,1965-2027,2435 -2488,2539-2649,2694-2770,3251-3350,3402-3545,3834-3958
  Homolog annotation: Hit_ID=NP_493429.1; Match level="QueryCoverage =96%, HitCoverage=54%, E-value=1e-126, Identity=32%"; Hit description= predicted CDS, mechanosensory transduction channel NOMPC (1O503) [Caenorhabditis elegans] emb|CAC14420.1
ILINRGTKVDIPTRDNYTALTVAVRSGQASVVETLLGFGADVHITNGQIGETALHVAAGLPCGDIECAQMLLKSGAQPNVQRVQDGRTPLHIAVMLLKSGAQPNVQRVQDGRTPLHIAVNKLCFFLCRLLLAEGADAQLKSKNGETALHLAAKHCHFPVVQLLLDHLSSSKDADSMRSFVNAITEDGQTDGQTCLHYASQIGPEQVHFKDEDAKIVSLLIDNGGDSELQALSNLETAMHMCARTGNESILLAMVNKIGPGAVQIVQNKKSKNGWSPLLEACARGHVGNGWSPLLEACARGHVGVSRILLQHHARIDVFDDAGRTALHLASANGHIELTKLLLKYKAFVTALHLASANGHIELTKLLLKYKAFVNSKAKNGEAPLHLAAQYGHPRVVSMLVQEHGASLEAITLDNQTAITLDNQTALHFSAKYGQLVVSQTLLALGANPNARDDKGQTPLHLAAEDSAPCAINADQSALTPPRSFLLSIRGXRNASAETLQXRHSL

SEQ ID NO: 129382 - protein, 115 aa, Heterodera glycines
  Coding regions on vcDNA: vcDNA=SeqID_55805; Strand=+; Position=1 -34,482-616,734-781,856-961
  Homolog annotation: Hit_ID=NP_493429.1; Match level="QueryCoverage =93%, HitCoverage=5%, E-value=4e-41, Identity=79%"; Hit description =predicted CDS, mechanosensory transduction channel NOMPC (1O503) [Caenorhabditis elegans] emb|CAC14420.1|
ASLKRGHIAAENDFPDVVKLFLKMKQNNHAVLTAVDHSGFTCAHIAAMKGSLAVVKELMMIDKAMVIQAKTKCLEATTLHCLEATTLHMAAGGGHAKIVKILLENGANPEDENAL

SEQ ID NO: 129383 - protein, 179 aa, Heterodera glycines
  Coding regions on vcDNA: vcDNA=SeqID_55806; Strand=+; Position=1 -431,569-674
  Homolog annotation: Hit_ID=CAE73588.1; Match level="QueryCoverage =100%, HitCoverage=20%, E-value=6e-10, Identity=31%"; Hit description= Hypothetical protein CBG21069 [Caenorhabditis briggsae]
KELADRHVLISSQNEKISQLDNAIAKQQQLRHLFLYENGGQNERVVGEAEKTRECMAGEDSGGAEKQTQQQQHNELDRTRHEMDRLLERVRELEREKRQRQQRQQHVGGMTTAETVDTGDVGKMPSEDTASNGIDEQTDALKHRIHELEEALRESVGITSEREKALAEQKKVNQKLSDQ

SEQ ID NO: 129384 - protein, 137 aa, Heterodera glycines
  Coding regions on vcDNA: vcDNA=SeqID_55807; Strand=+; Position=1-414
MLSSDSKSSPSTRLFNETFRFCVLAVLFGLLKFPTTPFCCCCNAAASRARCLVNGGERLIIFLKQHEFYWRILKSTTRVLYWRILKSTTRVLYWRILKSTTRVLYWRILKSTTRVLYNSVGCMKSPTRGQKNDNVDI

SEQ ID NO: 129385 - protein, 24 aa, Heterodera glycines
  Coding regions on vcDNA: vcDNA=SeqID_55808; Strand=-; Position=1-74
TTWLNASDLPKDGGEWTLWQRRIP

SEQ ID NO: 129386 - protein, 52 aa, Heterodera glycines
  Coding regions on vcDNA: vcDNA=SeqID_55809; Strand=+; Position=1 -144,811-825
MGRSKLLRKAIHLGAQFLASFLMGKCKIIIIWSAFLVIRKLMIHYVDKDENG

SEQ ID NO: 129387 - protein, 125 aa, Heterodera glycines
  Coding regions on vcDNA: vcDNA=SeqID_55810; Strand=-; Position=1 -25,198-273,763-1039
MKFMKIMQEECARKIQFSLSNGKEIIENGNLLSAVAKTNEIALRIFRRIKACPFLEEFAGLWLLPADIWPKFGQMPTKFVFMVANGCQLIRVDGPPQKCATFDHLAFEKPRAIRQQIIKPLVGIN

SEQ ID NO: 129388 - protein, 221 aa, Heterodera glycines
  Coding regions on vcDNA: vcDNA=SeqID_55811; Strand=+; Position=1 -234,465-521,2249-2341,2397-2504,2562-2735
NFTSTALLTWGCSDEADKNVCEEFFMNASNTALRSTKQRCECQFGDQGKDMANEHVKLPEAEKPGPIPTIPPSALNKRNYGTNSQGKNANGRWMGGPYQNIAQKMKSVLPLSLFFFFYCLAFPCICYGIHCKTGMYDTSGNAAIVISECAADHHFCSAIGCAIGTEQITVLWSCEKQNDTKVLVKRVSFENHTCMAQIGQKDANMSNEEFGFPELVQLVLK

SEQ ID NO: 129389 - protein, 38 aa, Heterodera glycines
  Coding regions on vcDNA: vcDNA=SeqID_55812; Strand=-; Position=1-115
LIEPVKSFRMISRLFDSVNNFKSYIDSKLAQTELARSA

SEQ ID NO: 129390 - protein, 102 aa, Heterodera glycines
  Coding regions on vcDNA: vcDNA=SeqID_55813; Strand=+; Position=1 -99,623-829
MSRQLPLIMFVIALQIGFAEGGFFSAVTDFFDNVGQSLEKAWNDIKEPMLDAGALYLAPLSSLLPVTSFGALVALVIEKGVDNPHGTGTEFACGPNTNAIFK

SEQ ID NO: 129391 - protein, 307 aa, Heterodera glycines
  Coding regions on vcDNA: vcDNA=SeqID_55814; Strand=+; Position=1-924
  Homolog annotation: Hit_ID=NP_851596.1; Match level="QueryCoverage =92%, HitCoverage=19%, E-value=3e-17, Identity=34%"; Hit description =sperm protein 3111 [Rattus norvegicus] gb|AAP13530.1| sperm protein SSP3111 [Rattus norvegicus]
MTFQSLGLNPPAFQSLGLKSPAFQTLGLNPPTFNDIPIAGTQPTSISISGTQFSGFPITGTQFLCFPITGTQISGTPISGTQFSGFPITGTQFLCFPITGTQISGTPISGTQFSGFPITGTQFSGIPITGTQFLCFPITGTQFLCFPITGTQISGTLISGTQFSGFPITGTQFFLCIPITGTQFLCFPITGTQISGTPISGTQFSGFPITGTQFLCFPITGTQFSGFPITGTQFLCFPITGTQISGTPISGTQFSGFPITGTQISGTPISGTQFSGFPITGTQISGTPISGINSQAFQSLGLKSAAF

SEQ ID NO: 129392 - protein, 41 aa, Heterodera glycines
  Coding regions on vcDNA: vcDNA=SeqID_55815; Strand=-; Position=1 -15,2220-2330
MYGLKCIRHYEGVICEQVSAKGFFRLASKVSLAGIFHNFWS

SEQ ID NO: 129393 - protein, 102 aa, Heterodera glycines
  Coding regions on vcDNA: vcDNA=SeqID_55816; Strand=+; Position=1 -108,720-772,871-931,1169-1252
MSPNKFALLLLLICFNISAANGFKSPFSELKKFFETEEACQKLCEGSCLDPQKACYSKCGNTKQQCDDECTKCANGPLSKCKGKSADLCFPSGHEKAFKDAQ

SEQ ID NO: 129394 - protein, 44 aa, Heterodera glycines
  Coding regions on vcDNA: vcDNA=SeqID_55817; Strand=+; Position=1 -72,1115-1177
MGWRVCGPVVVFSMHANQMHAEYECRQIPPLILDAIPFPSSGGE

SEQ ID NO: 129395 - protein, 640 aa, Heterodera glycines
  Coding regions on vcDNA: vcDNA=SeqID_55818; Strand=-; Position=1 -249,723-2262,2580-2712
MLPQNVSPSAPFGNATGTTAAAVPSAEALDRNNNNSSSTNINNNGTISAMSQQQQKQQQAPAVGTVPTSARRTTIAATTSTTIANIVLRELDYGRSQLLWKCSIDEIQGMETEIGQQKQQQRRQAEDKQKQQQLVMNNSCATEHDDDEHGDGKQQQQRLGHGVMDEQQQLYLHHKLEQLEHDVPTCRATILTVPPSTMAAAAAEAVPQAMTLMTATHVIVRSARFTTKWRRNTLLARERMARETSSSSLMSSIDGRQLMQEKQEEVNSTDDTPKGKAAKDEAEAAAQVKDALHRMKEGSTESRTASRESDHCDNANGRCSRKCSSVLGSARAVPRRRRPSSLDASIDSSTTCGAASETAHNSEAVPLFGGTAAPFSERPSASSAAGADLVELVCSTDCGGASAVNRHDSIIRFIDAHSPPISPLSPTAVAGGDERTARRRSSIFRDMIMLGTGGGSDRRKSVAKCEQQQQQGPLAAQPLEAVPKKTTPLLADQPTTSASSSVTSMSSYFKSFFRRTSKTPLQEQTQAQNAAQENNAKTNNNGTTTERRSSSSCRMSIVPSNTEQSNVVQLEQHDQDKLEQIPTNTSSKASASIGRRELAPSFSPPMSAMPMANRRWTVREQRVAFRRTKQRQPPANRRRP

SEQ ID NO: 129396 - protein, 85 aa, Heterodera glycines
  Coding regions on vcDNA: vcDNA=SeqID_55819; Strand=+; Position=1-258
MVPLLLMFVLLLLLLFLSNASADGTAAAVVPVALPNGADGDTFCGNIRPVGVTKAISTCAMRKPSLKENIGPFGLTNSHQLIYAL

SEQ ID NO: 129397 - protein, 346 aa, Heterodera glycines
  Coding regions on vcDNA: vcDNA=SeqID_55820; Strand=-; Position=1 -68,204-480,538-815,1034-1136,1194-1418
  Homolog annotation: Hit_ID=NP_508191.1; Match level="QueryCoverage =100%, HitCoverage=33%, E-value=1e-151, Identity=76%"; Hit description=DIACYLGLYCEROL KINASE (dgk-1) [Caenorhabditis elegans] gb|AAC48134.1| Diacylglycerol kinase protein 1,
TPKAATAAVLKLQNAMYEEKKLIVLCLPNVQQHMIPADVEPLLVLVNVKSGGCQGTELLSAFRRLLNPFQVFDVLKGGPLVGLYVFRNISKYRILAAGGDGTVGWVLQCLDIAKQDAACFSPPCAVLPLDAACFSPPCAVLPLGTGNDLARVLRWGGGYTGEESAADILKEVIEAEEVRLDRWAIVFHEEERSQPSAAGMDEGQNEAQVMSNPEDQTSMIIMNNYFGIGIDADVCLRFHNKRDANPEKFSSRLFNKTQYVKIGLQKAFERNTQYVKIGLQKAFERNCKDLWKRIELEVDGRPVELAQCEGIIVLNLLSWGSGANPWGTAREEGGFQKPTHYDGLLE

SEQ ID NO: 129398 - protein, 52 aa, Heterodera glycines
  Coding regions on vcDNA: vcDNA=SeqID_55821; Strand=+; Position=1 -24,743-877
MRIEERCGRRPRAGSELGSSAQTTGSSSATAHIHNHRRANGTRSRQPQNDTV

SEQ ID NO: 129399 - protein, 71 aa, Heterodera glycines
  Coding regions on vcDNA: vcDNA=SeqID_55822; Strand=-; Position=1-215
MHIRNFNVQSLANCFDCLAFLLKLTFQIVPFCAGARMASSSSGQVEHGTGEAQIVRTLVLISDLHFHKGLI

SEQ ID NO: 129400 - protein, 76 aa, Heterodera glycines
  Coding regions on vcDNA: vcDNA=SeqID_55823; Strand=+; Position=1 -20,499-709
MCRVRAIQFFKKMFAKFMLFLFCYIIGKKFSLCEQILSPAIQDYSECGVSNFDPFNERSAEDTEISHAIKRGINYH

SEQ ID NO: 129401 - protein, 54 aa, Heterodera glycines
  Coding regions on vcDNA: vcDNA=SeqID_55824; Strand=-; Position=1 -150,480-494
MSRCGLISCSSSSLLASVWCTAKRMAVKPQFALMPTSEIGAAEVPLAEAKKSQL

SEQ ID NO: 129402 - protein, 116 aa, Heterodera glycines
  Coding regions on vcDNA: vcDNA=SeqID_55825; Strand=+; Position=1 -283,538-605
MQNEAVLLNGSDKGGASFEFDDGSASSDTTDAIDDEFVVPNSTDESDETCDTFSEFNEAHTSSRKQKKGKAKRREKRSKALRTTGKRLIICNGLGTKKQAFDGSTNCIFNTSEGNG

SEQ ID NO: 129403 - protein, 95 aa, Heterodera glycines; identical to SEQ ID NO: 124528
  Coding regions on vcDNA: vcDNA=SeqID_55826; Strand=+; Position=1-654

SEQ ID NO: 129404 - protein, 64 aa, Heterodera glycines
  Coding regions on vcDNA: vcDNA=SeqID_55827; Strand=+; Position=1-324
LRSGKNKRKINVNCKTYNEDPDSKLLKTINLAVKNEIYGRISFIALFESGPHINIYQVMKNALR

SEQ ID NO: 129405 - protein, 219 aa, Heterodera glycines
  Coding regions on vcDNA: vcDNA=SeqID_55828; Strand=-; Position=1 -195,239-283,403-541,1161-1313,1384-1511
  Homolog annotation: Hit_ID=CAE58603.1; Match level="QueryCoverage =56%, HitCoverage=34%, E-value=9e-29, Identity=50%"; Hit description =Hypothetical protein CBG01770 [Caenorhabditis briggsae]
MPATNSPHSSNLAEKATDSLLNGLQNTPAVTYEDLTVATDGFSPNKIVGRGGYGVVYRGVWKHTPVAIKRIQGKCGSDERQQRERIRQSLQELKTLAKFRHDNVLSLYGYSLDGPEPCLVYQFMSNGQRAFSASRNPQGIVEFVLKMCTEAKHKDDTNFKNKCYFELADKRTPKTDDERSLLIFNKLLSVGISCTEKDRFARPIFSEIFARLNDEELED

SEQ ID NO: 129406 - protein, 25 aa, Heterodera glycines
  Coding regions on vcDNA: vcDNA=SeqID_55829; Strand=+; Position=1 -33,281-325
MLEIAILDSKKLTKIVSKNPKIVKK

SEQ ID NO: 129407 - protein, 91 aa, Heterodera glycines
  Coding regions on vcDNA: vcDNA=SeqID_55830; Strand=+; Position=1 -269,429-518
LESLSTLSLLFVVAHSVQFLHAFCFNCRPFFAWFCYCRRRLIPWPPKSSGISAVLIRFRFRCVSIVILLRINFLRAQVVRYSPLLLMVAKP

SEQ ID NO: 129408 - protein, 174 aa, Heterodera glycines
  Coding regions on vcDNA: vcDNA=SeqID_55831; Strand=+; Position=1 -141,182-565
MPATTTCIPNDNADTVEERQIDERETQFDLETDMDSEQGRHSKVTYEPMIAPIDSVLEPVFGVPPKKRELGVRKPGPLENISERQFYRYRFAMRENSRGAFHWLWFARRLAEYFVNAVLNRIERNEMEHIKAIQQRKNYRQTLARDYIKAIEQGLQQQGRNAKLGNTCRIHCIL

SEQ ID NO: 129409 - protein, 95 aa, Heterodera glycines; identical to SEQ ID NO: 124528
  Coding regions on vcDNA: vcDNA=SeqID_55832; Strand=+; Position=1-660

SEQ ID NO: 129410 - protein, 116 aa, Heterodera glycines
  Coding regions on vcDNA: vcDNA=SeqID_55833; Strand=-; Position=1 -73,222-499
MPSLNSSEISPKNVKKCYEEEKVINFPNLTPGKTTQRRKESKRRSTRRSHQTATTQRSNEKAIEDKQFYRNRALQYLGEVEETEAKKSVLNKALCDWKRKRQTQEGKLWQWDWHNG

SEQ ID NO: 129411 - protein, 32 aa, Heterodera glycines
  Coding regions on vcDNA: vcDNA=SeqID_55834; Strand=+; Position=1 -18,860-940
MCALSRKKLKITSELNCKAIEALLNGVLKFGK

SEQ ID NO: 129412 - protein, 55 aa, Heterodera glycines
  Coding regions on vcDNA: vcDNA=SeqID_55835; Strand=-; Position=1 -33,146-277
MRACSPILKDDSLRPPIQWASPKLAQFVAMDGADSAAHFPWEELAWQLGPRNSLM

SEQ ID NO: 129413 - protein, 55 aa, Heterodera glycines
  Coding regions on vcDNA: vcDNA=SeqID_55836; Strand=+; Position=1 -56,104-248
ISYKDKSNFESLRPPIQWASPKLAQFVAMDGADSAAHFPWEELAWQLGLELRRCS

SEQ ID NO: 129414 - protein, 68 aa, Heterodera glycines
  Coding regions on vcDNA: vcDNA=SeqID_55837; Strand=+; Position=1 -87,145-264
MAWLSLLWALFAGTLSFVFVPLFSTFSLVSVFLALVTNLPIIVFDLLGKRSHRIYLPFLLINVGLRIN

SEQ ID NO: 129415 - protein, 184 aa, Heterodera glycines
  Coding regions on vcDNA: vcDNA=SeqID_55838; Strand=-; Position=1 -37,1061-1178,1261-1432,1538-1704,1785-1841
  Homolog annotation: Hit_ID=CAE59009.1; Match level="QueryCoverage =89%, HitCoverage=37%, E-value=2e-34, Identity=43%"; Hit description =Hypothetical protein CBG02285 [Caenorhabditis briggsae]
LVKISKNDNKYYGSNDLSSSALRRLLEQSKKSRSLQLKGAGIKRVPSGIVEVHSLLRILELSSNKLRELPSTIGTFTMLKQLYIANNRLTNLPDEIGCLKTLELLDVSGNNQLTELPDPLAACNSLTQMNASNNKFSTFPSVVTRLVRLEVIDLSEKSIPELPDEISNTSLPFLPQKKGNFSLR

SEQ ID NO: 129416 - protein, 676 aa, Heterodera glycines
  Coding regions on vcDNA: vcDNA=SeqID_55839; Strand=+; Position=1 -102,159-248,305-385,443-523,583-672,728-808,866-1096,1150-1224,2465 -3664
  Homolog annotation: Hit_ID=NP_507780.1; Match level="QueryCoverage =46%, HitCoverage=25%, E-value=3e-34, Identity=29%"; Hit description =predicted CDS, DNA polymerase type B, organellar and viral family member (5T899) [Caenorhabditis elegans]
MFPDDDGYESEDDEILLPPPPIPPQLGHPPPNVPAVRVQPMHVGQQRLPLRDLPQFEDHPQNVPAVRVQPMQQPLPLRDLPQIFHPPPNVPAIRVQPMQQPVPMRAVPQFLHPPPNAPEIGVGPIHDGQQPLPLRALPQFAQPPPNVPAVRVQPVQQPIPLRDVPLFVNPPPNVPVIRVQPMPQPLPLRDMPQIHHPPRNVTSIWIKLWLLFLSLWVFLQGIHVRQIQREYAVPQFAHPPPNLPYHPPENVPAIQPRQRPRQLRDVPLFDHPLPNGQKFGLKPIFKGQGVRKNEVCVIREGDHWDGIKSASWFFGVRYFCVGCEVTYDRPERHRMECKERCKKCCRMGFGFPCADVCVKIHCEECNRNFYNNECFEAHKKVACNEYKKCEKCAEVYQTRSKHVCGEKFCKLCKVCHPGRQCFIKKIQVRPQKAYRIVAYDLETTVDGGEHRPNLVCAARTCNICAGEERECEICEGPSKITWSVADGFDPMSEFVVWIMSFQRFETIAFAHYAGRFDSHFVLSELTKKEIATELMMADLKIYQIKAGRVIFRDFWMLSQNKLADLPKTLGLNITEKLYFPHKYNKNENFGRRLPNLPPLEDYCPDNMKEEEAVKLEKWYNENYQTEFELGRQKKYGFLNYIGFRGTAEDILRKRRGNSVAISFEVSTIVFGNNRGF

SEQ ID NO: 129417 - protein, 166 aa, Heterodera glycines
  Coding regions on vcDNA: vcDNA=SeqID_55840; Strand=-; Position=1 -201,244-543
INLARNFERLCALRKLPCGELFIQFGFIQFGFEDELEDAKYFADFLAYLSFGRSGPTATTRVVTYSMPIKIGELFGAILIYVLGSANPLTMKKRTAGGYLMRQHFPRLLQFPVTEMASHGLGQLVRADGMELYRLMNPHHKGDVGYLMIIETTQHPGSYYFNFSIE

SEQ ID NO: 129418 - protein, 21 aa, Heterodera glycines
  Coding regions on vcDNA: vcDNA=SeqID_55841; Strand=+; Position=1-63
MDFPSPVAGSMTSPLTSSTRP

SEQ ID NO: 129419 - protein, 226 aa, Heterodera glycines
  Coding regions on vcDNA: vcDNA=SeqID_55842; Strand=+; Position=1-681
MLFSFFLFQFYSVVCSIASKRSPEPWGDTLKSIDDNARDFKWPDRHEKGTWAAVAATGEGSRAKAETGVNREEGSGMEEEEDSHIVRAEALSEREGGVAVAAANKGQTQKTSDDDNDYHDGAHQQVVVMARGGEDARAKAEASGGPRSVVETRISDNQRGGERLALGSAIIHRQGRRRGGGGGGRNRKPSERQRRTRARTKTLLPTINFTPAPPQYMELNNRQKGN

SEQ ID NO: 129420 - protein, 42 aa, Heterodera glycines
  Coding regions on vcDNA: vcDNA=SeqID_55843; Strand=+; Position=1 -8,310-430
MRIKYSEFVLVSKIDFSRHLVHEHMYTSSKMQADTRKIGIRT

SEQ ID NO: 129421 - protein, 67 aa, Heterodera glycines
  Coding regions on vcDNA: vcDNA=SeqID_55844; Strand=-; Position=1 -42,211-372
MSHRRSHADNVETMAQLIAGLLPPLALEARISGGNALGNQLVTQLGLSVQAAQNVDMAILGRAKLKI

SEQ ID NO: 129422 - protein, 121 aa, Heterodera glycines
  Coding regions on vcDNA: vcDNA=SeqID_55845; Strand=+; Position=1 -87,367-505,552-691
  Homolog annotation: Hit_ID=NP_500734.1; Match level="QueryCoverage =96%, HitCoverage=6%, E-value=4e-11, Identity=30%"; Hit description =LAMinin related (lam-1) [Caenorhabditis elegans] pir||T15099 hypothetical protein W03F8.5 - Caenorhabditis
MSNTKAAGQSAAGASEIADQVEQKHNAMKSTYDKVLALLEEKEGGNEERKQRAEELRKRTTELLAKIKRSREEKISLIERADSLDVELNNFHTSIEELSDQIDQVTSEIDRRVEFHATCDA

SEQ ID NO: 129423 - protein, 38 aa, Heterodera glycines
  Coding regions on vcDNA: vcDNA=SeqID_55846; Strand=-; Position=1-216
KRIERTRFDEVLVSQKKCKHLKIYKKFKNENSCEIFWK

SEQ ID NO: 129424 - protein, 91 aa, Heterodera glycines
  Coding regions on vcDNA: vcDNA=SeqID_55847; Strand=-; Position=1 -132,241-308,353-427
MWDEQQPMTSQGTRRRISHFANSLWTTPAIGGNAVNGNRRTDETSHNQFRTARMDDDSVQTLDDSDVQMVEESDRKAAPPPKAERGPLLLT

SEQ ID NO: 129425 - protein, 34 aa, Heterodera glycines
  Coding regions on vcDNA: vcDNA=SeqID_55848; Strand=-; Position=1 -20,197-281
MFLGVYSLLINMAALEAFRNFSCRINVEEIEKKF

SEQ ID NO: 129426 - protein, 96 aa, Heterodera glycines
  Coding regions on vcDNA: vcDNA=SeqID_55849; Strand=+; Position=1-290
LVEDISDQYDDSEQPTIIHHEPATPTTMFDNYGPIEKIVVVGTGLMGSGIAQIAVESGVKVCLVGRSQEKCDQTRLKINTGVQKSIKKRMANETAE

SEQ ID NO: 129427 - protein, 121 aa, Heterodera glycines
  Coding regions on vcDNA: vcDNA=SeqID_55850; Strand=+; Position=1-363
MLAKRKQHVGESLDEFAQEIRTLVAKAYPDTSLEMNFEALALGDMEDDVKREHEERLHKFRAGIAKDFFRANMTASIKEKILFMDEPPTFEDAITQAKRVQQMQGALAEDLCKQTQGTKAE

SEQ ID NO: 129428 - protein, 160 aa, Heterodera glycines
  Coding regions on vcDNA: vcDNA=SeqID_55851; Strand=+; Position=1-483
  Homolog annotation: Hit_ID=NP_701782.1; Match level="QueryCoverage =100%, HitCoverage=19%, E-value=2e-25, Identity=36%"; Hit description= hypothetical protein PFL2110c [Plasmodium falciparum 3D7] gb|AAN36506.1| hypothetical protein PFL2110c [
KVKEKVEEEEKVEEKQKVEEKQKVEEEQKVEEEQKVEEKVEEEQKVEEKVEEKQKVEEKVEEEQKVEEEGKRKRTRNRKRTRKRKKRGRKRGTANGRGTESGREEEQQKVEEEQKVEEEQKVEEKVEEEQKVKEKVEEEEKVEEKQKVEEKQNVEEKQKV

SEQ ID NO: 129429 - protein, 308 aa, Heterodera glycines
  Coding regions on vcDNA: vcDNA=SeqID_55852; Strand=+; Position=1 -214,247-347,404-593,677-837,1018-1278
DPNVVNDQQQQQKHILPLPPQQNEQNEVKSTTGLTPAEAVRRSQISALVEPKQPQQQQQEINNGAGDEHGGYQFVTHHFPLFRSISVLSDNWYDWVEGNQTDKAGNQQQNVIVHQSVNSTINADEHGISDEASPVASLSTIDLGRVYTTVGTVMESLLVNFAHLWQYRLFRFAFVLLSIYFCLGFLEQCAVAMTAACVRWAWPPVHFMLGSSRGTLFYLTDCFHFYGSKSFKEDYDDDFFESTCIEVIAPPEHEIIYGPSAFVAIFVAIYALATGRKVQKATALTGELLRNKSVVKIGGLRQKVKAAA

SEQ ID NO: 129430 - protein, 144 aa, Heterodera glycines
  Coding regions on vcDNA: vcDNA=SeqID_55853; Strand=-; Position=1 -49,102-169,485-577,630-702,966-1117
  Homolog annotation: Hit_ID=NP_493982.1; Match level="QueryCoverage =95%, HitCoverage=27%, E-value=1e-35, Identity=56%"; Hit description =solute carrier family 2 member 3 (2B799) [Caenorhabditis elegans] gb|AAK31540.1| Hypothetical protein H17
MFYSADIFKNAGLQGQWPTVATIAMGTVNVLMTFVSVVLVERLGRRTLHITGLVGVLLSSAFIAISLLNSSVQWVSYLSILFVLLFVISFATGPGSIPWLFVNEIFPSNARGNANSIAVLSNWGSNAIVGYSFPMLNVCLCTVD

SEQ ID NO: 129431 - protein, 96 aa, Heterodera glycines
  Coding regions on vcDNA: vcDNA=SeqID_55854; Strand=-; Position=1 -268,431-453
MFFEATITFAFVSIWDRPPFFIVRDCVPQFRLPFTERTLEEIERVEKGHQIGHGTTKVGKRIAHFQVGSRIGTTKIRIQGTTHEDGNRTREKNDDE

SEQ ID NO: 129432 - protein, 49 aa, Heterodera glycines
  Coding regions on vcDNA: vcDNA=SeqID_55855; Strand=-; Position=1 -48,154-255
MARRAAKNMCKKWSKYKNFFVKGEIGFKWLIVRIIFIINIIWAFFSGTF

SEQ ID NO: 129433 - protein, 99 aa, Heterodera glycines
  Coding regions on vcDNA: vcDNA=SeqID_55856; Strand=-; Position=1-300
RRNLFYSRHNPSPTLLINCPNHLLLLPVAVLLQPVVVVVVAVSAASAQFQSVATPSSAWSCGCSSAPRRSAATRAAVRPHSIWPGRPPRPISPSPDAAP

SEQ ID NO: 129434 - protein, 69 aa, Heterodera glycines
  Coding regions on vcDNA: vcDNA=SeqID_55857; Strand=-; Position=1 -190,825-844
  Homolog annotation: Hit_ID=CAE72793.1; Match level="QueryCoverage =92%, HitCoverage=5%, E-value=4e-23, Identity=78%"; Hit description =Hypothetical protein CBG20066 [Caenorhabditis briggsae]
MLWLNLIMDTLASLALATEMPTEELLERKPYGRKKSLISRTMIRNIFCHAVYQFTILMVLLFKGFQPLV

SEQ ID NO: 129435 - protein, 67 aa, Heterodera glycines
  Coding regions on vcDNA: vcDNA=SeqID_55858; Strand=-; Position=1-204
FEYPKRTLEKIDFFVFGAVPPNRCAQIYGETESFRNSFPIACTLILRWIFAPHNCLSTPHGHLKKSI

SEQ ID NO: 129436 - protein, 163 aa, Heterodera glycines
  Coding regions on vcDNA: vcDNA=SeqID_55859; Strand=+; Position=1 -181,510-698,901-1020
MSLLPISRCSSLFHAARSLACRRPPPLASCHCLLSVPSTAPFSSHLSSSSPVVLHSLTTPVTSTHWCHRPAFASQSTPSAPVPNSTNNTPAAAGGGGIGLYQRYEQWLQNYPALYKLHRLTVDGSKWCYSDLKTFFWLAYGLRKGRITLNDLNARELFIYIQA

SEQ ID NO: 129437 - protein, 34 aa, Heterodera glycines
  Coding regions on vcDNA: vcDNA=SeqID_55860; Strand=+; Position=1 -81,267-290
MDDLRRNERKLFPRIVDALRQHNPSSAKIQFFSY

SEQ ID NO: 129438 - protein, 50 aa, Heterodera glycines
  Coding regions on vcDNA: vcDNA=SeqID_55861; Strand=-; Position=1 -111,164-205
MKANGQNGKKKRFAVKLMSYGTKFTFKFMMRVLLRGLASQRIGRPKLVRR

SEQ ID NO: 129439 - protein, 236 aa, Heterodera glycines
  Coding regions on vcDNA: vcDNA=SeqID_55862; Strand=+; Position=1 -131,184-223,266-486,596-742,833-939
  Homolog annotation: Hit_ID=CAE64733.1; Match level="QueryCoverage =92%, HitCoverage=45%, E-value=2e-63, Identity=53%"; Hit description =Hypothetical protein CBG09520 [Caenorhabditis briggsae]
WLFAVFRLLQLPFCSPFNCPPPQKWGPGPPQNCPSPTDPNNRPPSALERWFTKAMFESALERWFTKAMFEDLFPFANLGWDLFPFANLGWGPDRCFPYSYESFAIAARYFPRFGTESPKENGLSRTENERRDLAAFFAHAIQETGQNDISLYQSIPNQSAADACFYRGGLFNWFEGGPVSAFLDSNLPGFRPTDGAKCLSNGRCSPSFFPCANGTSDDGRFFKSCYFGRGTIQISY

SEQ ID NO: 129440 - protein, 126 aa, Heterodera glycines
  Coding regions on vcDNA: vcDNA=SeqID_55863; Strand=-; Position=1 -98,215-322,731-810,1247-1349
  Homolog annotation: Hit_ID=NP_501822.1; Match level="QueryCoverage =98%, HitCoverage=35%, E-value=7e-43, Identity=66%"; Hit description =C. elegans WNT family member precursor (40.4 kD) (wnt-2) [Caenorhabditis elegans] emb|CAA92624.1| Hypothe
NFEECEWQFRYHRWNCSPQELNTFVPIHKKGTREAAFTYAILSAGVTHEIGRRCRLGFLRSCGCSETTKGVNEDWTWSGCGDNIDYGYRFSRDFIDVREKEESNKRSAEWHGRSLMNRWNNEVGRK

SEQ ID NO: 129441 - protein, 110 aa, Heterodera glycines
  Coding regions on vcDNA: vcDNA=SeqID_55864; Strand=-; Position=1 -160,207-379
MDANSSTDVDLRKQHSNGNGNVRQQAENNGTEQQQNNGRNFLQAPTSFHDVVLGVLTQLSRKYLFIDAQKKALFYLAMVIVLSLLSHAINLPSGYLTQVLDFIFKIFVRL

SEQ ID NO: 129442 - protein, 115 aa, Heterodera glycines
  Coding regions on vcDNA: vcDNA=SeqID_55865; Strand=-; Position=1 -112,194-429
MSLSPTLDSNNKNEAKTEEEEAAAKVEVVIHQRHAFQGVFGVSLIKILASISSNFESRTRFRTKSETSYFFSNEKGLMIFYCNIRGFQNVSMCFKSFLGEKTKFEVSTFYLFIYS

SEQ ID NO: 129443 - protein, 118 aa, Heterodera glycines
  Coding regions on vcDNA: vcDNA=SeqID_55866; Strand=+; Position=1 -111,503-634,685-799
PGLDPDLKKPGFFLDLDFPGFCPGNQGPGPTWNPGPGYSDNNIENVNRRSLIYLSEKSFSTEHNVNTSRGLIMEHLVKFMGFREEFLRADASSYIQPITANKRPPGPSSPPVFSNEQL

SEQ ID NO: 129444 - protein, 36 aa, Heterodera glycines
  Coding regions on vcDNA: vcDNA=SeqID_55867; Strand=+; Position=1 -25,574-659
MAKMEGEESEKYLTLDNWKLDELNKLDIGRTEHLDI

SEQ ID NO: 129445 - protein, 191 aa, Heterodera glycines
  Coding regions on vcDNA: vcDNA=SeqID_55868; Strand=+; Position=1 -183,238-369,454-659,1060-1087
  Homolog annotation: Hit_ID=CAE66475.1; Match level="QueryCoverage =84%, HitCoverage=13%, E-value=8e-35, Identity=47%"; Hit description =Hypothetical protein CBG11754 [Caenorhabditis briggsae]
QNLSANYTQFFLTVPNKTQFFTIQSLYLPSFILSKLTIVPFLAYIETAQLDGETNLKIRQAVPLTAQLTAVPLTAQLTDIAQLSALRAHIECEPPNRRVHEFSGTMCAGDDEKPAAIDQFLLRGAKLKNCRWVFGVVVYTGHDSRLLMNSTSAPLKTSRIDVMTNQRSVILFLMLVLVTIVSVRGGGGGGG

SEQ ID NO: 129446 - protein, 233 aa, Heterodera glycines
  Coding regions on vcDNA: vcDNA=SeqID_55869; Strand=-; Position=1-702
MYTYQTSEIERKLKHCGVRALTVDAYQAQECDVIIIVTTRSKYSEVGSGKTDNMHFFEDDQRATVALSRARHAVFIIGDLVSISAGQVWKRFIEMAITRTSVVRAEYVLALLGRTLMRSPTCLFDSAKRESVEDESFLESWALKHGLRLDRTNAFAQQSQQPRAPSFQFQNRQFPALQTTGSSDRAGPSGNGGEQRGAPTLAPQYGRGQGRRGPDNQWMHYGGNPKRQKGGRR

SEQ ID NO: 129447 - protein, 75 aa, Heterodera glycines
  Coding regions on vcDNA: vcDNA=SeqID_55870; Strand=-; Position=1-228
MAYATEVNRKKWHDNIGNEMDRIGLGWDEQMDKFTTGLGREKVGQCTLCTKYEILNAADTAIFKKFASKKIQLPP

SEQ ID NO: 129448 - protein, 89 aa, Heterodera glycines
  Coding regions on vcDNA: vcDNA=SeqID_55871; Strand=-; Position=1-268
MLKPPSQVGTDKRHNERVERLPLRAFKKIGRVGTLPALAHTSAASAAIQSVMSSGEEATTPALTSGGGASSTRTAGGGSAFQRWGGNRR

SEQ ID NO: 129449 - protein, 237 aa, Heterodera glycines
  Coding regions on vcDNA: vcDNA=SeqID_55872; Strand=-; Position=1 -357,644-999
MGSLKVDRLGVLIDLNGDLLSAWSNMKRKGTDAISSLLLARVRARFSSLPDQQQPLWMVAEMLEIAKMRVDTESKRQTLEEPKVTEGNCETKNSPRKKEDGRISSEFQLHEHFSKITVQDGAFGAPISSTRHQKLLQKCNNIASHSQAPTPTPNGMTSFSSKEVPSPAVVPIANAMVKLGKAIETVESSKGIQPTQQQKQSFEGIVMFTHTKGDEMYWLFYDEQTRRFTRMASAKGS

SEQ ID NO: 129450 - protein, 58 aa, Heterodera glycines
  Coding regions on vcDNA: vcDNA=SeqID_55873; Strand=-; Position=1 -57,227-292,478-528
AVVRPSRPSGPTKPLKSTADVPTSLYSADPIDCAKTTKGRKAVSRPPPPPAKKTDKGK

SEQ ID NO: 129451 - protein, 21 aa, Heterodera glycines
  Coding regions on vcDNA: vcDNA=SeqID_55874; Strand=+; Position=1 -54,191-202
MRTRPIWQVKQRLLTSQKKGF

SEQ ID NO: 129452 - protein, 244 aa, Heterodera glycines
  Coding regions on vcDNA: vcDNA=SeqID_55875; Strand=-; Position=1-735
MSFPAEQNCTLPTETQPIMNKSILYIPIRIPRSFPVFKCWNVTTVACTESFLRVVTLDHPPKKFESETSLDDCQNSLNYRPMNRISEKRWESFKSIRKEYGWYGVNCYNNVQTVIEEGNGGILDGEMLVTSWGDSLKIEQFTIGKDDWVRLPGAVELLMWRIPSGEYWDTHFSMGPVTTETWPGQAIVVHELQYTFPISKDQDRKNQVIGVPREAIKSQNNVLNHYVGEVERGQISSETTQFHQ

SEQ ID NO: 129453 - protein, 163 aa, Heterodera glycines
  misc_feature (161)..(161): Xaa can be any naturally occurring amino acid
  Coding regions on vcDNA: vcDNA=SeqID_55876; Strand=+; Position=1 -168,236-274,611-673,724-800,1222-1260,1335-1376
  Homolog annotation: Hit_ID=EAL27559.1; Match level="QueryCoverage =96%, HitCoverage=77%, E-value=4e-41, Identity=54%"; Hit description =GA21906-PA [Drosophila pseudoobscura]
GPAKFAIKMFHPCANFFEGGNFRGKLPFPKDYPLRPPTMRFASRIVHPNIDRDGDRDGNVCISILHEPGDDRFGYEKASERWLPVHTVETILISVISMLSDPNFDSPANTVETILISVISMLSDPNFDSPANVDAAKTHRENPTEYRRQVARCVRETEEQXAN

SEQ ID NO: 129454 - protein, 125 aa, Heterodera glycines
  Coding regions on vcDNA: vcDNA=SeqID_55877; Strand=-; Position=1 -243,288-420
MVFKSLKFRSRRHFTSDVLRNLYVNVKARVKEDIRKTDFISLTIDGWSSHEGKHSLLSVTVHYIGSNMEPTFRVMEAVPIKGSHTGEKMCGLLSQVLNDYGVNAEKVHLIVRDNESAMQKATRIA

SEQ ID NO: 129455 - protein, 137 aa, Heterodera glycines
  Coding regions on vcDNA: vcDNA=SeqID_55878; Strand=-; Position=1-414
MPPQSKYIKYFKISHGTAKCLSCSYSYGSKSTTFPKTCLREHLQRHHPDKYEELLKEEEKAKVKPNGQQSIQSLLLASTSTARLCLSPTPAKMPRNESPFSSSQPKIVKSFCNYLDISKFQSRLSTMEFGWRNDKKG

SEQ ID NO: 129456 - protein, 50 aa, Heterodera glycines
  Coding regions on vcDNA: vcDNA=SeqID_55879; Strand=-; Position=1 -135,409-426
MIYLKINFLFTFLFVNLCFVIAMDNDELTKLVKSSNKATKNKQKVNHVIL

SEQ ID NO: 129457 - protein, 191 aa, Heterodera glycines
  Coding regions on vcDNA: vcDNA=SeqID_55880; Strand=+; Position=1 -112,350-440,639-840,1383-1553
MKGFISHHPGVPPRELLAINCSDEKGENVCYGAKCVEDKNGQENNATIYVYDCEADRNPCHLPNGIEPWISSETGLKWHCQCMICKGTDKCNENFFPNETIKDLLPPCHGQENRTNRTNFSSWLSDEPAKDENGISVQQATGAKPDAIDQGNDQGSEQKLRGAEHGPEKMQNNVDQGAVPKQNGTDQAKES

SEQ ID NO: 129458 - protein, 167 aa, Heterodera glycines
  Coding regions on vcDNA: vcDNA=SeqID_55881; Strand=+; Position=1 -61,400-770,828-899
  Homolog annotation: Hit_ID=AAG53669.1; Match level="QueryCoverage =47%, HitCoverage=39%, E-value=5e-12, Identity=46%"; Hit description =ribosomal protein L19-like protein [Trypanosoma cruzi]
MRYSTSFFAFIFIIFIQHIQCSSSTPTSNAANPARASSAPVQAPTPSPAVAAQASTAAVPASSAAVPASTAAVPASSAAVPASTAAVPASSAAVPASTSSGTTVQQNSASIKGKEIDEAQSSPECSICLEKLNEGNQSEALPCAHVFHQHCLSKWYLAFSFMSLSMA

SEQ ID NO: 129459 - protein, 68 aa, Heterodera glycines
  Coding regions on vcDNA: vcDNA=SeqID_55882; Strand=-; Position=1 -190,242-258
MAQKKILVLVEACQFENEYLIEYLTKNQIFIIVDASFPKQQSSDDEQNVSNEKQHDEGEKVAKVIAKR

SEQ ID NO: 129460 - protein, 24 aa, Heterodera glycines
  Coding regions on vcDNA: vcDNA=SeqID_55883; Strand=+; Position=1-80
RTLSTAVRQRSSKIYSMPQILWAG

SEQ ID NO: 129461 - protein, 164 aa, Heterodera glycines
  Coding regions on vcDNA: vcDNA=SeqID_55884; Strand=-; Position=1 -126,178-242,651-885,928-993
  Homolog annotation: Hit_ID=NP_509429.1; Match level="QueryCoverage =98%, HitCoverage=28%, E-value=7e-57, Identity=57%"; Hit description =transmembrane 9 superfamily member 2 (75.3 kD) (XJ38) [Caenorhabditis elegans] gb|AAB71307.1| Temporarily
MTPMPVTFCFINQQNMNVCTTGFPMGCYVTKEGKPKDACVLDGRYRQQDSFYLFNHVDIKIEYSIKHESKGGMNCGMEAAPQPIGAGEKEFKVIYSYSIVWEPTDVKWSSRWDYILDSMPHTNIQWFSIMNSLVIVIFLSGMVGMILLRTLHRDIARYNRLDEE

SEQ ID NO: 129462 - protein, 18 aa, Heterodera glycines
  Coding regions on vcDNA: vcDNA=SeqID_55885; Strand=-; Position=1 -26,767-797
MTHIHKKERAFGITKSDF

SEQ ID NO: 129463 - protein, 116 aa, Heterodera glycines
  Coding regions on vcDNA: vcDNA=SeqID_55886; Strand=+; Position=1-351
MSVPSNPLPDQSASIGNLSIGPGAKYAEIVDGSGGSALNLLLLITLAKSISSAGKVSKLSDTVLRMDYEHRNRPVQLTVNWDAVTHDKLDFYHFHWTKPEDEVLDHLEVEAFIFIL

SEQ ID NO: 129464 - protein, 175 aa, Heterodera glycines
  Coding regions on vcDNA: vcDNA=SeqID_55887; Strand=-; Position=1 -74,188-640
MSFKRVNSFQPAVPLAKKWDFRSIGNNFAEEMENYKLMDYQSTTCEKFGFTKNITEFRVNPDVERPDEAMKDAIDNMIKVALKTTEEKMKRKVRMFGVAITGAGLASPVWVPYRAYPQNNADVIMQEINKLGQSGDGDENAFPITMKITCVTMPSGEGPRNVHKFDFGFKEHQRI

SEQ ID NO: 129465 - protein, 122 aa, Heterodera glycines
  Coding regions on vcDNA: vcDNA=SeqID_55888; Strand=-; Position=1 -91,165-245,660-825
  Homolog annotation: Hit_ID=NP_491005.2; Match level="QueryCoverage =95%, HitCoverage=9%, E-value=7e-31, Identity=60%"; Hit description =PaTched Related (ptr-12) [Caenorhabditis elegans]
TFMAQFFSSVLCVTPFLVLAIGVDDAYLMMHAWQRITDQMRRKPHAWQRITDQMRRKPIGNISRCSKLPKVLVETGPAVLISALTNICADAVGSFTGSPEITLLCVGNMAAIAVDFIYQITF

SEQ ID NO: 129466 - protein, 86 aa, Heterodera glycines
  Coding regions on vcDNA: vcDNA=SeqID_55889; Strand=+; Position=1 -94,185-241,595-704
MHAFCARAIYHRACQSKAKQQRCCFERIKGIESVNRLLEKYICNLSTILRKSVHRLLEKYICNLSTILRSEVRNDKLHDSNQFFVL

SEQ ID NO: 129467 - protein, 219 aa, Heterodera glycines
  Coding regions on vcDNA: vcDNA=SeqID_55890; Strand=+; Position=1 -597,650-697
  Homolog annotation: Hit_ID=NP_508412.1; Match level="QueryCoverage =93%, HitCoverage=51%, E-value=1e-51, Identity=47%"; Hit description =vacuolar atp synthase (54.2 kD) (XC857) [Caenorhabditis elegans] gb|AAA91266.1| Vacuolar h atpase protein
SNEYINTSVRCLQMMLRKEKYRRKFVEYDGVKSILLALNGRANFQLQYQLIFCLWSVGFFRTFNSKSWKKFVNLIPISFRNLLEKIDNREMVRESALQMVQCKTLKTLELMDAKKFDDPDLVRDCITFGNFGWEIKKFRWTTLNDKVDYYFIKLINNKQILRILIKILETSSDPLPLSVAAHDIGEYVRHYHRGKTIVEQYPSKIVEQYPSKQTMMKML

SEQ ID NO: 129468 - protein, 176 aa, Heterodera glycines
  Coding regions on vcDNA: vcDNA=SeqID_55891; Strand=+; Position=1 -31,205-422,486-575,632-820
MELGLQSLEKIAIHGDIKPDNFMYVKKVGENETLKLIDYDGATFIPVGLFENPRRLANKVVPREFYVATPTYAAIEYYEENMMLTTKMDMWALGIIIYELILVQATFNERISMGKITQILLGIGNIYLGMQRNSRGIKLTEESLFENDSWAKNNCASLLTILNVWQKYPKTALIIT

SEQ ID NO: 129469 - protein, 29 aa, Heterodera glycines
  Coding regions on vcDNA: vcDNA=SeqID_55892; Strand=-; Position=1-88
MLIKKGSNTKLIRSLLHGDLISPFWLGTR

SEQ ID NO: 129470 - protein, 177 aa, Heterodera glycines
  misc_feature (10)..(10): Xaa can be any naturally occurring amino acid
  misc_feature (13)..(13): Xaa can be any naturally occurring amino acid
  misc_feature (30)..(30): Xaa can be any naturally occurring amino acid
  Coding regions on vcDNA: vcDNA=SeqID_55893; Strand=+; Position=1 -198,246-282,339-423,469-506,554-613
  Homolog annotation: Hit_ID=NP_501303.1; Match level="QueryCoverage =81%, HitCoverage=25%, E-value=3e-30, Identity=50%"; Hit description =thioredoxin domain containing 4 precursor (47.2 kD) (4I598) [Caenorhabditis elegans] gb|AAA82296.2| Hypot
RNIKHIYTIXSYXDFIINLNNLVENFECSXTYDHDCIIFFNSKVVFVAFCADWCPFSRKLKPVFEEAAIKWHDNNPNTAAIKWHDNNPNTSVVSVVWAFVDSVKQADVADKYFVNKYPTMKVFINGELIKNEYRVFINGELIKNEYRSTRSVEALTDFSTRSVEALTDFVKKQLEVS

SEQ ID NO: 129471 - protein, 290 aa, Heterodera glycines
  Coding regions on vcDNA: vcDNA=SeqID_55894; Strand=+; Position=1 -121,621-772,827-1024,1708-1952,2006-2162
  Homolog annotation: Hit_ID=CAE58581.1; Match level="QueryCoverage =40%, HitCoverage=39%, E-value=2e-25, Identity=52%"; Hit description =Hypothetical protein CBG01747 [Caenorhabditis briggsae]
MDMHSGELHKKFHETLDEKIAELQKKALEQLDAEFGEAPAESMPSRHAPKAKQVGLADNEDHQPLNRQQSLSPKDEQLQQTQQLMDRISDKLERVQPKHQKVAESIRAIRSQGVRLMGPGSKMSQNVKAKMVALYQTAQKQCESEHSYLEQVLADIQKQISASKYEVKDVDDDDDDGEKLQVVPPTRLIPLPHFRADPRRHAHALFPVGAIVLALYPQTTCFYKGIVESSPTGPNDDYMIAFEDNTFPSGYSPTLPVPQLYVLTHCEVTPQHRKRKKSPLSDLTDEASSD

SEQ ID NO: 129472 - protein, 253 aa, Heterodera glycines
  misc_feature (167)..(167): Xaa can be any naturally occurring amino acid
  Coding regions on vcDNA: vcDNA=SeqID_55895; Strand=-; Position=1 -118,169-295,350-482,1463-1759
  Homolog annotation: Hit_ID=NP_500631.1; Match level="QueryCoverage =96%, HitCoverage=60%, E-value=1e-35, Identity=37%"; Hit description =ECSIT (40.6 kD) (4F515) [Caenorhabditis elegans] gb|AAF60446.1| Hypothetical protein Y17G9B.5 [Caenorhabd
QPDKEIHDLVSSIFGPWNYATRKSKRQLYWMPKLKHTNKYLDRRVVEHKKLEGVEYLDRRVVEHKKLEGVELAQIALKMMCRDSGTQISSFKVSRTNPEHHNWIVSGQSPLQKPEHHNWIVSGQSPLQKRIIANLPDQSTCHVDASRVWVQDHMASFIIYSRNSDVXLLFSFLVCFFSQNLHRGYKRLWEGHSDYRTNLHQQSDQTILAMAIFGVNSNDFASSWLNHLQEDNPRLGQLSVLIRLKELRRSLEK

SEQ ID NO: 129473 - protein, 118 aa, Heterodera glycines
  Coding regions on vcDNA: vcDNA=SeqID_55896; Strand=-; Position=1 -187,239-405
  Homolog annotation: Hit_ID=NP_500631.1; Match level="QueryCoverage =65%, HitCoverage=21%, E-value=8e-13, Identity=42%"; Hit description =ECSIT (40.6 kD) (4F515) [Caenorhabditis elegans] gb|AAF60446.1| Hypothetical protein Y17G9B.5 [Caenorhabd
MFIRAQSLSESVFPLVRSFASSSSSADGFRNTYNPRQPIIWKENFRKMPRNEKTKEAFLKQIEIFQKSRGKRGVGHVEFIEAALKNIKEYNLHKDLDIYKALLNIFPKGDLLPTNIIQ

SEQ ID NO: 129474 - protein, 52 aa, Heterodera glycines
  Coding regions on vcDNA: vcDNA=SeqID_55897; Strand=+; Position=1 -47,116-227
MYKQRKAIKIANLNAMYFIWLTTRKSVTSFVTNAGLTQSYGVRGDVTSNWER

SEQ ID NO: 129475 - protein, 129 aa, Heterodera glycines
  Coding regions on vcDNA: vcDNA=SeqID_55898; Strand=-; Position=1-832
LFEYPKRTLEKIDFFVFGAVPPNRCAQIYGETESFGNSFPIACTLILRWIFAPHNCLSTPNGHLKKIDFFCFRGSPPRTDAPQIYGETESFGNNFPKSLNFNSGVGFLVPLKLVEEPPNGKLEKNQFFF

SEQ ID NO: 129476 - protein, 286 aa, Heterodera glycines
  Coding regions on vcDNA: vcDNA=SeqID_55899; Strand=+; Position=1-860
  Homolog annotation: Hit_ID=ZP_00020514.2; Match level="QueryCoverage =90%, HitCoverage=20%, E-value=2e-13, Identity=26%"; Hit description =COG2152: Predicted glycosylase [Chloroflexus aurantiacus]
MTQPSNIQLLGLHPPAFQSLGLNPQHFNHSATQSTAFQSPGLMQPAFQSLGLNPPAFQSLGLNPPTFQSTGLNPPAFNQQDSTHHRSNHRDSTHQHSNHWDSIHHRSNRRDSTHQHSNHWDSTHSISIARTQATIVPIAGTQPTSIPITGTQPSSIPIAGTQPTSIQITGTQPTAFQSKGLNPPHSITGTQPTNIPITGTQSTNIPISGTQPTNIPINRTQPSSIQSLGLNPPTFQSTGLNSPAFQSVGLNPPTFQSTGLNPPAFNHWDSTHQHSNQQDSTLQHFN

SEQ ID NO: 129477 - protein, 95 aa, Heterodera glycines; identical to SEQ ID NO: 124528
  Coding regions on vcDNA: vcDNA=SeqID_55900; Strand=-; Position=1 -630,795-1142

SEQ ID NO: 129478 - protein, 78 aa, Heterodera glycines
  Coding regions on vcDNA: vcDNA=SeqID_55901; Strand=+; Position=1 -90,355-501
MTCCSDERQADADVGDHFSRCCFEHFVDGETEFDFSKTDRWRFECRYGSHVQQYSFFEASASAENSDQQQQRNEAEDE

SEQ ID NO: 129479 - protein, 121 aa, Heterodera glycines
  Coding regions on vcDNA: vcDNA=SeqID_55902; Strand=-; Position=1 -235,463-593
MVYVNGQKGVAPGTPNVPNGARAEPKTNFGETLLKYYEYYEFVPSVLSWYSHFSTLSVCKDFSVHHKALEYCKETKASDEKLFMKAAEEINELCSLLEEATKRVKAMVKNGKKEHFSWDGI

SEQ ID NO: 129480 - protein, 131 aa, Heterodera glycines
  Coding regions on vcDNA: vcDNA=SeqID_55903; Strand=-; Position=1 -71,120-194,320-569
  Homolog annotation: Hit_ID=CAA50558.1; Match level="QueryCoverage =66%, HitCoverage=19%, E-value=5e-13, Identity=46%"; Hit description =FUS-CHOP protein fusion [Homo sapiens] gb|AAB27103.1| TLS-CHOP [Homo sapiens] prf||1916411A TLS-CHOP prote
MSGYGSGYGSTGYGQQQYSPYSSSYGSGGYGTSGYGGYGQQQYSPYGSSGYGSSGYGGYGSSGYGQQQYSLPSSYGGWGRIKAIRQTFGHFEQLRLIGLRWLWPTGSLRYIEHLLRNGEKKRDRGKTTQKL

SEQ ID NO: 129481 - protein, 64 aa, Heterodera glycines; identical to SEQ ID NO: 129150
  Coding regions on vcDNA: vcDNA=SeqID_55904; Strand=-; Position=1-913

SEQ ID NO: 129482 - protein, 152 aa, Heterodera glycines
  Coding regions on vcDNA: vcDNA=SeqID_55905; Strand=-; Position=1 -156,230-270,324-440,925-1047
  Homolog annotation: Hit_ID=NP_502253.1; Match level="QueryCoverage =100%, HitCoverage=21%, E-value=7e-41, Identity=54%"; Hit description= no mechanoreceptor potential A like precursor, LEThal LET-653 (76.8 kD) (let-653) [Caenorhabditis elegan
DGCQADHVGLVCPPQKTDYGIRVTVESFRYQTTTQIQYTCLVRICPFAPCPQTCPPVDGCPGDDMHSGTRELTLHSGTRELTLEQIRAALIANPQLQRQLAFCRSSRRLAPFPFLALQQQRIVLGGDTIVRRRLVVVNSEEELRYYVKTGEV

SEQ ID NO: 129483 - protein, 91 aa, Heterodera glycines
  Coding regions on vcDNA: vcDNA=SeqID_55906; Strand=-; Position=1 -245,530-560
MNQQQVIKTKRNNDKLVHDGALYVFYKFSNDGLKKFWRCEFHGPSDQCKGMLIYKRTEIDEEQFLLADTGVFQIQGQNGPQRMQQQINTKE

SEQ ID NO: 129484 - protein, 59 aa, Heterodera glycines
  Coding regions on vcDNA: vcDNA=SeqID_55907; Strand=-; Position=1 -8,347-518
MGSFFFGRVKREMLLPVLLLRVVARVRPDSRREKPTRTNPGSFPSRGKPAPNGKLKRIS

SEQ ID NO: 129485 - protein, 23 aa, Heterodera glycines
  Coding regions on vcDNA: vcDNA=SeqID_55908; Strand=+; Position=1-69
MLFYPISVSLILFTFFAGSAEAQ

SEQ ID NO: 129486 - protein, 190 aa, Heterodera glycines
  Coding regions on vcDNA: vcDNA=SeqID_55909; Strand=+; Position=1 -200,359-728
  Homolog annotation: Hit_ID=NP_508635.1; Match level="QueryCoverage =98%, HitCoverage=15%, E-value=7e-39, Identity=46%"; Hit description =M protein repeat containing protein (XE304) [Caenorhabditis elegans] gb|AAK39135.1| Hypothetical protein
MEIQKLEEERNGLRTERERLGEEFKGKLCRAESLFEMELTAAKMLYMRELQALREHEEALKDELAARQEEFHDRVVEMQFQSRQSKDEIIHCREEITQLEKALGQKAEEIQRLSKEVRDNLKRRKFNNYLEMSFKLKKLAIARRKTEETIYQLVQVKSEAEEAARELSAQRERAKRLNGAEEARERLEET

SEQ ID NO: 129487 - protein, 281 aa, Heterodera glycines
  Coding regions on vcDNA: vcDNA=SeqID_55910; Strand=+; Position=1 -221,519-662,710-762,926-1084,1139-1237,1283-1305,1402-1482
  Homolog annotation: Hit_ID=CAE66579.1; Match level="QueryCoverage =98%, HitCoverage=35%, E-value=1e-108, Identity=72%"; Hit description= Hypothetical protein CBG11896 [Caenorhabditis briggsae]
SGLRPLVNDPNKKDTKSLARNHIIEVSKSNLITIAGGKWTTYRHMAEEAVDACVKACNLKPKNGCMTPGLMLEGAHDWYPLLYINLVQDYGIEVDVAQHLANTYGDRAFVVARMCKMTGKRWPIVGNRLHPIVGNRLHEEFPYLDAEVSYAIKEYACTAVDVIARRLRLSFLNTYAAHEVLNQVVMIMARELAWSRQETEKQLKVAKQLKVARDFINNEMGQEARMQWVSDVPLNLTKEEMQMAKEREMQMAKERFNQLDKDKKGHITVNDIRRHFRVWCH

SEQ ID NO: 129488 - protein, 60 aa, Heterodera glycines
  Coding regions on vcDNA: vcDNA=SeqID_55911; Strand=+; Position=1 -99,606-686
MSTDNGAAANVQPEQDEKLIAQPEQTAGKTASPPRKRINNEGPEEADTESSQQKKQRMDG

SEQ ID NO: 129489 - protein, 176 aa, Heterodera glycines
  Coding regions on vcDNA: vcDNA=SeqID_55912; Strand=-; Position=1 -26,87-333,384-641
MSSWFSYIRSSIIGDELPSTSEADVVDQIGPTEDDILPRTGQSVDTLSSCLASAASQQKLDYGQEDSITPSHGNSSLPAALSQEQQEHIKNVLRRAERSGRHAKVVVDLRHLKRGRHSTAAAQTATITTTPCAPSIGTQQQLERHEQQQLKRNEDEEEQQQEGQFIVQMDSLPEGK

SEQ ID NO: 129490 - protein, 157 aa, Heterodera glycines
  Coding regions on vcDNA: vcDNA=SeqID_55913; Strand=-; Position=1 -117,163-379,428-566
  Homolog annotation: Hit_ID=NP_505595.1; Match level="QueryCoverage =98%, HitCoverage=20%, E-value=1e-20, Identity=37%"; Hit description =udp glycosyltransferase 1 family polypeptide A4 (5K578) [Caenorhabditis elegans] emb|CAA94845.1| Hypothet
MNFYSTAYNILVFSPTLSRSHMISNGRVADALASDGHDVTFIEIEYAVPIGALNATKLANLWQIPGKFFNVNFGGKSLFKVLADSAFEKPSLVDIFFSSKIFQASLNDACEALIRTQSQQFELLKKRNFDVIISEQLNFCGAGIGHLLDIPVNIVLS

SEQ ID NO: 129491 - protein, 75 aa, Heterodera glycines
  Coding regions on vcDNA: vcDNA=SeqID_55914; Strand=-; Position=1-238
FLLFHCTKNEIVIDSVPSFSSVCILGGLLRKYGIEKSVQNLCVEWMTKVPPQFLLENLSIVKRAMSTSCAGYSTG

SEQ ID NO: 129492 - protein, 392 aa, Heterodera glycines
  Coding regions on vcDNA: vcDNA=SeqID_55915; Strand=-; Position=1-1179
  Homolog annotation: Hit_ID=AAG23159.1; Match level="QueryCoverage =52%, HitCoverage=89%, E-value=1e-66, Identity=59%"; Hit description =polyprotein [Heterodera glycines]
MWSGVGPPIVRRPLIRSFRFCKRMKNLARQYVYWPGIDDQIEEIVRSCQTCASEAKAPVKTTLHSWTKSDGPWKRVHMDYAGPFFGKMFLVIVDAYSKWPEIFEMNSTGSAATIGKLRYLCARHGLPETLVTDNGTQFSSKEFKEFTRLNGINHLFSAPYCPMSNGQAERFVDTFKRTCRKLKKEGITEMLDTFLATYRVTPNESLPECKSPAELFLQRKIRSKLDLLKPKKRPIVIRDEAMERKFNRRHGARPRSFDLDDMVYARHRLSQDWRPGHITQKKGVMYDVTFQDGSVGRFHANQLMVRHSDVDEEDSLDILNDAFGLPLAQANQQLGDVVAQPAGGVIEIAPPSPHPDQPQQPNEVNEERAVQQNVQNERPKRNRRPPDRYSRG

SEQ ID NO: 129493 - protein, 217 aa, Heterodera glycines
  Coding regions on vcDNA: vcDNA=SeqID_55916; Strand=+; Position=1-654
  Homolog annotation: Hit_ID=E86336; Match level="QueryCoverage=67%, HitCoverage=37%, E-value=2e-29, Identity=49%"; Hit description =hypothetical protein F14O10.11 - Arabidopsis thaliana gb|AAF88160.1| Contains weak similarity to an unknown pr
MSAFALRFASFLSLTALLVVRCSADESSSSEEEQKRPISDAAVPSSSNEMPQVVPAAVARRKRSIFGNFFAGLFHRNNETSTEGRRPSNGTESAEEAEKVKEKEEEKEEEEKEEEKKEKEEEEKEEKKEEEEKEEEKEEEEKEEKKKEKEEEEKEEKKEEEEKEEEKEEDEEKEEEKEKHNATDQSAVGREKRSPFGIFMKYKKNGKQLSIGQHATN

SEQ ID NO: 129494 - protein, 101 aa, Heterodera glycines
  Coding regions on vcDNA: vcDNA=SeqID_55917; Strand=+; Position=1-306
  Homolog annotation: Hit_ID=AAP92535.1; Match level="QueryCoverage =73%, HitCoverage=30%, E-value=1e-11, Identity=41%"; Hit description =Ab1-042 [Rattus norvegicus]
MRCRRKVVARRTAQSQRKKRKRQRKRRRRRRRKKRRRRMSRRRRRRRRRRKGGGGKEEEEKEKDNATDQSAVGREKRSPFGIFMKYKKNGKQLSIGQHATN

SEQ ID NO: 129495 - protein, 94 aa, Heterodera glycines
  Coding regions on vcDNA: vcDNA=SeqID_55918; Strand=+; Position=1 -128,384-540
  Homolog annotation: Hit_ID=XP_394805.1; Match level="QueryCoverage =70%, HitCoverage=7%, E-value=1e-11, Identity=53%"; Hit description =similar to CG2256-PB [Apis mellifera]
MPKTSHILLICLLFFTTFLVKTEAKIEETIELERNPSAERTEGCCCCGGWGYGGYGGYGGYSGYGGYGGYGGYGPFGVGLVGLTGGLLFGGWGK

SEQ ID NO: 129496 - protein, 188 aa, Heterodera glycines
  Coding regions on vcDNA: vcDNA=SeqID_55919; Strand=-; Position=1 -94,162-229,370-572,645-833,882-894
MPIITPTFPEQNVGANLNGATAKVILNELRIAFQQIRNDQNFNSPLKSKKFNEKYAHFILVVCSGHQINLAKFTPFVGKSIRYELHNFLQNSSLLSKRVDFFHVYPKAFSVNGSSSGEHSNRVISQWLVGIELLPGKIVDSELRSELSQMLGNFDAKVKNAFNYFLFHAVDLFSEYVEKNELKLRRFD

SEQ ID NO: 129497 - protein, 112 aa, Heterodera glycines
  Coding regions on vcDNA: vcDNA=SeqID_55920; Strand=-; Position=1 -196,783-925
MPNIGQLPPGKYNWREFEKLQKEIGNKIEHLIKNDQFDMGMCRYDLKDRAKRRAEMEKKMQMEISNNQILDDLMGFLNTKMLLTMLTKIFLLYPNGSMPFLVEKFFLTYSTW

SEQ ID NO: 129498 - protein, 310 aa, Heterodera glycines
  Coding regions on vcDNA: vcDNA=SeqID_55921; Strand=-; Position=1 -37,111-1006
MIEQIHAADQYEREKAEEKRKTKEEELSSKVKDNLKRNLNELKSERKANYESEEEEEEENCNGKMPKFDGKVPNRNEQEMANWETKSEENSEEEDKLDQNELLHLKIGHFSDDNLLSLKYGELFWAVSKESWENDEENDALTVKTLCWTLHLGVYANEISNRIGLFGTLEELKIIGKNEKLEIEKQWEKLKMVELSKIISRCERNKLMAKLHLLLKKIVASMDGFCAENGTNLWAEIRETKSQLHSRKLAKTMAKSETERQLKRKMDKVILALIQTENNGREDGMPKHRAEFEEQLKAVKHFDGQRKLGN

SEQ ID NO: 129499 - protein, 208 aa, Heterodera glycines
  Coding regions on vcDNA: vcDNA=SeqID_55922; Strand=+; Position=1 -156,651-854,2621-2808,3465-3543
MPTVDFLCQASSLSRINGTVGLEPILHWISQQQGFIKYFTMYPSAGGTQISERFFNSRGAPPASYNAMFKHGVVADDVNEFSIEKCEHSLKLKACVTADGTTDWALKSLSAYDEALSNVLHNCLRIPHLTFDYAMILRAEDGTGAIFKVRHKGSNLRDEMEEVPMDSIPFRKIIKKIHKIAIWPMFLGCISISWKGIPKIECLTFEAN

SEQ ID NO: 129500 - protein, 85 aa, Heterodera glycines
  Coding regions on vcDNA: vcDNA=SeqID_55923; Strand=+; Position=1-258
MPKDKYRASEDESLNSNNGFSIVNEKTQELLQFGQFWCNRWMLIRNQISWDWAGFVMKIFNDDVSSYYKDRFIFALNDEQYDDPE

SEQ ID NO: 129501 - protein, 74 aa, Heterodera glycines
  Coding regions on vcDNA: vcDNA=SeqID_55924; Strand=-; Position=1 -200,866-890
MVMTKTECNYGAPEYVTKFVMIRCPMCRDENKWAKWEKEAEGWEHRMGQRNRNLIDIYVDEENLDVGEYVELRF

SEQ ID NO: 129502 - protein, 90 aa, Heterodera glycines
  Coding regions on vcDNA: vcDNA=SeqID_55925; Strand=-; Position=1 -65,622-829
MNSNFQKILPPAPVYKNFFRKNEIWGPDFPDIWGPDFWGSRHLGIPTFGDQTFGDPTFGDPDIWGPDIWGPNDIEQKTLKKTADIWQPDI

SEQ ID NO: 129503 - protein, 125 aa, Heterodera glycines
  Coding regions on vcDNA: vcDNA=SeqID_55926; Strand=+; Position=1 -54,308-464,633-799
MCPLPLHFLKELNTHLKTNPLNHSNGHFSVDEYNSLQKRITLINLNDPPLSQVMGTLIVTLMSLKKAMESGNFGDSLIKMGNQRLKFALKFVAKRHGIEFDERNNFSLWPKNSQKLYFSKWVILY

SEQ ID NO: 129504 - protein, 55 aa, Heterodera glycines
  Coding regions on vcDNA: vcDNA=SeqID_55927; Strand=+; Position=1 -60,271-378
MPWYWHSDLPRCVSRRMAQQRHPYQQPNLHVPMHYGYNEAYFPGNFVHSRATDFP

SEQ ID NO: 129505 - protein, 84 aa, Heterodera glycines
  Coding regions on vcDNA: vcDNA=SeqID_55928; Strand=-; Position=1 -126,383-511
MRAIFSACDADELKRLLGAEQNGATLLHVAAQNDKADVIKLLIENGAVAPTDDTNSVTIQFTCGDGHLPVGQFLKSSVFIFCKL

SEQ ID NO: 129506 - protein, 95 aa, Heterodera glycines; identical to SEQ ID NO: 124528
  Coding regions on vcDNA: vcDNA=SeqID_55929; Strand=+; Position=1-657

SEQ ID NO: 129507 - protein, 63 aa, Heterodera glycines
  Coding regions on vcDNA: vcDNA=SeqID_55930; Strand=-; Position=1-189
MNTEEAHLLGIFFDTLTRAIKHGILLERIRLLDGQMLRLINEFCQIDVAYLLTQIDVVQELYE

SEQ ID NO: 129508 - protein, 66 aa, Heterodera glycines
  Coding regions on vcDNA: vcDNA=SeqID_55931; Strand=-; Position=1 -59,140-280
  Homolog annotation: Hit_ID=NP_491131.1; Match level="QueryCoverage =89%, HitCoverage=15%, E-value=2e-10, Identity=44%"; Hit description =predicted CDS, tyrosinase family member (1D831) [Caenorhabditis elegans] gb|AAK21515.1| Hypothetical prot
PDEAGFVTNGLFANWTTMDGRHSFQRMFGDQDDGEFINDARIDWVMTQDIVESVMAFTLPTQAINA

SEQ ID NO: 129509 - protein, 48 aa, Heterodera glycines
  Coding regions on vcDNA: vcDNA=SeqID_55932; Strand=-; Position=1 -21,598-723
MIDIKLLSNFSFSRTVLYFPAKFLIFQGLSLIFLSIFLFAADLILMIL

SEQ ID NO: 129510 - protein, 294 aa, Heterodera glycines
  Coding regions on vcDNA: vcDNA=SeqID_55933; Strand=-; Position=1 -208,792-1467
  Homolog annotation: Hit_ID=XP_514061.1; Match level="QueryCoverage =85%, HitCoverage=66%, E-value=5e-22, Identity=28%"; Hit description =PREDICTED: hypothetical protein XP_514061 [Pan troglodytes]
MPKWALVLFTLLPSFHCLPLHFLLSPLQLSPSAQRLHLVRVRPSDAGVFTCVAVNAAGVANATFSVIVLEPPQIVDFATEFKVIEGSEQRLECKVLGTPTPKVQWQKGGSELLANRGVHFAFTPPHAHNLHIYSTRKEHGGRYTCKASNKGGEVRQNIQLTVMGQWEKGKSGGEEKGILGKTIMAFWERRLNPIAFLVQNDSDYPFHLLLCSHFASVPPTITEGERFIRVTEGANLTLECPANGVPTPQITWHKTDEEGRSKEEERIKKTNTTEEGPPEGGKMILRELRETDGG

SEQ ID NO: 129511 - protein, 34 aa, Heterodera glycines
  Coding regions on vcDNA: vcDNA=SeqID_55934; Strand=+; Position=1-104
MKECHCDVEEDNFCFLCCGSANDRCLPAHEHDIL

SEQ ID NO: 129512 - protein, 70 aa, Heterodera glycines
  Coding regions on vcDNA: vcDNA=SeqID_55935; Strand=+; Position=1 -160,300-352
MSLFRNRSQLETVATKCTAMNTFSAFLRPCGTRTSSRPITTTAEIGVTDFGGKLGFYIAKKFTDFLINIC

SEQ ID NO: 129513 - protein, 31 aa, Heterodera glycines
  Coding regions on vcDNA: vcDNA=SeqID_55936; Strand=+; Position=1-93
MGSKNPTQNQSTGYREAIPEGFGLHINLGAS

SEQ ID NO: 129514 - protein, 100 aa, Heterodera glycines
  Coding regions on vcDNA: vcDNA=SeqID_55937; Strand=+; Position=1 -66,352-588
MTVADQHTAERAGTNATRWTSQDHFPTICQQPQQQQQKLRPSESFIRSIQQQQQELKQQQQKNTSNTIPSNSRMHRRQKKRSKWHTLDKCVSLVSILEAN

SEQ ID NO: 129515 - protein, 25 aa, Heterodera glycines
  Coding regions on vcDNA: vcDNA=SeqID_55938; Strand=+; Position=1 -53,451-475
MGTHATNSSRRRRYAHNCFPNFLQF

SEQ ID NO: 129516 - protein, 177 aa, Heterodera glycines
  Coding regions on vcDNA: vcDNA=SeqID_55939; Strand=+; Position=1 -250,591-742,894-1025
MGFDLLVENNADLSASGDQRIARNGGDVLFEFDQSPIIPPTQQNVDNTTIIQMDPIVHESGYENKIGISPTTTAEQFESVQLEAAEQLSTVPTTSKKAFSLNLPLFSGKNGRTKKGIKTPFSTGAELFGGSNEILSSNDQLESTNLNAQLVIKQMEGDNRPKESVGGGVSDEKNGYK

SEQ ID NO: 129517 - protein, 241 aa, Heterodera glycines
  misc_feature (7)..(7): Xaa can be any naturally occurring amino acid
  misc_feature (16)..(16): Xaa can be any naturally occurring amino acid
  misc_feature (18)..(18): Xaa can be any naturally occurring amino acid
  Coding regions on vcDNA: vcDNA=SeqID_55940; Strand=+; Position=1 -478,1359-1609
  Homolog annotation: Hit_ID=NP_509779.2; Match level="QueryCoverage =83%, HitCoverage=16%, E-value=1e-38, Identity=42%"; Hit description =related to oncogene ABL (abl-1) [Caenorhabditis elegans] emb|CAB60297.2| Hypothetical protein M79.1c [Cae
DFPRSVXILQFTSYKXIXMRSEFYPFLPMIRRFFSTKSDVWAFGVLLWEIFTYGMAPYPGVELNNVYVLLERGFRMDPPPECPDCVYRLMLQCWNWSPSDRPRFKDLLLSLFSQQPSESVDSERLRSASSLAFAAASAAQKREERKRTEREGTEMSSKREKDRLRKSMSSPRSEAETGNDPLLKRPEPKPRRSIEGKTKSTSMETRDTPSSSSSRGNRRNSTTRTILSENSDQAKTARIRT

SEQ ID NO: 129518 - protein, 44 aa, Heterodera glycines
  Coding regions on vcDNA: vcDNA=SeqID_55941; Strand=+; Position=1-138
EFWAKPGPGLAGDVRSRDRDLDFFRDLDRDQPGIFKNSKKFLKI

SEQ ID NO: 129519 - protein, 400 aa, Heterodera glycines
  misc_feature (10)..(10): Xaa can be any naturally occurring amino acid
  Coding regions on vcDNA: vcDNA=SeqID_55942; Strand=-; Position=1 -203,337-428,505-611,686-712,770-909,1029-1180,1239-1390,1459 -1549,1627-1756
  Homolog annotation: Hit_ID=AAD09400.1; Match level="QueryCoverage =94%, HitCoverage=57%, E-value=1e-103, Identity=53%"; Hit description= gamma-glutamyl transpeptidase precursor [Brugia malayi]
RSGLDKPNYXINMHNVMSFALGGGFIMTFYDAKSRSCKVLDARETAPAASSREMYGTDEWASKYGYRAIATPGELAGYWLAFKEYGSGRVNWTDLIISPAVRLARTGVPISEYLAYVLGVKEKHFRTLPSMKSWINPATNRVYEFGDVIRRPEVYEFGDVIRRPELADTMERLANAQNPVELFYRGQMAETIVAEIQKNGGLLSKDDLANYRPKVYDSPLISGGFRGALRMCGPPPPSSFAVTQAIVAVMTNYTRFGNPTDGVLDDTNYTRFGNPTDGVLDDTEFYHWLIEAQKFAYAQRTKLGDVDFVPEAMELARNMTNMTSTRFHREILKRVPPKAMFSAYYAEEPFQKEDHGTQKEDHGTSHVSVLDAEGNGVSATSTVNRWHVTVRYPSLMPFFI

SEQ ID NO: 129520 - protein, 190 aa, Heterodera glycines
  Coding regions on vcDNA: vcDNA=SeqID_55943; Strand=+; Position=1 -423,523-672
MKINFVIIFFLFVIVVIDGTDEDLFDDLWKNVKLSNSKNINKPIFGEINAIKEERIVKNENDEQKNANKLQMENTKPNLFQKIKKKPLEEQNNHLKLKMPKIEMDKLSEESFEIEFDEKADQNVSSTDHSNSSDDEDYNNMNAETRKEIKILNEFNLMKKELRCNYKTMPIVQFEREIAKKVGHISYQNL

SEQ ID NO: 129521 - protein, 21 aa, Heterodera glycines
  Coding regions on vcDNA: vcDNA=SeqID_55944; Strand=-; Position=1-63
MASKASGFRAGVYRTNPCLWE

SEQ ID NO: 129522 - protein, 214 aa, Heterodera glycines
  Coding regions on vcDNA: vcDNA=SeqID_55945; Strand=-; Position=1-645
MRLVHGKDPTPDVHYLHEKDDYHFVNAVHKYIVRHPELPWDSPEFNPSANIQQNIAEFREIFESEVFDENYELKTREEKNELIELVKGFRFYFADELGRFTLRIFSDKISHITLTDQLAYVLGYEQQQEIHNEDQAKYAVDLAGGVSHLCIYLNSGIIESMIFGNTFANLLQVIAVEGTSGSVVEKDFQSPLFHKIVAREVDVLDVEIRTLTGR

SEQ ID NO: 129523 - protein, 214 aa, Heterodera glycines
  Coding regions on vcDNA: vcDNA=SeqID_55946; Strand=+; Position=1 -148,679-786,1283-1671
MTEGITKKTGVSCDCQFGEKGKEMGNQQFILPPIAPIVENVTDINALKNRLECKIGVFRENGIGQIHIGFCGADATHCFAASCKIASGVIDTWGCQPSNDYCSKVGKLCHFCKLGKKDEKHSNMNFMIPTFLKKNATRVTKGIVSSTVLAPLPEGTTTTTTTTTVSTTTTSTASKTISTPSANLVTDISDEMSETTVDGKTESRPFHPQSFLFN

SEQ ID NO: 129524 - protein, 133 aa, Heterodera glycines
  misc_feature (73)..(73): Xaa can be any naturally occurring amino acid
  misc_feature (81)..(81): Xaa can be any naturally occurring amino acid
  Coding regions on vcDNA: vcDNA=SeqID_55947; Strand=-; Position=1 -52,3147-3491
  Homolog annotation: Hit_ID=NP_500013.1; Match level="QueryCoverage =90%, HitCoverage=8%, E-value=1e-30, Identity=52%"; Hit description =predicted CDS, polyprotein family member (4B673) [Caenorhabditis elegans] gb|AAC02594.1| Hypothetical prot
SIFPLSLFLSLSSPPLFHDELKRLKLLIEEYSDTFSQSQYDLGMFSEAEHHITTTTDEPISSPPRRVPYRYRXELKKHIEXLLASGVMVESDTPWVTPLVIVQKKDGGIRPCLDFRKLNEVTIPDRYPLPISG

SEQ ID NO: 129525 - protein, 40 aa, Heterodera glycines
  Coding regions on vcDNA: vcDNA=SeqID_55948; Strand=-; Position=1 -55,466-533
MKSFIMIPTIMDLDAKEKTKDMPNITESSIDLLLLEFGTS

SEQ ID NO: 129526 - protein, 40 aa, Heterodera glycines
  Coding regions on vcDNA: vcDNA=SeqID_55949; Strand=+; Position=1 -71,170-221
MRFPSTILEKSTVKLFQAQKPKSNNCLIHIHSLRIPIIAD

SEQ ID NO: 129527 - protein, 16 aa, Heterodera glycines
  Coding regions on vcDNA: vcDNA=SeqID_55950; Strand=-; Position=1 -48,413-415
MRREWAEKHYNEKRKK

SEQ ID NO: 129528 - protein, 76 aa, Heterodera glycines
  Coding regions on vcDNA: vcDNA=SeqID_55951; Strand=+; Position=1-263
GLLDAFPSFNYFPLAIINSITFILFSPFSFSHCNVSPPILFAFSPSPVISQSVVVMEQTSIIYSDFSLRINPTTNE

SEQ ID NO: 129529 - protein, 40 aa, Heterodera glycines
  Coding regions on vcDNA: vcDNA=SeqID_55952; Strand=-; Position=1 -57,205-270
MEIGFGEQLFLTKNVKISKNFHFVEFSYSSKRSYFAEFIL

SEQ ID NO: 129530 - protein, 114 aa, Heterodera glycines
  Coding regions on vcDNA: vcDNA=SeqID_55953; Strand=+; Position=1 -33,100-227,265-448
MASINTSSNDPLYLAYRFAGPSADLIVPAVALNLVALVGIVLNGTVLVVTVKSNSLRGSANFLMALICICELVHQIGHSFFLVVVISGKDFVSLLTADLIMIGNLILNIFLILI

SEQ ID NO: 129531 - protein, 95 aa, Heterodera glycines; identical to SEQ ID NO: 125597
  Coding regions on vcDNA: vcDNA=SeqID_55954; Strand=-; Position=1-657

SEQ ID NO: 129532 - protein, 331 aa, Heterodera glycines
  misc_feature (8)..(8): Xaa can be any naturally occurring amino acid
  Coding regions on vcDNA: vcDNA=SeqID_55955; Strand=-; Position=1 -121,187-300,356-426,494-584,638-759,826-1058,1731-1795
  Homolog annotation: Hit_ID=AAH35974.1; Match level="QueryCoverage =97%, HitCoverage=33%, E-value=7e-55, Identity=40%"; Hit description =DHX15 protein [Homo sapiens] gb|AAF90182.1| dead box protein 15 [Homo sapiens] sp|O43143|DD15_HUMAN Putati
CPKLKLIXMSATLDSARFQNYLNYCEMLIIRGRTFPVDILYSPTPVISYTHAAVETAYSPTPVISYTHAAVETALQIHLTAKRPGDLLIFVTGQKETEKVCRLIRWKCDDMVSQFETEKVCRLIRWKCDDMVSQFGQLYCFPLYASMPLDKQYCFPLYASMPLDKQQRVFQQCIPNKKCTLINRKCIVARKCIVATNVAETSITIDGIAFVVDTGFCKQKIYNPQIRVDSLLVSLLVTPISQASAMQRAGRAGRTQPGQCYRLYTENAYKTEMQPHTTPEVRINKNENIYMYNNLNKKFFIGGQFGQDKAPTLQRQLNMERFFDLLVGSSS

SEQ ID NO: 129533 - protein, 119 aa, Heterodera glycines
  Coding regions on vcDNA: vcDNA=SeqID_55956; Strand=+; Position=1 -45,635-811,1168-1288
  Homolog annotation: Hit_ID=NP_496801.2; Match level="QueryCoverage =84%, HitCoverage=36%, E-value=7e-27, Identity=55%"; Hit description =galectin, beta-galactoside binding lectin (31.8 kD) (lec-1) [Caenorhabditis elegans] emb|CAB04959.1| Hypo
LKLDKMKLESIKQNKSTPFRGVLDVRFEPGQTLTVKGIVGEKARQFSVNLHSRTADFSGSDVPLRVAARVDRAKIGLNSMVNKMWGKEQRKGHSLKPGKPIDLRIRAHDKEFQAVQAHA

SEQ ID NO: 129534 - protein, 233 aa, Heterodera glycines
  Coding regions on vcDNA: vcDNA=SeqID_55957; Strand=+; Position=1 -139,182-202,292-453,504-626,694-804
  Homolog annotation: Hit_ID=AAP05997.1; Match level="QueryCoverage =96%, HitCoverage=95%, E-value=2e-50, Identity=40%"; Hit description =galectin [Haemonchus contortus] gb|AAF63406.1| galectin [Haemonchus contortus]
VPRLQERKSLLQIIIDGKAFKRYAYQSPLQSITHLSIDGDLAIQHIHWGGKVYHWGGKVYPVPYETGLPHGFPIGKCLKMSGTPSLRKGGRFEVNLLRKNGHIALHLNARFDEKAVVRNSLEANEWGNEEREGKMEKAVVRNSLEANEWGNEEREGKMPFERGHCFDLAITNEANHFGIFVNGQHFANFVHRSKPEIFVNGQHFANFVHRSKPEDIFGLLIQGDIEVCQAKAI

SEQ ID NO: 129535 - protein, 182 aa, Heterodera glycines
  Coding regions on vcDNA: vcDNA=SeqID_55958; Strand=-; Position=1 -83,944-947,1151-1238,1300-1345,1408-1463,1534-1611,1857-1963,2247 -2333
  Homolog annotation: Hit_ID=NP_497972.1; Match level="QueryCoverage =84%, HitCoverage=81%, E-value=1e-40, Identity=55%"; Hit description =R-RAS related, associated to muscle and microspikes; GTP binding protein with predicted prenylation domai
MTHSFGSDQLITATEHSLTADHQQRSNGQKQFVDYYDPTIEDQYIQHCEIDGQWVILDVLDTAGQEEFSAMREQYMRNGRGFLLVYSVTDEQRGAQIVPASVAGEGHQRISGAVGGQQISEQQGRQLAAELGVPYIETSAKDPPVNVDAAFHELAKKNGPNRMASKAKRRSSAGSNKKCLIQ

SEQ ID NO: 129536 - protein, 225 aa, Heterodera glycines
  Coding regions on vcDNA: vcDNA=SeqID_55959; Strand=+; Position=1 -126,180-287,401-692,952-1100
  Homolog annotation: Hit_ID=CAE59721.1; Match level="QueryCoverage =100%, HitCoverage=54%, E-value=1e-38, Identity=43%"; Hit description= Hypothetical protein CBG03154 [Caenorhabditis briggsae]
MSVNKATVGAIALSGSTLLVCLFGIASIYSDIQAIWNELDMEMDQFKMQADDLWKDMLKMGAGTAANRARREAYGGYQASGSQPQPSPGALSSPQGVEVPPAVMPGFAPGVSPSVNSVFSPTAGSNNVFSPFAPTGSNSINNGLPMPFGQSPDGPNGGGTFPGGFITPAGSGPGCKCKSRNTCPAGPAGPPGDIGPSGVPGIPGKDGIPGQAAEDSQNAPLKGCF

SEQ ID NO: 129537 - protein, 146 aa, Heterodera glycines
  Coding regions on vcDNA: vcDNA=SeqID_55960; Strand=-; Position=1-443
FQSLGLNPPEFQSLGLNPPAFQSLGLNSAFQSLALNLPTFQSLVLNPTAFQSLALNPPAFQSLGLNSFQSLALNPPTFQSLALNTTAFQSLALNPPAFQSLGLNSAFQSLALNPPAFQSLGLNPQAFQSLQNSISPILRNPITGNE

SEQ ID NO: 129538 - protein, 62 aa, Heterodera glycines
  Coding regions on vcDNA: vcDNA=SeqID_55961; Strand=+; Position=1 -48,269-409
MIKILVLRSLNISMKMNRMPSAASALKATQKRHSKRNHLQAVGWTLKCMPEKCENPLPWCNF

SEQ ID NO: 129539 - protein, 71 aa, Heterodera glycines
  Coding regions on vcDNA: vcDNA=SeqID_55962; Strand=-; Position=1 -46,384-553
MLTTNLTFIFRHKVFWGDKNLKYPTMTIYILPTCMKKLFGDSICCFSLLAAEGVAAHWSTFDCSEKLNSMI

SEQ ID NO: 129540 - protein, 99 aa, Heterodera glycines
  Coding regions on vcDNA: vcDNA=SeqID_55963; Strand=-; Position=1-297
  Homolog annotation: Hit_ID=NP_741147.1; Match level="QueryCoverage =95%, HitCoverage=13%, E-value=3e-24, Identity=54%"; Hit description =rna helicase (84.4 kD) (3G680) [Caenorhabditis elegans] gb|AAB52678.1| Hypothetical protein F56D2.6a [Cae
MSHINPLNNRPYSSKYFELLETRRRLPVVKYQHQFVQHLQSQKQCLLIVGETGSGKATQIPQWAMDFVHGTAQKVICTQPRRLAAMCVANRVAEEMDVS

SEQ ID NO: 129541 - protein, 91 aa, Heterodera glycines
  Coding regions on vcDNA: vcDNA=SeqID_55964; Strand=+; Position=1 -225,273-323
MFSFVEEGWLFSALSLGTLLGTILIGHLCTLVGFRRTFTAYGILNGLGTVAVPLAVKFLTKPFHFVAIFGARFFQGIFLSMSLVAIGNMMC

SEQ ID NO: 129542 - protein, 44 aa, Heterodera glycines
  Coding regions on vcDNA: vcDNA=SeqID_55965; Strand=+; Position=1-132
MPLSGFLCDSSLGWPGRLLFPWHSDAFHIFTFLFVLSGNAITAQ

SEQ ID NO: 129543 - protein, 18 aa, Heterodera glycines
  Coding regions on vcDNA: vcDNA=SeqID_55966; Strand=+; Position=1 -38,96-114
MGIWVRKEKGINCMCSYA

SEQ ID NO: 129544 - protein, 82 aa, Heterodera glycines
  Coding regions on vcDNA: vcDNA=SeqID_55967; Strand=-; Position=1-248
MFSNNSFGATLILCWMGNRNRKGRSFIRRKTSQEIEDKGVFLFQSSDFGINYDKNRPKMVKRSDVEEVRGHQFSDDETNPSQ

SEQ ID NO: 129545 - protein, 100 aa, Heterodera glycines
  Coding regions on vcDNA: vcDNA=SeqID_55968; Strand=+; Position=1 -144,193-300
  Homolog annotation: Hit_ID=NP_498121.1; Match level="QueryCoverage =99%, HitCoverage=45%, E-value=4e-22, Identity=52%"; Hit description =yeast HydroxylAminoPurine sensitivity related (20.5 kD) (hap-1) [Caenorhabditis elegans] gb|AAG00041.1| Y
NDKSAYSLCTVAYSEGKDKPIHLFTGLTNGQIVEPRGSREFGWDPCFQPDGFQKTFAEMTKEEKPDGFQKTFAEMTKEEKNQISHRAIALGKLREFLQNE

SEQ ID NO: 129546 - protein, 53 aa, Heterodera glycines
  misc_feature (43)..(43): Xaa can be any naturally occurring amino acid
  Coding regions on vcDNA: vcDNA=SeqID_55969; Strand=-; Position=1 -53,94-255
KERAIRSITSFDRFMACLFQCQTVAKHCHRKQSEFVEGLLVMXEQSKKSAKRQ

SEQ ID NO: 129547 - protein, 140 aa, Heterodera glycines
  Coding regions on vcDNA: vcDNA=SeqID_55970; Strand=-; Position=1 -192,316-546
MANEFDPNWNDEEISAHMGNLTDREAGSRLMHPRPSERSLFKDDEHFFGILTDYEMQKKEISEKAIHLLHKHILGSREPHAAGVYRSNDLLVLEKKPTAAKEVPAQMKEFVHWANSNENNGDIARFAALVHYKLVNDSFT

SEQ ID NO: 129548 - protein, 86 aa, Heterodera glycines
  Coding regions on vcDNA: vcDNA=SeqID_55971; Strand=+; Position=1 -85,157-332
MENSLRTDVLLPHHPICSFGPCPLATFLGKEKTKIGIEKFVYFLFHTAALHFTSHKNIIIFHAVISYPFFMLEIPTNLIFFFNLHI

SEQ ID NO: 129549 - protein, 319 aa, Heterodera glycines
  Coding regions on vcDNA: vcDNA=SeqID_55972; Strand=-; Position=1 -11,71-349,410-851,911-1071,1542-1608
  Homolog annotation: Hit_ID=AAL78214.1; Match level="QueryCoverage =45%, HitCoverage=74%, E-value=5e-09, Identity=27%"; Hit description =putative esophageal gland cell protein Hgg-20 [Heterodera glycines]
MNRRWVCNDVWMDIFPSFDRAQLGLKMALLSPRFDALVDKHFDGKTQFTIWKAIEIRKDTDEMPKLFVEGKSEGFPLPDRPLPNKIIFSSYKQLQIQYIDHFVIEFLRSNQQIWDKGTKLKIIVWEKNEDNKPILDDVVREIWPFFATNIRQFGFDGAEFLDNLRRLISPTILSDLDQLNSILPGDLFPDVLADDDFDGPNATSAGQALAKWLHNPRKDGQPKSLHCWEMMASTNFEWLNSFKEVFVRARTSVSYTVYFTFFVSAPIEPFELVNEQTKEKLTLKKESDIGSSHSWLLKPLSPPAAAAEKEASQSSEKGV

SEQ ID NO: 129550 - protein, 106 aa, Heterodera glycines
  Coding regions on vcDNA: vcDNA=SeqID_55973; Strand=-; Position=1 -175,666-811
MSLLRAQRFVVERFDGCSVYHTPLPYEFVVTNFTKIEVVQFAPKLVESFEKLIPGCLYNECLQIHCEVASIKIGVGRVNFEEILTTPVKRRSSETFDQIKKSQKNG

SEQ ID NO: 129551 - protein, 123 aa, Heterodera glycines
  Coding regions on vcDNA: vcDNA=SeqID_55974; Strand=+; Position=1 -160,515-726
MHKGCSKVPSTSDVRSPSVKRKRMISNLEIEEDEEITTSDEEREATANANKEPENDDEDEEEESEDEEETPLPEALAVTRSRRANAGRRMAELMAQQTNEKDDFYGTLYGGFEEVFLFSKTIF

SEQ ID NO: 129552 - protein, 29 aa, Heterodera glycines
  Coding regions on vcDNA: vcDNA=SeqID_55975; Strand=-; Position=1 -37,292-344
MGIWVKLLTKVGAHYPLKINCISVSEVTS

SEQ ID NO: 129553 - protein, 186 aa, Heterodera glycines
  Coding regions on vcDNA: vcDNA=SeqID_55976; Strand=-; Position=1 -87,564-934,1063-1165
  Homolog annotation: Hit_ID=NP_498881.2; Match level="QueryCoverage =100%, HitCoverage=14%, E-value=2e-27, Identity=38%"; Hit description= transient Receptor Potential channel subunit (118.1 kD) (trp-1) [Caenorhabditis elegans] gb|AAA28167.3|
MLNPLERQFLDAAEKGNRPVLEACLAKQLPDVRIGNALLVGAKFWFAIQKVTWMALQMKAMAIQCFTFPPPKCAIREGVYELVEVSGGTKGQNQRKTQRIKKVLVNHPSITSKTKANPNTNICTAKLRSGDMLGEGWAKYLDPTETATSEYSSDISPVIMAAHLIQFEILQMLLRKDANIEKPHKH

SEQ ID NO: 129554 - protein, 141 aa, Heterodera glycines
  Coding regions on vcDNA: vcDNA=SeqID_55977; Strand=-; Position=1 -192,841-1074
  Homolog annotation: Hit_ID=NP_502119.1; Match level="QueryCoverage =99%, HitCoverage=9%, E-value=1e-59, Identity=77%"; Hit description =AMOP domain containing protein family member (4M59) [Caenorhabditis elegans] pir||T22643 hypothetical prot
VVTWYNTGSAVSGRSDLDGGQLATYQAIWLTDQPGRLSYVIINYDKLGFDAADFRANSRSGRCRALFNGGNHTGFVDVDPTQLYKNSPKILAQRSGVPHMVRGRYMFRVDDVVRPGGCSNKTGGTCIRIFIMKIMALLSKC

SEQ ID NO: 129555 - protein, 92 aa, Heterodera glycines
  Coding regions on vcDNA: vcDNA=SeqID_55978; Strand=+; Position=1-304
MIGRAVRNRPFIFEGIFKFILYPRKMAISFFEKFYTSQKRLRMRRRAVHNRHFISQRIFIFRGYPRKMDISFFDKFYTHTNALEHDREGGAQ

SEQ ID NO: 129556 - protein, 208 aa, Heterodera glycines
  Coding regions on vcDNA: vcDNA=SeqID_55979; Strand=-; Position=1 -197,251-408,452-720
MMKGIREAIDQKYIKQAFVMINEDKEDPDVSLYISIAYSLAFLQVATEVFSVGFCYNEQHTMTVLDDKGNRIVSFGYKGEKVFRMQVKHIIKKLSVVTKNLEPLKKGAVPYLKLTYYENTPDDYEPSMFKHCENTYTFNKSNPPTFYKFGDISNKETAISFVLESVYIKGADVATLDDLLFDQAGYKDNDEVNMLDVTAEGFFASEEV

SEQ ID NO: 129557 - protein, 21 aa, Heterodera glycines
  Coding regions on vcDNA: vcDNA=SeqID_55980; Strand=+; Position=1 -54,576-587
MRTRPIWQVKQRLLTSQKKGF

SEQ ID NO: 129558 - protein, 127 aa, Heterodera glycines
  Coding regions on vcDNA: vcDNA=SeqID_55981; Strand=+; Position=1-384
MTFQSLGFNPSAFQSLGLNSPAFQSLGLNSPAFQSLALNPPTFQSLGLKSPALQTLGLNPPTFNDIPIAETQPTSISISGTQFSCISITGTQFSCISITGTQPTNIPITGTQISGITNTGTQPTNFQ

SEQ ID NO: 129559 - protein, 64 aa, Heterodera glycines; identical to SEQ ID NO: 129150
  Coding regions on vcDNA: vcDNA=SeqID_55982; Strand=-; Position=1-900

SEQ ID NO: 129560 - protein, 48 aa, Heterodera glycines
  Coding regions on vcDNA: vcDNA=SeqID_55983; Strand=+; Position=1 -70,260-336
MLITRFKGYVMIPRLCNLVESEKNNSTQKFGPQMSGLTSPPPAPLYRS

SEQ ID NO: 129561 - protein, 31 aa, Heterodera glycines
  Coding regions on vcDNA: vcDNA=SeqID_55984; Strand=+; Position=1 -72,255-278
MNKRTKMKTKIALIIFGTTICWLSDKLGRIS

SEQ ID NO: 129562 - protein, 83 aa, Heterodera glycines
  Coding regions on vcDNA: vcDNA=SeqID_55985; Strand=+; Position=1 -65,502-686
MEFAPPKFVEPKKPLNKKTAGRIFVTATKAEQIPIELVLLRNFNCPFNGSDHHAPGNVCIWRAARYSSAAPTYFPSMDGLMDG

SEQ ID NO: 129563 - protein, 61 aa, Heterodera glycines
  Coding regions on vcDNA: vcDNA=SeqID_55986; Strand=-; Position=1 -60,347-472
MAARLGIRFGLLMNLLLDTVTVASELLETMAMADMFFPSDHFFCFPDAFVGTLLVHTIIKI

SEQ ID NO: 129564 - protein, 19 aa, Heterodera glycines
  Coding regions on vcDNA: vcDNA=SeqID_55987; Strand=-; Position=1-57
MPIYRCYHHHFAGSTSRAT

SEQ ID NO: 129565 - protein, 159 aa, Heterodera glycines
  Coding regions on vcDNA: vcDNA=SeqID_55988; Strand=-; Position=1-477
  Homolog annotation: Hit_ID=CAE73419.1; Match level="QueryCoverage =97%, HitCoverage=12%, E-value=3e-10, Identity=32%"; Hit description =Hypothetical protein CBG20862 [Caenorhabditis briggsae]
MSLNNWVNDELHKVIGYSDSSTVAYMIALARKSNDCDDFLKRLQDVVPTNNLKTFAEKLLERVPRAGMFFLRNAREYPSSLAAKKVTPITKGPSESELQNLRLKNLSATLKPLAYEVEEPGTSTKEAKSGREKKRTRNTRKRWESSSSSSEDEQPNEVA

SEQ ID NO: 129566 - protein, 52 aa, Heterodera glycines
  Coding regions on vcDNA: vcDNA=SeqID_55989; Strand=+; Position=1 -104,375-429
MSGPQMSGSTKVGSPNVGSPNVGSPSCKSPKVASRNSGGKPGTYKSRTDFIL

SEQ ID NO: 129567 - protein, 29 aa, Heterodera glycines
  Coding regions on vcDNA: vcDNA=SeqID_55990; Strand=-; Position=1-87
MAFLEAKNDPMLVFDELMFKWLAFSEADN

SEQ ID NO: 129568 - protein, 39 aa, Heterodera glycines
  Coding regions on vcDNA: vcDNA=SeqID_55991; Strand=-; Position=1-119
TTTLGQILVEKGTGVTIDLYTFHRNKELWGDDADEFRPE

SEQ ID NO: 129569 - protein, 89 aa, Heterodera glycines
  Coding regions on vcDNA: vcDNA=SeqID_55992; Strand=+; Position=1-271
  Homolog annotation: Hit_ID=CAE65743.1; Match level="QueryCoverage =79%, HitCoverage=13%, E-value=5e-10, Identity=45%"; Hit description =Hypothetical protein CBG10828 [Caenorhabditis briggsae]
VSQKLQRTIEKTRQHGGITSLAAKSHGSTAAGTASSISFTPVHGLEIVTPMQKEEASGKASTYFTPSTNFIAPTKPAIKKVKQQMQKME

SEQ ID NO: 129570 - protein, 166 aa, Heterodera glycines
  Coding regions on vcDNA: vcDNA=SeqID_55993; Strand=-; Position=1 -113,252-639
  Homolog annotation: Hit_ID=CAE61451.1; Match level="QueryCoverage =92%, HitCoverage=27%, E-value=2e-09, Identity=33%"; Hit description =Hypothetical protein CBG05342 [Caenorhabditis briggsae]
MTFDVITRVAMGQRESRQFHSEDAKWAVAAFLRFQNNWFEYLATLFPWLGAKVIKPFIRQTGKIRHDPFALMDNKIREAVKERRRTRQHHHEQQHQNNGNNNQFESDQKRQVDFIDLFLDAVTDEENIEYKNQFCVFNKAVTKVVGWAKCNKFLSFFLIGLKSEFL

SEQ ID NO: 129571 - protein, 100 aa, Heterodera glycines
  Coding regions on vcDNA: vcDNA=SeqID_55994; Strand=-; Position=1 -65,135-369
MFWLILLQISFLFFCLFLAFYFFWLYRAAYWKRRGIPCPDGKLFSGNLDEMFWEEKLRFFQLAKWTEQYGKVPPPPLLGFYDKLLTYSGSLVCHHTLKRG

SEQ ID NO: 129572 - protein, 41 aa, Heterodera glycines
  Coding regions on vcDNA: vcDNA=SeqID_55995; Strand=-; Position=1-163
KQKMGKIIKLIAWLKFNQINISWYHSIALIVLFQNIIFLNF

SEQ ID NO: 129573 - protein, 95 aa, Heterodera glycines
  Coding regions on vcDNA: vcDNA=SeqID_55996; Strand=-; Position=1-818
MFEYPKRTLEKIDFFVFGAVPPNRCAQIYGETESFGNSFPIVCTLILRWIFAPHKCLSTPNGHLKKSIFLFSGQSPRTDAPRFMGRPNPSGIASL

SEQ ID NO: 129574 - protein, 26 aa, Heterodera glycines
  Coding regions on vcDNA: vcDNA=SeqID_55997; Strand=+; Position=1 -27,151-204
MQTYGWAERLAPIKKNANKAIRDALL

SEQ ID NO: 129575 - protein, 110 aa, Heterodera glycines
  Coding regions on vcDNA: vcDNA=SeqID_55998; Strand=-; Position=1 -109,427-559,643-730
MFKLSFVLLFCTICCNATNGTTANEEQKEETTEQLQVTTPQPSTAPTFVLDEENVQTLVEDAIDYSHKVFLITRLPTAKDKSNMSVFAPFTLFPSPYPREMYKQAIDVAK

SEQ ID NO: 129576 - protein, 356 aa, Heterodera glycines
  Coding regions on vcDNA: vcDNA=SeqID_55999; Strand=+; Position=1 -93,196-264,322-579,670-833,880-1366
  Homolog annotation: Hit_ID=NP_503545.1; Match level="QueryCoverage =97%, HitCoverage=76%, E-value=8e-97, Identity=50%"; Hit description =ALDH3C2, ALdehyde deHydrogenase (48.8 kD) (alh-5) [Caenorhabditis elegans] gb|AAB94178.1| Aldehyde dehydr
MREMIVQNKDKICEAIYKDLRRNKETNMKMEVDGPLQAIDYCLSELDEWMKPQKLDDHQLGKPLVIFEPKGVALVITAWNYPAALAFQPAIEAIAAGKKTSKFWNLTFSISGNTVVIKPSEVSPNTSKLLKEMFDATFDKKFIAVVEGAAPETQALLDQRFDHIFYTGSSSIAKLIMQAAAKNLTPVTLELGGKCPVVVENDADLEKAALRIAEGKWLNSGQTCLAPDYVMTTAEMKPKLVNALQKSIQTLYGENPKKSEQYSRMVNQRHFDRVKALLDKTNGKVLYKNGEPDRDDVFIPPVLVDTDLKDALMQEEVFGPVLPILTVKGLDEAMDVINDGEKANASRPNIKINLTL

SEQ ID NO: 129577 - protein, 228 aa, Heterodera glycines
  Coding regions on vcDNA: vcDNA=SeqID_56000; Strand=+; Position=1 -266,292-714
  Homolog annotation: Hit_ID=NP_702063.1; Match level="QueryCoverage =87%, HitCoverage=4%, E-value=2e-11, Identity=19%"; Hit description =hypothetical protein PF14_0175 [Plasmodium falciparum 3D7] gb|AAN36787.1| hypothetical protein [Plasmodium
TGTQPTNISMSFQSLGLNPPAFQSLRLNSQAFQSLGLNPPTFQSLGLKSPAFQTLGLNPPTFNGIPISGTQPTSISISGTQPTSISISTLGLNPPAFQSLGLNSQAFQSLELKSLAFQTLGLKSPAFQTLELNPPTFNDIPITENQATSIPILGLNPPAFQSLGLNSPAFQTMKSPAFQTLGLNPPAFQSLGLNSQAFQSLELKSLAFQTLGLKSPAFQTLGLKSAAF

SEQ ID NO: 129578 - protein, 179 aa, Heterodera glycines
  Coding regions on vcDNA: vcDNA=SeqID_56001; Strand=+; Position=1 -76,186-280,556-677,752-998
  Homolog annotation: Hit_ID=CAE69483.1; Match level="QueryCoverage =66%, HitCoverage=62%, E-value=1e-42, Identity=66%"; Hit description =Hypothetical protein CBG15686 [Caenorhabditis briggsae]
EEDDVEKGRTKNPFDQRKEEDAELDQVTISTTAMSAGTQNATGQGHVHKVIMVGSGGFVENYEPTKADAHRKQVVLDGEYCAVDILDTAGQEDYSAIRDNYYRSGEGFICVFSITDLDSFDQLVEFREQILRVKNADPNVCILLVGNKSDLDAERKVPLEQAQQRDQFHQRWKGALFCI

SEQ ID NO: 129579 - protein, 404 aa, Heterodera glycines
  Coding regions on vcDNA: vcDNA=SeqID_56002; Strand=+; Position=1 -183,306-764,857-1032,1104-1264,1727-1959
MNSDNSSAINSKSFDQISEIGSMATDGLLQDDGVPDYAKIIIKQQQALIATLMNMQQQQQESRYASTISLFQQHQPHFLSNNDSSFPPPGIPTHPSPPPGIRPPVSPAPVSAPPPPPPGFRAPPGFNVSVSSRKFELDSTKSDTGGSHKFDIREELKKAFALDDTNENDSSSAEQQNLSPRSQNIREAQNARLPMSSSFSSIENLQNFTGLSQQDSSSPVSALSRQPIAAAVPSPQSASSSVCALALNYVLVDQMVLNYERVYEQKEKMASETLTMVDRQSSPERSIYQRFANLGAVLYILQRLHRLHPDGFTVAQYVQFENVRNIGSNLFRLLRRCSSNNAIRVQHLLEISVKRFVVSLHHSKCHFSPNWCPSAPPCPTPTLWSTCAIASRPFSNCVVRLKTI

SEQ ID NO: 129580 - protein, 118 aa, Heterodera glycines
  Coding regions on vcDNA: vcDNA=SeqID_56003; Strand=+; Position=1 -187,244-495
  Homolog annotation: Hit_ID=CAE71346.1; Match level="QueryCoverage =62%, HitCoverage=19%, E-value=2e-20, Identity=60%"; Hit description =Hypothetical protein CBG18249 [Caenorhabditis briggsae]
MSARIQHEAFFEHFGIVLDNAEGVYFSGQEIAGKVVIECREPRRISELLLEVKGRARTHWTKSRKMCSENETYFCEQFNTEYTRKLPKTEAENDAGGGTPREGGRTVAERRRESIKMM

SEQ ID NO: 129581 - protein, 33 aa, Heterodera glycines
  Coding regions on vcDNA: vcDNA=SeqID_56004; Strand=+; Position=1-101
CLSLFLRNFIHIQMLSSMIGRAVRNLPFIFEGI

SEQ ID NO: 129582 - protein, 92 aa, Heterodera glycines; identical to SEQ ID NO: 125147
  Coding regions on vcDNA: vcDNA=SeqID_56005; Strand=+; Position=1-304

SEQ ID NO: 129583 - protein, 121 aa, Heterodera glycines
  Coding regions on vcDNA: vcDNA=SeqID_56006; Strand=-; Position=1-366
MHNHTSQTPARGQPMMVNRTRIMDSGRIEQLSSVKEWKEFAKLGKPVPLNQIRFTTPPCPIPPFLAVSSNSPNGATNTLPGVSRTANNFPNLVCVRVPLAPTPLPQYLVTLPTHFPMHHNH

SEQ ID NO: 129584 - protein, 133 aa, Heterodera glycines
  Coding regions on vcDNA: vcDNA=SeqID_56007; Strand=-; Position=1 -37,475-806,1342-1374
MWRRIVLLCTVPGADEKAEIVMEIELLNGNSAMLSHERAMALEQRGKVKEWTGAIRIIAGGAEPYSRRIETKYRIHSDFGIWKKIVEILTDETSQKENIEENDSENSVGKFRVVLIYLEQWARRAKKSEKQRT

SEQ ID NO: 129585 - protein, 209 aa, Heterodera glycines
  Coding regions on vcDNA: vcDNA=SeqID_56008; Strand=+; Position=1 -279,629-979
MDQQHAHAHQQHPTDNSQPKQQFQPQQLDLHLGQMVDPSFLLQDFQLAQSVTVGVNGQVGMVPFLGFDLQQQLNSLATAPATDHQQMNAVSVDIGPNATRFLPSVTKVQQEKNMSAEFVNDRQHIGYDLFCTTVNRGTAVVELEEFEVRNGASLPTYGQHHFTSADQFGQLGIDQHRFVHLSAGQILEGKQIKAEEQQQPPGTTVAMSY

SEQ ID NO: 129586 - protein, 266 aa, Heterodera glycines
  Coding regions on vcDNA: vcDNA=SeqID_56009; Strand=+; Position=1-801
MKFAKKMLMIPEAEYLALRSAMNSGDYLQNEKASLDAKISQNLQDPDISEDLKAKRHDWLYKERRTVKGILENRPQKVVIENHVPGPNVAPYLGLNTQSKPQETDEHRKIIIPRKRLEEQTPDPESDNDTINELTPEPQTTSTLKPIPIKTIIHPTLLNGLFRYVKENKDLFKITAAGKVQSNMNLPIENSNYRDVLLYLAGKKDETPRGAKFLKDRLLKDPTVKDMVDKSKVMWGRGRKKAIKSIKTPGIVREKKPFKPLIWARL

SEQ ID NO: 129587 - protein, 88 aa, Heterodera glycines
  Coding regions on vcDNA: vcDNA=SeqID_56010; Strand=+; Position=1-314
  Homolog annotation: Hit_ID=CAE70160.1; Match level="QueryCoverage =79%, HitCoverage=38%, E-value=1e-20, Identity=64%"; Hit description =Hypothetical protein CBG16627 [Caenorhabditis briggsae]
GLCHDQQQRLERCVMQAHWSGLFPDRTIPEFDRAGYKRFNRHWDDDLAMFRLKYKLHPGSWFYIKRYNPRIREYRPFKADEIPDIERE

SEQ ID NO: 129588 - protein, 103 aa, Heterodera glycines
  misc_feature (7)..(7): Xaa can be any naturally occurring amino acid
  Coding regions on vcDNA: vcDNA=SeqID_56011; Strand=-; Position=1-310
  Homolog annotation: Hit_ID=CAE70160.1; Match level="QueryCoverage =90%, HitCoverage=52%, E-value=2e-22, Identity=54%"; Hit description =Hypothetical protein CBG16627 [Caenorhabditis briggsae]
LSCSDIXLAFSFLWLLSSILPKTGLCHDQQQRLERCVMQAHWSGLFPDRTIPEFDRAGYKRFNRHWDDDLAMFRLKYKLHPGSWFYIKRYNPRIREYRPFKAD

SEQ ID NO: 129589 - protein, 45 aa, Heterodera glycines
  Coding regions on vcDNA: vcDNA=SeqID_56012; Strand=-; Position=1 -9,1070-1198
MNFVYDNGDGWHFVFTFGWKSPKMCRTWVEKGPDFKISPNQCSKY

SEQ ID NO: 129590 - protein, 115 aa, Heterodera glycines
  Coding regions on vcDNA: vcDNA=SeqID_56013; Strand=-; Position=1 -36,344-409,464-520,576-641,699-758,814-873
MRQQTGRENWGGFYTPGGTETTAAVNARRGQKRRVFKLKGNVEMNEADRTANEELDNVINISANANANNGINGDEAAAAVSDGDANANNETNCQGAAAGMSDGGANANNGTNAET

SEQ ID NO: 129591 - protein, 260 aa, Heterodera glycines
  misc_feature (35)..(35): Xaa can be any naturally occurring amino acid
  misc_feature (253)..(253): Xaa can be any naturally occurring amino acid
  Coding regions on vcDNA: vcDNA=SeqID_56014; Strand=-; Position=1 -118,538-1039,1081-1191
  Homolog annotation: Hit_ID=NP_917837.1; Match level="QueryCoverage =92%, HitCoverage=10%, E-value=4e-34, Identity=37%"; Hit description =B1158C05.18 [Oryza sativa (japonica cultivar-group)]
LTSYGPGTQMSLSGQKFFLFPGKNRKFSEKNTSRXSSKNYFDVAQLNQLNPMGMPTHLLRLKTGSIVVLLVNLNTSKGLCNGTRLLVKKLTDNLIECETIGGGFSAKIVGIPRNRHTYKDKRPDGVSFERFQFPVRLAFAMTVVKAQGQTAFRLGIDFTEEPFAHGQLYTALSRATSRDNIRIFAPNKPLDDNGNPLIRNIIASGIISCLFCQITAINKSFIPIISCLFCQITAINKSFIPNPGQTHPLLFKXGGWLDGA

SEQ ID NO: 129592 - protein, 1103 aa, Heterodera glycines
  Coding regions on vcDNA: vcDNA=SeqID_56015; Strand=-; Position=1 -79,209-3438
  Homolog annotation: Hit_ID=NP_920205.1; Match level="QueryCoverage =90%, HitCoverage=64%, E-value=2e-93, Identity=28%"; Hit description =putative DNA helicase homolog [Oryza sativa (japonica cultivar -group)] gb|AAP52492.1| putative DNA helica
MIAKEFLSNENVYNSLLAFASVSVGYPFMQRTQNIAYGGDRVNETTIKKLDFIIRKYNPLAQELVNFHKQYQNTLKEKGPEAVLNFRLTLVEARDAPASVRDVSIHSRQANLPDEGNSLFAVWAESEQPPFLKGIWITNDEGKLKKFPPHHPLTDSLCYPLMFPHGDNGFHLKIPYNPLNKPEKNEAMEIDVESDENTGDSDADASDDDNESVASSVDSVDKRGPRQFLSIRSYIRYRMALRKHKNIHNIWSSGGGLSQKFTLDYAARIDTNVANYLRRPELNLRSTLPENALRWLSRNAGLSSTEDLGSIVMFRRSEPGTRAYFQHKFYDATTIMSRFKKPGNASFFLTFTTNPRWREISRNFLHKGQKTVDRPDLICRIYEDKLRHLHYLIDKKNILGKMIGQECREFQKKYGGPHAHRVYHTSLLAIPENVDNIIWAHIPEEPAKNDKSDWANFIRKLRELLPKFQFHDCGPHCLNKKGKCKKGFPKPFSKFTVLHDDRPAIYFRPSPEEGGQTLTVKRGKAQVIYDNSRISSYNPYILVHFETHHNLEYAYGQSTNLKYLYKYPFKGPSFSYVKTNEENGKISIDEPAFYARMLYRSSPEAYSRIMSYKYAKLSHTVIALSLHLPGQQKVYYKSGQEEAIGQQLQAGILPETPLTAYWKMCETNPDVKKILFERMPEQYSFNRSGKFWKKRVISTNPRPKTRERKPIIGRIYPVSPRNPELFALYLLTKHFPGNPQQLKIVNPPHVCSTFLEAARLRGLIDDSDVWIRTMTEGSASLGPAQMRQLLANILIFGATENCLIDGALLWDKFLHHMCDLRCTDAERPARIDRALVLLEKLLVRLGKQCKDYGLPTPTISIMNNPQLGLDEFFFPQHANDDDANDIDTSSYERGKLNIEQQKFFDLVKTAFIDSRCSRLFYLYGDGGTGKTYLLNYILYHLRRIGAKIIPTASTGMAATRFYAGGTTVHSAFKFGINVEPGKLPSIPFDSFFGRRITECDIIIIDEMTMLERTVLENIDALCRLMCSQKRHLPFGGKCVIISGDWKQSLPVVIDSYGSPAQVSACIQSSPLYSLFTKFKLTQSMRVNPNEIEFLKWLDDVGRG

SEQ ID NO: 129593 - protein, 266 aa, Heterodera glycines
  misc_feature (206)..(206): Xaa can be any naturally occurring amino acid
  misc_feature (226)..(226): Xaa can be any naturally occurring amino acid
  misc_feature (243)..(243): Xaa can be any naturally occurring amino acid
  Coding regions on vcDNA: vcDNA=SeqID_56016; Strand=-; Position=1 -32,262-383,461-583,641-776,1129-1222,1273-1428,1650-1669
  Homolog annotation: Hit_ID=NP_491636.1; Match level="QueryCoverage =98%, HitCoverage=23%, E-value=2e-64, Identity=52%"; Hit description =tensin (1G152C) [Caenorhabditis elegans] gb|AAK77616.1| Temporarily assigned gene name protein 163, isofo
HYSPSPHLQNGKSTFSDRKCLSDSSDVIHHHPVFVKDTSRYWYKPTISREEAIAMLKDKPPGIAMLKDKPPGTFIVRDSNSFPGAFGLALKVAQPPAGVPSSDGNELVRHFLIGNELVRHFLIEPSPKGVRLKGCSNEPVFGTLAALVYQHSITPLALPCRLILPEFDPAATPEHLNSNHSLLHNITPYNFTYFYSINTKSLTTPXPFHNFTYFYSINTKSLTTPXPFHLSTPHFFQLLQTHXLNSLSHFKLSSHSITFTDNLKIL

SEQ ID NO: 129594 - protein, 18 aa, Heterodera glycines
  Coding regions on vcDNA: vcDNA=SeqID_56017; Strand=+; Position=1-56
YREAIPEGFGLPINLGAS

SEQ ID NO: 129595 - protein, 102 aa, Heterodera glycines
  Coding regions on vcDNA: vcDNA=SeqID_56018; Strand=+; Position=1 -35,118-391
MLNRANDQFLLCFILKIKDEEEYQRNKMRPHEIDQTRPVAEVPRTKKYLENDRAIKNLIEQFDQLGPDQRDDQRWITHLHALSFRLTTKGIQMHLSAGHLLG

SEQ ID NO: 129596 - protein, 167 aa, Heterodera glycines
  Coding regions on vcDNA: vcDNA=SeqID_56019; Strand=-; Position=1 -79,179-603
  Homolog annotation: Hit_ID=NP_955828.1; Match level="QueryCoverage =95%, HitCoverage=30%, E-value=6e-10, Identity=29%"; Hit description =internexin neuronal intermediate filament protein, alpha [Danio rerio] gb|AAH65939.1| Unknown (protein fo
MAKILEEEAEGEEREREKFGEFLKKRKRFLGELLDTDGIRKIKELLNYEVIFGISKKNYRKFAHFLFQNEYFSASENLKSDSSTSEEEEEKEEEEEGEKGKEKKEEKEVGKGVGKEEEEGGGEKEKRKERGKGGGGGSSTESDQTFEEINGIFNEEKKNNVKEKRQK

SEQ ID NO: 129597 - protein, 234 aa, Heterodera glycines
  Coding regions on vcDNA: vcDNA=SeqID_56020; Strand=-; Position=1 -388,798-1115
  Homolog annotation: Hit_ID=AAO52309.1; Match level="QueryCoverage =99%, HitCoverage=35%, E-value=2e-24, Identity=28%"; Hit description =similar to Oryza sativa (japonica cultivar-group). Putative histone acetyltransferase [Dictyostelium disco
KVEEEQKVEEKVEEEQKAEEKVDEEQKVEEKDKEEVEVEEKVEEEQKAEEKKRNRKWKRKWKKQKVEEKVEEEQKVEEEQKVEEEQKAEEKVDEEQKVEEKVEEEQKVEEEQKVEEEQKAEEKVDEEQKKVSSATSIDYSDRNPIEKPTKTTEDKSLRSQQQSNDDSDLTEQQQQQQLSPNCPLRRSTRVSVLNAKKQTQQNERTESERSADSATKDNDDELEMVGNRRLQQNH

SEQ ID NO: 129598 - protein, 59 aa, Heterodera glycines
  Coding regions on vcDNA: vcDNA=SeqID_56021; Strand=-; Position=1-179
MLATPLFLFLITQLLLIGAVVGNDQPIATTLIEKLRSFLKNMLDTVTEIDEANSRQLIV

SEQ ID NO: 129599 - protein, 95 aa, Heterodera glycines
  Coding regions on vcDNA: vcDNA=SeqID_56022; Strand=-; Position=1 -87,178-225,271-293,345-397,453-528
  Homolog annotation: Hit_ID=AAT38471.1; Match level="QueryCoverage =83%, HitCoverage=58%, E-value=2e-09, Identity=38%"; Hit description =IL5 receptor binding protein [Brugia malayi]
MDAVKRELAEAKQIRKNRQEYDALAKLIKDELEEAYAKQKMLEQRLIEKRKNMYTLAVLLDNLEEMNKESEDVPMSEGDDASPAGAVPSSSAGSL

SEQ ID NO: 129600 - protein, 638 aa, Heterodera glycines
  Coding regions on vcDNA: vcDNA=SeqID_56023; Strand=+; Position=1 -79,761-894,937-1080,1247-1357,1405-1532,1617-1829,1934-2007,2052 -2222,2270-2448,2508-2666,2713-2779,3248-3417,3460-3530,3638 -3749,3815-3916
  Homolog annotation: Hit_ID=XP_319986.1; Match level="QueryCoverage =98%, HitCoverage=70%, E-value=7e-23, Identity=20%"; Hit description =ENSANGP00000005315 [Anopheles gambiae]
MGEKREKKREGKDKEKKRKKEREERSTQKHIDSALHIEEEDEEEEQNEEDVEKEELSISDSVVMKSIYAVENHEADGMVSGGDAVPLPSAVADSPFLEVDLNRTLTPQSQWTNESTGTMHSPDDDESSQNGQSSSSQSAPISSALDASLTNLYKEKENDECDDDRSMPRRASERTLDRFEDVRTIASSDIEVIRQMDDWSVTSSYPNSSHQQSNTQKIGQIRSIGELQQSQTPPELTTKLDTSEQSQREMDEKIAILMAKLAHRDQKIEENAAEAKLQSQFAEKEKQLTDLLDEGRKLSEYSGRQAKEVRKLKQQLEQLDIVTAARDSAVEELQEAHQQLQEQENAMEQLRDELENCEHKARKLQAQLDDKMTNATNLEGKVCEQLTKVEALTAEKRRMEKTLQTTSREREELAQENKKLAAKLMNRKAQDRIIGERERGLEEELRQERLKSESANARIRELEQRIECIQDMNRDIAVEYQTVGEGANSPLLITISSLEEKLLGLERENDILTRSTRQMSAELGAMKRRHEAEMGTIERSLEEEKQQNAQKTEELAKAFSERANIQTRIEKLEDELSQSKREHSERVNRMEKRMEQLETDIQAKRNELTELQRKNCEFQQKIIASTVERRNNANSLLI

SEQ ID NO: 129601 - protein, 47 aa, Heterodera glycines
  Coding regions on vcDNA: vcDNA=SeqID_56024; Strand=+; Position=1 -103,386-426
MYFLISFCSAHGHSDNHCVLSDDSVRVFGRRSRHAKCVYFGLILVPN

SEQ ID NO: 129602 - protein, 109 aa, Heterodera glycines
  Coding regions on vcDNA: vcDNA=SeqID_56025; Strand=+; Position=1 -160,877-1044
WCIFGFAVKQQTKLDVDIHLEKGTYAYANYGYLCINGKGKGTNAQYSYGVGDTCFDLKSDDAKSADAVARMAFRIPSPFAVAALQKSPKHQQVDSSTELNWSRQTNARC

SEQ ID NO: 129603 - protein, 68 aa, Heterodera glycines
  Coding regions on vcDNA: vcDNA=SeqID_56026; Strand=-; Position=1-205
DLKSDDAKSADAVARMAFRIPSPFAVAALQKSPKHQQVDSSTELNWSRQTNARCVCLHSVLIFNFQTE

SEQ ID NO: 129604 - protein, 194 aa, Heterodera glycines
  Coding regions on vcDNA: vcDNA=SeqID_56027; Strand=+; Position=1 -129,187-405,588-822
  Homolog annotation: Hit_ID=XP_146481.3; Match level="QueryCoverage =71%, HitCoverage=12%, E-value=5e-11, Identity=28%"; Hit description =PREDICTED: similar to carboxylesterase 2; carboxylesterase ML3; acylcarnitine hydrolase M1 [Mus musculus]
MSQSPSSMSSSSSSAESSHSAGNKGGQPNVCALVAKTGFQKTGHVESHGDHVGKMLGNVSDDSEEGEEEEAAQQQHAEVAVAAMDDASSDSPATSSDEEMPMEQRQQKQRDAEGTEGNTEEAEEDDEGQIGRRKAQLQRNEQDEEEDDMDEMFARDDDVEMHGIEGEEEEGAQSTSQRDAEGEEERQMDTTLGE

SEQ ID NO: 129605 - protein, 237 aa, Heterodera glycines
  Coding regions on vcDNA: vcDNA=SeqID_56028; Strand=+; Position=1 -276,330-768
  Homolog annotation: Hit_ID=AAL78214.1; Match level="QueryCoverage =57%, HitCoverage=72%, E-value=8e-10, Identity=30%"; Hit description =putative esophageal gland cell protein Hgg-20 [Heterodera glycines]
FISADCWLCVFELLAPSQLGLGIALISHRFDVYIGEHFKTRKWALKFIQILLKIGENGTKEMEITNLDGETLPIPKIQLPRKVIGFKRIIINYIDHNVISFLDRLSPLFASFPINLAFGTNKMGILDLVVRNTWPMLGKNIHGIESYPSFLHCLRHFVPSFLNECPPLRFVFFCFGELFPEFPADDNAMASERQAVAKWLFTPLQNDVPKVFKFEFVRNEWENWPSKIDAFKAVISI

SEQ ID NO: 129606 - protein, 345 aa, Heterodera glycines
  Coding regions on vcDNA: vcDNA=SeqID_56029; Strand=-; Position=1 -472,629-703,966-1043,1680-1843,2031-2279
MKDESSVFINLLFDHNFCFLLPIDAESSPLSTTTAVDENLFHQLVHHLFQFILFVVNGQKSNGICGFIFKCSCLNCLFFPYPNHSILCIIMCRPLLFLLVSLSALSFKFALPPELGMPNGPRTGAASSVKVVELSHPATARHGTGTGSGNPYMDYGIEENFSLIGAIFVGQLIFCFLASSDKEFIMKIGTNVNRLKMALQLDWKKAAKTLIQQNGSLSAAEFEEALPLGSFMKDFDGMALRIVALELTKGIGQMHGTKMCKTMPVPKASNIDHLGTNCTQIVFADRMPQFWLNVSVSPYFIACEQFKAPFDPSTMFNQSRTSSDLFDACQKVPTTPNCEKLAHYL

SEQ ID NO: 129607 - protein, 109 aa, Heterodera glycines
  Coding regions on vcDNA: vcDNA=SeqID_56030; Strand=-; Position=1-330
MDKLFCANFAVKTWEKESGAPIECQFDVKSVNAKIDETEQIGTKWVFCMYASANEKLQGKPNIFEQPNKVEEILKPKYFIFNLEIKPTYGNDFVFYMPCVLNSIIINKF

SEQ ID NO: 129608 - protein, 150 aa, Heterodera glycines
  Coding regions on vcDNA: vcDNA=SeqID_56031; Strand=+; Position=1 -135,214-361,835-1004
MKTCVVCTCIVSIVYSIYMNWFPERRPFHCLIQLGYFEPMTSITKYITATLPDAGLYDAVQIAELASICTPFFLYGITVIKMVHDHKKNPSTSINFGHPLATSRHNFSCPTAHSDAVAQQGFALISAQRFDKNIRHNFVTLKSNFDYNHM

SEQ ID NO: 129609 - protein, 329 aa, Heterodera glycines
  Coding regions on vcDNA: vcDNA=SeqID_56032; Strand=-; Position=1 -35,162-437,490-904,955-1218
  Homolog annotation: Hit_ID=AAL78214.1; Match level="QueryCoverage =33%, HitCoverage=58%, E-value=2e-18, Identity=38%"; Hit description =putative esophageal gland cell protein Hgg-20 [Heterodera glycines]
MVCRVSSSVGRLFICGDCWLLVFDFLAPSQLGLGIALINRRFNCIVDEHFKTRKWKLGEIRICYKIGENGTKQMQIVNSDGNPLPIPQNPLPNKVIGFRHINIFYIDQNVIAFLRRFHRFFAVCSTVLYIRTENVRILEFVLLNILPMFRHSMHLMFLNSIAFRRLRQLAPSLLNDCPFLCAVIFYGDILPEFPPDESANASDGQAVAKWLFTPRPDGLPKWLRCFENSPDQWSSTMEQFKAAFSNASSPVTFCIYFPMSSLADFIVPFDRINEVTGEQLALEIYAHDCCLFRCPIAWDRRKWDNVWEEMYVRQNPIYIRIRDGGFDDG

SEQ ID NO: 129610 - protein, 226 aa, Heterodera glycines
  Coding regions on vcDNA: vcDNA=SeqID_56033; Strand=+; Position=1 -58,583-905,963-1207,1259-1313
MNELIIEEKGKVIKGSKLAINLGCFVREIWPIFAPNIRNLVFPNADDLDNLRRHISPTILTDLDQLNSINSYFLVPDGIGDDGPNATAGQALTKWVHTPSKNGQPKRLCCFNANGPQNLEWINNFKEAFRRATTSVSYHIQFYFWVEPMPIEQFELMNEVTNEKLTLKQEIDEFDVNVYNCELRYDNNLGANLNNIRFDLWGGNSCCIGPLSLPAKEEEADESNEK

SEQ ID NO: 129611 - protein, 57 aa, Heterodera glycines
  Coding regions on vcDNA: vcDNA=SeqID_56034; Strand=+; Position=1-173
MISIDASIVVPDWIADDGPNATARQALSKWLHTRAGRNYGLRITDYGNYGLFGVTDY

SEQ ID NO: 129612 - protein, 111 aa, Heterodera glycines
  Coding regions on vcDNA: vcDNA=SeqID_56035; Strand=+; Position=1 -221,497-611
MRISFYKTTTPIEPFELLNERTNEKLTMMKKDFGGSDWLFKRCPIIEETAAVQKDNNLDHLNGVHFSLYNDCFGPLSPPADQNDKESFSTPGPSDQQKKERSFKEMTDHLS

SEQ ID NO: 129613 - protein, 130 aa, Heterodera glycines
  Coding regions on vcDNA: vcDNA=SeqID_56036; Strand=+; Position=1 -111,141-422
MPDLPLPPNQCLGYLDVCCRLLLGVFSISQSGRFSIRVVDSFDPNDAACVEDCQECFTDSVWQDLAYIQSNFGRLSHAITKLETQGLTIQESLEIFAGVQNEMDNAIGEKAERIRERFAFIVSNNAGLET

SEQ ID NO: 129614 - protein, 373 aa, Heterodera glycines
  Coding regions on vcDNA: vcDNA=SeqID_56037; Strand=+; Position=1 -357,587-778,873-1064,1163-1336,1654-1860
  Homolog annotation: Hit_ID=NP_499161.1; Match level="QueryCoverage =95%, HitCoverage=17%, E-value=7e-38, Identity=33%"; Hit description =CBP/p300 homolog (cbp-1) [Caenorhabditis elegans] emb|CAA82353.2| Hypothetical protein R10E11.1a [Caenorh
MGPHLVPQSTPTLSHAMNGPPSSSAGLAGRQWKQCRRWWPHRWALGGGAAAHHLGVPSAMVVVSSTAASSAGQPPPTYNNTNAAMGGGVGQHRMGPHGQSSFVQPQQQQNTGGGQQQHQPMLQGPPMDSHHHQQQQGPPLPMTIAQRQSAAVQQQQQQSSANPNAAGGAMMVAQSPLGAMMNSQQQSMNNANSGGPPQMRGGGIAQQQQMLGAGGGAGQPQDPEKRKLIQQQLVLLLHAHKCQQIERSELRQNRAPCTLPYCSVMKGVLEHMVGCSAGRQCQYAHCASSRQIIAHWKNCNKDDCPQPSSSASACSGPSSVGMNNTSTGPSAAVGPTSVGSVGGGPMSSFGSPPSTSSAVNNLLDGYTPNTLVF

SEQ ID NO: 129615 - protein, 120 aa, Heterodera glycines
  Coding regions on vcDNA: vcDNA=SeqID_56038; Strand=+; Position=1 -162,1053-1253
  Homolog annotation: Hit_ID=CAE65110.1; Match level="QueryCoverage =45%, HitCoverage=2%, E-value=4e-10, Identity=55%"; Hit description =Hypothetical protein CBG09974 [Caenorhabditis briggsae]
MEKLVLGDDQKSADSAASAASRNDSVKKCITSLVHACICRDANCRRGTCHKMKKQQSPWAQPPQSPRQQQIGACGLQQQQQQTVWCAADANVGHDDVTKCNATAAAATERSDGRGSGVPS

SEQ ID NO: 129616 - protein, 126 aa, Heterodera glycines
  Coding regions on vcDNA: vcDNA=SeqID_56039; Strand=+; Position=1-381
MPVFWSITLANCVHWQGPAGLHRVPSSGALQQQMMSPNSQQQQHITPPPYVRSAAAAQQSPLHHQQQQPFVGGGVGAVQPPGQQQQHQERFGTAGAQPQQVVQQHHTKQQQQRLFQQQQQIRGKQK

SEQ ID NO: 129617 - protein, 18 aa, Heterodera glycines
  Coding regions on vcDNA: vcDNA=SeqID_56040; Strand=+; Position=1-56
YREAIPEGFGLPINLGAS

SEQ ID NO: 129618 - protein, 54 aa, Heterodera glycines
  Coding regions on vcDNA: vcDNA=SeqID_56041; Strand=-; Position=1 -49,279-394
MPHWTRAIFSIQQPSRTQRAADFNFSSKKPVFGSVKHREKPNLHPPRPKEYIFG

SEQ ID NO: 129619 - protein, 106 aa, Heterodera glycines
  Coding regions on vcDNA: vcDNA=SeqID_56042; Strand=+; Position=1-321
VAQRYFSSSRKQTEQYLERQANDQYSRRAREHSYRARSAFKLMQINDKMHFIRPGTNNNCESANARLKHSLQDSLRLTRVQVHFCYSFLLKLALCPAPGSWCQVLS

SEQ ID NO: 129620 - protein, 243 aa, Heterodera glycines
  Coding regions on vcDNA: vcDNA=SeqID_56043; Strand=+; Position=1-732
  Homolog annotation: Hit_ID=NP_507780.1; Match level="QueryCoverage =97%, HitCoverage=14%, E-value=4e-24, Identity=31%"; Hit description =predicted CDS, DNA polymerase type B, organellar and viral family member (5T899) [Caenorhabditis elegans]
MFNKSSNYDKVLQHLPPREDYCPDQMKKADLQKFDNWYNYNRSQPFDLKEKLPEYCCNDVRILTHALVELRREFKQLTQRDGKHGGIDILWQAMTIASACVKNFALNHLKPNSLAIVPEKGYTPQQNQSALAIKFFDWYSHINNVNIQTAHSRYGEYVFKREGEVYQVDGYIKGTNGRRDKIIEVNGCVWHGCEICFGNMDEESRMPNGKTLREIREREKRKHKTLRRYVDLELYGSTKSMRS

SEQ ID NO: 129621 - protein, 519 aa, Heterodera glycines
  Coding regions on vcDNA: vcDNA=SeqID_56044; Strand=+; Position=1 -108,161-293,337-448,491-632,675-784,822-948,1063-1357,1399-1547,1662- 1771
  Homolog annotation: Hit_ID=CAE64947.1; Match level="QueryCoverage =96%, HitCoverage=50%, E-value=4e-64, Identity=34%"; Hit description =Hypothetical protein CBG09778 [Caenorhabditis briggsae]
MNDQQPIPSFMTNFPVSGQQKAALQFAFYNTLLFSLLGILGICLASIFAVYRLLYLFLMPMLWALLVGTVLFPLKRMISEGLKGWLDRLDGENRPLLVGLAFLPVQITKGWLDRLDGENRPLLVGLAFLPVQITLQFSFAVYETALSFTGLCLGLGYFALFTGLCLGLGYFALKVLCHYGAFSSLLLLIGRIYGFADSLIEISTRNWVFLLIFCYSLGLVFLLIFCYSLGLGGWIYLHEIGQINKKFARVLSLPIWFFLLAYLSDFFGFFRVFIFILCSLPIWFFLLAYLSDFFGFFRVFIFILCCSLLVLISAGLIGTNAENEDEEKNDEADTETEQSQRENGNGTNVGTALGGEARLDQVKRWISLNWFDLNLLSPKKAFSSDVHLRVIGGLCALLWVVNHDLLLFFFVIIPFAIAFAVHLGAQIGLFAFILAQIGLFAFILQHLTQCKEQIVHKTIKFVHVIVAGPLRKFVHLLFTSDRMFVIGFRDRVDLLSSLIVMAILAVGCLFALLFTLFQL

SEQ ID NO: 129622 - protein, 358 aa, Heterodera glycines
  Coding regions on vcDNA: vcDNA=SeqID_56045; Strand=+; Position=1 -63,169-499,571-1131,1188-1309
  Homolog annotation: Hit_ID=Q94637; Match level="QueryCoverage=41%, HitCoverage=8%, E-value=7e-13, Identity=32%"; Hit description =Vitellogenin 6 precursor gb|AAB49749.1| vitellogenin pir||T18561 vitellogenin vit-6 [similarity] - Oscheius sp.
MKKVAQQQQQQTNKRAQNAAKVLKVITPEQQIECHPKTNAAGIPTQLICKVNGQQVTGDEQCQDSSSCVQFNNKQQDDVTIQTEAIAVRFNGRKAWLKVSQAYKNTQCGLCGHYDDSDDQGEELRMANGQRASDLAEFHRSYALEDAEECPQQVMNNFYSEQQQQNSEQDTFYGQFNQFEDEDEADDEQQQQSEKDEWQNEQFNGQFEEQNDGQVTDGGNPFEGIFNDQQQQQKCCCCCDDDEDEEGTNEQSQCRQNCQNGGECPEKCNKNDQKQCRKSSPPQPQQQQNCKGSDDEQCKGICNDGDEACAEQQQQQWKAVWPILRTKTPRAEPRGVLFHPPGQTLPAGCLPVQSDERL

SEQ ID NO: 129623 - protein, 77 aa, Heterodera glycines
  Coding regions on vcDNA: vcDNA=SeqID_56046; Strand=+; Position=1 -110,184-307
MPIIRPFRRQSNGMAQVNSPRDMCRVEVTWSLCADGRRTQFIVQTFRGFGITALFEQNGKAGGKFDIKKVKYLININ

SEQ ID NO: 129624 - protein, 119 aa, Heterodera glycines
  Coding regions on vcDNA: vcDNA=SeqID_56047; Strand=-; Position=1 -86,169-442
MVTKVFLLFPGETSVAFLLEKFFLIYSFWVWPMPLQLKEINYAKEEAFLNWSPEREWFERKQSEVGHAQIWMEMPIISPVVPYTNMANKIQPSVAKNILNEFLNGKLNKLMERKKNPIN

SEQ ID NO: 129625 - protein, 178 aa, Heterodera glycines
  Coding regions on vcDNA: vcDNA=SeqID_56048; Strand=-; Position=1 -196,276-443,568-740
MGQVPPKLNFNGKLIQIILTKFGKKIGTLLKESFVDVYTNEKDEKIGREKHEKFRMELEDELFAIGDDDDKAARIMEKLEKMVSYEERTTAQSDSMKEEVKKAEMKRKTIWQLMENLNVLWEHSLPLALLEHLLSPNELYILHQTDDENVLNGSTLRRFRTFYAFVELWAKGGDKTEE

SEQ ID NO: 129626 - protein, 176 aa, Heterodera glycines
  Coding regions on vcDNA: vcDNA=SeqID_56049; Strand=-; Position=1 -167,529-715,925-1101
MAGDRDWPHPQNAIKNVMPMPFHSVTLPPVNGILPSDAMRLNAVEVLEDVDFRYAKELCDAHSDWTLAYERKRTRVWTRRVDDASGGGNGGKQSTLQMIKTRSEFADVPAALCYDMLQDTDYRLKVSPINRFFIYSSTKQFDAVIPYRTITVGQIHAEDGACRLFEPEQRHLLLRP

SEQ ID NO: 129627 - protein, 50 aa, Heterodera glycines
  misc_feature (9)..(9): Xaa can be any naturally occurring amino acid
  Coding regions on vcDNA: vcDNA=SeqID_56050; Strand=+; Position=1-426
QRRIKVQTXREAIPEGFGLPINLGASVQGDCPENPKKNFLDKNYLNELTR

SEQ ID NO: 129628 - protein, 54 aa, Heterodera glycines
  Coding regions on vcDNA: vcDNA=SeqID_56051; Strand=+; Position=1 -41,1383-1506
MKDGQNPNAFPLSINCICLKLNKQLMKSITELPNSSINAKRGKHRKSRRIKSNN

SEQ ID NO: 129629 - protein, 129 aa, Heterodera glycines
  Coding regions on vcDNA: vcDNA=SeqID_56052; Strand=-; Position=1 -116,257-354,633-807
  Homolog annotation: Hit_ID=NP_501127.2; Match level="QueryCoverage =98%, HitCoverage=9%, E-value=9e-33, Identity=58%"; Hit description =RNA Polymerase, Class III (C), rna polymerase (rpc-1) [Caenorhabditis elegans] gb|AAA83341.2| Rna polymera
IINAVRSISTPIITVALADERDEKLARRVKARIEKTTLGDISDYVEQVFLPDDLFVLIKLNTRRIRAMQLEVTMDTIIDAICAAKLPVPRILCDQVRSVGKSMLLVRPVESSKCSMTMYMHYLKYHLPS

SEQ ID NO: 129630 - protein, 1526 aa, Heterodera glycines
  Coding regions on vcDNA: vcDNA=SeqID_56053; Strand=+; Position=1-4580
  Homolog annotation: Hit_ID=XP_315603.1; Match level="QueryCoverage =48%, HitCoverage=96%, E-value=1e-104, Identity=33%"; Hit description= ENSANGP00000017599 [Anopheles gambiae]
MTRRTVLQQLASVFDPLGLVCPALHDAKMFFQSLWETKLDWDDPLPTDKVQEWNTIATTWNQQKVRVPRRVTPLEVASHQLHAFVDASKDAYGACIFIRAQHGVAITAHLIFAKSRVKPKGSNLTIPRMELMGMLIGIRMLQFAEKQLGLAIRHKFIWCDSKPVLGWVSSSEQQPRFVENRLKEIRAVDQVRFRYISTEQNPADVASRGCTVLELTSHPLWWNGPSWLIHPEDRWPITIEVKPANDDVQNIAEIAAIVPIVQKDEAWICADRFSDWTCLRNVVVLVLRALRRWLTMSSKPIIGLCSRVSACGPIQASDFQLAERLLIELAQVDCTDLAKQRPEVRLRTDEQGLIRLETRLGNCTASDDWKSPILLPDQSPITLLIIRDRHEKVRHSGVEATLTSFLEKFWCPKARGTVTREVKKCLRCRRIQGPAFALPAMPSLPTDRVVRSAPFEHVGIDYLGPTMTRIVTGPTTAAHKAWIVLITCLATRAVYLEPVLDLTASSFLLILRRFTCRRGVPTRILTDNGTQFVLASKVSAALEAGRVPTSALDRFLAREAIHWRFIPQLSPWQGGVYERLVALVKSCFKRELGRVMLSWEELVTYTAEVEAVLNQRPLCHVSEEPDGILPLRPIDFLLPRAKLGIAFNAETENEEFRISSTNQRDTLIQRWHSVSSSIDHFWNRWQKEYLLMLRQRLQWKFKKQRNQIAREPTEGEVVLISEEKLPRNCWPMGRIVELQRSHGEIRNAKIRLATGKVLSRPLNRLYPLEVASSAGQDESHQQLTNPPLEEHHNRTQTADSTPICQLRARRNSPGPTHSMVTRSKTKALASVLSILMCLFLIGASQTNASSTTKPKRGKGLPIRCRGCELTCTKTGVDISIPNGIVKFLLCCAGGTQCITQSGVRKSFHRLPKEHLLFDYDCEAMYWTKRGNKRIGSVQCPGRDACELIDCWVCLERLANPDCRPDVTFGLIGGASFFTFLFLFWILPLMCHVTMFWILQHLFTLLVRLLCCFWPSQNAPQREESPLLAFQSLPTPRRRQMSRSRFRPFPKLQTTLLLLTLCAFTSCARAQVVSITASAEKCQRSDFGSVCHLESSTTVTLLPSGLPVRLLLRHPDERVLGTLEISMRSLTLHCLPKSEQWLRSYHIETVSVKRCPSRGNCTREFCDEVNNGRKTEVHELSEWTKHPGFNRCSASCSFWWCGCLNAGASCIFYRPHAIANSPIVYEQISCPTWEYRLRTSLKLSVNANFTKEPSVSLTPGITFRWKDLSITPIASSVPPAPIMANKFLSDGNNMAISDEIQSDLQCPSRANAKRLNCTLRWGSCPMCLPDHDSAKINCQCRDVKLEPALADPEKRLPIQLKNLLLRNERRDIFAEITYAPIQLSIQFEGLRIATEEDLTKCHAMSKGLFGCYSCHTGAHLHLQCHTDFGSALGYVRCSDGTEFTALCHKTPEVLNVSLSFNRAEVDINCTIECSGGRNPFVINGHLRYVPKHFQAPNGGSSFASKAKPSNSCLIWCPDWNFDFSDVF

SEQ ID NO: 129631 - protein, 196 aa, Heterodera glycines
  Coding regions on vcDNA: vcDNA=SeqID_56054; Strand=-; Position=1-700
  Homolog annotation: Hit_ID=XP_308624.1; Match level="QueryCoverage =72%, HitCoverage=16%, E-value=1e-18, Identity=35%"; Hit description =ENSANGP00000024486 [Anopheles gambiae]
MSSKPIIGLCSRVSACGPIQASDFQLAERLLIELAQVDCTDLAKQRPEVRLRTDEQGLIRLETRLGNCTASDDWKSPILLPDQSPITLLIIRDRHEKVRHSGVEATLTSFLEKFWCPKARGTVTREVKKCLRCRRIQGPAFALPAMPSLPTDRVVRSAPFEHVGIDYLGPTMTRIVTGPTTAAHKAWIVLITCLAT

SEQ ID NO: 129632 - protein, 22 aa, Heterodera glycines
  Coding regions on vcDNA: vcDNA=SeqID_56055; Strand=-; Position=1-68
MAKEENVTGQHLFIYSSFIYKQ

SEQ ID NO: 129633 - protein, 79 aa, Heterodera glycines
  Coding regions on vcDNA: vcDNA=SeqID_56056; Strand=+; Position=1-240
MYADPAGSRTKIKFADPVAGLEFKIFCRTGSGRINPTNPAFSKNAGLRTGILQNPAQDPVLLRALVSGIVARNVSILDS

SEQ ID NO: 129634 - protein, 163 aa, Heterodera glycines
  Coding regions on vcDNA: vcDNA=SeqID_56057; Strand=-; Position=1 -303,1235-1420
MFAQHFRRWPKCITNGQISADGTVADERVAKGTETTEDGQPSEGGAEGVRKKRENGETGKGGEGEDRTVTSKWREWRANGPHIQPTRQGSAPISPKRRWTADAECEGSFAIEPIDGAELRGQCLAKIAKYQTKRKALDKAVGTNFFVGIQDELLAFRRAKQKQ

SEQ ID NO: 129635 - protein, 33 aa, Heterodera glycines
  Coding regions on vcDNA: vcDNA=SeqID_56058; Strand=+; Position=1-100
FNLIIVRNAKLKRCTNRLLYETPLYELPIIRTA

SEQ ID NO: 129636 - protein, 339 aa, Heterodera glycines
  Coding regions on vcDNA: vcDNA=SeqID_56059; Strand=+; Position=1-1020
  Homolog annotation: Hit_ID=NP_491240.1; Match level="QueryCoverage =79%, HitCoverage=20%, E-value=1e-47, Identity=38%"; Hit description =zn-finger, CCHC type and RNA-directed DNA polymerase  and Integrase, catalytic domain containing protein
MVEQCKDCQNSAKMPRKAPLHPWPVPDGVFDRIHVDFAGPCQDGRTYLILVDAKSKWPEITQMISTNAASTIDILNKTFHRYGFPKEMVSDNGPPFSSFEFRRFCEHHGIKHSFSPPYQPHCNGLAERMVDTFKRQAKKEGTNKNQNWISEFLFSYRTNPSQVLNGFAPAKLFLGRMPRTSLSLLAPKNDSSPNKINVYQSKMKRQYDQHHDTSDRQFKIGDTILTLNYGRYGKPSWLEGKIVDGKNLVWKVKIHSLGIVVNRHINQIRSFIPKIPISKDFVEEQRPNSPTKTPTTKNNQPHGSHDEQPSVLARPQRERRPPKRLNIGPNAGARYEIEG

SEQ ID NO: 129637 - protein, 140 aa, Heterodera glycines
  Coding regions on vcDNA: vcDNA=SeqID_56060; Strand=-; Position=1 -42,267-365,426-508,548-623,862-899
  Homolog annotation: Hit_ID=NP_733439.2; Match level="QueryCoverage =100%, HitCoverage=14%, E-value=1e-26, Identity=50%"; Hit description= CG1775-PC, isoform C [Drosophila melanogaster] ref|NP_524610.1| CG1775-PA, isoform A [Drosophila melanog
PFQQQVEFEWQGFLSFSELPDHWCSIAYFELDTQSGELFKVPWQIKEVAIDGGMDPSGASRVAIDGGMDPSGASRFCLGALANVHRSEASERARMHIGKGVGEASERARMHIGKGVGTQRDRKGSNWLRCLSQKSVFVRS

SEQ ID NO: 129638 - protein, 159 aa, Heterodera glycines
  Coding regions on vcDNA: vcDNA=SeqID_56061; Strand=+; Position=1-480
  Homolog annotation: Hit_ID=NP_625403.1; Match level="QueryCoverage =93%, HitCoverage=54%, E-value=1e-35, Identity=52%"; Hit description =putative secreted lyase [Streptomyces coelicolor A3(2)] emb|CAC13062.1| putative secreted lyase [Streptom
MHSLIILGIAFANLAPNAFGQQWPKATSDETVSATIKVSGGTKDFGYKRLTASSALGTGDQSEGQKALIRAEKGAVIKNLIIGQNGADGIHCYDGCTLQNVWWEKVGEDAATFRSSSGCKEYNFLVTGGGVKNAKDKVFQMNGGGTLTIKDFVVIYTYI

SEQ ID NO: 129639 - protein, 136 aa, Heterodera glycines
  Coding regions on vcDNA: vcDNA=SeqID_56062; Strand=+; Position=1 -328,643-725
  Homolog annotation: Hit_ID=AAH55165.1; Match level="QueryCoverage =64%, HitCoverage=31%, E-value=2e-12, Identity=35%"; Hit description =Zgc:63611 protein [Danio rerio]
MVVSKVTQQNNASEDELELHNAWPQYSPADKVLPTRFLQIIRLINNKFKERLPAWQIIEQHPQHFTHFFMQILQMALDEKLPFVHQIDIITFLCNCFNSLEVDLVCREAEADIDAVSYCERLVSLFIDLEAQLTTR

SEQ ID NO: 129640 - protein, 37 aa, Heterodera glycines
  Coding regions on vcDNA: vcDNA=SeqID_56063; Strand=+; Position=1-117
KRGDPFVLQNFFTIKNHDNFLSGVLKVANHESDMYFD

SEQ ID NO: 129641 - protein, 103 aa, Heterodera glycines
  Coding regions on vcDNA: vcDNA=SeqID_56064; Strand=+; Position=1 -157,274-317,441-548
MSVSPVISRMLSVEMKEKQQRMITLDELGVDMDQFMEFLEAITYLNGPFLPNPKNVLMLLKLADYFQVSALKSRCETHLINCVEIPLIDRFLLIDRYGLDNLK

SEQ ID NO: 129642 - protein, 19 aa, Heterodera glycines
  Coding regions on vcDNA: vcDNA=SeqID_56065; Strand=-; Position=1-58
GLLESWVRVPPGELPFMFY

SEQ ID NO: 129643 - protein, 438 aa, Heterodera glycines
  Coding regions on vcDNA: vcDNA=SeqID_56066; Strand=-; Position=1-1315
  Homolog annotation: Hit_ID=XP_307651.1; Match level="QueryCoverage =31%, HitCoverage=78%, E-value=4e-31, Identity=48%"; Hit description =ENSANGP00000025299 [Anopheles gambiae]
MSADQLKQLLEAMRVQSDAIQQLMGQTPQNAASASLNHANLASSIDGRISKFNYDAETGNTFEQWFKRFGVLIEEDGKDLPESTKVRLLLGKLGDEEYGKYRDSISPTQPDKVTWVDSITKLKGLYAETRSLFVRRYDGHVYFILVDSFSKWPEVYQMNSMTAAATVFTLRSIIHRLGIPEEIVSDNGTQFHSSEFAALCKEFGIKHTFTPPFHPQSNGQVERFVDTFKRAMTKCKGEKNSLEKVLLSYRSTGYSPDQLFLGRKLRTKLALVHPKGQIDQSEKFEKCKFKQHQKDYSTKMAQQFDRNNGTKAIEFLPTDSVLLLNYRLGKSHWLQGTIVKRLNNSPTYRVHVPTLGRIVHRHANQLRCRLDFEDNSNWEPPIQEQMAIEPNQRTPPRQHAAIDQRTPPVVDQARQKAKSPIGVRRSQRVPKPVKRFTP

SEQ ID NO: 129644 - protein, 222 aa, Heterodera glycines
  Coding regions on vcDNA: vcDNA=SeqID_56067; Strand=-; Position=1-667
  Homolog annotation: Hit_ID=EAK89729.1; Match level="QueryCoverage =69%, HitCoverage=83%, E-value=3e-19, Identity=29%"; Hit description =uncharacterized glycine-rich low complexity protein [Cryptosporidium parvum]
GLNSSAFQSLGLNPPTFQSTGLNPPTFQSTGLNPPTFQSVGLNPPAFQSLGLNPPTFQSMGLNSSAFQSLGLNPPTFQSVGLNPPTFQSTGLNPPTLQSVGLNPPTFQSTGLNPPTFQSVGLNPPAFQSLGLNSSAFQSLGLNPPTFQSMGLNPPAFNHWDSILLHFNHWDSNLRHSKQWTQISGILNTGTQPTNFNGTQSTSISITGTQSTNIPINGTQST

SEQ ID NO: 129645 - protein, 73 aa, Heterodera glycines
  Coding regions on vcDNA: vcDNA=SeqID_56068; Strand=+; Position=1 -36,84-185,237-319
  Homolog annotation: Hit_ID=AAQ75554.1; Match level="QueryCoverage =97%, HitCoverage=24%, E-value=5e-28, Identity=81%"; Hit description =EXC-4 [Caenorhabditis elegans] emb|CAD21669.2| Hypothetical protein Y105E8A.22 [Caenorhabditis elegans] sp
MSAKPLLELYVKASGIDSRRIGACLFCQEFWMELYALYEVGCVRVEVKTVNVNSEGYKKHFSGAQPPIMVEQD

SEQ ID NO: 129646 - protein, 166 aa, Heterodera glycines
  Coding regions on vcDNA: vcDNA=SeqID_56069; Strand=+; Position=1 -21,86-134,195-361,430-564,658-783
MANLVKLVGFFILVLLWPKALANITSEVKDMMDKFSSLKAYTNDIVKKLRNVSDNIDDFIWVTRPVSALIKAGAKTAFQPNAEELEAIKVWHNFVKVEFENLIEVTQQLKPGIKYYLIQDEYIKAVKRPMHGLEELYKNITDPDKDRSQYLEKFRAGCLAQLEVLQ

SEQ ID NO: 129647 - protein, 92 aa, Heterodera glycines
  Coding regions on vcDNA: vcDNA=SeqID_56070; Strand=-; Position=1-304
MIGRAVRNRPFIFEGIFKFILYPRKMAISFFEKFYTTQKRSSMIGRAVHNRHFISQRIFIFRGYPRKMAISFFDKFYTHTNALEHDREGGAQ

SEQ ID NO: 129648 - protein, 92 aa, Heterodera glycines
  Coding regions on vcDNA: vcDNA=SeqID_56071; Strand=-; Position=1-304
MIGRAVRNLPFIFEGIFKFILYPRKMAISFFEKFYTSQKRLRMRRRAVHNRHFISQRIFIFRGYPRKMAISFFDKFYTHTNALEHDREGGAQ

SEQ ID NO: 129649 - protein, 85 aa, Heterodera glycines
  Coding regions on vcDNA: vcDNA=SeqID_56072; Strand=-; Position=1 -43,723-937
MSKICTKIDQNMYIARVRYIKRQPATYVTASEIERASSSYNFELYRKDMAIIRDMLLDDIELFQSVPQCKPMEGLTAGPGPGTGQ

SEQ ID NO: 129650 - protein, 37 aa, Heterodera glycines
  Coding regions on vcDNA: vcDNA=SeqID_56073; Strand=+; Position=1 -22,235-326
MLIGRIGGGFGVADHESVTHFDQFRSPDLNSVPILTK

SEQ ID NO: 129651 - protein, 57 aa, Heterodera glycines
  Coding regions on vcDNA: vcDNA=SeqID_56074; Strand=+; Position=1 -128,173-232
SLEEKNKNPLFSFFSLSLMPNFPFEPTRVGLLSSAYFRFQVAFQLPVSLCCRASIRA

SEQ ID NO: 129652 - protein, 159 aa, Heterodera glycines
  Coding regions on vcDNA: vcDNA=SeqID_56075; Strand=-; Position=1 -139,217-402,697-851
MFVDQTKRQKCAESFQKVGKRNSTGTNTKKLFGERSGRRCGEVQGRNFEFPPIVWVVMHSLLSHCQLLADSHQSEGAFSVVRFGQHGFMHLSNATLRALDIFTIGGEIERLDMVEILINFTSIRQTLYNDYLRRIPDIKFLARKLVQRKAGLIVCLFVF

SEQ ID NO: 129653 - protein, 765 aa, Heterodera glycines
  misc_feature (14)..(14): Xaa can be any naturally occurring amino acid
  Coding regions on vcDNA: vcDNA=SeqID_56076; Strand=-; Position=1 -83,555-665,733-963,1015-1157,1234-1333,1382-1767,1840-1931,1983 -2024,2244-2375,2436-2605,2658-2762,2801-2908,2955-3094,3148-3274
  Homolog annotation: Hit_ID=NP_740938.1; Match level="QueryCoverage =99%, HitCoverage=67%, E-value=1e-142, Identity=37%"; Hit description= bile acid beta-glucosidase (1P23) [Caenorhabditis elegans] emb|CAD21661.1| Hypothetical protein Y105E8A.
LIKLNCFRRIRSLXANALSTISQKANLEEEFDFGALGGRFGWFVRADSEAAEERTPFDRPKFSQVLQLIVLQLIPFLCRYAFFWLRNVFSRERLFIDIFRPFRHFPYTALPCGAIGSGSISRDFRGAFCRFNLRPGLVQQHNEPIKADQFVLTLSSAADQFVLTLSSADGSLIRQTALSAVPSFAASDELSSWEFSLSPNDVTYRALYPRAWMKFELPEQKVVVLMRQLSPVLPGDYMNSSLPCTLFNSSLPCTLFTFRIVNNSDYPLNVSVTFTFRNAIDVNDVTPATECNSNLFKTSKGRLKFHWLPLRKCQMSAEGVLLHQSVFGMPCTFALGALPRPTTAMSATRSFDPSGDGFCLWNSMASGETLAEIVRSCLVTAYESGSKRSCLVTAYESGSKQCDCDQEMAFALIWHMPFVQFGGGKRTFRRWHMPFVQFGGGKRTFRRWYSQFFDQSDQQSGAVALCEYALANYVQWEAEIDKWQGPILSNPALPNWFKSAALPNWFKSALFNELYFLTAGGTVWMCYDSEWRQQETQLSDYSAAHFRRFGRFGYLESWEYRMLNTYDVHFYAWEYRMLNTYDVHFYASFALGHLFPQLEHSLQTDFNDQICHFDDQICHFDPKTVKYHMSGVHSPVKTKNRVPHDLGNPAEEPWLKTNVYRMHDTSEEPWLKTNVYRMHDTSEWKDLNLKFVLCSYRTFCTVLGRDRQFLAQVWPQVQIMVAEGVWPQVQIMVAEGLEHWDTDGNGMIENFGPADQTEAWKMHGV

SEQ ID NO: 129654 - protein, 186 aa, Heterodera glycines
  Coding regions on vcDNA: vcDNA=SeqID_56077; Strand=-; Position=1 -62,591-735,1193-1356,1407-1596
  Homolog annotation: Hit_ID=NP_740937.1; Match level="QueryCoverage =92%, HitCoverage=31%, E-value=3e-51, Identity=67%"; Hit description =AdaPTin or adaptin-related protein (91.6 kD) (apt-1) [Caenorhabditis elegans] emb|CAD21660.1| Hypothetica
MANVVEMTIEKIDEVKSRLGSHLNDPEQFVAGLALCTLGSICSAEMCRDLASEVEKLLLKSTNTYLKKKVKILRLLRILGRDDPRVSEEMNDILAQVATNTETTKNVGNAILYETVLTIMETKSESGLRVLAVNILGRFLLNTDKNIRYVALNTLLKTVAIDFQAVQRHRTTVVECLKDADISIKK

SEQ ID NO: 129655 - protein, 174 aa, Heterodera glycines
  Coding regions on vcDNA: vcDNA=SeqID_56078; Strand=-; Position=1 -216,270-578
  Homolog annotation: Hit_ID=CAE69300.1; Match level="QueryCoverage =93%, HitCoverage=66%, E-value=7e-48, Identity=56%"; Hit description =Hypothetical protein CBG15355 [Caenorhabditis briggsae]
MIFPEGSVFFQLDPSIFKESQPQIIMPEGYESGRGKFEFALGYIGCSVIGGFGVGSVRGMFGELGNPQNRTLAWNPWYTRMLNAATKHGSGYAQTAGTAMFLYSVTELGLKLSRADDLLNSFIAGPIAGGLFRGLPHGLRAGGVGALAGLGLVTVWNLCDRDSRRELREILRLS

SEQ ID NO: 129656 - protein, 25 aa, Heterodera glycines
  Coding regions on vcDNA: vcDNA=SeqID_56079; Strand=+; Position=1 -22,145-200
MTKFIQKEIFGSILKGVFFVFIAFF

SEQ ID NO: 129657 - protein, 333 aa, Heterodera glycines
  Coding regions on vcDNA: vcDNA=SeqID_56080; Strand=+; Position=1-1002
  Homolog annotation: Hit_ID=EAA60764.1; Match level="QueryCoverage =98%, HitCoverage=80%, E-value=2e-53, Identity=46%"; Hit description =hypothetical protein AN4722.2 [Aspergillus nidulans FGSC A4] ref|XP _408859.1| hypothetical protein AN4722.
PAETETTPAETETTAAKTETTSAVTDTTPAETETTPAETETTPAETDTTPAETETTPAETETTPAETDTTPAETETTPAETETTPAETETTPAETDTTPAETDTTSAETDTTTAENETTPAETETTPAETDTTPAETETTPAETETTPAETDTTPAETETTPAETETTPAETDTTPAENETTPAETETSPAETETTPTVTETTPAETETTAAKTETSPSATETTAAETETASAETDTTPAETETTPAETETTPAETERTPAKTETTAAETDATRSPTAPSTRGGYYPGARSTHSSSAPTTPSTRGGYSPGARTTDSSSAPTPPPTRGDYYTGT

SEQ ID NO: 129658 - protein, 325 aa, Heterodera glycines
  Coding regions on vcDNA: vcDNA=SeqID_56081; Strand=-; Position=1 -296,463-1141
  Homolog annotation: Hit_ID=XP_320889.1; Match level="QueryCoverage =99%, HitCoverage=44%, E-value=1e-70, Identity=42%"; Hit description =ENSANGP00000012033 [Anopheles gambiae] ref|XP_313651.1| ENSANGP00000013044 [Anopheles gambiae] ref|XP_314
PFALLGKFICTVQFSDKPPQTLIAYVSGEVGHNLLGLPWIEALKIIPRQILFPSSKSADQATMIENFSAVKPPNKSINDVASLTAALQNDFTEVFEDGFHWAAPILAVKKKKGKSRVCIDFSTGLNNALELNRHPLPRPDDIYASLNGAKFFSNLDLRDAYLQMEMDEESKQLCAINTHRGLFQCQRMPFGVKSAQAIFQHLMEQICAGIPGVFAYLDDGLIAMKTLEQHITALYTLFGRIKEYGLRIQLDKCKFLQPELLFLGHIVSANGIRPDPSRSDAIRKMPAPIDKSTLRSFLGALNYYGRFVKCMRELRAPLDKLLQKD

SEQ ID NO: 129659 - protein, 114 aa, Heterodera glycines
  Coding regions on vcDNA: vcDNA=SeqID_56082; Strand=+; Position=1 -115,408-637
MARGGTDEGGTVAGLLFSHRIQSDQKTSPKATEGRVQADAENEYDIGGLQPFTLYEFTFVAFNEAGSSDPVTMKQETVNDWVPPPREVQNAERHNENVGVSSSSTSVATYISVG

SEQ ID NO: 129660 - protein, 85 aa, Heterodera glycines
  Coding regions on vcDNA: vcDNA=SeqID_56083; Strand=+; Position=1-305
FSCCPASSSPLPIAPSTRVGMPPPPPPMANALRRPPPCPETQLILFFFEFHIFCVALLIYFCSFWCSFIPFLIFFRFQTNTINIS

SEQ ID NO: 129661 - protein, 21 aa, Heterodera glycines
  Coding regions on vcDNA: vcDNA=SeqID_56084; Strand=-; Position=1 -54,578-589
MRTRPIWQVKQRLLTSQKKGF

SEQ ID NO: 129662 - protein, 71 aa, Heterodera glycines
  Coding regions on vcDNA: vcDNA=SeqID_56085; Strand=+; Position=1-262
LFEYPKRTLEKIDFFVFGAVPPNRCAQIYGETESFGNSFPIACTLILRWIFAPHNCLSTPNGHLKKSIFLF

SEQ ID NO: 129663 - protein, 92 aa, Heterodera glycines; identical to SEQ ID NO: 125147
  Coding regions on vcDNA: vcDNA=SeqID_56086; Strand=+; Position=1-304

SEQ ID NO: 129664 - protein, 35 aa, Heterodera glycines
  Coding regions on vcDNA: vcDNA=SeqID_56087; Strand=+; Position=1 -8,1948-2047
MGSVPNLYFFTDLQFVSFPKFDTTNSDQFAKMPPI

SEQ ID NO: 129665 - protein, 59 aa, Heterodera glycines
  Coding regions on vcDNA: vcDNA=SeqID_56088; Strand=-; Position=1 -129,1111-1161
MASSLSCCPKFLSAPCGSVESERLFSKAGLICTDLRNRIKGDNANRGHLRLSNKQQRWI

SEQ ID NO: 129666 - protein, 271 aa, Heterodera glycines
  Coding regions on vcDNA: vcDNA=SeqID_56089; Strand=-; Position=1-816
  Homolog annotation: Hit_ID=XP_521668.1; Match level="QueryCoverage =76%, HitCoverage=98%, E-value=9e-17, Identity=26%"; Hit description =PREDICTED: similar to uncharacterized glycine-rich low complexity protein [Pan troglodytes]
MNDKIDWLGRFAASHPFLGFFSNRRDSTHQLFQSLGTQFSCISITGTQLTSISITGTQPTSIPITGTQPTSIRMTRTEPTSISIIGTQFSCISITGTQLTSISITGTQPTSIPITGTQFSCISITGTQPTNISITVTQPTSIPITGAQFSCISITGTQPTNISITVIQPTSIPITGTQFSCIPITGTQPTIIPITGTQPTSIEHFPRLFFFLVAFPYGTTFLAFSSSLLVSCGISLWHNILGIFIISSCGISLWHNMTHISVSHESHRTNH

SEQ ID NO: 129667 - protein, 89 aa, Heterodera glycines
  Coding regions on vcDNA: vcDNA=SeqID_56090; Strand=-; Position=1-269
FVCGDCWLLVFDFLAPSQLGLGIALISRRFDFYVDEHFKTRKWKLNNKLLIMQLDIEENGTKKMQIVKSAFGNPLPIPRNPFPNKVIGF

SEQ ID NO: 129668 - protein, 15 aa, Heterodera glycines
  Coding regions on vcDNA: vcDNA=SeqID_56091; Strand=+; Position=1 -21,560-586
MPLTRLPTKANNFIH

SEQ ID NO: 129669 - protein, 32 aa, Heterodera glycines
  Coding regions on vcDNA: vcDNA=SeqID_56092; Strand=-; Position=1-97
QSADEKFVRNWVEESAEQRPLGREVPCHGPIQ

SEQ ID NO: 129670 - protein, 71 aa, Heterodera glycines
  Coding regions on vcDNA: vcDNA=SeqID_56093; Strand=+; Position=1-213
MSPVIAPFVLAIIGIIALPTIEGAVGRQQVKLGEQYKYENVPGKLMVKRQTAASKEPQYLFAGQTAWTTDG

SEQ ID NO: 129671 - protein, 555 aa, Heterodera glycines
  Coding regions on vcDNA: vcDNA=SeqID_56094; Strand=-; Position=1-1667
  Homolog annotation: Hit_ID=NP_508324.1; Match level="QueryCoverage =90%, HitCoverage=19%, E-value=5e-84, Identity=37%"; Hit description =predicted CDS, peptidase family A16 and RNA-directed DNA polymerase and Integrase, catalytic domain and Z
MAYRRLTTMLQRLQKTPEVLKQYTTVITDQLNAAIIEETTIGAGKHEHFIPHQAVITPKKLRVVYDASAHTRGAPSLNDCLLRGPVWLPDLAGMLIRFRACRVPVIADVEKAFLMVGIEEDDRDVCKFLWVRDPFRPVTTDNLVTYRFRRLAFGLTPSPFCLAAVVRHHLRKYDSNFAEELIRDTYVDNVLIPADTAEEAAIKGQEAKRMFADARMNLREFLSNDETLNSSFSDAEFLGKTTAKVLGLEWNAETDKIRMKYPGSEPDTPISTTRRTVLSSVASLFDPLGLVCPATLKAKLFFQKLWDDNHEWDTPLSREEAREWEHILASWEGESNVIPRGVTAGRGHPLQLHVFTDASEIAYAAAAYIRTGGESGCNSRLIMAKSRLKPKKAATTFTIPRMELMGILLGVRLAAFIEKQLHHPIAGQHIWSDSMIALHWVRTASAQPQFVANRLFEIRKATATTFHYIRTNENPADLATRGEVPTLLQHNDQWWNGPQWLRGPRTEWPSELEFQPDQEGLPSPAGQEEGQSAFIVRNEASTGLESEQFPSSLLT

SEQ ID NO: 129672 - protein, 90 aa, Heterodera glycines
  Coding regions on vcDNA: vcDNA=SeqID_56095; Strand=+; Position=1 -229,744-787
MLDLARPTEENADQKKPKDSPTYRDRIKRNFDRGTRERTFEIGQKVFIRNYRDGPKWFRGLIITKNGVIYFVRTMRGIETTNNFLIHKSE

SEQ ID NO: 129673 - protein, 22 aa, Heterodera glycines
  Coding regions on vcDNA: vcDNA=SeqID_56096; Strand=+; Position=1-8,87- 147
MKGDFNFGEAVKNFQLLDEGIY

SEQ ID NO: 129674 - protein, 181 aa, Heterodera glycines
  Coding regions on vcDNA: vcDNA=SeqID_56097; Strand=-; Position=1 -281,380-602,662-703
MVAAEELEDVKEEVIGRLLKLLPKVLEGLKPKPAELSTEVDRRIQALDVVEEQLNVVKRARATDEMVTGAMAKVMAQLRNASRGMGTMDMSTLSSLQSNWDNLMRKDTHWQIRKAINSLGGCPKDPQGNTLMKQCMEEAITKVDRYIDDVNDWFKSQRPIDMDDWKWLAAEIQMIIRWKSP

SEQ ID NO: 129675 - protein, 143 aa, Heterodera glycines
  Coding regions on vcDNA: vcDNA=SeqID_56098; Strand=-; Position=1 -260,349-519
MPARERVLAPSKLMELMEKLGNVLVTDPKMRQKIDKYDKKRADEAARRAAMMPPRQDPQAIAKRRTWPKEDGLALERGHLPQGNNQSPTRLQSTPRIWIQEDDRWRQPMTFSRKDVRERSWLESDTDSDLDSPLPCCARGEGV

SEQ ID NO: 129676 - protein, 101 aa, Heterodera glycines
  Coding regions on vcDNA: vcDNA=SeqID_56099; Strand=-; Position=1-306
MRATREKTAAFSRWPVSGISGPMGLQGPPGLQGQIGNSGSTGPPGPPGKQKPGIFAFERFLCAPTEYCLCSERFNGLPPDEGPPETAGGRNARDGNWPKCV

SEQ ID NO: 129677 - protein, 26 aa, Heterodera glycines
  Coding regions on vcDNA: vcDNA=SeqID_56100; Strand=+; Position=1 -17,303-366
MFPKRCHRAERKMGKDRLDNAAPGIS

SEQ ID NO: 129678 - protein, 97 aa, Heterodera glycines
  Coding regions on vcDNA: vcDNA=SeqID_56101; Strand=-; Position=1 -134,202-310,497-547
  Homolog annotation: Hit_ID=NP_495584.2; Match level="QueryCoverage =100%, HitCoverage=18%, E-value=1e-41, Identity=83%"; Hit description= tryptophan hydroxylase (60.9 kD) (tph-1) [Caenorhabditis elegans] gb|AAD30115.1| tryptophan hydroxylase
HAVEGNSAILRFDPDRVVQQECLITTFQTAYFFTRNFEEAQQKLRTFTSNMNRPFVVRYNPYTESVEVLNNKRSLMLAVNSLRSDINLLAASLHNIL

SEQ ID NO: 129679 - protein, 145 aa, Heterodera glycines
  Coding regions on vcDNA: vcDNA=SeqID_56102; Strand=-; Position=1 -112,258-367,656-871
MEVPDVEAAAFKVMLSFIYADDLSELNGENAMAVLYAADKYGIDGLVSHCLQIPIQNLPNVFLAHAHARLFNLEALRWADEKCRKNAIECSAENRREALGPALFKIRFPLIHTSEIARCKLELRMFGNPSNCFAKSRNGGFDDKM

SEQ ID NO: 129680 - protein, 278 aa, Heterodera glycines
  Coding regions on vcDNA: vcDNA=SeqID_56103; Strand=+; Position=1 -57,139-273,427-552,818-956,1229-1399,1445-1653
MAPRRKRKAAQLVGQDEAVLPTNDGQQLASAAPVTNNGTVQQAENDGTDAVAAAAAAIDGTGGQQLAANNNGGQHAEAAVIDGTGMPNGQQIEAAADENDDTIGQAINVNADCPNVPPGVLPNPKTRQYQVKSVLAQFTHASGRKCYFLEWLGFRGRNSWCLSEDTDCTEYIERFGTVATVDAVLSALLGESVPASIADELQANPKFGQVLAKLDDIEDEFILRTTQYNILFAKGLMESPEGKTIIEDVSTQMHFFNLNYIFPKAKSKLGRFVAKCMS

SEQ ID NO: 129681 - protein, 119 aa, Heterodera glycines
  Coding regions on vcDNA: vcDNA=SeqID_56104; Strand=-; Position=1 -214,261-406
MKRRVAPLTTAAAVSAEQHKIIGPESPKPHEETPKNVEPKDELATKKRKVDDRELWKLAKGKFLLTTYLCHDDWNRLYNNQQKVKRLEGDRFAFGFEMCEECVWANCRATDLLAPMKKK

SEQ ID NO: 129682 - protein, 185 aa, Heterodera glycines
  Coding regions on vcDNA: vcDNA=SeqID_56105; Strand=+; Position=1-558
MVLVSTFCAQLLNCPVKSLRDRLNHPEDRALVLKHIIGRKARTTYNDRNGMTKTFFVTGISAQGAAFLPAYGQLRNPFNINVAAHFYTRHRIKLHFPYAPCIIERFSGGGEDRHYPMELLELIDDNMDMDINNNNEHWLGRLFTEIDDKQSSSNSSDTTMRLVFEGDMDEDSGRNECSQSTVPLY

SEQ ID NO: 129683 - protein, 399 aa, Heterodera glycines
  Coding regions on vcDNA: vcDNA=SeqID_56106; Strand=-; Position=1 -98,146-717,763-954,997-1092,1143-1384
  Homolog annotation: Hit_ID=NP_001004509.1; Match level="QueryCoverage= 90%, HitCoverage=24%, E-value=3e-50, Identity=33%"; Hit description =si:busm1-180o5.3 [Danio rerio] emb|CAD60788.1| novel protein similar to DNA polymerases [Danio rerio]
MGGRTGPLKLLRKAGPGEKISYYDFTSLYPYINFTTRYPIGQPNVHVLNQEVDWRSAADNPYPLALLKVWVVPPRRVDVPVLPVKVGERLCFPLCITCAKEHPTGGVHNDYHCEHNDRQRGWVSTCTSIELNEALDEGYLVTKVFRVLEYEQSDDKLFRPYIAEFMAQKIQASGFDNSIRGDAEKEQQFVRECAEQFDITIDPTKMAVNKGKRSLAKLCLNNLWGRFSLRNFGLAQTLITDDPATLAEYLDNKSIEVTSIDELDEQHILITYLQKKDWVDEHSCSNIVISLWTTSAARLVLLKAMQKVVRSPGSDLLYTDTDSLILVHPEERCPLKTGPHLGQFTDEYPDHDIVEFCSGGAKQVHFQFIFVYFSILPPFSTVFVCDARARRREPNWNMC

SEQ ID NO: 129684 - protein, 632 aa, Heterodera glycines
  Coding regions on vcDNA: vcDNA=SeqID_56107; Strand=+; Position=1-1898
MQKPIPSNRPNSSVSKTLACGLEKMVNASGNEPLTVPVLADRSDPLGLKSVQPDTVPMESAEGTKEVEIMEVDEMSGEKGKKDEMGKEKVKSGGMEEEEESEGSESELLGEGGFDNLKLNPSLRAGNKAVEKEDKGKPYLVAQVRSDGVIAARMKLFWDFPELVFVPFSLFDNAQPIEIGDLFRLHKCEWTKSETGWEERGDWLYEATGRLNYQATATDVSQLRQRIPTQAVGILVDVQRARDRHVKVAMVSAPELSCVMRAYRRHFPADFTDNDIRYRSVVRLQLRQINSPPWVLYSQQFAYVLPSDFGKKRGDELLVHHANVIAGVEPEPMGYEFPFSAELSWAKVQLGEKVMAAAVAAQAFDVKADLRKHTLFVEPVVINEISTRSVIIQFVMPVPSIEELTELCKIWEVDLAVGCKVNPAAKAKPCAHGYVLSIEKRAFCVGYEIDVKVILSYQEAKDQDAQEEFDQMRCGELDGCVELIPQTSVRALQERMFTLRSNDCSKVAKDEAKVGRIMSILLGRPVKPESPKANNPLMTFGALSKLKEGQIDTALCMLDEVPRLVFQQAGPGTGKTFSAASIVATVLATDPTARVLALAPPNVAVVKLVLEMQDALAAGNHVEPNACLVLRD

SEQ ID NO: 129685 - protein, 27 aa, Heterodera glycines
  Coding regions on vcDNA: vcDNA=SeqID_56108; Strand=+; Position=1-85
KSHLAKYLEKNGKKRKKKNEMNSKKEK

SEQ ID NO: 129686 - protein, 267 aa, Heterodera glycines
  Coding regions on vcDNA: vcDNA=SeqID_56109; Strand=-; Position=1 -625,668-846
  Homolog annotation: Hit_ID=EAL50505.1; Match level="QueryCoverage =100%, HitCoverage=32%, E-value=4e-10, Identity=22%"; Hit description= hypothetical protein 21.t00051 [Entamoeba histolytica HM-1:IMSS]
MSRNMKEICDQNRFFNEKQKREIVEKFHKIKERIMQMGKKYSRKEWKKIERKIAKKLGVSYEKIYKLKREFGMMKKKNHSIEEKRIMLKQFDQIYAKLKMKFNEKWEGKREKCKKIIAKHLGINIRSIYQWKKQLKNGKLIKNQNKDEQKREIVEKYLKVKNEFMQNGKHSLKEWEEFRAEIKQIFGVGYSTIKRWAKKLKINQNVSKERKMLSIAEKMEKIKQYYQIKEQNPKLKEDEIAKILNIPKNSLRKYKTKFGIKPKNKLL

SEQ ID NO: 129687 - protein, 24 aa, Heterodera glycines
  Coding regions on vcDNA: vcDNA=SeqID_56110; Strand=-; Position=1-74
AELSPKFQSYDEAIKWRMMGVNHV

SEQ ID NO: 129688 - protein, 203 aa, Heterodera glycines
  Coding regions on vcDNA: vcDNA=SeqID_56111; Strand=-; Position=1-610
MKIYKLNFVIFLIINLFDETLSVDDNLCKKNEKIRPSFAEIFGQKWENEKMEANETDQSDQNSNWQNENELNSAVSIESNQNNNQLNDQQKIEIVHKFHATKEGIKKTGKYSHKIWNRIEQKIAKKLGIGRTKIYKWKKELGIKIKNDQNYYEMKRKEFIQRIDEFKRMSAVNGKQKQFAKELGIDRKTLSKWKKKFGIEMRK

SEQ ID NO: 129689 - protein, 70 aa, Heterodera glycines
  Coding regions on vcDNA: vcDNA=SeqID_56112; Strand=+; Position=1 -74,187-325
MSFKRVNSFQPAVPMAKKWDFRSIGNNFAEEMENYKLMDYQSTTCEKKSRADFRNNGREIKTHQSILVDR

SEQ ID NO: 129690 - protein, 290 aa, Heterodera glycines
  misc_feature (284)..(284): Xaa can be any naturally occurring amino acid
  Coding regions on vcDNA: vcDNA=SeqID_56113; Strand=-; Position=1 -39,320-478,538-668,720-828,871-942,990-1127
  Homolog annotation: Hit_ID=XP_231305.2; Match level="QueryCoverage =93%, HitCoverage=23%, E-value=3e-41, Identity=39%"; Hit description =similar to mKIAA3002 protein [Rattus norvegicus]
PPPPVSTRIVPPPTFSKLFTSLESDDGPIYWCRPGEQLIRTDESKFDEIKSKRTGGEVLALNKLKRALERREILFEDRRALERREILFEDRTPCHADHVTDENKAHTTAAVGLLQAVRSPTDKIGDRLVKDVICKIGDRLVKDVICFHAADFKRVTDILKLDLYEPPMSQCTQWVEEAKLNTLRREGIRYARPMSQCTQWVEEAKLNTLRREGIRYARFMLRENSVYFMPRKIIHQFRTISAFMLRENSVYFMPRKIIHQFRTISACGSVAWHVRLRKYYEDEXTCGESC

SEQ ID NO: 129691 - protein, 54 aa, Heterodera glycines
  Coding regions on vcDNA: vcDNA=SeqID_56114; Strand=+; Position=1-303
IYLNFQFFFGFFSKNFLSFFSAGTASDNVFYLFRKINLFFFFLIILIVFHPEIF

SEQ ID NO: 129692 - protein, 182 aa, Heterodera glycines
  Coding regions on vcDNA: vcDNA=SeqID_56115; Strand=-; Position=1-549
  Homolog annotation: Hit_ID=AAA16924.1; Match level="QueryCoverage =96%, HitCoverage=97%, E-value=2e-34, Identity=41%"; Hit description =TATA box-binding protein
MFFPIIKNCVAVVDTKTPLDIEKIYLISPSTKYNPRKIHAVIMKVYNPNATAIIFSTGKFVCTGATNEKECRQAAEQVTERIKQCGYNEARVHEFAVKNLIATADAGFHIHLGPLYDFVGAKCCSFTPELFPGLVYRNQNPKMSIIVFSSGKLNLTGSRSKEEIDFAFNQFYQIISNFKYSP

SEQ ID NO: 129693 - protein, 104 aa, Heterodera glycines
  Coding regions on vcDNA: vcDNA=SeqID_56116; Strand=+; Position=1 -295,375-394
MEEVNSVYQHYSHQNLSDATGLFPLKFPTHRRNKNEGTIEMEIEKVSEFAVEEVGSRRFSDAMDIGGFPWKIMAQIETKYGSNEKWLDFTLSNDGLENDKLDKV

SEQ ID NO: 129694 - protein, 31 aa, Heterodera glycines
  Coding regions on vcDNA: vcDNA=SeqID_56117; Strand=+; Position=1 -54,478-519
MIFNNEAKSWGNNFISFAKIVYINRYLVQMI

SEQ ID NO: 129695 - protein, 100 aa, Heterodera glycines
  Coding regions on vcDNA: vcDNA=SeqID_56118; Strand=+; Position=1 -146,516-672
MIEPIGKANFRKACALRDTRSMYAPTSAVDAASVPNLARNSATISVAERACFCVFSQWIIKLRWRASGLVSWHTTQLMRTTQLILIFLFFNYILIYIYHF

SEQ ID NO: 129696 - protein, 88 aa, Heterodera glycines
  Coding regions on vcDNA: vcDNA=SeqID_56119; Strand=-; Position=1 -98,255-421
ALSSAIFLLSVAKISDEDSEDSNEAGSADNQRATEIVAEFLAKFGTLAASTADVGAYMERVSLSAHAFLKLAFPIGSIIASSLQISTK

SEQ ID NO: 129697 - protein, 183 aa, Heterodera glycines
  Coding regions on vcDNA: vcDNA=SeqID_56120; Strand=+; Position=1 -174,781-930,1292-1519
MDTINNWMGKNRNLFYYFAFSMAIPSTILYILEMVTIIRHKQFAQLSFYKLFCVRAITIWESQSFLMILALIVFVVPLLSCLPIMKMNVTPMAYERESDGFFIQENVSGYSFLGYLNGMKSLTSVIFLLLSLLVNLSTLIAYRRSKRVHQQNSQNGSDVIEKKLLIYALLTFSGHAFVSVFLV

SEQ ID NO: 129698 - protein, 141 aa, Heterodera glycines
  Coding regions on vcDNA: vcDNA=SeqID_56121; Strand=+; Position=1 -43,200-395,833-873,954-1090
  Homolog annotation: Hit_ID=XP_317462.1; Match level="QueryCoverage =97%, HitCoverage=9%, E-value=2e-30, Identity=43%"; Hit description =ENSANGP00000007067 [Anopheles gambiae]
GPIRRFLIPPPNCSTRVLHSVCAIADDNSAALLSLKELKCILLASRQQFPIVDVRWRPLDDFLLLRCEDSSVYVWQIETANLDRIVAGLTTDEAISAAISAENGDDAVENGQQQMLKGASSQVQMLKSQRQHRNIAAVMCG

SEQ ID NO: 129699 - protein, 207 aa, Heterodera glycines
  Coding regions on vcDNA: vcDNA=SeqID_56122; Strand=+; Position=1-624
MQTIISVDESREPATPQQKKRKQKQQAVEQLLVEVPEEEHQQSGRKPAGGKGEIGEETEGTGGKEGTGQHLEEEAQLRQIGPTTDTTPRDAEQTGMSFVGKVNTLDQKIGPEAKRLQILLELTHNRHNRANLNAKQLHVVNEMFNLFMYNHTFVVYLSFIRYYLWQVALVQNCGHKQPISEHTDQPGTVAVKEEGQPTGHGKGGHRC

SEQ ID NO: 129700 - protein, 61 aa, Heterodera glycines
  Coding regions on vcDNA: vcDNA=SeqID_56123; Strand=-; Position=1 -22,234-397
MNVSTHPGMYEFLPMYTNFEPNRTYTLTGIYEQSTKIDPPQFETNFVIMHKSEQTRQMMKW

SEQ ID NO: 129701 - protein, 74 aa, Heterodera glycines
  Coding regions on vcDNA: vcDNA=SeqID_56124; Strand=-; Position=1-223
MNYQNFAEYKGVAIRGAAAWERLGQHAFVNPYQDFASMSHSKGDEPLMERPYSKNKTNGRGNGVRSFGRQSMMR

SEQ ID NO: 129702 - protein, 32 aa, Heterodera glycines
  Coding regions on vcDNA: vcDNA=SeqID_56125; Strand=+; Position=1 -87,194-205
MLLLLLLLLDMLLLLLINRLRRRRQPPRPNNW

SEQ ID NO: 129703 - protein, 144 aa, Heterodera glycines
  Coding regions on vcDNA: vcDNA=SeqID_56126; Strand=-; Position=1 -354,404-484
MSGTIRTRIPILVKSLKNKIEKYYEQIEQGKYEFDSNDLPGCLKLYEFIKKEIFNFEKTFDSLTELDKKWKKIRNKLNTEDKNAEIKIYKIYTEKHDYLKILEEADSVIDELKSLNLEGINMKMMMRMMMMKTNQMMNKTEKKN

SEQ ID NO: 129704 - protein, 73 aa, Heterodera glycines
  Coding regions on vcDNA: vcDNA=SeqID_56127; Strand=-; Position=1 -158,325-388
MSSKIEHRTDQKEKWTNYNDPSGNPNVLLCSYILIAVREREHLWELIRVWDKQVFQTKKLRVQLSKFDGGDDQ

SEQ ID NO: 129705 - protein, 149 aa, Heterodera glycines
  Coding regions on vcDNA: vcDNA=SeqID_56128; Strand=+; Position=1 -249,476-676
ATTVHYYKLLRLVLSLSLLKYMSNSPRQINRIVDEEGQEWEVEEVQLDVSKTGLGFSISGGCDREPDLMYNDRYIRVTDISKGLVKRLKYPPLQKSLSQSHLSEPIASGTFQRSLSGVAADSRTLPLQPPVRSRKRMNGMAVPWIQRLD

SEQ ID NO: 129706 - protein, 108 aa, Heterodera glycines
  Coding regions on vcDNA: vcDNA=SeqID_56129; Strand=+; Position=1-327
  Homolog annotation: Hit_ID=CAE68757.1; Match level="QueryCoverage =95%, HitCoverage=8%, E-value=1e-17, Identity=48%"; Hit description =Hypothetical protein CBG14691 [Caenorhabditis briggsae]
MGFGFNIVGGEDGEPVYITRVAPGGAADQTGNIRMVKTNCDHRKTNIDFPKGDVLLRVNDVDLSMATHGEAAVALKAIPQGAQVKLLLQFRPKEYSEFDERLQQQNYR

SEQ ID NO: 129707 - protein, 53 aa, Heterodera glycines
  Coding regions on vcDNA: vcDNA=SeqID_56130; Strand=-; Position=1 -134,179-206
FCICCSRRSSATSSRLPGSLSSVFFRLFVFSSSRPLFRWSSVVIRNVKNPLLF

SEQ ID NO: 129708 - protein, 239 aa, Heterodera glycines
  Coding regions on vcDNA: vcDNA=SeqID_56131; Strand=+; Position=1 -242,1417-1619,1687-1961
  Homolog annotation: Hit_ID=BAA95789.1; Match level="QueryCoverage =94%, HitCoverage=46%, E-value=8e-10, Identity=21%"; Hit description =KED [Nicotiana tabacum]
MEWIGANRRGEEKCSGQKGLSVPTQQRQAIREPKGRKSSNGNQMPKNKVTNLVEDKSIAFAGVKPGKLKHQSELVNSNGSLKQKTKSKNDHQHRQSEEVVGETKGAFVMLIREVETKLHQTERNKELEEMREKEHDEHQQPRKEEKERGDEAEIGLNDEEERATWTTEDGENEEMDEARKGRTDESELEERVDETEKMNQEREWLHRQRNGEVEVGTSEISPKNQDVNGGCDLFASRKP

SEQ ID NO: 129709 - protein, 70 aa, Heterodera glycines
  Coding regions on vcDNA: vcDNA=SeqID_56132; Strand=-; Position=1 -384,490-608
ITHLYKGDRTVQFTGDEAEIGLNDETEKMNQEREWLHRQRNGEVEVGTSEISPKNQDVNGGCDLFASRKP

SEQ ID NO: 129710 - protein, 214 aa, Heterodera glycines
  Coding regions on vcDNA: vcDNA=SeqID_56133; Strand=+; Position=1 -50,103-308,371-504,820-1074
MADENESEQRSLERMEKDMESVQMNGGHQQQEEVEVKQWENCFAVKALLKTNQKLQMTLRTLEEKLRNTNQEKDYYKKHFKGENGGTHNGNWRGQLTDDFGKELLMANKRKYQLENRTKQLELELRETQQRCHHLGESVKSMEKLLWLEKERSATLEREREQLRGELGELRRHGDALKRELAELSGEEGVGGTEFSTESHNHQVGIDGDTGKVE

SEQ ID NO: 129711 - protein, 88 aa, Heterodera glycines
  Coding regions on vcDNA: vcDNA=SeqID_56134; Strand=+; Position=1 -92,459-633
MTRKDNFEEQKRKLEWRLGEMTQWWNDAKWSEHALEKDVRLRSCWFEVDSEGHQEVFLIVRMGWAEMDVQLAVLYSGHFCELGVRFVV

SEQ ID NO: 129712 - protein, 720 aa, Heterodera glycines
  misc_feature (417)..(417): Xaa can be any naturally occurring amino acid
  Coding regions on vcDNA: vcDNA=SeqID_56135; Strand=+; Position=1 -109,154-237,278-360,448-589,659-837,886-979,1049-1151,1199-1322,1478- 1629,1670-1783,1961-2048,2102-2249,2340-2528,2574-2661
  Homolog annotation: Hit_ID=CAE56174.1; Match level="QueryCoverage =98%, HitCoverage=80%, E-value=1e-153, Identity=43%"; Hit description= Hypothetical protein CBG23794 [Caenorhabditis briggsae]
VGDGPSSSLRCGLGFCTFDWLQKLHTAKWLLAILCICAFNQSFVINAIFPVGLSTLEKRFCICAFNQSFVINAIFPVGLSTLEKRFQMSSTRTGIISSWYDFAVLIAVFPVCQMSSTRTGIISSWYDFAVLIAVFPVCYYGNYGHKGRWHKGRWISVGSLIMALGSAVCVLPHFSSAPWHMDHSQMDSNNDFGQCANTSRPDCAPSAAGGNTSRPDCAPSAAGGASDAYFVMFLLGQTLHGFGATPLFSLGTAYLDENVSEKSSPVFLAIHSFLTSVGPIVGLFVGGKIHSFLTSVGPIVGLFVGGKLLTFYDDFDRVSLAIKDLAIKDSADPRWVGAWWVGFAACSVVSLIISFPIMMFAHELPEAKKRRENEMFAHELPEAKKRRENEVDLCYFIRRVFHINPFSRCTPSQKCFXVLLSSPTFVAIIFVGIFESIVLNGFSSFMPKILEIILNTSPTVGSYLSSVIIFGAAGGVMVGGILVRVIIFGAAGGVMVGGILVRQLQLQVGGMLKMVLLCHLVTLSLISCMLLKCPSRELVGITVAYDHKFVLSSSLTLLENLCNSESSSLTLLENLCNSECHCDANFRPVCDRSSGRTYYSACYAGCSLRQEEIDGTLWGDCSCVRNVSLPTNANFSSARHLANGFCPVDCGWTLWLFLFLLFLSVVASFAAGIPTQQIMLRVIPLQQRTLGIMLRVIPLQQRTLGIAVNWTFLRLLGTLC

SEQ ID NO: 129713 - protein, 557 aa, Heterodera glycines
  misc_feature (438)..(438): Xaa can be any naturally occurring amino acid
  Coding regions on vcDNA: vcDNA=SeqID_56136; Strand=+; Position=1 -74,129-261,307-526,643-791,840-976,1034-1088,1141-1365,1634 -1905,1942-2200
  Homolog annotation: Hit_ID=CAE67920.1; Match level="QueryCoverage =99%, HitCoverage=49%, E-value=1e-128, Identity=46%"; Hit description= Hypothetical protein CBG13518 [Caenorhabditis briggsae]
NDNASTSSFAQNSLEELLTATDLLSYHDAYHDALKNVLKLRHAGDIGDTDSADLDGIGMSRPEQRRLMREYAKKFRLKKFRLKVFGEAKQCKQRKVTGETDHWQGPGGEEQPQHHIIPPERVTLCKKIGTGEFGHVFQGPLQTSPRITKVAVKRILPEKLISQHASFLQEAAIMTRMHHPNVIRLFGVVLETKAVMLVSELAPCGVSELAPCGSLLECLQCPSWREPFSVAVLSDFALQIAQGMRYLSSHRLIHLIHRDLAARNVLVCTPSKVKISDFGVKISDFGLSRCLGHGEDYYRSEFTPSMKLPIAWCAPECINFLRFTSASDVWAYGICLWEMFSYGKTPWEGMSGSQILHSIDTQRKKLHCPEACPREAYLLMLNCWEWEAHLRPTFEQICDRLPSMVPPLLVTICESGTAKSGQLNYGRDETIALIDKKXGQPINYFFWRGISKAGKVGLFRPEDTIFWRGISKAGKVGLFRPEDTIAFLGAENPSAGDALSEQLRTEKGKMKKQLDKEKKRKKAVEISEPKGDLRHTCHVGADGRSFGLLNVNKSDLA

SEQ ID NO: 129714 - protein, 510 aa, Heterodera glycines
  Coding regions on vcDNA: vcDNA=SeqID_56137; Strand=+; Position=1 -127,382-1075,1133-1408,1569-2004
  Homolog annotation: Hit_ID=NP_608540.1; Match level="QueryCoverage =42%, HitCoverage=63%, E-value=4e-14, Identity=30%"; Hit description =CG2839-PA [Drosophila melanogaster] gb|AAF51469.2| CG2839-PA [Drosophila melanogaster]
MTTSMVSLPPPRPPKNGTKQRKKTEAENGDEMTRSVCIGQINGNDQLLLISAAGHCSVAEYLNASSAAASLSPPALPPKPPRFRSFANFSDWPSPSAPSASPTDTLSQPKFGQHIQSPINLPDQTHPPEPIHHNSKPTEEERKRKKSKETEEDRGRKSDEEAEKRGKSKEKREGKDGGRDREGKEEEEERERGGKREEEREEEEEENEEDESLIRRPSSVCCEFSSKGEDGEEEKRILQVLTDLQRDLTNFSLCSLDDCSEGRPLLDGEQRREKKLTEEEERKRHLRELSLERHGIVTGHSAEIVGMDRAELERRTNEERRRVLKKLVRDGGEESADEKRASFVGSFISSASKMLVGGTNHGTNGGKEPLANWPPEAQEAYKLLVQCGHNLKGTSINEGHSEGKKPSPKSNDGTLGQTAEMIELPKKIEYINSMLVGWEGEKRGKRSDRKDTLERRSDRRKDELHLAEASLQNESPPPVPPKPMARARWAQIGNNFDQGKTEDKQSRSFD

SEQ ID NO: 129715 - protein, 211 aa, Heterodera glycines
  Coding regions on vcDNA: vcDNA=SeqID_56138; Strand=+; Position=1 -394,599-652,700-886
MRRRNLFKMFFNKYLFLFAAFLASDYVLYSKLSKFLLDENLDLEELNAKTFHRVTIDQLIANVSRSTPLDLLTKIPSRNDIDPEEKSAFAYQKVKQQKGGVADQSDQRRVELISSDQNKKMCVKWECQWRNEEFQNDAEPRDEAESVHEEEPMDDGRRTMGGGGGRCGGCEREDLHGGGGGRARTEPDGHQGPDRLAGRLPSDGIPQIRNE

SEQ ID NO: 129716 - protein, 85 aa, Heterodera glycines
  Coding regions on vcDNA: vcDNA=SeqID_56139; Strand=+; Position=1-258
MLIRLDHFSYNEFRYLIKRLAYALYFPYSVSTIEIQADKTHFFPQIESDRKLRVHFVSLMHKYSMDRYNVIGLMETKWAEKAMSE

SEQ ID NO: 129717 - protein, 67 aa, Heterodera glycines
  Coding regions on vcDNA: vcDNA=SeqID_56140; Strand=-; Position=1 -4,195-394
MASNAGDLITTDIVFQLWHMFLKEEMARTQSPREPLGQMEEVGGGDDKLFLEDVDNADEKQRLTTLT

SEQ ID NO: 129718 - protein, 209 aa, Heterodera glycines
  Coding regions on vcDNA: vcDNA=SeqID_56141; Strand=-; Position=1 -120,179-271,526-634,846-934,976-1114
  Homolog annotation: Hit_ID=NP_996932.1; Match level="QueryCoverage =95%, HitCoverage=77%, E-value=9e-44, Identity=46%"; Hit description =Unknown (protein for MGC:77244) [Danio rerio] gb|AAH66418.1| Unknown (protein for MGC:77244) [Danio rerio
DRNRTPSGTHTSRLEFNEEEPLGEGTNAWIKLNVGGKVFLTTRQTLCRESGSFLAVFLTTRQTLCRESGSFLARLSQEDHSLPSEKDESSSYLIDRDSDYFSAVLNYMRHGKLILDHGLSEEGLREEAEFYNLPKLISLCNERISEREKQKKELQTKHVYRVLQELQTKHVYRVLQCHEDELTNVISAMSDGWKFEQVIPTIKRSKENG

SEQ ID NO: 129719 - protein, 133 aa, Heterodera glycines
  Coding regions on vcDNA: vcDNA=SeqID_56142; Strand=+; Position=1 -57,292-411,530-754
  Homolog annotation: Hit_ID=CAE70385.1; Match level="QueryCoverage =90%, HitCoverage=21%, E-value=7e-44, Identity=75%"; Hit description =Hypothetical protein CBG16947 [Caenorhabditis briggsae]
MIENGMDVARMNFSHGDHEYHGGTIKNVREAAAKCTKKRNVAIALDTKGPEIRTGLLAGGGSAEILLEKDASIRLTTDSAFEKSGTAINLYVDYKNITKVVTKGSRVYIDDGLLSLIVEEFCGFIFKSLRRRF

SEQ ID NO: 129720 - protein, 637 aa, Heterodera glycines
  Coding regions on vcDNA: vcDNA=SeqID_56143; Strand=-; Position=1-1914
  Homolog annotation: Hit_ID=NP_703336.1; Match level="QueryCoverage =99%, HitCoverage=50%, E-value=5e-17, Identity=19%"; Hit description =P. falciparum RESA-like protein with DnaJ domain [Plasmodium falciparum 3D7] emb|CAD48951.1| P. falciparu
MGARLKNNERLPENERQTDSERIRENGRQRDNERTRENERQIDNQRIRENERQIDSMMVEVSNKTTDQRINSEQLHVGQFTAAKGQTNNRIEGDTSLLRKSTLKEKAKGEKKQSNDQNNEREVIADKKMGAIKQPSDRISDWTRSNRNEEASSGKKMPNGRILWTKILPVQTSASNKSLPNSADKENILPTTDGRSLRNLSGDRPFSSKQLPTDEQKKSDGQKKDGPGGQQRTSDMRTKAGNSELSQRILQLLKNLRIAKEAVANYGTGRRRRRKRSAEKIADQKQGRRITENGQEMISDQKSDQSLADQGQAPLPGQQKAAITGQDFRERPGEEKPPDEKKAEEKGIEEEAKFVVEELFTGQIGEKADQVEEEEVKLRGEEEILDGILVEEEQKEREEPFGDVPEGMVDELVEKQLLKGEKDGTKAFAEVIRAVLKEIGDVLFDGEEEQNQIEEAQQGTQKLPKMKEAGEEAGDQGKEDTYQQQMPEVIGSDQPVFGDQRRPSIREDDNDGIDQPLSDQQTINSGAIPDQLDKSLPAADAQNDGHQFQESAKAPKLSEFDQQNEEENAGSYGRRWSDQSQRINDRPRGNSDEFGTRQADDQQQGSSRKMFDGVLRDRGGRAVRVEDLPGNSVLNKI

SEQ ID NO: 129721 - protein, 55 aa, Heterodera glycines
  Coding regions on vcDNA: vcDNA=SeqID_56144; Strand=-; Position=1 -100,169-236
  Homolog annotation: Hit_ID=NP_004414.3; Match level="QueryCoverage =87%, HitCoverage=6%, E-value=3e-09, Identity=56%"; Hit description =dishevelled 3 [Homo sapiens] sp|Q92997|DVL3_HUMAN Segment polarity protein dishevelled homolog DVL-3 (Dish
MLDWLMSNVQGFKDRKCARAFASAVLLKGFIKHVVNVSAFNEKCYYIFDGNLNSF

SEQ ID NO: 129722 - protein, 48 aa, Heterodera glycines
  Coding regions on vcDNA: vcDNA=SeqID_56145; Strand=+; Position=1-153
GKESCQMTMSNHNRMMNFNNVNIRKYDNKNERNGAGFGANSDTAAFEV

SEQ ID NO: 129723 - protein, 37 aa, Heterodera glycines
  Coding regions on vcDNA: vcDNA=SeqID_56146; Strand=-; Position=1 -78,610-645
MALNLTYLLTLSLYCSNSMHEVGAVQKWNLNTKIKKF

SEQ ID NO: 129724 - protein, 69 aa, Heterodera glycines
  Coding regions on vcDNA: vcDNA=SeqID_56147; Strand=-; Position=1-209
IVHALAHAFVHRHRLHLHVAPEAIGQRMRVPLFARGRRRRVRVQPMCALQLAPILHLLETVVRALGCLS

SEQ ID NO: 129725 - protein, 119 aa, Heterodera glycines
  Coding regions on vcDNA: vcDNA=SeqID_56148; Strand=+; Position=1 -70,676-852,1104-1214
MPFTKMINIVLVVNCTKAQGAAADKKSNLTSILWFCAADEKNAEKCAESYQKDGSLCQCQYGGEGIDHGNEQFIPTPPPVPSIVRCKYGMIYENKLGFAYPRVCEEGYHYCFAANITKK

SEQ ID NO: 129726 - protein, 290 aa, Heterodera glycines
  Coding regions on vcDNA: vcDNA=SeqID_56149; Strand=+; Position=1 -93,623-855,920-1046,1237-1281,1385-1510,1559-1643,1756-1918
  Homolog annotation: Hit_ID=NP_490989.1; Match level="QueryCoverage =89%, HitCoverage=39%, E-value=7e-34, Identity=33%"; Hit description =probable atp-dependent RNA helicase Ddx10 (82.6 kD) (1D65) [Caenorhabditis elegans] gb|AAF60456.1| Hypoth
MDENEHFSCDQLQMLVIDEADRILDMGFRHQARFITETFTHLRPGLYFTGLWGDLKQSKRIERFNKFNAVDGGAAMVCTDVASRGLDFRGMDWVLQMDCPSTVDDYIHRVGRTARMNRKGEAMLMLTPFQEPFVTFCCFAQAKECPRHRSDSLIAYAKALYFSELKEVFDVQSIDFDALSQNEMEEEEPFLKVSRRDVFNSITEVDMKEEILARISSKKPNGQDSHGYGHRAFSTSGAAQELSSALDEEIKAEKELVQDKLGGTSAPSVPGFKITTKGAEVRLSKTHGNE

SEQ ID NO: 129727 - protein, 85 aa, Heterodera glycines
  Coding regions on vcDNA: vcDNA=SeqID_56150; Strand=+; Position=1 -92,397-563
IEVILIVNHSVDIEEDEEYEDDPQAEMETRASQRTTRVCSKTMMAMKMIKRMGVVGKRKRFETERESDEEEDTKQQQKKGDAICC

SEQ ID NO: 129728 - protein, 66 aa, Heterodera glycines
  Coding regions on vcDNA: vcDNA=SeqID_56151; Strand=-; Position=1-200
YLPIFVVFQITEKRMHTIGSSSFLKFFCCSFLPLFFPLFILNFFCRQNLYNTHFAPKHQENCSLMK

SEQ ID NO: 129729 - protein, 132 aa, Heterodera glycines
  Coding regions on vcDNA: vcDNA=SeqID_56152; Strand=+; Position=1 -174,1247-1471
MANSVGAQTNGTKIASPSKSTSQAVLLAQAIRANDTELFASMVNRLGNNWQTISTTIKVPNLTDHFATITQWMENRVRHIDKLLQLQGKLSFMISAMPQQSDLWRARDEQPMIVFAADECQVEEEQQEDMDD

SEQ ID NO: 129730 - protein, 82 aa, Heterodera glycines
  Coding regions on vcDNA: vcDNA=SeqID_56153; Strand=-; Position=1 -44,100-151,210-362
VTLEGRTRLPQRVQELVIDIGNAMTSIQQTSGSTDLLITSIRNFTSVDGIMANSEQNLVKIQNQMDRIETQTNGAEQNLKNV

SEQ ID NO: 129731 - protein, 25 aa, Heterodera glycines
  Coding regions on vcDNA: vcDNA=SeqID_56154; Strand=-; Position=1-77
MDLKLFLILKMSDNPKEEEKQMDKE

SEQ ID NO: 129732 - protein, 272 aa, Heterodera glycines
  Coding regions on vcDNA: vcDNA=SeqID_56155; Strand=-; Position=1 -355,414-559,606-923
  Homolog annotation: Hit_ID=AAQ74888.1; Match level="QueryCoverage =54%, HitCoverage=12%, E-value=2e-10, Identity=31%"; Hit description =UBP [Gallus gallus] ref|NP_989802.1| UBP [Gallus gallus]
MPFPVRLTLIFTVPSGLLIAEEVVGIEKYRSQSKMCGTSEGLLYGPLQFPSNWRNLTFGKIIFDIEKVSEFVGEKVGSCRFSETVQIRGLPWNIVAKINGKADEKWLGFYLQCAAAEEDENWCCECSATFRIVSQKFDVKNSTGKFFGQIFDHTADQAGFHGFISFAELLDPNNEFYNREEDKVTLTVDFILKDAKMGQFSAPKTADKTIFMEIEKASEFFCEIIGSERKSETVLIKGLPWKIVAKINRSADDEKCLGFYLLCAVPKESEWN

SEQ ID NO: 129733 - protein, 135 aa, Heterodera glycines
  Coding regions on vcDNA: vcDNA=SeqID_56156; Strand=-; Position=1 -36,83-279,487-661
MSSIEVRRVREELRKIIYRSRIVYDVDVRTIYENLIIITIFASSQLADFCTDPFVLCHLDACFAYNLTISPRDIFIGKKVRPVPYNAKDAVDGKLNRREKMEVIGKVEHTEWAAPILVVKKVDGSDEALKNSFAY

SEQ ID NO: 129734 - protein, 75 aa, Heterodera glycines
  Coding regions on vcDNA: vcDNA=SeqID_56157; Strand=+; Position=1-227
MCLRGGRCKGKTVEGRGRRKTKRKRKRKKKKKKVEKAGKEAKRKQQKEEEERKRKGRESGRRKKKEEEEGEQEGR

SEQ ID NO: 129735 - protein, 399 aa, Heterodera glycines
  Coding regions on vcDNA: vcDNA=SeqID_56158; Strand=+; Position=1 -13,61-1244
  Homolog annotation: Hit_ID=EAK90470.1; Match level="QueryCoverage =91%, HitCoverage=29%, E-value=2e-25, Identity=29%"; Hit description =hypothetical low complexity protein with coiled coil regions [Cryptosporidium parvum]
MVTAQFENSLIKQHFLIDLLKNEKKTKEVLDILGIDGLTIHKLQNEISEKIDHLNSKNKSKNKTKKKKYIKRKKEKIGEVLKGTEEENTEEISENFDEKKEGMEENKEKTIKNLEKEEEIGEKEEKIEEKEEKEGKLDENIEKEEKVGENLEKKEKMKEKEEKEEKEEKIEEKEEKEGKLDENIETEEKVGENLEKEERTEEKKEKMKKNLVREEKFDENEEKINEKLEKRKLEEKVSKSKDFETENGTKLKKKDEQFATEKLEVNEFAFIKLGDFEDDQFLALKYGEFLGILSRNDGEKARKAWSPALKQFGEKENLEKCEHSLAHLLDIGILANEIWHYVQTMKALNGKSKDLAKFEKEWAQLKQLKLEEEISPKNLEQTLFSLMTRIVVEGITAKN

SEQ ID NO: 129736 - protein, 56 aa, Heterodera glycines
  Coding regions on vcDNA: vcDNA=SeqID_56159; Strand=-; Position=1 -54,122-238
MGFFFYLIVAVALFGGGMFVGMSLGGKKSSDGASGSGAKKEKKHKGSKSSSSEKSQ

SEQ ID NO: 129737 - protein, 104 aa, Heterodera glycines
  Coding regions on vcDNA: vcDNA=SeqID_56160; Strand=+; Position=1 -145,206-315,501-560
MDLTPIHRIHVAYVWLNHFHVQLVALDVSRVDTRAVFSTHCSALLAGLSGTSGPQLSLDGQLLALRTLLQNVDDARSQADVFRFQFDESSWAADPHRQHPTQRL

SEQ ID NO: 129738 - protein, 41 aa, Heterodera glycines
  Coding regions on vcDNA: vcDNA=SeqID_56161; Strand=+; Position=1 -8,1362-1479
MHWFDQQAANNCKFLRFANNALRKYLLYLISKKFLREKEGF

SEQ ID NO: 129739 - protein, 55 aa, Heterodera glycines
  Coding regions on vcDNA: vcDNA=SeqID_56162; Strand=-; Position=1-288
FFSFFRNIFVFFSAGTASDNIFYLFRKINFFFFLIYFNYISSLNFLINIFKLSPY

SEQ ID NO: 129740 - protein, 69 aa, Heterodera glycines
  Coding regions on vcDNA: vcDNA=SeqID_56163; Strand=-; Position=1 -122,239-326
MEATALALIIVGKNDKFWEHKQRWSRSEVCRFRLIISNIFGMKSAENGVPNSAGTQVTVLYKALKRHYK

SEQ ID NO: 129741 - protein, 90 aa, Heterodera glycines
  Coding regions on vcDNA: vcDNA=SeqID_56164; Strand=+; Position=1 -168,754-858
MLTANSRHQFQMFPPPFHVAPSVLNRPMALSLVFHRAALAAHSSADRCLPNGTICAKECEIRAAHVGSNGVLELAWTFRKDTPKSLANVN

SEQ ID NO: 129742 - protein, 102 aa, Heterodera glycines
  Coding regions on vcDNA: vcDNA=SeqID_56165; Strand=-; Position=1 -120,880-917,1181-1331
  Homolog annotation: Hit_ID=CAE71868.1; Match level="QueryCoverage =60%, HitCoverage=2%, E-value=2e-17, Identity=61%"; Hit description =Hypothetical protein CBG18920 [Caenorhabditis briggsae]
MLQFRRVMRTILLLQLLRLLFPLHHHQQKRSFQQQRKNAKECAYTCHRNHDCKIKKTSPTAYCDCWEKFGCRALITGNLVKREQLLNLFLQNGKLVDKLNAR

SEQ ID NO: 129743 - protein, 158 aa, Heterodera glycines
  Coding regions on vcDNA: vcDNA=SeqID_56166; Strand=-; Position=1 -137,484-661,825-978,1441-1448
  Homolog annotation: Hit_ID=XP_519892.1; Match level="QueryCoverage =68%, HitCoverage=4%, E-value=4e-18, Identity=35%"; Hit description =PREDICTED: similar to progestin-induced protein; ubiquitin-protein ligase; hyperplastic discs protein homo
MDTSCGRKLADTFFEPLMDVPEPVERMFCCTLFSAILSKGGTLYWRGIFPFTERRKLWEKARMKKKQVTSASSNDIVVGSEVRTKSSPIYSVGSVAVNFAGGLPMIGTLYEDAWTLNETCRFRVQTPDNYDAIPIGNDKDKQQQQQQHREKRVSFSRP

SEQ ID NO: 129744 - protein, 139 aa, Heterodera glycines
  Coding regions on vcDNA: vcDNA=SeqID_56167; Strand=-; Position=1 -135,404-602,963-1048
  Homolog annotation: Hit_ID=NP_524296.2; Match level="QueryCoverage =73%, HitCoverage=3%, E-value=7e-25, Identity=57%"; Hit description =CG9484-PA [Drosophila melanogaster] gb|AAF54431.2| CG9484-PA [Drosophila melanogaster]
RIMMTRPGVRSGGFCRTGVIIDRNRSNRPMIPASSVPEELIVQCQVVLQGKSRDVIVRELQRTNLNVNEAVNNLLSRDDDEMEDLDETGEAYLHEELLSLLDAGLRSDGDTDGYEYVISRDMARRRDGWTNKKKNWGPI

SEQ ID NO: 129745 - protein, 82 aa, Heterodera glycines
  Coding regions on vcDNA: vcDNA=SeqID_56168; Strand=-; Position=1 -54,442-636
MNYFIEILLLLLCTLVQKDEAEGRIVFADDHLPPTSNAIGLHGHRHATLAELGAQPLPKVVAERYACLNIACLFPRLGFFTG

SEQ ID NO: 129746 - protein, 45 aa, Heterodera glycines
  Coding regions on vcDNA: vcDNA=SeqID_56169; Strand=+; Position=1-136
MEKLEKRRKAKIAYFLKYKPPGLLFFIFFKSGLKRMNEAAFGLLF

SEQ ID NO: 129747 - protein, 223 aa, Heterodera glycines
  Coding regions on vcDNA: vcDNA=SeqID_56170; Strand=+; Position=1 -74,255-411,461-547,649-937
  Homolog annotation: Hit_ID=NP_505689.1; Match level="QueryCoverage =90%, HitCoverage=23%, E-value=5e-43, Identity=45%"; Hit description =solute carrier family 21 member (5K962) [Caenorhabditis elegans] emb|CAA16312.1| Hypothetical protein Y32
ANWRLLSATSYAFCDDSLNSLRTMTKRCDQKLSNVAPTATIFLGLLILGVGRTMPFSLGLPLIDDNVRKSNLPLYFAGMFCIRIMGPMLGFLLGSFFYFAGMFCIRIMGPMLGFLLGSFFNKNYYTLGMPYGMTPRDPMWIGRWWAGFLLIGSVLLLPSLALFFFRNPKQKASAGEENEDEGGHRPRLALVDRHLEKGEDGEVGIGIDIQIYPWNGTQAIVPK

SEQ ID NO: 129748 - protein, 38 aa, Heterodera glycines
  Coding regions on vcDNA: vcDNA=SeqID_56171; Strand=+; Position=1 -38,164-242
MGSRNAPNFHLHRKLIRSAPNFAGILKGRENNLFLNII

SEQ ID NO: 129749 - protein, 95 aa, Heterodera glycines; identical to SEQ ID NO: 124528
  Coding regions on vcDNA: vcDNA=SeqID_56172; Strand=-; Position=1-662

SEQ ID NO: 129750 - protein, 16 aa, Heterodera glycines
  Coding regions on vcDNA: vcDNA=SeqID_56173; Strand=-; Position=1 -13,115-152
MATMDFWSIFFITFGA

SEQ ID NO: 129751 - protein, 140 aa, Heterodera glycines
  Coding regions on vcDNA: vcDNA=SeqID_56174; Strand=+; Position=1 -141,246-527
MHMYYIPLDRGGLTSILNFADSEKQKLWGLKNRNFWLCFHLKLVAQLAKKSQLFVARKKVYENLYFLKMKFYFQKIDAGISENQQSRKYTPKLVITNRKNSSSPGSETLMSSRVDVRTNPPDQNRSAISTNRSVIRPSII

SEQ ID NO: 129752 - protein, 335 aa, Heterodera glycines
  Coding regions on vcDNA: vcDNA=SeqID_56175; Strand=-; Position=1 -67,344-424,524-635,742-825,923-1065,1209-1246,1680-2038,2086-2210
WHGFLGDQLSAEFFVTDQQLLKECREKLANSELRETKLVFKNGELNAENRALKAELEKQKRMMEHIELKAKVFNMEQEKQQFEKKYVSVEVFNTLVERIKQLENQQQKKEEGRNVFVDHQLLDIFLAWAKQQKENVGQQHKKENVQQKLDGKCVMFDKIMSRKLQRVPAIRRRRRFASIGFATKEMPLDGPIGQHLNSYGYQSNGSFGCNFISRPCKMAFGTMPIPFNGAVGKQRGGYGGSANWPFPLDFVPVPMPSDRALAYQSPSFSTGDVVGCGVHLDTRLIFLTKNGLRIDDYSFFTTTPTDSLFPCVSLWTGDKIEANFGPSFKFNLATL

SEQ ID NO: 129753 - protein, 87 aa, Heterodera glycines
  Coding regions on vcDNA: vcDNA=SeqID_56176; Strand=-; Position=1 -55,163-371
MSSSSGSPDSFFRSANDQAAAAAAEEVGKYEVFSWHGFLGDQLSAEFFVTDQQLLKVGHLKTYKERASGSVPDSRNVPKTEKDFCKI

SEQ ID NO: 129754 - protein, 158 aa, Heterodera glycines
  Coding regions on vcDNA: vcDNA=SeqID_56177; Strand=-; Position=1 -78,545-719,785-1008
MCPNGKFMSLEEWAAFILRIFLLTQKDVKRLWNMDPTFLDSTSKVQPYWRHSHLQFNQQQINSNFYPKFEQKLSENWQNDEKFTIVLQAYRRDAQLLYTLKSLDGLRYLDRVIVIWGDFRRPITEHAYTWPHIHVPIFVVSASVWHFETQKTTFININ

SEQ ID NO: 129755 - protein, 146 aa, Heterodera glycines
  Coding regions on vcDNA: vcDNA=SeqID_56178; Strand=-; Position=1 -88,135-192,243-408,481-609
MLIQIRILNSLVLIFVIIFLTIYTTKYFKVQNYVFIIASKEAVNFFDWSKCAEFGVFMPNNSNLMPKEEQLLAKWMISSNYWQKDIEKACFLVYFINKKSNLLTEHLPNDGMNSLIIFLNDIKPTEEFRKKNFRAIFVASDFNEGY

SEQ ID NO: 129756 - protein, 326 aa, Heterodera glycines
  Coding regions on vcDNA: vcDNA=SeqID_56179; Strand=-; Position=1 -691,779-1017,1196-1246
MNSKLGYLDEQVREMLTLSFSQTIKSICDYMLETRRWAATALLSDPTTFARKLFQSGKLVARVAGPELIKVWPCIELQAHDYEFAKIGNSADSEFECIDKIPIKFRVKDNKRMAFIDPRTMILSSDARLAPCSQYRKQLIFVRGSLYEIDQIDAQVKQVNANRIEGFSLNLSLAPTYARHSFLHLALVNVSDFIGQFYDANLARESELTFQIKSEDAIVTKTLSEQWEQVNFLIRFGLMIRDEYVGRGTTRRMTFGGNKTQKIVKSPARLNMMDLNASVEFGNEIELSPVKLIEPAQTQAYKIAGKRKRPYCSAQNGIQTFQCSQI

SEQ ID NO: 129757 - protein, 81 aa, Heterodera glycines
  Coding regions on vcDNA: vcDNA=SeqID_56180; Strand=+; Position=1 -72,158-331
MAYARLRTPLLEISNMIIADVTKLDFIGTICSGILSKGNTLALESDMVKYDQLSKGITESTHLWWKTESCQCVMVCFVAFI

SEQ ID NO: 129758 - protein, 149 aa, Heterodera glycines
  Coding regions on vcDNA: vcDNA=SeqID_56181; Strand=-; Position=1 -149,526-828
LTKPIYLRKYVGRGKAAAKKLHKLEKKDSFKNQTKAENLQQQHDPLTQQRRMSFSNALDAIRARTLSNTNSPAHPLFRESNELLLHQSSAVDHLQKMNDVKCRTKNGGNIGGHRKYFTMFEGGNEIDSEELKAEDELPNEDKNESKEIP

SEQ ID NO: 129759 - protein, 20 aa, Heterodera glycines
  Coding regions on vcDNA: vcDNA=SeqID_56182; Strand=-; Position=1 -46,366-382
MLVDNVPEKRQENKNYFKLL

SEQ ID NO: 129760 - protein, 207 aa, Heterodera glycines
  Coding regions on vcDNA: vcDNA=SeqID_56183; Strand=-; Position=1 -114,716-895,940-1267
MSSSKRKHQWHLLANVSDYSKSEKGFQSDEKLDDNDLEVAMINESCLFGDTVFQQQSAAFFALPSLLPFNNQTNIVSSFVSPFNEEQNSDESDAAAKSIAYDVVSSLFDGEPLYSSESFSDDEGSMVVNASILQVLQDDETESELEQENTEATKENETAKSVSEESESIEFQPTVPTCNNSMPTLLSQMYAADEQTLPVFDSWEELG

SEQ ID NO: 129761 - protein, 192 aa, Heterodera glycines
  Coding regions on vcDNA: vcDNA=SeqID_56184; Strand=-; Position=1 -173,485-639,1079-1225,1389-1492
  Homolog annotation: Hit_ID=NP_510443.2; Match level="QueryCoverage =82%, HitCoverage=16%, E-value=1e-20, Identity=29%"; Hit description =attractin family member (140.8 kD) (XP337) [Caenorhabditis elegans] emb|CAA93653.2| Hypothetical protein
MVTNRWNLLSSPNASTLDLPMALAGHSAHVIGNEMHILFGYNPFEGYMFTPQIYSFGWNNLGSFGAPLFRHSAVILDGIMLLVGGNSHNESSTTRKKDCYSEQIYAYDMICKRPVKIYSKEFEAIARYGHSAFVSGGNMFIVGGFNGEMLNDVLLFTPGSPFSQLPRAKRRWSLTKNTVQGLPWETSKDKTG

SEQ ID NO: 129762 - protein, 154 aa, Heterodera glycines
  Coding regions on vcDNA: vcDNA=SeqID_56185; Strand=-; Position=1-465
FSHFFTAKLVPTVAFSCLALSNNLTIFETQTKKILDQKWLSLFSHFFTAKLVPTFAFSCLALSNNLTIFETQQKKFLTKNGYLFFLIFLPQTWYQQLPSLVWPYQTILRYLKRKQKKFLTKNGYLFFIIFLPQTWYQQLPSFVWPYQSILRYLK

SEQ ID NO: 129763 - protein, 33 aa, Heterodera glycines
  Coding regions on vcDNA: vcDNA=SeqID_56186; Strand=-; Position=1-99
MLFSNPFILCLLLNFLIIGPSQFIGQFINIIGE

SEQ ID NO: 129764 - protein, 62 aa, Heterodera glycines
  Coding regions on vcDNA: vcDNA=SeqID_56187; Strand=+; Position=1 -48,108-183,423-487
MATFNVAHLITLIGVGSIAHRLLLMSNKIKTKLKLEKQNENVFTELHDNQNGLSTKLENGGK

SEQ ID NO: 129765 - protein, 82 aa, Heterodera glycines
  Coding regions on vcDNA: vcDNA=SeqID_56188; Strand=-; Position=1-249
MRRGATVIRRGATVIRRGATVIRRGATVIRRGATVIRRGATVIRRGATVIRRGETVIRRGIKVIECGTKMIRRGTKIECNLL

SEQ ID NO: 129766 - protein, 100 aa, Heterodera glycines
  Coding regions on vcDNA: vcDNA=SeqID_56189; Strand=-; Position=1 -114,574-759
MSWFIEKPFELLPVYYYYYLNTKNKTQRIVSSLSFFEMENPGFFLFCLDLDLDFFFTFDLDLDFLDKNPGPGKIQVAEKWPGPGSRKNPGLDPGPGRALL

SEQ ID NO: 129767 - protein, 250 aa, Heterodera glycines
  Coding regions on vcDNA: vcDNA=SeqID_56190; Strand=+; Position=1-753
MLTAYGEFNGRKRSRFDPSYSPLNNQHSLDKKQQLLDGVAKLNFDNLVNDQTISEESWAQIAQLTTLLKLAANIIGDSMAPQIDNAAEMERRRSVVATGIPESVSDIPSERVAEDHNTVTRLLDQLGVECPVTSYRMGNQAPNGRPRPLKIVLAASKFQRITITHWSKKRAELRKIPQMQRLNLRESLTPEQLSARREMQKECTAKRAQTGQDWIIYNDRLILRDDIKGKSTAMFPPTVSLITNVHPTKN

SEQ ID NO: 129768 - protein, 427 aa, Heterodera glycines
  misc_feature (385)..(385): Xaa can be any naturally occurring amino acid
  Coding regions on vcDNA: vcDNA=SeqID_56191; Strand=+; Position=1-1291
  Homolog annotation: Hit_ID=NP_510671.1; Match level="QueryCoverage =91%, HitCoverage=44%, E-value=8e-59, Identity=33%"; Hit description =predicted CDS, endonuclease/exonuclease/phosphatase family and RNA -directed DNA polymerase (XR69) [Caenor
NFLTKIPKIFTNLSKKIFKDETPLILYENKTIIDDGEKAEIFAKHFALTFQNSSNYPQPPTTFSNSSNLPTLSNIQFNVLDVLEILIYLPNKNNTSPDNISFKFLKTFHLILARHLTDLFNLSLCSGNLPKIWKTSLVLPLFKNGDKNLVNNYRPISITCSCCRIFERLIAKKLTEFLLKNNLISEHQFGFLKSRSTTLQLISSLEDWYNAILRNQKIDIIYLDLQKAFDQVPHDLLIYKLKKTITGNLLNWLRDFLLGRTFKVRINQKFSNEFPVKSGVPQGSVALISVFNWAETWGLNFSVKKSSVLYLGKNNKKIPYTIKNATIPESKIIRDLGILIDNKLKFNGHVSIILQKAYLKSRILFKKIKTKSTKTWITVYKSFIXSLLEYATEIWNPQTKKEINRLEKFQKNFTKNVFRKCCLPYIS

SEQ ID NO: 129769 - protein, 73 aa, Heterodera glycines
  Coding regions on vcDNA: vcDNA=SeqID_56192; Strand=+; Position=1 -55,866-1032
MFPGLSFSSVVEIAWHGQGQDPAGLILQILYFPKYAELRTGILQNPAQDTVLRRSLVLVSNPAFFVNFGVLRE

SEQ ID NO: 129770 - protein, 224 aa, Heterodera glycines
  Coding regions on vcDNA: vcDNA=SeqID_56193; Strand=-; Position=1 -309,511-876
MDIWSAGLTILQLTLKKTFGYKEKVDEKIGELFRSAKLKFEGGKFKPDPAKLSLPIDIYEYSRDHLKYDEYWPSGNWWYNYLTVIHDILTLWDKMPEIVFLSVNMLNIDAEKRMSAKGIIDYLEGKCKPKEYEKNAEKMALFGDVSDEKLKIFMGTEHMGFCIFEKYLNDGLILFGGDNDEREKKVKEDFNKMENIKQNLIKNAVKSIETFMKELEERDEICDH

SEQ ID NO: 129771 - protein, 144 aa, Heterodera glycines
  misc_feature (21)..(21): Xaa can be any naturally occurring amino acid
  misc_feature (71)..(71): Xaa can be any naturally occurring amino acid
  Coding regions on vcDNA: vcDNA=SeqID_56194; Strand=-; Position=1 -205,485-670,826-868
  Homolog annotation: Hit_ID=NP_495301.1; Match level="QueryCoverage =79%, HitCoverage=11%, E-value=6e-37, Identity=62%"; Hit description =diacylglycerol kinase zeta (2G748) [Caenorhabditis elegans] gb|AAC24300.2| Hypothetical protein K06A1.6 [
LLSHFVSQFSSNKFNFIKIKXKNDFSFFVFRRALAKSPVVKRAAAIQEQEQKRVSKHRTSRYWLDEQGPVXLSPSEHIWLPSSASSASSSAVDTECYLGEKDCQKMGEKRRCSGCHIVAHTACFPLLAKMNLSCKMTFRDCAQK

SEQ ID NO: 129772 - protein, 61 aa, Heterodera glycines
  Coding regions on vcDNA: vcDNA=SeqID_56195; Strand=-; Position=1 -33,89-189,765-816
MEKEYKQSVRKLYAGKHRGYLLMPVELPNPNDPNGDRFSGQGHVLIHSAIRSMNNTPIADG

SEQ ID NO: 129773 - protein, 99 aa, Heterodera glycines
  Coding regions on vcDNA: vcDNA=SeqID_56196; Strand=-; Position=1 -129,496-666
MDDAVELVTALENMRVNIDLLSVKTDKYFIPDIFLRNLANAKMKTRIGAVLNEFRKKIKDEKLAKRCKALIKVCFWMRDMHKNKGIKNILNTQNCGTKL

SEQ ID NO: 129774 - protein, 36 aa, Heterodera glycines
  Coding regions on vcDNA: vcDNA=SeqID_56197; Strand=-; Position=1 -32,805-883
MAPLSLKGGRGQIDKLYKLTTNCLLNVCLRSTKMCR

SEQ ID NO: 129775 - protein, 68 aa, Heterodera glycines
  Coding regions on vcDNA: vcDNA=SeqID_56198; Strand=+; Position=1 -6,193-393
MKYSDGYCNNLLKSPKFSCTTSASSLCCSRAKFRFCGVIEQANEETETIFINIFNCKNKICLITNPNF

SEQ ID NO: 129776 - protein, 81 aa, Heterodera glycines
  Coding regions on vcDNA: vcDNA=SeqID_56199; Strand=-; Position=1-246
MECSSTHLDDVDRTSNFAEALHSVTKFGGNLVAVIQQFGASLTRSDVSRRRLMPTWQFVWWENSNPKRKGSIMMAMLKFFS

SEQ ID NO: 129777 - protein, 129 aa, Heterodera glycines
  Coding regions on vcDNA: vcDNA=SeqID_56200; Strand=+; Position=1-479
RTDAPRFMGETESFRNSFPIACTLILPWIFAPHKCLSTPNGHLKKSIFFVFWAVPPNRCAQIYGETESFGSSFPIACTLILRWIFAPHNCLSTPNGHLKKSIFLFSGQSPRTDAPRFMGRPNPSGVASL

SEQ ID NO: 129778 - protein, 30 aa, Heterodera glycines
  Coding regions on vcDNA: vcDNA=SeqID_56201; Strand=-; Position=1-3,60- 149
MEIVSKNNPKTQLRIKIMEKSQKSVSRNPS

SEQ ID NO: 129779 - protein, 84 aa, Heterodera glycines
  Coding regions on vcDNA: vcDNA=SeqID_56202; Strand=+; Position=1 -44,771-981
MNVKGFHSRLTHKNRHLPMLLLPLISLSLFDLTNELTREQLMLKRKNDIGRFLLIRYPIVRDPSKWAKFEFRDAMISPSDQQQK

SEQ ID NO: 129780 - protein, 122 aa, Heterodera glycines
  Coding regions on vcDNA: vcDNA=SeqID_56203; Strand=+; Position=1 -108,224-484
  Homolog annotation: Hit_ID=XP_220829.2; Match level="QueryCoverage =70%, HitCoverage=13%, E-value=4e-09, Identity=35%"; Hit description =similar to hypothetical protein FLJ20315 [Rattus norvegicus]
MARPRGSGRDPFKARSARARRRAGNKRKAAAGTAANVQAANRRPICLICLKKMTQVRQVRTICDHVFHYVCFHRWLKYRLFCPVCLLNFRTELYHSGNAVFEGAYNDGHVVLIPDGEQSNSG

SEQ ID NO: 129781 - protein, 209 aa, Heterodera glycines
  Coding regions on vcDNA: vcDNA=SeqID_56204; Strand=-; Position=1 -34,443-606,666-954,1137-1279
  Homolog annotation: Hit_ID=A48145; Match level="QueryCoverage=71%, HitCoverage=100%, E-value=2e-49, Identity=62%"; Hit description =ubiquitin-conjugating enzyme ubc-2 - Caenorhabditis elegans
MTWTQGKVGKEKHNYLRLSSSSLHCATTTTTLQKRPHRRFSSFVRSSVLHINSLAVFAMALRRIKQELAELKQEPITGCTAAPMDDGKDMFHWKATIKGPPESPYEGGTFHLDIVFRRDYPFTPPIVKFETPVYHPNVNKQGGICLDVLKTTQWAPSLTISKVLLSISSLLCDPNPNSALEMNIAIIYRNDREQYNRNAREWTQKHAMK

SEQ ID NO: 129782 - protein, 92 aa, Heterodera glycines
  Coding regions on vcDNA: vcDNA=SeqID_56205; Strand=-; Position=1 -162,669-784
MDEEPRDEMTRQTTDGWERMQKTTAEEGGGGGYIQLTLFPHMIPTVKIVLLYLTFYCPNKLFMYNTKLDIAFVRSQLEMSADHLSTVALFTI

SEQ ID NO: 129783 - protein, 69 aa, Heterodera glycines
  Coding regions on vcDNA: vcDNA=SeqID_56206; Strand=+; Position=1-209
CTLQFYCPNKLFMYNTKLDIAFVRSQLEMSADHLSTVALFTIRYEHNVSIVVRALRHGVSRMIQFRAKV

SEQ ID NO: 129784 - protein, 92 aa, Heterodera glycines; identical to SEQ ID NO: 125147
  Coding regions on vcDNA: vcDNA=SeqID_56207; Strand=-; Position=1-304

SEQ ID NO: 129785 - protein, 61 aa, Heterodera glycines
  Coding regions on vcDNA: vcDNA=SeqID_56208; Strand=-; Position=1-185
MIGRAVRNRPFIFEGIFKFILYPRKMAISFFEKFYTSQKRLRMRRRAGAIAILFHRGFLYL

SEQ ID NO: 129786 - protein, 105 aa, Heterodera glycines
  Coding regions on vcDNA: vcDNA=SeqID_56209; Strand=-; Position=1 -208,350-459
MPLIIYFSVLFLLLIPICNIDIKEWKFLQYYILLSSIPMFLPSAINPIVSICTIKYYRYELVSGLKRSSEKFVKLFFRQNIHPQNLNETAHKEDQAKWATNVANN

SEQ ID NO: 129787 - protein, 139 aa, Heterodera glycines
  Coding regions on vcDNA: vcDNA=SeqID_56210; Strand=-; Position=1 -190,273-378,698-821
MPLDECVGCHWDNYGYKSNGTFETSGSVWLNEERYEFSRGDTIGCGVNLASRRIIFTHNGRQLAQAVFRKARSMGIFNLLDGDDDEAPVQRKAVHKTFSVQCITDVHNSRQWTNTIRTAFATTINSDNPIVRRKQLAAY

SEQ ID NO: 129788 - protein, 33 aa, Heterodera glycines
  Coding regions on vcDNA: vcDNA=SeqID_56211; Strand=+; Position=1-101
MAHECYGFGNVRAIKHAHRARCWGICAAPQAAH

SEQ ID NO: 129789 - protein, 27 aa, Heterodera glycines
  Coding regions on vcDNA: vcDNA=SeqID_56212; Strand=-; Position=1 -11,691-763
MRDGTFYSNFKCASIMYSVIKEAKILF

SEQ ID NO: 129790 - protein, 173 aa, Heterodera glycines
  Coding regions on vcDNA: vcDNA=SeqID_56213; Strand=+; Position=1 -116,366-771
MFEFRVRDSEIHQIEFIFMISGHKSPWKHVFIIKSKFFIVSSKLPSFNWTVPTISLFTNFPVKQLNCAPDWYRSEFRPAAAASVAADYVEKKIPMTPTLLLALLLPLALSNRQMSWSGTTMECAHVFYFVTYSPHCSLLCTDVLMDTFPFLDPTRPQNGTDFATFRLFSRRAF

SEQ ID NO: 129791 - protein, 213 aa, Heterodera glycines
  Coding regions on vcDNA: vcDNA=SeqID_56214; Strand=+; Position=1 -161,692-1172
MSFFEVFALCARPFVGKARIFFVLRRNTTKGFGGELARRSNCRIHNYPNGDGELYIDHFVIAFLRSNKQIFDNGRGTNLYLNVFYHFNRKRVQRILDDVFLSEILPIFAPNIRRLDFPNDDHLRHLLRISSPSLLTDLNQLNSIDSDYLVPAAAIDDFDGQNATSAEQVLSKWLHTPRKDGQPKRLRCCIGCALQTKKWMKKFKQVAPIFFRH

SEQ ID NO: 129792 - protein, 38 aa, Heterodera glycines
  Coding regions on vcDNA: vcDNA=SeqID_56215; Strand=+; Position=1 -113,1498-1501
MGDEAMPNWTNGSVGRAENLDNLNNVSIIFRGFTNCIG

SEQ ID NO: 129793 - protein, 81 aa, Heterodera glycines
  Coding regions on vcDNA: vcDNA=SeqID_56216; Strand=-; Position=1-246
KFKRSNSISGCDSERKPLIEWSNEEEISTTEVEPELVSRTTAKTTKCQGQKETEAKQIQKLMDEKYKSRALMDGLKQSGLL

SEQ ID NO: 129794 - protein, 73 aa, Heterodera glycines
  Coding regions on vcDNA: vcDNA=SeqID_56217; Strand=-; Position=1-221
VDSRGQQIGRNLRVAGGDVLLGQDYVRHCGQQIRNQLADTMRQHEIGQHLGKCGKIDAFIGILLRNSLFSHTS

SEQ ID NO: 129795 - protein, 80 aa, Heterodera glycines
  Coding regions on vcDNA: vcDNA=SeqID_56218; Strand=+; Position=1 -189,339-442
IATPLRYACTLVGIRIAFNTLRRLGKLRTTREIDLTVRQRLDLLIEHRDQKRSAKRAVRHQNNSMKRHSLCSSRTRTKLD

SEQ ID NO: 129796 - protein, 146 aa, Heterodera glycines
  Coding regions on vcDNA: vcDNA=SeqID_56219; Strand=+; Position=1 -120,284-439,492-653
  Homolog annotation: Hit_ID=NP_499556.1; Match level="QueryCoverage =98%, HitCoverage=32%, E-value=3e-41, Identity=58%"; Hit description =NitFhit related protein, nitrilase and fragile histidine triad fusion protein (49.9 kD) (nft-1) [Caenorha
MSARRVLVAVGQLNVQHDLQQNFERCARMVRRAGERNGCKMVFLPECFDYIGRTVAEQIDQALDTRGPYIGKFRELAKQHGLWLSLGGFHHKRPELRSDHLPRNTHLLIDSDGQTRAEYDKLHLFDLDLPGKVRLMESEFSSHGHK

SEQ ID NO: 129797 - protein, 101 aa, Heterodera glycines
  Coding regions on vcDNA: vcDNA=SeqID_56220; Strand=-; Position=1 -99,202-408
MATIIHLAAIYEHPAILRALLDQDGSHIDARDSEGRTALHYAAALAGTLREDDADGSGGDDKEKSRDAAELECFDILLDSGANEGLLDVEGRKTWKNGILI

SEQ ID NO: 129798 - protein, 183 aa, Heterodera glycines
  Coding regions on vcDNA: vcDNA=SeqID_56221; Strand=-; Position=1 -76,200-677
DDFDNATALADHLKALHKDKDRYLGYFNWTKFYQKRWVPTVKTSAFCQLCEMVHHQMEEGGEFVGRNYTVKSHKKLWGAQRCRENYVQNDSKTPRKNLNFVIFVSQPNSIPNNGLKSPAFQTLGLNPLTFNDIPITENQPISISISETQFSGFPIAGAQPTSISIAGTQPTSIPNNGLKAPAF

SEQ ID NO: 129799 - protein, 53 aa, Heterodera glycines
  Coding regions on vcDNA: vcDNA=SeqID_56222; Strand=+; Position=1 -148,1112-1125
MYNCDKKGTTVIKIGTTEIRRGTTEIRRVTKMIRRGAKVTKRGATVIRREILE

SEQ ID NO: 129800 - protein, 46 aa, Heterodera glycines
  Coding regions on vcDNA: vcDNA=SeqID_56223; Strand=+; Position=1-155
LHRIAEKIRDQFPNVDRLIAKRKPSLSKRLTESKNLEMYLICNFNQ

SEQ ID NO: 129801 - protein, 281 aa, Heterodera glycines
  misc_feature (23)..(23): Xaa can be any naturally occurring amino acid
  misc_feature (81)..(81): Xaa can be any naturally occurring amino acid
  misc_feature (221)..(221): Xaa can be any naturally occurring amino acid
  Coding regions on vcDNA: vcDNA=SeqID_56224; Strand=-; Position=1 -503,2921-3169,4104-4198
  Homolog annotation: Hit_ID=XP_311331.1; Match level="QueryCoverage =99%, HitCoverage=100%, E-value=2e-33, Identity=37%"; Hit description= ENSANGP00000001657 [Anopheles gambiae]
FCTSTNHCCTSSNHCCTSSDHCXTSSNPCSSSNHFCTSFNHSCTSSDHSCTSSNHFCTSTNHCCTSSNHCCTSSSLFNLLXSFCSSSNHFCSSSNHFCSSFNHCCTSSNHCCTSSDHCCTSFNHCCTSFNHCCTSFNHCCTSSDHCCTSFNHRCTSSNHCCTSSNYRTSFSHFCTSSNHFCNSSNLCCTSYNHCCTSSHHCCTSFNHCCTSSNNSLPLLIXCTSSNHRFTSSDHCCTSFSHFCTSSNHFCTSPNHSCTSFNHSCTSSDHCCTSSNHCCTSS

SEQ ID NO: 129802 - protein, 102 aa, Heterodera glycines
  Coding regions on vcDNA: vcDNA=SeqID_56225; Strand=+; Position=1 -139,232-401
MIKRGTTVIRRGTTVIKRGATVIKRGTAVIKRGATVIRRGTTVIRRVIRRGTTVIRRCATVISRGTKVIRRGTTVIRRGTTVIKRGTKVIRRATKGLEEVQQ

SEQ ID NO: 129803 - protein, 102 aa, Heterodera glycines; identical to SEQ ID NO: 129802
  Coding regions on vcDNA: vcDNA=SeqID_56226; Strand=+; Position=1 -139,232-401

SEQ ID NO: 129804 - protein, 279 aa, Heterodera glycines
  Coding regions on vcDNA: vcDNA=SeqID_56227; Strand=+; Position=1 -348,389-880
MGVFQHCMDEAIIDSRQSGVEPTHLGCIVSSQNLSSDIWIPIRQLTPDTINTILNRFNDVAQSKKQDDVTLWGEPFTVTVTTLNRNALPAKRQLKGGVARKLAPVHHNIHPNCLIKIQNFDDDNYCLFYAIQATLVRSIGDLDRRRFHDYVNGNSEMRGKLKNDALEMMNAVNAPAGQPNYDAEVYVPRIVDWWNGEKFVGQWKFKTFLFGSAGHYKPLFKYGPEDYVVPIILYFEEEHFNGVQKSGNLFGKPYCLSCEKTYDRPKRHIVNCKARCIKW

SEQ ID NO: 129805 - protein, 443 aa, Heterodera glycines
  Coding regions on vcDNA: vcDNA=SeqID_56228; Strand=+; Position=1 -197,236-589,1080-1299,1407-1686,2058-2149,2191-2379
  Homolog annotation: Hit_ID=NP_507780.1; Match level="QueryCoverage =37%, HitCoverage=10%, E-value=5e-16, Identity=32%"; Hit description =predicted CDS, DNA polymerase type B, organellar and viral family member (5T899) [Caenorhabditis elegans]
MFGLDVQDKPFFPHLANRPENYGCQIFPTKSNYLAGGINPEKRKEFDIWYAQNQNQPFLLDEALASYCKNDVDILMAGLIAFRTEFLEMSKRPADPDGKANRATYTTPHNGIDPLKHCITIASACMRHFRTNHLKPGHLALVPEKGYDSCGDNQSDLAMSFMQWYTEKYAVRIQNAFSAEGEKSCVTYYPVGHPTLHVPCEDVDWRRPEDNPYPLAILKVFVIPPQKIDVPVLPVKVDDRLCFPLCMSCCKKCPNGGLNAALEEGYRVTMLLRVLEYNKSDNQLFRSYMSEFMAQKLHASGFDEEIRGNSEAEERFIKECREKFDIKIDRAKMIPNKGKRALAKLAVNNLYTDSLIYVHPKGANPLKTGPHLGEFTDEFPKHDILEFISGGAKQYGLKLRKKGSENEFDYVLKLRGITLNYDVTKNQGLCYDTFKTRTTSKSI

SEQ ID NO: 129806 - protein, 179 aa, Heterodera glycines
  Coding regions on vcDNA: vcDNA=SeqID_56229; Strand=-; Position=1-540
MVLLTEKIAQLLNCRITELRDRLNHPSDCEIVVKAFYGKHIQTTYKDRNGYTKTLVFGGITAQGAATTMAYGRLGRPYNVNVAAHFYVRHRIKLRHPFLHCVIERFPEGQEDRFYPLELCKIEEVDESKWLGQIFTEINNNNISATNSTNFADTQTSNDDSKSVDGRDEYSQNDCYSLW

SEQ ID NO: 129807 - protein, 202 aa, Heterodera glycines
  Coding regions on vcDNA: vcDNA=SeqID_56230; Strand=+; Position=1 -64,116-258,1635-1772,1988-2250
MSVPSNDNQFPKTTNECQVDDDDVDTDPSPEEVEKWTPEEVIEWEKRIFGKMPPEEEFWQEIIDDGDKDNRGGRGNFRLRYNPLAAVELTLLGNRLEDRARRHRVAIGASTSASLLVFQAQQQEHRRREVQRQFEVAEQLQEEIQAAEEGENDQENEDQHQQQQQGGEEAQHGGEEEVQQAAQQNFERTVRLQLRESQRFHN

SEQ ID NO: 129808 - protein, 69 aa, Heterodera glycines
  Coding regions on vcDNA: vcDNA=SeqID_56231; Strand=-; Position=1 -52,159-235,285-365
MSISTNSTNGDFIPTDGEVNCESISLDNDGQSDGKVTVQQQPKEFREKCAKMEMNFKIIKLELEKVAFT

SEQ ID NO: 129809 - protein, 361 aa, Heterodera glycines
  Coding regions on vcDNA: vcDNA=SeqID_56232; Strand=+; Position=1 -901,950-1134
MKTFFVLILYVLLLKNANEQTEAGKINKEKSFDQIFGQGWDDGEEENICRIDQIFNGQTADQDNQFDQIFGESLEVKEGESEEMSTNSDQLEQLQENVGQISDHFSNAIGKKKREIVEKFDKIKEKVKQMGKKFTRKEWHKIERKIAKKLGVNQRKIYKWKREFGMMINKYSIDEKRETVKRFDQIYGKFKMKFNENLEGKREKCKKIIAKHLGISLKSIYKWKKQLKNGKPLKNQQIDDEKREIIEKYFKLKNEFMQNEKHSRKEWKEFSANIKQIFGIYYRTIEKWDKKFGIKQNISKGRKHYTIVEKMEIMKQYFELKNQNPKLTNGEIGEILNIPKGSLERYKAEFKRKSEGVPNTE

SEQ ID NO: 129810 - protein, 90 aa, Heterodera glycines
  Coding regions on vcDNA: vcDNA=SeqID_56233; Strand=-; Position=1 -130,201-341
MVGEGEAKEERINQFNCLSQTTKVEENVGDNRRINEKKEKEENEWQLVGRKRSSARSEQNLLGEMNEWPFIASGKAKKAPKSAMDLPTDE

SEQ ID NO: 129811 - protein, 49 aa, Heterodera glycines
  Coding regions on vcDNA: vcDNA=SeqID_56234; Strand=-; Position=1 -123,341-367
MSISDKIREAREWSYCIDTLKASVDSMYEICRIQQNILGCESKNVIPNF

SEQ ID NO: 129812 - protein, 33 aa, Heterodera glycines
  Coding regions on vcDNA: vcDNA=SeqID_56235; Strand=-; Position=1-103
TGFGISRMNAVRDQWAPKTHGNMFSQLYTNVSP

SEQ ID NO: 129813 - protein, 84 aa, Heterodera glycines
  Coding regions on vcDNA: vcDNA=SeqID_56236; Strand=+; Position=1-291
NARKWTGNGTCEVHEGRLWHLITLISSSETIVGNSRFILLLYVLHNLCYFIYTIFVHFQYLLIYSFGLCKKMNNESFVGMCSIQ

SEQ ID NO: 129814 - protein, 19 aa, Heterodera glycines
  Coding regions on vcDNA: vcDNA=SeqID_56237; Strand=-; Position=1-59
TFAFSSLALPNTHTIFEML

SEQ ID NO: 129815 - protein, 19 aa, Heterodera glycines
  Coding regions on vcDNA: vcDNA=SeqID_56238; Strand=-; Position=1-59
TFSFSSLALPNTHTIFEML

SEQ ID NO: 129816 - protein, 19 aa, Heterodera glycines
  Coding regions on vcDNA: vcDNA=SeqID_56239; Strand=-; Position=1-59
TFAFSSLALPNTHTIFEML

SEQ ID NO: 129817 - protein, 19 aa, Heterodera glycines
  Coding regions on vcDNA: vcDNA=SeqID_56240; Strand=-; Position=1-59
TFAFSSLALPNTHTIFEML

SEQ ID NO: 129818 - protein, 19 aa, Heterodera glycines
  Coding regions on vcDNA: vcDNA=SeqID_56241; Strand=-; Position=1-59
TFAFSSLALPNTHTIFEML

SEQ ID NO: 129819 - protein, 19 aa, Heterodera glycines
  Coding regions on vcDNA: vcDNA=SeqID_56242; Strand=-; Position=1-59
TFAFSSLALPNTHTIFEML

SEQ ID NO: 129820 - protein, 19 aa, Heterodera glycines
  Coding regions on vcDNA: vcDNA=SeqID_56243; Strand=-; Position=1-59
TFSFSSLALPNTHTIFEML

SEQ ID NO: 129821 - protein, 123 aa, Heterodera glycines
  Coding regions on vcDNA: vcDNA=SeqID_56244; Strand=-; Position=1-369
MNAKIIRVPKIACDLSLAKNGVSKNRNYAQKASQTILTLPIPSTIAFIHPIMSAKIIRVPKIACDLSLAKNGVSKNRNYAQKAPQTILALPIPSTIAFIHPIMNAKIIRVPKIACDLRLEKNG

SEQ ID NO: 129822 - protein, 114 aa, Heterodera glycines
  Coding regions on vcDNA: vcDNA=SeqID_56245; Strand=+; Position=1 -72,135-221,303-485
  Homolog annotation: Hit_ID=NP_740855.1; Match level="QueryCoverage =92%, HitCoverage=7%, E-value=8e-32, Identity=60%"; Hit description =splice (1G205) [Caenorhabditis elegans] gb|AAK21388.1| Hypothetical protein F46F11.1a [Caenorhabditis eleg
MSSARLPKGSNEGTPSSDEGEFKKIVIGICAMQRKANSKPMRSIMLKMNEFYKDFLDFVIFPEETILNESVENWPLCDCLISFHSTDFPLKKAIEYEKARRPYVLNDLHRQFDL

SEQ ID NO: 129823 - protein, 533 aa, Heterodera glycines
  Coding regions on vcDNA: vcDNA=SeqID_56246; Strand=+; Position=1 -636,1117-1275,1630-2047,4174-4391,4534-4704
MVAFGTELDEGTRDIGIGGVPNGGRKWGRMCSKESWRLSSACPPSARKQFAPTVCYFLFPNCVSTVPLFSPPSLRFSPFVIFGDLSVLPDLLRHSAGRTSDFSFVGCQRRIAIDGIEIIGQDLAILEERLDQFMAEVFAHFITINCSLLIRSMQPLHPCVRSLEVREIKGQMFAMEKMPGRHVEKAFVCLREAIHSLANAKVSKLSPLIVSRMNVNSMRFVLHRHTNNTQPTPFPLSFQLIVNSSTPLDIHWHRLAMGVSPDGKMSLRLLIEENRPEDAISQLCLSAKSADHSVLASIFAVISVLFLLSFVLFAIVFRFKKRKRKESAKRNRSVQISSSFVTQSQTPPIIVPSQFNGEEEEQKMAKLENWRAMAVSTDTFSSIGFSSCSTFPRHSNIIGPSDAEADGDGVISDNEFAEFEFMDEEDPISDQQSNDNYQQNGQQQKEQRNGDKMDQLNDHNSKEEQIGKRADENGAEKSARSEGDFSFLVDEEEFDEFPAKTVEEIDQTHKGEVPVNKPPKPLTFAEMSLLGAS

SEQ ID NO: 129824 - protein, 333 aa, Heterodera glycines
  Coding regions on vcDNA: vcDNA=SeqID_56247; Strand=+; Position=1 -254,306-473,527-717,770-1013,1078-1224
  Homolog annotation: Hit_ID=XP_396386.1; Match level="QueryCoverage =100%, HitCoverage=76%, E-value=1e-76, Identity=43%"; Hit description= similar to CG17593-PA [Apis mellifera]
ELLALLIIFVYALNYAYGKSKNHSIAHKWFMDNRERLEKQFALVGDDGTSQENMGGCLIRETDFAYSVWCTGRIGCRSMHSQIKLFKRQDLLGMMIGLVRPRPDNVVYKIDLDPDEMDSFVLIFGQRKNVQKTVKEMHDLSTYVTERKNVDKVQLPSSICVFAEIAETIPAIIDASTLQFLKKCEKYVEYIHFSDQYAGAKQPDDQYVRLPETHPTLVFSYIITDDNEEGHLMDSMLLNFTFFMLDKVRRYRLSKEGKAKADKKRQNVQENFLKLTHQQRQEAAQTRREEKTRERKQRVIEEEDPDRQKRLERLEQKRDAKQKQPKMKQFKIK

SEQ ID NO: 129825 - protein, 53 aa, Heterodera glycines
  Coding regions on vcDNA: vcDNA=SeqID_56248; Strand=+; Position=1-159
MTTEPNGAVDQQQQQLLFASTACACRPNTMEWCKTTSFIVFASQRTICIVSDQ

SEQ ID NO: 129826 - protein, 66 aa, Heterodera glycines
  Coding regions on vcDNA: vcDNA=SeqID_56249; Strand=+; Position=1 -51,141-290
MAKETDDWTIKADWTHKFEDDLAVNDKWAMSNLLGMASQLNFTFQLGPPGGKRGYMVQIFVFKRSI

SEQ ID NO: 129827 - protein, 48 aa, Heterodera glycines
  Coding regions on vcDNA: vcDNA=SeqID_56250; Strand=+; Position=1 -35,474-579,792-797
MLNVARPPKYVCIEGGHNETVPELYNPFYLSDSPYGAYSKLNNDEKLA

SEQ ID NO: 129828 - protein, 23 aa, Heterodera glycines
  Coding regions on vcDNA: vcDNA=SeqID_56251; Strand=+; Position=1 -63,197-205
MSSLSSSSKLAASLMARCSSLNP

SEQ ID NO: 129829 - protein, 89 aa, Heterodera glycines
  Coding regions on vcDNA: vcDNA=SeqID_56252; Strand=+; Position=1-268
MMGIRDRKNWQNFAVLREALALAQSYFYMWQIGAKKREMRQKLFELYPSFNSGELFRRDITKKHPADQLRRKADHHQHINQRIGRGGGM

SEQ ID NO: 129830 - protein, 108 aa, Heterodera glycines
  Coding regions on vcDNA: vcDNA=SeqID_56253; Strand=-; Position=1 -49,79-356
MSGQDSGIQAGQCGQKSQRRDLRGREKGVGFWDLDGTTLVMASLLFFSWHKANKTHGASAAASLRPHGQTVAVRSCGDCINFFTFRRCDEALDFLQRKIGPEKVENSF

SEQ ID NO: 129831 - protein, 23 aa, Heterodera glycines
  Coding regions on vcDNA: vcDNA=SeqID_56254; Strand=+; Position=1 -63,883-891
MWRLRWSKTGQPDEHSSSIQQFF

SEQ ID NO: 129832 - protein, 284 aa, Heterodera glycines
  Coding regions on vcDNA: vcDNA=SeqID_56255; Strand=+; Position=1 -141,452-705,753-1212
  Homolog annotation: Hit_ID=NP_001004509.1; Match level="QueryCoverage= 76%, HitCoverage=14%, E-value=1e-23, Identity=31%"; Hit description =si:busm1-180o5.3 [Danio rerio] emb|CAD60788.1| novel protein similar to DNA polymerases [Danio rerio]
LLHQRCWEYDGSSGRLSPGILRNFHGAKGYVDGIDDKENPRPGIECCAARGTGAKSVTPTTTCCYWECEIHRMLERSKEMRKAFEDYVDDGPLVIRDAFMGGRTGPVKLLRKAGPGERISYYDFTSLYPYINFTTCYPIGTPKVHVLNHEVEWRSAADNPYPLALLKVWVVPPRRVDVPVLPVKVGERLCFPLCISSAKEHPTGGVDNDYHCEHNDRQRGWVSTCTSIELNEALDVGYLVTKVFRVLEYCPRVRRAVQHHHRPNQNGGQQREAVPGQVVFEQLM

SEQ ID NO: 129833 - protein, 190 aa, Heterodera glycines
  Coding regions on vcDNA: vcDNA=SeqID_56256; Strand=-; Position=1-573
MVLVSTFCAQLLNCPVKSLRDRLNHPEDRALVLKHIIGRKVRTTYNDRNGLTKTFFVTGISAQGAAFLPAYGQLRNPFNINVAAHFYARHRIKLHFPYAPCIIERFSGGGEDRHNPMELLELIDDNMDMDINNNEHWLGRLFTEIDDKQSSSNSSDTTMRLVFEGDMDEDSGRNECSQSTVPYISFVFAH

SEQ ID NO: 129834 - protein, 118 aa, Heterodera glycines
  Coding regions on vcDNA: vcDNA=SeqID_56257; Strand=+; Position=1 -211,266-411
MKRRVAPLTAAAVSAEQHQIIGSESPKPHEETTKNVEPKDELATKKRKVDDRELWKLAKGKFLLTTYLCHDDWNRLYNNQQKVKRLEGDRFAFGFEMCEECVWANCRATDLLAPMKKK

SEQ ID NO: 129835 - protein, 99 aa, Heterodera glycines
  Coding regions on vcDNA: vcDNA=SeqID_56258; Strand=-; Position=1 -115,590-693,749-829
MWPPIIRSLKGERSYRVKAVLATYTHSTKRIGYYVDWLLCNLLGRDPATVLKIDDLNISFAPSLNVQDIPYKKAIAQLGEFVKNCLEAPAPEQSDSEDE

SEQ ID NO: 129836 - protein, 73 aa, Heterodera glycines
  Coding regions on vcDNA: vcDNA=SeqID_56259; Strand=+; Position=1 -77,715-859
MSSATEKILLFLFVVAQRIGDMVKGRPIEAVGSAEVVQKQFDAAAPVNLFTCGAHRFDYVRQSTPAAGSAPRA

SEQ ID NO: 129837 - protein, 288 aa, Heterodera glycines
  Coding regions on vcDNA: vcDNA=SeqID_56260; Strand=-; Position=1 -217,259-386,430-951
  Homolog annotation: Hit_ID=E86336; Match level="QueryCoverage=72%, HitCoverage=48%, E-value=1e-16, Identity=37%"; Hit description =hypothetical protein F14O10.11 - Arabidopsis thaliana gb|AAF88160.1| Contains weak similarity to an unknown pr
MPPKRRRCCLNQSCEDCRRKQAIKAIEADNIRAKACQGEHDPACVVNLRITNPELHREAYDGMDAVVERITDGPIDVHCPDCDLVYSHYAVKWIGSERDWHGLGPGVTIVGTNQLDSNDVREFETEKREREKEVHDGLMLGRVNENIDLLNQINEFEDFAADPGRMAKKIVFELEEEEEREEEQEEEREEEQEEEREEEQEEEREEEQDEEGEEEQVGTSSDVGNKKRRKKKKKRSRGGKGFRDWMNKEKEKEASASGNDAGGEEDENSHAVSITSSTAKKAIMDFAL

SEQ ID NO: 129838 - protein, 96 aa, Heterodera glycines
  Coding regions on vcDNA: vcDNA=SeqID_56261; Strand=+; Position=1 -168,263-302,1264-1346
  Homolog annotation: Hit_ID=P07850; Match level="QueryCoverage=69%, HitCoverage=14%, E-value=3e-18, Identity=61%"; Hit description =Sulfite oxidase
DAPSGDPFAADPPRHPALIVNMQKPFNAETPPSLLIDSFLTPKELFFVRNHMAVPRTNEETHKVRIDGIGHRGAVESVTGTKPDGFKGLLPVHQCE

SEQ ID NO: 129839 - protein, 65 aa, Heterodera glycines
  Coding regions on vcDNA: vcDNA=SeqID_56262; Strand=+; Position=1 -118,230-300,811-819
MHQQKQRQKKEKKKKQQQQNVKIITTAAAMHLTTAHFTAHPSLALGFLTRDLAEYEDLVHRLKKK

SEQ ID NO: 129840 - protein, 74 aa, Heterodera glycines
  Coding regions on vcDNA: vcDNA=SeqID_56263; Strand=-; Position=1 -153,493-564
MRQLSTVCLKNQVTVTGSFVQIQYPMTHFLDTKIDVNGAVPSISDGNVEEIKILKNCVFAFDPLFVRLSKMNNQ

SEQ ID NO: 129841 - protein, 29 aa, Heterodera glycines
  Coding regions on vcDNA: vcDNA=SeqID_56264; Strand=-; Position=1 -66,123-146
MAISFFEKFSMQQTLSNMKRSAKNGYLFF

SEQ ID NO: 129842 - protein, 29 aa, Heterodera glycines
  Coding regions on vcDNA: vcDNA=SeqID_56265; Strand=-; Position=1 -66,123-146
MAISFFEKFSMQQTLSNMKRSAKNGYLFF

SEQ ID NO: 129843 - protein, 29 aa, Heterodera glycines
  Coding regions on vcDNA: vcDNA=SeqID_56266; Strand=-; Position=1 -66,123-146
MAISFFEKFSMQQTLSNMKRSAKNGYLFF

SEQ ID NO: 129844 - protein, 29 aa, Heterodera glycines
  Coding regions on vcDNA: vcDNA=SeqID_56267; Strand=-; Position=1 -66,123-146
MAISFFEKFSMQQTLSNMKRSAKNGYLFF

SEQ ID NO: 129845 - protein, 73 aa, Heterodera glycines
  Coding regions on vcDNA: vcDNA=SeqID_56268; Strand=-; Position=1 -102,196-315
  Homolog annotation: Hit_ID=NP_788670.1; Match level="QueryCoverage =89%, HitCoverage=44%, E-value=2e-21, Identity=72%"; Hit description =CG10851-PF, isoform F [Drosophila melanogaster] gb|AAN13578.1| CG10851-PF, isoform F [Drosophila melanoga
MSRIYVGHIPYEARERDVERFFKGYGRIRDILIKRGYAFVELDDPRDADDAVYDLNGRSMMGWRVVFHFDREF

SEQ ID NO: 129846 - protein, 147 aa, Heterodera glycines
  Coding regions on vcDNA: vcDNA=SeqID_56269; Strand=+; Position=1 -112,328-488,527-697
MPCGENNISLSLHNFVSSARIETGIRPLERAARALQEVKKLFEFLQFCFHNFRKLFGIIMPKQNEIVLKYSFLDLTWFLDIEAVFYAISKTKKCLVVKTIFHISLHNFVSSARIETGIRPLERAARALQEGMERKNSYFWDFFRNQN

SEQ ID NO: 129847 - protein, 156 aa, Heterodera glycines
  Coding regions on vcDNA: vcDNA=SeqID_56270; Strand=-; Position=1 -256,302-513
MVEMGTEIQTSRNELKSFQEEVDKAKNITLEHVEKNDMKEAKKSADVAKGIARQAKTKYTSTLEEYNDKSEKGFSGMVVRLNEALEAEKGPQKRERLANEDVQFNYDSIDQKFIVYLSSAVTHIDLSKHLAYVLGFKNTRLFHAEEATYMPDLTGG

SEQ ID NO: 129848 - protein, 56 aa, Heterodera glycines
  Coding regions on vcDNA: vcDNA=SeqID_56271; Strand=-; Position=1 -127,172-215
MNFLFLFLINASAIKHVLGNDSICGENEVYKADFENMLIKLIDINGSSAELEKEFG

SEQ ID NO: 129849 - protein, 104 aa, Heterodera glycines
  Coding regions on vcDNA: vcDNA=SeqID_56272; Strand=-; Position=1-315
AKIELLRSIEADLKAERKLREERKKQSQERERKQLEEQQQLEEGGASGGDAGGVDKMPPPPPPPRQLEAAGGGGNDGIIGGGGGGEGGGVADEMPSKKERNLHR

SEQ ID NO: 129850 - protein, 114 aa, Heterodera glycines
  Coding regions on vcDNA: vcDNA=SeqID_56273; Strand=-; Position=1 -211,576-709
MPPISRAIGACVHRPPITLRSNCSVWTGSHVSSRATTLSRSSMAIWPIRVKLDNKIYKFKFVALEKLAYFWPRFCCGLPTESMFTEVKGHEVIIIASAVQKGNYSVGLTYSITE

SEQ ID NO: 129851 - protein, 69 aa, Heterodera glycines
  Coding regions on vcDNA: vcDNA=SeqID_56274; Strand=+; Position=1 -137,467-539
MSKFVIIARFLLPIVLLLISSRPVSASYQDDLDDDDEEVDYMAGYTEEQKKCCTDWLQAVQKLFPRMLH

SEQ ID NO: 129852 - protein, 87 aa, Heterodera glycines
  Coding regions on vcDNA: vcDNA=SeqID_56275; Strand=-; Position=1-787
IIFIQKIFFWVFGAVPLNRCAQIYGETESFRNSFTIACTLILRWIFAPHNCLSTPNGHLKKSIYFCFRGSPPEPMRPDLWGDRILPE

SEQ ID NO: 129853 - protein, 41 aa, Heterodera glycines
  Coding regions on vcDNA: vcDNA=SeqID_56276; Strand=-; Position=1-123
MNSLPFLSLWLLIGTLLLLTAFVANCQNLFQPSQVSLGSEK

SEQ ID NO: 129854 - protein, 208 aa, Heterodera glycines
  Coding regions on vcDNA: vcDNA=SeqID_56277; Strand=+; Position=1 -95,221-295,347-803
  Homolog annotation: Hit_ID=NP_500074.1; Match level="QueryCoverage =35%, HitCoverage=26%, E-value=3e-11, Identity=43%"; Hit description =nuclear Hormone Receptor (nhr-41) [Caenorhabditis elegans]
MLVAVQRHSLLLQLLPCLRWFNESALVELFFSTLLGSIPIETVIPFILNTNLPLNKLDEQCDGKNSANTDATTTTTTTTTAEATMSEQNGGANGTPENGDEQHGDRADVAVEQHRAVQPAGAGQGLPSAAVAVAAAAVAELLSLNSPAGHRKEKHVKVEQSEAVDSNDDDKRDGCAVEDDYQQRDKHNYEHEKEEKQGQQESKQYQQH

SEQ ID NO: 129855 - protein, 470 aa, Heterodera glycines
  Coding regions on vcDNA: vcDNA=SeqID_56278; Strand=-; Position=1-1413
  Homolog annotation: Hit_ID=CAA82797.1; Match level="QueryCoverage =55%, HitCoverage=40%, E-value=2e-29, Identity=34%"; Hit description =gag protein [Ascaris lumbricoides]
MEFLNDHTQAREDIERMEESNRQNRNFPSNRPPQNRVQRQYYPNFPHNQMKPNPRNQQTSTPFPYTSAFTTKSKPVRLAQFKPNPTQNRTQNKTFCRFCERENHASKECKIYSTPEKRNERVRELKLCLNCLNKGHMANECKSTYLCFNCKYKHNTLLCTRKQTQYKPKEQKTRVNMAKNYENHEETQTFMTMDYDKNLSNYEEEELLMTAEVNCINPDKHKVKKEIILFDNGSQKSYITEECAQSLQLTTIEEKLLAISTFNQNKPKIIKSRLVKVGIKTLKGEVEYITLQTVEKITDVTKMVNKENVDVLGVKIPISHASPQILIGIDHYWHFMLPNSQIQLLPSGFYSINTKLGKILSGKGTIEDTNCNSVTEKRKKDETNQILQKFWELENIGIIDSPHMTDEDAAMIHFDKNVTFKNNRYHVRWPYKRENPNLPTNFGLCMGRLRNVVKQLIKNNQFTNYDKILQ

SEQ ID NO: 129856 - protein, 207 aa, Heterodera glycines
  Coding regions on vcDNA: vcDNA=SeqID_56279; Strand=+; Position=1-622
MTFQNVPSSLCQERMIDAQPLPIIFGHSIGGPSSSTSGGTNCGSVGRRVSNAGGKRRSAGTNNNGTGTNHQHLRHSLSAMLNISSSSVSSVDSSSSLLLFPPLSASSHSVSGSSPAKQQRRHHQQQAASSSTANCCANADDGMGDDKMEDHQNGNKLLAKMVVDGQQQQTNHANGKGTAKREADEQMEEEEGSSNGGEGPHEAAKRP

SEQ ID NO: 129857 - protein, 205 aa, Heterodera glycines
  Coding regions on vcDNA: vcDNA=SeqID_56280; Strand=+; Position=1-618
MNEMAELKAIINRLSAIEKLISTNNNNTLATEMTAQFSAIADRLGEIERKLNNNNNGIGSAEDKERKRSLVLIGLPESEEEVPSLRAKDDAKTVEEVLDRLDVEVCPQMVYRMGRRSDEKRKGPRLVKVVLPASTFQRFALMQWGRRRTELKKRAGWERLLVRPSLTKEELEIEREQRQKKWMEFGQKKTDENITTRRGGNEKNF

SEQ ID NO: 129858 - protein, 84 aa, Heterodera glycines
  Coding regions on vcDNA: vcDNA=SeqID_56281; Strand=-; Position=1 -48,257-463
MPGQSFQNRIIQLVAESQGRRERSASNTKLRWQTEARQMSNKERTIARGSDHWSVEGQSISDGQQQQNGRETFAGELLANGLIN

SEQ ID NO: 129859 - protein, 78 aa, Heterodera glycines
  Coding regions on vcDNA: vcDNA=SeqID_56282; Strand=+; Position=1 -96,344-481
MLQTRLCFYLSDQLNDSILEALARHFLITNFSGIVSVTLRQNKLVCLELVGIPLLTSNALKAVNSNRLRSVDLSGCRK

SEQ ID NO: 129860 - protein, 683 aa, Heterodera glycines
  Coding regions on vcDNA: vcDNA=SeqID_56283; Strand=+; Position=1-2052
MREPKRRTESRPDQSRHAEGTQNRDQFPRVFMVRSNPSSQRPITPGASALRTGTHAPHRKVADRNRNRLAQSRGPAPTDNGCSLCQNWGHRPSNCPTYPTFQERRQRFFEQRRCLRCLSSDHIASCCPRPKACRWCQRDDHHSLVCWVGPGKPIAIREPAGPETREHIGSKPVESVMMVQTVLNSESNSRPPEARAKAKRKRPKRRRSHLTKQSENQGERSPGTDLRAFTAMGESLPAFLMVCPVIAANDDTTRQCRTVLLMDPGSQVDYAQTILTKQLELPNAGSSPLVVQVFGGSKKKVPSAKHRVKLKRLDGGWEQLEVSSVPNVCTPIHTKLVEPGTHPGLLKPMDATVQPQIVIGIRKFWDLVIGFKKSAEGAFLVDTVFGTVLCGEHFGAPLGQSVPRDTILMAISGEENRWNRMPASSGVEAADKSKPSIYENDRLGIGPLNPTPKNPRDRKDPPHVQPEKRCRVEQQRTKCELPESDQDGTTEPCERGLSQCLLGASLLWKVMTWVTRHPIRVFNRLTGGDIPEPTADQVKGQERVQLARRARAAARAWRNAERGRASRPGAAMALLPLLCFVALFSSSEPMSVMLRSEDCASTPSGFKCSGSAAMIIGPEVGELRDSVNGITPKGIGPLCLFLQWEGGISTVARLGPPRRRPQCRESDERKRMGFGWPGLFPAD

SEQ ID NO: 129861 - protein, 150 aa, Heterodera glycines
  Coding regions on vcDNA: vcDNA=SeqID_56284; Strand=+; Position=1-453
MTTKTAKDEKLRNANKKWARQIDKITQKDEMGKPMVRQSEEKKQLQKGIGILKLTQKAFIKVPLILVDDESTSEGINCLNSEISEKFLQNFFSVSNRIFFCHGFGVVSASDLKERLRWIIRDNALLALENAHPQLMHFGGKSPIWTCGIS

SEQ ID NO: 129862 - protein, 170 aa, Heterodera glycines
  Coding regions on vcDNA: vcDNA=SeqID_56285; Strand=-; Position=1 -46,207-313,370-545,594-639,1162-1296
  Homolog annotation: Hit_ID=NP_505451.1; Match level="QueryCoverage =70%, HitCoverage=20%, E-value=7e-10, Identity=34%"; Hit description =ligase family member (60.3 kD) (5J989) [Caenorhabditis elegans] emb|CAA94751.1| Hypothetical protein F11A
MQKACISPVSTLLNEVELARIFNETKCKVVFCADSLLERILATRPLCPHLKYVVLISTTNCQSAVSLPNSQFQSVFHWSDAVGSSNSVDLSRPLPKIDVEKDVMFMPFSSGTTGLQKGVMLSHRNVKVAFLVPPILVLLAKSAAPSRYDLSSLKLIMTGAAPVGTDLLDK

SEQ ID NO: 129863 - protein, 31 aa, Heterodera glycines
  Coding regions on vcDNA: vcDNA=SeqID_56286; Strand=+; Position=1-95
FLFSEFVAFKIERLRNLFAVQLHFVIRPFVS

SEQ ID NO: 129864 - protein, 54 aa, Heterodera glycines
  Coding regions on vcDNA: vcDNA=SeqID_56287; Strand=+; Position=1 -59,283-388
MGLQGDSFALFIMVSQLFFRLISCKQTAIEFMAPADIKSQTNNEQEDDDFGYAK

SEQ ID NO: 129865 - protein, 78 aa, Heterodera glycines
  Coding regions on vcDNA: vcDNA=SeqID_56288; Strand=-; Position=1 -119,806-923
MFNASTTAGGDECGTNGKMKIQISFTNRTIIVENENFMFKRPYTVYAFIILIIFSPFTKLRSYINVHEIIMRAITQLK

SEQ ID NO: 129866 - protein, 84 aa, Heterodera glycines
  Coding regions on vcDNA: vcDNA=SeqID_56289; Strand=+; Position=1-252
MINTGDGGALTVLKDEKAMTYYGIGEGATVLLFTQFEIAVKYKKDNAEKMCTVRMKGTDLVAELRDKIVEEMKNVFPLIVYNSI

SEQ ID NO: 129867 - protein, 217 aa, Heterodera glycines
  Coding regions on vcDNA: vcDNA=SeqID_56290; Strand=-; Position=1 -171,223-399,597-902
MAMLSFVFSIGILTWTYDYMVGNDHLNLSLINAEEIFQIQQFLDGNLSDFVLYCGQNDYFLGQITMGLYFVENIICYAVIVICGYKMARFVYKNLDKSSARRQQINRQITINLILQAFIPLAMNLINLIISVEMVIFEFQLSPSFMFIQMCITLPFHWLPVLNPLVSILCVGDYRNAVANFIRHTICRRQNAVAQQQILMNNLRNNNRNAQLPIVLS

SEQ ID NO: 129868 - protein, 120 aa, Heterodera glycines
  Coding regions on vcDNA: vcDNA=SeqID_56291; Strand=+; Position=1-363
MVAKSKVFGQIKGNSPAEQLQSLRRIALDTGLPEKENICRKCNRRGPIESQCDKIRAYHQNKGQNFNTNTVMLPAAYINSVHSSNLLKAPINVHGITIGFILDSGAVIIIINEDDYNAMG

SEQ ID NO: 129869 - protein, 72 aa, Heterodera glycines
  Coding regions on vcDNA: vcDNA=SeqID_56292; Strand=-; Position=1 -63,112-267
MCCKNSSFTHTIGHVTEAIIKLMKKLNAEKLMSLCPKVVRQSNALRLTSAAKRTCAIVTSEWAKCQHKIIIN

SEQ ID NO: 129870 - protein, 63 aa, Heterodera glycines
  Coding regions on vcDNA: vcDNA=SeqID_56293; Strand=-; Position=1 -137,214-268
MFLLLSQIFLLSFACQMSAKNLSNLHEMAKCHLGYDISVYNGHGCWCAVNDGIKKKSVDAIDE

SEQ ID NO: 129871 - protein, 425 aa, Heterodera glycines
  Coding regions on vcDNA: vcDNA=SeqID_56294; Strand=+; Position=1-1276
  Homolog annotation: Hit_ID=CAA82797.1; Match level="QueryCoverage =60%, HitCoverage=42%, E-value=1e-16, Identity=26%"; Hit description =gag protein [Ascaris lumbricoides]
MTAPIQALIRGCASKLGALLGTEIPPDLGINALPNQCQRRLYKFRNLLNDLERVVQKIEDNLGLANEYIGKLSRDNAIRKETEMQELMQELQINEKQKAADVLIPILRDKIEALEEKLDITHNTDGDTTSGIGPLSRSVPMRKNLPKTELKRFDGSPSQWIPFWDYFRTIIHEDSHVPKIDKFSYLDSCIEGKASAIIQGIPISESGYDDAIDLLLKTYGETKRLIRTLNRELMSLPISESFEDDESLYLKSEKIFRQLISMNQNVEDGMYYSNLEGKMSPEVLDKYCVIKDAEDNDDWDTSKFRNAFSRALDQIKHRQELRKNVIEPKRDKHELTMSFTAFSKNDKYQGRNKFPQRNSDQSHPRGRKFEPRKFRDQRHDNSDSSVSHSPMRDRRNSPYPKRDWSSSPEREKWKKDEQRKCQLCQ

SEQ ID NO: 129872 - protein, 100 aa, Heterodera glycines
  Coding regions on vcDNA: vcDNA=SeqID_56295; Strand=+; Position=1 -100,546-748
MDHIYYGVRLGGAAEQTPNWPRKRTITPKCACSGKSKFFPVLPGPGFFSHLTWILISWTKIQENPGPGKIQVAEKWPGPGPGSRKNPGLDLGQGRSLIII

SEQ ID NO: 129873 - protein, 360 aa, Heterodera glycines
  Coding regions on vcDNA: vcDNA=SeqID_56296; Strand=+; Position=1 -162,337-477,814-967,1047-1309,1566-1782,2660-2793,2833-2844
  Homolog annotation: Hit_ID=NP_501628.1; Match level="QueryCoverage =90%, HitCoverage=66%, E-value=1e-29, Identity=28%"; Hit description =putative protein family member (4K65) [Caenorhabditis elegans] emb|CAA92518.1| Hypothetical protein F49C1
MKRRVHVGTCFSPLFLAEHWQLVVLAIEIYRHYGIQLQVVYLMSAVEGLYKILKAYSSKEHIQLEPWASIEIDGQIDKEMNLELDWRNQATAHTDCLLKYGYSAEFLIVGDMDDILIPDDKEYYAEFIRNDYRHKKNAVALLYQRYTVDIVTTQNSSKFSLFDALTSAKVAFYQPDDPKYVVNTSRAESLWIHWPVIIKPNTATRLVPSMEGRMLHFRNWHFLEDENDILASENYMHRKVKNAALWRSVALNESFLSTKTARQISRRFKSDIFKRNFGTFLKLPTKRMYAEMMAKCYDKIFYLHDKQVTDCPGKTLDDFCRYQGDKNHCLDGVIPCLYKNDECVPNHKLDGVTISSSVWI

SEQ ID NO: 129874 - protein, 68 aa, Heterodera glycines
  Coding regions on vcDNA: vcDNA=SeqID_56297; Strand=-; Position=1-206
MVIFGTVSFPFSSVCLLQNLRETVVKCLNWQSVIAGTDFPRNAKAENSQWIHFGVFFQLPSPLLFVLP

SEQ ID NO: 129875 - protein, 127 aa, Heterodera glycines
  Coding regions on vcDNA: vcDNA=SeqID_56298; Strand=+; Position=1 -159,244-468
MHEFWRCKIKCPYCPARITVSRIWQQNEQGKRFKMGHYNNENHNHPPRTGNIMVRNAEDRLRQEARQANPMRTRDIVAEVRSSIPVGVRVAVESGTPSSSAMVRAFNWHKSNARRLQGDEGLDLDGS

SEQ ID NO: 129876 - protein, 218 aa, Heterodera glycines
  Coding regions on vcDNA: vcDNA=SeqID_56299; Strand=-; Position=1-657
  Homolog annotation: Hit_ID=XP_346518.1; Match level="QueryCoverage =77%, HitCoverage=18%, E-value=2e-22, Identity=37%"; Hit description =hypothetical protein XP_346517 [Rattus norvegicus]
MENQNTLKKGEEAEEEAVNSEMGIFKKEEGNKKAKEKEEKGEKEREKEEEEKEKEEEEKKKREEKREKEREKEEEEKGKKEEKEEQMEKEIEQEEDEKGKEHNEKLEEMKREEGPSKGVRFMERTETEGTQEMERLEEYERKLRRNTKEALELVDRLCELQRGQTAPSEAISGKIMAISNANWTMINANGDINTNCDARLMPNFDSIRLAPSDATIKK

SEQ ID NO: 129877 - protein, 260 aa, Heterodera glycines
  Coding regions on vcDNA: vcDNA=SeqID_56300; Strand=-; Position=1 -123,657-1316
MTAHIVQKHPQYAAKLLAKQLEFGDHHSEQPGNTMPKVEEGQFPVPNSASSLAATGIANTSSNDNGTEKEALSGTEEGASLCHSRGYGTETPFSTIVPSSPSVSISNFEWVEDIQIGDLPNQNESFARVPSPATPPPLAPSAQSKDIPFDATFEHFRVPPPATPPLSSSSSVLTMNTTAAEDSSNCSTIFSTTTTPKADAIDNENSANCYLDRFGKEWRLLVEAAADVKQLDQIAGEHCLNRKGPTKNDGRIYFKWVAMS

SEQ ID NO: 129878 - protein, 31 aa, Heterodera glycines
  Coding regions on vcDNA: vcDNA=SeqID_56301; Strand=-; Position=1-93
LSLFLLLLFINYLNFIKYVKINFSKIWDIKS

SEQ ID NO: 129879 - protein, 32 aa, Heterodera glycines
  Coding regions on vcDNA: vcDNA=SeqID_56302; Strand=-; Position=1-97
MAIRTVVAVENTAEATIPEKDGQLFDASTKPR

SEQ ID NO: 129880 - protein, 126 aa, Heterodera glycines
  Coding regions on vcDNA: vcDNA=SeqID_56303; Strand=+; Position=1 -160,687-904
MGRKNLKTSKSLRPLENINDSVGKIGEDLEDEELEEADDNESLEDEIGAESGEGLDECRVFGQNSGPGYFRVQKSRVQVFKPGTGGTESGRGTESGRESGRGTESGRGTESGRETESGRDTEREEK

SEQ ID NO: 129881 - protein, 72 aa, Heterodera glycines
  Coding regions on vcDNA: vcDNA=SeqID_56304; Strand=-; Position=1 -84,144-278
  Homolog annotation: Hit_ID=NP_741446.1; Match level="QueryCoverage =86%, HitCoverage=34%, E-value=2e-21, Identity=70%"; Hit description =serine/aRginine rich pre-mRNA SPlicing factor, Serpin (20.5 kD) (rsp- 6) [Caenorhabditis elegans] gb|AAA82
MSSRRGGGNNVEGKVYVDGLPEDATSEELDDVFHKFGRIRKIWVARRPPGFAFVEFEDTRDAQDAVRSLDGT

SEQ ID NO: 129882 - protein, 165 aa, Heterodera glycines
  Coding regions on vcDNA: vcDNA=SeqID_56305; Strand=+; Position=1 -433,928-992
MPRPLFPLPFPSSASPPLSAIPRVRFLTLSLSFVSVVFFLLTLAFSVLILTNINALHTEVMVDIEQFKVNLGKVRIVSELCPMAKGVVSKAWDGMVELQAADGGQNNGKSAGKENAQTTIDRQKRQYGTMPSYSSAYVNKQQTSKPGEPGQPGEGGAEQLHSKMI

SEQ ID NO: 129883 - protein, 325 aa, Heterodera glycines
  Coding regions on vcDNA: vcDNA=SeqID_56306; Strand=-; Position=1 -54,106-307,400-472,556-659,705-811,869-1003,1255-1427
  Homolog annotation: Hit_ID=CAE66984.1; Match level="QueryCoverage =84%, HitCoverage=20%, E-value=1e-54, Identity=43%"; Hit description =Hypothetical protein CBG12380 [Caenorhabditis briggsae]
RYAILCQTWPQWHGEPKKGCELICRSAELADTEFRKGCELICRSAELADTEFRLGHTKIFVKNPESLFLLEEGRERKFDAFARVIQRAFRRFTAKKHLTKQKEAVSLLQGRKERCRFSMERRFVADYIGMDQRPYIGMDQRPGLQAIIGRRERLYFAAAVVKFDRRFRASRIDLLLTAKYLFLVGRKASRIDLLLTAKYLFLVGRKPLKSGVNKGKLVEVVKRQIPLQIPLTQLQAVTVSTLQDDLVLLSVADSYCSLVETPLKTELLAALQKTQLKTNGRLMVVTVLKGLPSESSQFFWGGGFIRPRHQSSLLIPFILIFKFRI

SEQ ID NO: 129884 - protein, 46 aa, Heterodera glycines
  Coding regions on vcDNA: vcDNA=SeqID_56307; Strand=-; Position=1-356
INKKHCQRQCLPKKRQKNFRKKAKKIENLNKFTSEKRKKSLQHLRF

SEQ ID NO: 129885 - protein, 53 aa, Heterodera glycines
  Coding regions on vcDNA: vcDNA=SeqID_56308; Strand=-; Position=1-351
LFFENFFVFFSAGTASDNVFYLFRKINFFFFLIYFNYISSLNFLINIFKLSPY

SEQ ID NO: 129886 - protein, 23 aa, Heterodera glycines
  Coding regions on vcDNA: vcDNA=SeqID_56309; Strand=-; Position=1-71
WYGRKRKESHESNLIGIFKRAYF

SEQ ID NO: 129887 - protein, 160 aa, Heterodera glycines
  Coding regions on vcDNA: vcDNA=SeqID_56310; Strand=-; Position=1 -187,842-1137
MAFPCPPLAFPLLFIFLLSLSSVGTVPLMGSADLVHLPREHQSTQRIQRLKTALNENEAKREGLTRIREPFGPDKPYCLKVGLPFCLNALNTIPQIQFDEKGLCYASPLTREVPPLPTYEDACKMLSLAEIMANCGENKGRKEQSECIENKGKQQKNEKV

SEQ ID NO: 129888 - protein, 431 aa, Heterodera glycines
  Coding regions on vcDNA: vcDNA=SeqID_56311; Strand=+; Position=1 -60,104-241,297-456,830-1082,1134-1307,1819-2175,2231-2384
  Homolog annotation: Hit_ID=AAH70814.1; Match level="QueryCoverage =80%, HitCoverage=69%, E-value=4e-41, Identity=32%"; Hit description =Unknown (protein for MGC:83890) [Xenopus laevis]
FYNEELSSPQMPINYQVMKQGTDYSVHGCKAKAERNPIYRWTVGKGAINKFEFAGHDNSLMATAGQDGFLRVFNWKTMDLVGFFKSYFGGLLCLAWSPDNLYIATGGEDDLLTVYSLAERNAFQNGHHFPSGHEESVSSAPQIGHLPFANCDDLRTTNANSLQLLPNGKVTHRNGSSDDANDVSHCQPQLLYRVGTVGHDCQAFCAFGTFPKTFWLLRPFPNITSTKSPFLLHPQTLQMFPLEIPRSFPLASQMHCPQPKLIKQHGNSSNGANSNESTLKRGENYAQFLGTVQCPRLEDVPMIEPLMCKKVVVFRFAAIGVSVPFRLHTKDSALCSSARIASVVNFNLAEFYSNFCCLSDCLSGGNHLHLGSTEYIGETSERPGATTKSWDRTKTVTPFPGKTAMGRAFDRHVKQANSTPGTVIESIHSYN

SEQ ID NO: 129889 - protein, 74 aa, Heterodera glycines
  misc_feature (6)..(6): Xaa can be any naturally occurring amino acid
  misc_feature (10)..(10): Xaa can be any naturally occurring amino acid
  misc_feature (13)..(13): Xaa can be any naturally occurring amino acid
  misc_feature (16)..(16): Xaa can be any naturally occurring amino acid
  Coding regions on vcDNA: vcDNA=SeqID_56312; Strand=-; Position=1 -98,143-277
KTFGHXTKSXMDXPQXNEILPGTVHHLLLKKVGVLRRSFVCHLFQANVALFAYSFCFGYLSIVFVNIFFIKNKF

SEQ ID NO: 129890 - protein, 368 aa, Heterodera glycines
  Coding regions on vcDNA: vcDNA=SeqID_56313; Strand=-; Position=1 -93,576-681,768-962,1021-1110,1214-1306,1515-1540,1588-1684,1736 -1917,2104-2253
  Homolog annotation: Hit_ID=NP_001002171.1; Match level="QueryCoverage= 91%, HitCoverage=84%, E-value=4e-84, Identity=48%"; Hit description =zgc:91942 [Danio rerio] gb|AAH74052.1| Zgc:91942 [Danio rerio]
LGRLRRRKPSEGRSNKVPRKMQKKALRKVGKCPIVYSEDYNISFFGIEKCHPFDSNKWGNVFRFLIASGALVESGALVESAVLRPIEAKKEHLLLVHSKKYLRSLNGRFTLTRILEVGLVLLFPICLIDRRILRPMRFQTQTGGTVLAARVSLIRGWAINIGGGFHHASEGKGGGFCVYADVTLAIKLLFANELIKSAMIVSVDVDAHQGNGHETDFASDSRGNGHETDFASDSRVYILDLFNASIYPGDSDALKSVSSVSRAVPLPFGAEDDFYLRRLEMELDAAFADFSVPDFLLFVAGTDSLIGDPLGGLSLSPKAIFRRDEIVFGAAIRRRVPITMVTSGGYTNRSAKVIADSILNLNQKGLIQ

SEQ ID NO: 129891 - protein, 162 aa, Heterodera glycines
  Coding regions on vcDNA: vcDNA=SeqID_56314; Strand=-; Position=1 -66,131-553
ASVSGLALPKLNELEIRLLTSLRWDVSIQSEDFEKVLARLEGFVASEMAQQNGVMSYNELCILSNTHGFNRSILCLLTVLLKFLFVLLAFHLALLAGLSVLNMAVSRKQELAASDACIYHHGWDDCSHPPILLANERKIDANLTKVVHKDDFFAFVHAFSIS

SEQ ID NO: 129892 - protein, 29 aa, Heterodera glycines
  Coding regions on vcDNA: vcDNA=SeqID_56315; Strand=+; Position=1 -66,123-146
MAISFFEKFSMQQTLSNMKRSAKNGYLFF

SEQ ID NO: 129893 - protein, 29 aa, Heterodera glycines
  Coding regions on vcDNA: vcDNA=SeqID_56316; Strand=+; Position=1 -66,123-146
MAISFFEKFSMQQTLSNMKRSAKNGYLFF

SEQ ID NO: 129894 - protein, 29 aa, Heterodera glycines
  Coding regions on vcDNA: vcDNA=SeqID_56317; Strand=+; Position=1 -66,123-146
MAISFFEKFSMQQTLSNMKRSAKNGYLFF

SEQ ID NO: 129895 - protein, 350 aa, Heterodera glycines
  Coding regions on vcDNA: vcDNA=SeqID_56318; Strand=-; Position=1 -1036,1333-1349
MQIFSCAVCNAKCGISSSQQLLPFLDPELHILTASSPFADCGNFCYHYLQLSQGNWIKIDTRTATIQKIDSSSIGDPRSLGRQIFVGNHAASFSSMDDRQRTRRRAIRALGRMAAFGSMEVEGEGAQNGACAHTRSSPERVIGLTEEWFRDKLRLLVSYWTTACFIYVTFILGRDVLIPLVWVYLMGPVIVTIRNLVTGNQWTQRNRATRGTRRAPAISRIEAIELVPPPMPQEMRANETASSQQEEPELSPLVMELKRQMIAFRSKRRFQSRRNVATERQPRMSRRSFDGKRRICGRSNSPGPFPPFSPVMCPPFVPFFLCIYPSHFVPIDTIPHPLLYFSHIYYFIYR

SEQ ID NO: 129896 - protein, 46 aa, Heterodera glycines
  Coding regions on vcDNA: vcDNA=SeqID_56319; Strand=+; Position=1-236
NFFIWTSLFVTRNHYFGDFVTKIVKNHYFGVLSLFFHYFNIFWKIP

SEQ ID NO: 129897 - protein, 26 aa, Heterodera glycines
  Coding regions on vcDNA: vcDNA=SeqID_56320; Strand=-; Position=1-78
GRFAPVSKFVGLLRPLRGLRRALRAR

SEQ ID NO: 129898 - protein, 274 aa, Heterodera glycines
  misc_feature (182)..(182): Xaa can be any naturally occurring amino acid
  Coding regions on vcDNA: vcDNA=SeqID_56321; Strand=-; Position=1 -32,97-127,185-218,300-353,507-592,646-700,755-791,844-1196
  Homolog annotation: Hit_ID=NP_495552.1; Match level="QueryCoverage =98%, HitCoverage=55%, E-value=7e-49, Identity=43%"; Hit description =hatching enzyme EHE1 family member (2H690) [Caenorhabditis elegans] pir||T15444 hypothetical protein C07D
QRSQVLSLDNGCMDYSTIIHECMDYSTIIHEIMHVVGIMHVVGFYHEHERWDRDFYRWDRDFYIDIIWQNIDKSALDQFGKIDLTKTSYYGQPYDYKSILHYDSLAFSKNGFPTDSLAFSKNGFPTMLPKKGAATIGNAKDFSEIATIGNAKDFSEIDLAKINDLAKINRMYGCDAMATTDXTRRNLPLPAKAPQRHKSPTFSGTKDGTLPQMPIGQVPFGDEKSHLDRGQSEHGQSEFGKGQCWRFLPFKAACARAVCWSSKDRCHATNLQHV

SEQ ID NO: 129899 - protein, 87 aa, Heterodera glycines
  Coding regions on vcDNA: vcDNA=SeqID_56322; Strand=+; Position=1 -114,489-638
MAQAAGIASTRALHRQENSKKWPWKTDKRFWPSSTEKRQGILRHQQLPKRGGQGEKLAETNANAQRQKIFGEKAMETMPLTGQKQWP

SEQ ID NO: 129900 - protein, 350 aa, Heterodera glycines
  misc_feature (324)..(324): Xaa can be any naturally occurring amino acid
  Coding regions on vcDNA: vcDNA=SeqID_56323; Strand=+; Position=1 -84,137-220,381-502,552-634,972-1052,1156-1312,1385-1452,1528 -1615,2100-2218
  Homolog annotation: Hit_ID=XP_355031.2; Match level="QueryCoverage =99%, HitCoverage=75%, E-value=8e-96, Identity=51%"; Hit description =similar to cyclin-dependent kinase-like 1 (CDC2-related kinase) [Mus musculus]
LDKYEKIGKIGEGSYGVVFKCRNRDTGELVAIKKFFESEDDPAIRKLVAIKKFFESEDDPAIRKIALREIRMLRQLKHPNLVNLIEVFKRNRKLHLVFEHCDRTVLDDLERFPSGCPESLTKRLIFQLFSAIRFCCPESLTKRLIFQLFSAIRFCHSRNCIHRDIKPENILLTSNDVVKLGDFGFARIMSVNEIYTDYVATRWYRAPELLVGDTHYGSPVDIWAVGCVFAEMLTGEPIWPGRSDSDVDQLYLIIRTMGKAAITTAASKITSQQMKIFHNNAKITSQQMKIFHNNAYFRGISIPEPEEHIGAPINFKNEFGIFNXRCVEMDPKMRWSAEELLDHEYFRSSE

SEQ ID NO: 129901 - protein, 96 aa, Heterodera glycines
  Coding regions on vcDNA: vcDNA=SeqID_56324; Strand=+; Position=1 -116,165-339
LQSQNLADVLTTITDCARFIREYPFPGFVHNVLFKLAQAFQGELFGRKFEQSLNAIRLRIVTAIRECSGVNLGVTIPSEDIVRCIMKVSHSNDYKA

SEQ ID NO: 129902 - protein, 77 aa, Heterodera glycines
  Coding regions on vcDNA: vcDNA=SeqID_56325; Strand=+; Position=1 -127,225-331
MAVQIAQLADERKKYKKKCDELEKQLKQQQKQHQQEKEKGNNDKKALKIFKEGNGIGKTEKSCGTSSADHQQQQKVN

SEQ ID NO: 129903 - protein, 67 aa, Heterodera glycines
  Coding regions on vcDNA: vcDNA=SeqID_56326; Strand=+; Position=1 -78,136-259
MFIAKKEMELINSEQRRQISKLEIENRAFGEELKRQKMISFALELENNKMMMEKKQKQKEEMAKAKY

SEQ ID NO: 129904 - protein, 60 aa, Heterodera glycines
  Coding regions on vcDNA: vcDNA=SeqID_56327; Strand=-; Position=1 -67,150-265
MHHHPPNHEKAINLSILTVSGPALQPYFPRKRKTFVSGKLPTRANKSVGGSLVGIVYGQN

SEQ ID NO: 129905 - protein, 142 aa, Heterodera glycines
  Coding regions on vcDNA: vcDNA=SeqID_56328; Strand=+; Position=1 -22,1227-1635
  Homolog annotation: Hit_ID=AAP92584.1; Match level="QueryCoverage =90%, HitCoverage=26%, E-value=3e-36, Identity=62%"; Hit description =Ab2-057 [Rattus norvegicus] gb|AAP85373.1| Aa1262 [Rattus norvegicus] gb|AAP85367.1| Aa1011 [Rattus norveg
CVSLTCHAWPFLVRGAICLVYSDNERDSSLLNSWLIASGHNFLEGFSVFSRTKLSNNRSVMPLDVRGCTRATLAKSACLPSPKGVGKPVKICRDWDRTLQLLSVNEEFLVGASHQLALNTSLPFVHTARRCPGLSHFEKFGD

SEQ ID NO: 129906 - protein, 155 aa, Heterodera glycines
  Coding regions on vcDNA: vcDNA=SeqID_56329; Strand=+; Position=1 -94,277-650
MRKAKCETPKNANNAKGEMRKAKHRPIPARHFPFGVLSKDEVIAVYQFKSLPNCHGISDGIFPMPFSTNGRISDRKKGTLLMDIEKVSEFAREEVESSRYSEKVYINGLPWKILAQIKMKNGGTDNEKWLGFYLWCYAPKEGAKLLIINIYINNN

SEQ ID NO: 129907 - protein, 349 aa, Heterodera glycines
  Coding regions on vcDNA: vcDNA=SeqID_56330; Strand=-; Position=1-1049
MNFNPLYTIDYENYFQLFLENLLNIQNEAKQNLDEYRKRSKDWYDAKPQVKANKFEISERVMVAFPGMHRNSRHKKLLWNHFGPYTITKISESSAELVPVDKTAADPITVPLERLIKVPKAVPDIATLPRGKNPYKNVLNAMIFMISAQLNFENMPKRATENWQLGTIAKECVGADKYGKEKSSAKILRVNCLNLKLKVKRERKANFSGQTQTDAGICWTSVCSQKDAEHELCTTLKLGELDPVLGQSGPGAMIVQSPLQALLAVFLLRSGTVTSNTAARTFVEMIIKSGPQMEMATYSEKRGDYVGTGKFPQENDQVKALEKCVEMCFVARAALSATGYKPLAMAPPN

SEQ ID NO: 129908 - protein, 39 aa, Heterodera glycines
  Coding regions on vcDNA: vcDNA=SeqID_56331; Strand=+; Position=1 -109,287-297
MRVDFKYALAIQVRIHAMRSTFKSKTRFRAFERASIGFN

SEQ ID NO: 129909 - protein, 23 aa, Heterodera glycines
  Coding regions on vcDNA: vcDNA=SeqID_56332; Strand=-; Position=1-70
MDVDEHQPPWKKLSVNTVDNLTL

SEQ ID NO: 129910 - protein, 59 aa, Heterodera glycines
  Coding regions on vcDNA: vcDNA=SeqID_56333; Strand=-; Position=1-178
MANSGEHSSRRQQQQQRHPNTTAENNSDIEGTAHRVASVTLNTESDSRTSADLPAYPFR

SEQ ID NO: 129911 - protein, 49 aa, Heterodera glycines
  Coding regions on vcDNA: vcDNA=SeqID_56334; Strand=+; Position=1 -73,252-317,678-688
MFSRQMLKGYYAKRGYNFDIRTLFDGIDKRIDACAKGFNEDPVVLYESN

SEQ ID NO: 129912 - protein, 102 aa, Heterodera glycines
  Coding regions on vcDNA: vcDNA=SeqID_56335; Strand=-; Position=1 -144,318-482
MALTRLHHFTKALVTEANALSKGGSSSIVLGHSAEFERCIHSMLVMAQVFAPCLATEQWAKYQAVPKLNDQLQRQAEKPINENEWPTVDEDDGDVVHEAEMK

SEQ ID NO: 129913 - protein, 172 aa, Heterodera glycines
  Coding regions on vcDNA: vcDNA=SeqID_56336; Strand=-; Position=1 -101,396-492,755-946,1314-1442
  Homolog annotation: Hit_ID=NP_056155.1; Match level="QueryCoverage =73%, HitCoverage=17%, E-value=1e-28, Identity=39%"; Hit description =leucyl-tRNA synthetase 2, mitochondrial precursor [Homo sapiens] gb|AAH25989.1| Leucyl-tRNA synthetase 2,
MSWVWKSRIWMSWVLDIWMDELGTGYMDELGMEDDTFFDSSWYYLRYLDPHNSNAPFDPDIVSKHMPVDIYIGGMEHAKVHLFYARFIYHFLHELGMVPSREPFAHFIQLGVVRAPTYKLPDGRYVPDSEDPMGVIDSYGLDETRMQLLIEARPNYQIDWPYPYPTFRMLAS

SEQ ID NO: 129914 - protein, 146 aa, Heterodera glycines
  Coding regions on vcDNA: vcDNA=SeqID_56337; Strand=-; Position=1 -48,825-935,1190-1346,1954-2078
  Homolog annotation: Hit_ID=NP_492096.1; Match level="QueryCoverage =54%, HitCoverage=9%, E-value=6e-10, Identity=39%"; Hit description =leucyl tRNA Synthetase (lrs-2) [Caenorhabditis elegans] pir||T27887 hypothetical protein ZK524.3 - Caenorh
MRIQLSKTGVNFDWNRRLLDGLSSLEAEWGGVVGTQADWIGTCDVHRFLLQTEHSSGHGVEQQQFDLRLTDPTQLGTAQFVVITTEHSLAEEAAKHGKLSHNEPFTISEPKGVFVCPPDVAARRKHACPRQIYAKIGDFTTKGKSF

SEQ ID NO: 129915 - protein, 66 aa, Heterodera glycines
  Coding regions on vcDNA: vcDNA=SeqID_56338; Strand=-; Position=1 -33,114-168,357-469
  Homolog annotation: Hit_ID=NP_500272.2; Match level="QueryCoverage =100%, HitCoverage=43%, E-value=1e-27, Identity=90%"; Hit description= ubiquitin conjugating enzyme (16.9 kD) (ubc-13) [Caenorhabditis elegans] gb|AAK93865.2| Ubiquitin conjug
MAAPKVRFMTKIYHPNIDKLGRICLDILKDKWSPALQIRTVLLSIQALLSAPNPDDPLATFVLNEF

SEQ ID NO: 129916 - protein, 129 aa, Heterodera glycines
  Coding regions on vcDNA: vcDNA=SeqID_56339; Strand=-; Position=1 -94,365-437,494-554,611-700,1696-1767
  Homolog annotation: Hit_ID=NP_500273.2; Match level="QueryCoverage =78%, HitCoverage=58%, E-value=2e-15, Identity=41%"; Hit description =arginine-rich mutated in early stage tumors like (19.0 kD) (4D692) [Caenorhabditis elegans] gb|AAK93864.2
MALIMKPTFLMLISTCIIALVYASAEYDECEVCTDLFTEVMKKVDESGEKGEPAVKKMIIEHCKSVKGVDDKKEKLCFFIGAHPDSSTSVLGDIAKPLSFHKPPNKGCTEKVDYITRINELKPKPKGEL

SEQ ID NO: 129917 - protein, 162 aa, Heterodera glycines
  Coding regions on vcDNA: vcDNA=SeqID_56340; Strand=-; Position=1 -80,159-250,323-377,423-445,608-668,755-896
  Homolog annotation: Hit_ID=NP_500130.1; Match level="QueryCoverage =100%, HitCoverage=26%, E-value=4e-60, Identity=68%"; Hit description= transmembrane protein TM9SF3 (66.6 kD) (4C515) [Caenorhabditis elegans] gb|AAK68454.1| Hypothetical prot
DKKWYLEPVVIALSAGFLPFGSIFIEMYFIFTSFWAYKIYYVYGFMLLVALILIVVTACVSCVSIVGTYFLLNAEDYRWRWTSFASGRWTSFASGASVAFYTYNYAFYYYFFKTKMYGLFQTSFYFAYMLLFALALGLLCGTVGYVSSASFVHKIYSRIKLD

SEQ ID NO: 129918 - protein, 69 aa, Heterodera glycines
  Coding regions on vcDNA: vcDNA=SeqID_56341; Strand=+; Position=1 -89,302-422
MVPRIGLVHGRGQTPKKWGTLIINEFRYLLYVKKHIKQYKEKESYAYVMQTFMCYRSFAYQCQPKGKSL

SEQ ID NO: 129919 - protein, 1327 aa, Heterodera glycines
  Coding regions on vcDNA: vcDNA=SeqID_56342; Strand=-; Position=1 -2159,2207-4028
  Homolog annotation: Hit_ID=S08405; Match level="QueryCoverage=72%, HitCoverage=83%, E-value=0.0, Identity=38%"; Hit description =hypothetical protein 2 - silkworm transposon mag
MAQQQQDNKIKSAKGPGAYSQEMSWDSWAERFDFFIKLRGITDPEMKKLLLFTEIGPIYDELRMMAQPDDIRDMDFAEITALMCERYGEAKSIAARRHELFTARQHSGQSIRDFSIQLRSLIAKTEWGKDSIDMCLSALFVNGIVDDSIRAELIKKGDKDLKFKDAVELAVVLEQSNVDAQAIGSDSLKSLKGNVAKISGRGGGYDRAKGTNNSKSADSKPCYRCGRSGHWANICPGKADKCTKCGRVGHWAIVCRTNGGNKNPARVESRLWKSSNRVKQIQLQCDEKPPVISSLERESAKTETVPPSFIQLKVHKGNAEFELDSGADVTIIGSQDWSHIGKPELKESQGLLAYGGIPIKGVLGMANVNVEYNGMQINTDIYVVKGNKRNLCGRDLIRGLRIDLNKAFGINAIQIGSTNNDQKEVDKILEKFQEVFRDELGRCTRQISLKFKPGVQPKRCKARPVPFALKAEVEKILDQWVQQGVLEPTNNSDWATPLVIVPKPNGKIRLCCDYKVTVNQWLDVHQYPLPRPDDLFSVLNGGQKFSKVDLKDAYLQLMLDDEAKKCLAVCTHKGLFQFTRLPFGVASAPAIFQQVMDEILQGIEGVAVYLDDILITAPTQAEHLCRITQVLERLKANGLRVKRDKCEFMRESIEYLGHRVDKNGVHASEEKLEAIRKMPPPQNLKELQSFLGMVNYYGKFVPAMATVSEPLNQLRRMEEKNFVITEVLVHYDPGQPLYLATDASDYGVGAVLFHKSQQNGKEGVIIAYASRTLNAAERNYSQIEKEGRGIIFGVEKFKQFLYGRKFVLQTDHEPLKKIFGPKSEIPVVAARRLHRWSLILMNFDFDIEYCPTKEFGNADGLSRLPCPEIAKIDLDSAEVRAVQLENIDSLPVTAKSIASETAKDQILKKVKEFIEIGWPKKVESDQLKPFEPNKNSLELVNGCIMLGNRTVIPRKFHGKMLELLHATHSGIVRMKALARQKIWWPGIDKDIEMERKRCRNCQSDAPEERKVPLHPWETPDRVWQRLHMDFCGPFMGHMWLIIVDAKSKWPEVIKMKNITANATIEAIRIVFGTHGLPQQIVTDNGRQFASAEFENYCRSRGIEHTLTPPYHPKSNGLAERFVQTFKNGLRHMMGDSIGLDLAVSQFLLQYRVTPHASTEVSPAEMLFNRRLRTLLDLVQPNPQGNQPEMAKSKSGERMKRNYDKKAGKAKNFENGQPIFARNYHGGPKWIQGRILEKIGAAMFRVKTARGVWCRHFDQLKADLTSTADNRDQESESESEADAESDDEQQPQPIPIGSPRQEIRQKIAPEGGVPDQALRRSTRDRKKR

SEQ ID NO: 129920 - protein, 36 aa, Heterodera glycines
  Coding regions on vcDNA: vcDNA=SeqID_56343; Strand=+; Position=1-128
IARKDFRFPTFLGSEFRLPKFLMKSWKFFKFFFSKN

SEQ ID NO: 129921 - protein, 36 aa, Heterodera glycines
  Coding regions on vcDNA: vcDNA=SeqID_56344; Strand=+; Position=1 -57,335-388
MGVQMGYIINLTELVTFVVSDLINLLQMTFLISTQN

SEQ ID NO: 129922 - protein, 32 aa, Heterodera glycines; identical to SEQ ID NO: 125422
  Coding regions on vcDNA: vcDNA=SeqID_56345; Strand=+; Position=1-100

SEQ ID NO: 129923 - protein, 367 aa, Heterodera glycines
  Coding regions on vcDNA: vcDNA=SeqID_56346; Strand=-; Position=1 -11,71-346,397-829,884-1212,1264-1318
  Homolog annotation: Hit_ID=AAL78214.1; Match level="QueryCoverage =39%, HitCoverage=74%, E-value=6e-10, Identity=27%"; Hit description =putative esophageal gland cell protein Hgg-20 [Heterodera glycines]
MNRRWICGDVWMDILPSFDRPQLGLKMALISDRFDFLVDKHFDGKTELTIWRRIKIVKDEGPKAKLSVLIDDKCVAFPFPDHPLPNKIRFKDLQIYYVDHSVLAFLRSNKQIWDRSGIKLELFVPLYMTDVKLIWDVFTREIWPLFAKSIRHFGFHDGDYLDKLRRRISPTLLTDLDQLYSIDSGALFPDGIADDGPNGNAGQVLAKWLHTPTKNGQPKRLYRNNLLGPLNLEWVNNFKETFRRATTSVSYNIQLYFLVEPMPIESFELVNERTNEKLTLKQSKEYNLVNWLLQRCPIEETATAPVKWENRENSGANLNYIRFELRHDNNSGANLNNILFEVWGGNSCIGPLSLPAEEEEADESNEN

SEQ ID NO: 129924 - protein, 34 aa, Heterodera glycines
  Coding regions on vcDNA: vcDNA=SeqID_56347; Strand=-; Position=1 -40,125-189
MEKSCKLWRDYIDYFLFISLFDSESIREPYLSFN

SEQ ID NO: 129925 - protein, 20 aa, Heterodera glycines
  Coding regions on vcDNA: vcDNA=SeqID_56348; Strand=+; Position=1 -23,547-586
MHIMIFSRCSANMRNCIYFY

SEQ ID NO: 129926 - protein, 41 aa, Heterodera glycines
  Coding regions on vcDNA: vcDNA=SeqID_56349; Strand=-; Position=1 -8,191-308
MVGKHNKETKRLKTNNSKLLYFFNKPCQRHAELRTNKWRLA

SEQ ID NO: 129927 - protein, 217 aa, Heterodera glycines
  Coding regions on vcDNA: vcDNA=SeqID_56350; Strand=+; Position=1 -48,523-636,733-816,888-1034,1367-1536,1952-2042
MFNGEQQNDGNDNGRVRGSTSAAAVVQQVPQGSNATSAAAAVMPMSFLDNNNINLPVAFSSGSDGSGGGGGALTVAGHMPWGLSTTGGGSGEGGSVQHLQNLVYMAGVPQSAGQAQAVTMTTAAAATWTANALPPHIRDAIERVHARQMQKMITVQPDFADILPPCADNGMSSLGWLMLDWQADMVMGCEFDEQQQHADHCGGGGTAAASCGQQHHS

SEQ ID NO: 129928 - protein, 395 aa, Heterodera glycines
  Coding regions on vcDNA: vcDNA=SeqID_56351; Strand=+; Position=1 -225,320-468,779-1594
ANLMSSSNTPIIVEAAEQQQHRAGGSTTASARPSSATGTTAIASSSHHSNMSITAAQQNTRGGGGSQDVRVAKNGNGNATDVHEQQSEDDGPNATAANLNSVGAQRVVDAEPEHDDDEEGTSETAWLSTARPPPPSCTPVGRPFCHRRRRRRLLHSISPPAGPSHGRRSSPPPQRACSISAQRNLHTVVQRINDLEAQVARDERNARERRQRARRQQLLLQQHQHMPLSSSSSPSPSPHHVANAAEADVITIDDVEPLGLAQQQQLHRGDARYFAHELMTLEDEAGAAEMIILDNEPLSVADREWLISTAFKMRQLPSSVKGSVEVDENGNSNISCCICRDWIVSDADSVVRLACQHFLHRKCFAQEAMRRSICPLCRRHFVTGETMPTNEDGGN

SEQ ID NO: 129929 - protein, 459 aa, Heterodera glycines
  misc_feature (185)..(185): Xaa can be any naturally occurring amino acid
  misc_feature (222)..(222): Xaa can be any naturally occurring amino acid
  misc_feature (261)..(261): Xaa can be any naturally occurring amino acid
  Coding regions on vcDNA: vcDNA=SeqID_56352; Strand=-; Position=1 -37,921-1073,1240-1860,3598-3822,4809-5009,5683-5803,6255-6283
  Homolog annotation: Hit_ID=AAK31375.1; Match level="QueryCoverage =99%, HitCoverage=36%, E-value=5e-43, Identity=30%"; Hit description =ppg3 [Leishmania major]
RCWVRAHSNSALPAHSGSSSASPCRSAPAGACRATPTCTRATHAEPPFAAAHPDAATPPATDGSVPGSPSQKKRSRRGFSPSNGSCCPTTPSSSAPMSTPLSSNNCSPMRAPASTVGAPPRHATLTARCSAQRLPSSSTPCAMHRSQITSAQTSTGTCFSNTAWSNAAGAASPSPMPPTSASSSXSSPPSAGHSSATLATFAAAAAAAAPPAPGHTPHPKRXTGPLCCRAAVAAADRVASAPSSSSPSDSLSSSSSSCSPXASSAMPSPAPVRSNDSAKSGPKSAATPSPPTSTLPSPSFVPLLRSNGHTALMRNNTVPLNRSTPPADCAASRSNSAAIAAAEMSHSRSATESGSLSRMIISAAPASSSSVINSCAKYRASPLWSCCCCASPSGSTSSMVMTSASAALAPSSSSSCSGSASTTRCAPTLFKLAAVAFGPSSSLCCSCTSGRGSCLCCFS

SEQ ID NO: 129930 - protein, 492 aa, Heterodera glycines
  Coding regions on vcDNA: vcDNA=SeqID_56353; Strand=+; Position=1 -141,1325-2659
  Homolog annotation: Hit_ID=EAA56207.1; Match level="QueryCoverage =35%, HitCoverage=19%, E-value=4e-09, Identity=30%"; Hit description =predicted protein [Magnaporthe grisea 70-15] ref|XP_363932.1| predicted protein [Magnaporthe grisea 70-15]
MAAELERLAAQSAGGVDLFSGTVLFRISAVWPLERNSGTKEGEGRVEAKQYCVECERPVHRRSHPLGCRAVCGLCLRYDALHFPCRRDADTPQGGLFCAQCRFVFPNADCFATHRQCVDPPPALGLLGGGGGGGGAVVDRRRGRPYRSMCEERRLCAQCNVVVWARSGAHHCRRHPQQQQQQHVRAIATASTAAPMVPPAAAATVATVAAVGQQQQQQQQQHHCQKCGGPHDASRTPHFVQPKQFARQCQWQQPNTNGIADDAQGEQDEDEEDNESDGEEEEGADATRGQRQQQRRDNKAVRFIFWDVECAQERVVQQQQQQQQMLQERVADEWPAEGGDDYDDDADVGGIGDGEAAPAAFDHAVLLKHVPVLVCAEVICERCIAHGVELEREPLRRAPRCQCGVPWRGANRRRWCSRIGEQLFDDSGVDIGADELGVVGQQLPLDGLNPRRLRFFCDGEPGTGRGAMEQFVDFMLHTGPKGVRTVMLAHNG

SEQ ID NO: 129931 - protein, 103 aa, Heterodera glycines
  Coding regions on vcDNA: vcDNA=SeqID_56354; Strand=+; Position=1-312
MVEVSTNWWEIEAKSGYWPRETPNVGFDNMRRANVGHLVTEFALIYAKSKSCHLSLRDMRRAKFGHLVTEKAKVWPQGYEKRNSWPFCHRKCKSLPLRPLGQK

SEQ ID NO: 129932 - protein, 61 aa, Heterodera glycines
  Coding regions on vcDNA: vcDNA=SeqID_56355; Strand=+; Position=1-185
TIWSTPSGGRAARTTNAISSAPRVTRNGGEEQDKQKKRIKRWDWVKFWWYCARSGSLSIAL

SEQ ID NO: 129933 - protein, 46 aa, Heterodera glycines
  Coding regions on vcDNA: vcDNA=SeqID_56356; Strand=+; Position=1-140
ILGKTGTGTWGPEKPGPGPRFFFGTGNRDQPGNFKNSKKILKNQKI

SEQ ID NO: 129934 - protein, 205 aa, Heterodera glycines
  Coding regions on vcDNA: vcDNA=SeqID_56357; Strand=+; Position=1-618
  Homolog annotation: Hit_ID=EAK82052.1; Match level="QueryCoverage =92%, HitCoverage=22%, E-value=6e-18, Identity=36%"; Hit description =hypothetical protein UM01093.1 [Ustilago maydis 521] ref|XP _398708.1| hypothetical protein UM01093.1 [Usti
MAAHHQHPHAVGAGGISAAGLLQQQLQQQQLQQQQQQQQQQQQLQNATNAVTAATQQHPMAAAFAAQAQLTAAAVAAAEASQQQQQHNASNNNSGNANNIGSGAMATVHTTLPTATIAGIPSANALQQQQQQHQQQVAAAAAAAAQHQQQQQQQLVVSSHQQQQQQQNNAVATQQQPPVQAVQPLQQQQTAIPSLAWPIFYVREN

SEQ ID NO: 129935 - protein, 50 aa, Heterodera glycines
  Coding regions on vcDNA: vcDNA=SeqID_56358; Strand=-; Position=1 -18,78-212
MGSMEIKVPKHTLGHRPFVAQCLWHFVAAEEVPTVAAVAVLADFVNCKYF

SEQ ID NO: 129936 - protein, 76 aa, Heterodera glycines
  Coding regions on vcDNA: vcDNA=SeqID_56359; Strand=+; Position=1 -20,211-421
MDSFLAFENLHDLAPEPHTKAIRSFHLFGVRLFECKGGLEHRVVEEYRDASEQFPSGNDARRRAFLALLRREPFYG

SEQ ID NO: 129937 - protein, 109 aa, Heterodera glycines
  misc_feature (105)..(105): Xaa can be any naturally occurring amino acid
  Coding regions on vcDNA: vcDNA=SeqID_56360; Strand=-; Position=1 -48,169-450
RHFGHFLCQFISVLEENERIAEHNFPLARQPMARRIGRQNGRKAQNTLARIPRLHRRHFQMSTATIGRKGTEIIHLGCRLQPIVVGKHTKHKVTFAVRVKSMTAXATVH

SEQ ID NO: 129938 - protein, 150 aa, Heterodera glycines
  Coding regions on vcDNA: vcDNA=SeqID_56361; Strand=-; Position=1-451
YIDHSVIAFLRSNHQIFDKRGTNLYLWLPSSPLNMDTQRILDIFVREIWPIFSENIRHLGFSRRDHLDHLLRQISPTILIDLNQLVSIHSFDLLPAAIGDGFDGPISTISAGQALSKWLHSPRKDGQPKRLCCDNYNAQTNTDWINNFKE

SEQ ID NO: 129939 - protein, 163 aa, Heterodera glycines
  Coding regions on vcDNA: vcDNA=SeqID_56362; Strand=+; Position=1 -210,374-655
MAIKASSISTVTSITSSSLLFGMFLFVKFGQFFRQIFATWAFTMVMIWTICVVSFHRQFSLIFRGMGYSEHFLRANAISSVSYEIHFSVHVPSMEMVPFELMNEWTNEKLTLAKAKENELDKSWIMKRCKFGKTAAVHWEDGKWDNNCNNVFFWLFSGTNCIG

SEQ ID NO: 129940 - protein, 28 aa, Heterodera glycines
  Coding regions on vcDNA: vcDNA=SeqID_56363; Strand=-; Position=1-87
VQEKNMDFHVNDSPNYYTNAFFNCSPNA

SEQ ID NO: 129941 - protein, 36 aa, Heterodera glycines
  Coding regions on vcDNA: vcDNA=SeqID_56364; Strand=-; Position=1-109
FVRFRPLTVQEKNMDFHVNDSPNYYTNAFFNWSPNA

SEQ ID NO: 129942 - protein, 108 aa, Heterodera glycines
  Coding regions on vcDNA: vcDNA=SeqID_56365; Strand=-; Position=1-327
MAVQRLTPTRKSSSVAKRPAFSSSKQPKGKAANPTKTSQTNELNRKMKAVSPTASGSGANHHCVATLARSSDSTTVIDKGSQQNCPNMSSATISKTPCQQHSSEKTLN

SEQ ID NO: 129943 - protein, 66 aa, Heterodera glycines
  Coding regions on vcDNA: vcDNA=SeqID_56366; Strand=-; Position=1 -144,553-609
MDKALCALISSDRIIYNLKEYIIWTQRELLQDKMFDDETSSGLMRSMRANRGTLGTKIKYLFYIIE

SEQ ID NO: 129944 - protein, 208 aa, Heterodera glycines
  Coding regions on vcDNA: vcDNA=SeqID_56367; Strand=-; Position=1 -192,343-777
MAFAEEQANGEAIVTLNFRSGRVCPYFHVCIYMLWTEMPINENAMNAEMPIEMNPLTRNGRSTWPVPYLQDAIPNDGLNKWIMFGNFFNLTIGPALETPDLFYHFRVFCDDDKLKSRMQKIDEEDKKVEKWTVSEEYDDYKFKSFTKGRTSTKVVFNSELRQKCDRYHIKVWATHKEWIRMDETAMTVGQVENEDLSNWEMRICPIGK

SEQ ID NO: 129945 - protein, 317 aa, Heterodera glycines
  Coding regions on vcDNA: vcDNA=SeqID_56368; Strand=+; Position=1-951
MGIVVALNGSLPNVRSVQLRMPNGQTVTRPISRLCPLETENQTPEPAPDATVSTPTDQSPRDAKNTEMSVNEMPPIPSLSGEPTISKHNGMLTRRKSRLFAIPPTTTMIIAIFVTHLWAQASPAQGIWPFDPDHPGPPPTSNCVGNHVNCTRKGVKISSNSAVQKVTICCSNACFDRLAASEISYELSSDLLVNEYVCSATFGLSSTRSCTAEIACPAVDECELIDCSICIDRPANWRCNPRLSLVLLLVIGSLISCLTGWIVCFCSSARVVLNRGYQIAAFLLSWPIRLAFFIAGRPWTREDRERVAERLELGVQR

SEQ ID NO: 129946 - protein, 97 aa, Heterodera glycines
  Coding regions on vcDNA: vcDNA=SeqID_56369; Strand=-; Position=1-292
  Homolog annotation: Hit_ID=A40437; Match level="QueryCoverage=73%, HitCoverage=12%, E-value=7e-09, Identity=44%"; Hit description =glutamic acid-rich protein, retinal - bovine gb|AAA30536.1| glutamic acid-rich protein
MTTPLPDLKVARLESLPIKPPMDDIDESDEEDEGEEEQGEELKSKNGTEKEVVEDQQKTEEQKEKTEEKGGEKGTDECAEERDGEQQDEAEKADNEM

SEQ ID NO: 129947 - protein, 69 aa, Heterodera glycines
  Coding regions on vcDNA: vcDNA=SeqID_56370; Strand=+; Position=1 -95,117-271
MDDIDESDEEDEGEEEQGEELKSKNGTEKEVVEDQQKTEEKGGEKGTDECAEERDGEQQDEAEKADNEM

SEQ ID NO: 129948 - protein, 224 aa, Heterodera glycines
  misc_feature (205)..(205): Xaa can be any naturally occurring amino acid
  misc_feature (213)..(213): Xaa can be any naturally occurring amino acid
  Coding regions on vcDNA: vcDNA=SeqID_56371; Strand=-; Position=1 -159,203-318,366-389,434-498,549-594,648-755
  Homolog annotation: Hit_ID=NP_509897.1; Match level="QueryCoverage =88%, HitCoverage=12%, E-value=1e-43, Identity=51%"; Hit description =guanylyl cyclase (gcy-9) [Caenorhabditis elegans] emb|CAA91488.1| Hypothetical protein ZK455.2 [Caenorhab
YVQQAPEVIREFLSTKHLPVGSQSADMYSLGMVLYQILFKMEPFYERNLPLNKLLNKIAMAGDNLLNKIAMAGDNDQIIRPTFPNQNQIAANEEAYNLQLLSAIEACWLEAIEACWLEIPEMRPNIKRMKAIVIPEMRPNIKRMKAIVNANLRSTGSGSLVDQMMKMMEDGSGSLVDQMMKMMEDYTAYTANLEQLVKVNKWRFXQLQKEVIXNFSFLKFFNKF

SEQ ID NO: 129949 - protein, 421 aa, Heterodera glycines
  Coding regions on vcDNA: vcDNA=SeqID_56372; Strand=-; Position=1 -73,331-498,545-619,670-755,806-947,992-1028,1071-1146,1207-1252,1303- 1418,1469-1588
  Homolog annotation: Hit_ID=NP_509897.1; Match level="QueryCoverage =95%, HitCoverage=26%, E-value=2e-72, Identity=42%"; Hit description =guanylyl cyclase (gcy-9) [Caenorhabditis elegans] emb|CAA91488.1| Hypothetical protein ZK455.2 [Caenorhab
QLVITAHGYDKKFIEDFELRLNKVSPPLLLQYAILAYMSLYDALFLYGLAVRDAYEETKNQSVFLDGLYIWKKMTARQFIGATGQVLMNNKAIRVPSYATGQVLMNNKAIRVPSYATYHTKNGTMKIVVELTARLGDKLTMKIVVELTARLGDKLKCAMSENDCSEHVAHETMSHYYSVAHETMSHYYSTGDGSMPLDMPKCGFDGNLCDYTLIYILFGVILFLGVTIPLGYFLTIPLGYFLHKKEKERILYEMTWRIPREKVRLLEQHKKEKERILYEMTWRIPREKVRLLEQRSKKSMSIRSRSQESHSYDKSMSIRSRSQESHSYDESIGSESIGSKANSRLLAKQALANGVKCAFKRYQQNRSISFNKNDLSRLKELKNDLSRLKELKIMENENLNKAIGRKGGGGGGKIERGIMKR

SEQ ID NO: 129950 - protein, 570 aa, Heterodera glycines
  misc_feature (66)..(66): Xaa can be any naturally occurring amino acid
  Coding regions on vcDNA: vcDNA=SeqID_56373; Strand=-; Position=1 -56,170-243,397-667,722-755,864-953,1062-1119,1171-1204,1286 -1460,1505-1620,1672-1724,1862-1950,2230-2397,2442-2516,2701 -2786,2835-2941
  Homolog annotation: Hit_ID=NP_509897.1; Match level="QueryCoverage =98%, HitCoverage=43%, E-value=1e-137, Identity=46%"; Hit description= guanylyl cyclase (gcy-9) [Caenorhabditis elegans] emb|CAA91488.1| Hypothetical protein ZK455.2 [Caenorha
LPLFGIVQQKLFNKTSHFNQHFLLPTPKLFLYLKFGHSPTRTVPSLTNRKCWKCEQRMNKQKKNKXTNCQKLQVLQRHEREGHSPARNSATVRPISTKISLINVFRLFTMESCNRFSGVEYAAYLHYMKNTSVYFGPGCNNETSVYFGPGCNNEMLIIGRLVSRWNVPIIAHLSGDDALSDRAVFDTLGSVALTSATEMARAILTFLQLYGWKQILTFLQLYGWKQVGLVVGLVRPSVHFERLSLHSLRNYLKDANIEINVEIELDPYMTPDEIIATGRLRHLRNRARIIMLEMGMDLHIMLEMGMDLHSAKSFMIAALRSHMKTPDYVYIIPWLAHLHDHYPWEASNIEKQLHDHYPWEASNIEKQETRSAFDDTIVITAHGYDKKFIEDFELRLNKVSPPLLLQYAILAYMSLYDALFLYGLAVRDAYEETKNQSVFLDGLYIWKKMTARQFIGATGQVLMNNKAIRVPSYAATGQVLMNNKAIRVPSYATYHTKNGTMKIVVELTARLGDKLKCAMSENDCSEHVAHETMSHVAHETMSHYYSTGDGSMPLDMPKCGFDGNLCDYTL

SEQ ID NO: 129951 - protein, 128 aa, Heterodera glycines
  Coding regions on vcDNA: vcDNA=SeqID_56374; Strand=+; Position=1-387
MFTCFQPYNCKKVNLNRWKIIDKTNASNSKHIARAISVAEVSATEPSVSNTLEEVKCEKGKTKWHGKEWHGGERMACKGMAREGMAPARSERASSPDKWAMIGTFQRETNRPMISISKGRKERRINLK

SEQ ID NO: 129952 - protein, 108 aa, Heterodera glycines
  Coding regions on vcDNA: vcDNA=SeqID_56375; Strand=+; Position=1 -55,101-372
MPTPGTTPETLPTRTTTTEPSTTSPKGTPAKDRKEGDQTRPTPALPIILPLINNNWWWKNTPAPPLRRERSERDGEKRRGNKEQKGGKERGKGRERGKGKTQKRSYKS

SEQ ID NO: 129953 - protein, 209 aa, Heterodera glycines
  Coding regions on vcDNA: vcDNA=SeqID_56376; Strand=+; Position=1 -152,617-824,870-1141
  Homolog annotation: Hit_ID=NP_492616.1; Match level="QueryCoverage =35%, HitCoverage=20%, E-value=4e-17, Identity=59%"; Hit description =enzyme hatching EHE1 family member (1K463) [Caenorhabditis elegans] emb|CAB05814.2| Hypothetical protein
FINQFEKVPDTDSTTYGVKYDYQSVMHYAKDAFATAAGKITMETLDKQFQDVIGRVKDASPGDYVKICNIYACQTCMGIPFTPGQSRPTEGQKVVTLGPPTMPTPGTTPETLPTRTTTTEPSTTSPKGTPAKDRKEGDQTRPTPALPIILPLINNNWWWKNTPAPPLRRERSERDGEKRRGNKEQKGGKERGKGRERGKGKTQKRSYKS

SEQ ID NO: 129954 - protein, 123 aa, Heterodera glycines
  Coding regions on vcDNA: vcDNA=SeqID_56377; Strand=+; Position=1 -54,502-597,682-805,1435-1532
MSRTCKTFCMPLVSLCLTFHKKWAQLRVSSVFDHFLLAHMSQFLIKYKNSAEKCLNAVLKLCKMLLKLPGIIRYNGIEEPLEHFVTDRELFFPRYAGNDCSNCGHCLPVARNDNRRLGEVGER

SEQ ID NO: 129955 - protein, 38 aa, Heterodera glycines
  Coding regions on vcDNA: vcDNA=SeqID_56378; Strand=-; Position=1-114
MISRLFDSVKNFKSYIDSKLARTELARSGESGGEEERD

SEQ ID NO: 129956 - protein, 46 aa, Heterodera glycines
  Coding regions on vcDNA: vcDNA=SeqID_56379; Strand=+; Position=1 -31,160-267
MIGRAVRNRPFIFEGIFKFILYPRKMAISFFDKFYTSQKRLRMRRR

SEQ ID NO: 129957 - protein, 150 aa, Heterodera glycines
  Coding regions on vcDNA: vcDNA=SeqID_56380; Strand=-; Position=1 -86,136-502
AKPATGPNRQRKPTEKKEKEENGDKDRPKKERKIAEPPQRVPFRHPTQIALNLPSQLQPAIPATLKYGVHLHSARHSFSTSLKSVSVDSEPRVSDQLKIPSPETLNRQIPPLLHGIRLPMPAGASSSSSNAFQETLREEEEAAAALASLK

SEQ ID NO: 129958 - protein, 191 aa, Heterodera glycines
  Coding regions on vcDNA: vcDNA=SeqID_56381; Strand=+; Position=1 -102,225-284,333-406,456-531,624-689,761-850
  Homolog annotation: Hit_ID=NP_502166.1; Match level="QueryCoverage =99%, HitCoverage=99%, E-value=9e-34, Identity=45%"; Hit description =multiprotein Bridging Factor, transcriptional coactivator (17.1 kD) (mbf-1) [Caenorhabditis elegans] emb|
MSKMGRMESDTDPNTVTILRKHQAPQRVLKSDAAVNAAKKRGDDVETTKKYFAGVNRQHKTDKNTAVVNRQHKTDKNTAVLDAETEQLHHERVSLKLGTVIQQAVSLKLGTVIQQARQAKEWTQKANFHRANEKVEVIREYENGKAVPNQSILTKMERCLGILTKMERCLGVKLRGKELGQPLAPASTAKP

SEQ ID NO: 129959 - protein, 155 aa, Heterodera glycines
  Coding regions on vcDNA: vcDNA=SeqID_56382; Strand=+; Position=1 -54,100-160,363-413,454-526,673-1114
  Homolog annotation: Hit_ID=CAA92962.1; Match level="QueryCoverage =72%, HitCoverage=14%, E-value=1e-21, Identity=49%"; Hit description =Hypothetical protein F56H11.1c [Caenorhabditis elegans] emb|CAA92483.1| Hypothetical protein F56H11.1c [Ca
QLNISLHRTSVTLFSMKGPNDANSSMQFELRLVSGRTEFPSVFLATRANFLLQKGENRNSAIISLRDPLDGPQEVHLELVLRLSVRGIFAGKYMANLTVFVSQQKAQPHHPPQLQQKNSAKRHRRRRRTHRNREERGASGHRNGIRTVTEKIGGW

SEQ ID NO: 129960 - protein, 206 aa, Heterodera glycines
  misc_feature (75)..(75): Xaa can be any naturally occurring amino acid
  Coding regions on vcDNA: vcDNA=SeqID_56383; Strand=-; Position=1 -259,929-1088,1645-1806,2198-2239
  Homolog annotation: Hit_ID=XP_393539.1; Match level="QueryCoverage =83%, HitCoverage=76%, E-value=2e-32, Identity=42%"; Hit description =similar to serpin 4 [Apis mellifera]
YELASLLPLKKCFFIKSYLMQIIQMFGHCLSFSLVLINALYFKGTWADKFNATLTKKAQFHMDAKNFKEVADNYXDNFKIKMPIKNVQLQLLGMPYKGEKEFMFVLLPTERFGLAKLLAQLDGKKLVELIKMRDKHTVTVDLPKFTLEVTHELNKPLTNMGMATAFTNNANFEGISDKNLYIGQVVQKAFIEVNEEGTTARAVTGI

SEQ ID NO: 129961 - protein, 82 aa, Heterodera glycines
  misc_feature (27)..(27): Xaa can be any naturally occurring amino acid
  Coding regions on vcDNA: vcDNA=SeqID_56384; Strand=-; Position=1-257
NIRVPKIACDLSLEKNGLSKNRNYAQXASQTILALPIPSTIAFIHPIMNAKIIRVPKIACDLSLAKNGVSKNRNYDQKASQT

SEQ ID NO: 129962 - protein, 128 aa, Heterodera glycines
  Coding regions on vcDNA: vcDNA=SeqID_56385; Strand=-; Position=1 -289,381-478
  Homolog annotation: Hit_ID=NP_035604.1; Match level="QueryCoverage =53%, HitCoverage=88%, E-value=4e-20, Identity=62%"; Hit description =small proline-rich protein 2H [Mus musculus] gb|AAN86829.1| SPRR2H [Mus musculus] sp|O70559|SP2H_MOUSE Sm
MFVRSSAILLIVAVALVPLSDAILFGGGGNNCCCCCSPPPCPPPCPVQPCCCAPPCPPPCPCPPPCPPPCPPPCPPPCPPPCPPPCPPPCPRPCCCGGCGGGGCGGGPIIVNCAGGCGGGCGGFGFGK

SEQ ID NO: 129963 - protein, 337 aa, Heterodera glycines
  Coding regions on vcDNA: vcDNA=SeqID_56386; Strand=+; Position=1 -259,311-670,728-1013,1060-1166
  Homolog annotation: Hit_ID=NP_498047.1; Match level="QueryCoverage =100%, HitCoverage=28%, E-value=1e-173, Identity=89%"; Hit description=RNA polymerase II subunit (3G33) [Caenorhabditis elegans] gb|AAA21158.1| Hypothetical protein C26E6.4 [
VLNRLTYTATLSHLRRCNSPIGREGKLAKPRQLHNTQWGMICPAETPEGQAVGLVKNLALMAYISVGSLPEPILEFLEEWSMENLEEVAPMSIADSTKIFVNGAWVGIHRNPDQLMTTLLKLRRQMDIIVSEVSMVRDIRDREIRISTDAGRVCRPLLIVNDRKLVLKKHHIEQLKERDVMDEQQQFTWSDLVAGGVVELIDAMEEETIMVAMTPEDLKTGGYCESYTHCEIHPAMILGVCASIIPFPDHNQSPRNTYQSAMGKQAMGVYTTNFHVRMDTLAHVLYYPQKPLVTTRSMEYLRFNELPAGINAIVAILSYGGYNQEDSVIMNQAGIDR

SEQ ID NO: 129964 - protein, 83 aa, Heterodera glycines
  Coding regions on vcDNA: vcDNA=SeqID_56387; Strand=+; Position=1 -150,218-233,284-366
  Homolog annotation: Hit_ID=EAL33927.1; Match level="QueryCoverage =98%, HitCoverage=9%, E-value=3e-25, Identity=66%"; Hit description =GA15406-PA [Drosophila pseudoobscura]
AERNIIMQVTCNATQSTDRNVRVVALQCLVRIMSLYYRHMEPYMGRALFQAMKDAEDDVALQGIEFWSNVCDEELNLAAEVEE

SEQ ID NO: 129965 - protein, 65 aa, Heterodera glycines
  Coding regions on vcDNA: vcDNA=SeqID_56388; Strand=+; Position=1 -21,78-253
QTWYQQLPSLVWPYQTILRYLKRKQKKFLTKKWLSLFLIFLPQTWYQQLPSLVWPYQTSFFSFFY

SEQ ID NO: 129966 - protein, 360 aa, Heterodera glycines
  Coding regions on vcDNA: vcDNA=SeqID_56389; Strand=-; Position=1 -42,92-223,265-357,424-562,632-672,720-782,831-957,1061-1156,1204-1256
  Homolog annotation: Hit_ID=NP_498332.2; Match level="QueryCoverage =94%, HitCoverage=37%, E-value=6e-58, Identity=40%"; Hit description =ABC transporter family member (3H232) [Caenorhabditis elegans] gb|AAF60553.2| Hypothetical protein Y42G9A
REPMLLRVRLFQTLLVGLLLGSLVGLLLGSIYNTAVTQSTVMNINGLMFQAVANMNFMFQFAAVHVFCDELPIFVFCDELPIFMREHSSNLYRVDTYFLAKNLAELVQYVVYPVIFSSIVYLVQYVVYPVIFSSIVYWMALLVASFDSSLLFTLSCVSITNVAVSLAYASACIYASACIFGANDVSTAVMPIFVIPLLAFGGFYTAVMPIFVIPLLAFGGFYISQDSLPSYFYPLKYLSYFGYAYEISQDSLPSYFYPLKYLSYFGYAYETAAINQWTRVHQISGAFFRIFYCCRCCRNGTDVLEGMSFSENNLWRDYGIMAAMIIVLRLVAFFALWLRSLIKLRLVAFFALWLRSLIKK

SEQ ID NO: 129967 - protein, 107 aa, Heterodera glycines
  Coding regions on vcDNA: vcDNA=SeqID_56390; Strand=-; Position=1 -172,242-393
  Homolog annotation: Hit_ID=G89567; Match level="QueryCoverage=86%, HitCoverage=38%, E-value=3e-11, Identity=40%"; Hit description =protein T08A9.2 [imported] - Caenorhabditis elegans
MPTKQMLLCSILLTIHFASQFLVFGLENSARSVAVRGSMFCNGNPYEGLTVRLYDRESLEHDDMMTEGTTDQSGNFELIGHEEEAEAMAEMDPRLIIFHVNLETQLP

SEQ ID NO: 129968 - protein, 152 aa, Heterodera glycines
  Coding regions on vcDNA: vcDNA=SeqID_56391; Strand=-; Position=1 -111,171-515
MDISKWGIRMFVHRGNLSSVSVLDLPEFIVALHLVYRSLQNEPVPDRLSPALVPPSKLGIVRRMSTRSVDPSPHHSHPPREYRVMPSITSLCFISAHLELSRLQRRFPEHPIRLSRQSPHSPPSPGESSGRLSTAKRGKSKATVTVRPECGR

SEQ ID NO: 129969 - protein, 504 aa, Heterodera glycines
  Coding regions on vcDNA: vcDNA=SeqID_56392; Strand=-; Position=1 -301,354-465,562-859,910-1040,1095-1261,1310-1398,1446-1497,1551-1716
  Homolog annotation: Hit_ID=CAE56020.1; Match level="QueryCoverage =99%, HitCoverage=45%, E-value=8e-88, Identity=41%"; Hit description =Hypothetical protein CBG23578 [Caenorhabditis briggsae]
FIVLVVVPLMVIFLCITVKLGIPVIFVLLFHSFHFYNVSSVQFRRLTSKSRSSHLSFVEDAYSGSDSIRIFKAIKQFRAKGYRISDICNECFIVEIFSNRWLQIWLQIRLDIVADVSVFICVAVAIWMASQGVISLGVLALSFPIPFQFTGYLGEVARFWRESEVQMVCVERVNEYINNKWEADWRAPASERLAEWPSRGQIQFRDLCLRYREDSALVLNRLNFEIASSERVGIVGRTGAGKSSITMALFRIVEPASGQKSSITMALFRIVEPASGQIFIDGTDITTVGLHDLRSALTIIPQDPVLFCGSLRSNIDPFDDPVLFCGSLRSNIDPFDQYSDSDLWAALEKAQLKDTISGLEGTLLYKLTEKGSNLSEGQRQEGQRQLVCLARALLRQRTRILILDEATAAVDTYTDSCIQQCIRTHFNDTYTDSCIQQCIRTHFNHCTVLHCTVLTIAHRLDTILDYDRVIVMDEGAVAEFDTPTALLADGESMFAKMAKQAGVV

SEQ ID NO: 129970 - protein, 678 aa, Heterodera glycines
  misc_feature (74)..(74): Xaa can be any naturally occurring amino acid
  misc_feature (557)..(557): Xaa can be any naturally occurring amino acid
  misc_feature (561)..(561): Xaa can be any naturally occurring amino acid
  misc_feature (599)..(599): Xaa can be any naturally occurring amino acid
  Coding regions on vcDNA: vcDNA=SeqID_56393; Strand=-; Position=1 -110,600-684,787-950,1007-1204,1382-1607,1792-1976,2062-2268,2368 -2517,2567-2651,2704-2791,3932-4158,4235-4436
  Homolog annotation: Hit_ID=XP_414899.1; Match level="QueryCoverage =96%, HitCoverage=67%, E-value=1e-108, Identity=33%"; Hit description= PREDICTED: similar to ATP-binding cassette protein C1 variant A [Gallus gallus]
ICSILLSVLVSFVFTQTPYFSGKSITIGLHYNKNIILSSSARQSFSTGEVVNFLSTDLVFLSKFQVHLKLSLSXPIGFASFGLWMELGMSSVFGFAVLAMTLPINAVLTKLMTHFEVAQMKIKDDRVKFVTDVLQMKIKDDRVKFVTDVLGGIKVVKLYAWEESMQKRIFELRHREVKNLWMIFLLDVFINLSFMLAPLIATLVSFSAFTIIYHQTMRPDVAFVSLLFFAMLRYAIYQIPQTISYSAQAFVSIRRVLKFLNADEQQQSHIIQAANEFCVHSVILRHCSFTWEKTPILHLRDISLEIEAGKLVGIVGKVGSGKSSLLSAILGQFEEGEEGSKCMVRASSIGYVPQKPWIQNKTLRRNVLFDGPFNEDKYWRVLDACALKADLKLLAAGDMTEIGEKGGINLSGGQKARVALARAVYMDADLYVLDDTLSAVDAHVGAHIFERVISNQGLLAGKTRLFALNSLGLLAGKTRLFALNSLSFLKFCDLIVVMNDGQIDSVGTGQIDSVGTLDELKQQEGPFAELMKEHMDPEESIRNLGIYGAFSSVYGEXFVSXKLYSQSVAEKETVVSPKTYFFLRYLTLFNCKKLDDSNXKKENVSYGFMWLSFLYGFFLVQMFLAFFSTFSVGAYRASLAFHDKLLHSLFRSPMAFFDRTPLGPILNRIGNDIDRIDE

SEQ ID NO: 129971 - protein, 118 aa, Heterodera glycines
  Coding regions on vcDNA: vcDNA=SeqID_56394; Strand=+; Position=1-357
MDSDNETQMKFGKKNQIRGQEIDDFAGGKRLTSGGGQFEQLKKSGNVKKRKIEEKNLVKNCTRNDGTQTEQSNERIEVATREHHFASKIHKKEHTKSGHGQPQREAEVNECDDHSAKH

SEQ ID NO: 129972 - protein, 66 aa, Heterodera glycines
  Coding regions on vcDNA: vcDNA=SeqID_56395; Strand=+; Position=1-201
MVKESTKEGRDLWKRKRGAEEEKGMAREQGDEAEEPGDVQGAGADEASPDALSISKSRTELNGETE

SEQ ID NO: 129973 - protein, 41 aa, Heterodera glycines
  Coding regions on vcDNA: vcDNA=SeqID_56396; Strand=+; Position=1 -69,617-673
MHKWCTDISPTRHHDSRRNDRFWIPILFSLVGDEASYGRSK

SEQ ID NO: 129974 - protein, 204 aa, Heterodera glycines
  Coding regions on vcDNA: vcDNA=SeqID_56397; Strand=-; Position=1 -99,162-294,354-665,997-1065
  Homolog annotation: Hit_ID=CAE67217.1; Match level="QueryCoverage =100%, HitCoverage=35%, E-value=8e-58, Identity=53%"; Hit description= Hypothetical protein CBG12654 [Caenorhabditis briggsae]
MEVRKKKLIENSEVIDAAEQAINGNGRLHLLGLISDGGAHSHIGHLFGLLDSFKQLKVPKVFVHFFADGRDASPTSGAVFLQQLLDFLIAEDYGELATIVGRYYAMDRDKRWDRIKALIFEKISFFGFSFFLKVAYEALVGGVGEQCEPANAVQLVNGRYAIQQTDEFLMPIVFSDEARVKDNDTLVFFNYRADRMRQITKCMG

SEQ ID NO: 129975 - protein, 86 aa, Heterodera glycines
  Coding regions on vcDNA: vcDNA=SeqID_56398; Strand=-; Position=1 -177,381-464
MFNCLINLLSNLIATHLSPNGAYGLVFGINSFVALLLQSVVTLLIVDVNGAFALSLEAQFVTYSICMLVSSFTFPPLQLLVKCGKK

SEQ ID NO: 129976 - protein, 19 aa, Heterodera glycines
  Coding regions on vcDNA: vcDNA=SeqID_56399; Strand=-; Position=1-3,94- 150
MNFKLIGEKRMVRSRFNEK

SEQ ID NO: 129977 - protein, 67 aa, Heterodera glycines
  Coding regions on vcDNA: vcDNA=SeqID_56400; Strand=-; Position=1-205
SPLLAATRVLNVAFSDDLCEGAYYEDSRVTALKCADDPEFVWSVGTSVRDMIVDSNANSFNKSESTE

SEQ ID NO: 129978 - protein, 30 aa, Heterodera glycines
  Coding regions on vcDNA: vcDNA=SeqID_56401; Strand=+; Position=1-214
ARGNINGIFVFSDPENPKNPKLDSFCFYKF

SEQ ID NO: 129979 - protein, 109 aa, Heterodera glycines
  Coding regions on vcDNA: vcDNA=SeqID_56402; Strand=-; Position=1 -233,765-858
  Homolog annotation: Hit_ID=AAH78516.1; Match level="QueryCoverage =95%, HitCoverage=92%, E-value=1e-25, Identity=50%"; Hit description =MGC85327 protein [Xenopus laevis]
FFSSKVVYVSVPSAEIGKRIAHELVRSRLAACVNIVPQITSVYEWKGKVEEDSESLLIIKTGRERLEQLREAVIKLHPYEVPEFVAFPIEYGSEPYLRWISDQISDKEG

SEQ ID NO: 129980 - protein, 209 aa, Heterodera glycines
  Coding regions on vcDNA: vcDNA=SeqID_56403; Strand=-; Position=1 -121,172-471,590-798
KDGTERTVADTVAPNVNKMLVPKRKVTADALLDSLRAEDGAKKHKQNAKVCLPPPSVPSSLSSSSVTLSSALWDHENDENAIVVIDNNTSTTAQSQDASINSSSHLIGCSNTTMNSSTMLVPLSDSMLLDASPLNNPFKKKRHYGHPLQSPVKNWESLPLLNQLLVTWVVLLQIEASWSSHVTICRDLSTSSTRSNRLRRCLRPQPHEK

SEQ ID NO: 129981 - protein, 491 aa, Heterodera glycines
  Coding regions on vcDNA: vcDNA=SeqID_56404; Strand=-; Position=1 -352,483-829,1406-1871,2211-2357,2410-2571
MGKWPILPLEVLGREKQHSATNIISICSEILPRVQMANCFANGNFLSHPPAFLMAYGTRLLVNAPHSAAASDEKLVEGNVKGMRKESERAAEGTASLGRAFVPGIGSEVSDCFYSSMVPAAHFDVSARALCCSIVRFLPLAPSSSSNPFFSSHRRLRLLLNTFPFIFLPHGTLIKKSESNEIRFCCVCVQFDDGEGTTESQLAEAVLVTLPQEGQQTTTPFGHFCERLALQIEGQAMLNFEMSFHFVQNDEEMNWHLPNESHSEANEKDEAMTQYHQKCVQMVDFPWVFHPSSFIPFLAFRSAQLSVLSSLSHSIRTFLRCRCLPSVVGAKGQSAGEEAVVPLALLLKGPCGSGKSTLLAKLMSKLRTTDEDNAFVPVAADIVDCSDAEIFGRLFGEFRRRKVPIVCAISGGIKMSEEISAWEGPPLKWETHRIGPIDKCTQKEVLNKLSMHGDIMRTDLRIESANFGTIGELCRLVERLELRIGTNRTPA

SEQ ID NO: 129982 - protein, 249 aa, Heterodera glycines
  Coding regions on vcDNA: vcDNA=SeqID_56405; Strand=-; Position=1 -110,156-290,335-399,443-482,521-667
  Homolog annotation: Hit_ID=NP_510386.2; Match level="QueryCoverage =95%, HitCoverage=15%, E-value=1e-22, Identity=29%"; Hit description =PeRoXisome assembly factor PRX-1, peroxin (112.1 kD) (prx-1) [Caenorhabditis elegans] emb|CAA94120.2| Hyp
KRNEFGEGELSIRFDQIAGLESVKSKLTEIFIWPARYPSLFGLSGVRVGHRAILHGPSPARYPSLFGLSGVRVGHRAILHGPSGCGKSMLIRALAGSMGATVFSVRGPQLLSKYVGKSEQNIRQLFAKSVRGPQLLSKYVGKSEQNIRQLFAKAKASKPAKASKPALIIFDEIDAIAPQRGSDNSHVTDRMVNALIIFDEIDAIAPQRGSDNSHVTDRMVNQMLTELDGFEGNTEGMDSKSRKTFVTWH

SEQ ID NO: 129983 - protein, 197 aa, Heterodera glycines
  Coding regions on vcDNA: vcDNA=SeqID_56406; Strand=+; Position=1 -165,209-345,386-479,622-819
  Homolog annotation: Hit_ID=NP_502869.1; Match level="QueryCoverage =89%, HitCoverage=42%, E-value=5e-14, Identity=25%"; Hit description =ariadne family member (55.4 kD) (4Q290) [Caenorhabditis elegans] emb|CAB70234.1| Hypothetical protein Y73
MSNSNDSDDLIIYDDNEDIKDVSSDSGDEVAMEEVTNAGTSTAGALSNEEIRDYQVLSQTELVDELNKLSSETSAVLRFNGSICKVLLHHFKWNKVTLIERFFEFPETSNTDSFFRNANLLDPTKHTKIEGKILGEGRPYVTCPELRCTIVADDEFVLKNVDNKQALRSYHKLVLNSFVEVDIFGSIQLQILFSVTP

SEQ ID NO: 129984 - protein, 253 aa, Heterodera glycines
  Coding regions on vcDNA: vcDNA=SeqID_56407; Strand=+; Position=1 -15,68-153,197-296,332-391,437-567,1439-1616,2279-2470
  Homolog annotation: Hit_ID=CAE72928.1; Match level="QueryCoverage =46%, HitCoverage=22%, E-value=1e-34, Identity=62%"; Hit description =Hypothetical protein CBG20248 [Caenorhabditis briggsae]
MEQMQVLGFSWIETQFLQKAVEILVECRRTLMYTYVFAFYLVQNNITKMFEDNQSDLELATEQVNFNLSEYLERELPNEKVAEVKQKVQDKYRYVEQRRQILLKHCVEGRERNEWEFCQATIENKTDFRGIQLNPIRVLYRWPMDKLYKHFLRPTFGNYWATIIRVYVPKFFWFFMTFEFFYYVWKYESKSWQKRIGFSTINRPDRYVLVKDHDEETLKLGLTDYSRSDYFDKEFYQRIKTANIDFGPPKRPW

SEQ ID NO: 129985 - protein, 29 aa, Heterodera glycines
  Coding regions on vcDNA: vcDNA=SeqID_56408; Strand=+; Position=1-87
MEKAQMEDRTHRKTENCNKNCTCGIPCGQ

SEQ ID NO: 129986 - protein, 149 aa, Heterodera glycines
  Coding regions on vcDNA: vcDNA=SeqID_56409; Strand=-; Position=1-449
AQHETSHKDSSIYVVTFFNSSDILHKNATFGDYITLNHTAVSIINDTYKVTYVCSNKSISLTPDMDKFGKYIAFMFKPIRYVLALINLFLLAIIILITLLGQIEGEFKWFILNISTLNIFFYLFTEGGRCVVEDLFPLLQNSRISWEVV

SEQ ID NO: 129987 - protein, 90 aa, Heterodera glycines
  Coding regions on vcDNA: vcDNA=SeqID_56410; Strand=-; Position=1 -87,288-471
  Homolog annotation: Hit_ID=AAC17116.1; Match level="QueryCoverage =73%, HitCoverage=19%, E-value=6e-18, Identity=66%"; Hit description =AP-4 [Homo sapiens]
MFTDSINNDLDDRRLRRQIANCNERRRMQSINAGFQALRQLLPRKDGDKMSKAAILAATAEFIQSLLREKDKLLEENCVVMAKKRRMDTE

SEQ ID NO: 129988 - protein, 24 aa, Heterodera glycines
  Coding regions on vcDNA: vcDNA=SeqID_56411; Strand=+; Position=1-73
MHCLCVASWDHVLVRVLTLLAQLG

SEQ ID NO: 129989 - protein, 114 aa, Heterodera glycines
  Coding regions on vcDNA: vcDNA=SeqID_56412; Strand=-; Position=1 -304,915-953
  Homolog annotation: Hit_ID=CAE75246.1; Match level="QueryCoverage =99%, HitCoverage=42%, E-value=2e-17, Identity=37%"; Hit description =Hypothetical protein CBG23203 [Caenorhabditis briggsae]
VYSSPPLLWSQELAALAKTWALKLADRGSVLYPELPGIGENIFLLTSKCNGTAADAISSPSAGMATNCPPIGDHLTTGIELVAHWAAEAQKMDFARPRWNNVAFYRPAGNSNLP

SEQ ID NO: 129990 - protein, 68 aa, Heterodera glycines
  Coding regions on vcDNA: vcDNA=SeqID_56413; Strand=-; Position=1-207
MKEEDRHWNLIVQDYNNNPQNRMRGRGMARKNIYVQQDQAIRAIFLDRHNRPFLAYLRAIAYRMPEPN

SEQ ID NO: 129991 - protein, 291 aa, Heterodera glycines
  Coding regions on vcDNA: vcDNA=SeqID_56414; Strand=+; Position=1-873
  Homolog annotation: Hit_ID=AAM51140.1; Match level="QueryCoverage =89%, HitCoverage=25%, E-value=2e-32, Identity=32%"; Hit description =SD27140p [Drosophila melanogaster]
MEASNANDNVRITIPRLNVQKGRRNNCSLEKHRKEIRQISKSAEFKAEDFALAERVLIRLDQMDDAEEFQHFKTVFEDDGILRLKTRLEMSEKPYSFSHPILFAKHSALAKLIILDRHQKRHHLGVDTTLTEFLSEFWMPSARLNVKRALRDCLLCRRMNAQQFALPTMPPLPGERVRRHAPFQSIGIDFLGPTTISLAGEKIKAWILIITCLATRAVYLEATLDLTSESFINVLRRFISRRGKPDIIWSDNATTFKLAQKTLELLSAPGPDQEVQNFLTHNRIQWRFIAQ

SEQ ID NO: 129992 - protein, 397 aa, Heterodera glycines
  Coding regions on vcDNA: vcDNA=SeqID_56415; Strand=-; Position=1-1194
  Homolog annotation: Hit_ID=XP_320889.1; Match level="QueryCoverage =85%, HitCoverage=40%, E-value=4e-55, Identity=35%"; Hit description =ENSANGP00000012033 [Anopheles gambiae] ref|XP_313651.1| ENSANGP00000013044 [Anopheles gambiae] ref|XP_314
MPFTPGHNSGGTRKAKHRNNPRGPTMQRNNPRVHQTPIMARQAADHQRIRAAHVESDHWRTDCRFKDATCHKCQGQGHIAKACRRSSNQAKNRRERSVHTVVVKSHCMGIGTAAGRWWRLTFIINGIKILMNIDTGAQATILTLKTWKKLGSPKLDKPDIETRNCNEVAFNVEGKFVCTVCQPNQAPKKLVAYVSSEINYDLFGLPWIEALDVIPHEIMYPDIRPKAQPAPAEINAMAIPQPTHKISDLESLTKALQTDFSEVFGPGLGHCTKAKAHLILKSDAHPTFCKARTVPHGALNAVNEELDRLLQIGAIKPIEFSHWAAPILVVMKKNGKTRVCIDFSTGLNNSLKLNTHPLPRPDDIYTAISGSVYFSNLDLRDAYLQMELDEESKHLCE

SEQ ID NO: 129993 - protein, 101 aa, Heterodera glycines
  Coding regions on vcDNA: vcDNA=SeqID_56416; Strand=+; Position=1-305
  Homolog annotation: Hit_ID=XP_320889.1; Match level="QueryCoverage =100%, HitCoverage=12%, E-value=2e-20, Identity=45%"; Hit description= ENSANGP00000012033 [Anopheles gambiae] ref|XP_313651.1| ENSANGP00000013044 [Anopheles gambiae] ref|XP_31
MDQIVTGIPGAFAYLDDGIIASKTLEEHICSLYKLFKRIQEFGLKIQLEKCKFLQPELLFLGHVISAKGIRPYPGRSEAIRQMPPPHDLSTLRSFLGALNY

SEQ ID NO: 129994 - protein, 135 aa, Heterodera glycines
  Coding regions on vcDNA: vcDNA=SeqID_56417; Strand=-; Position=1 -99,583-710,988-1168
MADYNIQKESTLHLCLKLFGGARTGKTAHYSRSCCHEHEEQTEFDKADSAEKNFEVLSASLYDIKECAVCREERKCTIVLNNARQGFEIVDTGNAATPPQQQRQRQPPPQQQQQQHHLLPCFLDKFVLLLLRLSK

SEQ ID NO: 129995 - protein, 23 aa, Heterodera glycines
  Coding regions on vcDNA: vcDNA=SeqID_56418; Strand=-; Position=1 -11,403-463
MTQLNSAIVIMTQLFTSNRDNHL

SEQ ID NO: 129996 - protein, 69 aa, Heterodera glycines
  Coding regions on vcDNA: vcDNA=SeqID_56419; Strand=-; Position=1-354
VPQTDTEKNRFFCIRAVPPNRCAQIYGETESFGNSFPIACTLILRWHFAPHNCLSTPTGHLKKSIFLFS

SEQ ID NO: 129997 - protein, 61 aa, Heterodera glycines
  Coding regions on vcDNA: vcDNA=SeqID_56420; Strand=-; Position=1-187
RNWHVRNERRRKQRKEKQQKSKRKTATKALPRGGHPKWATDGRRGMALGTNKNVIGGIEGN

SEQ ID NO: 129998 - protein, 214 aa, Heterodera glycines
  Coding regions on vcDNA: vcDNA=SeqID_56421; Strand=+; Position=1 -183,798-908,958-1059,1109-1113,1160-1402
  Homolog annotation: Hit_ID=XP_392584.1; Match level="QueryCoverage =75%, HitCoverage=44%, E-value=7e-34, Identity=49%"; Hit description =similar to ENSANGP00000010432 [Apis mellifera]
MAGHLWAIYSMHISHCQHLISVTESFGRPQLFVLCSCPFSKVLKKSDALSSMFGVDLFFKQIFAYELAKEKNLKYVNGFDNPDVIAGQGTIGLEILDQVGDVDAIVVPVGGGGLIAGVALAVKTLKPEVLIIGIESEMCPSFKNAMEHSDEPLYPEASLADGRTKTTFIFNHLIKQTFTPIAFQGLAVPSVGHNAVFMADGLIDDLVTVCEESI

SEQ ID NO: 129999 - protein, 75 aa, Heterodera glycines
  Coding regions on vcDNA: vcDNA=SeqID_56422; Strand=+; Position=1-225
PGLKCPAHAKNFFYFREKIEIFPKKIPVDRARKTMFWKWSPFLWEKSLKNPKIQKPENRFLGLARKIFKIFEILK

SEQ ID NO: 130000 - protein, 94 aa, Heterodera glycines
  Coding regions on vcDNA: vcDNA=SeqID_56423; Strand=+; Position=1 -96,139-327
MNFNNLTTPIDEQTMIESLSLDEPSNELRSVEKMDEELNKKEEPFTLAECCTAFDLVAVMFDCKIPVPYEEEQKRYVYEHQDKPRFIYITEDGD

SEQ ID NO: 130001 - protein, 129 aa, Heterodera glycines
  Coding regions on vcDNA: vcDNA=SeqID_56424; Strand=+; Position=1 -79,139-449
MTVTSNSEFRLIECVPILEEVAREFGSYSSHRDYRVSGCMMIRTLTSLNRLYIFDAEDCIEVNGKYVSYFIAILGEGFLKARGRHEPKMVNEYYEKYDGLNGFAEFIRNWAFTFFCLHAFDDDDTSDED

SEQ ID NO: 130002 - protein, 101 aa, Heterodera glycines
  Coding regions on vcDNA: vcDNA=SeqID_56425; Strand=+; Position=1-314
TEEKVYWRLLNNIGEAHHYPVPRRRVHQNVFRGIILTHTVRSLVIERLRSIRMSPSASPYAINVTPSLGTASVNRMFTAVQPSLISSKPGESSCALVIWKT

SEQ ID NO: 130003 - protein, 163 aa, Heterodera glycines
  Coding regions on vcDNA: vcDNA=SeqID_56426; Strand=-; Position=1 -177,544-858
MTNAQEDSPGFELIKEGCTAVNIRFTEAVPNEGVTLIAYGEADGLILIDRNRSITSDLTDPAGMPGTHWCAIWAQSPAVAYFFDSYGEMPIRLIKKYLSDNFKNIYYNKTRFQSVLSNVCGHYVITFVYFMSIGLGFENVMQILNRSNNPDGFVYRFVTKSIQ

SEQ ID NO: 130004 - protein, 95 aa, Heterodera glycines; identical to SEQ ID NO: 128210
  Coding regions on vcDNA: vcDNA=SeqID_56427; Strand=+; Position=1 -425,591-993

SEQ ID NO: 130005 - protein, 80 aa, Heterodera glycines
  Coding regions on vcDNA: vcDNA=SeqID_56428; Strand=-; Position=1 -61,252-307,423-548
MQNNQKAMLRRIGELEKEIKEQRKVCQMEHKQLMTVSETLENKVDKHSDLVTVLEMKIIALEKQQKELQKSKKRGEEGII

SEQ ID NO: 130006 - protein, 42 aa, Heterodera glycines
  Coding regions on vcDNA: vcDNA=SeqID_56429; Strand=+; Position=1 -59,217-286
MTDEDAKRAEEEKEWPKPTRYVSYREGEFVFCGSFTSDIAFI

SEQ ID NO: 130007 - protein, 300 aa, Heterodera glycines
  misc_feature (39)..(39): Xaa can be any naturally occurring amino acid
  Coding regions on vcDNA: vcDNA=SeqID_56430; Strand=-; Position=1 -93,1794-2047,2102-2228,2279-2587,2657-2695
  Homolog annotation: Hit_ID=CAE57522.1; Match level="QueryCoverage =95%, HitCoverage=13%, E-value=6e-44, Identity=36%"; Hit description =Hypothetical protein CBG00497 [Caenorhabditis briggsae]
TSEHGIHMETAEIQSDVAPSEQTAGKGGGSDGNDRLTTXLLQDAKVYARIRELREAGLWSATRLPKCEDPPRRKLHWDYLLEEVRWIATDFTNERKAKKEWARKVVFIPKKSDEKDSTNEVKKKEQSTNEVKKKEQEEKEAKRICGTVAKKIREFWTNVDKVVEFRATEIVESRKRKALEIVESRKRKALGQQLNFLVGAADKITSLLHEHMADSASVSRRSHSEKSRAGDLSEGEGMLTDGEDDERTIDTEEAHQQKAHVEMEVNELSKEANLELDEFLTSMPSGYMPSGYLESLGYKI

SEQ ID NO: 130008 - protein, 225 aa, Heterodera glycines
  Coding regions on vcDNA: vcDNA=SeqID_56431; Strand=-; Position=1 -163,246-386,492-649,1416-1521,1568-1641,1762-1797
MTTVSEGEQSGSGDGGGRIFLIGLTDSCAVWKYVVELRDSWDEKVCMMVINKPEGGQLLDKYTECFAFCDKENQIGVLDFVDHPTIKDGYVFTLKAGEPLPHVDLLPLDGVGLPEWAQHNDCILLMLVRRMDHGDKQWKRQRMGIDTSTPPIKKKIELVHCINSVLVYAQNISDDVIRANEGECKAHIENLLCIRRQLARLYRLGRTSPIDTSQTVSDEEVNAED

SEQ ID NO: 130009 - protein, 301 aa, Heterodera glycines
  Coding regions on vcDNA: vcDNA=SeqID_56432; Strand=-; Position=1 -198,367-545,774-953,1018-1185,1323-1502
  Homolog annotation: Hit_ID=NP_509805.2; Match level="QueryCoverage =87%, HitCoverage=16%, E-value=7e-58, Identity=45%"; Hit description =phospholipase C, putative effector of Ras (212.9 kD) (plc-1) [Caenorhabditis elegans] emb|CAB60298.3| Hyp
RQSKCCWGSVFSEWSANRFVAVDGGRRTVEEPTSANDHRSDAASEEKQQQSRLLPKHKPSATVADGPPGPHSPLPYLLKPRSGFESATGTALSDAGDLDSLYTPRSRTPTTSSYGGRSVGGRSIKEFVELFRLFSTRMRKDLKDLFQDFVIAAHSSANSHVPPKRATSADCKSSCSPRVQSRLESQMSSYPSCAEFVPDDVLTRNSALHMCQLNDKQQKIYNALALASVCSSAPMDTSRNSMEYIDEQYAQKLIQEHEPDPTYRAKQIMSFEGFVRFLCDPINYAFVPEQTKPSEEQLHHP

SEQ ID NO: 130010 - protein, 20 aa, Heterodera glycines
  Coding regions on vcDNA: vcDNA=SeqID_56433; Strand=-; Position=1-60
MANFNGNADTFLCRDIGEFK

SEQ ID NO: 130011 - protein, 238 aa, Heterodera glycines
  Coding regions on vcDNA: vcDNA=SeqID_56434; Strand=+; Position=1 -57,107-172,257-305,577-705,863-993,1153-1376
  Homolog annotation: Hit_ID=NP_491494.2; Match level="QueryCoverage =93%, HitCoverage=29%, E-value=1e-47, Identity=45%"; Hit description =TPR repeat containing protein family member (75.6 kD) (1F558) [Caenorhabditis elegans] gb|AAO12420.1| Hyp
KMAFVPIKDGEFTSTIYAMIKENKFTECIRILQYELQIKENKFTECIRILQYELQRNPESRAALSLLSRAALSLLGYCYHHMQDFIMAAECYEKLSELFPQHTDYRLCHAQSLYNVSFPWPFFIIRSQINEPKMECKVVKLDAAIKYREEDVQNARILVEQFDSDDPDMEVNLACLDYKEGNFEGALRRFTEVDESPASQNQLTYAIALCHYQMHNFPQALQMVGRRKRKESEMHFNN

SEQ ID NO: 130012 - protein, 81 aa, Heterodera glycines
  Coding regions on vcDNA: vcDNA=SeqID_56435; Strand=-; Position=1 -26,70-130,179-337
MASSSTIKIFSLFLLVLCIGLAIEQSQAYWGGYAYAYPYGGWYGKRQAGFGPSASVGTFGNGHGGNANGGGGGGAPPPTNF

SEQ ID NO: 130013 - protein, 499 aa, Heterodera glycines
  Coding regions on vcDNA: vcDNA=SeqID_56436; Strand=+; Position=1 -635,677-725,774-934,1045-1066,1112-1303,1351-1471,1519-1838
  Homolog annotation: Hit_ID=NP_001004509.1; Match level="QueryCoverage= 96%, HitCoverage=34%, E-value=1e-55, Identity=29%"; Hit description =si:busm1-180o5.3 [Danio rerio] emb|CAD60788.1| novel protein similar to DNA polymerases [Danio rerio]
EPVPAEDAYGGEDEQGLDVEEIWECQIREQLKRDDEMRAFFDDLGTDRGPIDPRQTFYGGRTGPLQLIAEPKEDEKISVFDIVSLYPWVNYATDYPIGIPAVIHPTVEEMIVDWTRPEHLQYQGIYRVRVIPPKGLRIPVLPLKIDERLLFCCCHRCAAKFRKLNTRRVHKCPHTDEQRAFTGNFTHIELARALETGYRVDRFWRAWHYDEWSDGIFKDYVRLLIKLKVEASGFPDGANTVEQRQQFADEYRRIYSVNLDLENVRRNPGLRFISKLMLNSLCLIMDHKIEVSAVIPLSDTAVRVMYKSKKNFVSEHTSSNIVISLWTTNRARLKLLDFMTQIDRTEGAKLLYTDTDSVAVLHKRDIVPIQTGEYLGQMSEEYLDYEIKTFVCGGAKQYGFRMLNKRTGEVEYVQKIRGITFDVNNSKALQFDHFLQKVKNYGRNTGDDNDDAPAVFSYDKIMPTRDSRIITRELRKKYMPICQKGIINEQYEVYPFGYE

SEQ ID NO: 130014 - protein, 608 aa, Heterodera glycines
  Coding regions on vcDNA: vcDNA=SeqID_56437; Strand=-; Position=1 -989,1107-1419,1468-1992
MTVHFMNVFYVGLVLSYVPLLLHSELINVDLTVDNQNYLDRGKYLTFSKDATAQHFGYSWNTACRIEKCERNSEWAVSLQNVYTLHNYQSVFFEMKSLVKMSPLACFEYNGHSFTFFEDRESGETAIFRGRQQKIVERLIQHGRVVFDHLSGRLFLIDKHQRRISEIELEYLELWWLRTNQSSAHTILKSNFVAFLPPDKSDYTLVDNHVFVIRDQRIYKFHIDDYVKGNRALIFVANSSDVRFNYLIYKPKDQNINRGVFAHLRMSDAWMSISYLFNLFLIVLCTYILKQLRRKNRKNPLNGSGSTGYYSNPFIDDAYSSQHQQLLNIQLFSFAKTDTPYLPTYCMQRAIRYLIDSYGLSSVDDLYTCLKDEIKSGPEGGNCLYPNPLCAVDCVHIANADHPNQPVHIDGSLELIADVELYSTCYPKKKFEGIERTSVCGAEGLEDLPGRLAAVSVTPLRTIEQQQHEPDSGRAGSDQLLERRRTRKRDYNLVRVLCRFNNCGPYRLTKQLQKRRTENLAYLSQLDIETVHLRKNIKIIPDALCPIGANQVFAYRGFLGITVQQHLYTRHRVMLKYPTLPCVVQFGGGHHRDIFPIELLRVSKTETF

SEQ ID NO: 130015 - protein, 809 aa, Heterodera glycines
  Coding regions on vcDNA: vcDNA=SeqID_56438; Strand=-; Position=1 -2118,2395-2706
  Homolog annotation: Hit_ID=NP_502799.1; Match level="QueryCoverage =55%, HitCoverage=64%, E-value=1e-12, Identity=20%"; Hit description =putative nuclear protein, with 2 coiled coil-4 domains (4P607) [Caenorhabditis elegans] emb|CAB16521.1| H
MEAFYIVLPSNTPGPGNTASNFTVRLPHTLELDSKWSVALSAIIYPYSFPSISVDEDDSISVKLVNPNYREDAGNSDEESQKFINLSVKIPNVQFQSVQSLQKTLNQIIQNAYDTKFGGSSSLNDGTPNKRVKRQTELSESGAGVIEVENFFTRNPFDYWQQIGELRKKHYQLRERVEKMTKEYNSTADDERKTLLSTELGVFQGRETFLKEHLHLIEEEAKRRDGEQQEANEQRLIDRFFARYPDNYREQLDEWRSSYLRDVLDLQTKMGEYEGVKDLKRLEELNSQTERMRNSIHVFGRKMEILNNAALQRDQKKSQEDFERLSHEQNLTFVQEFFQANPVNYWQAIQKNYEALQLEYTKKRELREKLEFETDATERDSLQRQIESIQRLIDYRRKRFAALEYEAKKRDAQTGKANSGLSAVAEGSNRTSSTRTDSFSPDEPANPDEAINSKNNHQNTTTTATAILSSETPAEQNLADQDNSIADKNEPGTPPSSGLEQSGDAATSVTQAEDGGNLPQAAALSSNNPKFVAKQSTVATERRKEKIIEKLIDEQVDRMVDGTHAQQKMLQEEGKDNDSEHRISTYKLIEEVLHGEHGQLMVQQRESKMAAEFAYNEITQRFGIRMGPGVMHVDLSKQLSYVLGFDHKTRIYNNQSAKYPPDLSGGVRQLYVYAPKLVEDSIIGDRMAPLLRVVNVSGTPGLDMPERGGGLLQNISRFLMPVATNLLKSASKEGISAGTRMLDDLAQGKAFKESLKTQAKQGFENLAEKLNQCGKGGRQRHKAITHRKNNKTGKLRGKRQIIDQLTFAH

SEQ ID NO: 130016 - protein, 90 aa, Heterodera glycines
  Coding regions on vcDNA: vcDNA=SeqID_56439; Strand=-; Position=1 -112,299-459
EKSSKKSKKSSSSDLCHSPKKAKKEPQTPPSERTNASEDETTATPMEVTTTAPIKTEKAAVAMEEQGEEETLRERLLERVKLKQLKSEED

SEQ ID NO: 130017 - protein, 59 aa, Heterodera glycines
  Coding regions on vcDNA: vcDNA=SeqID_56440; Strand=-; Position=1-180
PPVTVVVPALVLADVVPVLAPPGRRPVRVAAVHGRAIANARGRVAVLARATKTAKRPAN

SEQ ID NO: 130018 - protein, 71 aa, Heterodera glycines
  Coding regions on vcDNA: vcDNA=SeqID_56441; Strand=+; Position=1 -158,1191-1248
MSCSWLVMCGGSWRWPGKAVMPLCNAVSSSGMTSLGKWQIVRQKGQAVVMAKRVPRDREFLPKPGPGLAGT

SEQ ID NO: 130019 - protein, 185 aa, Heterodera glycines
  Coding regions on vcDNA: vcDNA=SeqID_56442; Strand=-; Position=1 -90,142-249,291-390,527-672
  Homolog annotation: Hit_ID=CAE59173.1; Match level="QueryCoverage =95%, HitCoverage=94%, E-value=5e-26, Identity=37%"; Hit description =Hypothetical protein CBG02480 [Caenorhabditis briggsae]
SKSKYFELVSGFYKSYAAMQNFQRTAAKVKCRVVDVDEGRVCRVVDVDEGRVKVEMEVQEEHTNTFGTLHGGLTATLVDIVTTTALCATRRGSAGVSVLTATLVDIVTTTALCATRRGSAGVSVDLTVNYLAPAKIGDTILIDAFVNRRGQTMGFTGADIFRKSDGLKIATALHTKAFPREVSEA

SEQ ID NO: 130020 - protein, 28 aa, Heterodera glycines
  misc_feature (2)..(2): Xaa can be any naturally occurring amino acid
  Coding regions on vcDNA: vcDNA=SeqID_56443; Strand=-; Position=1-84
TXNLRCQTASLPHRVTFALKWQRKMRQK

SEQ ID NO: 130021 - protein, 43 aa, Heterodera glycines
  Coding regions on vcDNA: vcDNA=SeqID_56444; Strand=-; Position=1-130
SISICPSFSADGASSTKRQMSAYLSCIASASKLTERSTSKLTK

SEQ ID NO: 130022 - protein, 176 aa, Heterodera glycines
  misc_feature (17)..(17): Xaa can be any naturally occurring amino acid
  misc_feature (36)..(36): Xaa can be any naturally occurring amino acid
  misc_feature (173)..(173): Xaa can be any naturally occurring amino acid
  Coding regions on vcDNA: vcDNA=SeqID_56445; Strand=+; Position=1 -289,377-466,1180-1301
  Homolog annotation: Hit_ID=CAE57456.1; Match level="QueryCoverage =63%, HitCoverage=31%, E-value=2e-29, Identity=59%"; Hit description =Hypothetical protein CBG00420 [Caenorhabditis briggsae]
RFLPKIVSIFRKTRLFXPSGGPFFKSMVKWLLVVPXGAAGKIIGNFTLIQIVKSSHCFQLKHIMPGVVSMANCGPNTNNSQFFICTEKAEWLDGKHVVFGHVVEGMVFGHVVEGMNIVRQVEQQGTPSGKPTMQVSEIISASLSIDSFLFIYAASSVATSTTGAPQKGPFVQXSRS

SEQ ID NO: 130023 - protein, 206 aa, Heterodera glycines
  Coding regions on vcDNA: vcDNA=SeqID_56446; Strand=-; Position=1 -40,86-181,222-297,358-676,767-856
DSAEGGGGQKRREGLLQRFCARHPDSAKCRGNSGGTEKVPGSENGEGGGLMERFCARHPEHSKCNGGTEEGTDTTQQTPWHSTASPNGDFSAWSSSAGDYNRRPPSFHNFRPSFAISPNATDERRPTPTANVDMHAAQMDKGECCSLLQRPCCSDVKPEDPSVSFGFLSEEAREAMLKNCLSGAVDCKAQPFGMIQKRTMVLQVSK

SEQ ID NO: 130024 - protein, 196 aa, Heterodera glycines
  Coding regions on vcDNA: vcDNA=SeqID_56447; Strand=-; Position=1-588
  Homolog annotation: Hit_ID=NP_608540.1; Match level="QueryCoverage =69%, HitCoverage=21%, E-value=5e-11, Identity=30%"; Hit description =CG2839-PA [Drosophila melanogaster] gb|AAF51469.2| CG2839-PA [Drosophila melanogaster]
MAGQKMPNIISRKRTTKTKAPQKGRSAEGETEEEEETEEEREEEKGEKVYSEGTEEERETDKREKGRETKRRRTEEDTEREEAEDDRFEIVYLPALKAPKRKLQQKAKATTTKKGHNEDRERGEDEREDDLQQLQTTRGRQRKRGRQSLIKLQKGQVIGGAGTPWPMSWHEARETQYQKPTKYSATPWGFFPVFGH

SEQ ID NO: 130025 - protein, 70 aa, Heterodera glycines
  Coding regions on vcDNA: vcDNA=SeqID_56448; Strand=+; Position=1 -59,566-719
MLCLETPKHGNSHLLRGGISFCAAVLLINTQYAQHGLDELPTRLHYCASDVFIYRAETVEAIKNSSKKRN

SEQ ID NO: 130026 - protein, 94 aa, Heterodera glycines
  Coding regions on vcDNA: vcDNA=SeqID_56449; Strand=+; Position=1 -168,353-469
  Homolog annotation: Hit_ID=NP_386546.1; Match level="QueryCoverage =100%, HitCoverage=19%, E-value=7e-30, Identity=67%"; Hit description= PROBABLE MANNITOL 2-DEHYDROGENASE PROTEIN [Sinorhizobium meliloti 1021] emb|CAC47019.1| PROBABLE MANNITO
VGVQFVPDVTHYEIMKLRLLNGGHAAIAYPAALLDIKLAHNAMQNKLISAFLHKLQTDEILPTVPPVPGIDLLDYCKHVQQRFGNPKIEDTIRR

SEQ ID NO: 130027 - protein, 77 aa, Heterodera glycines
  Coding regions on vcDNA: vcDNA=SeqID_56450; Strand=-; Position=1-234
MVASTLEQFNSLDDQELDRRILNAGLPIGLGEEQPAKGETSQEEMEQLYQQLTDEERKKFTELADGIFHDELAIYIF

SEQ ID NO: 130028 - protein, 263 aa, Heterodera glycines
  Coding regions on vcDNA: vcDNA=SeqID_56451; Strand=+; Position=1 -136,189-428,559-747,1272-1409,1677-1766
  Homolog annotation: Hit_ID=NP_509907.1; Match level="QueryCoverage =57%, HitCoverage=16%, E-value=9e-11, Identity=30%"; Hit description =putative protein, with at least 5 transmembrane domains, a coiled coil-4 domain, of bilaterial origin (XM
SIWLSLAFISVFGLLAALAMLFGANVSHLVCRPLEEPLQRPDFLSLLDRFVHLYGLDRPSSVSPHKSSPSASDHFSLDQLFSANRRPADLISECAQKHTLYTMLGLDKKFKLIGREGLQDDYQYLQRSIMDNLSSHQLIDEALSRGIVPDDPRLSARQWHFFSGPMRDALQRLGQVRMPEWNSSDVEQAIEKLKTSYKEAKESPSWDNTISTASLLAKLGDDSVFRFLSDAVNLCEGEPVRFSSTRPVTGSLCISPPPKKLKE

SEQ ID NO: 130029 - protein, 49 aa, Heterodera glycines
  Coding regions on vcDNA: vcDNA=SeqID_56452; Strand=-; Position=1 -38,223-334
MRENAISKCIARNKTCRKNLTTTTTTPATITASTILMLSYGNFYEKSIF

SEQ ID NO: 130030 - protein, 523 aa, Heterodera glycines
  Coding regions on vcDNA: vcDNA=SeqID_56453; Strand=-; Position=1-1572
  Homolog annotation: Hit_ID=NP_508646.1; Match level="QueryCoverage =82%, HitCoverage=21%, E-value=6e-57, Identity=32%"; Hit description =predicted CDS, RNA-directed DNA polymerase  and Integrase, catalytic domain containing protein family mem
MLWLKNPARPVSGYNLLIYRYKRLVFGATCSPFILAAVLLQHFDKHEHPFAQALAANMYVDNLLIECETEEEAIDKSSIAKQILKDADMNLREFLSHSPNVMGQIPEDDRLDKTPAKVLGLTWDTPSDCITFSLPKDTDITATRRSVLRIIASTFDPLGLVGPCLLPAKRLFQRLWGEGTAWETPLPETEAETWNQTLSLWQNQTIVVPRHSILGKQSRLQLHVFCDASEHTFAAAVYIRSETADGSEANLIFAKNRLRPRTANQRFTIPRLELLAILVGIRAMRFAEKELRRPIDERHLWSDSQIALSWVKSDEPKAQFEQRRLVEIRQGPPTIFHFVRTYQNPADVATRGCTPAELRTRHIWWKGPEWLTSPETEWPDELTFATPADSPSADLPFEESETKTLMAKQSPLPPPLIDPARFSTMLTLLGTTILVLQFIGRRRPKWLRSGISSIPRSGPPTGDSFRAARTFLIRQDQRSSLDGYDKHPTVFNEDGLLCLKPGSCTRTVRPLSPLPSFSTATHL

SEQ ID NO: 130031 - protein, 149 aa, Heterodera glycines
  Coding regions on vcDNA: vcDNA=SeqID_56454; Strand=+; Position=1-514
ETEWPDELTFATPADSPSADLPFEESETKTLMAKQSPLPPPLIDPARFSTMLTLLGTTILVLQFIGRRRPKWLRSGISSIPRSGPPTGDSFRAARTFLIRQDQRSSLDGYDKHPTVFNEDGLLCLKPGSCTRTVRPLSPLPSFSTATHL

SEQ ID NO: 130032 - protein, 58 aa, Heterodera glycines
  Coding regions on vcDNA: vcDNA=SeqID_56455; Strand=-; Position=1-175
MPTVREILESLQKPIKRPRIPTNEDSVLNAERTDAEQQMEDTSTRNDLDVAASDDEEN

SEQ ID NO: 130033 - protein, 95 aa, Heterodera glycines
  Coding regions on vcDNA: vcDNA=SeqID_56456; Strand=-; Position=1-290
VIYNVIFEDGSSGRYHANQLRLRKTTQIVEDPLSILNEEFNLPIQMAPMANGHQNGQVLENRPDPINAEDQVEEPPIREEQQDVIQAVQSPTPQA

SEQ ID NO: 130034 - protein, 84 aa, Heterodera glycines
  Coding regions on vcDNA: vcDNA=SeqID_56457; Strand=-; Position=1 -136,180-216,533-611
MKGIISFLLLFVIAPTNGAKPGNELNVVPSDIINNLKNVLESDELVLFGGNEWMANTSLEKALNTLRFRMIPTIWIWLTKKKFI

SEQ ID NO: 130035 - protein, 84 aa, Heterodera glycines
  Coding regions on vcDNA: vcDNA=SeqID_56458; Strand=-; Position=1 -90,373-537
MDENFENIRTTIGVARKVISMEARLLDYKNKVQVPMNQLRDLMDLFKIGYSKKQSDVDEIKNFSASQHSLFHPLLNKIRLQITK

SEQ ID NO: 130036 - protein, 77 aa, Heterodera glycines
  Coding regions on vcDNA: vcDNA=SeqID_56459; Strand=-; Position=1 -170,1091-1154
MLGFYDDISPQNKPSQKLCFKKSEKAINKVENWDGKPSQLKYSLITQAKWKKAVIFCYVENNSTIFVALLGAFVRAS

SEQ ID NO: 130037 - protein, 130 aa, Heterodera glycines
  Coding regions on vcDNA: vcDNA=SeqID_56460; Strand=-; Position=1 -235,282-439
MSSPIKFSPSKSSDAKNETNVKAAVLTPNSLKLPNRKHQLNSAGNNGEQPPTKVRKVEDRELWKLAKGKYMLGFYLCSDDWNRLYNNNAKVVRTEDGRFAVNFELCAECTLKNARATDLLAPPKQKKSAE

SEQ ID NO: 130038 - protein, 258 aa, Heterodera glycines
  Coding regions on vcDNA: vcDNA=SeqID_56461; Strand=+; Position=1-777
MAINMNDKKGLLKQILGESDITVTTSGLTISGPRLTNPRFLPFEESGRCRSCKATEVEVDTMVTKEGITLWCTRIDKVQFVPFDVVYDLPGHCFFRVKNKARVFNIPYGDLLSDNTCDQIQLTLHADEERRLKRKAKAALDLVEQGLMEDAMHDGASWKKAKTAIGVLNKLLLVGTHGDNENKETAALTTSENQQQEQQPPTAPPSEEIVSIVPSDVGSQVLSSGEVKLEEEKQADLGDIDKTLDEFFASLKASTTSM

SEQ ID NO: 130039 - protein, 79 aa, Heterodera glycines
  Coding regions on vcDNA: vcDNA=SeqID_56462; Strand=-; Position=1 -208,303-334
MLLSIFGLVFILISETLLFSSIEADKHIAKLTAYCNLTSDNLTFALPEPINAKVRARFAICMILKYTVTGIYYVQGCQI

SEQ ID NO: 130040 - protein, 63 aa, Heterodera glycines
  Coding regions on vcDNA: vcDNA=SeqID_56463; Strand=+; Position=1-287
GKKLVKIVENVGPAVPIGAAGKNFWKFECYLLRNLPIKLFKFSFGGGGIRKKFPLFAGKFLKI

SEQ ID NO: 130041 - protein, 72 aa, Heterodera glycines
  Coding regions on vcDNA: vcDNA=SeqID_56464; Strand=+; Position=1 -103,404-519
MFGIRNSKQRKLIDDQLEDDDFEMEQFSPDWQLIDEISIKLLENGIGTFETLQRALPSVVLAQIERIVSVFF

SEQ ID NO: 130042 - protein, 269 aa, Heterodera glycines
  Coding regions on vcDNA: vcDNA=SeqID_56465; Strand=+; Position=1 -234,278-559,603-762,806-938
MENVLRYNNSLSFGHVITQRSEEEYFRIVKCNNLIQYVLWDYNPPDGSLPLLHGQLFTIPSEQAETRLGEIAEQFELNAVLLCKLHEMLRKLHPMATLYETAAETFNQLPPDERVNLRMLVVGTNRQGKERTLTEDEAQPIDVQLPHDSLLKQIHPGRLQVETEAGSHLVAQLFMDSGQNVMPNMNYEVVLLGRKGTGAQHLKWWRREIDPATFPLIFPKGQFGFEDGLPLKLKEGEKFDTKQNAITNKNNDKPLDDNEDLGEAEEFLG

SEQ ID NO: 130043 - protein, 147 aa, Heterodera glycines
  Coding regions on vcDNA: vcDNA=SeqID_56466; Strand=+; Position=1 -99,666-863,936-1082
  Homolog annotation: Hit_ID=XP_416536.1; Match level="QueryCoverage =65%, HitCoverage=23%, E-value=4e-19, Identity=45%"; Hit description =PREDICTED: similar to Tryptophanyl-tRNA synthetase, mitochondrial precursor (Tryptophan--tRNA ligase) (Tr
MGGGGGQLLIPIGALFQLRLNCFRTLATLLACGVSSVCTRLRSLRNPTVKMSKSDTDAKSRIELTDNAETTAIKIRKAVTDSTSNITFDPVQRPGVSNLVTLFSLFSDLTVDQVVTQSIGIDTLGFKGKLAELIKSVQSIAFVVSLL

SEQ ID NO: 130044 - protein, 186 aa, Heterodera glycines
  Coding regions on vcDNA: vcDNA=SeqID_56467; Strand=-; Position=1 -114,219-378,998-1135,1182-1303
  Homolog annotation: Hit_ID=XP_513751.1; Match level="QueryCoverage =99%, HitCoverage=25%, E-value=4e-33, Identity=41%"; Hit description =PREDICTED: similar to chromodomain helicase DNA binding protein 1 -like [Pan troglodytes]
DLVELYALLKLASPDQFKPNGQQSFIMRFAKLGDDEEVSQRFRKIFDKYCLRRNKILNDVPLCSEVILYHGLSKLQYDMYRAILSSNRCTMRTEKQARQSLMSTLVQLCKCCDHPYLFRGIEKEPFEEGEHLVNDSGKALILDRLGKALILDRLLAYLHKKGHRVLIFTQMQRFLDIVYDIMSLRG

SEQ ID NO: 130045 - protein, 126 aa, Heterodera glycines
  Coding regions on vcDNA: vcDNA=SeqID_56468; Strand=+; Position=1 -107,156-222,268-412,507-565
LVGRFLENDRGPQAMAEFLALFDRSIQETTTDQLSEPAREKVRCLFNLRENKWGVVAEPNVGDGPLTTASTSVGIIGPDDVPLTEDECAFMEENLDNFVDNSPGESQCLNAFDEDNVEDDFEKFLQ

SEQ ID NO: 130046 - protein, 87 aa, Heterodera glycines
  Coding regions on vcDNA: vcDNA=SeqID_56469; Strand=+; Position=1 -78,136-321
MDLGKTVDALAEDESVELLNESAEFRGDMDSSFGSDLHSVSFQEISSILRAKPDINVFYRTPCSGASRFSRRSSSARTQIGVIFQNE

SEQ ID NO: 130047 - protein, 44 aa, Heterodera glycines
  Coding regions on vcDNA: vcDNA=SeqID_56470; Strand=+; Position=1-134
LVELNLSWAEVDVDAMLAVCRLMPSGVRRLNLSGFRQLSSLNDR

SEQ ID NO: 130048 - protein, 150 aa, Heterodera glycines
  Coding regions on vcDNA: vcDNA=SeqID_56471; Strand=+; Position=1 -21,210-641
  Homolog annotation: Hit_ID=NP_502448.1; Match level="QueryCoverage =45%, HitCoverage=17%, E-value=2e-11, Identity=50%"; Hit description =solute carrier family 35 member A2, possibly N-myristoylated (4N619) [Caenorhabditis elegans] emb|CAB0532
MSGLCIAVVIKYADNILKTFANSFSIIVISIASIWVFASMPKPLFIVGAALIITAALIYAKFPYRAKPKADQRSNSNSATDSGSADSDSSNMSNCGTAPPTGRGGDRMPKEEDKVSRLTKLFRMGRSPTMAKLTPGQLDANGDGNGVQKF

SEQ ID NO: 130049 - protein, 98 aa, Heterodera glycines
  Coding regions on vcDNA: vcDNA=SeqID_56472; Strand=+; Position=1 -87,357-434,489-620
MTNGPKQKPRTNSAKGPVVCPTWSSKQWEADDETLGDGKDIADLENEEKEDGEEAADEQPVPEPMKKKKKTKTAQSNAPVGTSRSSKNDGKNDLTNFQ

SEQ ID NO: 130050 - protein, 208 aa, Heterodera glycines
  Coding regions on vcDNA: vcDNA=SeqID_56473; Strand=-; Position=1 -20,538-1166
  Homolog annotation: Hit_ID=NP_508337.1; Match level="QueryCoverage =97%, HitCoverage=88%, E-value=3e-30, Identity=43%"; Hit description =predicted CDS, putative nuclear protein (XC449) [Caenorhabditis elegans] gb|AAC48211.1| Hypothetical prot
PKKKFMMPKPRPILKLRPKRPSLKHMPKPRPILKLRPKRPSLKHMPKPRPILKLRPKRPSLKHMPKPRPILKLRPKRPSLKYMPKPRPILKLRPKRPSLKHMPKPRPILKLRPKRPSLKHMPKPRPILKLRPKPGPEHMPKPRPILKLRPKRPSLKHMPKPRPILKLRPKRPSLKHMPKPRPILKLRPKRPSLKHMPKPRPNLGNCTN

SEQ ID NO: 130051 - protein, 51 aa, Heterodera glycines
  Coding regions on vcDNA: vcDNA=SeqID_56474; Strand=+; Position=1 -40,176-291
MDSVGGGDFSSSAANGGRKTAEEKRASNLERRQLEKDERHSFLESSLSKGI

SEQ ID NO: 130052 - protein, 111 aa, Heterodera glycines
  Coding regions on vcDNA: vcDNA=SeqID_56475; Strand=+; Position=1 -287,341-389
AFTDASSAVNFIFVVRFPPSFAKSVVPFVLTNNLTSEQLTLKSTSNSRLFVFVRSPIVRNASEWTKWENEAIGWDFVDQPNRIDVYMYREDQTGDGLLNKLTGPINRKKKK

SEQ ID NO: 130053 - protein, 270 aa, Heterodera glycines
  Coding regions on vcDNA: vcDNA=SeqID_56476; Strand=-; Position=1 -396,529-942
MSELLRISIAPMVVRLKMYIETAQENLGKELADQSVRADLIAERQNLCKTISLLEKYNGKWEAIFLRVKGQALQDEEQNYRDFKPEGKAFMHWVDQARGLVDTIEGALGLSELGDAIPQPNQPAQVVQQAPVKHIYLLGCLPEKSVARRAIDLYPPSDENYPRVVEILKKRFGDEKTMVESIQAELLHLAKPAKSVQSLRQFSESIERICHQLLDYGENEQNKFMASTIKSKLPYHLLTQVVEKEMRAGGAFNCTELRRAISSIVEVKEE

SEQ ID NO: 130054 - protein, 174 aa, Heterodera glycines
  Coding regions on vcDNA: vcDNA=SeqID_56477; Strand=-; Position=89-613
MPRFSMIAFLAMRIPTRDPWFEEDWEPVLPLVPDHVDRRLRDPRLEEEEEERANDAHLRRERRVHGRIEPLSSWIERYHEPRWYETALDMGHEIDPFMPCLQEYVGFSPHEGGMLVDLYPVELVNIRNRVGVAWRAPAVVEEPHLPPPDQAQLPDGRLENRPPRVARRLQMNRR

SEQ ID NO: 130055 - protein, 149 aa, Heterodera glycines
  Coding regions on vcDNA: vcDNA=SeqID_56478; Strand=+; Position=1-631
MGTHQSTPIGVTFPPAPVLKSDFVYDGSNMALTREPLTIDFNCKSRQEAIDFNCSLGVQACTDCIPDHSSGLVNCNCRSHNLEKLMESPERRLPLNIKNYQLRNTGRKVIALTGFSPVQLNLQIEGLQMALELHQSLCTILPLNISGCY

SEQ ID NO: 130056 - protein, 1117 aa, Heterodera glycines
  Coding regions on vcDNA: vcDNA=SeqID_56479; Strand=-; Position=1 -2870,2948-3388,3484-3526
  Homolog annotation: Hit_ID=CAA82797.1; Match level="QueryCoverage =36%, HitCoverage=59%, E-value=3e-18, Identity=24%"; Hit description =gag protein [Ascaris lumbricoides]
MVVRLKMYIETAQENLGKELTDQSVRADLIAERQNLCKTISLLEKYNGKWEAIFLRVKGQALQDEEQNYRDFKPEGKAFMHWVDQARGLVDTIEGALGLSELGDAIPQPNQPAQVVQQAPMVHQRHDVTLPPITLPKFSGEPREWPLFWKLFETSVESLQIEDFKKHIYLLGCLPEKSVARRAIDLYPPSDENYPRVVEILKKRFGDEKTMVESLQAELLHLAKPAESVQSLRQFSESIERICHQLLDYGENEQNKFMASTIKSKLPYHLLTQVVEKEMRAGGAFNCTELRRAISSIVEVKEEVQRCTQIFRGEEKPRNFPPHSNEGRANQGRGTPFRFSRPFREERWRPVEGNETAMRMSPQTNHSFSAIIQQRTPIPNRGSNRICFLCETKGHTPSWCTKYITPGARRKRLADQDRCINCLIMGHNSLNCTSPRRCSQCGERHHFMVCYGGEKQWNIPPQVQRNDFHGMGTESPPNQFIQGHERPDNRNDSVGMMSPQVNRSFLTLTSPQFSQRKIGTRTRQTCSLCCVVGHPPSRCPQYSTPGARRRRLAKQRKCFNCLMKDHKAQQCQSPKRCLKCGGKHHYMICYHGDAPIGSTPQQIREGRTVQKKQSSKQRGEFPRSKTLYSGVSSRVEDKPSESIAFHCSSTSGLKNVTNKSHSFFCRAMVMPKHDHQKMIEKSVLFDQPSQISYQSDSHFGEQKTPKVTPTDKKICGCCIKKNGVVSHSVFSIRINRMDNKWEETLPNRTEQSIIALTLCFYISISLMVLSILKALSIGRKTIAWLMIQLKVLLLCFEDQSTPCFQEGRQRGAIPQFCTARHILQIMAFTVILACLFPLPVKGGTETNAYPTNQCNECKLLCFNKGVKAKIPKEINKVELFCAENCYIHENVKKLTYELPKEILLNDFQCEGHFWMDSKHMFKKDILCPAVDECELIECYFCIEQLANPTCYPLISSMTLYGHLADNSIYQANNYLAGPNRPPKDRRPRATASQNWTSRRVYRTMAFVVLMANSLQDLTGAETIAVMAKSEKCFKNATSMRCIVENSATLTLLPVGQTNTLLLKTEEGVLLGSINVLLKALALECQSFTKEWQRSYAINVLAAKRQFILPGQHSLLGQ

SEQ ID NO: 130057 - protein, 55 aa, Heterodera glycines
  Coding regions on vcDNA: vcDNA=SeqID_56480; Strand=-; Position=1 -61,1092-1198
MADPFDSKSFGFMPAIGEQQVLICWRAFYFAIKPPKKVNVRIYARIASIFWPTGV

SEQ ID NO: 130058 - protein, 28 aa, Heterodera glycines
  Coding regions on vcDNA: vcDNA=SeqID_56481; Strand=-; Position=1-85
VPSSARRTRRRRQCIGAQATHGSAQHRR

SEQ ID NO: 130059 - protein, 51 aa, Heterodera glycines; identical to SEQ ID NO: 124998
  Coding regions on vcDNA: vcDNA=SeqID_56482; Strand=-; Position=1-155

SEQ ID NO: 130060 - protein, 483 aa, Heterodera glycines
  Coding regions on vcDNA: vcDNA=SeqID_56483; Strand=+; Position=1 -577,760-1634
  Homolog annotation: Hit_ID=BAA95789.1; Match level="QueryCoverage =84%, HitCoverage=84%, E-value=5e-16, Identity=25%"; Hit description =KED [Nicotiana tabacum]
FFENQSLLELHYIKAFSTDDSAEHEALKLAVDLFIWVMWFEKEILQLDNEHAKTAPRLTMAWKQNRWYYEMTYDKLFDIEKENEREELAKIRQEIGILLQESKNFAEQKRQMIDANLKIELRSKRLQRLQKPSRTAPPFGTLDRELYDIRRKAMARDDQVEPEFKKWLQQTHFNRLSDYVSQCNEFNAKFVKGTSKETLKRVAEFVGEENADEINRKANDCFGKLSNFEEYLAADGTHIHGIYMNPSEILEDIRKSEEIDKEKEAKEAEEKPFDLDATMAFLNFGGTDKKGKMAKKDAKDGTKSSDRRKKGDRKKQLEGELTDDPYKTPTESSIMPKSDEICMEKSKTKKSKSDSNQKVKKNKVEKPKHKKEKPASIKPKENEKGSRTPKNKKIDKMPNDDNASKTSKTKKEKTVITPNDKSEKEIEQKINDNVITDQKNEIKETKKKEEKKAKTLKKRNKNDGDAQKEFESIGIIGNNKIIK

SEQ ID NO: 130061 - protein, 460 aa, Heterodera glycines
  Coding regions on vcDNA: vcDNA=SeqID_56484; Strand=-; Position=1 -221,271-356,401-511,557-678,745-870,1211-1276,1323-1467,1509 -1587,1629-1706,1796-1915
  Homolog annotation: Hit_ID=NP_502782.1; Match level="QueryCoverage =51%, HitCoverage=77%, E-value=6e-37, Identity=38%"; Hit description =ribosomal protein S7 (4P532) [Caenorhabditis elegans] emb|CAC70123.1| Hypothetical protein Y57G11C.34 [Ca
IKNETWLIVIEREFFALLFRCFFVRALLFRSFQALSFVVHLPFHQQKTISTSVFALTVFDPRIFTEPIVSTEELNKPLNKPLPPNDKRNYMYLKPMLFDQTPVFYRDEIVDKMVRVFLMEGKKELSPVFYRDEIVDKMVRVFLMEGKKELSRVNVLSALEIVKRTQYEKWLNEKDEKWLNEKDEKRRAEIILDPIEVANRAILNCRPLMKLEKTIKAGTLYLGTLYLVPMPISEKVAIFKAMKTMRDICRLKAGKKRNEKRPHSASSTTVALLTQFEHQYSVSTADITAKIGQLHHLGPITAKIGQLHHLGPSEFAQLAKEVRHLLADVEELLEQMELSAREIPSSSSERSKYETRVKSERSKYETRVKSYRNDKRQLDAELRKAIERAKSNAERAIERAKSNAERDELFQCGDGSVSGDQMDKLITNTERLERTSRKIEDAYRVTVETQQSALTISDLP

SEQ ID NO: 130062 - protein, 43 aa, Heterodera glycines
  Coding regions on vcDNA: vcDNA=SeqID_56485; Strand=+; Position=1-220
TCLWGVSGSLITNMTFIGPISNTGPEFNKKSKTQNLKNSHFSS

SEQ ID NO: 130063 - protein, 94 aa, Heterodera glycines
  Coding regions on vcDNA: vcDNA=SeqID_56486; Strand=-; Position=1 -220,973-1037
MYSSSSEEGEIHEHPQPNPPVQEFHPNPQAHDPLPNLQPNEKMFFVAETTQHRVVLLADGFEYNFKADSRMADGVCGHQKYHPGLGCRLHHVRL

SEQ ID NO: 130064 - protein, 337 aa, Heterodera glycines
  misc_feature (37)..(37): Xaa can be any naturally occurring amino acid
  misc_feature (124)..(124): Xaa can be any naturally occurring amino acid
  misc_feature (130)..(130): Xaa can be any naturally occurring amino acid
  misc_feature (180)..(180): Xaa can be any naturally occurring amino acid
  misc_feature (279)..(279): Xaa can be any naturally occurring amino acid
  Coding regions on vcDNA: vcDNA=SeqID_56487; Strand=+; Position=1 -55,114-232,280-439,1999-2132,2337-2565,2682-2793,3253-3298,3438 -3477,4486-4534,5459-5496,7046-7067
  Homolog annotation: Hit_ID=XP_478998.1; Match level="QueryCoverage =99%, HitCoverage=26%, E-value=9e-50, Identity=34%"; Hit description =putative diaphanous homologue [Oryza sativa (japonica cultivar -group)] dbj|BAC55695.1| putative diaphanou
LLRKIIESKLPPPRGPNSPNSPIPPPPNFLLFSRVIXRPANPKKCIHFDLSEYSFIHPPARPLGARPLGPHFCSCGQNAGAVPPPTAAAAAMPSSAPPPPTVVALVTPNSLSAVTPDGPLPFSXPPPFFXCVHLFCGPPSAPPPFPAPASEAPPPGAPHFSTAKMPKCSPLPPELGPAVXLPPPPTLLPGVPPLTPPPPPPLNAGDCFISMPPPPSPAVPLSSEWSGPFGAGPPPAPDESPIPPPPPLLFIGFCAETLDGPVPAPPGVPTPPPPPSCCXGGPTPAAPTVVGHIMPPPPPTPMGKLGGGPPPPTTDDGYPPQPGGPYMPPPGYSRPNS

SEQ ID NO: 130065 - protein, 441 aa, Heterodera glycines
  Coding regions on vcDNA: vcDNA=SeqID_56488; Strand=-; Position=1 -89,131-283,897-981,1587-1725,1781-1820,2083-2251,2634-2750,3816 -3945,4044-4253,4488-4579,4959-5060
  Homolog annotation: Hit_ID=EAL29116.1; Match level="QueryCoverage =96%, HitCoverage=98%, E-value=7e-34, Identity=30%"; Hit description =GA20167-PA [Drosophila pseudoobscura]
MFQQQPPPHSQMQQQRKENFLSSDSQAREKLSQFVYEYLYQLGATKTAEMFKNEFLAHNMPNLQIDLSSSSGPGFLYNWWSVFWDLYSAHPDKKDKVDATSEAKTYHKMFPNPAAMGPGGGPPQNFPDGMMPNAYYGPRGGPQPGPSSNQASPIPGGGGPPRYGQQGTRSGAPTPSSVVGGGGPPPNFPMGLAPPQMMALNEQQQLRMMMAARQQQANQAVRMQMQQQQQQHNNGGRAVRGGGAAQFNNAHPYMDSPSGTPPFHFAGHHDSAGGVGTPGGAGTGPSSVSAQNPMNSNGGGGGMGDSSGDSRAAPNGGGPAPNGPLHSLLNGTAGDGGGGMEMKQSPAFSGGGGGGVNGGTPGSNVGGGGSQTAGPSSVHSQSGAPGGGASLAGAGNGGGADGGPQQQQTPPEEISKIKASLMEGYAGQQQQEDFPQQHQFP

SEQ ID NO: 130066 - protein, 142 aa, Heterodera glycines
  Coding regions on vcDNA: vcDNA=SeqID_56489; Strand=-; Position=1 -107,449-496,733-1004
EEWFNSLANPQQNDGAIPSLQQAKAASVRQKSSSFVGPQQQPCPDERLIWQDERHLAEKCRNKNIRNGTNIGNDEHFGDADAGTSADAVERRGWCRFAASFGLLARLRHAPSNFHREIRHLNLAQCREVHKVAVIYAAKDQQ

SEQ ID NO: 130067 - protein, 268 aa, Heterodera glycines
  Coding regions on vcDNA: vcDNA=SeqID_56490; Strand=+; Position=1 -797,1263-1273
  Homolog annotation: Hit_ID=XP_345024.1; Match level="QueryCoverage =92%, HitCoverage=88%, E-value=2e-21, Identity=24%"; Hit description =similar to SPAC23A1.17 [Rattus norvegicus]
GLNPPAFQSLGTQSTNIPITGTAFQSPGQNPPAFQSLGLNSPAFQSLALKSPAFQSLGLNSPAFQSLALKPPAFQSLALNSPAFQSLGLNPPAFQSLGLNSPAFQSLRLNPPAFQSLGLNPPAFQSLGLNPPAFQSLGLNPPAFQSLALNPPTFQSLGLNPPAFQSLGLNPPAFQSLGLNPPAFQSLGLNPTAFQSLGLNPPAFQSLGLNPTAFQSLGLNPPAFQSVGLNSTAFQSLGLNPTAFQSMGLNRTGAFRPHSPNFCAKGFS

SEQ ID NO: 130068 - protein, 484 aa, Heterodera glycines
  Coding regions on vcDNA: vcDNA=SeqID_56491; Strand=+; Position=1 -335,665-1223,1271-1532,1576-1874
  Homolog annotation: Hit_ID=NP_507780.1; Match level="QueryCoverage =77%, HitCoverage=28%, E-value=9e-25, Identity=26%"; Hit description =predicted CDS, DNA polymerase type B, organellar and viral family member (5T899) [Caenorhabditis elegans]
MEERDNMIKGGCKTTEEGMKRKERMIGVEITGDGLASPVWVPYRAYPQNNADVIMQEINKLGQSGDGDENKKTLLLSEPIMMKITCVTLPSGDGPRNVHKFDFGFKEHQRIRMRFTPESTEWWHLKSQLIHGNQSVVLWKGPMGRENVVPIFLENGHWDGLKNYVCFFNRGRKFCVDCECFYSRDVFHTLECRARCYYCNRVGGVPCGKESGVKIECPKCHRYFYNWECYNYHQGHTCKLWKRCVICDKTYQFNPKKDHECGETYCQLCSVSHDPKRGCYIMPIEEKEDKDVYRIVVWDSETSQDSIYKGDQKEHVINYISVRVTCTECCDDKNRANCKICGEERTKDWSEAEGHEPTKDFVEWILTAFTNYDTYIFAHNAGRFDGHFVFNYLCRTGKNPIPLINGLKIYEFKVQNSRKHSMLIWRDSCLLMPVKLESLKATFNLGCEDKPFFPYYYNKTENYGIRLEHLPPMEDYSPGSMNKR

SEQ ID NO: 130069 - protein, 21 aa, Heterodera glycines
  Coding regions on vcDNA: vcDNA=SeqID_56492; Strand=+; Position=1-65
MAISFFSWGFDRKLGTNICLL

SEQ ID NO: 130070 - protein, 19 aa, Heterodera glycines
  Coding regions on vcDNA: vcDNA=SeqID_56493; Strand=+; Position=1-59
TFAFSSLALPNTHTIFEML

SEQ ID NO: 130071 - protein, 19 aa, Heterodera glycines
  Coding regions on vcDNA: vcDNA=SeqID_56494; Strand=+; Position=1-59
TFSFSSLALPNTHTIFEML

SEQ ID NO: 130072 - protein, 19 aa, Heterodera glycines
  Coding regions on vcDNA: vcDNA=SeqID_56495; Strand=+; Position=1-59
TFAFSSLALPNTHTIFEML

SEQ ID NO: 130073 - protein, 19 aa, Heterodera glycines
  Coding regions on vcDNA: vcDNA=SeqID_56496; Strand=+; Position=1-59
TFAFSSLALPNTHTIFEML

SEQ ID NO: 130074 - protein, 19 aa, Heterodera glycines
  Coding regions on vcDNA: vcDNA=SeqID_56497; Strand=+; Position=1-59
TFAFSSLALPNTHTIFEML

SEQ ID NO: 130075 - protein, 352 aa, Heterodera glycines
  Coding regions on vcDNA: vcDNA=SeqID_56498; Strand=+; Position=1 -47,107-382,425-848,912-1223
  Homolog annotation: Hit_ID=AAL78214.1; Match level="QueryCoverage =41%, HitCoverage=77%, E-value=5e-14, Identity=31%"; Hit description =putative esophageal gland cell protein Hgg-20 [Heterodera glycines]
MSDNPKKANKEMEKAIFISADCWLEVFNLLPPSQLGLGIAMISRRFDYYVDEHFKTRKWKLGKMKIRRKIGQNGANEMKIVNANGKELPIPQNPLPNKVIGFRSIWIYFIDQNVITFLGRFDRFFASCTTMLSITTGNVRILEFIVLNIWPMFKDTIYLLSLDIVAFRRMRQLAPSMLNDCPSLRFVNFFDGISLEFPPDDSANASDGQTVTKWLFTPRPDNLMNDLIVSIQDSAMEQQWLATVEHIKASFSSASSPVSFDIYIDFSLSSSISSIVPFELTNEFTGEKLALSKEDEEADFEDEEKYYSLFSLSRCPIGSDDKKQQKFEKFDELYDRWNLIDIWIGDDGFGDG

SEQ ID NO: 130076 - protein, 45 aa, Heterodera glycines
  Coding regions on vcDNA: vcDNA=SeqID_56499; Strand=+; Position=1 -83,343-397
MVKVKKTDTSDFYIKYINWFLLTREDEWSFFFFGFCRANRASEGL

SEQ ID NO: 130077 - protein, 109 aa, Heterodera glycines
  Coding regions on vcDNA: vcDNA=SeqID_56500; Strand=+; Position=1 -47,108-390
  Homolog annotation: Hit_ID=AAL78214.1; Match level="QueryCoverage =85%, HitCoverage=48%, E-value=2e-09, Identity=32%"; Hit description =putative esophageal gland cell protein Hgg-20 [Heterodera glycines]
MSDNPKEAEKEMEKAIFIAADCWLEVFDLLPPAQLGLGIAMISHRFDYFVDEHFKTRKWKLRPIVIQRKIGENGAKEMEIVNNFGGKALPIPQIPLPNKVIGFRAIQIL

SEQ ID NO: 130078 - protein, 343 aa, Heterodera glycines
  Coding regions on vcDNA: vcDNA=SeqID_56501; Strand=+; Position=1 -47,106-384,642-1062,1113-1397
  Homolog annotation: Hit_ID=AAL78214.1; Match level="QueryCoverage =43%, HitCoverage=77%, E-value=3e-14, Identity=30%"; Hit description =putative esophageal gland cell protein Hgg-20 [Heterodera glycines]
MSDNPKEANKEMEKAIFIAADCWLEVFVLLPRSQLGLEIAMISRRFDYFIDEHFKTRKWKLRPIVIQHKIGENDAKEMQIVNNFGGKALPIPQIPLPNKVIGFRAIQIFFVDQNVITFLGHFHRFFAKCATNLAITTGNVRISEFAVFTIWPMFKDTIYLLILNIVAFRQIRQLVPSLLNDCQSLRSFNLCDGISLEFPPDDSANATDGQALAKWLFSSHPDNLPKKLRCYMNSIMEEQLSATVEQIKAAFSSASSPVSFIILIDFSSSSSLSSIVPFELTNEFTGEKLALSKEEEYEDLIGFTLIRCPIVSDDKKQQKFKELDLRWNRIGIDIADAEAAMGN

SEQ ID NO: 130079 - protein, 25 aa, Heterodera glycines
  Coding regions on vcDNA: vcDNA=SeqID_56502; Strand=-; Position=1 -47,490-520
MYSFLYAMAIVHGDKSLLVSMSPVR

SEQ ID NO: 130080 - protein, 302 aa, Heterodera glycines
  Coding regions on vcDNA: vcDNA=SeqID_56503; Strand=-; Position=1-908
  Homolog annotation: Hit_ID=XP_345024.1; Match level="QueryCoverage =84%, HitCoverage=87%, E-value=6e-34, Identity=28%"; Hit description =similar to SPAC23A1.17 [Rattus norvegicus]
AFQSLGLNSTAFQSLGLNSTAFQSLGLNATAFQSLGLNPPAFQSLGLNPTAFQSLGLNPPAFQSLGLNPPAFQSLGLNPTAFQSLGLNPPAFQSLGLNPPAFQSLGLNPPAFQSLGLNPPAFQSLGLNPPAFQSLGLNPPAFQSLGLNPPAFQSLGLNPPAFQSLGLNPPAFQSLGLNPPAFQSLGLNPPAFQSLGLNPPAFQSLGLNPPAFQSLGLNPPAFQSLGLNPPAFQSLGLNPPAFQSLGLNPPAFQSLGLNPPAFQSLGLNPPAFQSLGLNPPAFQSLRLNSFQSLSLNPQHFHH

SEQ ID NO: 130081 - protein, 175 aa, Heterodera glycines
  Coding regions on vcDNA: vcDNA=SeqID_56504; Strand=+; Position=1 -167,503-567,820-965,1186-1337
  Homolog annotation: Hit_ID=NP_505065.1; Match level="QueryCoverage =64%, HitCoverage=25%, E-value=9e-32, Identity=50%"; Hit description =serine palmitoyltransferase 2 (62.7 kD) (5I501) [Caenorhabditis elegans] gb|AAA92303.1| Hypothetical prot
VNGFHCPPKETKNWEEKKDKTSQEKEDGEKGKANGQRKKEQIEPKAWEEEEEFEKGFAPLVDSFEAIYARNCYMRVRFPGSQTEVINVSSYNYLGFAQSDGPCAEMAAKAVEKGGLSTCGSALEVGQCSIQSDLENLVAKFLGVEEAICFSMGFATNSMNVACLVDEVGKTYPGI

SEQ ID NO: 130082 - protein, 132 aa, Heterodera glycines
  Coding regions on vcDNA: vcDNA=SeqID_56505; Strand=+; Position=1 -249,299-448
  Homolog annotation: Hit_ID=NP_502301.1; Match level="QueryCoverage =96%, HitCoverage=55%, E-value=1e-14, Identity=34%"; Hit description =RNA and export factor binding protein, ALY family (aly-3) [Caenorhabditis elegans] emb|CAA92829.1| Hypoth
MANVDLALDEIISKSRPPPPPPAPQQRNFGGKRPFRMNATNRPGFGRRNSLGGGQRFMRSGSDNVVWINIANLPDTVLTQDLQELFEDYNVFGIGVHYDEFGAHMGTADLFVDTPSAESIIRDFLNVAIDDA

SEQ ID NO: 130083 - protein, 40 aa, Heterodera glycines
  Coding regions on vcDNA: vcDNA=SeqID_56506; Strand=+; Position=1 -105,1073-1090
MRETDGVLAKRANVRFFACVRAMVNNASGGCAVKKINKTA

SEQ ID NO: 130084 - protein, 124 aa, Heterodera glycines
  Coding regions on vcDNA: vcDNA=SeqID_56507; Strand=-; Position=1 -160,1659-1748,2138-2262
MFFTFAANSASSNVYHYISAVEQRFLTDTGCIVGDTSAEDGQLGQLPRYKQPIEKAIFEKVECPVCGKRLFRHNLLVHHRIHTVHNKKKFGEACAYCTLFNSFDCTKNDGNRKRVGRVYGRKCH

SEQ ID NO: 130085 - protein, 255 aa, Heterodera glycines
  Coding regions on vcDNA: vcDNA=SeqID_56508; Strand=+; Position=1 -168,213-273,690-790,1001-1140,1185-1296,1482-1564,1607-1707
  Homolog annotation: Hit_ID=CAE62553.1; Match level="QueryCoverage =99%, HitCoverage=64%, E-value=5e-50, Identity=40%"; Hit description =Hypothetical protein CBG06663 [Caenorhabditis briggsae]
ARLLSFFESIGWKVYTVPETASFFLGPGRIRFPDLSSEQAAQFQTDLLKALIQNEDVFFNQAELSEAEKIMIILDRGAMDGSAYIDMESWSNVLSACGVDNHEMRERYHQAWIGHQCLSIVDNSNCCSFDEKISKLIAVVCERLGIPISDRLAPNSKKRKWLVSKIVDNDAFLQIKQEKFSLQHDYLNTAGSSQVRLRSRSQNGKYTYTLTTRTFEDADGKKLPQPVETRKQLDRREYQSYLKLLDRSRQSIHKK

SEQ ID NO: 130086 - protein, 135 aa, Heterodera glycines
  Coding regions on vcDNA: vcDNA=SeqID_56509; Strand=+; Position=1-707
VFGAVPPNRCAQIYGETESFGNSFPIACTLILRWIFAPHNCLSTPNGHLKKSIFFVFGAVPPNRCAQIYGETESFGNSFPIACTLILRWIFAPHNCLSTPNGHLKKSIFLFSGQSPRTDAPRFMGRPNPSGIASL

SEQ ID NO: 130087 - protein, 95 aa, Heterodera glycines; identical to SEQ ID NO: 129573
  Coding regions on vcDNA: vcDNA=SeqID_56510; Strand=-; Position=1 -747,1085-1156

SEQ ID NO: 130088 - protein, 86 aa, Heterodera glycines
  Coding regions on vcDNA: vcDNA=SeqID_56511; Strand=+; Position=1 -92,759-927
  Homolog annotation: Hit_ID=EAL29673.1; Match level="QueryCoverage =80%, HitCoverage=19%, E-value=1e-10, Identity=42%"; Hit description =GA16660-PA [Drosophila pseudoobscura]
MAVFPVFPIVWHSLRSLHHGKMSLYQTAIFCVSLLRFALPAALFVAFSLFSIVHLFTLEHPYLLADNRHFTFYIWQRLFQRHWLVK

SEQ ID NO: 130089 - protein, 348 aa, Heterodera glycines
  Coding regions on vcDNA: vcDNA=SeqID_56512; Strand=+; Position=1-1044
  Homolog annotation: Hit_ID=CAA82797.1; Match level="QueryCoverage =78%, HitCoverage=40%, E-value=6e-23, Identity=28%"; Hit description =gag protein [Ascaris lumbricoides]
MEWPAFWQSFESAVDRAALEPVDKLNYLHGCLRGKAARAVTAYRGGENYAHAVAALRRLFGDPRKIAEALQSELINLRPVDDSVGSLQHFLETLERVCRQLLNLNMPDDSPFMYQIIRSKLPSTVLSELVKMERAAGIPWGTPQLRAGLAEVLGVREEVERCLRETNTDRQTRFRHEARPSRPQRPERHENARVFSVAQSVVNSGEKRVPSCLFCPGQHWAAECNKVTDTENRKRCLLQQNRCLNCLRKDHQLKECRSKQGCRICKERHHSSICPSAKGTSSARQKQPKPLHKNKQTFGTERNSRPLVSSAVANDADSIPEPKIVNTIMAIVSPSVPHLVMIMALRAP

SEQ ID NO: 130090 - protein, 95 aa, Heterodera glycines; identical to SEQ ID NO: 125597
  Coding regions on vcDNA: vcDNA=SeqID_56513; Strand=+; Position=1 -286,450-925

SEQ ID NO: 130091 - protein, 27 aa, Heterodera glycines
  Coding regions on vcDNA: vcDNA=SeqID_56514; Strand=+; Position=1-81
MVGRIKNVYSKVYDVPRRPFEKERLDQ

SEQ ID NO: 130092 - protein, 35 aa, Heterodera glycines
  Coding regions on vcDNA: vcDNA=SeqID_56515; Strand=+; Position=1 -61,285-331
MLELNSNKTKKVQLEEFIMCICISAVDEPFKRKVD

SEQ ID NO: 130093 - protein, 244 aa, Heterodera glycines
  misc_feature (5)..(5): Xaa can be any naturally occurring amino acid
  misc_feature (8)..(8): Xaa can be any naturally occurring amino acid
  Coding regions on vcDNA: vcDNA=SeqID_56516; Strand=+; Position=1 -122,173-268,590-697,753-880,948-1078,1806-1885
  Homolog annotation: Hit_ID=NP_497892.1; Match level="QueryCoverage =95%, HitCoverage=94%, E-value=6e-75, Identity=61%"; Hit description =peroxiredoxin, thioredoxin-dependent peroxide reductase, mitochondrial (24.9 kD) (3F499) [Caenorhabditis
VVNRXTRXQCWAGPDCATTRHQTADAIRPLGPKSSVPSFKGQAIVNAEMKTISYDDYKGGQAIVNAEMKTISYDDYKGKWLIFFFYPLDFTFVCPTEIIAFSDRVAEFKQLGCEVIACSCDSQFSHLAWVNTPAWVNTPRNDGGLGKMEIPVLSDFSKKIAADFGVLDKETGLSYRLFLIDPNGTVRHCLVNDLPVGRSVDEALRILKAFQFFEKHGEVCPADWEEGGETIDVKSPKEYFKKQK

SEQ ID NO: 130094 - protein, 339 aa, Heterodera glycines
  Coding regions on vcDNA: vcDNA=SeqID_56517; Strand=-; Position=1 -39,89-232,321-433,483-572,625-720,768-849,884-1078
  Homolog annotation: Hit_ID=AAR05390.1; Match level="QueryCoverage =98%, HitCoverage=13%, E-value=9e-42, Identity=35%"; Hit description =selective LIM-binding factor Wimple [Mus musculus]
MRLKYLSSVVSASDEISCAGDEISCAGALCYSPNGRKLAVGTPDRHILLFDDKFRRRDKFGTKPMEPKFGKMSYLIKCFGKMSYLIKCAVFSPDSAKLAVGQTDHIVFVYRLGDTWNEKKVICNKFAQSSANEKKVICNKFAQSSAVMAQCWPTESKLIIGLLDGKVRCLLDGKVRCASASSNKCSTLYRAETAVTVLAQHPNRKSFLSGHSDGTIFLYSFLAQHPNRKSFLSGHSDGTIFLYSFETRSHARLKSQVCVHPCAPQALLLSAVGIETRSHARLKSQVCVHPCAPQALLLSAVGILAAGTDRRIVSYSEHGAMQQFDYSINNYKREFNCLI

SEQ ID NO: 130095 - protein, 152 aa, Heterodera glycines
  Coding regions on vcDNA: vcDNA=SeqID_56518; Strand=-; Position=1 -168,768-1058
MSFSAIVNNLSAKVDNLSGVVNNHSVKLDNLSGVVNNLSGVVNNLSAKVETIEKKMAVMGAYNENNGTIEVTLHGYNVGKAIVERILNTENGTVHLHGMREPMSLAKAVEIGFFDNLSLTVVDPNTTQKAVFGRNIGTEKKYFCQARVIFFF

SEQ ID NO: 130096 - protein, 161 aa, Heterodera glycines
  Coding regions on vcDNA: vcDNA=SeqID_56519; Strand=-; Position=1-486
  Homolog annotation: Hit_ID=EAL35225.1; Match level="QueryCoverage =73%, HitCoverage=39%, E-value=2e-21, Identity=51%"; Hit description =hypothetical protein Chro.30409 [Cryptosporidium hominis]
MVNSPAPNFLNLKEVFGNGSDKLKMDELTKDGGKEKEENEEEKEEEKEEEKEKEEEKEEETKEEEEKTEEEVTEEGNGEEKEKEEETEEEEEEEEECENGQKRETDEEEDEIERIIMSSSHLLKCEEVNRRTMSLVQSCSAHANLVGLQNREGMERDFFGY

SEQ ID NO: 130097 - protein, 209 aa, Heterodera glycines
  Coding regions on vcDNA: vcDNA=SeqID_56520; Strand=-; Position=1 -121,226-641,1011-1103
  Homolog annotation: Hit_ID=EAL49477.1; Match level="QueryCoverage =30%, HitCoverage=6%, E-value=3e-22, Identity=61%"; Hit description =hypothetical protein 42.t00003 [Entamoeba histolytica HM-1:IMSS]
MTCFECGTPYVLNMDGSRSLAPFNVICDGSKYCTGKYCVTRKSQYPRSFCATSWEDPKAIQCQKVNDPYDDQECICDRNFCNYPYDPMNPPPPTTTLPPPPPPTTTLPPPPPPTTTLPPPPPPTTTLPPPPPPTTTLSPPPPTTTTILATTSAYVITCPDGRQFGPNDLAVYMGQILKQAILGTYSNAFGNSALDSYKDGINTHICNYM

SEQ ID NO: 130098 - protein, 36 aa, Heterodera glycines
  Coding regions on vcDNA: vcDNA=SeqID_56521; Strand=-; Position=1-107
FALRLEHLGQRPAESDSNLRTEFDGPFSVETTLIIL

SEQ ID NO: 130099 - protein, 27 aa, Heterodera glycines
  Coding regions on vcDNA: vcDNA=SeqID_56522; Strand=-; Position=1 -37,88-134
MRGFGVPEIIQQALFCFFKPSISEILT

SEQ ID NO: 130100 - protein, 57 aa, Heterodera glycines
  Coding regions on vcDNA: vcDNA=SeqID_56523; Strand=-; Position=1 -87,309-395
MKNDQQKQEQLFGKITELEKKMNKQQIKMTLLTLRGNYWDATACNNGIEITDKFDSC

SEQ ID NO: 130101 - protein, 111 aa, Heterodera glycines
  Coding regions on vcDNA: vcDNA=SeqID_56524; Strand=-; Position=1 -85,191-299,618-757
  Homolog annotation: Hit_ID=NP_509543.2; Match level="QueryCoverage =83%, HitCoverage=33%, E-value=5e-18, Identity=50%"; Hit description =putative protein, with at least 6 transmembrane domains, of ancient origin (30.4 kD) (XJ777) [Caenorhabdi
MIDGILSKHLRNIDQNNSVAMAQLHIRLAFLRKVLGILAFQFLATIGLGVAFYITDGVKVFIQQQPWFPFASFFGSIALLFAMFVYARSVPLNYFLLSGWTILQAVTVGTI

SEQ ID NO: 130102 - protein, 47 aa, Heterodera glycines
  Coding regions on vcDNA: vcDNA=SeqID_56525; Strand=-; Position=1 -90,313-366
MSAGRALRTSVLYKIGVDHFLLRLTVFRVQEKRRPLPKHSFSSSIDW

SEQ ID NO: 130103 - protein, 248 aa, Heterodera glycines
  Coding regions on vcDNA: vcDNA=SeqID_56526; Strand=+; Position=1 -102,159-248,434-514,574-663,720-800,859-1083,1137-1211
  Homolog annotation: Hit_ID=EAL47359.1; Match level="QueryCoverage =62%, HitCoverage=29%, E-value=5e-11, Identity=29%"; Hit description =hypothetical protein 106.t00024 [Entamoeba histolytica HM-1:IMSS]
MFPNDDGYESEDDEILLPPPPIPPQLGHPPPNVPAVRVQPIHVGQQRLPLRDLPQFEDHPQNVPAIRVQPMQQPVPMRAVPQFPHPPPNAPEICVGPIHDGQQPLPLRALPQFAQPPPNVPAVRVQPVQQPIPLRDVPLFVNPPPNVPVIRVQMPQPLLRDMPQIHHPPRNVTSIWIKLWLLFLSLWVFLQGIHVRQIQREYAVPQFAHPSPNLPYHPPENVPAIQPRQQPRQLRDVPLFDHPLPNGQ

SEQ ID NO: 130104 - protein, 289 aa, Heterodera glycines
  Coding regions on vcDNA: vcDNA=SeqID_56527; Strand=+; Position=1 -102,160-249,307-387,586-675,732-812,869-1100,1154-1228,2180-2298
  Homolog annotation: Hit_ID=EAL47359.1; Match level="QueryCoverage =70%, HitCoverage=32%, E-value=4e-11, Identity=28%"; Hit description =hypothetical protein 106.t00024 [Entamoeba histolytica HM-1:IMSS]
MFPDDDGYESEDDEILLPPPPIPPQLGHPPPNVPAVRVQLMHVGQQRLPLRDLPQFEDHPQNVPAVRVQPVQQPLPLRDLPQIFHPPPNVPEIGVGPIHDGQQPLPLRALPQFAQPPPNVPAVRVQPVQQPIPLRDVPLFVNPPPNVPVIRVQPMPQPLPLRDMPQIHHPPRNVTSIWIKLWLLFLSLWVFLQGIHVRQIQREYAVPQFAHPPPNLPYHPPENVPGNPTTATTAPAERRATIRPPVAKRTGLFYALENARNYQLMGKSITEDKFRYLMKTEKKQRQLAM

SEQ ID NO: 130105 - protein, 203 aa, Heterodera glycines
  Coding regions on vcDNA: vcDNA=SeqID_56528; Strand=-; Position=1 -174,234-650,770-790
MDTKLSILAKELPTKREMFENAKIGDIELATFMLDFHAELSQAGQTNSYWANESDQTMKDYLQKAEELFRLANELIKPLKKIAGQQMEELIKRLEPEISKLISLIDDQENSEELSEQLEKRVDKIKEIGCKAMGIVLTIDTPKKEEICKTVEEIEKVTKELEKNTGKSDKVKAKMRKLKKLLENDNKQFVERPYKMERKRKGI

SEQ ID NO: 130106 - protein, 133 aa, Heterodera glycines
  Coding regions on vcDNA: vcDNA=SeqID_56529; Strand=+; Position=1-530
FLSPPRLFLFHGFQFFFCHFQIFHLTKCFIFLYKFDEIAQCLLNFIFIFHGHLINQIRLNFNHQSVKLPSKLINDCPHGRQQFGVTKDGKRSNLASLSAGVRPWKILTQKSYKIRMPTLGKKKKLCQFLIYSF

SEQ ID NO: 130107 - protein, 124 aa, Heterodera glycines
  Coding regions on vcDNA: vcDNA=SeqID_56530; Strand=-; Position=1 -189,452-637
MKQFLFTFFNILIFSFSSFKFSVSTRDEEWEKWEEWKTQSQEIIEEIQKVQLDQKYLLRMNIKDFCVKIFHGLTPAESDAKFDLFPSLVTPNCCRPCGQSLMSLEGNLTLWWLKLRRIWLIKCP

SEQ ID NO: 130108 - protein, 171 aa, Heterodera glycines
  Coding regions on vcDNA: vcDNA=SeqID_56531; Strand=+; Position=1 -255,735-995
MGFYSLVEDKLMKEINGLPTLCQNFFKNFLEKIDFKQMMDDLMHYQQIRASLKHPKMNKIGDTVNIKVTVVQQLASLLYYGLLYQALLDELNKPKNLSKRDAAKFWIKNFLIFSLAAIRAEFNMAKYEMENGLDDDRINLLPKFSIGRHYNEKLAKKLAEWTDRMQKRHQT

SEQ ID NO: 130109 - protein, 299 aa, Heterodera glycines
  Coding regions on vcDNA: vcDNA=SeqID_56532; Strand=-; Position=1 -124,178-273,319-678,730-1049
MVFSRDKSGLAKQMNSLSAKARRKRKEWRQDRAQKGGSTPKSLKQTLAVPTADGEETSTQAAESGPSTSTLDLRPRSSTRPLSATPVRHHVRVRPKTTDKATNMDFKTTDKATNMDFTTTDNATHMDLTTMDKATDVDLAYEDAATQTEQLDKQLKEQEQTISFLRLQVRNRDAMIADLRRQLEQQAQKDQPTPSTRRKKNAATLEQTSRRNLAKKIADVIDRDRSRSVSRCSLQSLHREVRHKFGHYTPMKKEQLRQQQTIHEEDGLFLLSQLGTQKAYERMKALLRLIGGKFDVYRP

SEQ ID NO: 130110 - protein, 188 aa, Heterodera glycines
  Coding regions on vcDNA: vcDNA=SeqID_56533; Strand=+; Position=1 -164,345-453,609-904
  Homolog annotation: Hit_ID=NP_700830.1; Match level="QueryCoverage =84%, HitCoverage=28%, E-value=3e-09, Identity=28%"; Hit description =hypothetical protein PF10_0357 [Plasmodium falciparum 3D7] gb|AAN35554.1| hypothetical protein [Plasmodiu
SLKSDAVPNVGYPNATPTPLDKKAKKQKRRNDGNSAIHQTVKQMIVGEVAKGNGKANRHKGKRKVTFSSESSGNEYYADNSEQKSEVVRKDLIATNGQFSEDSMENEEESLDDDLEEEEEEIGEDLEDEELEEADDDELRNGNLEDEEEANSSFFTSDDESLEDEIGEESGEGPTNPTILIGLNYSNV

SEQ ID NO: 130111 - protein, 36 aa, Heterodera glycines
  Coding regions on vcDNA: vcDNA=SeqID_56534; Strand=+; Position=1 -78,652-684
MALNLTYLLTLSLYCSNSMHEVGAVQVFEFFFAVKI

SEQ ID NO: 130112 - protein, 511 aa, Heterodera glycines
  Coding regions on vcDNA: vcDNA=SeqID_56535; Strand=-; Position=1 -1079,1242-1411,1456-1536,1624-1830
  Homolog annotation: Hit_ID=EAL49477.1; Match level="QueryCoverage =87%, HitCoverage=50%, E-value=2e-21, Identity=23%"; Hit description =hypothetical protein 42.t00003 [Entamoeba histolytica HM-1:IMSS]
KFEKRKEEKEVKVKRKKKKAKQKKQKKAAEEKEEKEGENTVIGEEREEGTNTVEKDTVGKESDQKEGKENEERKEEKAGKDKENTVIGEEREEGTNTVEKDTVGKESDQKEGKENEERKEEKAGKDKENTVIGEEREGGPNTVENVTVEKGSDQKEGKENEEREEEKVGAYSEGITEIGENNLVENNRKMKMREFGDGKFLAAKYDEYLEIINKGQQQNEQHTEEMGKSIALLNIGVLSNEISNRLEAKEWEANGSQRKSIGEQWERLKRTEYSQAEREGKEEKHLEKICQIIGEIVGAMGENREKGGAKCDQIIGQLHQRKLGEAIKEGKVKNWEEMGESSKKMALLNLYNGTMAEKKNQKLFYEYKNNANLTTIAEEKDKCQFKENNSQLFQTEKFQELNSAEEKKRKFRETEKVKKEIKLKNGQKNGREMAEIKQIFDEWSDAAHFQFPSLFFLRDTHSKFATICILPEEFEEKLIFGESNCDEKTEQRADKCSDNSLFCALCKVMEN

SEQ ID NO: 130113 - protein, 542 aa, Heterodera glycines
  Coding regions on vcDNA: vcDNA=SeqID_56536; Strand=-; Position=1 -82,129-713,760-1236,1411-1895
  Homolog annotation: Hit_ID=AAF75554.1; Match level="QueryCoverage =42%, HitCoverage=17%, E-value=6e-10, Identity=24%"; Hit description =mature parasite-infected erythrocyte surface antigen [Plasmodium falciparum]
MKVSLNHLTNGKYLTLLENEFPEVLRIDILTKKSVVYRVQQMLMNRSNSELYINNFVLFVTALLVDQMARLHSQFGATARPKASPALRLLADKANAAAEDALRHFGSTSQLCVMNTILIFVWEVNIEKKAENVTKKAVKKLGTSECEEWRVQRQAMAEAMGTRLGTLITAAIAELLMIDKTKVQSALKYPGAQIRLLRLAGTVKRTDQLTEHFDLAQLFVNNALTNDDDFWVHYLQAMCRADKIERKSHKFGADLAAFVRWLRQKLTVERRLNSHFVLIRNYISDQIYNPIFDAEETTLMGGEEFLEKLFWGTKKMVEKLKGTEKKSENLFERWKLIAEEKKEAKKAKNGEFEAKKRWVGQIHAEEMRKLLKNGKLSQLSEVLNVFGSKTIREGLLQFFDVNEIDELFKDFKLKENKKTQIENLEDYFSEDEESEEIEEEFEQSEEELDEEDEEGEDGREDEFEGDEAPKKQKEIVAPENAKECAKRMSDRKEGEILECDQTEDNALADHRQNEWRSAVPSPSSANVSAFSVLGQFKIVSSL

SEQ ID NO: 130114 - protein, 159 aa, Heterodera glycines
  Coding regions on vcDNA: vcDNA=SeqID_56537; Strand=+; Position=1 -122,169-226,285-333,390-541,913-1009
  Homolog annotation: Hit_ID=EAL31478.1; Match level="QueryCoverage =71%, HitCoverage=20%, E-value=1e-23, Identity=51%"; Hit description =GA14544-PA [Drosophila pseudoobscura]
MSSPNDVEQNEEKGPMKCQSFRWHSDGAEDEYGRYPFTEYPKKRQKILSTVLEAIGNTPMVKLNKIQSEFGIECDIYCKCEFLNPGGSVKDRTALRLVENAERVGRLRAGMTVIVPFSGNVGIGVAMNEAGTAMCHFDGTAEEILDALDGAVEMVVIGV

SEQ ID NO: 130115 - protein, 234 aa, Heterodera glycines
  Coding regions on vcDNA: vcDNA=SeqID_56538; Strand=-; Position=1 -262,313-755
MVFEQRTKQTNFAAINVKFLFILIFLICLSNFVLSGKNQWKKQNKLEEETEQKTLWNIPPKQKVIDERHRCPEKEGKKRTEKATEENDDERIELMNIFKNFIRNESKNKRTEKLKMRINSLKLVLERTIGGILAFARKIGTKNEQKGEFIEEIEKWENKRREIEEKAGQKKMDGKMNNWLMWICLMYELGTKMVEGMAKHAAAQKGSLMVEAWRKYAKEKHIADILKVGGGNGH

SEQ ID NO: 130116 - protein, 369 aa, Heterodera glycines
  misc_feature (363)..(363): Xaa can be any naturally occurring amino acid
  Coding regions on vcDNA: vcDNA=SeqID_56539; Strand=+; Position=1 -95,167-249,305-574,800-961,1029-1116,1527-1746,1795-1867
  Homolog annotation: Hit_ID=AAH44091.1; Match level="QueryCoverage =92%, HitCoverage=55%, E-value=1e-102, Identity=56%"; Hit description= Cbs-prov protein [Xenopus laevis]
IAFHAISAAIGGTPLVKLQRLPREDGIEAEILVKCEFLNAGGSVKDRVKCEFLNAGGSVKDRIARKMVELAEAKGILRAGQSTGILRAGQSTIIEPTSGNTGIGLALMAAIRGYRCIIVMPEKMSWEKECVLRALGAQIVRTPSEKGYTDADSHIGVALRLQREIPGAVILDQYRNDGNPLAHYEGTAEEIIWACDGKLDAVVVGAGTGGTMTGIAKKMRQKLPNCKIIAIDPEGIIAIDPEGSILANPNRQTHAYEVEGIGYDFVPYTTDRNLVDEWIKTNDANAFRTARRLISGEGLLCGGSSGANVAAMEVAKRMGRGKRVVTILPDGIRNYMSKFIDDEWMSKFIDDEWMRVKGFEGIXKRGQKK

SEQ ID NO: 130117 - protein, 25 aa, Heterodera glycines
  Coding regions on vcDNA: vcDNA=SeqID_56540; Strand=+; Position=1 -73,1122-1126
MKVFTVGLDQKPPLEEAKGSPEKSD

SEQ ID NO: 130118 - protein, 95 aa, Heterodera glycines
  Coding regions on vcDNA: vcDNA=SeqID_56541; Strand=+; Position=1 -95,359-551
MGYENAGPYDYYHRASSAIGEKFDRLFSLAKSNELPPSLPISASMDRDPSTTSTTSAPAQPSEPVVAIDSFPQFMGLNGRRVHQPFGPQQNSVEV

SEQ ID NO: 130119 - protein, 198 aa, Heterodera glycines
  Coding regions on vcDNA: vcDNA=SeqID_56542; Strand=+; Position=1 -137,502-751,1072-1278
MEQPMPQMFGSNGMTNSGPFSQVRDARLQFLRNILQKIKQHAEDIGFDGTMQVSIIEVEPQNGADGAETAAQENGNINNNNNIWGPQQRGVEMGQQPQQQQQQSLPAQMAFPMPQHFFPHPRPLIDDFKNSRSFLDGFGEFHPPSFVQQQQQQMNNHITEPEERPRMFGPWAQQQQMPNMPDEFQQQQQQQQQQQQPN

SEQ ID NO: 130120 - protein, 130 aa, Heterodera glycines
  Coding regions on vcDNA: vcDNA=SeqID_56543; Strand=+; Position=1 -36,150-506
  Homolog annotation: Hit_ID=AAL77223.1; Match level="QueryCoverage =41%, HitCoverage=3%, E-value=2e-10, Identity=60%"; Hit description =Bck1-like MAP kinase kinase kinase [Podospora anserina]
MNLRFPPIQPPQVNNEWAQQQQQQQNALQLQQNGAAALPRPAAFDRWNGGPPPSSSNNGFFVPPPPSPQFAQQQQQEQTEQQQQPQPQQSVVQQQQQQPQPQPLQQQVVSGGDWHSFLATKTQSSKELKQ

SEQ ID NO: 130121 - protein, 239 aa, Heterodera glycines
  Coding regions on vcDNA: vcDNA=SeqID_56544; Strand=+; Position=1 -191,565-705,994-1227,1802-1957
  Homolog annotation: Hit_ID=AAG27458.1; Match level="QueryCoverage =88%, HitCoverage=21%, E-value=6e-11, Identity=26%"; Hit description =latent nuclear antigen [Human herpesvirus 8]
DKTDPDNSKDDDDNDDDENSNANRGTGTMFGAGPPSAQPSDIVKFPTVTVVEAAKNEHDDAVEPIPTSLGTEQPAAPPAQPTPAAATPQVQAAGAAVAPSQTEHQQEKKEQSADELVEVDAPPQPIVPQQNNQPAQPQQQQPQQQQQEEMTKTEQEQPQLNQQQQPSPPGISPFQQKWFPEVPSVFFQKDNSREEIEKTEKVFESMVQNMKRMIGKMFKVDDSDSTEIVQVKIKPIEAF

SEQ ID NO: 130122 - protein, 92 aa, Heterodera glycines
  Coding regions on vcDNA: vcDNA=SeqID_56545; Strand=+; Position=1-501
KKNNFVSKCQKLQKFNPPKPLLYFENVNSIVQPPKSHHSKCVTVKVICIHSFVEFCVFFLNFPGCFGITSSRVPRLKMELIGADQKLSAAGQ

SEQ ID NO: 130123 - protein, 21 aa, Heterodera glycines
  Coding regions on vcDNA: vcDNA=SeqID_56546; Strand=-; Position=1-62
EKRAGAETGAPKRERRNAWVP

SEQ ID NO: 130124 - protein, 78 aa, Heterodera glycines
  Coding regions on vcDNA: vcDNA=SeqID_56547; Strand=+; Position=1 -78,778-933
MGRNGYRVRDSDQQNGSSVPQFRPGPAKNETEIGDDNKSAQSEHENEHEKKPNNEMSRINGGDETNERETNKTESEEK

SEQ ID NO: 130125 - protein, 446 aa, Heterodera glycines
  Coding regions on vcDNA: vcDNA=SeqID_56548; Strand=+; Position=1 -59,262-372,424-865,917-1092,1792-1918,2124-2326,2566-2790
  Homolog annotation: Hit_ID=NP_573364.1; Match level="QueryCoverage =42%, HitCoverage=40%, E-value=1e-09, Identity=26%"; Hit description =CG7874-PA [Drosophila melanogaster] gb|AAF48935.1| CG7874-PA [Drosophila melanogaster] gb|AAO45238.1| GH1
FDGTNWQHKVKTRKPKVPMPNIGNANEGEEEKMPQPERAQITHMSREGDKMPEKEKANSNSDTAEQQPKHQHELEIGQFRSPTAEANDGSEGFEVITREENGGHQTEEGEEEQKANEGEKMPKSSGNAENTGQGEGTQSAATTTTSALASTTTTSETETAKQTERTTEQPQSSPREEGAGGGAANGPADTEVDILAPRGPPAADETDKEKTEVPLLPAEEKPSTTAPTEQTQTTPKTTEAEEEQTTPTPTTTAISAGHGVETLHSALSAAIGPGFLDYQIEALHQGSVIVEGQLLSREEISDAQSLPAHGPNGNGVAANQRQQEEEASQFGSKCSFLGFEIQAESTGYIIGGAVVVGVLIVVFAIFAIVVFGHRTEDDNARHGQCHQRTKHRRKAQRNERAAAADHPKRLAIFHSVGVHFSEQQTLRGGDRIARSVIDQRIVIFEL

SEQ ID NO: 130126 - protein, 48 aa, Heterodera glycines
  Coding regions on vcDNA: vcDNA=SeqID_56549; Strand=-; Position=62 -134,234-304
MPSLCSSPLRVHRLNGRPTAQPMQCVFARRANGLARAEIHATERAPLV

SEQ ID NO: 130127 - protein, 194 aa, Heterodera glycines
  Coding regions on vcDNA: vcDNA=SeqID_56550; Strand=-; Position=1 -82,256-332,383-768,820-859
MVLAQTICMGKLWEGSEKKHSHGIGNGPLAKIRNKKDENAIIGPIRMTKFSEKFENFVVFKCFGTSFNVKNFCGFVGKRLRYELLEFVENPLAFWVDFCHVFPKAIALSKCQTDGSKICELAWIVGIQMAPNQKANGTFKRKLNAKLSKKLEAKLQGDFEKGSFHNIQLKAEMASGETVRNWIAKEEREEDEEE

SEQ ID NO: 130128 - protein, 84 aa, Heterodera glycines
  Coding regions on vcDNA: vcDNA=SeqID_56551; Strand=-; Position=1 -243,359-370
  Homolog annotation: Hit_ID=CAE64938.1; Match level="QueryCoverage =79%, HitCoverage=17%, E-value=1e-12, Identity=44%"; Hit description =Hypothetical protein CBG09769 [Caenorhabditis briggsae]
MFAASSPPPDGFRPLFAEERRDALKERPLRFWRDWDERRSRIMGQGLGPKNAWEEQIQWTERGMMWPYPIDNDYMAGEEEKENM

SEQ ID NO: 130129 - protein, 264 aa, Heterodera glycines
  Coding regions on vcDNA: vcDNA=SeqID_56552; Strand=-; Position=1 -211,379-679,755-850,977-1042,1096-1122,1192-1245
  Homolog annotation: Hit_ID=NP_502225.1; Match level="QueryCoverage =93%, HitCoverage=34%, E-value=6e-50, Identity=48%"; Hit description =c2, putative phospholipid binding domain containing protein (70.2 kD) (4M511) [Caenorhabditis elegans] em
GSALISVPTRHFTPTVSRERKKRQKNASKKRHRPPLPSMVSCGTLRFLLAECRREYTWLDFVGGGMQLEFMVSIDFTASNGDVRLPNSRHFIDHLCLNQYEIAIRSVLEICQHYNDSKQFEAFGFGAKVPPNQTTVSHLFPLQANAQPAARGVDGVMDAYRTTLQSVLLYGPTSVLLYGPTYFEPTVRYASQKCANFPRDGSRYQILLLITDGLIYDMVKTKLAIIEASSLPLSIIASSLPLSIIIIIIGIGDEDFSKMDEDSD

SEQ ID NO: 130130 - protein, 287 aa, Heterodera glycines
  Coding regions on vcDNA: vcDNA=SeqID_56553; Strand=-; Position=1 -381,790-1013,1063-1154,1216-1313
  Homolog annotation: Hit_ID=NP_080091.1; Match level="QueryCoverage =96%, HitCoverage=43%, E-value=4e-35, Identity=35%"; Hit description =copine family member [Mus musculus] dbj|BAB23372.1| unnamed protein product [Mus musculus]
SARHSAHAGGVNALGQVSTAGESTKKWPKNSRDLKDKDLLSKSDPMCVIYSLVPGKGGTGPEYVEIGRTEVIWNNLNPRWNTKVTLNYFFETKQQLRFDVFDIDTENTRDLSSQDFLGVFCLGRVVGKEGMKKVPNFGDEPGQEGKLIIRADEVDEGQKEMVRMVCHGQQVASKGIFSARDPFLEFHRLYADGSWVFCYRTEVQTRTVDPEWKPIEIYRTEVQTRTVDPEWKPIEISVRHLCQGDKNRDFLVECFDDFLVECFDYKLAGVSHFSINYLNSSGGQKWG

SEQ ID NO: 130131 - protein, 79 aa, Heterodera glycines
  Coding regions on vcDNA: vcDNA=SeqID_56554; Strand=-; Position=1 -90,416-565
  Homolog annotation: Hit_ID=NP_505828.2; Match level="QueryCoverage =78%, HitCoverage=18%, E-value=5e-14, Identity=44%"; Hit description =diacylglycerol acyltransferase (58.0 kD) (5L600) [Caenorhabditis elegans] gb|AAF82410.1| diacylglycerol a
MYKPFVRNGFGRWHASLAVFATSAFFHEYLGGRAGNIVVWLSLILGQPMAILMYVHDWYFLHHPELHAAHRQNLTIAHF

SEQ ID NO: 130132 - protein, 169 aa, Heterodera glycines
  Coding regions on vcDNA: vcDNA=SeqID_56555; Strand=-; Position=1 -120,277-428,527-636,2114-2240
MIRNKLESLQESRKKRYLSDISNTTEEDVNLGVKFVEPNADLDSHTTQEIAEDAQIEFFSIILAVFSWNANVLPLLLSNIYRLDTAPDVGCYTRDNNFDYQLGTSYAATPRVRHRLTGTINSYMANHYTYGTHKWTEAQRSIVKIEGQRQFAEKGKGNNKRSKCHQQQK

SEQ ID NO: 130133 - protein, 111 aa, Heterodera glycines
  Coding regions on vcDNA: vcDNA=SeqID_56556; Strand=+; Position=1 -328,440-780
STQFSPTGNHCLLDLCIYFQKLKFLATLGTIILTINSEQAMRLPLEFGTGSPAPSTLKLNKKIHLQHGRTKSFGHHIFQFRRHSQIEGYAGKLKDLKILMIQLSMSRNEFY

SEQ ID NO: 130134 - protein, 26 aa, Heterodera glycines
  Coding regions on vcDNA: vcDNA=SeqID_56557; Strand=+; Position=1 -214,277-520
TQITNTNVYQKHDTHNCVTLNSNNKH

SEQ ID NO: 130135 - protein, 61 aa, Heterodera glycines
  Coding regions on vcDNA: vcDNA=SeqID_56558; Strand=+; Position=1 -10,244-313,962-1067
MIIKKCTDKERSPSVRGVSEPKFGRFCHFFDEAPEGVQHGQNRLCAREESRVLGEGEELGN

SEQ ID NO: 130136 - protein, 152 aa, Heterodera glycines
  Coding regions on vcDNA: vcDNA=SeqID_56559; Strand=+; Position=1 -58,1369-1769
MKLPLPVCLVPVPPVKICTGNIIYYCSMLIIPFWIILFLNVARWGILSMPEKMVGNGLNMGQLIQNDQNPNQIENQNGPNLDQIANQNDSNLDQIDLNAPNPDELIETGKLGEVPILLPRKYQDRTIQVEFIAHKIISDAETRQKFFKPVEL

SEQ ID NO: 130137 - protein, 48 aa, Heterodera glycines
  Coding regions on vcDNA: vcDNA=SeqID_56560; Strand=+; Position=1 -133,206-219
MFTNFPLLFSAFSIFLLLLTLQFPPKVLGMFSNYNVLPLYQKNNGFNG

SEQ ID NO: 130138 - protein, 95 aa, Heterodera glycines
  Coding regions on vcDNA: vcDNA=SeqID_56561; Strand=-; Position=1-287
HLFDLSNSIICTNGSSMANASVISMAAAISKGSLLSQCQSQQTTKQSERPNDFDGHFVGATDCASRQRTYALSDSPVSSPLKQPAEAAGTVKIPK

SEQ ID NO: 130139 - protein, 92 aa, Heterodera glycines
  Coding regions on vcDNA: vcDNA=SeqID_56562; Strand=-; Position=1 -252,419-445
MAIHCPASPIAAPFLLPLLLLLSPFVVQLNGISFVPSPLGFINPFIEGNLRFGPNGQFEASPISPTPLVSQTVPGWLLSRNVRGFTRPRKKT

SEQ ID NO: 130140 - protein, 72 aa, Heterodera glycines
  Coding regions on vcDNA: vcDNA=SeqID_56563; Strand=-; Position=1 -108,333-443
  Homolog annotation: Hit_ID=CAE59493.1; Match level="QueryCoverage =100%, HitCoverage=62%, E-value=1e-14, Identity=45%"; Hit description= Hypothetical protein CBG02878 [Caenorhabditis briggsae]
MDDLMDEGVTDEEGFFHLSGKESEITPIEPKVNIYHLPASYITDGPVAEKVFPLGTLNLAGSFKGETRDCLN

SEQ ID NO: 130141 - protein, 116 aa, Heterodera glycines; identical to SEQ ID NO: 127487
  Coding regions on vcDNA: vcDNA=SeqID_56564; Strand=-; Position=1-351

SEQ ID NO: 130142 - protein, 118 aa, Heterodera glycines
  Coding regions on vcDNA: vcDNA=SeqID_56565; Strand=-; Position=1 -161,228-423
MEDKFKEDLLQYLVSAGKAESASFRLNDQINAHSADHSALKQLFLSLESVIEPFKTQSEVIGLIGTELGWRPVIKLLQALLINGFATADVVLKERALKVLAELIPMYTSSAIGPHWSK

SEQ ID NO: 130143 - protein, 391 aa, Heterodera glycines
  Coding regions on vcDNA: vcDNA=SeqID_56566; Strand=-; Position=1-1174
  Homolog annotation: Hit_ID=XP_318550.1; Match level="QueryCoverage =94%, HitCoverage=36%, E-value=7e-70, Identity=38%"; Hit description =ENSANGP00000020240 [Anopheles gambiae]
MANDQPLQTVLQFLRNGWPAKVADSEISPYFPKRDKIFEVDNCLLYEDRVIVPTSLRSRILKALHIAHPGIVRMKALARRHVYWPGMDSAIEKVVSTCEECQLGQKNPTKAPLSPWPTTDKVFQRVHIDFAGPCSDGHQYLILIDSFSKWPEVYRMNTISAYATVFVLRSIIYRLGIPEEIVSDNGTQFRSAEFATFCKEFGIKHIFIPPFHPQSNGQVERFVDTFKRSMKKMSKGGKDWIEKMLFSYRTTPHVALNGFSPDQLFFGRKLRTKLSLVHPNGEKAENFDQNSFKKGQSKYTDKMAQNFDRKHGSKVINFSPNDHVLLINYRNNKTEWLQGKIVERLHNSPTYRVYVPVLRRLVHRHANQLRRRHLLEDEARKRGTSSRTAAA

SEQ ID NO: 130144 - protein, 376 aa, Heterodera glycines
  misc_feature (7)..(8): Xaa can be any naturally occurring amino acid
  Coding regions on vcDNA: vcDNA=SeqID_56567; Strand=-; Position=1 -144,192-338,495-575,624-753,799-893,938-1010,1061-1223,1268-1328
  Homolog annotation: Hit_ID=CAE61696.1; Match level="QueryCoverage =88%, HitCoverage=52%, E-value=1e-115, Identity=66%"; Hit description= Hypothetical protein CBG05644 [Caenorhabditis briggsae]
LINFVQXXNALMRMAGGDLSVGCQWPGSKDEYELQDAIGVGATATVFKAFCKSKNEMCAFCKSKNEMCAIKSINLEKCQTSVDELSHEIQAMSLCSHPNVVNYYTSFVVGEELWVVMRLLNCGSMLDILKRKIKAIGKDQAIGKDQAAYGVLDEVIIATVLKEVLRGLEYFHNSGQIHRDIKAGNILLANDNILLANDGTVQIADFGVSGWLAASGGDLSRQKVRHTFVGTPCWMAPEVMEQVLSRQKVRHTFVGTPCWMAPEVMEQVSGYDFKADIWSFGILCIELATGTFKADIWSFGILCIELATGTAPYHRYPPMKVLMLTLQNDPPSLETNADRKEQYKAYGKSFRTVIKDYGKSFRTVIKDCLQVWNGAT

SEQ ID NO: 130145 - protein, 143 aa, Heterodera glycines
  Coding regions on vcDNA: vcDNA=SeqID_56568; Strand=-; Position=1 -215,371-520,570-638
  Homolog annotation: Hit_ID=CAG31921.1; Match level="QueryCoverage =94%, HitCoverage=40%, E-value=1e-20, Identity=38%"; Hit description =hypothetical protein [Gallus gallus]
VADTYARISHGLEKFGQLEAASGEKEFGQFLGKVTTSFEKLKKAEARVGTDEELKEVDTLRYFLGETQAAKAENEQAEACKKFEMISKLAKTELTELKKERIASFKKNLSELADLEVKQSKAKIVILQSAIAALNEMIGAQNN

SEQ ID NO: 130146 - protein, 252 aa, Heterodera glycines
  misc_feature (10)..(10): Xaa can be any naturally occurring amino acid
  Coding regions on vcDNA: vcDNA=SeqID_56569; Strand=-; Position=1 -133,804-938,998-1119,1178-1301,1359-1512
  Homolog annotation: Hit_ID=NP_507518.2; Match level="QueryCoverage =82%, HitCoverage=37%, E-value=5e-58, Identity=50%"; Hit description =phox-like (5S448) [Caenorhabditis elegans] emb|CAB60945.2| Hypothetical protein Y59A8B.22 [Caenorhabditis
QMEMWDFQKXFVIKLTRTLRKATVETQHPIVVNISDALSEREKVKYTVQTKTNAPEFARVEMSVVREHDEFIWLHNCLEDNEEYAGFIIPPAPPRPDFDIPPAPPRPDFDASREKLQKLGEGEATMTKEEFVKMKQELEQEYLATFKKTVEYLATFKKTVALHEKFLTRLAAHPVFQKDQNFRVFLEYENDLSVRSRNKKELSVRSRNKKEIVGSIFKRFTQTADEVFLSGQVLSLFSFLFFLSFALNAENL

SEQ ID NO: 130147 - protein, 130 aa, Heterodera glycines
  Coding regions on vcDNA: vcDNA=SeqID_56570; Strand=-; Position=1 -100,405-520,1695-1871
MSATVCFLSGWHLLQGNTAGIMATDGPHTEIGVELYGGRPAQHGRVDDGQRDEKRRQRATPQAETDEEHPSILPEDAGWFDRRPGGVFLKMLLHISLACFAVFMIPYTYEKVVPEEYRCKIKYKKNDGHH

SEQ ID NO: 130148 - protein, 122 aa, Heterodera glycines
  Coding regions on vcDNA: vcDNA=SeqID_56571; Strand=-; Position=1 -141,439-666
MTSPTDQQEPIQTTEAADDKAKSDQHQQTNEEQTKCKKRRIEEKENLGLPIAQSTPLVPGPSRAIAHCQPNQSIVVAQNHALRHSPPPTMAPSPILGHYFPFGPNSADSSAVSMFPSPGRGW

SEQ ID NO: 130149 - protein, 199 aa, Heterodera glycines
  Coding regions on vcDNA: vcDNA=SeqID_56572; Strand=+; Position=1 -141,304-429,538-870
MKNPEEIGEEESAEELVKLCEKWKMMALAVDAFVGGDLNVKPQFELVIILVNEKDCDLDQLLWTDTRKNLDGLSATLKCCRRFRCNSGSDHEKKVTNEPDYSLKKDFVLLRQFDQGNSLKLERYIGVLLMEYKTQKQMVATDPCEEAKLKVIKLMKDVQKSLDKKEKDGVTKTDKGGLNELIKMEKLKSKTGTRNDKAK

SEQ ID NO: 130150 - protein, 126 aa, Heterodera glycines
  Coding regions on vcDNA: vcDNA=SeqID_56573; Strand=-; Position=1-806
KILKPENWSTICNAGKDHEKKVTNEPDYSLKKDFVLLRQFDQGNSLKLERYIGVLLMEYKTQKQMVATDPCEEAKLKVIKLMKDVQKSLDKKEKDGVTKTDKGGLNELIKMEKLKSKTGTRNDKAK

SEQ ID NO: 130151 - protein, 20 aa, Heterodera glycines
  Coding regions on vcDNA: vcDNA=SeqID_56574; Strand=+; Position=1-63
YREAIPEGFGLPINLGASVQ

SEQ ID NO: 130152 - protein, 126 aa, Heterodera glycines
  Coding regions on vcDNA: vcDNA=SeqID_56575; Strand=-; Position=1 -56,284-608
MSGLTAHFEPMIPQQNGGRPLNGLSLLSGVLSAASLPDSPLSPSSVGGGLFPPAFPSSLLFGTVPSPFFAQSAIVADQQQQLIAQLIAAQQKLASALLGSPPAAQQNATQTATMAEVGDTNQQKMF

SEQ ID NO: 130153 - protein, 502 aa, Heterodera glycines
  Coding regions on vcDNA: vcDNA=SeqID_56576; Strand=-; Position=1 -449,502-775,825-1179,1230-1657
  Homolog annotation: Hit_ID=XP_417173.1; Match level="QueryCoverage =81%, HitCoverage=8%, E-value=2e-59, Identity=36%"; Hit description =PREDICTED: similar to dynein, cytoplasmic, heavy chain 2 [Gallus gallus]
MPRGQQFFQLAMGESHAEWDVVELLRHSALEGHWLCLYNVHLTPAVVNRLMTELGSLSGQLHADFRLWLTTEPDDQLPVVFLQLCLKAAYETPPGLKKNLERNFIGGRTEQKGTKRGTDEAAKAKAAFVLHWLHAVVQERRNFIPQAWLKAYEFSEADLRSAKIALNSLFGIAGKNNLKGVDWEMFRGLMLNAIYGGRIDVELDNRVLLAFLLELFNSKMIDGAGDELAPGLKMPMFGEQKDFMDWVSSTLPETDRPELLNLPRNIMLSWDLAQSDAAIAKLRRLFAALSLSQQNASGVGTFPRRDIAKAFSKHLWGEALAPLLSLWKRLNQQKPQMLQNAQERQKEMPKLEKEKANAKGEANADDPLVEMLQLEFAYALKLLQNIHSSLSAISRAIKGTNLPEKQTIEVAQSLINFQAKAMQIDFVDQSFFLSDSVFLGFPLGRWSVGAIEIFGGIGVQSAQHPNAALPGPVPAIAAFPGQFGPAFSPRFSAECFSPILRP

SEQ ID NO: 130154 - protein, 489 aa, Heterodera glycines
  Coding regions on vcDNA: vcDNA=SeqID_56577; Strand=-; Position=1 -184,257-622,827-1149,1199-1792
  Homolog annotation: Hit_ID=CAE66545.1; Match level="QueryCoverage =100%, HitCoverage=9%, E-value=1e-123, Identity=47%"; Hit description= Hypothetical protein CBG11853 [Caenorhabditis briggsae]
MGILDTSWESMRRFLAKGGVKEEIINFDVRRITPSTAKKVGALVKSKAASFDPVNAKNASTAIAPLAAWVTANLQYALILEKIAPLEQKKESLVKNLNAAEQQMERLSKGLKSLDKKVAELKTNFENCMKEATEIKIDLDREQATIVVAGKMVERLGGEYARWQQQQKELEDELRTVEHCCLIGAAFVTFLGAATEEMRAQTMANWREICQLPAAFDLLNFLASETAQLRWKSEGLLANKLAMENGAILFAVKNTPFVVDPSGTVCTFLANHFKGNSTEILRANQPDLMTKIELGVRFGKTLIIDEIDERIEPALVPLLRRDFHTIGARLAVQLGEKQASTEQRTGTADGVWHLLLAFLAVHLFGFFGFNRRFSQVDFNDQFRLFLCSRNEHCHLASHVSAVVSEINFSITRSGLASQFLSLAIELEKPELEQSSTQLSSQMEALKLEMDNLEQVLLEQLAVSDGSLLDNTALLESLNESKEKADKVAR

SEQ ID NO: 130155 - protein, 67 aa, Heterodera glycines
  Coding regions on vcDNA: vcDNA=SeqID_56578; Strand=-; Position=1-201
  Homolog annotation: Hit_ID=NP_492221.2; Match level="QueryCoverage =100%, HitCoverage=1%, E-value=1e-15, Identity=65%"; Hit description =abnormal CHEmotaxis CHE-3, altered AVeRmectin sensitivity AVR-1, OSMotic avoidance abnormal OSM-2, abnorm
MQKKAAKKSKLLAEKQAEANGALAEITRSMSGATEQKEDMEKLKSTTEAENANIEQQKKLIEQQLAD

SEQ ID NO: 130156 - protein, 522 aa, Heterodera glycines
  Coding regions on vcDNA: vcDNA=SeqID_56579; Strand=-; Position=1 -840,883-1098,1153-1310,1852-1976,2018-2245
  Homolog annotation: Hit_ID=NP_492221.2; Match level="QueryCoverage =67%, HitCoverage=8%, E-value=1e-99, Identity=52%"; Hit description =abnormal CHEmotaxis CHE-3, altered AVeRmectin sensitivity AVR-1, OSMotic avoidance abnormal OSM-2, abnorma
MLLDADAGIGHWHGRQSVRTGGDGKDRIGEGIGRTVGQTGGRRQKTEWHKQRCPLEVLVFNCDEGIDVRAIGRIFVGLIQCGAWGCFDEFNRLGRGVLSAVSSQVQLIQEAVRAKASLCRIGDLSVPVDFNSAIFVTLNPAGKGYGGRQRLPDNLKQLFRPVAMSVPDNQQISETLLFSEGFGQAKVLAKKLVTIFELAKEMLSEQQHYDWGLRALKTVLKGCADAMAKRRQNRGGTADDETEMVVQQLQLNTLSKLTFADARRFRVLLDGIFPGTKREAAQFADLIEPIRKASEHFQMRTTNAQLQKLFQLYEQLRQRIGVIIVGPPGSGKSTLWRLLQKALSLSGEQPGDHEPKRDAAQPTCGPNGLGHARVDGRHADPGGSHGRQRRNKPAWIVCDGDVDPEFIHQNEKELPAQFGDWLNKNLVPSLEWTVKQRNGALAFSQIGILNNALSLVQNAKSKNQFLVALLRAFAPFVSSDKRSELCQRVFSQNTCAIPDTKVPLNVYCDGRTDSLLGYSDDF

SEQ ID NO: 130157 - protein, 272 aa, Heterodera glycines
  Coding regions on vcDNA: vcDNA=SeqID_56580; Strand=+; Position=1 -112,381-1087
  Homolog annotation: Hit_ID=XP_233316.2; Match level="QueryCoverage =80%, HitCoverage=19%, E-value=5e-09, Identity=30%"; Hit description =similar to predicted CDS, putative nuclear protein (XC449) [Rattus norvegicus]
MNCQIWFGQLMCIMLLMVSTDYVVSQDDSSTSSSSSTIHRPHRLQLQPVHRPALQPRPLLLRPVPRPRRLQLQPVRRPALRPPQLQPRPVHRHQRVLRHQLLRAPQLQHPLQLRPVHRPHRLQLQPVHRPHQLRLQPVHRPALQPVLRPHRLRPVLRLQRVLQRLHQLRPAVRQPQLIRRPAAVPTRLVTERATFTRIGATDFRHGLNSIVPKHATCAHQRPPALQLQPRLQQAPHLPRPNRQVVHPVAALTVLVPDCAAVTVGCATVLAFG

SEQ ID NO: 130158 - protein, 356 aa, Heterodera glycines
  Coding regions on vcDNA: vcDNA=SeqID_56581; Strand=+; Position=1-1071
  Homolog annotation: Hit_ID=CAE63242.1; Match level="QueryCoverage =21%, HitCoverage=8%, E-value=3e-18, Identity=54%"; Hit description =Hypothetical protein CBG07607 [Caenorhabditis briggsae]
MGNVEQQGKHCLLLRQQQPPRGKEAQVSSDSLTSINPPSGTSSSPSSTSLSTAADVPSQCNARHCQHPATPTTAQITDQEEVAAEASSARAADHLQLDIDQTSMNASFDSDQTGKDEYDQSTDQRWVLDQTVGSDRISDQYLRAAGQNRRAARKWEIDHDQSADQNWNSDQSQIPVQQIWKRDRNRSPYRNDQSRSTAQNRATDQNLRNDRNWAIDQSENADHKCGADQRWVKIDQNGLDNNRLSSSDHTFVSPSPPSTDHHHHHLHASNFSHRFFGHYFGPLLLHPIVRALITVGYMAYIGIAIAGCMNFREGLEPSHLVTSDHYIARYFDDMKTFWKMGPQLHIAVIWGKSMGL

SEQ ID NO: 130159 - protein, 126 aa, Heterodera glycines
  Coding regions on vcDNA: vcDNA=SeqID_56582; Strand=-; Position=1 -154,213-358,424-504
SELYRETKCPNPKQSNIFEPDINYNLVIHNNGSSTELKWKCFRTKKYSDSKRRRINDGTDGAGPSEQRELPNEKRVPKITQDLLANFTGKQNDQNQQENERDRAINETLDLLDNFGSEDHQKAPAE

SEQ ID NO: 130160 - protein, 21 aa, Heterodera glycines
  Coding regions on vcDNA: vcDNA=SeqID_56583; Strand=+; Position=1 -54,579-590
MRTRPIWQVKQRLLTSQKKML

SEQ ID NO: 130161 - protein, 95 aa, Heterodera glycines; identical to SEQ ID NO: 125597
  Coding regions on vcDNA: vcDNA=SeqID_56584; Strand=-; Position=1-673

SEQ ID NO: 130162 - protein, 329 aa, Heterodera glycines
  Coding regions on vcDNA: vcDNA=SeqID_56585; Strand=+; Position=1 -112,156-234,296-357,412-536,582-784,923-1173
  Homolog annotation: Hit_ID=NP_507879.1; Match level="QueryCoverage =96%, HitCoverage=30%, E-value=8e-69, Identity=46%"; Hit description =Na/Ca eXchanger (97.2 kD) (ncx-1) [Caenorhabditis elegans] emb|CAB60477.1| Hypothetical protein Y113G7A.4
TSQEREMEVTKLTGAKVKVWSRVWNETVSQLPLMAWGSSAPEISSAPEILLSVIEIFANNFEAGDLGPSTIVGSAAFNLFIIVGICIMAIPSNEIRRIDRVDVFWVTVLWSIPSNEIRRIDRVDVFWVTVLWSSFAYVWLFLILCVFSPNVVDVWEGILTLIFFPLTVVSAFVANKHAVWEGILTLIFFPLTVVSAFVANKHAKSFGKRILTTKAITSFRHTPRLSKQKRRDSAKSNGNGVSSDTDLDQLNGDSNALVKQKHFLEIIKRLRNENPNLSVAELQQLASSLIFTEVPKSRAFYRIQGIRRMTGNGDISSKKFREQAQEEQA

SEQ ID NO: 130163 - protein, 45 aa, Heterodera glycines
  Coding regions on vcDNA: vcDNA=SeqID_56586; Strand=-; Position=1 -93,146-189
LDSNLFSLFHFLSFAMPQYNLFANRSLLFTKRFFVVGPPGTKGLN

SEQ ID NO: 130164 - protein, 97 aa, Heterodera glycines
  Coding regions on vcDNA: vcDNA=SeqID_56587; Strand=-; Position=1-294
MVVLLLILLLVLVVLQLLLLPFARSWRREGQRGRIFRGRHGRTAPTAALAHCAGGDGKRRQRLRVVHYRSPFAAGAATAAELLHFATETVEFLFLRH

SEQ ID NO: 130165 - protein, 120 aa, Heterodera glycines
  Coding regions on vcDNA: vcDNA=SeqID_56588; Strand=+; Position=1 -71,400-639,768-819
MVNRSDCVAVIICQSMHLSTFSRSYEIHFFVYKSTPIEPFELVNKRTNEKLILIKAKRNARLNKGIMKRYPIGNSVAVPWGKNGNLNNLNNVSFMLCDAKRCNGPLSLSAAKQRKGCLIM

SEQ ID NO: 130166 - protein, 38 aa, Heterodera glycines
  Coding regions on vcDNA: vcDNA=SeqID_56589; Strand=-; Position=1-114
RGGRRTKSAKFAKFLTKSTHNFSQTQPNCTILVSYDSP

SEQ ID NO: 130167 - protein, 67 aa, Heterodera glycines
  Coding regions on vcDNA: vcDNA=SeqID_56590; Strand=-; Position=1-3,76- 276
MKIHTIKLAIRNLVEDFDANENPNGDEILTHSLSFQNRLILNSFGNWHDPDNQWLYIRSRWPLGNYF

SEQ ID NO: 130168 - protein, 32 aa, Heterodera glycines
  Coding regions on vcDNA: vcDNA=SeqID_56591; Strand=+; Position=1 -80,637-655
MGRAKEWKIDIFDRNGGREEHLLDKNGLIENT

SEQ ID NO: 130169 - protein, 153 aa, Heterodera glycines
  Coding regions on vcDNA: vcDNA=SeqID_56592; Strand=-; Position=1 -15,235-357,841-1000,1507-1670
  Homolog annotation: Hit_ID=NP_871946.1; Match level="QueryCoverage =63%, HitCoverage=19%, E-value=3e-32, Identity=58%"; Hit description =3'5'-cyclic nucleotide phosphodiesterase family member (2H918) [Caenorhabditis elegans] gb|AAO38608.1| Hy
MEAKKVLRSAIHLADLSNPTKPIELYRQWNERILEEYLRQGDREKQIGFIDFIVHPLYETWAELVNPDANAILDQLEDNRQWYMTRLEEMEDEEECSESDDTDDKQRQQQQQQQQQLLEKPFPKSASLLISSGQSTPQRSSDKPSAPGTPKMV

SEQ ID NO: 130170 - protein, 104 aa, Heterodera glycines
  Coding regions on vcDNA: vcDNA=SeqID_56593; Strand=-; Position=1 -57,286-331,620-696,1034-1165
  Homolog annotation: Hit_ID=NP_871946.1; Match level="QueryCoverage =98%, HitCoverage=20%, E-value=2e-35, Identity=66%"; Hit description =3'5'-cyclic nucleotide phosphodiesterase family member (2H918) [Caenorhabditis elegans] gb|AAO38608.1| Hy
GVFSDLEVLAAIIAAAIHDYLINTNNELAIMYNDESVLEQHHLAVAFKLLQERDCDFMAGVIEMVLATDMSKHMTLLADLKTMVEAKKVSGTDTLLDKYQDRIL

SEQ ID NO: 130171 - protein, 67 aa, Heterodera glycines
  Coding regions on vcDNA: vcDNA=SeqID_56594; Strand=+; Position=1 -138,422-487
MDDNKLYDPYDKVILSYKHGTHIMNGSSDDRRQHFQIGEHALRRRETNRGHIGLSINSKKIKNKNNF

SEQ ID NO: 130172 - protein, 111 aa, Heterodera glycines
  Coding regions on vcDNA: vcDNA=SeqID_56595; Strand=-; Position=1 -46,101-118,194-253,500-627,726-807
  Homolog annotation: Hit_ID=NP_871946.1; Match level="QueryCoverage =88%, HitCoverage=16%, E-value=5e-29, Identity=61%"; Hit description =3'5'-cyclic nucleotide phosphodiesterase family member (2H918) [Caenorhabditis elegans] gb|AAO38608.1| Hy
VQRLRNTQSVPSEFGVPCKKEIEVYMQRINEWGLNIFKIHELSKQHSLTTVTYTLLRKRKLMFKFDINPGTLVNFLLHLEHNYRNNPYHNQIHGADVAQSMGVLISTPALE

SEQ ID NO: 130173 - protein, 104 aa, Heterodera glycines
  Coding regions on vcDNA: vcDNA=SeqID_56596; Strand=-; Position=1 -88,247-470
MVVHWSILVRVDRDQPEFPGLPGHGFSDPVQLIISIYQFSTFSFFSNFKMSDGFAKMSRSDQLKIGRDRLLRCLAKCGGEYQSVRHLDVQNKYLEEYNAQLRQS

SEQ ID NO: 130174 - protein, 79 aa, Heterodera glycines
  Coding regions on vcDNA: vcDNA=SeqID_56597; Strand=+; Position=1 -68,317-488
MDVELMNEFAMGRIGHAMGGGGGKCVTAEKGQPKRRQRRLTISRGRATNSAQNEAKGTAEGLAKELANFGTDSVGQWRS

SEQ ID NO: 130175 - protein, 41 aa, Heterodera glycines
  Coding regions on vcDNA: vcDNA=SeqID_56598; Strand=-; Position=1-125
MIMETEEGEKNEGMPFVTEILNVVNEMCGTEMPEKTQKEGL

SEQ ID NO: 130176 - protein, 167 aa, Heterodera glycines
  Coding regions on vcDNA: vcDNA=SeqID_56599; Strand=+; Position=1 -193,598-908
MVRPTKSTIQKRNAAAAGCAVIEAQKARMAALKAILDRSVPAESGDPAFFEICQQIWAILGQFLGELWPVTFGYLTKPEELATAWASSLPAQVGLHPLHHSLPMKRLVSSVAHEGLHLLECQQGRQWPRAGSSTKHDHGPFFRAKCAELIEMSGGLIQPEFKEFDHL

SEQ ID NO: 130177 - protein, 155 aa, Heterodera glycines
  Coding regions on vcDNA: vcDNA=SeqID_56600; Strand=+; Position=1 -160,249-332,484-707
MKNGDQNNCNWNESDKNDEENEQKSHQEQRERLRLILAGIGDGSIGPMKILSKTFFLTEVPFMANYEQVVSFLIVAKLGYSDSKSDGSSRNRRRRKKRNDMLIAIIVVLVVVIVALISCYFGRACDGSSSAPAGTSANKSASKSAISSKTEGARK

SEQ ID NO: 130178 - protein, 49 aa, Heterodera glycines
  Coding regions on vcDNA: vcDNA=SeqID_56601; Strand=+; Position=1 -140,351-360
MWHFLRTIELHEMPEFFMDSHLNPDYYHRKKRTLYHRCIFAGCRAKICL

SEQ ID NO: 130179 - protein, 55 aa, Heterodera glycines
  Coding regions on vcDNA: vcDNA=SeqID_56602; Strand=-; Position=1 -142,225-250
MTKLKGSMVIIEKRSKEGLQKECNFHMTAKAMGKHPEQIHQGDEQKKTKVNTTSK

SEQ ID NO: 130180 - protein, 188 aa, Heterodera glycines
  Coding regions on vcDNA: vcDNA=SeqID_56603; Strand=+; Position=1 -47,100-375,434-663,898-911
MSDNRKEAEQKMAKAIFISGDGWLAVFDLLPPSQLGLGIAMISPRFDFYVDEHFKTRKWALKFMRIRSKIGANGTKEMEVVNYDGKPLPMPQIELPRKVSGFKRILINFIDRNAIAFLHHLRPLFASCPINLIINAASDHILEITLHLATDREKYLWNVFFLSNFQTFATICAITSQDGGVKTEAFIP

SEQ ID NO: 130181 - protein, 40 aa, Heterodera glycines
  Coding regions on vcDNA: vcDNA=SeqID_56604; Strand=+; Position=1-121
MVIIEKRSKEGLQKECNFHMTAKAMGKHPEQIHQGDEQKK

SEQ ID NO: 130182 - protein, 79 aa, Heterodera glycines
  Coding regions on vcDNA: vcDNA=SeqID_56605; Strand=+; Position=1 -127,583-695
MACRCVRHFDDEKMGGQNAGGHRPEEIGRTFDGGTEVLREQREVFPSPATPLPHLFWVHPKITPGQNHAAKNLKKIFQT

SEQ ID NO: 130183 - protein, 56 aa, Heterodera glycines
  Coding regions on vcDNA: vcDNA=SeqID_56606; Strand=-; Position=1 -109,302-363
MGNLPLISFIFFFSIIIPVANGVITRSLTPRRGAAGVLFGFQGLTIQGQMTTTRRL

SEQ ID NO: 130184 - protein, 61 aa, Heterodera glycines
  Coding regions on vcDNA: vcDNA=SeqID_56607; Strand=+; Position=1 -108,1063-1140
MLVWWCCCCSPSSASCLVPTWPLSIGEAVQCLAKRMASTYTWKGCRNWQLFSTNFAQFSPR

SEQ ID NO: 130185 - protein, 23 aa, Heterodera glycines
  Coding regions on vcDNA: vcDNA=SeqID_56608; Strand=+; Position=1 -11,840-900
MPFHLVSNNNEVKSDLATNGIYS

SEQ ID NO: 130186 - protein, 130 aa, Heterodera glycines
  Coding regions on vcDNA: vcDNA=SeqID_56609; Strand=-; Position=1 -277,431-546
MVLPLTAALSKLLSCKPENLAEYLNNPEAVNKANAYLAGKKLKTTYQGRDSKTKEVKFGTFSVKPAAETYAFEGFLGKFPKIQFRSNTYAFRELLAVEEGGESQPVERPAAETDYLDYLNFRSGWQSTLY

SEQ ID NO: 130187 - protein, 139 aa, Heterodera glycines
  Coding regions on vcDNA: vcDNA=SeqID_56610; Strand=+; Position=1-420
MDTGGGNIKKAAVQRTSPTPKLGLTQRHKSLEEMANCRLGTGTGSSNGGTKLGGKLFRALAGTGNGGHGDSLQQKLSLAPPAAVNDGATNTVAAATVNDRNYNNRYHHHYLQQQQHGGNNDRNMVLSGEVTVQLKKVMG

SEQ ID NO: 130188 - protein, 58 aa, Heterodera glycines
  Coding regions on vcDNA: vcDNA=SeqID_56611; Strand=-; Position=1 -34,150-292
MVRKENYKLTPGPLLITTSALAIKVNILVSNFFLPFLINEFKGVEEGNDSTPEGTGIK

SEQ ID NO: 130189 - protein, 77 aa, Heterodera glycines
  Coding regions on vcDNA: vcDNA=SeqID_56612; Strand=-; Position=1 -142,549-640
MTLSNVPTIISRTVKPVISHNQSEAKRNVLIMYKKLQRSVKVYWWDFGIITTMTITFETCFLLKTSNRNRRYNSLRG

SEQ ID NO: 130190 - protein, 93 aa, Heterodera glycines
  Coding regions on vcDNA: vcDNA=SeqID_56613; Strand=+; Position=1 -164,214-328
MFTFIARADVVISNGPAIGLGICLSACLFDFLRLYRCRVVFVESICRVQKLSLTGANLLFPNFSRVHRPMEEFAKEIPKKRIYGQARLIFMLA

SEQ ID NO: 130191 - protein, 71 aa, Heterodera glycines
  Coding regions on vcDNA: vcDNA=SeqID_56614; Strand=-; Position=1 -108,153-257
MVASERGHESLIELSRSFWRKLWISNVHLDHEEFLESLRQLNIQIPPDEIIFNNRWGKLIEQWHCELLNRQ

SEQ ID NO: 130192 - protein, 231 aa, Heterodera glycines
  Coding regions on vcDNA: vcDNA=SeqID_56615; Strand=+; Position=1 -78,124-236,291-547,601-693,860-1014
  Homolog annotation: Hit_ID=NP_508198.1; Match level="QueryCoverage =97%, HitCoverage=98%, E-value=9e-65, Identity=56%"; Hit description =sec22 vesicle trafficking protein-like 1 (24.3 kD) (XB655) [Caenorhabditis elegans] gb|AAB07559.2| Hypoth
MSIILTLIARVRDGLILATSIEGADDPEHNTVKYMTQAKMLFKKLNSPGTPQAQSVASGQYFFHYIVKDTVCTLCLCDQTLPRKAAFSYLEEVGSEFLNQHGTQIDATARPYHFLEFGIPFLLIYWDPFVSSDSYIQNIKRKHLDRGRNAMAAVNSELQDVTRIMVSNIEDVIHRGEALNILESRASDLSDLSKKYREDARQLNRRTAIFKLFVGLAVAFAFFMIFRFVYM

SEQ ID NO: 130193 - protein, 305 aa, Heterodera glycines
  Coding regions on vcDNA: vcDNA=SeqID_56616; Strand=+; Position=1 -157,876-911,962-1023,1077-1534,1578-1609,1838-2011
  Homolog annotation: Hit_ID=NP_496984.1; Match level="QueryCoverage =83%, HitCoverage=20%, E-value=6e-79, Identity=51%"; Hit description =glycogen debranching enzyme (2O638) [Caenorhabditis elegans] emb|CAB05588.1| Hypothetical protein R06A4.8
YSIAEFDQLNPPIEANFSDLKHLVDGIEHEWHMLTIQDVVWNHAAKNANWLQAIEAIIGHVHYERVAANGPRKEAVTLSEPLVTNYFYHPSEFGLNAWEEDEKFAFDPSTSARLMACNGWVMNADPMSNFAEWPSQVYLRRELVCWGDSVKLNYGQQPADCPFLWEYMRRYTEKCARIFHGFRIDNCHSTPIHVAEYLLHAARKVRKDLYVVAELFTGSEQLDNLFVNRLGITSLIREAQNAHDSHEQKRTPYDFVPTAAMCSISGSACGTVRGYDEFVAHNIDVVKEQRMYRKWSEFGEKAKEW

SEQ ID NO: 130194 - protein, 359 aa, Heterodera glycines
  Coding regions on vcDNA: vcDNA=SeqID_56617; Strand=+; Position=1-1079
  Homolog annotation: Hit_ID=NP_920205.1; Match level="QueryCoverage =94%, HitCoverage=22%, E-value=4e-28, Identity=28%"; Hit description =putative DNA helicase homolog [Oryza sativa (japonica cultivar -group)] gb|AAP52492.1| putative DNA helica
MNFRGATEAYAIVHSMPFARLSHHVVKLAIHLPNQQPIVYRAFQLVSKAQQIQQGELPETQCSAYWKQWQNEWKNDPKFKDILFEKVPERFRWAKDKWVLYKRQQIKRPPIGRIVPVPPSDPERFALYSLMRHFPGDPDHLKMVNGLLCTSFTEAAIMHGLLEDDKIWDKTLAEAALSRWPDQMRWLFVSILVYGQPSNAIELWNKYKDQMYNPQGIITLAQHKVAELEALADIDWRLHSCFNLSCVHFSLPDPPTSIAKNTDAAIEEFFFGDDDLNLPPGQPNPRPQPNTPPPLNSDQQKVFDAVLLAIQSNPRDSTVPRRFFIYGDGGTGKTFLFGQIIRRLRKAPYTYKVLATAST

SEQ ID NO: 130195 - protein, 49 aa, Heterodera glycines
  Coding regions on vcDNA: vcDNA=SeqID_56618; Strand=+; Position=1 -110,199-238
MFAFFLAYQNFIEPGSFYSLSNRPKFFLQPRGREAAENCSETHQNLFTS

SEQ ID NO: 130196 - protein, 54 aa, Heterodera glycines
  misc_feature (18)..(18): Xaa can be any naturally occurring amino acid
  Coding regions on vcDNA: vcDNA=SeqID_56619; Strand=-; Position=1-438
LGPIKLISRKSRMNSHFXIFYRFLNIWIFFGLPKLHRTWFFLFSFKSPQIFFTA

SEQ ID NO: 130197 - protein, 102 aa, Heterodera glycines
  Coding regions on vcDNA: vcDNA=SeqID_56620; Strand=+; Position=1 -96,154-366
MLGSVHKSSRTTCAHQRTGAFGGANASPTGQQLPCYDFCPVQATAIKSVPVCIPTEAGTLTGPEFLEMAQSRAATGGVYKGQGRIQSELMTRPYKEFLVHGQ

SEQ ID NO: 130198 - protein, 78 aa, Heterodera glycines
  misc_feature (36)..(36): Xaa can be any naturally occurring amino acid
  misc_feature (52)..(52): Xaa can be any naturally occurring amino acid
  Coding regions on vcDNA: vcDNA=SeqID_56621; Strand=-; Position=1-353
PNRTAGRWVNRNHLGNDPASGSPTATLLRLLPGSSXLRLNRFRSAYRPKPEXNRPRISRNGSVPGSDGRSVQRAGTYS

SEQ ID NO: 130199 - protein, 47 aa, Heterodera glycines
  Coding regions on vcDNA: vcDNA=SeqID_56622; Strand=-; Position=1-141
MTSEEMTVAVGQAMLAVVERDASTGWGVVIHTISAEGVTATMIKSRM

SEQ ID NO: 130200 - protein, 27 aa, Heterodera glycines
  Coding regions on vcDNA: vcDNA=SeqID_56623; Strand=+; Position=1 -41,637-679
MLKTLHFVIFNFENYLTISYLFLSFIL

SEQ ID NO: 130201 - protein, 75 aa, Heterodera glycines
  Coding regions on vcDNA: vcDNA=SeqID_56624; Strand=+; Position=1 -112,330-445
MEAMMKNTDERAAAATQGAMTTEKHTKQTEVRKNQTTAYLLYQKIVILFREFDPVLLHKCDFDLIRIRVQSPERV

SEQ ID NO: 130202 - protein, 66 aa, Heterodera glycines
  Coding regions on vcDNA: vcDNA=SeqID_56625; Strand=+; Position=1 -158,499-541
MAWDFNFIGRIKLTLILTIEPIRTISGKKTEGKGKEEQKEKQERNRGKKRKRNARRALVIMNKNLL

SEQ ID NO: 130203 - protein, 1494 aa, Heterodera glycines
  Coding regions on vcDNA: vcDNA=SeqID_56626; Strand=-; Position=1 -184,220-4518
  Homolog annotation: Hit_ID=NP_508324.1; Match level="QueryCoverage =79%, HitCoverage=43%, E-value=1e-151, Identity=31%"; Hit description= predicted CDS, peptidase family A16 and RNA-directed DNA polymerase and Integrase, catalytic domain and
MVNRETVDIRKSKIPINHACPQILIGIDHYWHFTLPNSQIQILPSEFFSIDTKLGKILSGKEKRKKDETNEILQKFWELENIGITDSPHLTDEDTALIHFDKNVIFEENRYYIRWPYKRETPNLPTNFGLCLGRLRNVVKQLIKNKQLENYNKILQEQMDTNVNEIADFKSKNLIHYLPHHPVIKESSNTTKIRPVFDASAKLRGSNSLNDEIHQGPKLLPDLCGMILRFRLKNFVLIGDLEKAFLRVGLNEIDRDTTRFLWVNQSYLDEINQKYREIEMRDVELRRFTRIPFGVNASPFLLTAVVNLHLSKTDEMFEKFKTLQIDEELCISGKEKQFKELCTELKENAYVDNFVMMCDDEKEIKFKHYWSKEIFKLASMNLREFVSNHEQSNKEIQKLEGSEIPKMTKMLGIKWNVDTDELELQIKIPLMSRDTTKRQILTMIAKNFDPMGWISPVILKYKLFFQKLWRSNKDWDDKLNDEEIREWNNISNIDEVSIPRSPFTSQNLKCASLHLFSDASELAYATAAYLHANNKTDLLFAKTRLTPLKGLTIPKLELLGLLIAARAVKFIIKESKLKFETICIWCDSKCVLSWLKCKKNLPIFVKNRVEEIKQIVSEFHITFYYVKSTDNPADLASRGTTMNEMKYNELWWKGPKWLKLGKENWPAHSFYTPEQNDSLYDDNIMEIENTQTNLVKMDYQGFIEWKKYNSWDKVTRICQILLKFVFFTLKDSPEFKTKFKIQKFQNELSLKFMAQKMLIRIIQKEMEPNNEEERQLGIYRDNDEILKCGGRLKNAQIKATNPIFLPRTHFGTHLIIMDHHRRNLHAGTMTTLAEIRKTYWIPKGRRIVDQIRKQCFYCKRYNAKPYQQPKMPQLPKSRVQITEPFQNVGLDYMGPLQIKSFTEKCWIILFTCFSTRGIHLELVTSLSVQHFLNAFRRFISRKGTPKNIWSDNASQLKLASKVLPEVLKLKDILKDDSIKNYFEKENIKWIFSIELAPWQNGAIERLNQNVKSAMKKAIGRKLIEFDSFQTLICEIEALVNSRPITFIYDEINSYQILRPIDFILPHKNLCIPPILEDETNDPTYLPKPTYYDQTIELWKKTTKILDDYWKIWTEEYLPSLRERYKTENKNPKNCVKSFPEPNEVVIIHDETPRAMWKTGIIKNVIKGKDGIIRGANIELPSKHVINRPLKLLYPLEINKIDCEENETITNLIKTTEHKQIGTNRKRKQSVLSSPKLSKVFLNTLTFLLLFMQLLPCLSHLYECPKTNEKWRTKYTTFCVENGFTIKQNKLTMEFCYCKIFCHKQHVIKNHPPYCGPQCKCPDWTNSCSFASYHRIKREITDQENIQKIISFFKPNVCSFNKTEKCSLMDKNIFSSIMLYDNSIHSVKSLNLLHTQANSRIDYRCLGEGNLTIGTQKFCQEHECTDTHGTKFCFYEPHEKTYLVKSDREIIPIKAWGSIERIFYLANDTLMDELKRKKREFDPFENEQISAECTK

SEQ ID NO: 130204 - protein, 113 aa, Heterodera glycines
  Coding regions on vcDNA: vcDNA=SeqID_56627; Strand=-; Position=1 -165,299-472
MLYNVFKPRREAGQFQNFVPHFTVESPSTLLDNYVSMSTVAFGQLWNGKMGISDGVLIMLYNAFKPRREAGQFQNFVPHFTVESPSTLLDNYVSMSTVAFGQLWNGKMGISDG

SEQ ID NO: 130205 - protein, 76 aa, Heterodera glycines; identical to SEQ ID NO: 128275
  Coding regions on vcDNA: vcDNA=SeqID_56628; Strand=+; Position=1-388

SEQ ID NO: 130206 - protein, 36 aa, Heterodera glycines
  Coding regions on vcDNA: vcDNA=SeqID_56629; Strand=-; Position=1-216
TDQKRTRFCEGIKKTRKSTAMMLTPVILNLKFFINF

SEQ ID NO: 130207 - protein, 111 aa, Heterodera glycines
  Coding regions on vcDNA: vcDNA=SeqID_56630; Strand=+; Position=1-336
QKQNNKQPQFEGQNHLTAENTAQKIKEEPIEIGNEMPIINEKMKIKYEQEEEFNVKTEPNIGEIKVKEGANLNKKDLTPKESEGNNSSPIKMGLLYQVNIILQIFEDNENA

SEQ ID NO: 130208 - protein, 180 aa, Heterodera glycines
  Coding regions on vcDNA: vcDNA=SeqID_56631; Strand=+; Position=1 -313,398-627
MRLLCLIGFSKNEQKVINVFLIDLHHLIFKFVENVDLINEYLSKGSEQISLTEPENPDNEISVDFGDEKMDNFSFNETVENIFEHLNVEKDTKINCENNRKTKKGKLSVEEKKQIVQQYINAKKSLDKKLERKEIKNLNEAIAHKLGVSTRQIRDWKHKYQIGIYLLVNSMAFVIRIFYK

SEQ ID NO: 130209 - protein, 95 aa, Heterodera glycines
  Coding regions on vcDNA: vcDNA=SeqID_56632; Strand=+; Position=1 -73,137-351
MLIIPYFFKYNNNLHILQLTDFSVKSIRKYSQEKKLKIIRQFDEMLKEHKRNSSKKYTYKTENQIAKEMGINRATIIRWRKEFCLSSKKRNYLSF

SEQ ID NO: 130210 - protein, 54 aa, Heterodera glycines
  Coding regions on vcDNA: vcDNA=SeqID_56633; Strand=-; Position=1-210
FEYPKRTLEKIDFFVFGAVPPSRCAQIYGETESFRNSFPIACTLILRWIFAPHN

SEQ ID NO: 130211 - protein, 100 aa, Heterodera glycines
  Coding regions on vcDNA: vcDNA=SeqID_56634; Strand=-; Position=1 -81,313-534
  Homolog annotation: Hit_ID=AAA83498.2; Match level="QueryCoverage =85%, HitCoverage=21%, E-value=4e-12, Identity=42%"; Hit description =Hypothetical protein F30B5.7 [Caenorhabditis elegans] ref|NP _500517.1| solute carrier family 39 member 1 (
MDTISLQVLLAFAMFATTALAGLLPIKLLHAITRRQDENDEQRSRKSDYILTLLSCFAGGVFMSTCFLDIFPHIKSVSAYESRLHCLDMSSRVSRQGLKF

SEQ ID NO: 130212 - protein, 63 aa, Heterodera glycines
  Coding regions on vcDNA: vcDNA=SeqID_56635; Strand=+; Position=1 -64,114-241
MPVSQANSWIPLVLSLVLRLRETRHTESKNFSGRDSRAANFKEIYRSEQFKISALLKDTAHNQ

SEQ ID NO: 130213 - protein, 150 aa, Heterodera glycines
  Coding regions on vcDNA: vcDNA=SeqID_56636; Strand=+; Position=1-453
MLFFLLLLSLSLFLLLVPNVCCHNAELVLLDPSQIGFFLPNYFVKKFEKKLFVKFAREFRPVFVAFAMLEPPYLYVDQSENIRSVDRAEVEKLMKFKLVSRLRKEKKLMETAQFNLTLAHDIQGALFSVPVPSVERSREQETFGITKLPY

SEQ ID NO: 130214 - protein, 178 aa, Heterodera glycines
  Coding regions on vcDNA: vcDNA=SeqID_56637; Strand=+; Position=1 -128,444-554,601-899
  Homolog annotation: Hit_ID=NP_505600.1; Match level="QueryCoverage =71%, HitCoverage=44%, E-value=6e-20, Identity=53%"; Hit description =chitinase family member (5K597) [Caenorhabditis elegans] emb|CAA96587.1| Hypothetical protein C08B6.4a [C
VDLMHEPNLVLTKTDPPLALLASLWFYMTPQPPKPSMHDIITEMPRHFDEMMHNVSWQPDWSSTWREDRPCVCAPAAYGGAIPYFQPGFYPSQFVEENEANKAQCKKMLSEQPQNFGMDPMTSGCLNHTKVAEGAKVPPGTTTLTEKVPMSTAGTKVPRMAYGTVSYLRPNLTIIALG

SEQ ID NO: 130215 - protein, 105 aa, Heterodera glycines
  Coding regions on vcDNA: vcDNA=SeqID_56638; Strand=-; Position=1-317
MQNRHLEEVLHIWMKSCSVFAEEWKERTYEPVELKEILVNRRAIGEEPSLGWESWLTELTKRFGQALTAIRAKAFWPNAYYVLKETVVVGDNLAELLAKQIPNAG

SEQ ID NO: 130216 - protein, 56 aa, Heterodera glycines
  Coding regions on vcDNA: vcDNA=SeqID_56639; Strand=-; Position=1 -54,520-633
MFNGEQQQQNDGNDNGRVLGSTSAGTVLQQMPLGSNSTSAAVAVMPMPFLDNNNNN

SEQ ID NO: 130217 - protein, 21 aa, Heterodera glycines
  Coding regions on vcDNA: vcDNA=SeqID_56640; Strand=-; Position=1-65
MAKKRLPLSENQQPTPPKRKE

SEQ ID NO: 130218 - protein, 53 aa, Heterodera glycines
  Coding regions on vcDNA: vcDNA=SeqID_56641; Strand=-; Position=1-162
GKICAGIGQSFGNGTGNEFGNGGQIEENAMANGGGTKLRNSEKPKRFSGKVPK

SEQ ID NO: 130219 - protein, 90 aa, Heterodera glycines
  Coding regions on vcDNA: vcDNA=SeqID_56642; Strand=-; Position=1 -83,811-1000
MCLLKCKTVVKNCYNSFQRRDRKKIKIGEEIEKSIVSSRWRTEGYIGAMDVGLPYQLLKFLFFKKDTKTSIDNPIQRLVKKNNNRLGLPY

SEQ ID NO: 130220 - protein, 52 aa, Heterodera glycines
  Coding regions on vcDNA: vcDNA=SeqID_56643; Strand=+; Position=1 -143,524-539
MEIGAANVRQHFELSLKRAVWRILRENTMKQFLTMKRSLGGTISFLLRKMPK

SEQ ID NO: 130221 - protein, 37 aa, Heterodera glycines
  Coding regions on vcDNA: vcDNA=SeqID_56644; Strand=-; Position=1 -29,220-304
MSKSVIDEINFPGAPIGPPDACFVNWFLTRIRSFSDF

SEQ ID NO: 130222 - protein, 97 aa, Heterodera glycines
  Coding regions on vcDNA: vcDNA=SeqID_56645; Strand=-; Position=1 -133,177-337
MAEQFVQHETAEEQQVKAKKPNVDERFLWKITRGQFVLAIRLCSEDWNNLFHNKDKARRLEDGRVAIGLEMCEECAKLNCCVSDLIAGQKKNQKKPE

SEQ ID NO: 130223 - protein, 51 aa, Heterodera glycines
  Coding regions on vcDNA: vcDNA=SeqID_56646; Strand=+; Position=1 -232,368-443
LDNYCEQLRVNEHSRRWPVVKQKNGNIRWGAFFSKNSSFRLTIPPFLCTIS

SEQ ID NO: 130224 - protein, 44 aa, Heterodera glycines
  Coding regions on vcDNA: vcDNA=SeqID_56647; Strand=-; Position=1 -44,107-197
MCTQTALSVGATFFRRINWIFYYVLPSHFKCEALNTYASTDCQR

SEQ ID NO: 130225 - protein, 100 aa, Heterodera glycines
  Coding regions on vcDNA: vcDNA=SeqID_56648; Strand=-; Position=1-303
MERHRLIPGQELVDRNLAELEFHDYFATDHHGNRFLLVDSRTAEPENPVFFIFCSDAGIQRLRTYRNWACDGTFKSFYAAFFELFVFLSLSKGSSTAVHI

SEQ ID NO: 130226 - protein, 56 aa, Heterodera glycines
  Coding regions on vcDNA: vcDNA=SeqID_56649; Strand=+; Position=1 -62,514-622
MDKIILHADLFLTLAIDIPNIFQIFVQIWSALLLKNEFVLFSNIVRICVRVRIWTK

SEQ ID NO: 130227 - protein, 78 aa, Heterodera glycines
  Coding regions on vcDNA: vcDNA=SeqID_56650; Strand=+; Position=1 -204,265-297
HTLLPDQALELAKAASQVTTANANRNQRTAQQQLQAPTQNGGDTSSSSTSSVVSERRTSQMAYFEFPEADFDSLEALV

SEQ ID NO: 130228 - protein, 30 aa, Heterodera glycines
  Coding regions on vcDNA: vcDNA=SeqID_56651; Strand=+; Position=1 -17,402-477
MPGGEICQGEKCKKERLLSVVLENWKVQKN

SEQ ID NO: 130229 - protein, 160 aa, Heterodera glycines
  Coding regions on vcDNA: vcDNA=SeqID_56652; Strand=+; Position=1-483
MKTQNEEMRSDEAERQTKEREQVKKLLDEYKRKVNKEMEKNVKKMEKDEKLKEVLREIEEAKAKHPGEKRKAAKSITEINEKHWDELYQGDIVLSVEQAQYLLDTVTKNEQEKSNSSPAGNGAEKRKKRGTDENGKKETFPILKWPLLTIPFSFHSIIRN

SEQ ID NO: 130230 - protein, 324 aa, Heterodera glycines
  Coding regions on vcDNA: vcDNA=SeqID_56653; Strand=-; Position=1 -122,333-582,630-769,812-1062,1106-1317
MLPLYRFVTTTRATKEVMSGRNFLLADSGIYREAGRQTTERREQWVFPVLYGLLTTKTKETYARFFRMVVSFWPNFRPDSISVDFEAGIIGAVKEVFSDCELSGCFFHLVRNFKKRLATEHLVERYNSDPVFQMYAKMITSLAFLPIEHLTLGIMALERELPLELQPVFDWFINNYTGRPRFDGTRNPALFDPVIWSVHLRTIQKRDRTNNYAEAAHRSLQRAFGCDHPSIWTFIDRLRKCQKIIDADFAKFSIGEQPSKKRKQYRDADRRILTLVERYAQEMGVQNPLVPIHYDPQYFANPGPNFNYVIEFLQGISHNYEMNP

SEQ ID NO: 130231 - protein, 249 aa, Heterodera glycines
  misc_feature (21)..(21): Xaa can be any naturally occurring amino acid
  Coding regions on vcDNA: vcDNA=SeqID_56654; Strand=+; Position=1 -212,424-564,624-682,851-886,957-1066,1124-1216
  Homolog annotation: Hit_ID=NP_499790.1; Match level="QueryCoverage =77%, HitCoverage=45%, E-value=2e-50, Identity=55%"; Hit description =twk-8 protein like family member (3O574) [Caenorhabditis elegans] emb|CAB07286.1| Hypothetical protein T2
SESPNRQSFTIHHFVYSLGNXSCVFPQAVFFTSTLLTTIGYGNLVPVTSAGRMFCIFYALFGVPLILITVADIGKFFSTLIVLLYTHYTRAKLRLRQRLIGHGGGADAAGHSSTLMKAHLHENINISIPVTLVAAILLGYMSIGAVLLAKWERWPLFDGFYYSFITMFDGFYYSFITMTTVGFGDIVPAKHEFFLFDLFYIIVGVAINTMCIDLVDIEYVAINTMCIDLVDIEYIEKVTTPFFANSPNL

SEQ ID NO: 130232 - protein, 190 aa, Heterodera glycines
  Coding regions on vcDNA: vcDNA=SeqID_56655; Strand=+; Position=1 -177,373-651,692-808
PIGNPACWIVYNRSRIDMGGGCPSLFSGSRGISNNSTNVGTLSGTTLFLKNESIDMIRNQDHFLHRLNDQQIRHEHEHRHRHHHQHREQHHCKQCCAKEKQNFQNFTAPRSRISILVENDGAVMPAGSLAVMDEMSYDTLVSQFLGTDDHEGMEKTMKFLARYELIANMLLCPECQEKQASLVKYKQFPE

SEQ ID NO: 130233 - protein, 46 aa, Heterodera glycines
  Coding regions on vcDNA: vcDNA=SeqID_56656; Strand=+; Position=1 -54,106-192
MIRITENDQDLLILISERSEPLLVLVEMSTLFGINCNSHINFMIII

SEQ ID NO: 130234 - protein, 22 aa, Heterodera glycines
  Coding regions on vcDNA: vcDNA=SeqID_56657; Strand=-; Position=1-68
RSARRPAESPHPCACTDPASLN

SEQ ID NO: 130235 - protein, 101 aa, Heterodera glycines
  Coding regions on vcDNA: vcDNA=SeqID_56658; Strand=-; Position=1 -280,563-588
MISNKFSKPKSAKKGPIAFIELLQAHVTLINNFRLRVITASPVGRFDVHYGSRAAQRFKGTFLKLMKLSFMGFLRSLIYRMHKIRKIVWMVSYDFSFNIII

SEQ ID NO: 130236 - protein, 101 aa, Heterodera glycines
  Coding regions on vcDNA: vcDNA=SeqID_56659; Strand=-; Position=1 -108,242-439
MQHNCPLCTVSAVLEKKAKKSQMRIFMKNISRAEYKGFMTWDPTIGHPETWRLRSDIGTPTSRHLGAKRDLETRHLGAKRDLETRHLGAKRDLGTRHLGAK

SEQ ID NO: 130237 - protein, 29 aa, Heterodera glycines
  Coding regions on vcDNA: vcDNA=SeqID_56660; Strand=+; Position=1-87
MSRKMIKIRTISWGFLRLPDNPSVDNNPS

SEQ ID NO: 130238 - protein, 70 aa, Heterodera glycines
  Coding regions on vcDNA: vcDNA=SeqID_56661; Strand=-; Position=1 -50,159-319
MNFFTVLLFLANSVLSTGAFSCGEFLETNSMKFKQTLDPDNIRHPSVNLGNYCGAPDMTMWLCIGCSSPD

SEQ ID NO: 130239 - protein, 81 aa, Heterodera glycines
  Coding regions on vcDNA: vcDNA=SeqID_56662; Strand=-; Position=1 -75,303-473
MFTCLATTFNSKKIGTFEVEFLYSIILVYTYISCTAVATALAFYNIDEVACYCTVPYTVWTGLYFLLASYFRHTQIHNIEE

SEQ ID NO: 130240 - protein, 73 aa, Heterodera glycines
  Coding regions on vcDNA: vcDNA=SeqID_56663; Strand=-; Position=1 -109,1234-1346
MSFFWNTTNAIVSSLLPVLPAFVMSSSHRRDLEAFSISNLYSENAGWGEVNRFLNMLQRQTTQPLSLWVGCNC

SEQ ID NO: 130241 - protein, 263 aa, Heterodera glycines
  Coding regions on vcDNA: vcDNA=SeqID_56664; Strand=-; Position=1 -479,548-860
  Homolog annotation: Hit_ID=NP_702063.1; Match level="QueryCoverage =87%, HitCoverage=5%, E-value=2e-14, Identity=20%"; Hit description =hypothetical protein PF14_0175 [Plasmodium falciparum 3D7] gb|AAN36787.1| hypothetical protein [Plasmodium
MFDKIDWLGRFVASHPFFAFSPIVGTQPTRFQSLVLKSPAFQSLGLNPPAFQSLGFKSPAFQSLGLNPPALQSPGLNSLAFESLGLNSPAFQSLGFKSPAFQSLGLNPPALQSPGLNSLAFESLGLNPPAFQSLELNPPAFQSLGLKSPAFQSLGPNLTWLSNHWDSTHQLSMTFQSLKLNPPAFQSLGLNPPTFQSPTLNPPGTQPSNIPINGTQSTNIPITGTQPTNIPINGTQSTNITITGTQSTSISITGTQPTSIQSL

SEQ ID NO: 130242 - protein, 102 aa, Heterodera glycines
  Coding regions on vcDNA: vcDNA=SeqID_56665; Strand=+; Position=1 -274,380-414
METLKNFKLDALFKVLALPDKEFEEWLRELKLLHTTRFCDCGNEMSYKWIKDRNQPLWICNSKKNHDGKRPTIGFYTGTFFEGAHLSPKFSRSCHWSAYKLN

SEQ ID NO: 130243 - protein, 19 aa, Heterodera glycines
  Coding regions on vcDNA: vcDNA=SeqID_56666; Strand=-; Position=1 -4,306-361
MKTDCYEQKWTVKCAIGGL

SEQ ID NO: 130244 - protein, 44 aa, Heterodera glycines
  Coding regions on vcDNA: vcDNA=SeqID_56667; Strand=-; Position=1 -31,265-368
MLISKYNLGNTFDPIFYEKMFRGTRRCREAPPAENFEILTISQH

SEQ ID NO: 130245 - protein, 742 aa, Heterodera glycines
  Coding regions on vcDNA: vcDNA=SeqID_56668; Strand=-; Position=1-2228
  Homolog annotation: Hit_ID=NP_498959.1; Match level="QueryCoverage =45%, HitCoverage=15%, E-value=2e-47, Identity=33%"; Hit description =zn-finger, CCHC type and RNA-directed DNA polymerase  and Integrase, catalytic domain containing protein
MSGKKIYVQLAQQFFWPNMYADCVKMVQKCRICAHSRKPRANEPPMKIVQTSEPLELVCIDVLSIGLAYSSNKYILVAVDHFTKYLVAVPIPNKSADTIASEFVKNFILIFGTPKKLHSDRGKEFVNETLNEIVKILKVERSLTSGYDPQANGITERANQTILAMLKRSTASNWTWDERLPFVIFAYNITPSETTKFSPYHLMFGKIPNFPTEIFLPVNPNYTVDVDTYIQLFRENIAQLIKLAQENSKIARIKMKNHYEKQPKVTADKFKIGERVMVIFPGVNTRAAHRKLLWNQFGPYKILDLSDSSAKLVPVDKPNFEPISVPIERLVKVPEGVPDISTLPRGKNPFKNQLNALLSVVCLVYREMDIETCEENGQFTQTKSVKFGNGTIKMDEFQKTENMGQLFIGQLRTIANSADGEVRAKDNADHPLVWEMQCGGLGTEHRNCVQLTAADLDPVLERAGLGLKVIGRQEKMENVEGKVGFKVIGTPMKALLSNFLLKSGAVSSVAGGQKLTQLVISAPVGFELIAYSGGREDLVKNGFFPTENDIESAFTAWVERCAVTREKLMKTGYAPIEVPLPNVVAELPESEKMGWHEMLKRANFVLEKVRATIIHRKQLLVETATVIIGDSSAKQLVKLWPKSQFIGAENGTITEVIRAFDGAILSSKVKVAIVMVGRDSIRGDETIENVMERVGRLEQLLKRFSHVPVFWLPPPFIKQKMVEHEELVVKMKEHFGAMQGNV

SEQ ID NO: 130246 - protein, 1416 aa, Heterodera glycines
  Coding regions on vcDNA: vcDNA=SeqID_56669; Strand=-; Position=1-4250
  Homolog annotation: Hit_ID=NP_498959.1; Match level="QueryCoverage =96%, HitCoverage=64%, E-value=1e-134, Identity=27%"; Hit description= zn-finger, CCHC type and RNA-directed DNA polymerase  and Integrase, catalytic domain containing protein
MNVQQRQNADYQPRLTHQQNYAQFEERAYRQQNPGNLFVRNQPARYENANPNFGYGTSGNVMVNQQGGAQPPISNLEYVLILDRLPELKGNEGADKVRYFFKKFVSATEGWPDNKRISSLESKISGRAERAFNAALANQPYRFDAIRRAVQAQLEETDCREMGAFDELMNGLKRKPNEKLDELADRVQNVVLRAYPGLTQNLVDEYATKHLIRALSNPDLSLSLEMARRPGMCFDEFVALAARAESIQKATKNVPNERRNIEERTRPMQQNFSRFAQQFQPQQKQNFSQSFQPRENTVCYNCNEPGHFSRECRRPKQYFDGRANQSHAVPAAGANSFQMRPNGPEKRALPQTSTKESDQRRSQNFLKQNCIVVQEEAPPEAFCRGVQLSSEIAEFFANEFKERKDGNNQREMSSDRVGKILVIKIETFGAKTEAMIDGGAQISLVGASFLYMLIREKGLDLQKTNFARTNDRIADVNGKELRCFGTLTLPILRKGCEQVAIHFYVTSAPFGFDMLFGTNSLSALGFSLYDEPNNEMIHFEKATKSEDTVRMIFNMKFQPRTSKFVEMEVDEQWNGQDVLICPVPAEKAVRIDQSIGKVENGKIVCQISNLSSNVEQIDGNTVIGRVEEVELSYDSGNSFLPTKDFLIGEGENDIQFGDEMSLKVGHIPNEAKAKLMALLNDFTQIFAFSDEELSQTDLVSHQIATGNSAPIRSRIRPVPYAYREKVAEMIQNYLGRGIIRPSSSPWASPIVIVPKKDGTLRFCVDYRGLNSVTVKDAYPLPNIDNILLALGGKKIFSTLDFISGYWQIKMSPESIDKTAFATEFGLHEFVVLPFGLCNAVATFQRFMSQLFEGLINDFVFIYIDDILIASESWEKHQEHLKIVFERIREAGLKLKISKCHFSANELPFLGHILTTEGIKMDVNKVRPIMELPIPTSKKALQSLLGFLAYYRKFIFGFGAIAAPLYGLLKKDAEFAFGKLEKEAIKALKQKIFDDVILHFPNFEAAKNEPRRQFIMMTDASKIGIAAILCQPDENANVRPIYFASRKCNSYESKYCPTELEALAVRFGAKKFSQFITMPPTRVFTDHRALVHMFKSKTETGNSRVDKWLMQLNSRFILKVEYQPGKKNVIADLLSRSPALKCPDPPAEIEISRIAHIKMCQIQTELDEVKNRQEWIEKTKESELDFIYDFLNKRIVPQDPKNKQKLISLLPTFTILDELLYKCENDGKVRLFVPFIFRDALIRERHSGSCAGHMSGKKIYVQLAQQFFWPNMYADCVKMVQKCRICAHSRKPRANEPPMKIVQTSEPLELVCIDVLSIGPAYSSNKYILVAVDHFSKYLVAVPIPNKSADTIASEFVKNFILILGTPKKLHSDRGKEFVNETLNEIVKILKVERSLTPGYDPQANGITERANQTILA

SEQ ID NO: 130247 - protein, 40 aa, Heterodera glycines
  Coding regions on vcDNA: vcDNA=SeqID_56670; Strand=+; Position=1 -74,1585-1615,1769-1786
MPVDDLSPNSLLADEYVPPQHLGSRFYTASETFKSILHAN

SEQ ID NO: 130248 - protein, 129 aa, Heterodera glycines
  Coding regions on vcDNA: vcDNA=SeqID_56671; Strand=-; Position=1-390
  Homolog annotation: Hit_ID=AAG00553.1; Match level="QueryCoverage =69%, HitCoverage=20%, E-value=2e-10, Identity=42%"; Hit description =retinitis pigmentosa GTPase regulator [Bos taurus]
MAEDQEELDMTSTNPMPTTTMTKTTTIEMEEVEDEEGGGEAQEEEEEVKEQGEREGDGEEGTENITPGTETERETETDGEREREDGEGKGDTGGAAAEQSAEWAEVNKGEFAGSGKGTYWGNERWAKLG

SEQ ID NO: 130249 - protein, 119 aa, Heterodera glycines
  Coding regions on vcDNA: vcDNA=SeqID_56672; Strand=-; Position=1 -214,260-405
  Homolog annotation: Hit_ID=NP_872048.1; Match level="QueryCoverage =81%, HitCoverage=47%, E-value=9e-46, Identity=61%"; Hit description =dumpy shorter than wild-type protein 10 like, DumPY : shorter than wild-type DPY-10, ROLler: helically tw
MPGRPGTAGKPGSPGLSPNQTCPMQVKRDPPPCRPCPKGPPGIKGWPGFPGDVGPVGAPGEKGRDGDDGAPGESGPQGPPGFRGAPGAPGDKGETPKGGEINWRGNGAILNNSKSNGQL

SEQ ID NO: 130250 - protein, 301 aa, Heterodera glycines
  misc_feature (29)..(29): Xaa can be any naturally occurring amino acid
  Coding regions on vcDNA: vcDNA=SeqID_56673; Strand=+; Position=1 -217,262-430,669-782,1031-1090,1328-1459,1523-1621,1761-1820
  Homolog annotation: Hit_ID=CAF98668.1; Match level="QueryCoverage =100%, HitCoverage=60%, E-value=4e-49, Identity=38%"; Hit description= unnamed protein product [Tetraodon nigroviridis]
PNVAERKKWLPNSCQLIQNQKAFPIKIIXFLGSLTLNRHQASVLLANAFFCTFPAEFGHKGRRFPRFDFNAFRLFHLNTHRFRLFHLNTHRAVEKLKFLLHYFAQIRHCPPIGTLSFIRQAVERLPEWESERTKAGHLTALCDGRIEDEGAAHTQMDFANEFIGGGVLGHGAVQEEIRFLICPELVVACLICERMDDNEAILLLGAERFSDYRGYCDTLRWVYRKYGDDNTKRWGNSKTELLAIDALCTELLAIDALCFGSTMDFLSDQFDADAIKRELLKAYVGFSLQRLESPHGISTGN

SEQ ID NO: 130251 - protein, 64 aa, Heterodera glycines
  Coding regions on vcDNA: vcDNA=SeqID_56674; Strand=-; Position=1-195
ALCTESVLVAMRECFPHMYISSEKLELDPAKIRIKKAHFSDALHSVKPSAKRGILLLLFYLGVH

SEQ ID NO: 130252 - protein, 35 aa, Heterodera glycines
  Coding regions on vcDNA: vcDNA=SeqID_56675; Strand=+; Position=1 -62,719-764
MSNFTTFIIKQSKWNLFDHIKTFKVRHVKSTPKKV

SEQ ID NO: 130253 - protein, 29 aa, Heterodera glycines
  Coding regions on vcDNA: vcDNA=SeqID_56676; Strand=-; Position=1-89
MVSVGLANAQRLVAIVTGGASGLGCATVR

SEQ ID NO: 130254 - protein, 302 aa, Heterodera glycines
  Coding regions on vcDNA: vcDNA=SeqID_56677; Strand=+; Position=1 -147,192-259,300-338,389-518,567-701,746-910
  Homolog annotation: Hit_ID=CAE72912.1; Match level="QueryCoverage =96%, HitCoverage=95%, E-value=2e-70, Identity=50%"; Hit description =Hypothetical protein CBG20230 [Caenorhabditis briggsae]
VPFKEFPTSTFPMYHYQYRIIVIGDSTVGKSSLLRYFTEGKNAEISDPTVGVDFYARMIEIKPNYRIVGVDFYARMIEIKPNYRIKLQLWDTAGQEKFRSITRKLQLWDTAGQEKFRSITRSYYRNSVGVIVVSYYRNSVGVIVVYDITNRRTFEHVVDWMTEAEANLGGPDPAQLVFLLVGHKADLEEVFLLVGHKADLEEQREVLYEEGEYFAKHRRIKFIETSALTGENVNEAFLIVSREINAREAFLIVSREINARFETGALRICDGWDGIKSGLLRTQSITLSDIQETTKENSQCYC

SEQ ID NO: 130255 - protein, 161 aa, Heterodera glycines
  Coding regions on vcDNA: vcDNA=SeqID_56678; Strand=+; Position=1 -215,434-588,1499-1614
MEYVQSSAAETDESKLFLNLNESENCELNEIYETESETERKEIEAAEQVINALLYYKKYALSKLRKQANAILLFNMMAECGAHMLGGTIQQAFEITQLRPASEHYMTKVKSVLKQILRDWSAEGILGTRTQCFSTAITVVIFAVRKWLKIKFCDSNFILFV

SEQ ID NO: 130256 - protein, 132 aa, Heterodera glycines
  Coding regions on vcDNA: vcDNA=SeqID_56679; Strand=-; Position=1 -172,2097-2323
MALKEKVKKRRTTRRGHLAASVEDEVGSKQHEDGELIARHGKAQAEQFPGQSGQPRTGAITDLCWDLSHQLLFSASTDSLVIVWDIGGKRGNCYELKLCLLSSLSIFMVKWSQCQVDSSCVGCRLASLILRR

SEQ ID NO: 130257 - protein, 222 aa, Heterodera glycines
  misc_feature (14)..(14): Xaa can be any naturally occurring amino acid
  Coding regions on vcDNA: vcDNA=SeqID_56680; Strand=-; Position=1 -76,189-303,459-552,628-1003
  Homolog annotation: Hit_ID=NP_493426.1; Match level="QueryCoverage =94%, HitCoverage=11%, E-value=4e-40, Identity=42%"; Hit description =TBP-Associated transcription Factor family member (taf-1) [Caenorhabditis elegans] emb|CAC14425.1| Hypoth
KFKSNNTFFFSKFXGKTKPFSNTFSDSRLPIDPQHSLFPFENYELENTQWEDDIIWDSANMPATIEPRVLTLDYEDDPRAFGMPEDAAQVEEVLHHFAFAVHFAFAVFLQEQGVMKKSKLILAQVLKRQRQEVEEQIETQIAQIADKDPFNLSNDEYYAPKSSGANTKTHNLTIQHSLPAQNLHPALFPLLQHNVVAQLRHFHRPPLSRRTAQGMTGRTVPI

SEQ ID NO: 130258 - protein, 94 aa, Heterodera glycines
  Coding regions on vcDNA: vcDNA=SeqID_56681; Strand=+; Position=1-285
MANEYKQKGKKYSTKEWRQNYAEICKKIGVSHYVIMKWKKQFGMSKFITEKEKMEKMKIYWQIKKENPKMSERAIAKMMKIDRTNISKWKKLFG

SEQ ID NO: 130259 - protein, 123 aa, Heterodera glycines
  Coding regions on vcDNA: vcDNA=SeqID_56682; Strand=-; Position=1-372
MTTAKHQRTPDDEEEKNLRRKAKVALDLVEAGLAADAMMQDGTRWKKAKNAINVLANLLLAESLTDVSPTFDQQQQQQLLSKEEEREGCINSSSAAATTESAPDGDVMEDFVNSIQAVTSNMQ

SEQ ID NO: 130260 - protein, 156 aa, Heterodera glycines
  Coding regions on vcDNA: vcDNA=SeqID_56683; Strand=-; Position=1 -291,675-823,1128-1158
MQWIKFNCTLCPIGLHCFYPRKYAKPVLCAHPSVRNITDFLSTGQLDEAATTTTTTTALPTTAEVSAAAAECAPPPAHLTAWIAVCTALVALLVIAEAAGQSRADGAIEEGEEPVYDEVPLDSDIVVEMRDEDNGEEEEEEDYSDFYELSQRWTSL

SEQ ID NO: 130261 - protein, 42 aa, Heterodera glycines
  Coding regions on vcDNA: vcDNA=SeqID_56684; Strand=-; Position=1 -120,612-620
MKNSLLHLYILGIWLLSALMASPNLWVYRQILYDLISGQQLF

SEQ ID NO: 130262 - protein, 68 aa, Heterodera glycines
  Coding regions on vcDNA: vcDNA=SeqID_56685; Strand=+; Position=1-207
MPRYLFAFYGGRAVAEPKGTERSSTRKNALLQPAEAHNDVEDEERSPTDEKGREHDDEHLKGADSLPA

SEQ ID NO: 130263 - protein, 125 aa, Heterodera glycines
  Coding regions on vcDNA: vcDNA=SeqID_56686; Strand=-; Position=1 -45,470-658,780-920
MPLPLVKVPTKRTLKGEVPIETIHTVFALIIPHGGLFFNLLVDWGIKIEGLFFKPLLDWGIIGDWGINGDWGIIRANTVNAEGEADKAIVAKNKAGPGQSSDPSDMIMLPSTSDAPRRSRRIAAN

SEQ ID NO: 130264 - protein, 81 aa, Heterodera glycines
  Coding regions on vcDNA: vcDNA=SeqID_56687; Strand=-; Position=1 -108,1413-1548
SEDNTLVEWHNEIDAQRSRSLSARRDKRPEAPPKPLPKAAEPPTEVPQERWVDPLPEKLQFQQQENKFAELKCKYSRANAK

SEQ ID NO: 130265 - protein, 61 aa, Heterodera glycines
  Coding regions on vcDNA: vcDNA=SeqID_56688; Strand=-; Position=1 -13,636-689,1040-1101,1204-1260
MRFLAFICSAIFASFNGQQNTYLSFDSSKCALLACKISKNLVKANRASEGLSNDIKKVGFG

SEQ ID NO: 130266 - protein, 80 aa, Heterodera glycines
  Coding regions on vcDNA: vcDNA=SeqID_56689; Strand=-; Position=1 -91,121-270
MDMDEEAVAAVADEEEDLTLLPALTLPAAVPPMAFGVVAADAVASDERRLINAASRSSSDSGEHLMGDGGNADDELEELG

SEQ ID NO: 130267 - protein, 287 aa, Heterodera glycines
  Coding regions on vcDNA: vcDNA=SeqID_56690; Strand=+; Position=1-861
  Homolog annotation: Hit_ID=XP_313650.1; Match level="QueryCoverage =63%, HitCoverage=13%, E-value=4e-10, Identity=26%"; Hit description =ENSANGP00000003674 [Anopheles gambiae]
MVAPAETSATEASEAAKAALEVAWKEDEQQLLQRRHADDSALLLPATGGGGAATPPLVGFGTGMPSSDAVASAYQTATTTEVVVPKSSLAAARSSRAPLTQFGGRHNNNSNNNNRGWPTAWNHSGADGGGAVGGGGGGRGRYHHYHPQQKRLWKNNNSWQRNNQHRNSNDQFNQQQSQSFGGGGQNRPWFNNNHNQQHGQQHNRHQTLSFSSSGATPTTSYCSGNMNNTTSGYGSGFGGVNSSRYRGGRQQQQHEHPLQQSQIDYTQQQHNQRATSSSTTTTMDTKM

SEQ ID NO: 130268 - protein, 222 aa, Heterodera glycines
  Coding regions on vcDNA: vcDNA=SeqID_56691; Strand=+; Position=1-666
MANKFLLVPQEIYRGLTSASDTGVINLDAVRYDLDRARRERTNPTTKNVRYNQQLRRYLQMRRELADRPTKVELTKGLSVLLKRDGGVDDDDGEVVNTQPRPPAPPPPPPPPHHPSQQHHRRPPSLPDQQSSSSDDSHPPHPPRPPRPQRTKKNHQSSLKHDRLNQWQQRRRDLQQQQQPVVRDLLAEAAAAPLPESDDDDEQMLEGGYLLPTPSQNYGDIP

SEQ ID NO: 130269 - protein, 31 aa, Heterodera glycines
  Coding regions on vcDNA: vcDNA=SeqID_56692; Strand=-; Position=1 -31,317-381
MEKICLVGCAAIIGLLPFKSYENRYKRKEKL

SEQ ID NO: 130270 - protein, 172 aa, Heterodera glycines
  Coding regions on vcDNA: vcDNA=SeqID_56693; Strand=+; Position=1 -60,227-394,607-894
  Homolog annotation: Hit_ID=NP_504721.1; Match level="QueryCoverage =86%, HitCoverage=22%, E-value=3e-57, Identity=59%"; Hit description =protein kinase and Citron-like (92.4 kD) (5H270) [Caenorhabditis elegans] gb|AAA97966.1| Hypothetical pro
MRLDEQIPPAIMSFCRESVVFLTISSGEFAAIKIVKLETGDNFADIQQEILVLKECVHPNIISYYGSYLKRDRLWIYLHQRGKIHRDVKGANILLTHNGDVKLADFGIAAQITATIGKRKSFIGSPYWMAPEVANVERSGGYGSECDVWAVGITAIELAELKPPYYYLSPLQ

SEQ ID NO: 130271 - protein, 54 aa, Heterodera glycines
  Coding regions on vcDNA: vcDNA=SeqID_56694; Strand=+; Position=1 -85,657-736
MAKKEENHQKQPNHWGGEKRARNGRTFAIHGKILSLKKTPTKSKKWKSQQKKRE

SEQ ID NO: 130272 - protein, 16 aa, Heterodera glycines
  Coding regions on vcDNA: vcDNA=SeqID_56695; Strand=-; Position=1-49
EAIPEGFGLPINLCAS

SEQ ID NO: 130273 - protein, 134 aa, Heterodera glycines
  Coding regions on vcDNA: vcDNA=SeqID_56696; Strand=-; Position=1 -250,291-445
MRRVMQNREIDPVLEHHVGSDEEQTDGEGQAEQSQSPSNRLFIFANQLLDEDFVAPNGEVQNDEVIDDFDDPMDELVAEEIINLPQDEVWDDEFEQSEHQNLGDLLEVEDLENSIGRMQNLYAGFDVKKQWKRL

SEQ ID NO: 130274 - protein, 341 aa, Heterodera glycines
  Coding regions on vcDNA: vcDNA=SeqID_56697; Strand=+; Position=1-1026
  Homolog annotation: Hit_ID=XP_320889.1; Match level="QueryCoverage =89%, HitCoverage=38%, E-value=3e-81, Identity=48%"; Hit description =ENSANGP00000012033 [Anopheles gambiae] ref|XP_313651.1| ENSANGP00000013044 [Anopheles gambiae] ref|XP_314
MLDAFGLMDDVRKKVAMTLNVNNVKKEESVVDETLSRLRAKFPNVFSTNLGHCKKAKARLSLMADAKPVYCRPRPVPYNTKLVVEAELDRLLAANVIRPVDHTRWAAPIVVVKKAAGSARVCADFSTGLNNVLLSNQHPLPVPEDIFATLNGGHVFSQIDFRDAYHQIELEEGSKELCTIATHRGNFEYQRLPFGVKSAPGIFQSIMDSMLADCPFAIAYLDDVIIVSRTRKEHWTHLAEVFKRIDNFGFWIKPEKCSFGKERIKFLGFIIDKDGRRPDSTKIEAIRRMPIPTNVSTLRSFLGMVNHYQQFVKNLRFIRHVGRPFEAGHGLELVQRMSESL

SEQ ID NO: 130275 - protein, 21 aa, Heterodera glycines
  Coding regions on vcDNA: vcDNA=SeqID_56698; Strand=+; Position=1 -54,576-587
MRTRPIWQVKQRLLTSQKKGF

SEQ ID NO: 130276 - protein, 45 aa, Heterodera glycines; identical to SEQ ID NO: 124527
  Coding regions on vcDNA: vcDNA=SeqID_56699; Strand=-; Position=1-195

SEQ ID NO: 130277 - protein, 186 aa, Heterodera glycines
  Coding regions on vcDNA: vcDNA=SeqID_56700; Strand=-; Position=1-560
MVITRSPILTRQRALNLEIAVDRNGHQINVGGNQQNSLQRQNHSAGESFPQNQQIENSPISPTELAGFNGENGDDSSLVLEPNMTEEELRRRLLVVSIERSQPPANGNAGNGENAEGLRNAIRENDGRPNFGVNGQTFAHQRRPHDTFLSNLMNNGIGNFPQNLVHVPRTSTPTRNVEFEQQIGPF

SEQ ID NO: 130278 - protein, 38 aa, Heterodera glycines
  Coding regions on vcDNA: vcDNA=SeqID_56701; Strand=+; Position=1 -55,593-654
MSALSYRTEIDRLSLAVNEIRVFDLLFEFGFGDRNMPK

SEQ ID NO: 130279 - protein, 21 aa, Heterodera glycines
  Coding regions on vcDNA: vcDNA=SeqID_56702; Strand=+; Position=1-63
MLVLVGCLHLAHALEGAVPHQ

SEQ ID NO: 130280 - protein, 42 aa, Heterodera glycines
  Coding regions on vcDNA: vcDNA=SeqID_56703; Strand=+; Position=1-126
FGATERANNANVRCNRVERVQRTKRWRRDIFGAECHAGRSRA

SEQ ID NO: 130281 - protein, 338 aa, Heterodera glycines
  Coding regions on vcDNA: vcDNA=SeqID_56704; Strand=+; Position=1 -284,648-1058,1107-1428
NLLNMSLSTDHLRFAQYSSVSQKSPSSIELLQRALEAFAVANQSKFANSSAHSAPSIVGSPLIPPPLAHSQSQQLATNGATAAATTMSSVEQQLLSLLNFSQLSSKNGNTLCSFAPHNLLSSDGFCLSSATITATTTTAPTIVSEATQQNNAIVDKVNEQTDEALANSASAAADPSVPIDLSSNQQQSLLLSSAPNLAPPSVPRGRKSCDIRRSASSVSYKGNADVHEHFQRTFSGKWPRRQPSLRAHLQASGRASVGKKEAALCIGENEAEGSGTVRTEEPMEEEEEEGESAARNGAERTNAGGKTGEKGRPKSRQQVKSVYTAVIRKLFTSNEVNQ

SEQ ID NO: 130282 - protein, 55 aa, Heterodera glycines
  Coding regions on vcDNA: vcDNA=SeqID_56705; Strand=-; Position=1 -141,319-345
MASDGQALAKWLFTAHPDNVPKVFECSWGRNNKDDGDWPFKIADFKAIKAGNFIH

SEQ ID NO: 130283 - protein, 159 aa, Heterodera glycines
  Coding regions on vcDNA: vcDNA=SeqID_56706; Strand=-; Position=1 -179,222-314,358-429,473-517,570-614,661-705
MCQSEERNSIGLKSEEMFPSIEKAPEVEQKLKEQEEISRRAKLEERKQQEEREREEKTKRENAYKAPRRTIDGESSRKQMDKERKQLQDTEPTESDTTSNWRDMQRAVPKEEKDKPLRGVSAAHQTNATKSNEGDSNWRTKPTGITSTADSQNSWRTMS

SEQ ID NO: 130284 - protein, 136 aa, Heterodera glycines
  Coding regions on vcDNA: vcDNA=SeqID_56707; Strand=-; Position=1 -152,354-612
MTDLDAFFAKKASKGKKKGVIKLEEISVQLERRAMVFFKPFISKLSQNKRRNKEMRLDDNENKSSVEDISKSRPANEHNEDSERLAFDDKPNVPVVIKEMADSYVEREEEEKRASAEPARTWKTNSEVGFGISNFK

SEQ ID NO: 130285 - protein, 83 aa, Heterodera glycines
  Coding regions on vcDNA: vcDNA=SeqID_56708; Strand=+; Position=1 -35,121-286,365-415
MGLETNQGITKSFSKFSIRVDNQNACHQNIETGRNQCQFEAELRTTKEWQNIHPNVVANPFKTWHLMGVRRAGDSDSGIHFEA

SEQ ID NO: 130286 - protein, 73 aa, Heterodera glycines
  Coding regions on vcDNA: vcDNA=SeqID_56709; Strand=+; Position=1-219
MDPSNECGNSANLVTPRFLFNCSNYVYILRSVAFATNPRLVLTIVENAPGLVTPFHHAHSQAMVKKDTDRRSS

SEQ ID NO: 130287 - protein, 35 aa, Heterodera glycines
  Coding regions on vcDNA: vcDNA=SeqID_56710; Strand=-; Position=1-107
VLVQKHSNVFGFQIHFPICPTDRKKSSTWNLLKTY

SEQ ID NO: 130288 - protein, 192 aa, Heterodera glycines
  Coding regions on vcDNA: vcDNA=SeqID_56711; Strand=+; Position=1 -158,203-623
MSANAELQFVRIKTKAGSTEAEVTIGNGQPLSILEAIELLQKNFTAFEGISISHFDGDVLTLLHHLHSKLDCHHVNLAIETYNTDFSEQILDTILPLIQGVLKSIKMDAKHIENLTQLAPSLLCECPLLHSIATNKFSLEFTAKDGAPIEGQALAKWLHIANPEGLPKMIDFCYNANGLWTINKSEEMKDVG

SEQ ID NO: 130289 - protein, 65 aa, Heterodera glycines
  Coding regions on vcDNA: vcDNA=SeqID_56712; Strand=+; Position=1 -40,170-327
MWGVANRWMDNEAVRQISAMSWMNEWPQCQNWAGKANLWPNPTIERPNRWMDNVTGLQSEFVIPN

SEQ ID NO: 130290 - protein, 34 aa, Heterodera glycines
  Coding regions on vcDNA: vcDNA=SeqID_56713; Strand=-; Position=1-194
FISSGDHCCCCCRCSCVRHSFSEDASLSLLCPAS

SEQ ID NO: 130291 - protein, 45 aa, Heterodera glycines
  Coding regions on vcDNA: vcDNA=SeqID_56714; Strand=-; Position=1-137
KGYIKGVEGPFDWYIVSKMQKPIIVNIIALANLGTGIKLNSLTIT

SEQ ID NO: 130292 - protein, 141 aa, Heterodera glycines
  Coding regions on vcDNA: vcDNA=SeqID_56715; Strand=-; Position=1-426
  Homolog annotation: Hit_ID=XP_309989.1; Match level="QueryCoverage =85%, HitCoverage=44%, E-value=6e-10, Identity=32%"; Hit description =ENSANGP00000015194 [Anopheles gambiae] ref|XP_319667.1| ENSANGP00000022407 [Anopheles gambiae]
MDKTLADILEKLTQAIKQQNAPSTTQTAQNITLPDIQTFSPNSAEEFEEWLERFQFALDCAASNLDDEQKVKLLMTKLSPTAFSEYKRFCLPDEITKFNFADTKSRLLKLFSHPPSLAIDRYECLKACREGGEEFGAFVNR

SEQ ID NO: 130293 - protein, 37 aa, Heterodera glycines
  Coding regions on vcDNA: vcDNA=SeqID_56716; Strand=-; Position=1 -101,994-1006
MKKSVGISNIAENNPYIILVVMLTDSTFETLIKSKIF

SEQ ID NO: 130294 - protein, 69 aa, Heterodera glycines
  Coding regions on vcDNA: vcDNA=SeqID_56717; Strand=+; Position=1-208
FDYAFREYMMTELGFSEDVKKGLCEASCYYVDDVDQDDYTNSGFKNRASRFADGAKCETMVKLNFDIAR

SEQ ID NO: 130295 - protein, 68 aa, Heterodera glycines
  Coding regions on vcDNA: vcDNA=SeqID_56718; Strand=-; Position=1-207
MKLCLLFTLIIFLIVLININYVESVDKKLQQKTFDEIFGEKWEEKEEKQRNEKKKREIIGKFYKIREN

SEQ ID NO: 130296 - protein, 105 aa, Heterodera glycines
  Coding regions on vcDNA: vcDNA=SeqID_56719; Strand=-; Position=1 -153,1700-1864
MTELGFSEDVKKGLCEASCYYVDDVDQDDYTNSGFKNRASRFADGAKCETMKIGVKRKTAKNEILAPKNVEKEWKQNYVEICKKIGVGRDIIKNGRNNLEFAVKE

SEQ ID NO: 130297 - protein, 195 aa, Heterodera glycines
  Coding regions on vcDNA: vcDNA=SeqID_56720; Strand=-; Position=1-586
  Homolog annotation: Hit_ID=NP_701480.1; Match level="QueryCoverage =92%, HitCoverage=5%, E-value=3e-09, Identity=30%"; Hit description =hypothetical protein PFL0575w [Plasmodium falciparum 3D7] gb|AAN36204.1| hypothetical protein PFL0575w [Pl
MKLFPLFFKFILLIIKFDQFEAENKKLEQKSFDEIFGEKWEEKEEKQRNELKKREIIGKFYKIKEKIKQKGRKYSAKEWDKIQRKIAKKLGTNRLYIYEWIKEFGFQKQIKKSYKSKTDEEKLENVEKFIEMKNEFKRKRKHSRKEWDQNYAEICKKIGVNRETLRKWKKQFGISNKRITEKEKMEKMKIYWRIK

SEQ ID NO: 130298 - protein, 137 aa, Heterodera glycines
  Coding regions on vcDNA: vcDNA=SeqID_56721; Strand=+; Position=1 -211,265-467
MLRKPKKTCKKCERCQEVRLMAEIKKENVKAGKCRGEHLPGMIIEAHKTKPTQFKELYTDGDGVLEKILEAVVHCDECANDFAYYKDLWNCSGSMDCGWGPGISWIGEDCLVLHFINSFPLCTFIPKTKRLQNLFVH

SEQ ID NO: 130299 - protein, 132 aa, Heterodera glycines
  Coding regions on vcDNA: vcDNA=SeqID_56722; Strand=-; Position=1-397
MTLSSNHRDSKQQHSSLWDSITTNIPISGTQPTNISITGTQSTNIPINGTQSTSIQSLGLNPPTFQSPGLNPPVFQYLGLNPPAFQSLGLNPPTFQSLGLNPPTFQSTGLNPPAFNHWDSTHQKAIAGTQPT

SEQ ID NO: 130300 - protein, 118 aa, Heterodera glycines
  Coding regions on vcDNA: vcDNA=SeqID_56723; Strand=-; Position=1 -26,185-227,397-453,505-652,706-788
MFKIKTGSLSCKFQFELCNTKSQLTGHYALLEDPHVFPRQELGEPDTTVSYYSYAPWSENSNLKVRIKLLDGKSTQFSFYLLHDIPEPTKNMGATVMQMDVTVTSDNVATMKFTDFFV

SEQ ID NO: 130301 - protein, 99 aa, Heterodera glycines
  Coding regions on vcDNA: vcDNA=SeqID_56724; Strand=+; Position=1 -93,248-451
MSYILIENEKQKLLAFRIFVLVRCLNGYQTRVIIKSNLMNRRIIAQQKRRQQERKFDESLERARMRRGRKSTRARTCVHEATHGWILWKTKDCSDTFEM

SEQ ID NO: 130302 - protein, 135 aa, Heterodera glycines
  Coding regions on vcDNA: vcDNA=SeqID_56725; Strand=+; Position=1-408
MENSRRYMTRQELRRLLDNGVAVEIEDNEINVAHQQGLRTNWTDYAAENFEASPNFQPAAVFMENHRREIAFSSLRVPIRTSSPNNQNRDPVAPPAQNFVLQNMLPRRLDNDTLSFGGEEGGVDQHTRTNCLDFP

SEQ ID NO: 130303 - protein, 328 aa, Heterodera glycines
  Coding regions on vcDNA: vcDNA=SeqID_56726; Strand=-; Position=1-988
  Homolog annotation: Hit_ID=AAK31375.1; Match level="QueryCoverage =77%, HitCoverage=28%, E-value=3e-10, Identity=24%"; Hit description =ppg3 [Leishmania major]
IQQNRDPIGYTKRTRRYPSDRQPRQKHQQQQSKQSPMTDSSDGANPCESAMLSTTSASMPSSSFSGPSSSAYLIPAGGSSSAGAITPAYFCGARPSAYTPEYAGGVGLSSTGAYTPDYAGGGAGSSSAGAFTPAYIGGAPAHASAAYSAGASASSTKPLSIQIPALKLGPLAGPNGANFAGGYPNYNNNTSNNMQAQQQHHLWQQQQHQAQQQKHFTGANGTNSSHFGMRPNAQSISGGTSAGFMSSNNVGGTSSFSTSSSSFPTPIYGNTNAPQNDGGCAGGTTTKKQQQQQPPQNQTPPNNVPAEQMEEDTLLRRMIGIEQILIRI

SEQ ID NO: 130304 - protein, 161 aa, Heterodera glycines
  Coding regions on vcDNA: vcDNA=SeqID_56727; Strand=+; Position=1 -136,216-426,644-782
MVMCTPSDISGKGLFYTISFNRSMIMHILLIIINNTIVLVLKFKKENQHFSKSIFRSLLFLVFLETIGWLPSIYFAQFLKTAKFSPITTTYISAGFTTISTCITSSANGPTLYYFSLLYREEINGFLESIGIKKSISTQHQQHINTMPLNVVTRHNNWTHH

SEQ ID NO: 130305 - protein, 95 aa, Heterodera glycines
  Coding regions on vcDNA: vcDNA=SeqID_56728; Strand=+; Position=1-660
LFEYPKRTLEKIDFFVFGAVPPNRCAQIYGETESFGNSFPIVCTLILRWIFAPHNCLSTPNGHLKKSIFLFSGQSPRTDAPRFMGRPNPSGIASL

SEQ ID NO: 130306 - protein, 41 aa, Heterodera glycines
  Coding regions on vcDNA: vcDNA=SeqID_56729; Strand=+; Position=1-501
IFYRFLNVWIFFWLTKTSSNLALSILIQIAPNFFYSLTRPY

SEQ ID NO: 130307 - protein, 88 aa, Heterodera glycines
  Coding regions on vcDNA: vcDNA=SeqID_56730; Strand=-; Position=1-265
KMALFRFNETKTNRGRSLISCHNFDYCFERDARIAEGFEYWRCPRRPPYCPGRATVQSAWQIDPDGNRFKMGRVTAPHNHPPIFGQHN

SEQ ID NO: 130308 - protein, 431 aa, Heterodera glycines
  Coding regions on vcDNA: vcDNA=SeqID_56731; Strand=+; Position=1 -165,224-649,720-870,921-1474
  Homolog annotation: Hit_ID=AAG00554.1; Match level="QueryCoverage =93%, HitCoverage=63%, E-value=6e-38, Identity=29%"; Hit description =retinitis pigmentosa GTPase regulator-like protein [Takifugu rubripes]
MAKPEHFLRTFKHIASTPPEIVAKAKYVSRTACANEAKACMDLLKQAQTYLQRAQEKDEEERRQREQQEEQRRRLLARQAEEERRRQEELKMRLEKLNQQRQKFVDETKDILRLPQVNEGKRIINPGKFAPFSTISTHCFLLIMFILHTKIREEKKARVSTSRKKREGGEAEDFVNDSSDLGEYEDEELRNAARKMKTKKRPEQEMSGGSEEDDATVERRQKKIKAVEKRKRDRNLDEQVPARLRGKIKSKAYLSSSSSSPSPAQSGAEKSGDEEEKERDDEEMEVRAEKGGEEEEREDEEMEERAEKGGEEEEEEEENEREEREEEEREKMLEEGEEREEKGENEHGEEEEEEHERRDEEGEENVHGEEEEEEHQPRDEEDGEESGGGGEGDEGEEMEEEEEKDEEGSERREAMGEGEEQDGEEEEEEEE

SEQ ID NO: 130309 - protein, 159 aa, Heterodera glycines
  Coding regions on vcDNA: vcDNA=SeqID_56732; Strand=-; Position=1 -129,237-482,668-769
  Homolog annotation: Hit_ID=CAH93105.1; Match level="QueryCoverage =98%, HitCoverage=74%, E-value=6e-15, Identity=32%"; Hit description =hypothetical protein [Pongo pygmaeus]
MDMDKILSDMRQHISNLQDKLHVANSAVSKGQIVNEKITLMKEYQDKIASLNSCWRARNRTQLVHNLQQESRQIIALEEENRQLRFALKEMEDGLHLIMNDYRKMFSGFMRGEELAEVANAQHKKVFLAGVSYEQYFGIARAAEKFMAISENKVAEDDQ

SEQ ID NO: 130310 - protein, 58 aa, Heterodera glycines
  Coding regions on vcDNA: vcDNA=SeqID_56733; Strand=+; Position=1 -165,385-396
MVLLKSLLFFLPFYLFSFSLVSCPPPPAKRQKTEFQHENKANDNENRVEEEEPDKQGK

SEQ ID NO: 130311 - protein, 38 aa, Heterodera glycines
  Coding regions on vcDNA: vcDNA=SeqID_56734; Strand=-; Position=1-115
MPSFNTKNVGIDEVRKSSPEASDTGPRLDFRIFAIFGL

SEQ ID NO: 130312 - protein, 87 aa, Heterodera glycines
  Coding regions on vcDNA: vcDNA=SeqID_56735; Strand=+; Position=1 -17,93-339
MKMEYDSAIFGFAIKEQEELDKTIQYKKGTYAWESDGSVWINGEGKGTNDEYYYGVGDTVGIGVHLITGQLFFTWNGQCLGWQTNNI

SEQ ID NO: 130313 - protein, 112 aa, Heterodera glycines
  Coding regions on vcDNA: vcDNA=SeqID_56736; Strand=+; Position=1 -135,703-906
MREQRDVIFYFFRHHPARIFHQFGLHCLLIIQCCLRRAGQFDHYLPSSSAEEKGQEMVVAHCSAAKTPCGRSNACNKALESTAKHLWPTFVEPIGARKSFQNVAKPVDANQH

SEQ ID NO: 130314 - protein, 101 aa, Heterodera glycines
  Coding regions on vcDNA: vcDNA=SeqID_56737; Strand=-; Position=1-306
MIKNEDWHFANLSDVKMIEWNLLKLAFYKNDQGKKWKEIEEKLTEWKKEFLNSFQNERNNSKFQKMLQQLEEKLEKFEKAVTEKKKSVWTKIVEKLSEIFD

SEQ ID NO: 130315 - protein, 102 aa, Heterodera glycines
  Coding regions on vcDNA: vcDNA=SeqID_56738; Strand=+; Position=1 -328,357-395
NYELAILYSKILQLIIVAITNINKYQKRYDCDIKFCNCLNEYPNCFQTKVCSPTHILNILFFRIYYAGQFIFLENVLKKDKNNYFILPSLDMHMYFKFFIVM

SEQ ID NO: 130316 - protein, 39 aa, Heterodera glycines
  Coding regions on vcDNA: vcDNA=SeqID_56739; Strand=-; Position=1 -106,225-238
MSWRTDFCLKAIRIFIKAIAKFNITIVTFLIFIYVVCHC

SEQ ID NO: 130317 - protein, 217 aa, Heterodera glycines
  Coding regions on vcDNA: vcDNA=SeqID_56740; Strand=+; Position=1 -610,651-694
MFSTVSIATLFLINAYSFYSITAEEANIGNIPASNDKMPKDLASDDKMPKDLASDDKMPRSGKVQSERGMETNLTIGNKKPSNDKIPRSAQIPSEMGMETNSTIKNKTPSNDKMPKDLARDGKALQSKVKTKKNLTIGNKKPSNDKMQKDLARDGKTSRSDKMSNKDITQSGNKTETNLPNENNLPNNDKMLNDDTELLDEFKALLKSDTYKTKGAK

SEQ ID NO: 130318 - protein, 200 aa, Heterodera glycines
  Coding regions on vcDNA: vcDNA=SeqID_56741; Strand=+; Position=1 -45,384-681,775-942,1117-1214
  Homolog annotation: Hit_ID=CAE62006.1; Match level="QueryCoverage =96%, HitCoverage=25%, E-value=2e-49, Identity=55%"; Hit description =Hypothetical protein CBG06014 [Caenorhabditis briggsae]
GFFKLSDFFDQSFLNQDLIGQFGVGFYSAFLVADRVVVTSKHNDDDQYIWESDSSQFSIVEDPRGATLKRGTQVSLHLKEEAYDFLEPDTLKKLIQKYSQFINFDIMLWQSRVPVEESEEEKKETEEKKKEEAEEKPKEEKEEEKQKEEDEVVEEKKEGEEEEKKEEEEFRYVSKIKCSYNYIKIIIMHIHFLGGGGFAA

SEQ ID NO: 130319 - protein, 20 aa, Heterodera glycines
  Coding regions on vcDNA: vcDNA=SeqID_56742; Strand=-; Position=1 -54,108-116
MNEKTYGLIQLQIVQDFWDS

SEQ ID NO: 130320 - protein, 22 aa, Heterodera glycines
  Coding regions on vcDNA: vcDNA=SeqID_56743; Strand=-; Position=1 -54,167-181
MSTADTVCMKYLGLTNRIDLTR

SEQ ID NO: 130321 - protein, 95 aa, Heterodera glycines
  Coding regions on vcDNA: vcDNA=SeqID_56744; Strand=+; Position=1 -166,253-360
  Homolog annotation: Hit_ID=NP_733439.2; Match level="QueryCoverage =91%, HitCoverage=11%, E-value=4e-28, Identity=65%"; Hit description =CG1775-PC, isoform C [Drosophila melanogaster] ref|NP_524610.1| CG1775-PA, isoform A [Drosophila melanoga
CVTTPRTLDGRLQVHGRKGFPHVVYSKIFRWPDLHKNELKHKSFCVCAFDLKVEQVCVNVCVNPYHYQRVVSVEGIELESNNGRLVKKLLLHISI

SEQ ID NO: 130322 - protein, 380 aa, Heterodera glycines
  Coding regions on vcDNA: vcDNA=SeqID_56745; Strand=-; Position=1 -935,1669-1874
  Homolog annotation: Hit_ID=NP_523475.3; Match level="QueryCoverage =78%, HitCoverage=79%, E-value=4e-18, Identity=29%"; Hit description =CG3047-PA [Drosophila melanogaster] gb|AAF50957.4| CG3047-PA [Drosophila melanogaster]
MGPPHPPSTQEEDQSFQPPGFEEFPEAPSVDSDAEKSPATNENGVASLPMPPAPLSSGKTPTKQTNKLDLSPPIAPPGFASKPDTVQTNGTMTAANRMTVLTNTTAQTTALTQTNYPTTKPPIQTNPQTISANTQTNYPKTQTSVQTIYPTTQKTVQTIYPTTQTPIQTIYPTTQKPVQTIYPTTQTSVQTIYPTTQTPIQTIYPTTQKPVQTIYPTTQTSVQTNPPTISLFVPTNNTVEALPASLPTASQSQILTQDINGTTFSRIPKPLETRKSPEQLRKEVQKELPKDTKVPLELTPEFKQQKAEVQQIRAAFGQQNQAQIDAWKRKLAEMEAEKLRIEAGARQAEFQRQQKAQQEAWKKKMAEMEEEKQMREEAEK

SEQ ID NO: 130323 - protein, 80 aa, Heterodera glycines
  Coding regions on vcDNA: vcDNA=SeqID_56746; Strand=-; Position=1-580
LFEYPKRTLEKIDFFVFGAVPPNRCAQIYGETESFGNSFPIACTLILRWIFAPHNCLSTPNGHLKKSIFLFHKYFFQKVL

SEQ ID NO: 130324 - protein, 23 aa, Heterodera glycines
  Coding regions on vcDNA: vcDNA=SeqID_56747; Strand=+; Position=1 -60,119-130
MGNHSSIIDLPCCCDCICCLRIE

SEQ ID NO: 130325 - protein, 263 aa, Heterodera glycines
  Coding regions on vcDNA: vcDNA=SeqID_56748; Strand=-; Position=1 -110,159-321,765-943,1037-1109,1392-1623,2026-2060
  Homolog annotation: Hit_ID=NP_502119.1; Match level="QueryCoverage =95%, HitCoverage=14%, E-value=2e-92, Identity=60%"; Hit description =AMOP domain containing protein family member (4M59) [Caenorhabditis elegans] pir||T22643 hypothetical pro
MYDTTTFSRQEADSRQAFISQKAKEMCHDWYDEDGAQWNFIRDVETNASCPCMEHQAKFDLGRFMPHPRCSQTFRDIACTSTIGAKNCYMSASNIYGSYSGQHFDYGHGYAYGEFGREFRDEGVPPGGAEGGGAGPFGYGGYYGRERNQGNRFPTHYGQVCCYDEKGFLMQTTYQPVIKVIEETPYNPGYPLRAYEFGTSPYMGQFEVPGLSAFHHDYMPYFLCCKFAKFRCQLFYWRRPSSGCQQYQPPAIDFLCLISLICT

SEQ ID NO: 130326 - protein, 182 aa, Heterodera glycines
  Coding regions on vcDNA: vcDNA=SeqID_56749; Strand=+; Position=1 -439,495-604
MLLFLVALTLICIVASRFEVDYDQLTAEQKERLKLSLNKINVGYDQLTAEQKENLMRSFKMIEEWNKTPGITYTVLFKYFLCHVISLIQLGINQFSLMSDAKIQSFVRRTRDDIGLPKIPHRCGGDCYQIKPKPLKEENELALVGKVDAVTFRQIDERKGEPERQAKCSPISRFLSFYGLIC

SEQ ID NO: 130327 - protein, 90 aa, Heterodera glycines
  Coding regions on vcDNA: vcDNA=SeqID_56750; Strand=-; Position=1-270
MSGTNSSVGGAGAAKLRPSVEFLHTGSSVPLWSRNPLANLFRRSKRKEEKHRRIGTTEQEEEGEDGAKQHNGKDGASSSNTKRVDKARKR

SEQ ID NO: 130328 - protein, 82 aa, Heterodera glycines
  Coding regions on vcDNA: vcDNA=SeqID_56751; Strand=-; Position=1-250
AAGVPPSLYVRLPQPDDPFYFCALAVGLAAVPPITFGISGPPLHVFVQADGVTDAPKVELEDKQLWEEFHKFGNEMIITTSG

SEQ ID NO: 130329 - protein, 112 aa, Heterodera glycines
  Coding regions on vcDNA: vcDNA=SeqID_56752; Strand=-; Position=1 -78,162-422
MDNQKRLCLRAYVGLPNLEWLNNLRETFRHATTFSSVSYTVQFTLSASQIVPFELVNERTKEMLTLEKLSNYGGGEWLLKRCPIIGEKKDENSDAILNNIQFIFWGGSNCIW

SEQ ID NO: 130330 - protein, 58 aa, Heterodera glycines
  Coding regions on vcDNA: vcDNA=SeqID_56753; Strand=+; Position=1-174
TRVVQQLFYLTTSIDDAIEENRHKIGDQMYAFVTNLSNICEQLGTVGMDNVKMDEYLN

SEQ ID NO: 130331 - protein, 123 aa, Heterodera glycines
  Coding regions on vcDNA: vcDNA=SeqID_56754; Strand=-; Position=1 -68,124-204,244-466
MNFFNLLTVFLSLVINCSAPPIRPLSSVAGIWKKCNGKNGTILVENGCTKLLLCYQSEMAKNKKISKRFGVGKGNIGKLKFVECAEEIAEDQWHGLIITKHQDGVISYESRQIEREKYFRIWI

SEQ ID NO: 130332 - protein, 1162 aa, Heterodera glycines
  Coding regions on vcDNA: vcDNA=SeqID_56755; Strand=-; Position=1 -624,1405-1902,1952-2259,2311-2711,2758-3100,3146-3717,3765-3956,3998- 4093,4144-4274,4325-4648
  Homolog annotation: Hit_ID=NP_001004509.1; Match level="QueryCoverage= 77%, HitCoverage=58%, E-value=5e-95, Identity=29%"; Hit description =si:busm1-180o5.3 [Danio rerio] emb|CAD60788.1| novel protein similar to DNA polymerases [Danio rerio]
MQNQPPKRPTNFSIDSILYSNKKPRHGFLINQLLGVIQEGAGVSTTTTNKTANDYVKKLGSSVEHVPRFQYIKVKNQFNIEDVPANPEGLLAGIFQYCIDQSMQDSREREIEPTHLGCLISSPLLTSGDIPIPIRQITDNTVNTILNQFNKVAQSKQQQNVTLWGEPFKVIITVVDRSSLPIKRNLKGGARRNLAPVHHRIHDQCLIKGHKCYESYCQLCMSYHNPDRGCFIQPLQPKEHDPYRIVAFDLETMQHQPVSAQQPERREHQPNFIAARIACPDCIDNGNWKRATAGCRICGPYRTVTFCQRRFVDTAVDKQVIDENPLAAFVDWLVFQLPKKHDTFAYSHFGGRFDMVLVFREIFRIGFNPEMLRRGNKMYEMKIRKQKKRNPNITFRDSFNLMPCSLAALVPSYGLDVEEKPFFPHLANRPDNYGRQIYPTPDDYLAEGMMPEKRRQFDAWYEQHQAEPFLLDEALASYCTNDVEILMAALVAFRKEFFEISRRNEYVDGIDERENHDGIDVLRECMTIAGACMRPFRTNHLPTEHLAIVPERGYDNTQNQSLLALRFFHWYAEEHGVQVQTAHSPGGEKRIGPYSLDGWIETERRAIEVNGCTWHGCKKCYPRDNMLLPNGKTAGEVRERDAKRLDYLRSQLGRVDVYWECEIERMLERSREMRQSFAEYVDDGPLVIRDAFMGGRTGPLKLLHKAREGEKISYFDFTSLYPHINFVTSYPIGQPNVHVFNEQVDWHSSNDNPYPLALLKVWVIPPRQIDVPVLPVKVDNRLCFPLCIKCAKEWPTGGVDFDYHCDHSDQQRGWVSTCTSIELNAALDEGYRVTKLFRVLEYERSDDQLFRPYIAEFMAQKIQASGFDKNIKGQSDKEEQFVRECAEMFGICIDPTKMIVNKGKRSLAKLCLNNLWGRFSLRNFGLSQTLITDDPATLAEYLDNKSIDVTSIDELDTEHILISYLHKKDWVEEHECSNIVISLWTTSAARLVLLKAMQKVVRSPGCALLYTDTDSLILVHPDEQCPLKTGPHLGQFTDEYPEHNIIEFCSGGAKQYGLCLQRKEAGADTVKEYVLKVRGMTLNYDVINNQGLRYDTFKEEVVRYATTGDFEPITVTYPNFLRPNIREGGRVISMPMQKCYRPFVGKGIVGAEFKVMNFGHTL

SEQ ID NO: 130333 - protein, 17 aa, Heterodera glycines
  Coding regions on vcDNA: vcDNA=SeqID_56756; Strand=+; Position=1-66
HKHLFDLFYHIHNLIKI

SEQ ID NO: 130334 - protein, 185 aa, Heterodera glycines
  Coding regions on vcDNA: vcDNA=SeqID_56757; Strand=-; Position=1 -138,1593-1649,1692-2054
  Homolog annotation: Hit_ID=CAE66656.1; Match level="QueryCoverage =84%, HitCoverage=18%, E-value=1e-12, Identity=31%"; Hit description =Hypothetical protein CBG11993 [Caenorhabditis briggsae]
MRGFELDGGAFFMCTEISPRCYTIQQVKIAATKNGLMSGTEGLKKRLSDVDDALKGFAMRRPSQTSASASPPAFPSALRPFPFAGLSTCASNSPLPMLPWWFTAECRQELMGVPPPPPDERVPTPDTRPPSSVGEQPMSPEQLRQRIRRQLEYYFSRSASEIAKSVVVLKGKPGQRPLSEMPNGR

SEQ ID NO: 130335 - protein, 101 aa, Heterodera glycines
  Coding regions on vcDNA: vcDNA=SeqID_56758; Strand=-; Position=1-306
LTHERADETQSSSAGNGTEFGRSVPSSSDLVLLVRAPSPSLRQLPFLSPVKNWGGFLSPKQTVETVSAISEFSADLFKTPSPARLGKRPIICANVGQLLTP

SEQ ID NO: 130336 - protein, 299 aa, Heterodera glycines
  Coding regions on vcDNA: vcDNA=SeqID_56759; Strand=-; Position=1-897
MKGYCSTEMEMFFFRENPPNRTLGVMNQNVVVADPNLENSEQLDSMEMRRRLLNPNNDSALGQLRQNERASLDENEEEEANQGFMRNRTDWTQNLGERAGPTQQIFRNFVFGHSQNEDDFFDHPNIRRTSTPVNENRCVGVGPQNLNEIGLLAEQIGRVIVGQLNSAHQNPNTNPALNLTQHGVEIHQQIHHSAVFARRANNIPVRMPGQQNPAAIQQNFGRPQSQQIQPPNFQPRQPYAWPMNEQCVQVQQPTMPQMNYQPPPTLTHIKISLILAWENLILGLYWSGSLTSQAPKDRM

SEQ ID NO: 130337 - protein, 131 aa, Heterodera glycines
  Coding regions on vcDNA: vcDNA=SeqID_56760; Strand=+; Position=1 -114,163-273,317-487
MTLKIVSSLENLIRLTPDVHSILVLDGDGVPVVSAGEEIRNRSQYSISYNSLVEQAKKLGMGEQKFWVFRYEMNQVVMLRRDAFAVFIMASANANMGILCTMSAQLGPILEECKVIVNEVINGQMAGQSPR

SEQ ID NO: 130338 - protein, 46 aa, Heterodera glycines
  Coding regions on vcDNA: vcDNA=SeqID_56761; Strand=-; Position=1-140
KNFKLDALFKVLALPDEEFEEWLRELKLLHTTRFCDCGNEMRYKWI

SEQ ID NO: 130339 - protein, 167 aa, Heterodera glycines
  Coding regions on vcDNA: vcDNA=SeqID_56762; Strand=-; Position=1-504
  Homolog annotation: Hit_ID=CAB88203.1; Match level="QueryCoverage =89%, HitCoverage=57%, E-value=7e-28, Identity=44%"; Hit description =putative cuticular collagen [Globodera pallida]
SQAVLLVLLARLGPPEHPASPAAPGSREAQDSPDNKHRHALRPCRRVRNAQLGRPVSQEAKDRLGHPETMDSPGSLEQGGGQGPPGPPGPQGQPGQPGQPGGPGQPGQPGQPGIKRRENRTQPIKIIEMFFVSTTIPGPPGPPGNPGAPGQPGSPGQPENPRRTRTA

SEQ ID NO: 130340 - protein, 213 aa, Heterodera glycines
  Coding regions on vcDNA: vcDNA=SeqID_56763; Strand=-; Position=1 -134,186-247,354-457,530-576,762-977,1069-1097
  Homolog annotation: Hit_ID=AAO85552.1; Match level="QueryCoverage =99%, HitCoverage=50%, E-value=9e-63, Identity=57%"; Hit description =ubiquitin conjugating enzyme UBC-25 [Caenorhabditis elegans]
ATLTRVAQAQRQQHLSGNPTGSLTASDRLMKELKEIYRCQNYKNGVFTVEVFTVELQNDNLYEWDVKLKKVDNDSLLAADMRQLAKPPHNQDHLLFHFTFANSFPFEPPFVRLVSPFEPPFVRLVSPVVANGFVLSGGALCMELLTKQGWTSAYSVESLITQLGATLVKGNARISFERNAHINYSLARAQQSFRSLVQIHNKSGWYTPPKNEG

SEQ ID NO: 130341 - protein, 142 aa, Heterodera glycines
  Coding regions on vcDNA: vcDNA=SeqID_56764; Strand=+; Position=1 -98,161-333,1209-1363
MVRTEDRSVGRPSDQSSVRSAAPSNSLERKTDHLVSDRGDHHLDPALRLFVSSLRGYVRLRFGFRFLCDFALFPGLSLYFVLVSFLTIGFGGHVWILAKVHSIFTKAFAIVDQFIRAQMALPRGAGVSFVRLDRDDFHPLYQ

SEQ ID NO: 130342 - protein, 182 aa, Heterodera glycines
  Coding regions on vcDNA: vcDNA=SeqID_56765; Strand=+; Position=1-549
MKMLLTFLLLCALIFENSIDQIEAGKISQEKSFAEIFGQRWDDGAEEENICQNDQIIHGETVDQNQYDQQFDHLEVKEEESEEMSTDCDELGQLPMPTNNGQSCDKFSNETNKNKRETVEKFHKIKEKVKQMGKKYSTKEWVKIERKIAKKLGVSQEKIYKWKKQLGLNIINRLRMNKNVKY

SEQ ID NO: 130343 - protein, 46 aa, Heterodera glycines
  Coding regions on vcDNA: vcDNA=SeqID_56766; Strand=-; Position=1-139
MAAQSSFPQRTLNQMEGRSISSSDDEDEDLMKMCGIGDEHGHGREF

SEQ ID NO: 130344 - protein, 171 aa, Heterodera glycines
  Coding regions on vcDNA: vcDNA=SeqID_56767; Strand=+; Position=1 -99,217-345,392-557,647-691,741-816
  Homolog annotation: Hit_ID=NP_001005925.1; Match level="QueryCoverage= 98%, HitCoverage=56%, E-value=4e-76, Identity=82%"; Hit description =zgc:92836 [Danio rerio] gb|AAH83536.1| Zgc:92836 [Danio rerio]
RCMNPEEIFTKLEPIGRGSFGEVYKGINNQTAEVVAIKVLDLEEAEDELEDIQQEIKVLSQCDSPFVTRYHGSYLTGSKLWIIMEYLGGGSALDLTKSGRLEEKHIAVIIREILRGLDYLHSERKIHRDIKAANVLLSTNGDVKVADFGVAGQLTETVRKRMTFVGTPFWM

SEQ ID NO: 130345 - protein, 213 aa, Heterodera glycines
  Coding regions on vcDNA: vcDNA=SeqID_56768; Strand=+; Position=1 -40,105-257,302-427,892-1215
  Homolog annotation: Hit_ID=NP_505311.2; Match level="QueryCoverage =98%, HitCoverage=60%, E-value=8e-19, Identity=45%"; Hit description =germinal Center Kinase (70.5 kD) (gck-1) [Caenorhabditis elegans] gb|AAK77642.2| Germinal center kinase f
EFVELCLNMDPENRPSARELLRHKFILTAKKNELLRDVIERSTEFRIRQQQQQNLSADSDVDSDGNDGTTCWEYPTLKNTDILDHRQLSDIERAVLDAADNVATIKHNQVNNVPSTFVADVSVGIAPPPPPIRGVRCSSLENTLLPALDELTRTRHGAAHLDTIAVALKRAEQASPGLCDHLVTELITTMAHPQCTNAELRKAIDRLTTRRND

SEQ ID NO: 130346 - protein, 139 aa, Heterodera glycines
  Coding regions on vcDNA: vcDNA=SeqID_56769; Strand=-; Position=1 -55,111-174,273-393,986-1088,1142-1217
  Homolog annotation: Hit_ID=AAK69546.1; Match level="QueryCoverage =100%, HitCoverage=23%, E-value=4e-49, Identity=62%"; Hit description= folylpoly-gammaglutamate synthetase precursor [Cricetulus griseus]
LDDIDRLNVVHITGTKGKGSTAAFLESILRSLGYKTGFYSSPHLVHVRERIRINGRPISKQIFTQQFFHIYNTLFEHKKEVKLMPAYFKFLTLLAFRIFCDERVDVAIVEVGIGGEYDCTNVIRRPIVCAINTLDLDHT

SEQ ID NO: 130347 - protein, 59 aa, Heterodera glycines
  Coding regions on vcDNA: vcDNA=SeqID_56770; Strand=-; Position=1 -84,417-512
MPKNDLGFNDQTIRSRFVRKVFFIVGIMLSVVTLMSAFPFMCQPMMEFVQQHPVYAIVA

SEQ ID NO: 130348 - protein, 222 aa, Heterodera glycines
  Coding regions on vcDNA: vcDNA=SeqID_56771; Strand=-; Position=1-669
  Homolog annotation: Hit_ID=XP_318550.1; Match level="QueryCoverage =84%, HitCoverage=19%, E-value=5e-54, Identity=50%"; Hit description =ENSANGP00000020240 [Anopheles gambiae]
PIEGLDEAKFIQFYRRRDEISIVKDCLMFGDRTVIPKSLQKQILKMLHQGHPGVKRMKSLARMHVYWPMMDAEIETFVQKCTSCAAVAKNPIKTTLQSWPKSDGPWKRIHIDYAGPFHGKMYLIVVDSFSKYPEIFEMNSTNALATISKMRSLIAHFGIPETIVSDNGTQFQSHQFQNFVKSNGIEHIFTAPYMPQSNGQADAKQFSRPISCQPNPRTSNSG

SEQ ID NO: 130349 - protein, 132 aa, Heterodera glycines
  Coding regions on vcDNA: vcDNA=SeqID_56772; Strand=+; Position=1-396
MIHLIVHNKRNPGQIDESDHFAGKIQSKDIIKEDQDKVTKVIILLGRYNSKDIIKEDQDKVTKVIILLGRYNSKDIIKEDQDKVTKVIILLGRYNSKDIIKENQDKVTKVIILLGRYNSKDIIKEDQDKVTK

SEQ ID NO: 130350 - protein, 95 aa, Heterodera glycines
  Coding regions on vcDNA: vcDNA=SeqID_56773; Strand=+; Position=1 -63,120-250,610-703
MCLTGDPINASKALESGLVAEVFPPDQLVSEAIKLRRKNCSKFTTDGRNGETGGEPFIRNDAPRRMTAKKAWRHFRRSANPTGKTHRDRERKDTK

SEQ ID NO: 130351 - protein, 98 aa, Heterodera glycines
  Coding regions on vcDNA: vcDNA=SeqID_56774; Strand=+; Position=1 -166,650-780
MGLRTSDYKAYKSVLHSFAARNSYPLPYNFRIDYGFLNYLLVEKVNDLIYCILPKTLSFNSAPTNVFRRLQQSIELSGRRPSATVRHRKHWQRWWIYV

SEQ ID NO: 130352 - protein, 25 aa, Heterodera glycines
  Coding regions on vcDNA: vcDNA=SeqID_56775; Strand=-; Position=1-76
KTSWRRNGSAETRAPKRERRNAWVP

SEQ ID NO: 130353 - protein, 122 aa, Heterodera glycines
  Coding regions on vcDNA: vcDNA=SeqID_56776; Strand=-; Position=1 -126,184-426
MEEKKEQQLKKRKKKIAAEHQQKQQHQQKQEHWKEERRKRKRLNTSRNNNISRSKNIGRRRDGREREENGGEKGAATEQVLLMDVGNPPPKSRKIIVTFLKGKFIHSIDSKPFYISDLFIYI

SEQ ID NO: 130354 - protein, 252 aa, Heterodera glycines
  Coding regions on vcDNA: vcDNA=SeqID_56777; Strand=+; Position=1 -393,451-734,793-874
KRGTDLYLWISSSHSTNGQPIWDVFVREIWPIFSTNIRCLGFTGGDHLDHLRRRTSPTILTDLNQLNSICSCDLSPAAFGDDFDGPNSIISAGQALSKWLHSPRKDGQPKRLRCEDFKGQTDFDWANNFKEHFLRANAISSVSYQIRFYVHVPSMPMVPFELVNEWTKEKLTLAKAKKNEWGIGWIMKRCKIGEAVFVQQQKKDEKWINNCNNVLFWLDSDTNCIGPLSPPPKEEDEAGQSSEKGASSADNE

SEQ ID NO: 130355 - protein, 144 aa, Heterodera glycines
  Coding regions on vcDNA: vcDNA=SeqID_56778; Strand=-; Position=1-435
MALKKWAANVRGANVGPQKTDRNCRFWLVAANVVTRNQQQQKGNSEGGGEGRENGGKERKREEKKEQKLKKRKKKIAAEHHQKQQHQQKQEHWKEERRKRKREKGRRKRSSNGTSNANGCRKSPAKIPKNNCHIFERKIHSFDR

SEQ ID NO: 130356 - protein, 63 aa, Heterodera glycines
  Coding regions on vcDNA: vcDNA=SeqID_56779; Strand=-; Position=1-193
WMSFGFAVKQQNKLDGTIRSRKGTYAIDSDGKIWINGKETGINVEYSYGAGDTVGIGVNSIIA

SEQ ID NO: 130357 - protein, 200 aa, Heterodera glycines
  Coding regions on vcDNA: vcDNA=SeqID_56780; Strand=-; Position=1 -90,202-255,325-433,477-573,670-922
MKSSHNYKMIRRKFWKKSVFWRNSKKSSQKKKIVETISALEQEPKQRKAFSNFRQNYWDANFRHENLQIIGNKSLIVHYKRNFSGYCSSAFAKHPILLDKNSSDNFYYEISIGNLKCWMSFGFAVKQQNKLDGTIRSRKGTYAIDSDGKIWINGKETGINVEYSYGAGDTVGIGVNSVIRQITFTKNGKQLGWQIKILNF

SEQ ID NO: 130358 - protein, 157 aa, Heterodera glycines
  Coding regions on vcDNA: vcDNA=SeqID_56781; Strand=+; Position=1-471
MHLKLCLLFFSILFLIIRTDQIGSENKKLEQKSFDEIFGEKWEEKRNEEQKRREIIGKFNKIKEKIKQKGRKYSAKEWSKINGKIAKKLGTNRNYIYEWIKELGLNQKNFYKSKTDEEKLKIVEKFIEMSNEFKEKGRTYSIKEWNKNYAEICKKIG

SEQ ID NO: 130359 - protein, 91 aa, Heterodera glycines
  Coding regions on vcDNA: vcDNA=SeqID_56782; Strand=-; Position=1-275
MSSSNLMVAASPYTRSASSVIHSHGARFGSDQPQTQQLQQHCIYHADGSMYNNSTLVEPGGVHGLHPLSTATSSSTLVVNINNNNGTGNAA

SEQ ID NO: 130360 - protein, 199 aa, Heterodera glycines
  Coding regions on vcDNA: vcDNA=SeqID_56783; Strand=+; Position=1 -303,360-454,597-643,695-773,840-915
  Homolog annotation: Hit_ID=NP_872245.1; Match level="QueryCoverage =79%, HitCoverage=12%, E-value=2e-45, Identity=54%"; Hit description =protein kinase 25 family member (kin-25) [Caenorhabditis elegans] gb|AAO44917.1| Protein kinase protein 2
MSPAVRLDLASEISTMQRLRHQNLVQLFGVIFSEHIMMVIELCEDGSLLDRLRSQTKPRLLVTTLLNYAQQIASGMSFLESRKCLHRDLAARNVLLTHEEQVVKIGDFGLTRILKDNERLYIMSEPKKIPFSWSPPESLRFREFSHKSDVWAFGVTLWDFSLLAKSRGPGIVQLRFSNFSKVTFGCACPTFVREKFTIL

SEQ ID NO: 130361 - protein, 118 aa, Heterodera glycines
  Coding regions on vcDNA: vcDNA=SeqID_56784; Strand=+; Position=1 -76,132-412
MAIVPSLLMLDQKQYGLPLPGQQNELANPLQMPNELTDHQRKDCGQKLAAEATLAIGSRGNSANELNSHRHSTAIEWLSDGQSQQMGTKQSQKRMEHKCASLPQNEIVAVSKSSGNLN

SEQ ID NO: 130362 - protein, 88 aa, Heterodera glycines
  Coding regions on vcDNA: vcDNA=SeqID_56785; Strand=+; Position=1 -108,374-532
MIKKETERNGLFKRKKCLKNKGDVLMVLKKGSIICMYMHIMTANDCLNKTGIFEQPRSGFGNDHQQESNPDLPGFEISDFFKKCFDHA

SEQ ID NO: 130363 - protein, 59 aa, Heterodera glycines
  Coding regions on vcDNA: vcDNA=SeqID_56786; Strand=-; Position=1 -107,582-654
MPKSRLPMSPSWRSSRETKNGRPTVNRWWRQCASTRSQTQNAKLANLSCFMTAQETKSL

SEQ ID NO: 130364 - protein, 166 aa, Heterodera glycines
  Coding regions on vcDNA: vcDNA=SeqID_56787; Strand=-; Position=1 -75,140-186,1112-1355,2334-2468
  Homolog annotation: Hit_ID=NP_507051.1; Match level="QueryCoverage =96%, HitCoverage=41%, E-value=2e-20, Identity=34%"; Hit description =MOSC N-terminal beta barrel domain and MOSC domain containing protein family member (5Q577) [Caenorhabdit
MLLISVHVEQGVLRVDFPNRSSPVEVNLKEVEERNIVLRAKLFSDLQTDGLDCGDEVATALDEFLLEGKAAATTTEDGSGGGTVGRKLRLIYYGGDWLYTERDPKPDKSWWSNNPVPDVQDKQISVDARHFRPNLVVGGLPPFDEDRWLYVRAGEAEFVCYKPCTR

SEQ ID NO: 130365 - protein, 95 aa, Heterodera glycines
  Coding regions on vcDNA: vcDNA=SeqID_56788; Strand=+; Position=1-288
MENFFRFVQLANTFGFQFDLDQKLLRWNSSTVPTMVPEEEEAEMDAKTAQCQQHQQQQQPMEMETDEPTLITWTDQQQQEQQKRQQQRRKGGQTN

SEQ ID NO: 130366 - protein, 67 aa, Heterodera glycines
  Coding regions on vcDNA: vcDNA=SeqID_56789; Strand=-; Position=1 -49,158-331
IEIIKGSGCPGASYTGLNFKRGKSMTALIFWTCKVVITGTKNNSEIDEMYHYILPYLKMAQKKLGRR

SEQ ID NO: 130367 - protein, 20 aa, Heterodera glycines
  Coding regions on vcDNA: vcDNA=SeqID_56790; Strand=-; Position=1-62
MPGNKPCRVDEKHISKPLKH

SEQ ID NO: 130368 - protein, 29 aa, Heterodera glycines
  Coding regions on vcDNA: vcDNA=SeqID_56791; Strand=+; Position=1 -70,411-430
MAAEQQMELDFSTDGNNSEPSLAARIVGS

SEQ ID NO: 130369 - protein, 150 aa, Heterodera glycines
  misc_feature (5)..(5): Xaa can be any naturally occurring amino acid
  Coding regions on vcDNA: vcDNA=SeqID_56792; Strand=-; Position=1 -153,248-335,852-946,1028-1114
  Homolog annotation: Hit_ID=CAE74254.1; Match level="QueryCoverage =85%, HitCoverage=20%, E-value=1e-58, Identity=79%"; Hit description =Hypothetical protein CBG21943 [Caenorhabditis briggsae]
SFSLXNYFIFRNIEKINLDCPPQLVPVPGEGATPYRYCSPSAPINDGIQGCGINRHCQYSTTLERYICCGLESDVRLPNVCPPQPANLVPVELAGNYRTCNPYARSGTPQACPENSACLYTACPENSACLYTGQDNGFICCRVQLQSSPF

SEQ ID NO: 130370 - protein, 122 aa, Heterodera glycines
  Coding regions on vcDNA: vcDNA=SeqID_56793; Strand=-; Position=1 -164,306-510
MCELRSAFFKPLNLETIEEEADVLSQNSRVNLRNGGNRRSGVYSRPLSQTNTITTYDTQHDLLDVKSLTYQNMNTGNRVSGSLRFSTLRSALGIGIGVDKGSTITTNKSYAFPSRKIRKWNR

SEQ ID NO: 130371 - protein, 260 aa, Heterodera glycines
  Coding regions on vcDNA: vcDNA=SeqID_56794; Strand=-; Position=1 -48,100-230,284-451,504-586,639-678,730-826
  Homolog annotation: Hit_ID=CAE67642.1; Match level="QueryCoverage =100%, HitCoverage=51%, E-value=1e-75, Identity=58%"; Hit description= Hypothetical protein CBG13201 [Caenorhabditis briggsae]
ISFKRKDKGGLNLTTLVPQSELDTDTVVPQSELDTDTVKTILSEYRIHNADITLKYDATTEDLIDVIEGNRIYIPCIYVLNIYIPCIYVLNKIDQISVEELDILYTVPHCVPISAHHKWNFDDLLEKIWAYLNLIRVYTKPKGQLPDYNAPIIYTKPKGQLPDYNAPIILNAEKNFLDDLCMKIHKSLSKDFMKIHKSLSKDFKCALVWGSSVKHNPQSVGKTHLLKCALVWGSSVKHNPQSVGKTHLLNDEDVVQVIKK

SEQ ID NO: 130372 - protein, 230 aa, Heterodera glycines
  Coding regions on vcDNA: vcDNA=SeqID_56795; Strand=+; Position=1-693
MKRPMDSTATPPSSKTTRISADALAGQIDSLSAAVNALLVQDDISQAVKLQFGVLLTTLHTCQHVIDGLNNNANNNSAEEQERRRSLVIIGLPENPSARPSERVREDQKVVSGILDELGVEAVPTTTYRMGRPDVHRASPRLVKVVLPASVHQHIALGGWKKERTRLRSLPNWGRLLIRPSLSREQLQAEYEQRQAKRNGMTNHPPRANNASAISNQLHELGQKMQQNFR

SEQ ID NO: 130373 - protein, 386 aa, Heterodera glycines
  Coding regions on vcDNA: vcDNA=SeqID_56796; Strand=+; Position=1 -53,549-1636,2320-2339
  Homolog annotation: Hit_ID=NP_510671.1; Match level="QueryCoverage =95%, HitCoverage=37%, E-value=2e-73, Identity=37%"; Hit description =predicted CDS, endonuclease/exonuclease/phosphatase family and RNA -directed DNA polymerase (XR69) [Caenor
SNPFNSKLIARVFIKSNYPGKLPTVWKTSIILPLFKNGDKNLASNFRPISITCSCCRIFERILAKRITEFLLENNLISRSQFGFLRKRSTTLQLISTLEDWYNAILLNKKIDCIYLDIIKAFDKVPHELLIYKIEKIGIKGNLLNWLKDFLTNRTFKVRISQQFSKEFPIKSGVPQGSVLGPILFLIFINDLSPVIPDGISLKLFADDTKIYFCYDTESQRKKLDEALHCVSQWAKIWGLQFSPEKSASLYLGKDNFKIPYKFNGKTIKETQTIRDLGILIDNKLTFKSHISAILQKAYLRSRTLFQKIKSKSSKTWIKIYKSYIRPLLEYSSENWNPHIKKEIIRLEKFQKFFTRKVFLKCHLPVLPYSDRLKYLNISRRAFFLL

SEQ ID NO: 130374 - protein, 65 aa, Heterodera glycines
  Coding regions on vcDNA: vcDNA=SeqID_56797; Strand=+; Position=1 -5,192-384
MQSTKLKQSKVSRRFLIGQNCEEMAKDWGQIEEDEKIGDEYDQSADDNGQVFLTDFFVGRINAKI

SEQ ID NO: 130375 - protein, 19 aa, Heterodera glycines
  Coding regions on vcDNA: vcDNA=SeqID_56798; Strand=-; Position=1-57
GPGSRSRVLKSSGPGPGRA

SEQ ID NO: 130376 - protein, 324 aa, Heterodera glycines
  Coding regions on vcDNA: vcDNA=SeqID_56799; Strand=+; Position=1 -202,245-798,842-1060
  Homolog annotation: Hit_ID=NP_001004509.1; Match level="QueryCoverage= 86%, HitCoverage=19%, E-value=4e-46, Identity=36%"; Hit description =si:busm1-180o5.3 [Danio rerio] emb|CAD60788.1| novel protein similar to DNA polymerases [Danio rerio]
ECDVREELKKNKEMKKFFESVPDKGPINPRDAYAGGRTMPFCLYAKATEEIEISMFDIISLYPFVNYDTPYPVGVPKIVVSRNFNVNWTAPDDVPYDGLLKVKVIPPKNLLYPLLPVHIDEMLLFPNCWSCARRAKNEFVMTKDVKKCNHRPTQRAFLGTFTSIELRKALELGYRIVGFYRAYHFEQFDSQLFKGYVRMFLKIKVEASGWPAEVKSEDEKRAFIEMYKAKYDIGLDYDKIWFNPGLRMIAKLGLNSLWGKFSMRNTLSSTEIVGSMERWMELGRDNTIEFGRPVKISEEISRVVYRKKEEFIREHKVSNIVLSL

SEQ ID NO: 130377 - protein, 39 aa, Heterodera glycines
  Coding regions on vcDNA: vcDNA=SeqID_56800; Strand=+; Position=1 -99,734-752
MRKATPTAAALADDEDEESIESRVAKVVAVPPANGRDME

SEQ ID NO: 130378 - protein, 29 aa, Heterodera glycines
  Coding regions on vcDNA: vcDNA=SeqID_56801; Strand=-; Position=1-88
MAGRSDRNCARANGPYIGQNATLQHFPLQ

SEQ ID NO: 130379 - protein, 92 aa, Heterodera glycines; identical to SEQ ID NO: 125147
  Coding regions on vcDNA: vcDNA=SeqID_56802; Strand=+; Position=1-304

SEQ ID NO: 130380 - protein, 18 aa, Heterodera glycines
  Coding regions on vcDNA: vcDNA=SeqID_56803; Strand=+; Position=1 -22,638-672
MTKFIQKAIKISYYLFII

SEQ ID NO: 130381 - protein, 48 aa, Heterodera glycines
  Coding regions on vcDNA: vcDNA=SeqID_56804; Strand=+; Position=1 -118,253-281
MSPKDGTELPKLTRNKQKSRLNAHKGSSPGPHGDFRMKRVYNGVAAVR

SEQ ID NO: 130382 - protein, 170 aa, Heterodera glycines
  Coding regions on vcDNA: vcDNA=SeqID_56805; Strand=-; Position=1 -46,199-425,475-714
MAPRKQNEQFLDEIQNSDDDVKLVDSQSSHAEERPALKKRGRKSRWEKLLEDVNNAKKSNPAEVEVTDVDERKAANVFDYPTIFWKLARPKYGVFTFMCNECRNENFKRGDKRFILNTGSGQEKLEFTQTFCQDCAKLNFDCTDLIMKHQKKDDGPQKNGGLNTFFKTEK

SEQ ID NO: 130383 - protein, 165 aa, Heterodera glycines
  Coding regions on vcDNA: vcDNA=SeqID_56806; Strand=+; Position=1 -385,433-545
MPPLTTALSKLLNCKAENLAEYLNNPEAVNKASAYLRGKKLKTTYSNKGGTTKEVEFGNFSLKSASETYAFEGFLGKCPFCKHSHILESSEVKVHQYFYIKHRIRLLYPQLKCIVEYHSKGHCKYYPLELLAIEDSAEITGEKPTDTNYLDYLGFRSVWQPTPVY

SEQ ID NO: 130384 - protein, 203 aa, Heterodera glycines
  Coding regions on vcDNA: vcDNA=SeqID_56807; Strand=+; Position=1 -105,164-433,599-835
MLSIRNLSSQMFPREQGFLMDAYKQACADPYGYLLTTKIRLSLYPKMVKKQIVGQRVLDNYEYLKSLGRTTSHKKRRHLLSSAGCEELLTMVEICLNLLNGSFCLTRKQKQKLLPFANTIRRLARHYRGLVASREGVGLAKGDDDVAGQTNLGFVKRQLETVKRKRTANVSERNVLYNQQLRRYLKLRKEANDRPSNSATVLN

SEQ ID NO: 130385 - protein, 247 aa, Heterodera glycines
  Coding regions on vcDNA: vcDNA=SeqID_56808; Strand=+; Position=1 -264,432-513,560-648,704-1012
  Homolog annotation: Hit_ID=AAA93301.1; Match level="QueryCoverage =66%, HitCoverage=50%, E-value=1e-11, Identity=28%"; Hit description =HASI
MNEKKDHLLPIIMSDPQRFGATDRGKILNPKTGREFIDSDLAWSIERLVDPRPENAPSPSGTKELMRKLAQNPLASSLLNRLFVGSGQRNTTYTLFKPKREKFQRLRTVPGGFMTSGLGRLPSPFAKEQRLSVPAVGGGCVVAAYEVFGQMPKLPETLYTDRGLEFVAKPMQEFFAENGIKKYETSSKKKAAVAERAIRTLKTRLYKYFSAKNTSAWVDVLPKSNLLLASPHQLERAARASSPRQSG

SEQ ID NO: 130386 - protein, 201 aa, Heterodera glycines
  Coding regions on vcDNA: vcDNA=SeqID_56809; Strand=+; Position=1-606
  Homolog annotation: Hit_ID=NP_917837.1; Match level="QueryCoverage =96%, HitCoverage=9%, E-value=7e-27, Identity=40%"; Hit description =B1158C05.18 [Oryza sativa (japonica cultivar-group)]
MANVPGQVREYLSTDKPLDDRPLDIDEIESEVAALNRRTDSGMPPHSLRLKVGCVVVLLINKSDKEGLINGTRIVLEELGDDRLIGRVINSNAIGGQVRFFLERTRNVYEDKSPGGIKYERLQFPIKPAFAMTIQKGQGQTIRTVGIDLEREVFSHGQLYTAFSRATDGNNVRVHAPNREIDAQGRAKVLNIVATNMLKLQ

SEQ ID NO: 130387 - protein, 38 aa, Heterodera glycines
  Coding regions on vcDNA: vcDNA=SeqID_56810; Strand=+; Position=1-114
MRKAKCETPKNANNAKGEMRKAKPRPIPDVHPGSEEEA

SEQ ID NO: 130388 - protein, 92 aa, Heterodera glycines; identical to SEQ ID NO: 124679
  Coding regions on vcDNA: vcDNA=SeqID_56811; Strand=-; Position=1-920

SEQ ID NO: 130389 - protein, 32 aa, Heterodera glycines
  Coding regions on vcDNA: vcDNA=SeqID_56812; Strand=-; Position=1 -17,279-360
MANWIRSTKLTFEIKSVCSSLEFYDENKLYFT

SEQ ID NO: 130390 - protein, 44 aa, Heterodera glycines
  Coding regions on vcDNA: vcDNA=SeqID_56813; Strand=+; Position=1 -44,632-722
MSVIWRTVRRMAKIWCSSKCLFCHLCSPSSPLITLFSILFPSPT

SEQ ID NO: 130391 - protein, 70 aa, Heterodera glycines
  Coding regions on vcDNA: vcDNA=SeqID_56814; Strand=+; Position=1 -107,321-426
MIDQILIILAFIGTICDNKPSYCLIIKRRILSEKNSFLLVCIINHFFISLMNLFNVKILMVKKLNVNLCD

SEQ ID NO: 130392 - protein, 63 aa, Heterodera glycines
  Coding regions on vcDNA: vcDNA=SeqID_56815; Strand=-; Position=1 -97,317-411
MLNISAYFYCSSLCFQLFIHRIMINLPSVQLKIEKIVVVEFVPRPFIIFERFMWLFLVDGDIK

SEQ ID NO: 130393 - protein, 110 aa, Heterodera glycines
  Coding regions on vcDNA: vcDNA=SeqID_56816; Strand=+; Position=1 -35,91-247,372-512
MRCASPTRQSEWIDVNTYANIMTNNEMAEQSAFQSKLMLLRLKKVTHLPIDTDIKGNGEKEAEFPLTDFTSLMMYLILENISDNSSIDVMAIEDLDMEHILITYENKKSG

SEQ ID NO: 130394 - protein, 55 aa, Heterodera glycines
  Coding regions on vcDNA: vcDNA=SeqID_56817; Strand=+; Position=1 -56,134-185,314-373
MDIRSQEVELSGTGTGTGRNFLFDKNQAFMLFYILQVNVCSYKFTTNTKYILQRI

SEQ ID NO: 130395 - protein, 56 aa, Heterodera glycines
  Coding regions on vcDNA: vcDNA=SeqID_56818; Strand=+; Position=1 -105,233-296
MYAAINLQRIQNIFYKEYNFLFDKNQAFMLFYILQVNLCSYKFTTNTKYILQRKYK

SEQ ID NO: 130396 - protein, 50 aa, Heterodera glycines
  Coding regions on vcDNA: vcDNA=SeqID_56819; Strand=+; Position=1 -132,242-262
MEIDEQHQSNSAGHVVASGECVQQSEQQQEMPDLSAMTEEEQLEPKIEQK

SEQ ID NO: 130397 - protein, 158 aa, Heterodera glycines
  Coding regions on vcDNA: vcDNA=SeqID_56820; Strand=+; Position=1 -170,217-391,442-573
MENAEVSQCFSKFDNKFLFIIGHDNQYRKFKKTNERTDTIYLYCMNCENYNKQNSAGVIGSAIIREGQLDRTHQIMHHLQCKGVPLEQLTAEQIDRNQRRELIQCSADSKSIWREGSDRAREHDTAEDIEIDDPTGISFNYPNWQSVRRAYNRRKMNK

SEQ ID NO: 130398 - protein, 36 aa, Heterodera glycines
  Coding regions on vcDNA: vcDNA=SeqID_56821; Strand=+; Position=1-108
KIPSKIKGLLRTALPIMLESICMCIKFIKKRDSHFS

SEQ ID NO: 130399 - protein, 62 aa, Heterodera glycines; identical to SEQ ID NO: 126119
  Coding regions on vcDNA: vcDNA=SeqID_56822; Strand=+; Position=1-288

SEQ ID NO: 130400 - protein, 95 aa, Heterodera glycines
  Coding regions on vcDNA: vcDNA=SeqID_56823; Strand=-; Position=1 -23,165-265,358-521
MEEGIGNCLEPNWKIKEKIAEKIGARMNTISAWKRKLDSIAKKRKIYSDAEKMEYAKRSEEMRKRNPMINWKEIAETLGIPCANLRRWTRNWTPN

SEQ ID NO: 130401 - protein, 36 aa, Heterodera glycines
  Coding regions on vcDNA: vcDNA=SeqID_56824; Strand=+; Position=1-118
SYRTTPKILNLIDSEQSYGSKSLPTTFRPTTFWGAP

SEQ ID NO: 130402 - protein, 47 aa, Heterodera glycines
  Coding regions on vcDNA: vcDNA=SeqID_56825; Strand=-; Position=1 -38,848-953
MGAKVHLCVSFVMPKMLNCAQFSLPSFGLKYAHGLSNTLTPKKKKVK

SEQ ID NO: 130403 - protein, 89 aa, Heterodera glycines
  Coding regions on vcDNA: vcDNA=SeqID_56826; Strand=+; Position=1 -223,259-305
MTEFGLDSNEFPGYFSDGLPFSVFEGLSLTLDKMFLYALSVGPSEGMIRIWDWVKMNFLFFSGRKKISIILRRDCRLIDIVNSNTDHLS

SEQ ID NO: 130404 - protein, 364 aa, Heterodera glycines
  Coding regions on vcDNA: vcDNA=SeqID_56827; Strand=-; Position=1-1093
  Homolog annotation: Hit_ID=AAG23159.1; Match level="QueryCoverage =56%, HitCoverage=89%, E-value=7e-67, Identity=59%"; Hit description =polyprotein [Heterodera glycines]
MKNLARQYVYWQQIDEQIEEVVRSCQICASEAKAPVKTTLHSWPKSDGPWKRVHMDYAGPFFGKMFLVIVDAFSKWPEIFEMNSTGSAATIGKLRYLCARHGLPETLVTDNGTQFSSKEFKEFTRLNGINHLFSAPYCPMSNGQAERFVDTFKRTCRKLKKEGITEMLDTFLATYRVTPTESLPECKSPAELFLQRKLRSTLDLLKPKNRPIVIRDEAMERKFNRRHGARPRSFDLDDKVYARHRMSQNWRPGHITLKKGVMYDVTFQDGSVGRFHANQLLVRHSDVNEEDPLDVLNDAFGLPLAPANQNLGDVVAQPAGEVIENAPPSPRPDAPQQPNEVIEEGAVQPNVQNERPKRNRRPPD

SEQ ID NO: 130405 - protein, 153 aa, Heterodera glycines
  Coding regions on vcDNA: vcDNA=SeqID_56828; Strand=+; Position=1 -91,646-1016
MKIAISFILAAIEVPMFTDYKNTKSIQLIKKEKTILKEMKKKLTEIFYALFKKFNIDAYNMKILANTFEQNVPKTLSNIGTMLREQDKIDDEKQYVRIYWRKCIITARNQLESLKDGILSQIFNYLDEYKTVENIEQIGETLKIIRETLLADD

SEQ ID NO: 130406 - protein, 58 aa, Heterodera glycines
  Coding regions on vcDNA: vcDNA=SeqID_56829; Strand=-; Position=1-303
  Homolog annotation: Hit_ID=NP_498776.1; Match level="QueryCoverage =96%, HitCoverage=50%, E-value=1e-10, Identity=51%"; Hit description =heat shock protein (hsp-12.2) [Caenorhabditis elegans] gb|AAA27953.1| Heat shock protein protein 12.2 [Ca
MGQNLFIHCKHDQREGMLGTTSREVQRNYKLPDDVDPKSIRSNITRAGILRITAQKKR

SEQ ID NO: 130407 - protein, 110 aa, Heterodera glycines
  Coding regions on vcDNA: vcDNA=SeqID_56830; Strand=-; Position=1 -295,365-399
MEWRLARRGFTVLPMYKWQRSGPYSLITALNLLDRHHVKFSILTLFIHHCFPDPKKLLNSLRELAIEHNCPILLSVVLPIRQFVEFDDKIVSAGRKLPDIPTKGTTFEAQ

SEQ ID NO: 130408 - protein, 60 aa, Heterodera glycines
  Coding regions on vcDNA: vcDNA=SeqID_56831; Strand=-; Position=1-203
KGWQTENSDSSNFRWNAAVNRWSPLLNWSIFLSFHFKMINNKAYKMPKCNSDCLYVKINL

SEQ ID NO: 130409 - protein, 208 aa, Heterodera glycines
  misc_feature (7)..(7): Xaa can be any naturally occurring amino acid
  Coding regions on vcDNA: vcDNA=SeqID_56832; Strand=-; Position=1 -61,446-561,640-786,852-974,1031-1124
  Homolog annotation: Hit_ID=NP_740813.1; Match level="QueryCoverage =98%, HitCoverage=23%, E-value=3e-67, Identity=66%"; Hit description =alpha-CaTuliN, catenin/vinculin related (ctn-1) [Caenorhabditis elegans] gb|AAM54172.1| Alpha-catulin (ca
AWGQKIXAENQPNSGKSAAGDQQKIAKVGLEMKLLTAEVEAEAEKWDEYAENDIVKRAKAMSAMSYNMAMSAMSYNMYLFTKGDGPLKTTHDLFTQAEFFAEQANKMHKTVMEFAFEVPGSAEKNELLQILDKIPFHCQQLQVLVKSPTVGKSATFSKVDAVISEIKGLMNEIAKLVVDAVISEIKGLMNEIAKLVTACFVCATKVEI

SEQ ID NO: 130410 - protein, 308 aa, Heterodera glycines
  Coding regions on vcDNA: vcDNA=SeqID_56833; Strand=+; Position=1 -313,371-983
  Homolog annotation: Hit_ID=NP_502797.1; Match level="QueryCoverage =57%, HitCoverage=50%, E-value=4e-22, Identity=32%"; Hit description =HASI (4P602) [Caenorhabditis elegans] emb|CAB16520.1| Hypothetical protein Y57G11C.19 [Caenorhabditis ele
MPPPRPKKREPQPKVDPRPSTSKKADIKPKREPKFEPDPRPSTSRQAGYNPAPPAPKKEPKHEWKQTKRLHSPPRTAPHRIPKREPEIEETPQEQPPCGPIGRTEYNHQDGIENQKRVSPEKMELINATLDKLYNEPSSPACFSGVTAVWKEERKKIKQSSKKEVRNYLESHRSYTLMRPRRVHFRRAKTDAAGFMTDVQVDLADFRALSRQNRGHRYLLVAVDVLSKRLFVVPLKNKRAEEMLEAFKELVKQMPMVPHRILSDKGTEFKKQLLKKFFDEQEIQKHEPVHSSVKASVAERAIPNVPAR

SEQ ID NO: 130411 - protein, 415 aa, Heterodera glycines
  Coding regions on vcDNA: vcDNA=SeqID_56834; Strand=-; Position=1 -72,157-250,322-450,503-612,794-1058,1196-1543,1859-2007,2052-2132
  Homolog annotation: Hit_ID=AAK39520.1; Match level="QueryCoverage =54%, HitCoverage=50%, E-value=5e-23, Identity=32%"; Hit description =BTB domain protein [Homo sapiens]
MSKAGIAGLKLMLSTGEYADVHFLLVPAHKLVLMHASDVFEAMFRFDANKEQAENANYPSAVEVPDVEAAAFKVMLSFIYTDDLSEVNGENAMAVLYAAKKYNISGLVGPSLQIPISELHNVFFAYAYACLFELEIDQKMLSGLIESDLLLFSDEFQIWKAVISILKLNLNFFFSFLALRWADEKCGQNGIECSSENRRSVLGPALFKIRFPNIHEEEFSKGVVPFGVLTMEEVYGIYQYNSHPYLYLRVPDELLYALKFPSHGRIFDWNTAKGNRRGTLALEIGKLSEFAGEKVGSRRISDAVHINGVSWQIEAQIRQNSEGKAKYLGFYLWYDASKEGEGNWRNEYSATFRIVWQKSKAANSTGTLSDRVINNTKNWLGFHLFITFAELMDPSKGFYNKEEDKVTLAIDVTVK

SEQ ID NO: 130412 - protein, 26 aa, Heterodera glycines
  Coding regions on vcDNA: vcDNA=SeqID_56835; Strand=+; Position=1 -9,449-520
MKIAPNSKMLKNGQNRCKKVRNGLEK

SEQ ID NO: 130413 - protein, 385 aa, Heterodera glycines
  Coding regions on vcDNA: vcDNA=SeqID_56836; Strand=-; Position=1 -213,260-403,1134-1398,1453-1750,1807-1903,2839-2979
  Homolog annotation: Hit_ID=NP_436657.1; Match level="QueryCoverage =73%, HitCoverage=81%, E-value=3e-36, Identity=32%"; Hit description =hypothetical sugar transferase protein [Sinorhizobium meliloti 1021] pir||E95856 hypothetical sugar trans
LFPNVPIVVRDELKEQVSAHWKNVIGTVNEDGSEDLTAQYEQIYAKLLAQQNKTEWANMQQKVKKADKHKLCKKSVSGQKLKILVVSSPIFDTLPPKKAGGTEIMIYALTESLVKLGHDEMVKRHAHEYDIVHFHDPSSFIEFRHFLNHAVHTRHMPVDDTVFFGLFSDVPHISISEEQQRLTPIGKDTINHLISGAFNYIISGSYPLLDLNWVGSVHNGINLDDFKFVEVPKQQQPYLAWMGRMIPDKGVDVAIKFAIEAGMKLKIAAQIVDDHRKWWMKRILPLISEKHADLIEYVGEIGPEQRNDFLGNATAFLFTPKWDEPFGLGMIEAMATGTPLTSLDPELVYQIIMKLTIGYVLAMYSSALRLAPLLAPSSHAPFCES

SEQ ID NO: 130414 - protein, 320 aa, Heterodera glycines
  Coding regions on vcDNA: vcDNA=SeqID_56837; Strand=+; Position=1-962
MPSKQHNLRMKMKEDRRRTEKSVSPGRSPVPDGSADENGVVSHPGNVTPNIGALQLSTPASSIGSRRRARPSNAGTESITASQKSASSVDTQSISQNAESLPCKKKAKVDQADQPKNYEAITSTPISTQRSCGGRPTKMRRGPGRSKANDSMNESSSMNQSSEAITNLIVLPNVTEKINFSTVQIKFATSRNMACKIRRWADVGLYERDGETAQGPRSGPRFIETCWNDLTQFLNDAFVVEYLAYLASISQRKVVVVDPVVWQMGIDRVMQYKKMTFGYDPNVPAEVILLPVHFPGHWTLIIHDVQFGTHFADSLPTPYG

SEQ ID NO: 130415 - protein, 24 aa, Heterodera glycines
  Coding regions on vcDNA: vcDNA=SeqID_56838; Strand=-; Position=1-73
MEYTEGKDFLGSSFANTEAIKNTT

SEQ ID NO: 130416 - protein, 37 aa, Heterodera glycines
  Coding regions on vcDNA: vcDNA=SeqID_56839; Strand=+; Position=1 -47,127-193
MADLKKMKRDTEAEKTAESKNGLQKRHFSRPSNNKMF

SEQ ID NO: 130417 - protein, 146 aa, Heterodera glycines
  Coding regions on vcDNA: vcDNA=SeqID_56840; Strand=+; Position=1-441
MKLFPLLLLIILFLIDKIGSERKKLQQKSFGEIFGEKWQEKEEEKRNELKKREIIAKFYKIKEKIKQKGRKFSKKEWNKINLKIAKKLGTNQTYIQKWIKQFGLQKNKCYKSKSDEEKIVIVQKFIKMANEYKQKRKYSAKEWDQN

SEQ ID NO: 130418 - protein, 186 aa, Heterodera glycines
  Coding regions on vcDNA: vcDNA=SeqID_56841; Strand=-; Position=1 -174,232-618
  Homolog annotation: Hit_ID=NP_767161.1; Match level="QueryCoverage =68%, HitCoverage=18%, E-value=2e-12, Identity=39%"; Hit description =hypothetical protein blr0521 [Bradyrhizobium japonicum USDA 110] dbj|BAC45786.1| blr0521 [Bradyrhizobium
MSANREQLTENLKKIIALHKLQQDMKLIRDSILSGNFAVNEMGNNNMIVWTVPVPRNAGPQGVAPPRPLAPSCPPPPPQLPVFPPPPPQLPFLPSPPQIGMAPFCPRPPQMSPVLAPLALPPLAPAPLPLPSCSTFANPFGVRAPPNKCAVCGRRFLAPRRRATTEKLPSAKKARVHGPEEPMDEE

SEQ ID NO: 130419 - protein, 44 aa, Heterodera glycines
  Coding regions on vcDNA: vcDNA=SeqID_56842; Strand=-; Position=1 -100,463-497
MKLIENISIIYRRKLMNIIHQCIFHSFTTFESKDKSRKIKRLEI

SEQ ID NO: 130420 - protein, 24 aa, Heterodera glycines
  Coding regions on vcDNA: vcDNA=SeqID_56843; Strand=-; Position=1-73
IGFLAIIGIGDLIGIGFCLARHIP

SEQ ID NO: 130421 - protein, 38 aa, Heterodera glycines
  Coding regions on vcDNA: vcDNA=SeqID_56844; Strand=-; Position=1 -90,888-914
MPTNYDYHSKRLWNRSWNTKCVALPYQSAENGKNLNNF

SEQ ID NO: 130422 - protein, 169 aa, Heterodera glycines
  Coding regions on vcDNA: vcDNA=SeqID_56845; Strand=+; Position=1 -132,191-326,462-703
MSQFSDDSLPPTLDGPYSPVGDDGTELMDDAPPLENVIKHLPNTVVPSEENERKTRREPSITRELDAELFNRDGFVCLSAAQAEAGRFKAFRFIGQFLLSLTFGAVFPEDILRNLFTMCLSYAVEGAESMKISADHFIFLLTSKHLDYEVAVHFKKNRQHGNGEDSDSF

SEQ ID NO: 130423 - protein, 105 aa, Heterodera glycines
  Coding regions on vcDNA: vcDNA=SeqID_56846; Strand=+; Position=1 -164,398-500,548-598
MEPGAKKRRKRKNAENTDGEAMECEEEEDAVDEDAENNWMLGYEEAGEKPESVTTYKLIPIKLANFVKTFGLEIEGVENKKYFPHKFNKAENYGTVLETLPPMED

SEQ ID NO: 130424 - protein, 64 aa, Heterodera glycines
  Coding regions on vcDNA: vcDNA=SeqID_56847; Strand=+; Position=1 -64,556-686
MYPRGLIDPEYNCDHFEDSERETGLPKLEIVECYAEVAKLLTNSKNWGQQHLFNLAEKVLDGLG

SEQ ID NO: 130425 - protein, 19 aa, Heterodera glycines
  Coding regions on vcDNA: vcDNA=SeqID_56848; Strand=-; Position=1-58
FLNLGIVNMGTILTNDTAN

SEQ ID NO: 130426 - protein, 218 aa, Heterodera glycines
  Coding regions on vcDNA: vcDNA=SeqID_56849; Strand=+; Position=1 -604,1251-1305
RRVNHRRVGVGESTIGESASASQPSASRRRRVNHRARWRRRVDHRRVGVGESTIGRVGVGESTIGESASASQPSAKLASASRPSASRRRRVNHRRASRPSASRRRRVGVGESTIGESASASQPSASWRRRVDHRRVGVGESTIGELASASRPSASRRRRVNHRRVGVGESTIAESASASRPSASRRGALNCSPSACMFAKCAIKTIIYIKIFTQIIFT

SEQ ID NO: 130427 - protein, 37 aa, Heterodera glycines
  Coding regions on vcDNA: vcDNA=SeqID_56850; Strand=+; Position=1 -7,229-335
MYGVFWAADHESCVHFDQSLNPDPNLNKKSKIKLFDF

SEQ ID NO: 130428 - protein, 152 aa, Heterodera glycines
  Coding regions on vcDNA: vcDNA=SeqID_56851; Strand=-; Position=1 -67,118-318,969-1157
MKLLPTVLQPVLFLAFVANVFSYQEPILPVWCYEGIHVGGQANILTVNISGSDKKSLIFNGEMRKHLCVIYQSDSRQDVKECVEHVCYKDGELQMVFNLCAKHGYSQVCTPDDELIGLVVASQCQGGQYKCSRRYILKNDRTIPPAQRVKQT

SEQ ID NO: 130429 - protein, 316 aa, Heterodera glycines
  Coding regions on vcDNA: vcDNA=SeqID_56852; Strand=-; Position=1 -146,242-369,413-615,658-817,861-1033,1080-1217
  Homolog annotation: Hit_ID=AAL93203.1; Match level="QueryCoverage =99%, HitCoverage=53%, E-value=7e-30, Identity=26%"; Hit description =transposase [Bactrocera dorsalis]
MSLIWKYFKLSGRVAFCNICDFKKDYPPRAPTTPLISHLEHKHPDLHKEAFCSSAPSCSVPLTIAEDDFDGESVQPPKHIKSIILHSLQAKSPWEKDGEKTLIINTKIMEMIAVDLQPLSMVENEGFRRLIHELQPKYHMPGRKFFTTNLMPKIVETLKARIKKDIKKTNFISLTIDCWSSKDAAHSLLSVTCHFIYEGQPKFVVLAAKPIKGRHNATVLKDLLMKVFVEFSLEKSKIFVVLRDAAEVMVKVCTDLGLKSIDCFAHKCNLAIWDGVRKLNDDESTKSLLERIKKLVRKLKKSPVQKEQEGNLQKLL

SEQ ID NO: 130430 - protein, 100 aa, Heterodera glycines
  Coding regions on vcDNA: vcDNA=SeqID_56853; Strand=+; Position=1 -47,103-358
MSESPKKVGKQMEKAIFITGDDWLSVFHLVPPFQLGLGIALLSHRFDRLVDEHFKTRRWALDEIGIRRTFEKDGQYEMQITNSKLDPSPIETKVFDFYLK

SEQ ID NO: 130431 - protein, 636 aa, Heterodera glycines
  Coding regions on vcDNA: vcDNA=SeqID_56854; Strand=-; Position=1 -461,553-929,1126-2199
  Homolog annotation: Hit_ID=XP_526077.1; Match level="QueryCoverage =99%, HitCoverage=77%, E-value=2e-21, Identity=28%"; Hit description =PREDICTED: similar to flagelliform silk protein [Pan troglodytes]
FQSLGLNSPAFQSLGLNSPAFQSPGLNPPAFQSLGLNSPAFQSPGLNPPAFQSLGLNSPAFQSPGLNPPAFQSLGLNSPAFQSPALNPPAFQSLGLNPPAFQSPGLNPPAFQSPGLNPPAFQSLGITQSTCIPITGTQFSSISITGTQSSSIPSLGLNSPAFQSPGLNPPAFQSLGLNSPAFQSPGLNPPAFQSLGLNSPAFQSPGLNPPAFQSPGLNPPSFQSPGLNPPAFQSPGLNPPAFQSLGITQSTCIPITNNKSRRFFCIPIAGTQFYDLQSPHWDSFSCISITGTQPSSISITGTQSSGISITGSQIYEHSEHWDSILQHFNHWDSIVVHFNQRDSSLQHFNHWDSILQHFDHWDSILQHSSHWDSILMHFNHWELTLQHSSHWDSILRHFNHWDSILQHSSHWDSILMHFNHWESTLISITGSQIYGVPNTGTQFSSIPVAGTQPSSISITGTQPTSIPVAGTQPSSISITGTQSSSIPVTGTQFSGISITGTQPSSISITGTQSSGISITGTQSSAFRTLGLNPLAFQSLGLNPPAFQSLGLNSPAFQSPGLNPPAFQSLGLNSPAFQSLGLNSPAFQSPGLNPPAFQSLGLNSPAFQSPGLNPPAFQSLGLNSPAFQSPGLNPPAF

SEQ ID NO: 130432 - protein, 66 aa, Heterodera glycines
  Coding regions on vcDNA: vcDNA=SeqID_56855; Strand=+; Position=1 -70,175-304
MSKNTSTMLLFSLLANRIFLVTSVNDLTEAIGSMKEKLFTIYQKYDTDFTPNIPSILETERQEFFN

SEQ ID NO: 130433 - protein, 1856 aa, Heterodera glycines
  Coding regions on vcDNA: vcDNA=SeqID_56856; Strand=-; Position=1 -5463,5656-5763
  Homolog annotation: Hit_ID=NP_498959.1; Match level="QueryCoverage =81%, HitCoverage=71%, E-value=1e-153, Identity=27%"; Hit description= zn-finger, CCHC type and RNA-directed DNA polymerase  and Integrase, catalytic domain containing protein
MPNLRSPPLTRQRALNLGIRLNNNANQQGGQQIVEPQHLADRRLENEARHNSVSSVASSLLDPTEIRRRLLMSGIGENAAGVQNGPQDEQQFDALLNQHGNDLFQNENRGENFERDVFQPVVREPPLQFSENFENGPRQYELVGVRPVVTSTPHAVQPQRRPNSEPLNPGLVRPQAMFLNSFQQNIAANPNGNQRQRAEQRFIDEDERQAALVRHRQANLTHYVNNDRDFNAFHPIAGAQHVWRAQIQHVSYPNNPQIGEVNPQQIPRQNQGFVGNQQIFRPVAVRNDFHPENYGDNFNFGHPEQQNFGQQRTEQIQIANLEYVLTLDRLPELKGNEGADKVKNFFKKFSNATEEWPEHKRVKALETKVSGRAERAFNAAISSGPHRFDSIRRAMQNQLEETDCREMGAFDELMSGVKRRSNENLDALADRIQSLVSRAYPGLTQNLCDDYAIKHFIRALANPELSLTLEMSRKSGMSFDEFVALAARAESIQRATRVSSNENKYSDNRNRGFYFSNNFSRPQSSEFQGYSQQPRGRIVCYNCNEPGHLSRDCNQQIKGQRVNSNENERIRNQFATGSNSLAIRNNEESPKNNQRNFQPKSQNFLKQNCIVMQEDQPPDAFCCGVQLTSEVSNFLENELHEKNQSEESKEKDHVGKILVIRVETNNVRTDAMLDGGAQISLIGAEFLYKLIKEHGLDLRKSGFSRTKARIADVNGQQLKCFGMVTIPISRKGREKTPICFHITTAQFGYNLLFGTNSMSKLGFLLYDSVNKEMIEFEEGQQNDGNAARIIFSTKIEPRTTKLIEIGVDKEWNGKDVIILPSNIESGVKVEPTVGKVEDGRVIAQITNYSTLSQRVNEKTYIGMIEKVDEIFDTENSILSAEISSTMAYGKNESGKLGRADLHIGEILGHHKTELLELISQHTEIFATSEQELSQTDLIRHKIETGNALPIKSQIRPVPYAYREKVSAMIQDYLGRGIIRSSNSPWASPIVIVPKKDGTLRFCVDYRKLNSVTVKDAFPLPNIDNTLLALGGKKVFSTLDFISGYWQIKMDRNSIEKTAFSTEFGLHEFLVLPFGLCNAVATFQRFMTRLFAECLNKFVFIYIDDVLIASESWDKHIEHLKEVFKRIENAGLKLKVSKCHFASNELPFLGHILSREGLKMDMAKVKPVLDLPIPSTKKQLQSLLGFLAYYRKFIYGFGGIAAPLYSLLKKDINFKIGDLEKKAINTLKSKIVSDVMLHFPNFEAAKNDTTRKFILLTDASKIGIAAILCQPDEKGNIRPIYFASRQCKNYESRYCPTELEALAVRFGTKKFSQFITMMPTKIFTDHRALIPMFKSKKETGNSRVDKWLMEMNAKFILEVEYHAGKKNVIADVLSRSLALKCLDSPSEAEKVIIGQVRRSENGQRPQEILSHQEWVKKTKESELGFLYDFLTTKVLPIEPKSRQKLASSLHNFTIINELLYKCGKDAELRLFVPSSFRQKLIRERHSGVCSGHMSGKKIFLQLAEKYFWPNMYFDCVKSAFQCRICAHTRNPRSNEPPLKIVATAEPLELVCLDILSIGPAHSCNKYILVAVDHFSKYLVATAIPNKSADTIAKEFVKNFILILGVPKKLHSDRGKEFLNETLNEIAKVLKMEKSLTSGYDPQANGVTERVNQTILSMLKRSTASNWTWDDRLPFVVFSYNTTPSEMTKISPHHLMFGKPANFPSDVSFPVNPQYTVDVDEYIQLFRENIAHLVVKAREHSEKERQKMKNNYDKQAKVTANKFEIGQRVMVIFPGTNKRSPHHKIMWNHFGPFKILEISASAASVVPIDKLNSKPLKVPIERMGDRMDSQKSPKVNGKNLMGTEIKDFLGKFAELWHN

SEQ ID NO: 130434 - protein, 66 aa, Heterodera glycines
  Coding regions on vcDNA: vcDNA=SeqID_56857; Strand=+; Position=1 -20,391-513,569-626
MENRGKFFFLTKLERKSGGKKSDGLWEDSSAVGERKYQNGLFRTNCMDCLDRTNVVQALLAMESLR

SEQ ID NO: 130435 - protein, 29 aa, Heterodera glycines
  Coding regions on vcDNA: vcDNA=SeqID_56858; Strand=+; Position=1-87
MLAALNFSDRILGGIRHPSPAFIRCHNLA

SEQ ID NO: 130436 - protein, 178 aa, Heterodera glycines
  Coding regions on vcDNA: vcDNA=SeqID_56859; Strand=+; Position=1 -150,312-518,652-831
MDRENLEDSKNENKQLKEKIQKQEEEMERMRKALNEGQSSSAGAGTSSAKASASFSDQKIPVRGRLSLCKSVKYDVTLGEIERRVTGLEKITPNEYLRFLRTQKAKGKGRKLQEEIGKERWGPAIAAAMQFNLEREKNEQTCFTPLTEGEACKASLSHGWGWRNCWMISPKKFFKTKF

SEQ ID NO: 130437 - protein, 21 aa, Heterodera glycines
  Coding regions on vcDNA: vcDNA=SeqID_56860; Strand=+; Position=1-65
MSFASVAGQGDGYTQQELFKF

SEQ ID NO: 130438 - protein, 52 aa, Heterodera glycines
  Coding regions on vcDNA: vcDNA=SeqID_56861; Strand=+; Position=1 -106,212-264
MVIRFKTSEKFECLTEEKWEIPPLKQYTKKEQTIDANISEPTLCAARGFEPR

SEQ ID NO: 130439 - protein, 54 aa, Heterodera glycines
  Coding regions on vcDNA: vcDNA=SeqID_56862; Strand=-; Position=1 -138,186-213
IFSLDGTNEHEHIIDGKVQSVAISQNGDLYMTKQPTHGTEESAIWRSHIDHPIV

SEQ ID NO: 130440 - protein, 447 aa, Heterodera glycines
  Coding regions on vcDNA: vcDNA=SeqID_56863; Strand=-; Position=1-1344
  Homolog annotation: Hit_ID=XP_318550.1; Match level="QueryCoverage =89%, HitCoverage=42%, E-value=1e-111, Identity=49%"; Hit description= ENSANGP00000020240 [Anopheles gambiae]
MLKQDKVWQWADCQNAFENVIKILKSDQLLTHYDPAQEIIVSADASEHGIGAVISHRFSDGSLKAIAHASSSLSAAEKNYSQIEKEGLAIVFAVQKFHKYLFGRHFVLQTDHKPLLSIFGNKKGIKACTANRLQRWAITLLGYDFEIEYQNTADFGQADVLSRLIAKTPVPDNGVIIANIRESNETGVLNFVTKTLPLDHSDLANAAKSDQAIKNVKKFVCSHWPTKNKMAADIVPFHRRRYALTIEDECLLYADRVVIPASLQKDVLQLLHRGHPGMKRMKGLARQYVYWPGMDEQIENFVKMCNECTMEAKMPVKTELHSWPKADGPWKRVHLDYAGPFMGKMFLIIVDAYSKWPEVFEMRSSNSAATIDKLRSLCASYGLPEILVTDNGTQFASKEFKEFVTENGINHLFSAPYNPMSNGQAERFVDTFKRTCRKIKGEEHRKC

SEQ ID NO: 130441 - protein, 217 aa, Heterodera glycines
  Coding regions on vcDNA: vcDNA=SeqID_56864; Strand=+; Position=1 -216,379-749,1469-1535
MGPKKAPPARRKAEPSEGEEEVKRKKAKRIVIEDEPEEGANGTGSQLQQNGHEEAMAPVVKGGDEEDEVVSEVGIYLLPLAPSDAGGIAKMANSAGAASSVSINRLQFPQQHPNVLRRRFNGALSGRGNAQDGEEEEEDQEEQRTDRTGRKLFAQYKAQVKHLRLGFGSDCDEEAMASAVMPTFAGGGGIAELLTKSSFFVTGGQNLRNAKALAGDH

SEQ ID NO: 130442 - protein, 222 aa, Heterodera glycines
  Coding regions on vcDNA: vcDNA=SeqID_56865; Strand=-; Position=1 -79,437-481,539-622,681-768,818-1067
  Homolog annotation: Hit_ID=NP_498784.1; Match level="QueryCoverage =98%, HitCoverage=43%, E-value=7e-53, Identity=51%"; Hit description =speckle-type POZ protein (3J252) [Caenorhabditis elegans] gb|AAA27978.1| Hypothetical protein C50C3.8 [Ca
VEQRTEWRPFSHSAAATNRRKDKTPDTTRRLEMVSKQTTKATAISSRLEWRIDHFEKLMKLMTAISSRLEWRIDHFEKLMKLMKNGQNLISKQFSCTSGSSVVWKQFSCTSGSSVVWELHVYPNGKREEDVNNVSFFLRQVSFFLRQVGLQRGEDPVMTEFQIYALDASDCRISVCRDTKDFSNQQGRGKFQVHRDKMLASLRPDGKIFVFCFLPQFPFDFC

SEQ ID NO: 130443 - protein, 122 aa, Heterodera glycines
  Coding regions on vcDNA: vcDNA=SeqID_56866; Strand=+; Position=1 -118,219-344,896-1020
MALKAELETQKRLAEHNEMQAMEEKTDNEKQKKNEKEKYDSVFGLTQQLQNEQTKLFGRMDELEKQFGKLLQKKEEENCKYVSLGRIAQLINEEKKQLDKITAEFNNRHEEQTVNELALAKT

SEQ ID NO: 130444 - protein, 122 aa, Heterodera glycines
  Coding regions on vcDNA: vcDNA=SeqID_56867; Strand=+; Position=1 -8,459-679,722-861
  Homolog annotation: Hit_ID=CAC21848.1; Match level="QueryCoverage =89%, HitCoverage=52%, E-value=2e-11, Identity=40%"; Hit description =hypothetical protein [Globodera rostochiensis]
MKSDVIIGFAPKQPKMPLNGTLLNRCGTYAYSSTANCVLNGSWKNADVKFFPGDVVGCGVNLATQQIFFTKNGHRLDFAFLNNHLLDASSADQLFPFVILWNSGDQIEANFGPKFKFDMTTL

SEQ ID NO: 130445 - protein, 71 aa, Heterodera glycines
  Coding regions on vcDNA: vcDNA=SeqID_56868; Strand=-; Position=1 -37,125-303
MLAKTCASTPNIVRTPVSATILSIQHGVSAKCHSFGCCHPFTRTASTRLSAGTRTNAILGTESGEAAGELL

SEQ ID NO: 130446 - protein, 26 aa, Heterodera glycines
  Coding regions on vcDNA: vcDNA=SeqID_56869; Strand=+; Position=1 -42,983-1021
MSSIERQNLAGFSRLIFLQMYLYKFA

SEQ ID NO: 130447 - protein, 39 aa, Heterodera glycines
  Coding regions on vcDNA: vcDNA=SeqID_56870; Strand=+; Position=1 -74,175-220
MPPRCKTYYGKPKTFGFVKKVLFLKSANLIGNAANNADK

SEQ ID NO: 130448 - protein, 388 aa, Heterodera glycines
  Coding regions on vcDNA: vcDNA=SeqID_56871; Strand=+; Position=1 -461,597-996,1409-1497,1542-1758
  Homolog annotation: Hit_ID=NP_741033.1; Match level="QueryCoverage =59%, HitCoverage=26%, E-value=4e-22, Identity=33%"; Hit description =CAN cell Migration defective CAM-1, Receptor tyrosine kinase (103.9 kD) (cam-1) [Caenorhabditis elegans]
MAYISSPGPPMPPKCFSPFERLTLAGLRLGQCARLIRRLLGLAVLPVSAAHSLHWARCRCFCGAFDPLFVLLPEGKGPSVGAKAEKRRPGDDGTAAAGKRVVDAFGQCCGFAAQSARGCCWLHAKWALAANTTAPSPHVGTELQRRVHHHKQANDLNSAFYRKVQDERMRAAGVMPNDELLNPLLPYGGGGGDTLDRHIPTAPFGPPQTMFELKHSQQQLHHAQQQPYRFWENGATSADTMHSAGVGWHPPYYVQQQPQKQSYGSASANTEPTQAEPYQIASIQQEQAREMCAVFDHMVHGDLVEFLKVREPRGGTDNDEQERARNAEDFLRIATQITAGMQYLANKCFVHRDLAARNCLVADQQVIKVSDFARMKPKYARDYYRVIP

SEQ ID NO: 130449 - protein, 305 aa, Heterodera glycines
  misc_feature (1)..(1): Xaa can be any naturally occurring amino acid
  misc_feature (23)..(23): Xaa can be any naturally occurring amino acid
  misc_feature (31)..(31): Xaa can be any naturally occurring amino acid
  Coding regions on vcDNA: vcDNA=SeqID_56872; Strand=-; Position=1 -395,445-507,570-718,766-956
  Homolog annotation: Hit_ID=NP_495956.1; Match level="QueryCoverage =98%, HitCoverage=56%, E-value=6e-50, Identity=37%"; Hit description =integral membrane protein (2J458) [Caenorhabditis elegans] pir||T25203 probable membrane-bound phosphoest
XVSRWIINEWHVINKKTNHKKSXNKENKCFXMVVLTDLHAGASVYGKQISSVVKRVNSLDADVVFLIGDIVDAPRKLIEERVESLRHLKAQLGTFYVTGNHEYYYGNAEEWFALFESYGIRVLKNDVVKFNGYCLIGLNDITSEEVVKFNGYCLIGLNDITSEESGIPNHVMDVSVINYCPKIPNHVMDVSVINYCPKNATTIVLAHNPSAARKIFEFSQSNDHPVDLILSGHTHNAQYLVLHTHNAQYLVLMPFAYFILPYLYGLYVLSDGATKLFVSAGTLFQNAPMKIPFMSEIWSIEIEPR

SEQ ID NO: 130450 - protein, 95 aa, Heterodera glycines; identical to SEQ ID NO: 130305
  Coding regions on vcDNA: vcDNA=SeqID_56873; Strand=-; Position=1 -43,257-915

SEQ ID NO: 130451 - protein, 165 aa, Heterodera glycines
  Coding regions on vcDNA: vcDNA=SeqID_56874; Strand=-; Position=1 -96,157-408,613-762
MPLSWQHFLLIVFSVALSKVRPFPCGVCPKRILIEASVASSSCGVSEECDDPPKNAETIATTAAPLAEAKGNSSTEAGRDEEKGTERTAILAIAIRTFSNGSNEEVKPREGGHGLIPFVLDTTDAMGTGGAWPLLTVPNACAKPIFGEGTAKRAKRGRRRATERK

SEQ ID NO: 130452 - protein, 82 aa, Heterodera glycines
  Coding regions on vcDNA: vcDNA=SeqID_56875; Strand=+; Position=1 -120,1027-1154
  Homolog annotation: Hit_ID=CAE62811.1; Match level="QueryCoverage =43%, HitCoverage=26%, E-value=1e-10, Identity=77%"; Hit description =Hypothetical protein CBG06987 [Caenorhabditis briggsae]
MDTDKARVKLEEVKDRYGLGGDIEKEKEKMGIYTPKHTPGERTPRYHRTPIDFAILDGIGNGKRLVQSTNDYGTIGAARMQG

SEQ ID NO: 130453 - protein, 67 aa, Heterodera glycines
  Coding regions on vcDNA: vcDNA=SeqID_56876; Strand=+; Position=1-204
MGAEEKTDRNRRGGKLIGMEADEKVNGMRGGKVIGMEADEKVNGMRGGKVIGMGAEEKLIGIGEEEK

SEQ ID NO: 130454 - protein, 106 aa, Heterodera glycines
  Coding regions on vcDNA: vcDNA=SeqID_56877; Strand=-; Position=1 -174,202-346
FCLRSSVVVEFAYAISSRLNFSVHFTIADHSTRKCPSLSRHFLLSYSDHFSSSPIPITFPPLIPFTFSSASIPITFPPLIPFTFSSASIPINFPPLLFRSVFSSAP

SEQ ID NO: 130455 - protein, 92 aa, Heterodera glycines
  Coding regions on vcDNA: vcDNA=SeqID_56878; Strand=+; Position=1 -33,970-1103,1854-1965
MDRGITEYQLERSPGPSSGPCAPVAEGQRGAAQPMHRRLWQNRGRTDHGLQKGCDRKEAKTPSETELSLIGRISDQLREQQAMAQKHPIEHL

SEQ ID NO: 130456 - protein, 42 aa, Heterodera glycines
  Coding regions on vcDNA: vcDNA=SeqID_56879; Strand=+; Position=1 -7,415-467,566-634
MAAHHQFVLQTGVQADQTQFKGGQNAQRDGTVTDRTHFGPTP

SEQ ID NO: 130457 - protein, 44 aa, Heterodera glycines; identical to SEQ ID NO: 126591
  Coding regions on vcDNA: vcDNA=SeqID_56880; Strand=+; Position=1 -45,128-217

SEQ ID NO: 130458 - protein, 126 aa, Heterodera glycines
  Coding regions on vcDNA: vcDNA=SeqID_56881; Strand=-; Position=1 -19,153-201,1605-1919
  Homolog annotation: Hit_ID=AAP92584.1; Match level="QueryCoverage =100%, HitCoverage=25%, E-value=3e-33, Identity=60%"; Hit description= Ab2-057 [Rattus norvegicus] gb|AAP85373.1| Aa1262 [Rattus norvegicus] gb|AAP85367.1| Aa1011 [Rattus norve
LLAWGPRWFFPSPGSSDAGQRCGAWPFLVRGAICLVYSDNERDSSLLNSWLIASGHNFLEGFSVFSRTKLSNNRSVMPLDVRGCTRATLAKSACLPSPKGVGKPVKICRDWDRTLQLLSVNEEFLV

SEQ ID NO: 130459 - protein, 116 aa, Heterodera glycines
  Coding regions on vcDNA: vcDNA=SeqID_56882; Strand=-; Position=1 -101,288-537
MLSDTVATVMGAEHTVKAAKIPFLFYLAVFLKESSSYGNSRTQPSYGYGGQQSRYGTHEQNGGENGQFERQNAWRGGGGQWGQNQQNWGQPQQQQGATAAVEGGQIEKNRKINGKN

SEQ ID NO: 130460 - protein, 178 aa, Heterodera glycines
  Coding regions on vcDNA: vcDNA=SeqID_56883; Strand=-; Position=1 -135,178-577
MAVKLMEKAGISGEEKTFGLQHLGLIQNFWDKEYPEMFRIVAFDMRTGIKPIFKGEGIRKNEVCVIKDGDHWDGMKSVTQFFCVRNFCVSCEVTRERPERHRLECKERCKKCCRMGFGFPCADVCAGIYCAECNRNFYNTECFESHKKTACREYKKCEKCGETPTQGKTTCGEKICRF

SEQ ID NO: 130461 - protein, 166 aa, Heterodera glycines
  Coding regions on vcDNA: vcDNA=SeqID_56884; Strand=+; Position=1 -34,298-434,542-585,641-716,1027-1071,1116-1175
  Homolog annotation: Hit_ID=CAE59048.1; Match level="QueryCoverage =91%, HitCoverage=29%, E-value=1e-38, Identity=53%"; Hit description =Hypothetical protein CBG02331 [Caenorhabditis briggsae]
LPWNPVTIASDIDFQLPDFRFVNLSYGRQMRQYNAGAFDQLKVTFQFKRLYGYYIVQAYLPSYLFVFISWISFWIDRYALPARILLCVFWIDRYALPARILLCVNAACALIYQMGNVVQNLPRVSYVKALDLFFFVSIFFIFMSLCALDLFFFVSIFFIFMSLCEM

SEQ ID NO: 130462 - protein, 54 aa, Heterodera glycines
  Coding regions on vcDNA: vcDNA=SeqID_56885; Strand=+; Position=1 -79,547-632
MTMFPFVTETENNGVDHLLSTTDQRQGEYFAVHLKGSSSIGMGFLSFYLFFLRL

SEQ ID NO: 130463 - protein, 101 aa, Heterodera glycines
  Coding regions on vcDNA: vcDNA=SeqID_56886; Strand=+; Position=1 -42,475-738
MDKGAAGALLFLKKMLDQIAPPTGSADTDKMVADVHAYFLRHHTDQEVADVFGPDSDYAGGGTAGTRTDGTAFLRRSGLQRLPALLVNGVPLDNALVGGNQ

SEQ ID NO: 130464 - protein, 120 aa, Heterodera glycines
  Coding regions on vcDNA: vcDNA=SeqID_56887; Strand=-; Position=1-362
  Homolog annotation: Hit_ID=AAP51089.1; Match level="QueryCoverage =88%, HitCoverage=30%, E-value=3e-31, Identity=55%"; Hit description =transposase [Forficula auricularia]
HLHDQIRRPPFSAYRGGVLLLHDNARPHVAFSTQQKIEKLRWAVLPHPPYSPDISPCDYYLFRSMEHFLRGKEFADQNEVENALDGFFGSKNDQFYKKGIEMLPERWGRIIDQNGECIID

SEQ ID NO: 130465 - protein, 99 aa, Heterodera glycines
  Coding regions on vcDNA: vcDNA=SeqID_56888; Strand=-; Position=1 -206,627-720
MGGTPTLQAQPNANTMGGTPTPSPNECQHYGRNANTSSPTECHGRNANVLCRTATAAICPTAVCFPAGIPCPPLSSPADDLTVHIVNRKVKRQLALINH

SEQ ID NO: 130466 - protein, 92 aa, Heterodera glycines
  Coding regions on vcDNA: vcDNA=SeqID_56889; Strand=-; Position=1 -132,191-337
  Homolog annotation: Hit_ID=NP_647792.1; Match level="QueryCoverage =98%, HitCoverage=82%, E-value=2e-29, Identity=63%"; Hit description =CG17737-PA [Drosophila melanogaster] gb|AAR10187.1| similar to Drosophila melanogaster CG17737 [Drosophil
EEEGTRQGFCHIRIQQRTGRKTITTVQGIAPEYDLKKIVRYLKKEYNCNGTIVEHPEYGEVIQLTGDQRQHIKDFLCKVGIVKEDNCKIHGF

SEQ ID NO: 130467 - protein, 249 aa, Heterodera glycines
  Coding regions on vcDNA: vcDNA=SeqID_56890; Strand=-; Position=1 -144,190-283,325-437,1773-2171
  Homolog annotation: Hit_ID=NP_705822.1; Match level="QueryCoverage =48%, HitCoverage=32%, E-value=1e-24, Identity=48%"; Hit description =RIKEN cDNA 5330414D10 [Mus musculus] gb|AAH40385.1| RIKEN cDNA 5330414D10 [Mus musculus] gb|AAH31360.1| R
MMFISRLVDRGKFLPGTEREHAYKDTAWKSPTGDPGFFHMSAPCIYASVLENLDLDAGMSFLNIGSGTGYLSSMVGFVIGEKGISHGVELYQNVTEFANDNVAVIQQSGEASAFDWSGFRFISENNLNADDNQQIPNIIAFGRENGEADDDQNENNSEEGREIEQTQNTTGEEEEEDNETDDNVGMSSTESDGQDKMKANNGKGTCKNEDESKPSPTVETEQNKVHQSASESEHFKANTGKGIYSVIKL

SEQ ID NO: 130468 - protein, 49 aa, Heterodera glycines
  Coding regions on vcDNA: vcDNA=SeqID_56891; Strand=-; Position=1 -101,355-403
MGLTASVGQDNDELIDNLVSNDSLKTERVEKIMRIENHFDYWKGNRASE

SEQ ID NO: 130469 - protein, 51 aa, Heterodera glycines; identical to SEQ ID NO: 124998
  Coding regions on vcDNA: vcDNA=SeqID_56892; Strand=-; Position=1-155

SEQ ID NO: 130470 - protein, 257 aa, Heterodera glycines
  Coding regions on vcDNA: vcDNA=SeqID_56893; Strand=-; Position=1 -756,988-1005
FDDEAFLAFVKGPANFDKFCAGKGVTNDQSKELLAQIYGTHLGILFYMRKNWHCANVREEFEEFIDPEECQLFQNYLCIVYEFLFNVYAEQEDIMKPIFKQPIGFQISILMSLMSALELMAKFSKFCIYELKLIERNDSTLAETIQLENEQETLDYYKEKFGQNSKSGESSARAKFDKLMEKMFKKLEEKAMERDKLEKSSEKNFWQMAKGWPLSLRSFNGAASTSSTKAVDDAAQLYDSVLYLPNYGMADAVCFGF

SEQ ID NO: 130471 - protein, 262 aa, Heterodera glycines
  Coding regions on vcDNA: vcDNA=SeqID_56894; Strand=-; Position=1 -73,384-465,514-652,715-842,897-988,1069-1206
  Homolog annotation: Hit_ID=NP_500734.1; Match level="QueryCoverage =99%, HitCoverage=50%, E-value=7e-61, Identity=37%"; Hit description =LAMinin related (lam-1) [Caenorhabditis elegans] pir||T15099 hypothetical protein W03F8.5 - Caenorhabditi
GCSACACDPNGVNMTHTGEPYLKCNDIDGQCHCKQGRGGRTCADCQDFYWGNPLAGNPLAGCMPCECDTYGSQTLQCDRQTGNCMCKPGSGGPKCNQCARGYTGVWPRCQACGECFDNWDAILQTLGQELETLIGRANNIEDTGISSEYDDSFVEMENKIGEVISSEYDDSFVEMENKIGEVKRRMEGINITKEDEDMEQLRRQMDHLQKQIDTTREMLAEKNQRVTRVSTEVNLAEEGVKNLNESAQQIVQLANNLTERAD

SEQ ID NO: 130472 - protein, 48 aa, Heterodera glycines
  Coding regions on vcDNA: vcDNA=SeqID_56895; Strand=+; Position=1 -68,150-228
MQTALIKKIMTFPDQIVIRSNSSRPEGPKPKQKNATTDSKHEPNPNIY

SEQ ID NO: 130473 - protein, 48 aa, Heterodera glycines
  Coding regions on vcDNA: vcDNA=SeqID_56896; Strand=-; Position=1 -21,477-602
MVNKEQQVELCKESIDHLCNAINGIEDEQQKTTATCRAFNGKATNQIN

SEQ ID NO: 130474 - protein, 603 aa, Heterodera glycines
  Coding regions on vcDNA: vcDNA=SeqID_56897; Strand=+; Position=1 -161,215-856,1054-2019,2067-2110
  Homolog annotation: Hit_ID=NP_741748.1; Match level="QueryCoverage =87%, HitCoverage=33%, E-value=3e-22, Identity=24%"; Hit description =sensory AXon guidance SAX-3, roundabout homolog, immunoglobulin superfamily member (139.4 kD) (sax-3) [Ca
NHSSVEDRNITTNERATSVTLYRLIPNASYAIRVAARTNAGVGAFYIGEPVVMTEETLNRHIRLFERSENVWYRQPWSVLVCGIVLWCLLLLMMVLFWFRCCHQKGRSAAEAKEREFIKIRDGSVANSTTMVGGDARNAFWVAHEQFNGGTVETSSGTLARVGGQQNHQQHLSYFQPTNYSADRVPGPHNDAVNSQHHIALSNEMFSNGIPMVGRICPTATLQRHNGGDCSSPNSPHYHYAHLPFYAEQNNSLSTFLQQRPNPELYDAAVMHLTTNSKQRVNGNLEVVEQQPNSSSCGALLELNREWKRQQRITAEEQKKRETPQKKGGTTAQRRENEHDRDMGENQTYGTTGRGTRGGGGRRSQRSSSANTAQKQSSAFCSLRRVSHKENGSECRQNQQDSPQTDISYLQSSDGTNGSNNNNNKRSQQMNRQVKYDDTAPEYDPVMTDSLSQIVHREDIRKKIGPYFTLKLAYLITNPLSNAAGREKANRIVHSNRVSLIEDEGQEERDPLMEDAFGGDEDELDADGEMSENEHSGKESDRRAKRTTDPMKRCEEECNVANEHYYGFSPAPKRPNRQPMMGINISTLSVGVDRRTTASPAHR

SEQ ID NO: 130475 - protein, 47 aa, Heterodera glycines
  Coding regions on vcDNA: vcDNA=SeqID_56898; Strand=+; Position=1-327
FFLYCRNIEFAFDEIIFQFAFVPISFIRSNSLQINQNYNLKLTILNG

SEQ ID NO: 130476 - protein, 67 aa, Heterodera glycines
  misc_feature (42)..(42): Xaa can be any naturally occurring amino acid
  Coding regions on vcDNA: vcDNA=SeqID_56899; Strand=+; Position=1-205
  Homolog annotation: Hit_ID=AAN32888.1; Match level="QueryCoverage =83%, HitCoverage=16%, E-value=4e-22, Identity=89%"; Hit description =annexin 4C10 [Heterodera glycines]
MLQNGLTILLLISVVIGHSLANLGPTIKHNPHFKTVQTAHHXHDAIAKKHEASIEEGGILSENSFRN

SEQ ID NO: 130477 - protein, 31 aa, Heterodera glycines
  Coding regions on vcDNA: vcDNA=SeqID_56900; Strand=-; Position=1 -76,501-520
MRIMFDGWAKVGQGMADHNTDQKQNDANKFR

SEQ ID NO: 130478 - protein, 179 aa, Heterodera glycines
  Coding regions on vcDNA: vcDNA=SeqID_56901; Strand=+; Position=1 -187,877-1228
MSSSSSPEKILAQPSCPKKAKVDERALWKIFKGKYMLAIYLCDDDWRNLFENKEKVRRMDNDHGMAMESLKKDFLEAKMKVLVEEKVAEAKELAEFSISDAERKMNQSLNNAMRVGRERDHHQLRCVVEEQHIRCRLLTLQNYPVATMTKLNIEFATSRRVSQTGDASHVLSDRRPDVW

SEQ ID NO: 130479 - protein, 87 aa, Heterodera glycines; identical to SEQ ID NO: 129152
  Coding regions on vcDNA: vcDNA=SeqID_56902; Strand=-; Position=1-1135

SEQ ID NO: 130480 - protein, 75 aa, Heterodera glycines
  Coding regions on vcDNA: vcDNA=SeqID_56903; Strand=-; Position=1 -54,208-381
MQEAVHQLKKATNALSEKCTNCAPEKRAYRSNFLLVKKYFEDTTSLIKSEVKLWQTVLEEKEEQLRSKDDERSLR

SEQ ID NO: 130481 - protein, 66 aa, Heterodera glycines
  Coding regions on vcDNA: vcDNA=SeqID_56904; Strand=+; Position=1 -139,250-309
  Homolog annotation: Hit_ID=NP_506170.2; Match level="QueryCoverage =100%, HitCoverage=14%, E-value=5e-20, Identity=72%"; Hit description= putative nuclear protein of eukaryotic origin (47.8 kD) (5N183) [Caenorhabditis elegans] emb|CAA99907.2|
MSVSWGTQYSKLKTNLRLAANRLRLLQKKKTEQAVKARCEIADFLSTDKEDRARIRVETIIREDFV

SEQ ID NO: 130482 - protein, 97 aa, Heterodera glycines
  Coding regions on vcDNA: vcDNA=SeqID_56905; Strand=-; Position=1 -105,792-979
  Homolog annotation: Hit_ID=NP_491892.1; Match level="QueryCoverage =100%, HitCoverage=46%, E-value=4e-26, Identity=56%"; Hit description= i-109 protein (23.3 kD) (1H139) [Caenorhabditis elegans] gb|AAB96722.1| Hypothetical protein F57B10.5 [C
VVTGGQYDVDVVLEDPNGKVLYKEARKQLDTHTYKTEANGTYKVCFSNEFSTFSHKVVYLDWQVGPDEQHKMMPIPRAGGAQATQMERSAETISDRL

SEQ ID NO: 130483 - protein, 110 aa, Heterodera glycines
  Coding regions on vcDNA: vcDNA=SeqID_56906; Strand=+; Position=1 -96,925-1032,1090-1217
  Homolog annotation: Hit_ID=NP_497892.1; Match level="QueryCoverage =70%, HitCoverage=34%, E-value=8e-29, Identity=74%"; Hit description =peroxiredoxin, thioredoxin-dependent peroxide reductase, mitochondrial (24.9 kD) (3F499) [Caenorhabditis
KFIADFIGALKFDPEPRPTFPTPLPLLGGAHNFVCPTEIIAFSDRVAEFKQLGCEVIACSCDSHLAFGAWVNTPRNDGGLGKMDIPVLSDFSKKIAADFGVLDKETGLSY

SEQ ID NO: 130484 - protein, 123 aa, Heterodera glycines
  Coding regions on vcDNA: vcDNA=SeqID_56907; Strand=+; Position=1 -109,351-525,574-661
MAPSSSSAAAMTPLGVILVSKDESAERVLFMYPFERQKCHEHKDSVVSMIGKDVPKLGGGGTPDDVPCQPAAIDSGDQQQQRLCDGIALDGISTGFPVKMLAPLLVAKGSNGNGTPFDIKVLF

SEQ ID NO: 130485 - protein, 106 aa, Heterodera glycines
  Coding regions on vcDNA: vcDNA=SeqID_56908; Strand=+; Position=1-321
MPLKFNCAIFVIDLPPPLPHRSANSPEDLWSRVIAASQSFKKAAFCEQVAEEEEGCAWLIRAEAVSSSSTDRVAAPCHQQASTQCQQEEDGEIVEEGWSHYHRHWC

SEQ ID NO: 130486 - protein, 172 aa, Heterodera glycines
  Coding regions on vcDNA: vcDNA=SeqID_56909; Strand=+; Position=1 -62,375-756,1223-1297
MYKTNREDWKPEMSGRYNQRLTFFVNLEALNANGAEISEAKFEYSFRQTYGIQSPLNAKSLDNLVERMKQNETLFDQYFNYSSVQWMTRKLNETERCQKKTDRGRGRGNAMANQLSLIDKKCNGFRKSHLCVVEFVDFDQLERCINAKANKEHLDLLININIILFGRIKKKL

SEQ ID NO: 130487 - protein, 346 aa, Heterodera glycines
  Coding regions on vcDNA: vcDNA=SeqID_56910; Strand=+; Position=1 -756,816-1100
  Homolog annotation: Hit_ID=P08775; Match level="QueryCoverage=67%, HitCoverage=25%, E-value=6e-35, Identity=31%"; Hit description=DNA -directed RNA polymerase II largest subunit (RPB1)
MFGTILLKPYLLLAGLCLFIYGTEAWKCKPGKKGPTGPPGPLGKPGAPGKCPTKPKYGKTTTPKYDTTTSKYGTTRPKYDITTSKYGTTTPEYETTTSKYGTTTSKYDTTTSKYGTTTSNYGTTTPQYDTTTSKYGTTTPEYDTTTSKYGTITSKYGTTTQKYDTTTSKYGTTTSRYDTTTSNYGTTTPEHDTTTSNYGTTTSEYDTTTSKYDTTTSKYGTRTPKYDTTTSKYGTRPPKYTPSKRSAMSEFADAVVIRAARAEFADKKCPVGRPGDAGPAGPPGPPGKPGKCPSPVERYVKKSEEKEGYKRKEETEEKKEAEREKRYDHSVESDGFDFISILSFES

SEQ ID NO: 130488 - protein, 72 aa, Heterodera glycines
  Coding regions on vcDNA: vcDNA=SeqID_56911; Strand=+; Position=1-219
MPQGTTAEPISALQSYAPNWMDQFCWQFEHLIYAMVWKSNAYERREIKGDIKTDLSRKTLLFIKNMDLNAKN

SEQ ID NO: 130489 - protein, 170 aa, Heterodera glycines
  Coding regions on vcDNA: vcDNA=SeqID_56912; Strand=-; Position=1 -130,772-1011,1418-1560
MATSTDEGGSPRANMEEGLLSLPRDSVTLSVPSSRLKMPRRSKEDRLLSALGPFIYLFLPKSSHPIKSPNLFKKMFFVRQLESLAFHRDPFNRPELVHTLRGRELVLFVLLYAIGVIAIVFIFECTMPVFWINDQSRAEQRRRAAIVVRSAQKVMLDREMPSSIGPLRKT

SEQ ID NO: 130490 - protein, 66 aa, Heterodera glycines
  Coding regions on vcDNA: vcDNA=SeqID_56913; Strand=+; Position=1 -15,48-233
MNVKFRCAVNHGHGYREFHGFFHSRSRFTVPIHGYSVKNVHWIKLNIYKLHIVFIEKFSHFLGNFC

SEQ ID NO: 130491 - protein, 69 aa, Heterodera glycines
  Coding regions on vcDNA: vcDNA=SeqID_56914; Strand=+; Position=1-210
MKECLKKKLAQIDEMPKLVRVFCTFFTGHIDADKLIDALLHSGWSTVFNAQIGEKKHGKSILEKFNLEN

SEQ ID NO: 130492 - protein, 206 aa, Heterodera glycines
  misc_feature (157)..(157): Xaa can be any naturally occurring amino acid
  misc_feature (171)..(171): Xaa can be any naturally occurring amino acid
  Coding regions on vcDNA: vcDNA=SeqID_56915; Strand=-; Position=1 -113,164-273,312-397,463-604
  Homolog annotation: Hit_ID=CAE68459.1; Match level="QueryCoverage =100%, HitCoverage=32%, E-value=1e-37, Identity=42%"; Hit description= Hypothetical protein CBG14249 [Caenorhabditis briggsae]
YPPFCSETPQETYRKVMNWQQTLAFPPEIPISTEAKNTIKGFCCEVDKRLGNHTIKGFCCEVDKRLGNHSGIESIKQCPFFKRVDWQNIRLLPAPIRIEVKGIADTSNFDHFGDSDRLLPAPIRIEVKGIADTSNFDHFGDSDLAWKLPLTIRHPPXPKGKLPLTIRHPPXPKGEFVHYTFQRFQCLVWKAHVFDTLLRFRLSRKG

SEQ ID NO: 130493 - protein, 53 aa, Heterodera glycines
  Coding regions on vcDNA: vcDNA=SeqID_56916; Strand=-; Position=1-489
IKFLKIFNSFLNRPKSLGLTFFSETDQKRTKLCRDTERKRKTYFKYYLVSSFK

SEQ ID NO: 130494 - protein, 23 aa, Heterodera glycines
  Coding regions on vcDNA: vcDNA=SeqID_56917; Strand=+; Position=1 -17,173-227
MGKDLQRISHGKLAIDPIKTQNH

SEQ ID NO: 130495 - protein, 106 aa, Heterodera glycines
  Coding regions on vcDNA: vcDNA=SeqID_56918; Strand=-; Position=1 -189,409-540
MRSGAPLLLLPSPAVVLFLLLRFFRCRVAVVAVAKVAPAVSVQRLALRIKALAKVVLAVEHAVDFMPKGNEDEKGILNSKSEKEKPPNGNEEKTISKRKNNTKRKN

SEQ ID NO: 130496 - protein, 109 aa, Heterodera glycines
  Coding regions on vcDNA: vcDNA=SeqID_56919; Strand=+; Position=1-327
MRRAVSVSPTKSAGDFCGAWQCFSSTDSRHAYLAYHHCVFNGEYDFCERFNAQCQSLNGHGGCNLCDSHHCNTAPEEAEEEEKHNGGGGEEEKRGTAAHPHDEMPTEKA

SEQ ID NO: 130497 - protein, 38 aa, Heterodera glycines
  Coding regions on vcDNA: vcDNA=SeqID_56920; Strand=-; Position=1-114
KIPSKIKGLLRTALPIMLESICMCIKFIKKRDSHFSGI

SEQ ID NO: 130498 - protein, 262 aa, Heterodera glycines
  Coding regions on vcDNA: vcDNA=SeqID_56921; Strand=-; Position=1 -76,335-409,548-706,837-1018,1100-1396
  Homolog annotation: Hit_ID=CAE68824.1; Match level="QueryCoverage =89%, HitCoverage=31%, E-value=1e-78, Identity=60%"; Hit description =Hypothetical protein CBG14783 [Caenorhabditis briggsae]
MLLLLLRLPPVLDPKGFNGKFNYLKKHDLSTGSVGPPLRSCEIRLREWEEAGYLPTNSPPQGEVLIHGANVALGYFKDEEKTKEDFVELDGKRWFATGDIGQFHRKKDLIKLSHGEYIALGRVETALLTNPNVDNICVYGNPQKDYLIALVVPNRKNLQALAEKNAVNESSWEAICANKEMAKLLEKELQNFVSGLFFRPTFALLNNSFSGKLRREEIPRKVIICAEPWTADSGMLTEALKLKRKNIERKFAEEIRQLYEGK

SEQ ID NO: 130499 - protein, 379 aa, Heterodera glycines
  Coding regions on vcDNA: vcDNA=SeqID_56922; Strand=+; Position=1 -28,1205-1292,2150-2447,2660-2732,2791-2961,3003-3101,3155-3249,3308 -3409
  Homolog annotation: Hit_ID=AAC72366.2; Match level="QueryCoverage =99%, HitCoverage=27%, E-value=1e-131, Identity=68%"; Hit description= guanylyl cyclase [Heterodera glycines]
NPAIPHALHLLLRVAINANVVHSDWSAAPSPRPQSDVLRRRSIALLMFRNQNLMDYVFGMLEQYASSLEQEVEERTKELVEEKRKSDILLYRMLPRQVADKLKLGEAVEPESFQMATIFFSDVVSFTTLAGKCTPLQVNLLNGLYTAFDGLIDTHDCYKVETIGDGYLVCSGIPKRNTIGDGYLVCSGIPKRNGDQHAKEIAELSFAFLRTVSNFRVDHLPSERVNLRIGFHSGPAVAGVVGLTMPRYCLFGDSVNTASRGPAVAGVVGLTMPRYCLFGDSVNTASRMESNGKAGKIHISSSSNRFLTSGKIHISSSSNRFLTSVIGGYVTEPRGEVIIKGKGVMGKGVMETFWLLGRIGEVHLPEGPSVPERKSPAEM

SEQ ID NO: 130500 - protein, 584 aa, Heterodera glycines
  Coding regions on vcDNA: vcDNA=SeqID_56923; Strand=-; Position=1 -1618,1711-1848
  Homolog annotation: Hit_ID=NP_508324.1; Match level="QueryCoverage =86%, HitCoverage=21%, E-value=5e-70, Identity=33%"; Hit description =predicted CDS, peptidase family A16 and RNA-directed DNA polymerase and Integrase, catalytic domain and Z
PPRIEDGFLDLLSIRETSSIRIKSPKYLVQLELSNGKRESLIVNRIDQITGKLKRIDINSGKTEFIDEKPDILIGMAEFWKFFKSVEQIKENLFKVDTTVGPIICGQMKNNSGKLESLFENITAAVSVKTEEPKQFWNLETIGVWDNPEEKDDEIALKMFKETVQRKNGRYVVSWPWKGPREELPTNFAIAYRRLMSMLEKMRITPSQLRALDESFRENLKEQIVEESSIKGFGEHFLPHHCVFAPGKKPRIGYDGSAKPRSGKCLNDMLFRGPIEMPQLPGLLMRSRIPKIALWADIQRAFWTLELKEEDREFVKFLWVRDIRKPITKENLLVLRFKRVPFGVISSPFLLGATVRYHLSQIDSQLTNEIQKNLFVDNVFVGCKDEKEAMEKYVSMKQIFADARMNLREFVSNSYWVNNQILENDRLGKEKPKIMGVQWDVQKDEFLIKFAEPANSKMTRRRVLKDLNSIFDPCGWTSPCLLPAKLFFQTLWDSERKWDDNLNENECEKWIQITQNWKKANFTLKRRIEMGKSENNQLHEPLKTKKNESFYTKNGTFRGFDWNKGYEIRGERIGNKNKKQILMV

SEQ ID NO: 130501 - protein, 96 aa, Heterodera glycines
  Coding regions on vcDNA: vcDNA=SeqID_56924; Strand=-; Position=1 -26,374-638
  Homolog annotation: Hit_ID=AAS66293.1; Match level="QueryCoverage =88%, HitCoverage=42%, E-value=3e-13, Identity=46%"; Hit description =LRRGT00202 [Rattus norvegicus]
MKASCLTGAGAHDEMEEGKEEEKKEEGADEEKKEEVEEEEKKGEGEEEEKKEEGEQGREKGRRRRGREKGRRRRGREKGRRTRGREKEKWLISDKE

SEQ ID NO: 130502 - protein, 54 aa, Heterodera glycines
  Coding regions on vcDNA: vcDNA=SeqID_56925; Strand=-; Position=1-356
LFFEKFFVFFSAGTASDNVFYLFRKINLFFFFLIYFNYISSLNFLINIFKLSPY

SEQ ID NO: 130503 - protein, 50 aa, Heterodera glycines
  Coding regions on vcDNA: vcDNA=SeqID_56926; Strand=+; Position=1 -37,458-573
MSELNCVVQFALGHCLRPPTKTTKKAPICEPMAIDEKRRKERPFDYLCWT

SEQ ID NO: 130504 - protein, 93 aa, Heterodera glycines
  Coding regions on vcDNA: vcDNA=SeqID_56927; Strand=+; Position=1 -11,76-346
MNRRWICNDVWMDIFPSFDRAQLGLKLALLSPRFDALVDKHFNGKSELAIWRPIEIRRKDKGPEPNLSVRMDDKSLPDRPLPSKIRFKSLQIK

SEQ ID NO: 130505 - protein, 230 aa, Heterodera glycines
  Coding regions on vcDNA: vcDNA=SeqID_56928; Strand=+; Position=1 -384,499-804
  Homolog annotation: Hit_ID=AAV88076.1; Match level="QueryCoverage =100%, HitCoverage=19%, E-value=1e-41, Identity=36%"; Hit description= putative retrotransposon polyprotein [Ipomoea batatas]
MDLQQGFMQIPVAEEDIEKTAFISHLGIFEFITMPFGLTAAPDTFQRVMNSLRRRLTAAMLIYLDDIIIGSETEENHLTDIKNFLLLLKKVGLKLKLEKCHWGMSEIRYLGFLLSEKGVRIDPKQVEATLTQDKFEGKIEENWGPEQEHAFQTLKQMLTTVPGLESPRFARAFTIECDASKKAIGAVLLQENGPVAYISRALNRHETNYPSIEREALALVYTVKEFSPYI

SEQ ID NO: 130506 - protein, 138 aa, Heterodera glycines
  Coding regions on vcDNA: vcDNA=SeqID_56929; Strand=-; Position=1 -20,66-160,297-598
MQKLVKYQNELLAYYERERLLGENDAPLAMDGIIAELRGRWARWEEEEEEQEEGEEEEEEEEEGEEEEANESVMGSSIWSGSIDSAITGFSTMSATQRKKVLGRSRQWWQERKERKKAEKGRCAKTAGAPENDKLNFD

SEQ ID NO: 130507 - protein, 260 aa, Heterodera glycines
  Coding regions on vcDNA: vcDNA=SeqID_56930; Strand=-; Position=1 -114,474-1139
  Homolog annotation: Hit_ID=NP_502797.1; Match level="QueryCoverage =82%, HitCoverage=60%, E-value=2e-33, Identity=38%"; Hit description =HASI (4P602) [Caenorhabditis elegans] emb|CAB16520.1| Hypothetical protein Y57G11C.19 [Caenorhabditis ele
LKTGPEHYDKLHEMIERNPEKYGVDKSSGEILTNFKKPEAKKRNPSITLRDVDHFLHKQRTYTLFKPRKNRFRRLKTVPSGLHTDWQCDLCIMDALKEHNDGFRYILVCIDVLSRKIFTAEVESKKSEHMIAAFEKIFNKAGVLPNKLYSDAGLEFQAKKMIDYWKQKEIIKHVMYSPHLHAGAVERANRTLKERLYKYFSEKNTKRWVDVLDSIVRNLNSSANRTTGVRPMDVNFKNAAGLRNRLYKQGESSPKTPKFK

SEQ ID NO: 130508 - protein, 113 aa, Heterodera glycines
  Coding regions on vcDNA: vcDNA=SeqID_56931; Strand=-; Position=1 -26,736-769,847-1128
MSGFDPFKRLIFHLNIEEIWKKVVASEQTLFLHIVNGLLEELRQNLKQINQKLKWPAEMNKKDSDKQKKDRLSMSEEKKKDLLSMLEKKKNKESPCEEILPLSGAKEKDTKKK

SEQ ID NO: 130509 - protein, 63 aa, Heterodera glycines
  Coding regions on vcDNA: vcDNA=SeqID_56932; Strand=+; Position=1 -109,239-321
MNFNQLFIFTILLPLLFLINSANFIHARSAKIQSKAGKIPKILCDSVDECPYGMRCKAGMCMN

SEQ ID NO: 130510 - protein, 158 aa, Heterodera glycines
  Coding regions on vcDNA: vcDNA=SeqID_56933; Strand=-; Position=1 -180,486-641,769-909
MVDKFRETVQFVDDGAPSFLRLGAAKMVKKEQQRHCHACAKKVPDSELFICKDCNKPTKKHTVVTLDCLASERDRELAALRIEEILNHAQRMVDESRGMQNDIAKQFETMRENLLAKLSFFYALQNECLNGEQILLKEHIEEKVYSAIQKCEQLNEVH

SEQ ID NO: 130511 - protein, 96 aa, Heterodera glycines
  Coding regions on vcDNA: vcDNA=SeqID_56934; Strand=+; Position=1-291
MVARRAETVAIVRRLLFQLAKQANRRRVQQRRRLKQQQQPEDDDDQQQQDDGVAGGGDDERVEEEEEGDNDGGDQQEEDNDDDFIDDDAVVCFQSD

SEQ ID NO: 130512 - protein, 271 aa, Heterodera glycines
  Coding regions on vcDNA: vcDNA=SeqID_56935; Strand=-; Position=1 -42,85-325,370-618,664-783,825-988
  Homolog annotation: Hit_ID=NP_507780.1; Match level="QueryCoverage =88%, HitCoverage=18%, E-value=2e-32, Identity=32%"; Hit description =predicted CDS, DNA polymerase type B, organellar and viral family member (5T899) [Caenorhabditis elegans]
MAPYRIVAYDLECTTNTILDENSLKKETIHKPNFISARFTCSLCLGEIKECEICGDGPRHLKWCSMDRIDPLNCFVKWIINFQKYDTYAYAHFGGRYDSHFILRELANLGYKQPELTIADLKIYEIKFKKGEKSPKFFFRDSWLLMQNKLAHLPKTFGLDCESKLYFPHQFNKEENYGKILATLPPFDDYFPDELSEEEYEKFKKWYYANYNNGFILEEKLDEYCSNDTDILMKALIKLRKIFIDITKDKETPKGIDVMRLSTTIASSCMN

SEQ ID NO: 130513 - protein, 178 aa, Heterodera glycines
  Coding regions on vcDNA: vcDNA=SeqID_56936; Strand=-; Position=1 -55,165-236,278-486,870-1040,1096-1125
MNNADTVLHEIFRINQSYRFNPLDFCEIKELGRISVKNSDNYCLFYALTLSRFYQLINKNDEEAISRDQFKKIIANEQRQWEAVKQLMTDAKINMKEKSYGLEHLQIIQDFWALVSLAPRKEKHLTVRSVTGLFLMRIALSITKIKYVLYIKNVKNAKENLGRTQNIIAIRNIVENVI

SEQ ID NO: 130514 - protein, 271 aa, Heterodera glycines
  Coding regions on vcDNA: vcDNA=SeqID_56937; Strand=-; Position=1 -42,84-324,369-617,659-778,818-981
  Homolog annotation: Hit_ID=NP_507780.1; Match level="QueryCoverage =98%, HitCoverage=20%, E-value=2e-30, Identity=31%"; Hit description =predicted CDS, DNA polymerase type B, organellar and viral family member (5T899) [Caenorhabditis elegans]
MTAYRIVAYDLECTTNTILDEKSLRKETIHKPNFISARFTCSICLGEIKDCEICGTGPRHLKWCSRDGVDPLNCFVKWITTLEKHETYAYAHFSGRYDSHFVLRELANLGYKQPELTLADLKIYELKFRKGEKFPKIHFRDSWLLMQNKLAHLPKTFGLDCDSKLYFPHQFNKEENYGKILTTLPPFEDYFPDEMSEEEYEKFKKWYYSNYNNGFLLEEKLDEYCSNDTDILMNALLKLRKIFIEITKDEETPNGIDVMRLSTTIASSCMK

SEQ ID NO: 130515 - protein, 119 aa, Heterodera glycines
  Coding regions on vcDNA: vcDNA=SeqID_56938; Strand=-; Position=1 -55,165-236,278-510
MNNADTVLHEIFRINQSYRFNPLDFCEIKELGRISVKNSDNYCLFYALTLSRFYQLINKNDEEAISRDQFKKIIANEQRQWEAVKQLINETKINMRAKNYGLEHLQIIQDFWVKIKIQD

SEQ ID NO: 130516 - protein, 117 aa, Heterodera glycines
  Coding regions on vcDNA: vcDNA=SeqID_56939; Strand=-; Position=1-634
VISGTTTKKNEFSLSCQFGDLSKYNSQQNLNFPRKCHFEFPNPLPKFEFPLICHFMTNHNFPHLSLVTNQKFPIKKFPPSPRLSLFKSSKFSVKKVQDNLKPFNRFWFGSPPPQLTN

SEQ ID NO: 130517 - protein, 175 aa, Heterodera glycines
  Coding regions on vcDNA: vcDNA=SeqID_56940; Strand=-; Position=1 -397,982-1112
MDDSILASINDDENNQQQMMPPPQPLSSAANAFSNHGSASSSSSSAHVDNLLLHSTNMMPSTASATDNLFVVADQQQQQQQQQQQQTENDNNNNSNGIIQSKQQQQQQAEQTERRSPEEVVDELIRIAEARFGLYLYLEGLQKLATFQYQLCPVQSPLNNSLGFDLSAGWPADLL

SEQ ID NO: 130518 - protein, 159 aa, Heterodera glycines
  Coding regions on vcDNA: vcDNA=SeqID_56941; Strand=-; Position=1-480
  Homolog annotation: Hit_ID=XP_139295.2; Match level="QueryCoverage =94%, HitCoverage=18%, E-value=9e-34, Identity=36%"; Hit description =similar to caspase recruitment domain family, member 6; caspase recruitment domain protein 6; CARD-contai
GLIHTQLIHDPTHPYPTHPYPTHPYPTHPYPTHPNPTHPNPTHPYPTHPYPTHPYPTHPYPTHPYPTHPYPTHPYPTHPYPTHPYPTHPYPTHPNPTHPNPTHPYPTHPNPTHPYPTHPYPTHPYPTHPYPTHPYPTHPNPTHPNPTHPYPTHPYPTHP

SEQ ID NO: 130519 - protein, 40 aa, Heterodera glycines
  Coding regions on vcDNA: vcDNA=SeqID_56942; Strand=+; Position=1 -45,431-508
MRRPVKANNNNSRMAQALFRLRNNNRIRKMAWRGPTLTRR

SEQ ID NO: 130520 - protein, 75 aa, Heterodera glycines
  Coding regions on vcDNA: vcDNA=SeqID_56943; Strand=-; Position=1 -116,438-549
MAEIWDKKAKMAKYGFIPENHQNMDLYGLKTFTKSKNFRENGQKIDDNCPTLTNCKSPKKSTQTTAFTSTLCINK

SEQ ID NO: 130521 - protein, 51 aa, Heterodera glycines
  Coding regions on vcDNA: vcDNA=SeqID_56944; Strand=+; Position=1-154
RLIEPVKSFRMISRLFDSVNNFKSYIDSKLAQTELARRSWPVPPTLWVKPS

SEQ ID NO: 130522 - protein, 32 aa, Heterodera glycines
  Coding regions on vcDNA: vcDNA=SeqID_56945; Strand=+; Position=1-137
LKYSVYVAQKISYSELIAFSKPLNSFALLICT

SEQ ID NO: 130523 - protein, 50 aa, Heterodera glycines
  Coding regions on vcDNA: vcDNA=SeqID_56946; Strand=+; Position=1 -27,105-230
MAYNASTDVWFQYFNSNGPQWVILLAAYGFRALWATLGIMDHSGIVYITP

SEQ ID NO: 130524 - protein, 79 aa, Heterodera glycines
  Coding regions on vcDNA: vcDNA=SeqID_56947; Strand=-; Position=1 -30,332-541
MTSHNSRNISYWCICAVYGNCEERKSDGNGRFDKNIYNDKALEEHVDAAFEEHAEQIERNDKDQRLGQFAIVGIHIGNY

SEQ ID NO: 130525 - protein, 66 aa, Heterodera glycines
  Coding regions on vcDNA: vcDNA=SeqID_56948; Strand=-; Position=1 -15,761-946
MVIFEINALLIKQFIFENCLTPHPLSSPMTKWFATVRKRAMFAREFVKIWAPNVQTDKGRVIVGER

SEQ ID NO: 130526 - protein, 47 aa, Heterodera glycines
  Coding regions on vcDNA: vcDNA=SeqID_56949; Strand=-; Position=1 -70,358-431
MVDWGREKPKMSGNGEINNDVVKGPLPAGPSPAGGGGGGSANDSSIV

SEQ ID NO: 130527 - protein, 87 aa, Heterodera glycines
  Coding regions on vcDNA: vcDNA=SeqID_56950; Strand=+; Position=1 -107,159-315
  Homolog annotation: Hit_ID=NP_504202.1; Match level="QueryCoverage =98%, HitCoverage=24%, E-value=1e-29, Identity=72%"; Hit description =gmp reductase (38.8 kD) (5E848) [Caenorhabditis elegans] gb|AAB65350.1| Hypothetical protein F32D1.5 [Cae
FKAFYGMSSATAMLKHHGTVAEYRASEGKTVEIPYRGDVRETVKSLLGGVRSACTYIGAQKLKEMPKRATFIRVQMQANEVYSAFDA

SEQ ID NO: 130528 - protein, 69 aa, Heterodera glycines
  Coding regions on vcDNA: vcDNA=SeqID_56951; Strand=+; Position=1 -82,229-356
MLFLQIAFLLLLASIQLAIGSPILKRREKKLQKKINFYPLLIILPLKFVPFETKRMPRNRRIQYCSVKH

SEQ ID NO: 130529 - protein, 241 aa, Heterodera glycines
  Coding regions on vcDNA: vcDNA=SeqID_56952; Strand=-; Position=1 -195,627-719,768-888,930-1246
MTADGQQIHKVNFLSARVTCSDCADSVQCAIEQCEICMNEDGLMERSKYWAAFFLLRFILSWTLLRKLYHSIAAASSKRRLFSWMHDTEGAELLYTDTDSVIVKHRRGVEPLQTGEFLGQMSEEYTGYSIKSFVCGALLQGAKQYALKMVDERTGEIRYVQKIRGITFDVQNSQALQFEHFRHKVLNYGRQGEMPAVFSYDKIQPTRASQIVTREQLKRYLPVCQKGIITDELDVLPFGYQ

SEQ ID NO: 130530 - protein, 131 aa, Heterodera glycines
  Coding regions on vcDNA: vcDNA=SeqID_56953; Strand=-; Position=1-396
MKIDLFLIILTLIYSQRNIESVKKIRENFDEIFGKGWEEKAEEEEQQRDNSANNLQNGGENGADLNDQKKKWTLKNDQQKREIIRKFDAINERMKSKEKYQIKNRVKIENKIGRILGTNRKLIYKWKNEWD

SEQ ID NO: 130531 - protein, 462 aa, Heterodera glycines
  Coding regions on vcDNA: vcDNA=SeqID_56954; Strand=-; Position=1 -25,207-817,1039-1477,1741-1980,2805-2878
  Homolog annotation: Hit_ID=AAO85457.1; Match level="QueryCoverage =28%, HitCoverage=59%, E-value=7e-09, Identity=30%"; Hit description =putative gland protein G19B10 [Heterodera glycines]
MAKRLTMQTGHPNFNVSLTSLLISIDRLSKSLELVLELLKTECQLAKIASKNSSSSYPTNGYLAKFCDKKTGQNLDTIEKLTEHLTDFIEKDLPKIVEAMKKTETTEIIFTGRVHGTMAEILPRAKQYPNDASLLLYAQAMKALSRISQEIEPGTTKDALTKTLKKHTVASDDGDTVTLMPSELTQIIMELWTNTILKGIANAGQEKYNYLQPQLNGTGADRSQDRRHRRAPPVFHIHSNIIMMILLIVQMSLIAVVGIDASRSDANWVTVFTAFFTMFFIWRVQIPGQPPPPSIHFSLNFNLILPVVQTWIGVGMPFGGAAQRPPAAGDDYRAQHLLAMLQMFNAMNGRANTAAPSADWNRDRSADITTTATTPATPTGNNGNDDRKQVEHYDPVSDTFVGAEETFVTTTTESPINWEGEGTEDSNGDTDDSLLREYVSIHLNIRDPVLRHMPFFFKFPMT

SEQ ID NO: 130532 - protein, 153 aa, Heterodera glycines
  Coding regions on vcDNA: vcDNA=SeqID_56955; Strand=-; Position=1 -66,544-765,849-1022
  Homolog annotation: Hit_ID=NP_500384.1; Match level="QueryCoverage =93%, HitCoverage=36%, E-value=3e-19, Identity=37%"; Hit description =kinase, Germline helicase-Binding, mitogen/stress activated protein kinase, c-jun N-terminal kinase (kgb-
MKSLRNAAYGEKTMLARSEQGSLIALYDVRLPPKLKPLKKFDDLHLVTEYFGKNLRERIVEKLKNGTLWTHQELSYCIIQILCGVNFLHNSGIVHRDLKPTNVVMNERGNVKILDYGIARDIVPENLTTEAGTPIYRAPEIYLGIDSYDKKGN

SEQ ID NO: 130533 - protein, 124 aa, Heterodera glycines
  Coding regions on vcDNA: vcDNA=SeqID_56956; Strand=-; Position=1 -151,239-326,389-521
MVKSVVSLLKSYKISSPSTTSNTTPSTNSSDDSCDNERQQQQQQSDDIKRVNGDMKSLRNAAYGEKTMLARSEQGSVWKSIATEEDGTTRNVTIKLLRAPFHSPGTAKYTLREVALLSTLNHPN

SEQ ID NO: 130534 - protein, 342 aa, Heterodera glycines
  Coding regions on vcDNA: vcDNA=SeqID_56957; Strand=+; Position=1 -345,869-1237,1462-1636,2055-2194
MPPGNEMLAPDWQMVNVNGANFYGNDTSSAVNNAALGGAVGSGQQQQQNPQHFVATNGIAIARTRPIKRPSVRRSVSALNIPMKVVASANATPNAAAGGANNNSNNCGQFGTPSPQPSQQYLTAGTANFGRPGPSPPQQQHQQLSYGQVQQQRDGGQWLSSATNNGGTSPESPLSNHQAQQTQQQSPATGGYRSRSASMNVLTTPTMESQQQLMFNTSMGSSTNNNNNNIFGHSMQRLTSPDESPLDHVNVHQQYAVSTYANNEQQQQQLLLSPSPPKRSASFTDMCASYQQMNIQDFIKSIYINNWLILCIELDPDGPQPKISLANQQQSAAHFAAFKGIN

SEQ ID NO: 130535 - protein, 20 aa, Heterodera glycines
  Coding regions on vcDNA: vcDNA=SeqID_56958; Strand=+; Position=1-61
VNIDHSPQTQKCLKTVRIDV

SEQ ID NO: 130536 - protein, 32 aa, Heterodera glycines
  Coding regions on vcDNA: vcDNA=SeqID_56959; Strand=+; Position=1 -49,753-802
MFNEGQRMIINKIHEKVNITKGFDVEKKEGNK

SEQ ID NO: 130537 - protein, 63 aa, Heterodera glycines
  Coding regions on vcDNA: vcDNA=SeqID_56960; Strand=+; Position=1-290
GCEAGMCLGFAFRISPFALFAFFGVSHFAFRFLARNATFTPLRIGLNSHKIFQNFTYKLANFQ

SEQ ID NO: 130538 - protein, 193 aa, Heterodera glycines
  Coding regions on vcDNA: vcDNA=SeqID_56961; Strand=-; Position=1 -129,450-743,791-947
  Homolog annotation: Hit_ID=XP_395616.1; Match level="QueryCoverage =97%, HitCoverage=56%, E-value=1e-11, Identity=26%"; Hit description =similar to ENSANGP00000021998 [Apis mellifera]
QCQLKKRASGFYHQNVLSEEYKTIADYKQNAQWPCLEIDQYENVFWNGVTEEQRIFEYAQELPMQKGDKDWQPSLGSILELQFLSTNNGGLGVPIEGITSPYFYLRKAGSYFTAHTENSDLYSVNLLCPSSGTDNVGITIWYSIPAADFLKFKNLLSTFFVKEFTNDPEYLRNKSILVNPNIIRENGIRCIRT

SEQ ID NO: 130539 - protein, 38 aa, Heterodera glycines
  Coding regions on vcDNA: vcDNA=SeqID_56962; Strand=+; Position=1 -58,198-256
MATVHFACNQQSFCTPLIKHKPNKNTVSVSNSAYRKLK

SEQ ID NO: 130540 - protein, 519 aa, Heterodera glycines
  Coding regions on vcDNA: vcDNA=SeqID_56963; Strand=-; Position=1-1562
  Homolog annotation: Hit_ID=AAL27282.1; Match level="QueryCoverage =98%, HitCoverage=65%, E-value=4e-55, Identity=33%"; Hit description =spore wall protein 2 precursor [Encephalitozoon intestinalis]
EKDKIGTRRNTAEERKEKIATGRNTVGEAKGNSGRNTAEEGKDKIVSGRNTAEEGKDNSEKNTAIEGKDKIGTGRNTTEEGKDKIGIKNTTEEGKNNSGRNTIGEKSGINSTGDSGRNTAEEGKDKIGNGRNTAEEGKGNSGKNTLGGKTGRNTIEDGTGESGRNTVGVESARNAAGEGKDKIVSGRNTAEEGKDNSEKNTAVEGKDKIGIGKNTAEPGKDQIGTGKNTAEEGKGNSVRNATEEGKDKIGIEKNTGEEGKDKMGTGKNTAEPGKDQNGTGKNTTEEGKSNSGRNTAEEGKGNSERNTAEEGKSNSGRNTAGEGKYKIGTGRNTTEEGKDKIGTRRNTTEERKDKIATAKNTAEPGKDQIGIGKNTAEPGKDQIGNGRNTVEEGKGNSGKNTLDGKSGRNTIEDGTGESGRNTVGGESGRNAAGEGKDKIGIGKNTGEEGKGNSVRNATEEGKDKIGIEKNTGEEGKDKMGTGKNTAEPGTDQNGTGNNTTEEGKSNSARNNSRRRTRQF

SEQ ID NO: 130541 - protein, 253 aa, Heterodera glycines
  Coding regions on vcDNA: vcDNA=SeqID_56964; Strand=+; Position=1 -246,349-600,922-1183
  Homolog annotation: Hit_ID=AAN77190.1; Match level="QueryCoverage =98%, HitCoverage=99%, E-value=3e-33, Identity=42%"; Hit description =unknown [Choristoneura fumiferana granulovirus]
VFFPELPFPSSTVFLVANLVFSRFGCVFSNANLVFSRFGCVFRSGNFVFSFFGCVSSGADFVFSFFSCISSSANFVFSLSGFGCGCVFPSAILVFSRFGVFPSAHFVFSFFACVFLNANFVFSFFGCISHRIAFSFFGCVFPSANLVFSRFGCVFPNANFVFSFYGSFFGCVFNANFVFSFFSCISSSANFVFSFYGCILFRIVFSFFGCVSPTDNFVFSFFGCISSRIAFCFTDCVSSGAIFSFLSSLYFFW

SEQ ID NO: 130542 - protein, 163 aa, Heterodera glycines
  Coding regions on vcDNA: vcDNA=SeqID_56965; Strand=+; Position=1 -42,84-205,303-349,847-971,1017-1063,1200-1306
  Homolog annotation: Hit_ID=NP_741091.1; Match level="QueryCoverage =92%, HitCoverage=21%, E-value=1e-65, Identity=72%"; Hit description =protein Phosphatase with EF hands, homologous to Drosophila retinal degeneration C (80.3 kD) (pef-1) [Cae
MPDSLGKKSINVDEWRQILDVLWSDPKPQNGCWPNAFRGGGSYFGPDVTKKFLEKNGFRLLIRSHECKYEGYEFMHENRVLTIFSASNYYETGSNRGAYVKFVGKDKAPHFVQYMASKVHKKITVRERLSIVEQSAIKKLSEKLVSFNTELQKEFGKIDSTGT

SEQ ID NO: 130543 - protein, 144 aa, Heterodera glycines
  Coding regions on vcDNA: vcDNA=SeqID_56966; Strand=+; Position=1 -34,101-279,353-574
  Homolog annotation: Hit_ID=EAL47348.1; Match level="QueryCoverage =63%, HitCoverage=55%, E-value=8e-24, Identity=56%"; Hit description =ubiquitin-conjugating enzyme, putative [Entamoeba histolytica HM -1:IMSS]
MTFLTDILHPNVDMSGQVCISILHPPGNDPLGYEQASERWNRNRTVESILVSVQLLLAEPNFNSPANVDAAILFRNDPAQYRKEVRRRVERASASTPRARSSSTPPPVAQPPGEQQQGTPQPPATPPQGQEAQQQQQQTGEWYL

SEQ ID NO: 130544 - protein, 229 aa, Heterodera glycines
  Coding regions on vcDNA: vcDNA=SeqID_56967; Strand=-; Position=1 -248,564-767,988-1222
  Homolog annotation: Hit_ID=NP_496590.1; Match level="QueryCoverage =96%, HitCoverage=31%, E-value=3e-32, Identity=34%"; Hit description =streptococcus pyogenes AMV256 like (81.2 kD) (2M468) [Caenorhabditis elegans] emb|CAB55016.2| Hypothetica
MSDHDNLVNPRWAHSLIKTAARKLYTERTWKEEHFNDLVHTVLVQQPTLKAFLLNVLLKDHHDKRAHEKWRNFVSTERCRMSNAFDMVNLCSKDEQTQFLSLPRRCAVYEIDTAHAFRVFERQLDEYFLKKTHRVLVGVDAEWNPYVARSRASLLQLALVNSVYLLDLDALYADKSFQQFIDRLFLDKAIIKLGYQFGDDLAMLRARLPACVGLYRPQGIVCIGQLVDE

SEQ ID NO: 130545 - protein, 165 aa, Heterodera glycines
  Coding regions on vcDNA: vcDNA=SeqID_56968; Strand=-; Position=1 -15,372-788,847-910
MNVIFRFRPKSPKKIKSFFAKKKAALSSSKKPGAKKPFKNPFAKFKKSGAAGSDKKPDAKKPFMNPFAKFKKSGAAGSDKKPDAKKPFKNPFAKFKKSGDAGTDKKPDAKKSLFAKFKKSGAAESDKKPDDKKPLKNPAKIADKPGPHQQPVHHDPSHQPPLKKP

SEQ ID NO: 130546 - protein, 187 aa, Heterodera glycines
  Coding regions on vcDNA: vcDNA=SeqID_56969; Strand=+; Position=1 -181,344-543,920-1009,1080-1169
MENFTRFLHFINSLFVFNNYLFVSKSRPTSAFIVHQSFIGWHPRAFQNGRSQKACEPCTTGAELEALLTKTDKTEEDMKKLVHTIEVYLQPNPGGHLEFAIFWRKTLIFFPQFSAVRALDGLGEALKKERSVLNKKRLDLDVTKSRWKRASDDKKPAVEAELRTAQAEFDTQLVTIITALEALQTAM

SEQ ID NO: 130547 - protein, 46 aa, Heterodera glycines
  Coding regions on vcDNA: vcDNA=SeqID_56970; Strand=+; Position=1-140
MASKCLPPELLYEIVPFVLAKMLPQIRSRPVGCFTNFYCHVSSNGK

SEQ ID NO: 130548 - protein, 42 aa, Heterodera glycines
  Coding regions on vcDNA: vcDNA=SeqID_56971; Strand=+; Position=1-166
ILMSLSVIKCKYKNVIESVRTQICEYAKLTLKICHFMLCCRI

SEQ ID NO: 130549 - protein, 32 aa, Heterodera glycines
  Coding regions on vcDNA: vcDNA=SeqID_56972; Strand=+; Position=1-101
ARIQQSTTVKNKDIRKFLDGIYVSEKVAIADE

SEQ ID NO: 130550 - protein, 122 aa, Heterodera glycines
  Coding regions on vcDNA: vcDNA=SeqID_56973; Strand=-; Position=1 -203,470-500,872-1006
MAERCNSLRRGTGTGGATICAPPSSNNGKKRLPCPPLTFLNIPNFSLDELYARTFSRPDLEALVEIQEKALTAQKGELNLQTVLNSMRNANWTERIGAESATAERLHTAIAAMRTALAEKKR

SEQ ID NO: 130551 - protein, 110 aa, Heterodera glycines
  Coding regions on vcDNA: vcDNA=SeqID_56974; Strand=-; Position=1-330
MISNNIKANNNMCKLDKCTQSDDGKIGANFYAGGGCERCATFWPILEGKSRSRSSSKSVHQNGTIEEEGEEKRPKVIGKFVFAELFEKGGGRKSPNYGTMVADNNGRHQS

SEQ ID NO: 130552 - protein, 53 aa, Heterodera glycines
  Coding regions on vcDNA: vcDNA=SeqID_56975; Strand=-; Position=1 -9,175-327
MEQHRQRLEAMYPAGTFSNTYFRTAPMPPPRALMVRDRATRPLSICAPLPGNF

SEQ ID NO: 130553 - protein, 224 aa, Heterodera glycines
  Coding regions on vcDNA: vcDNA=SeqID_56976; Strand=+; Position=1 -233,778-1219
  Homolog annotation: Hit_ID=CAG09246.1; Match level="QueryCoverage =100%, HitCoverage=24%, E-value=5e-16, Identity=28%"; Hit description= unnamed protein product [Tetraodon nigroviridis]
MKKAEKRIKELEMTTEELKRENNELKKEMSNYDEAKKELERTREEVKEANERVGRAREEMEEKKREWGERESVEQLKKAFKLAEEVQKCEQKLSKMEEKEREWTEKVRECHWEGWKAQFATHCQVGRVEDEKAELAAELLAERRRVEKSETEFEMAKRLLEEKEERIREKERAQNAQQFPGTAEETHFELQEQQQTKVPMAKARKERDGNDGDEICRMSAELEK

SEQ ID NO: 130554 - protein, 18 aa, Heterodera glycines
  Coding regions on vcDNA: vcDNA=SeqID_56977; Strand=-; Position=1 -27,80-109
MYHFTVSYTGKKKSGKFM

SEQ ID NO: 130555 - protein, 78 aa, Heterodera glycines
  Coding regions on vcDNA: vcDNA=SeqID_56978; Strand=+; Position=1 -191,374-419
MYGSSRIPRPADLASNNSSRPASRASDMGSDFGTNGGVTSATPSRIPAPRAQQQKGVRFASGTGGSSDGSGRNTPSVL

SEQ ID NO: 130556 - protein, 114 aa, Heterodera glycines
  Coding regions on vcDNA: vcDNA=SeqID_56979; Strand=+; Position=1-345
MSQPNALAKIAKRLIYETRMCKELKEIGLQPHHQHRLEEAQQKFAKGECLTQCELTLLFMEQQERLRQKRFRQQQQLQQQPPQQQQPQQQQQPPQNWILSDLLIIFTKLSILCA

SEQ ID NO: 130557 - protein, 182 aa, Heterodera glycines
  Coding regions on vcDNA: vcDNA=SeqID_56980; Strand=+; Position=1 -144,1120-1256,1879-2146
MRRLLEADQLALGCLDTWLMMKLSGCDDQSFVTEPSSASSTGMFDPFTSDDEPEFDNADGDEGGHDDSAVCFVPAFGGIQTPIGDDFACAALMGRNSRQSPMCPSPIFKDCGHLTKWTAPSATVVAVAKVWSALSACSLRGRALPLRHFAVDSTGGGMRSGGVFIIMNGNDGKDDEMPMEFL

SEQ ID NO: 130558 - protein, 40 aa, Heterodera glycines
  Coding regions on vcDNA: vcDNA=SeqID_56981; Strand=+; Position=1 -68,675-729
MLGSAPNKRAQMFFKDSLSIGENTTFYTTFKKLSTNFSTL

SEQ ID NO: 130559 - protein, 616 aa, Heterodera glycines
  Coding regions on vcDNA: vcDNA=SeqID_56982; Strand=-; Position=1-1848
MILFGTTITALGADELGAFNGRGPIVIQYFRTRHNRNLMFPEAPCLCEKGGRNHVSYYPLELIEVRETFDRDPPFDFGTRMPWDDNPETVNMGPLEGEKSPKRLSISSKGSSITVEYHGTPQSGAGNPMEGISPDNHSVIIQEIDSESPTGNPVEMRGDPPRSEERSIVMNVPANSKIELIGPLKCKIILLVLSAFIMIHSVGAKQLPSALIHSPSRGPSSLKMREAPMNQIFLHGFGGDVHPGSEEEAVNHRPMSAVDGDASFRMKGTNMSHPFLCAYGMNQGHKIVSSALWRQLYKEEGKEQKVTCLSLFLPLQPPELQPTMDISKLLDESEEFVQQQQQHHQQQQKQQVVRFVKIDEESDDEALRIDISESESEEEDDDDEEEAVAALEAAVASAAPSPVVQETKKPRIQGPMEAPKTKRVAAAEGPFVKRARIGGPLNAQKSRCNKCGLLGHLSGDEARCPKTNALVKAEMDRKKAAAFAKRAEATMECSAPPIIPLPVKGGGQARAARAGGVAASMVAGGRASAEGAFRASKERARQELMAAMEKPKAAAIRVAERKAAARPGLQVPMETNAVLNGLSEIGARIDRERDNHLSMAEELQQRGKRAVAAMDE

SEQ ID NO: 130560 - protein, 37 aa, Heterodera glycines
  Coding regions on vcDNA: vcDNA=SeqID_56983; Strand=-; Position=1 -27,186-272
MILKYFMHKEFLFEFGLGIRIGVRFVVRDHKSPWQFV

SEQ ID NO: 130561 - protein, 71 aa, Heterodera glycines
  Coding regions on vcDNA: vcDNA=SeqID_56984; Strand=+; Position=1 -183,385-417
MVMTIFTIMNINVALLRVYNGIINQKASAYNGNNCCRNTATHCAAISTLCSSYVQPAIVFLFMLHIMICKF

SEQ ID NO: 130562 - protein, 31 aa, Heterodera glycines
  Coding regions on vcDNA: vcDNA=SeqID_56985; Strand=-; Position=1 -21,599-673
MGNGRSEQDGLANPPMLLHHAESELGSPLTS

SEQ ID NO: 130563 - protein, 40 aa, Heterodera glycines
  Coding regions on vcDNA: vcDNA=SeqID_56986; Strand=+; Position=1-123
VVACLSPMGQRIPIGGRTQDRHGKWKCIQEANAVKLVQEL

SEQ ID NO: 130564 - protein, 24 aa, Heterodera glycines
  Coding regions on vcDNA: vcDNA=SeqID_56987; Strand=+; Position=1 -6,362-430
MSVFSWAPGDAAEKFFEKILLNSQ

SEQ ID NO: 130565 - protein, 129 aa, Heterodera glycines
  Coding regions on vcDNA: vcDNA=SeqID_56988; Strand=-; Position=1 -159,1930-2037,2085-2205
  Homolog annotation: Hit_ID=CAE71617.1; Match level="QueryCoverage =37%, HitCoverage=1%, E-value=3e-11, Identity=60%"; Hit description =Hypothetical protein CBG18580 [Caenorhabditis briggsae]
SDPNKNADQPKSDGIDRTVVLIDQMNANKVSDQLEIDRPKSDQQKPSHWAKIKGPVLIANSTISHNRGHGIVIESTLDGRAFVNQSRIEANYGDGIFCRQKHDGLSSMQNRLGLEIGIPLSILDKKLAL

SEQ ID NO: 130566 - protein, 130 aa, Heterodera glycines
  Coding regions on vcDNA: vcDNA=SeqID_56989; Strand=+; Position=1-393
MKIKIILFSLLIFKNADNIYAGKINDEKSFDEIFGQRWDEKSEENGEKETDQHGIIGQMDDQNETKNDEINAQLLHETQFDQLFDENLQVKQESATNCDQLEQLPINFGQNCEQFSNAIDKKKREIVEKF

SEQ ID NO: 130567 - protein, 332 aa, Heterodera glycines
  Coding regions on vcDNA: vcDNA=SeqID_56990; Strand=-; Position=1 -943,1166-1221
  Homolog annotation: Hit_ID=AAO52526.1; Match level="QueryCoverage =84%, HitCoverage=24%, E-value=9e-10, Identity=25%"; Hit description =similar to Xenopus laevis (African clawed frog). DNA ligase I (EC 6.5.1.1) (Polydeoxyribonucleotide syntha
MEFKIVLLFLLMLKNLNTIYAGGIKEEKNFDEIFGQRWDEKEEKNEEKETDENGINGQMNDQNGPTNIENFVQRLFVEESNQIFDENLEMKEEESEEMSTNCDQLEQMTENSGQIYDQIPILNDKQKREIVEKFHKIKEKIKQMGKKYSKKERVKIERKIAKKLGINQKKIYKWKREFGMMIHKNSEDEKRQILKQFDQIYGKLKTKLNEKLYKKSTKCQKILAKHLGTHIRSMNKWKKQLKNGKTMKNKKTDDKKKEIIEKYFKLKNEFMQIGKHSRKEWKEFYIKIKQIFGLSYKTIELWAKKFDINQNISKGERKLSLLWKKQRVLSRI

SEQ ID NO: 130568 - protein, 24 aa, Heterodera glycines
  Coding regions on vcDNA: vcDNA=SeqID_56991; Strand=-; Position=1-73
MPNIFKILLIVLLAVVSFRLSAST

SEQ ID NO: 130569 - protein, 88 aa, Heterodera glycines
  Coding regions on vcDNA: vcDNA=SeqID_56992; Strand=-; Position=1 -140,563-690
  Homolog annotation: Hit_ID=NP_741734.1; Match level="QueryCoverage =100%, HitCoverage=5%, E-value=1e-28, Identity=71%"; Hit description =UNCoordinated locomotion UNC-2, voltage-gated Calcium Channel Alpha subunit (unc-2) [Caenorhabditis elega
GKPCAKTNASMALQMLDKSSGVGPQPCGTNMSYAYFVTFVFLSSFLMLNLFVAVIMDNFDYLTRDSSILGPHHLDEFIRVWADFDPAA

SEQ ID NO: 130570 - protein, 167 aa, Heterodera glycines
  misc_feature (154)..(154): Xaa can be any naturally occurring amino acid
  Coding regions on vcDNA: vcDNA=SeqID_56993; Strand=+; Position=1 -87,359-444,499-545,901-1015,1306-1459
  Homolog annotation: Hit_ID=NP_508927.1; Match level="QueryCoverage =100%, HitCoverage=15%, E-value=2e-70, Identity=76%"; Hit description= dihydropyrimidine dehydrogenase (XG89) [Caenorhabditis elegans] gb|AAK39195.1| Hypothetical protein C25F
CGNQYENDFRDINHTTLSERGALREAMRCLKCADAPCQKSCPTQLDVKAFITSIANKNYYGANYYGAARQIFSDNPLGLTCGMVCPTSDLCVGSCNLYATEEGAINIGGLQQFATEVFMKMNIHQIVCREIEQGRNSAHSQPVALFGCGPASIXWATFLARLGYTDI

SEQ ID NO: 130571 - protein, 53 aa, Heterodera glycines
  Coding regions on vcDNA: vcDNA=SeqID_56994; Strand=-; Position=1-223
IKFLKIFNSFLNRPKSLGLTFFQKLIRSAANFAGILKGREITYFKYYLVSSFK

SEQ ID NO: 130572 - protein, 117 aa, Heterodera glycines
  Coding regions on vcDNA: vcDNA=SeqID_56995; Strand=+; Position=1 -108,158-403
  Homolog annotation: Hit_ID=AAP30770.1; Match level="QueryCoverage =95%, HitCoverage=42%, E-value=2e-48, Identity=82%"; Hit description =putative gland protein G17G01 [Heterodera glycines]
MEKIVYLKLMQIVLTLAFIWQLLSLHQFCGTFADPKAFIHDISVGRCKRFTLIGKDSKSGEFGAVFDQDKWHNQLSMISTNGRPIEEQQHQFMDELAAKLPSAERHCIPITVRQQNE

SEQ ID NO: 130573 - protein, 40 aa, Heterodera glycines
  misc_feature (17)..(17): Xaa can be any naturally occurring amino acid
  misc_feature (34)..(34): Xaa can be any naturally occurring amino acid
  misc_feature (37)..(37): Xaa can be any naturally occurring amino acid
  Coding regions on vcDNA: vcDNA=SeqID_56996; Strand=-; Position=1-122
LVCVLASAASLSICSVXHVRSRSVVVTDEQGEAXTSXQKQ

SEQ ID NO: 130574 - protein, 241 aa, Heterodera glycines
  Coding regions on vcDNA: vcDNA=SeqID_56997; Strand=+; Position=1 -218,273-777
MLSPRFDALVDIHFDGKTELTLWRPIAIRNSVAAVPELHVFFDGANKSVPFPLPDAHSPPMPNNIRFKDLRINCIDHSVITFLRANQLIFQKGTNLRLSVPFGPFNIDDVQSIWDDFARQIWPIFAPTIRHFGFPDCHILDTLLRLVSPTIFTDDQINIHSINSGRQFPEAIGDDHFEGPTTATLDRSTTNYDGSIATSAAAGQALSKWLHISRKDGQPKQLRFRNFANPPNMEWQNNFKE

SEQ ID NO: 130575 - protein, 358 aa, Heterodera glycines
  Coding regions on vcDNA: vcDNA=SeqID_56998; Strand=-; Position=1 -491,585-718,934-1384
  Homolog annotation: Hit_ID=NP_502797.1; Match level="QueryCoverage =39%, HitCoverage=40%, E-value=9e-24, Identity=39%"; Hit description =HASI (4P602) [Caenorhabditis elegans] emb|CAB16520.1| Hypothetical protein Y57G11C.19 [Caenorhabditis ele
MKFAKKMLMIPEAEYLALRSAMNSGDYLQNEKASLDAKISQNLQDPGISEYLKAKRHDWLYKERRTVKGILENRPQKVVIENHVPGPNVAPYLGLNNQSKPQETEEPRKIIIPRKRLKERTPDPESNNDTLEELTPEPQTTSTHKTPVPIKTIIHPTLLNGLFRDVLLYLAGKKDETPRGAKFLKDRLLKDPTVKDMVDKSKVMWGRGKKQRTYTIHKPIRKKFPRLKTVPSGFHTDWQCDLCIFDQLKKHNDGYKYLLVCIDVLSRMIFSAPAKSKKSEDMIEAFDRVFEKSKIIPMKIYSDSGLEFQAGKMKKYFEEKFIIKNVMYSPDLTPGVVERGNRTIKERLYRYFTKMDTL

SEQ ID NO: 130576 - protein, 73 aa, Heterodera glycines
  Coding regions on vcDNA: vcDNA=SeqID_56999; Strand=+; Position=1 -114,157-264
MRRDDIFFFKTVIDYKINKEYHFLYFYSRLAFLIIIFHGFDLSQKRREREFGEKREFPKRRELARGETFSIFL

SEQ ID NO: 130577 - protein, 106 aa, Heterodera glycines
  Coding regions on vcDNA: vcDNA=SeqID_57000; Strand=-; Position=1 -207,253-294,354-425
MANDSHSSNALSETFGGSALLNITVDTRGIEEKLNNLQLAIEDSTGNLGVQVSDLNARVQSSQTLSSIATEDMRQDICALQTKEKVAVLDNTMKLASVKIQDVVKK

SEQ ID NO: 130578 - protein, 324 aa, Heterodera glycines
  Coding regions on vcDNA: vcDNA=SeqID_57001; Strand=+; Position=1 -152,377-593,778-1144,1192-1314,1362-1477
MLAGQKQPRDSGCGLTQPPKEKRMVLLMGKSANVQIVGPLSTGCPNVPKDSKKRFYGILFVKEQMQSHGLYPSEALQDPSTRASQIRRKQFTKGVRAPAKGAPGQPLACYHCGGPHLVKNCPKIFCYANYIKQDATTVGVRTRMHNVRHAATFHLMPALIEIGGACMRWTLMGDPLGSTIVAQKRVLKQFFVRVYTFEFKDPKCDHCGGPHESDKCIFGPRNKCAKGGYVHGKTAKCVETTDEHMGNGCKICGEIHDGDCPEAMQKLHCPHCGYDHKSYDCPNQPIPLCGVCGSLAHTTKKCQERCAFCGRKHLTKDCPDSQPG

SEQ ID NO: 130579 - protein, 18 aa, Heterodera glycines
  Coding regions on vcDNA: vcDNA=SeqID_57002; Strand=+; Position=1-56
YREAIPEGFGLPINLGAS

SEQ ID NO: 130580 - protein, 156 aa, Heterodera glycines
  Coding regions on vcDNA: vcDNA=SeqID_57003; Strand=+; Position=1 -119,364-481,702-935
  Homolog annotation: Hit_ID=NP_504671.1; Match level="QueryCoverage =83%, HitCoverage=43%, E-value=1e-10, Identity=30%"; Hit description =FUcosyl Transferase (fut-2) [Caenorhabditis elegans] gb|AAC25844.1| Fucosyl transferase protein 2 [Caenor
GSAFQSFKYYESRRTEIRQIFRIGQDLCKTVDEYKKELFGDDQSHKFCVYTRKGDFNKFTETKKDFTEQGIEFGFKYLMLIANVYLPKVMPRMNDMAFAIKTCDSLLITAQSSTFGWWIAYLMPDNATIFYNSKFGKGRTFFYENELRFFVLITSI

SEQ ID NO: 130581 - protein, 23 aa, Heterodera glycines
  Coding regions on vcDNA: vcDNA=SeqID_57004; Strand=+; Position=1-69
MAPPAAAAGEDEAGHEDKWGRHM

SEQ ID NO: 130582 - protein, 149 aa, Heterodera glycines
  Coding regions on vcDNA: vcDNA=SeqID_57005; Strand=+; Position=1 -234,421-492,550-690
MQLFFLFAVFIAANAFDSAQSVGKTSAEDEVRAVTEGAAPQRQTPTRKSLKMFGHGLRHHTGMDLLMKLGQQQAEEPKSFSSMDILRLFDGLDHQFYHDLEKAQSLFEENAKVVKSLENRVVKLESAMAKAAEHCEPGKVQLVSAHYDT

SEQ ID NO: 130583 - protein, 67 aa, Heterodera glycines
  Coding regions on vcDNA: vcDNA=SeqID_57006; Strand=+; Position=1 -75,115-243
MPFDELAECLPVQQELFNILKISLFKIPSDQICDQETSYICFFIQHRSITNYTFFSGMSGMSDHSFD

SEQ ID NO: 130584 - protein, 66 aa, Heterodera glycines
  Coding regions on vcDNA: vcDNA=SeqID_57007; Strand=-; Position=1-279
NFFLIIKNHYFILFIFILNSGTNFNRIWRHLTASAAIVGQYQQQQKQKHGTNNNSNNNSNNNSIKG

SEQ ID NO: 130585 - protein, 276 aa, Heterodera glycines
  Coding regions on vcDNA: vcDNA=SeqID_57008; Strand=-; Position=1 -172,687-830,915-1021,1153-1254,1615-1920
MSDFFLDNSDMDDNELELKLNNLQMLKNRRANKSLKMPPTDIGTTKLPVNGKGIDKKAQLKRDIETKMGTTDSEEKEKEPKENRVPPNENGNGYRPLSDNAKEKNAQLKREIKEILGIIDSEEKETEPKETKFCEMFSWVQNLFSFKLFFGLAFLLLSFAVFCWCASNKTQTSNTPIHSNSSSVPSIVRDPPFLVVWFPVIHAIVFYIATGSAIFANIFVFVMLVLCFRLLRRISASVQRREAEKMKEFYAKIEAEIDEEELEMAEFDANLRWDET

SEQ ID NO: 130586 - protein, 232 aa, Heterodera glycines
  Coding regions on vcDNA: vcDNA=SeqID_57009; Strand=+; Position=1 -137,201-300,364-531,599-892
MSTPPKADDKKKEVGGILKIGNTCCMGAALQALANVTALSNFLIENENRLPNNKLVMEYVQMIKSILVLRQPAAPFELKEVISSLTNLFADSFQHDSRLRDIPLDKIDIWCFMRLFKDKDEDGQGDRLICISLAQRFTDESHYIMGASDAGQLPMDVPLISINHCLADFIKPEDIEGSRCAQCSNATPCLTVVDNSVDEAVEQEKAENCPTTSSRKNRQAAILSGIILKKKK

SEQ ID NO: 130587 - protein, 95 aa, Heterodera glycines
  Coding regions on vcDNA: vcDNA=SeqID_57010; Strand=+; Position=1 -18,489-758
MPASILDLALEYKIKYDFFFAPVTLILAVLSLAMAFSAGFMVVLNRMFSLHMDVQENKNQVKELRKELDENVKNFNTLYSEFVNLKGEVNLLKGK

SEQ ID NO: 130588 - protein, 147 aa, Heterodera glycines
  Coding regions on vcDNA: vcDNA=SeqID_57011; Strand=-; Position=1-444
MAPGPCFHPAWLYIMDFTKSVIIDLIFVKPHTDDSPGFVFSGWQCAFHNDETYCAEKTAKNMSQKYKSVHCKCEIGEQGKDMANDKPIMTLPPPKPTSPPTPTTTEPPSEPLYVYIIGLLPAGAPGKLDIVKMASKKLGIGKIDIGK

SEQ ID NO: 130589 - protein, 47 aa, Heterodera glycines
  Coding regions on vcDNA: vcDNA=SeqID_57012; Strand=-; Position=1-141
  Homolog annotation: Hit_ID=AAV84250.1; Match level="QueryCoverage =100%, HitCoverage=22%, E-value=5e-13, Identity=65%"; Hit description= ribosomal protein S4 [Culicoides sonorensis]
FVIHRIQSREGQYKLCKVKKQAVGDKQVPYIVTHDARTIRFPDPHVK

SEQ ID NO: 130590 - protein, 120 aa, Heterodera glycines
  Coding regions on vcDNA: vcDNA=SeqID_57013; Strand=+; Position=1 -165,306-410,491-583
  Homolog annotation: Hit_ID=AAT07310.1; Match level="QueryCoverage =63%, HitCoverage=10%, E-value=1e-15, Identity=52%"; Hit description =medea [Anopheles gambiae]
MSRRMDRETRSRRVRLDNHSTQRTTASKTVEVGAEGSTTNQSRIKAEGGEHSDDETVADDPGVDDYRTLCTVRISFFKGFGLSYPKRTIQETPCWVELHLKRALQLLDEVMNTPLIDHLT

SEQ ID NO: 130591 - protein, 398 aa, Heterodera glycines
  misc_feature (165)..(165): Xaa can be any naturally occurring amino acid
  Coding regions on vcDNA: vcDNA=SeqID_57014; Strand=+; Position=1 -1117,1661-1754
  Homolog annotation: Hit_ID=NP_492313.1; Match level="QueryCoverage =93%, HitCoverage=53%, E-value=1e-53, Identity=35%"; Hit description =predicted CDS, RNA-directed DNA polymerase family member (1J119) [Caenorhabditis elegans] pir||T23706 hyp
IPEIWKKSIICPVPKIQNPVNPVDFRPISLLCSVSKIGRKIAGKINFVEKNNLLPNCQHGFRKSVTTQLFEVVDDFSFALENKKSIDVIFFDLAKAFDTVPHNRLISKLKSIGINNSLLKWIQNYLENRKFFVKIGSDFSDEYPCLSGVPQGSILGPLLFLIYIXDLPKFCETENVKIKLFADALKAYHVLSNISFSPLQNFINKFNRYFKLNGLKIASNKCLTLHLGHKNQKINYFIDDFPIPKNPAERDLGIYFTNDLKWAQHIDIISKKALRSAFAILKSIKTRDTKILVNLFNIYCRPILEFGSPIFNPYLKDIEKLENVQKTFLRVIFRRNNYAADLPNYAELLNIYDQKSLESRRLKIDLKLFYNLFNQKMYQILYGSPLPHDPFLNNLGEK

SEQ ID NO: 130592 - protein, 154 aa, Heterodera glycines
  Coding regions on vcDNA: vcDNA=SeqID_57015; Strand=-; Position=1 -216,593-787,1388-1441
MPHLCITVTLFIVITLLTTVALTDTKVYELKKDFTFVNIACLKKKLNDSDANAEIDNETIGEQQKNIATTEQQKILVIQKNLPKQQKQELSQRRVEAVQQQQQQQPTGVVKLNTARLNNNSTVDERKTNSSLKAQIKPVAKHETNKPSNQVKIF

SEQ ID NO: 130593 - protein, 38 aa, Heterodera glycines
  Coding regions on vcDNA: vcDNA=SeqID_57016; Strand=-; Position=1 -45,508-579
MCPVRNMNGKKIMEKPKNLLSDQRSSMVSNNWLLTKFE

SEQ ID NO: 130594 - protein, 46 aa, Heterodera glycines
  Coding regions on vcDNA: vcDNA=SeqID_57017; Strand=-; Position=1 -39,132-233
MNLNKSDCKATREHLLHDNSVHFEGDNEIFMTNHIQFASASAAPVK

SEQ ID NO: 130595 - protein, 28 aa, Heterodera glycines
  Coding regions on vcDNA: vcDNA=SeqID_57018; Strand=-; Position=1 -25,293-354
MGDNQRKYAIFPKCIIIEHTKNGIIMTI

SEQ ID NO: 130596 - protein, 33 aa, Heterodera glycines
  Coding regions on vcDNA: vcDNA=SeqID_57019; Strand=-; Position=1 -32,175-244
MALVIFLINLGHCLFRYGNSPWSASFCWEWKKH

SEQ ID NO: 130597 - protein, 155 aa, Heterodera glycines
  Coding regions on vcDNA: vcDNA=SeqID_57020; Strand=-; Position=1 -49,134-280,672-943
MKLILQLNVLFACFWSATFLSCRKGIIGTVDKPFVDKELTSPSTACPEKKELKFCAKAVCFREGKAEHYVTVYTCSTITDCNSAGREFLAKKECQANGSTEEACEEEKKKNKDNFIRKYGNYRCEQCQFGKDNEDNGNAKFPPYQPKSRKKIVFN

SEQ ID NO: 130598 - protein, 97 aa, Heterodera glycines
  Coding regions on vcDNA: vcDNA=SeqID_57021; Strand=-; Position=1 -104,452-641
MPISNKIYRNPNTDFSSDQQLIAAQKFAQQFVVNFGFTSLKIGAPKNSEFFFNFCFNICHLLFKNTGSYECRENVTQLRNGEFNTRFDQLGDFVFFG

SEQ ID NO: 130599 - protein, 78 aa, Heterodera glycines
  Coding regions on vcDNA: vcDNA=SeqID_57022; Strand=+; Position=1 -126,177-286
  Homolog annotation: Hit_ID=CAH68989.1; Match level="QueryCoverage =93%, HitCoverage=15%, E-value=9e-09, Identity=44%"; Hit description =novel BTB (POZ) domain containing protein [Danio rerio]
FLRPVEITDVEPSAFKVLLNFIYWDDLSERNGDNAIALLYAAKKYKIPELVKACVEFPVSELRDIFSALVRTRILEEE

SEQ ID NO: 130600 - protein, 244 aa, Heterodera glycines
  Coding regions on vcDNA: vcDNA=SeqID_57023; Strand=-; Position=1 -194,504-1044
MDSNKKRNESDGPRIEGKMGENRSSSSSSISSNLIDPINSNFNDPSADDDQPMLIPNEWAINMLMDTSSLMCHSQNLQQNQFIPNYKHFPSLSSSSSSLLSLPSSSSEATMFGEARENKIENEMEILNSNWSIVQQKTADKNNDYEIQKEKRQKLEELQMGNGALDEQQMEAQQAKKLLCIKFYKYNLILNGIEMHFYEHFDFLKMCSGKSGTKWMYNQQLETGGIGTSREIFAGISIPCFFLA

SEQ ID NO: 130601 - protein, 42 aa, Heterodera glycines
  Coding regions on vcDNA: vcDNA=SeqID_57024; Strand=-; Position=1-129
IHVFEVKSQDKEKQQERQRPDTLIAFHRIVITPEICGHRQFE

SEQ ID NO: 130602 - protein, 54 aa, Heterodera glycines
  Coding regions on vcDNA: vcDNA=SeqID_57025; Strand=-; Position=1-257
TFLVLFESIRKMLLACKFSKIFIYAQKNQSKKSSNYWVFEFLLAITFLKLNENF

SEQ ID NO: 130603 - protein, 78 aa, Heterodera glycines
  Coding regions on vcDNA: vcDNA=SeqID_57026; Strand=-; Position=1 -38,334-532
MTPKLEGQSVYFFQVKVEIRDDQQLLFKSCNGQFELFLLTAEGSSHSDGASSANFSKLGPIKRTVCFFLVQFMKLTVN

SEQ ID NO: 130604 - protein, 254 aa, Heterodera glycines
  Coding regions on vcDNA: vcDNA=SeqID_57027; Strand=+; Position=1 -253,691-1201
  Homolog annotation: Hit_ID=CAE69590.1; Match level="QueryCoverage =96%, HitCoverage=12%, E-value=1e-18, Identity=29%"; Hit description =Hypothetical protein CBG15812 [Caenorhabditis briggsae]
MNPISAKILNAHYGLKHPQTKLNITLNEAIALGLYDPVTRQFLNNNEQMDYWDSLAFHSPNTVHLYVKFGAIKVTPMDLDYALKYFLDRYVGEFRLLEYQISLPEALKYGYIEIRKPQPTFALSLTDCIEQTWINRETGLFIARPEKPHGFGEAMRFNGDGPSEILKCDVRECFDSENNTRLTIAEAVRRGILNLATNTFVDTKNGTQLTLPQAHHRGFIHKPLTLTEAVRIHLLDENEQFRDGTNRHTLLQAR

SEQ ID NO: 130605 - protein, 69 aa, Heterodera glycines
  Coding regions on vcDNA: vcDNA=SeqID_57028; Strand=-; Position=1 -29,99-279
MSLFYQENISATGPGPGSGQLSTEVPVLTGTGTSSGFFPVFPAKNSRFFNPKRSRSRLSQNSRSRGTLL

SEQ ID NO: 130606 - protein, 89 aa, Heterodera glycines
  Coding regions on vcDNA: vcDNA=SeqID_57029; Strand=+; Position=1 -146,528-651
MPNMDIKYGYKCQNMDKYGNIDINSEIWKNMENMDIEIHPRSLKPSQNMTRFDPIPVPWTRFKNFGSGPEPGFCGPGNTRTRFLSKFPD

SEQ ID NO: 130607 - protein, 108 aa, Heterodera glycines
  Coding regions on vcDNA: vcDNA=SeqID_57030; Strand=+; Position=1-327
MEDYGIKRGHTIYVSVDEFKIYAKRKHYNIRYPVWVSSTDTVTTLEEKFKAVYEHANGCECLSFTLKEGPRGSKVWASAKMDELGIEEGSYVTLDTRYCEDPPRVGEF

SEQ ID NO: 130608 - protein, 31 aa, Heterodera glycines
  Coding regions on vcDNA: vcDNA=SeqID_57031; Strand=+; Position=1-96
SPIRTFKAKISQNNVIELFIDALPAPCPFDN

SEQ ID NO: 130609 - protein, 520 aa, Heterodera glycines
  Coding regions on vcDNA: vcDNA=SeqID_57032; Strand=+; Position=1-1560
  Homolog annotation: Hit_ID=NP_912739.1; Match level="QueryCoverage =98%, HitCoverage=39%, E-value=4e-54, Identity=31%"; Hit description =unnamed protein product [Oryza sativa (japonica cultivar-group)]
MVNGQPCTSFTDAAIRHGLLEDDKIWDKTLAEAALSRWPDQMRWLFMSILVYGQPSNAVELWNKYKDQMYFPQGITTSAQRQAAELEALADIDWRLHSCFNLSSVHFGLPDPPNSIAKNTNAAINKFFFGDDDLNLPPGQPNPRPQPNTPPPLNSDQQKVFDAVLLAIQSNPRDSTVPRRFFIYGDGGTGKTFLFGQIIRRLRKAPYTYKVLATASTGCAAILLPYGKTAHSTFRLGREVSLDKLPSIPLESFFARRIREAQLIIIDEITMLHNTVIEVIDRVCKEMAIRQHKDLLFGGKTVIFSGDFKQSLPVVPHEGLTAQVTACFQTSPLFGQFTTMKLTINQRLGQGQQAYLQMCRQIGLGETGEHFWIPPQFLVKSKEELIDYVYPNFQQLLGNDKELLNRLILAPHIDTCDEVNEIMMANVPGQVREYLSTDKPLDDRPLDIDEIESEVAALNRRTDSGMPPHSLRLKVGCVVVLLINKSDKEGLINGTRIVLEELGDDRLIGRVINSNAIGGQ

SEQ ID NO: 130610 - protein, 366 aa, Heterodera glycines
  Coding regions on vcDNA: vcDNA=SeqID_57033; Strand=+; Position=1-1102
  Homolog annotation: Hit_ID=NP_490700.1; Match level="QueryCoverage =40%, HitCoverage=19%, E-value=6e-13, Identity=29%"; Hit description =RNase H integrase-like protein family member (1A698) [Caenorhabditis elegans] gb|AAK68496.1| Hypothetical
VERIVNERPITYTSQSEVIQPLRPIDLILPNIGNNRLEINTRSVENSDNDYILENSNTANVVQRYQKAMNMAEKFWQNWKDSYLLGLRERHQGNKHTPGKAPKLGDVVIISEPQTPRNCWKLGKIEEIMSQRTARVRISEKSIIERAIKHLYPLELAENANNSDSGIRKQEHSSVKQIHYNWAKEPPQNKALVKENSPNHYRWAKQPPKTINDITNVTCISEMNKDFDAVSLDCEEMERDLEDENKEEESKDERKGISQIPVEERRPRDGVGEKRVIINAPIAFVGDDEVEPIGRTFQDNGLRALVLVHSLRDIAWWHRLPEVVIINDVCQMVVVRTTEWAEHIRPFLSLLGRWAKPAVWIGSPYM

SEQ ID NO: 130611 - protein, 123 aa, Heterodera glycines
  Coding regions on vcDNA: vcDNA=SeqID_57034; Strand=-; Position=1-434
NKEEESKDERKGISQIPVEERRPRDGVGEKRVIINAPIAFVGDDEVEPIGRTFQDNGLRALVLVHSLRDIAWWHRLPEVVIINDVCQMVVVRTTEWAEHIRPFLSLLGRWAKPAVWIGSPYML

SEQ ID NO: 130612 - protein, 385 aa, Heterodera glycines
  Coding regions on vcDNA: vcDNA=SeqID_57035; Strand=-; Position=1 -23,73-309,353-508,551-679,723-1103
  Homolog annotation: Hit_ID=BAC32318.1; Match level="QueryCoverage =90%, HitCoverage=83%, E-value=7e-36, Identity=30%"; Hit description =unnamed protein product [Mus musculus]
FNRNGLKYICELVQEDVERKTGKSYICELVQEDVERKTGKSGALPTELQVLATLGYLASSSFQLWCGDILGIHQASVSRAIFRVTRALCRKAGDFIYFDDYENARLCSIPAFNAVAGMPNVIGLIDCENARLCSIPAFNAVAGMPNVIGLIDCTHIPILMPSEDGRDYYNRKGWPSINALAIVDHNGRFLNINCKWPLAIVDHNGRFLNINCKWPGSTHDSFILRHSSVWQDFESRRLRGKYFLGDSGYPCKKWLLTPFAKYFLGDSGYPCKKWLLTPFANPINNSQQQYNNAHSKTRVIIEQTFGRWKRRFHSLQTIRIKLENIGMFIIAAAILHNIALMKGIPEFDQEEFVDDQPENDDRVVIGEDIISDGFAVRANIAQNYF

SEQ ID NO: 130613 - protein, 170 aa, Heterodera glycines
  Coding regions on vcDNA: vcDNA=SeqID_57036; Strand=+; Position=1 -114,166-200,255-359,764-809,1273-1348,1391-1525
  Homolog annotation: Hit_ID=NP_494753.2; Match level="QueryCoverage =59%, HitCoverage=22%, E-value=2e-13, Identity=39%"; Hit description =ankyrin (2E574) [Caenorhabditis elegans] gb|AAB00714.3| Hypothetical protein C01F1.6 [Caenorhabditis eleg
IQQLKWNFSLHRAVFLNQMEEVEKNLADVKKKDVHGNTALHIACMLGNEEIARILLEKGAKVRARNNAEWNALDEAIAYGDVELVQTVHSIFQAQTKIAMQRGDMTLLLDIHKDEKAVLLDNIEKKYCVFRTEEVLPQQLLTEKKITKYHLNANQLDFKRAKTLLNHEKT

SEQ ID NO: 130614 - protein, 480 aa, Heterodera glycines
  Coding regions on vcDNA: vcDNA=SeqID_57037; Strand=+; Position=1 -68,114-223,294-420,469-690,755-927,983-1270,1319-1450,1493-1816
  Homolog annotation: Hit_ID=NP_508405.2; Match level="QueryCoverage =84%, HitCoverage=55%, E-value=3e-64, Identity=38%"; Hit description =erwinia chrysanthemi IndA protein (69.6 kD) (XC816) [Caenorhabditis elegans] gb|AAA82388.3| Hypothetical
WIAHRAGIRIFATGGIGGVHRGDSQDVSADLTELGRTPLGVVCAGVKSILDIERTLEYLETQSVNVVVLDKSAVFPGFFGPPTAIKGPYHTDSLDKVADILLLSFQMGLPNGTLIACPLTDDAVDKRLVDERNVIAEATKMALKEAEEAGIRGKEVTPFVLERIRQRAGKAATELNIALLENNARIAARLALLCSSKTLPAGIEKQPLITAGQQNSSSQCENGGTVKKRRPKIVCAGASVVDVSVFLDQSSVPPLGPAAVGTYLPARIIQTSGGVARNHADALSRLGCDVTLISALGTTTERNSGGGEESRNDTVDLYGRFLMEKCDHIDWSHVRHCPGTATASSVGICSKGTIISQAFIAVEPIMERIDEKYIRSMEAHIANADFLLVDANMNSGALRIAVELARLNGVKGTQTESQFRGGVSTTKRKVSLIAYSLVRTDKLDQGAEAVRSAWQKCSAQSECHIAEPERTGGSGATVER

SEQ ID NO: 130615 - protein, 38 aa, Heterodera glycines
  Coding regions on vcDNA: vcDNA=SeqID_57038; Strand=+; Position=1 -52,122-186
MEKACKIWRDYIDFSALDFLFISLFDSESIREPYLTFN

SEQ ID NO: 130616 - protein, 30 aa, Heterodera glycines
  Coding regions on vcDNA: vcDNA=SeqID_57039; Strand=+; Position=1 -52,124-164
MEKACKIWRDYIDFSALDFLFISLFDSESI

SEQ ID NO: 130617 - protein, 540 aa, Heterodera glycines
  Coding regions on vcDNA: vcDNA=SeqID_57040; Strand=-; Position=1 -82,125-528,659-1051,1103-1846
  Homolog annotation: Hit_ID=AAG14291.1; Match level="QueryCoverage =92%, HitCoverage=62%, E-value=6e-13, Identity=21%"; Hit description =glutamic acid-rich protein [Plasmodium falciparum]
MKEQRNLLLRLDVEFEKAKLQKATEARGASFPFPINSSSDFLDWEYDDSWDRERYKDISPFVSPPQSPPKIVEETEDEMTDYGETDQKEGQRGFVEEEYETAPAKIGNIRLTLPKYAALENGTTNGQSDAQHSPNDGQSEHNDEELEQSQRMNTESREEDEKDVICSPSNELKVTQQSPDELVSVSVHSFAPSATPQHFPFETTTTLPSAEFSSDPLVPSLTSEILLNEFLRQNVTMSSSSNCDNKPLENDGNNSVVNAMTKSLLCTHENGAEIKLNDQQESSKEEFRERVMKEKEQREVNKEPVKLKIKLDKMNINKVEERNAHENGNEEKKDGREKKEREEMMRKSEKKRRKAEKKEKKKQAKLEERMKKEREELNKCEPQPSPSSVHLQNDDRMPTQSLKISLSRLACWTGTNNVTPEYSSNLGGHGFHSNKESVDLTNGHSTPKNCQIKPENGGGDPLKLRLILNRGGNSSVEVKSTEHRKKSRKRKSHEEKPKPPEEQEEAPPKVPRLKIRFGTGNNEEKIETNAQPKTEPSQCE

SEQ ID NO: 130618 - protein, 51 aa, Heterodera glycines
  Coding regions on vcDNA: vcDNA=SeqID_57041; Strand=-; Position=1-155
MIARIAEKIRDQFPNVDRLIAKRKPSLSKRLTESKNLEMYHRCNFNQPNLK

SEQ ID NO: 130619 - protein, 45 aa, Heterodera glycines
  Coding regions on vcDNA: vcDNA=SeqID_57042; Strand=+; Position=1-138
IREKQCGDKNVFPLNKWLLLPRNHKEHLPFYLLIYNYERKERIMI

SEQ ID NO: 130620 - protein, 119 aa, Heterodera glycines
  Coding regions on vcDNA: vcDNA=SeqID_57043; Strand=-; Position=1 -96,282-344,408-547,670-730
MYGIKFSHAAPYCEILANVVSNTKTPFMISIELPDGQQTEKLVFEEPGAKNVILKGNNCASKHWQLNTFRWHFNLIQFFVTKFCLYTEEMKMASGNWRRSRKPTDLELKYPPSFSLDQN

SEQ ID NO: 130621 - protein, 119 aa, Heterodera glycines
  Coding regions on vcDNA: vcDNA=SeqID_57044; Strand=-; Position=1 -155,476-677,1330-1332
MPNTGMENGLKKGWQMLEKYGKFRRDAMCDRIDQIRATWQDDGTQTAEEQKWLLKFDEEIEKLHLHRLHQLISWEVPNSKPKLAELFHMKRLEGENVFAYRLRMIGLASLEEADQMRRQ

SEQ ID NO: 130622 - protein, 87 aa, Heterodera glycines; identical to SEQ ID NO: 129152
  Coding regions on vcDNA: vcDNA=SeqID_57045; Strand=-; Position=1-1136

SEQ ID NO: 130623 - protein, 193 aa, Heterodera glycines
  Coding regions on vcDNA: vcDNA=SeqID_57046; Strand=+; Position=1 -139,492-600,1028-1225,1624-1759
  Homolog annotation: Hit_ID=NP_491260.1; Match level="QueryCoverage =91%, HitCoverage=37%, E-value=3e-33, Identity=40%"; Hit description =guanylate kinase and SH3 domain containing protein (1E470) [Caenorhabditis elegans] pir||T29782 hypotheti
MAFPFSVTSRAPKAGEQQGREYKFERKEDILQRIRDRQMIEWGEYNGALYGTTAESVREVVRSGRVCVLDCSARALETLYNSEFMPFVVLVAAPPFEELVQLSRLHGKPREEDELRRICDQSDQLFHSDYAKCFDLVLVNRNRDISLRSICCPSFAINRIHQRLLDALEALKTEPQWVPLEWLQGSANVKSKS

SEQ ID NO: 130624 - protein, 38 aa, Heterodera glycines
  Coding regions on vcDNA: vcDNA=SeqID_57047; Strand=+; Position=1-438
KRIERTRFDEVLVSQKKSKHLKIYKKFKNENSCEIFWK

SEQ ID NO: 130625 - protein, 89 aa, Heterodera glycines
  misc_feature (3)..(3): Xaa can be any naturally occurring amino acid
  misc_feature (86)..(86): Xaa can be any naturally occurring amino acid
  Coding regions on vcDNA: vcDNA=SeqID_57048; Strand=-; Position=1 -126,421-543,1354-1372
  Homolog annotation: Hit_ID=AAG40111.1; Match level="QueryCoverage =79%, HitCoverage=3%, E-value=2e-28, Identity=80%"; Hit description =chitin synthase [Meloidogyne artiellia]
KIXVKKTNFFNKFLSYILPGKNRLTVHLKNKWLIRQRKRWSQVMYLYYLLGYRLAMRVHENRRRELLSENTFILTLDGDVDFQPFXFRL

SEQ ID NO: 130626 - protein, 103 aa, Heterodera glycines
  Coding regions on vcDNA: vcDNA=SeqID_57049; Strand=-; Position=1 -65,530-776
  Homolog annotation: Hit_ID=AAG40111.1; Match level="QueryCoverage =38%, HitCoverage=2%, E-value=7e-12, Identity=80%"; Hit description =chitin synthase [Meloidogyne artiellia]
MALMTGRAVCAPMSPPPSLTIWEQPSAADAICKIYVCATMWHESALEMTCMLKSILRLDEVNEYYLLMGIISVGTLYIPSMNMHMHCLSKDTSYRNTKLGPMI

SEQ ID NO: 130627 - protein, 91 aa, Heterodera glycines
  Coding regions on vcDNA: vcDNA=SeqID_57050; Strand=-; Position=1 -114,246-365,915-956
  Homolog annotation: Hit_ID=AAG40111.1; Match level="QueryCoverage =64%, HitCoverage=3%, E-value=1e-14, Identity=66%"; Hit description =chitin synthase [Meloidogyne artiellia]
MAKQRHIGPHKKAYRRVEKRAPKMQEQAGEEEIISAYNIYDDRVELNQFTTAYDALWLALFQVACALLCHFSAKFACKSYTKRVLYERLAK

SEQ ID NO: 130628 - protein, 236 aa, Heterodera glycines
  Coding regions on vcDNA: vcDNA=SeqID_57051; Strand=-; Position=1 -205,262-528,584-819
MAEKLKRAKVRLEFSEKMFYERALTEWRDKILKDSGNKNHAFVLRKALCNLKLFPLDVNGFSDLRKIRGIGVDIATRLSSAWKFTCATHFCTESPTIGQIKSLKSGEAFVLVEQSSTENGGRVPLVAGAKQRKAIPSQIGQQQKSQTNGKQKGHHFETAPLVRSNSQECVVMHKSESLEVMDFDHLLNVSVSQPAISSFAFEVSTQLQPIQTNLIPFSMFRIVGQKEQCLLRPLQA

SEQ ID NO: 130629 - protein, 328 aa, Heterodera glycines
  Coding regions on vcDNA: vcDNA=SeqID_57052; Strand=-; Position=1 -127,180-542,592-682,746-906,990-1079,1140-1224,1312-1378
ELVGDTHQQHMVRTVTAVTSLHILLFAGPVRMDLKCVKYFELVDPNGSLRQQRKLFRDKILRKHRKEQRNLERELRRRHRKQLEQRNLMEQNLEEQNKKKQLGKRQRGEESEKCRQTDGRAQNATDTKSDWNDSGHSLEKREQWQTSTDSRQRKKREENEEIGESSATSSSDDSFDSFPAANSAMATPSSLSSSALSSLEPELAEQLPEYMRSFTKSEPEEPYELLELDNWFGFRGSFSDLQVFTPNNDGEVALSSHGLFDARSLPFGQLRTIARGQASSRLFERNSYSGASITKVCQSQRFVKTKSPSMMASSEMMTAFKRECHCLS

SEQ ID NO: 130630 - protein, 78 aa, Heterodera glycines
  Coding regions on vcDNA: vcDNA=SeqID_57053; Strand=+; Position=1 -22,77-291
MFFLNIFAQVESYRGIQRLFFMLYLRKVITDFSQKFCKFGKVFTRSDLQICMKNALFFSGGTYVYLPKIFFCTIHRFS

SEQ ID NO: 130631 - protein, 128 aa, Heterodera glycines
  Coding regions on vcDNA: vcDNA=SeqID_57054; Strand=+; Position=1 -279,591-697
  Homolog annotation: Hit_ID=NP_509834.1; Match level="QueryCoverage =98%, HitCoverage=9%, E-value=6e-47, Identity=69%"; Hit description =peroxidasin (XL592) [Caenorhabditis elegans] emb|CAA91999.1| Hypothetical protein K09C8.5 [Caenorhabditis
DGYNFLIGPYTGYRPDTNPSVSNAFATAAFRFGHTLISPQLERLDKALRPTPEGPLPLHEAFFAPERLLAEGGVDPLLRGLFGTPLKMPMSDQLLNKELTEKLFHRAHNVSLDLAALNIQRGRDHGIP

SEQ ID NO: 130632 - protein, 177 aa, Heterodera glycines
  Coding regions on vcDNA: vcDNA=SeqID_57055; Strand=+; Position=1 -131,328-460,709-975
  Homolog annotation: Hit_ID=CAA62967.1; Match level="QueryCoverage =84%, HitCoverage=14%, E-value=1e-42, Identity=48%"; Hit description =valyl-tRNA synthetase [Takifugu rubripes] sp|P49696|SYV_FUGRU Valyl -tRNA synthetase (Valine--tRNA ligase)
MVRDAHGRKMSKSLGNVIDPLDVIHGITLEQLNKKLEDGNLDPNQGRDINLDVLRVQGYRFFCNKLWQGTRFVLSRLGPDFIPSDTFEPSTLALNLADRWLLSRLSHCVSECDVGFRTYNFRQLTSAIHHFWIHEFCDIYLESVKSIIVVNNANKKGADAIAEERSKNGTDEVTTQK

SEQ ID NO: 130633 - protein, 66 aa, Heterodera glycines
  Coding regions on vcDNA: vcDNA=SeqID_57056; Strand=+; Position=1 -121,284-363
MIHVLIHGHVRLIYSHYSVSIYGLNHVSIHGHDLRVNLRSFIIHVSIYGLKHVSIHGHDLLVNSRS

SEQ ID NO: 130634 - protein, 39 aa, Heterodera glycines
  Coding regions on vcDNA: vcDNA=SeqID_57057; Strand=-; Position=1 -72,172-219
MFKNLIIYAFRNHNSSKSTKIQEKMKIEHKQRLHPPEEL

SEQ ID NO: 130635 - protein, 26 aa, Heterodera glycines
  Coding regions on vcDNA: vcDNA=SeqID_57058; Strand=+; Position=1 -71,135-146
GTTVNHITLLGGKLLWFSFIDPDAVF

SEQ ID NO: 130636 - protein, 123 aa, Heterodera glycines
  Coding regions on vcDNA: vcDNA=SeqID_57059; Strand=+; Position=1 -285,623-709
MKVKYTLGTVIDEHHPNMVTQNSANQRANHKAADDHEPLDKQIQLKFKITMDSRNGKIGVEFRLNGQHITKDINGTVLTCCPAELVPFEDIQYITAKSFDMELSPDTDVQIYCIPPEKCILKT

SEQ ID NO: 130637 - protein, 591 aa, Heterodera glycines
  Coding regions on vcDNA: vcDNA=SeqID_57060; Strand=+; Position=1 -199,281-1183,1229-1386,1443-1955
  Homolog annotation: Hit_ID=NP_507780.1; Match level="QueryCoverage =83%, HitCoverage=34%, E-value=2e-43, Identity=26%"; Hit description =predicted CDS, DNA polymerase type B, organellar and viral family member (5T899) [Caenorhabditis elegans]
MRYYSLYKRGIITEDRWRWIKDRQTTVLQQKVLLLLREAGIPTTEPEYDAEIYIHQVQGLWSTKYPGEYKIFIFNDYQTRPITKSDVTDYQFPILLYHHDKHFDGIKTISKFWNKRYYCLSCESAFSNKSQHSMNCTSLCHGCREVGVDYPCESQQGYFKKCKHCNNNFYNNDCYERHLHKDLCSKFQRCEDCGVIYNIKYHGTTGHQCGERFCRLCKQFHVKEEDGENPCKSCFIQPLKLHKIKPYRIIAYDFEATQDKKVGNRFEHEVNFAAATIICTDCINNGEWKNSLLGKKCQICGPNRTITFSPFDYTNTKVDQKIITQNPLRDFVGWLLFDHNKKFSTVAFAHFGGRYDMTMIIKEVLAQGIHNPEIIKQGNRLYELKIKDNEHCPLTTLHDSYNLMPIKLSALIKSFGLKIQDKQHFPHMFNKEANYDNVLPHLPPRDDYCPKQMKKPDLQNFNNWYNNNYEQKFDLKEKLPEYCCNDVHILTHALIELRREFKQLTQRNGKHGGIDILWQAMTIASACVKNYALNHLKPNSLAIVPEKGYTPQQNQSALAIKYLDWYSHTNNVNIQTAHSRYGEYVFKREGQ

SEQ ID NO: 130638 - protein, 801 aa, Heterodera glycines
  misc_feature (244)..(244): Xaa can be any naturally occurring amino acid
  Coding regions on vcDNA: vcDNA=SeqID_57061; Strand=+; Position=1 -66,123-1112,1140-1265,1293-2363
  Homolog annotation: Hit_ID=NP_001004509.1; Match level="QueryCoverage= 100%, HitCoverage=51%, E-value=1e-88, Identity=28%"; Hit description =si:busm1-180o5.3 [Danio rerio] emb|CAD60788.1| novel protein similar to DNA polymerases [Danio rerio]
DSYNLMPIKLSGLIKSFGLKIQDKQHFPHMFNKEANYDDKQHFPHMFNKEANYDNVLPHLPPRDDYCPKQMKKPDLQNFNNWYNNNYEQKFDLKEKLPEYCCNDVKILTHALVELRREFKQLTQRNGNTEESTFCGKQTIASACVKNYALNHLKPNSLAIVPEKGYTPQQQSALAIKYLDWYSHINNVNIQTAHSRYGEYVFKREGQVYQVDGYIKDGRRDKIIEVNGCLWHGCEECFDEMDEXTRMPNGKTLGQLREREVRKHDILSRYVDLEVWEHEINEQLKKDKQMREYFENWKDRSPIKIRDAFHGGRTGPMKLLHTAKSGQKISYKDFTSLYPWTNFSTDYPLGHPKIISFPVNEQTPYKGLLKVLLLPPNPYKGLLKVLLLPPNNNINVTVMPIKFDERLLFPLCEKCAKHIDDNYSCPHFNPNDRAFVSTCTHLCEKCAKHIDDNYSCPHFNPNDRAFVSTCTHLELNAALEAGYTARKVFHVLQYDQWSNNVFKSYVSEMMALKIHATGFPSWCESEEQKSEYIEECWGKFAIKLDKEKMKAEPGKRYIAKLCLNSLWGRFSMRNLLSKAIIDNDESLIHQYTEDKKIELIDLEMMDDDVFMLTYKPKEEFVDENKYSNVVISLFTTSMARLYLYEALKKVADKILYFDTDSIIYVHPEDNDPLPTGKGHLGELTDENPDHDILEFISAGCKNYGLKLQRKDNGEICFDLKIRGFTLDEQTVQKIHYDTVKEQILRYGSDDPADPIIVTYPHFIRPNLIQGKVFTHSLTKHYQPIFTKGIINDSFQVLEFGY

SEQ ID NO: 130639 - protein, 189 aa, Heterodera glycines
  Coding regions on vcDNA: vcDNA=SeqID_57062; Strand=-; Position=1 -137,420-528,1014-1082,1703-1878,2157-2232
  Homolog annotation: Hit_ID=NP_493614.1; Match level="QueryCoverage =85%, HitCoverage=12%, E-value=4e-44, Identity=46%"; Hit description =alpha-2-macroglobulin, N-terminal and alpha-2-macroglobulin family member (1P593) [Caenorhabditis elegans
MVHWTTKVSNGAKDGTGGAAKNGGGAARDTNQYFFQPQPADVEMSAYALLTYMLLDNKEHALPIVRWLTAQRNSLGGFSSTQNGQQDTHLFTINAQNALVLQSYELPNLDAPVELEAVGTSMAFVQVQYSYHRQTLREDVPFYCAKEVREVRNGNRLQLELCCNYTRAGARSNMAVAEVDALSGYRFDE

SEQ ID NO: 130640 - protein, 140 aa, Heterodera glycines
  Coding regions on vcDNA: vcDNA=SeqID_57063; Strand=-; Position=1 -121,2085-2181,2498-2632,2920-2990
  Homolog annotation: Hit_ID=CAE72569.1; Match level="QueryCoverage =95%, HitCoverage=9%, E-value=9e-41, Identity=57%"; Hit description =Hypothetical protein CBG19756 [Caenorhabditis briggsae]
SKSNAPLMVSRFTAPVPQLLPAPRQRKYFPEAWIWADLLDDSGEVVYDAKAPDTITSWVASAFAINDKAGLGLAPSTVKLKVFRPFFVRLELPYAVKRGEKMALQVLVFNYLENEQEVTVTLKHQGFDFLQKDGSSIKKG

SEQ ID NO: 130641 - protein, 30 aa, Heterodera glycines
  Coding regions on vcDNA: vcDNA=SeqID_57064; Strand=+; Position=1-114
MYMHMRTDFAGGEERKLKEQPGMPGPPMPL

SEQ ID NO: 130642 - protein, 120 aa, Heterodera glycines
  Coding regions on vcDNA: vcDNA=SeqID_57065; Strand=+; Position=1 -109,534-787
MHFDNDGDVIEDDYGENIDEYDSQQNLGTQSNPQLIGADPEAKTSEGWTPLHSAANWGNFEVIATLLSWGVDVNRRTEISLSFLLYFISNSIIFVDYFKAKLCLSIWQLIRWRMTRTSST

SEQ ID NO: 130643 - protein, 121 aa, Heterodera glycines
  misc_feature (2)..(2): Xaa can be any naturally occurring amino acid
  Coding regions on vcDNA: vcDNA=SeqID_57066; Strand=+; Position=1 -26,299-556,997-1081
  Homolog annotation: Hit_ID=XP_426971.1; Match level="QueryCoverage =97%, HitCoverage=13%, E-value=1e-36, Identity=61%"; Hit description =PREDICTED: similar to UPF0202 protein KIAA1709, partial [Gallus gallus]
MXVSNDTIMLHDEQISPRANLPPLLVRLAERHADQLDYVGVSFGLTLALLKFWKRLGFVPVYLRQNTNDLTGEHSCVMVPKLQGEEEVNMAKWLSAFFVEFRRRFVSLLGTSFSAFSPHLH

SEQ ID NO: 130644 - protein, 52 aa, Heterodera glycines
  Coding regions on vcDNA: vcDNA=SeqID_57067; Strand=-; Position=1 -72,139-193,298-329
MIVVDIVMIVVIVVMSVVIVVMSVVLIKFICIVISFVIVNEICVIMSFVCVL

SEQ ID NO: 130645 - protein, 141 aa, Heterodera glycines
  Coding regions on vcDNA: vcDNA=SeqID_57068; Strand=-; Position=1 -96,495-644,960-1048,1166-1256
MANAMYAARARAAKAEKRQAQLRKAARARAGNARKREVVTIAWQTAEGWKERTTDHTMNDWPSVFIDVFVMDIHSFVVSYNHGVRARFWVRFRAFAKFKKLEFVMQLPIIPCLKNAIWTLKMPPPPPSPGARNFSPPPPRL

SEQ ID NO: 130646 - protein, 17 aa, Heterodera glycines
  Coding regions on vcDNA: vcDNA=SeqID_57069; Strand=+; Position=1-53
MVAAHRGTRDSAQSAPA

SEQ ID NO: 130647 - protein, 397 aa, Heterodera glycines
  Coding regions on vcDNA: vcDNA=SeqID_57070; Strand=-; Position=1-1191
  Homolog annotation: Hit_ID=AAC46935.1; Match level="QueryCoverage =67%, HitCoverage=71%, E-value=1e-09, Identity=24%"; Hit description =polyubiquitin
MNHFGLGISAGLTMLMRLMMRSSVADDEFEISSVIEISDFVWSCGPTVMVKGEDTVADLKKKFAEEIKIDPNRQELRNKIEPKRQMLRLGGRFGSTLEDSKTLKVYGIEKDQVISITFDEYEIFVHFNEKNYPIWVRKSDYVEDLEKKAMQMLKRELDINIDDIKLKSRQSPGSYDMFFEQWYTMEQYEIKEGAVIYVCYEYHYKTLVEFDIFIEYNQKKYPVRVKRADTVRDLKMKIGNIQEIGILPNQQQMLRLGGRFGPTLEDSKTLKDYGIEKDQVIIITFDEYEIFVHFNEKNYPIWVRKSDYVEDLEKKAMQMLKRELDINIDDIKLKSRQSPGSYDMFFEQWYTMEQYEIKEGAVIYVCYEYHYKTLVEFDIFIEYNQKKYPVRVKRADT

SEQ ID NO: 130648 - protein, 164 aa, Heterodera glycines
  Coding regions on vcDNA: vcDNA=SeqID_57071; Strand=-; Position=1 -193,393-451,793-1035
  Homolog annotation: Hit_ID=XP_321039.1; Match level="QueryCoverage =48%, HitCoverage=16%, E-value=4e-10, Identity=42%"; Hit description =ENSANGP00000011321 [Anopheles gambiae]
MGFKFIVGTTTIFLLIQSVGLITADRQKQQKQQQQQQQQKQQQNRIVLSPNRVPHWKVENNINRGPFYGQPEQVHLSYASDPSKLWVTWLTFDDTLDSLVVWGDQYSQLTRKTPATVDYFVDGGTEKTKRYTHRALIEGLKPGQRYCQWKSLILFLAFLINIKI

SEQ ID NO: 130649 - protein, 78 aa, Heterodera glycines
  Coding regions on vcDNA: vcDNA=SeqID_57072; Strand=+; Position=1 -68,695-801,1685-1746
MTRTVDHASTVIIFCRAFFSANMKIFGSLPPISFFFDLHLNGHTCFFQYLFLEKWKQKTFFEAFNASIIKHRKDVPYL

SEQ ID NO: 130650 - protein, 132 aa, Heterodera glycines
  Coding regions on vcDNA: vcDNA=SeqID_57073; Strand=+; Position=1 -276,382-487,641-657
MGHNFTMVELGWLCTALVSLMRNSSPPLVHTDQNAQQMLKLISDTKCSNSNSTTTTINGLSTVPTTVGTTATVQLNAALLEKLIRPGAADQQSQQNKIFADNQRLLDWLMTFVYMLISMFGIIGNIFEITTY

SEQ ID NO: 130651 - protein, 47 aa, Heterodera glycines
  Coding regions on vcDNA: vcDNA=SeqID_57074; Strand=-; Position=1-144
ERAGCRRRLLIINVLIEDHGEYKCTAKDDETMAQLIVHPKFVKKAER

SEQ ID NO: 130652 - protein, 77 aa, Heterodera glycines
  Coding regions on vcDNA: vcDNA=SeqID_57075; Strand=+; Position=1 -107,252-378
MNLFVNGKKTTEHVYGRQEWENGTVYTYASLAFRPGKIHHKKVISCEAQHPETNTNLRDSITLDVFCEFGLIVMMIG

SEQ ID NO: 130653 - protein, 24 aa, Heterodera glycines
  Coding regions on vcDNA: vcDNA=SeqID_57076; Strand=-; Position=1-80
RTLSTAVRQRSSKIYSMPQILWAG

SEQ ID NO: 130654 - protein, 136 aa, Heterodera glycines
  misc_feature (3)..(3): Xaa can be any naturally occurring amino acid
  Coding regions on vcDNA: vcDNA=SeqID_57077; Strand=+; Position=1-409
  Homolog annotation: Hit_ID=AAG23159.1; Match level="QueryCoverage =96%, HitCoverage=57%, E-value=4e-50, Identity=68%"; Hit description =polyprotein [Heterodera glycines]
DEXWKPCQNAAKAPVKANLQTWPKTHPWQRVHIDFAGPFFGKDYLIIIDAYSKYSEVFEMATKSTAATNNKLRYLFSRHGLPEILVSDNGTQFTSNEFSKFISNNGISHLFSAPYNPMSNGQAERFVDTFKRSFRR

SEQ ID NO: 130655 - protein, 95 aa, Heterodera glycines
  Coding regions on vcDNA: vcDNA=SeqID_57078; Strand=-; Position=1 -618,949-1296
LFEYPKRTLEKIDFFVFGAVPPSRCAQIYGETESFGNSFPIACTLILRWIFAPHNCLSTPNGHLKKSIFLFSGQSPRTDAPRFMGRPNPSGVASL

SEQ ID NO: 130656 - protein, 307 aa, Heterodera glycines
  Coding regions on vcDNA: vcDNA=SeqID_57079; Strand=-; Position=1-924
MGAKWTVREFRKAVGVQVKCMRAAESALAAMKGPERRHEQRSEPERGGRNARTGQGFQRAFMIRDQPPEKRTSNEAHTRTEVAMPPTRPANPNRVPLGSYSRPMGAHSQAQEGQGGQPRQGCSLCGQTGHQPSRCCKYGSAQAKRRRLIEQRRCLKCLGSDHTAQQCTRKTACRTCEQMDHHWLICWKGERRNEPPSHSRTEDAQQNRTMIIREIEAKHVRTPPPTESSKDGMGAKGEDPPLLDGEQRAFTTVGQQLPAYLMVCPVVVASEDGMTECNTNLLLDPASHGDYGDAALIKQLGTEKGRE

SEQ ID NO: 130657 - protein, 246 aa, Heterodera glycines
  Coding regions on vcDNA: vcDNA=SeqID_57080; Strand=+; Position=1 -288,556-801,894-984,1118-1233
MAGLRMTRARLRQLERIARRRIPTARLRPIVGPKTFLDINYGDDEEEESTSAKLPGQQDDEGDMDYTPANDPTAPTERRRRRRRRKTKTEGEKGQTQTNSDRSASECDDAEDASSSMRSSDTDFVCSDMDEQQQPEQGTSQSATVETEQVGDEQHQKQQRCTHDEEEEEGQSVEYLTKVDNPIYPIFIKSLATDTEIDPEVRQQLYDDEDNDPEYVFPDFDDLCDEQEDEYEFRRDRATEIPRNFL

SEQ ID NO: 130658 - protein, 731 aa, Heterodera glycines
  Coding regions on vcDNA: vcDNA=SeqID_57081; Strand=+; Position=1 -87,163-345,747-881,1019-1180,1268-2131,2210-2695,2838-2901,3314-3528
HVQLLCQAIVGTSQYANLVEPHNKSMLMLSELDGLSRERGAKSAFNVPTLEAAIYSAHDIKACREVNLALASTAAAETNGDELQPKNTVELLLAIGLYQLGGVQSHRNGKMRNRYQHIQQYFLPTKRVDQIRNHIKNVHSSPSPTIYHQLIMQAEKGHFPVTYRPDLGEKAQRKTPIEWPTNVQPYWLKWLSNLLGKCQTQMIMVDDGDNTDNDAGQQLHGVFEALNGTDQPSSPPAPPPAAFASADHLHQPASSDTSNSEAQTAQNVKVENANRQRHVKAGKKPRILATARKRCVPTATGAAPSTTSTMEQRKDDQQQLDTTTTVPYNNNEAATELLGDVFIPGEQQQPDFVDVEEEDHVVGVETRWRKRIRTASSTTTEDGASRLSGVAAATDVAEKGGTTPPTQTVTAAATMVNNNASSRRNCSSAANGAGGAEAATLSTMAQMTAKSAGVENINGTNCAESGVMPAATATSQLQKKSRRHERAERGMAALGDAHSLEQTERALAAAIYEDFGKRMFMHQANLLTFFLPLPPRKSTDVLPSGNIRKMPLSPFQDKLRAVQRVLATAPPPRYDPSLSAACSTAQSFASLWQLMGLTHPQLFHLFAAIAPEAQLPHALRVDPHWQACKRALRMLKTIHTYLAASRTLAQMKHMLKFLKETSRIGSTNLWTWTSSTSSNNNTRANAQQFPLMELATGTSSNSSSNMSDFPTDATRPNAVAFASDTAASRRN

SEQ ID NO: 130659 - protein, 39 aa, Heterodera glycines
  Coding regions on vcDNA: vcDNA=SeqID_57082; Strand=+; Position=1 -25,73-150,315-331
MTCQTGIRADEKLLDFFEQCKQCKVRFGKIVINNVCPTV

SEQ ID NO: 130660 - protein, 242 aa, Heterodera glycines
  Coding regions on vcDNA: vcDNA=SeqID_57083; Strand=-; Position=1-729
MEYTDLAVCDKRLMEGNGQGKSETNKNINQNIASTSQSANEKEIKRIAEINHCREMIRKTMAALAIKSDNEKIHELRETEKSDEKNPTELINNIDCPSSSGIGLRCTDALAWVMIKPESDEYQIKQKKDKNRDDQLRMIIFQRMGKCALAVRLDKEDKWPYFALVYPNEKLNQYPCLGSITSVPKVEKFEYFSSSNSELYSQNPKEESGTIYNIIKIERNEIKAIDVDFNVYDDESYDSINQ

SEQ ID NO: 130661 - protein, 100 aa, Heterodera glycines
  Coding regions on vcDNA: vcDNA=SeqID_57084; Strand=+; Position=1 -11,70-360
MDRRWICGDVWMDILPSFDHAQLGLKMALLSDRFDVLVDKHFDGKSELTIWRRIKISETVCGDRWQICGISIAGPFAAKQNPFSFPSDSVNQKLYRNQLI

SEQ ID NO: 130662 - protein, 201 aa, Heterodera glycines
  Coding regions on vcDNA: vcDNA=SeqID_57085; Strand=-; Position=1-606
MTETELRNRLLNVSIGRNIRNDNGTQNGDAPNLGQQNGNESVEIGQNLEHGGDAQMEFGQQMRGGLRDFEIFENFGHERGGLQNFGVERVSPNRHQHFGENRMQNRHISSEIRGQTNVRASNNREFVEQRPLLNRPPLAPQHSVIHRQYIQHVESLPPSFPYANERIPPAPSYAQPVFEQQRHQPRQNAPNPSQNLDVLHV

SEQ ID NO: 130663 - protein, 80 aa, Heterodera glycines
  Coding regions on vcDNA: vcDNA=SeqID_57086; Strand=+; Position=1 -123,172-291
  Homolog annotation: Hit_ID=AAK94486.1; Match level="QueryCoverage =98%, HitCoverage=37%, E-value=1e-39, Identity=98%"; Hit description =putative gluthathione reductase [Heterodera glycines]
MKKFDYLVIGGGSGGIASARRAAEFKVKVGLIESERLGGTCVNLGCVPKKVMYNTAIHAEFLRDHADYGIDSMNVKFNWR

SEQ ID NO: 130664 - protein, 21 aa, Heterodera glycines
  Coding regions on vcDNA: vcDNA=SeqID_57087; Strand=+; Position=1-65
MITENGGQARKATAEEEAKVK

SEQ ID NO: 130665 - protein, 62 aa, Heterodera glycines
  Coding regions on vcDNA: vcDNA=SeqID_57088; Strand=-; Position=1 -134,190-242
MSRNELVGFLLRQIKFHPIFANNFFSSSDSGLIHWDASALAQGANLNPPTNGREMTGHESAA

SEQ ID NO: 130666 - protein, 493 aa, Heterodera glycines
  Coding regions on vcDNA: vcDNA=SeqID_57089; Strand=+; Position=1 -91,166-209,547-653,712-919,979-1054,1098-1163,1216-1279,1397 -1548,1598-1632,1707-1756,1806-1841,1909-2165
  Homolog annotation: Hit_ID=CAE62666.1; Match level="QueryCoverage =93%, HitCoverage=45%, E-value=1e-110, Identity=46%"; Hit description= Hypothetical protein CBG06804 [Caenorhabditis briggsae]
SGRINITKMLERRGEATPKEAETILQQQQMDDDNDNNNNISDDDNDNNNNISTAHWANLGTQTIPLLVLLGFDTEMKEDGCHIWRLRHFSKPTYCNVCLNTYCNVCLNMLVGWGGKQGLACSLCKYTVHERCVRSAANNCIHTYNPSKRAADKQDHRWMESNCGGKCAKCKANVSIFQGRHCGGKCAKCKANVSIFQGRHCRWCKNLLHSKCIPSWPAACDFGQFAHLHSKCIPSWPAACDFGQFAHHILPPVHIIPTFMDRSCSISTNFHILPPVHIIPTFMDRSCSISTNFHPMQKHSKLKVIPLPPNSRCRPLLVLINPKSGGRQGERIFRKFQYLLNPRQVYNLCKDGPEPGVYNLCKDGPEPGLNLFKSLKQYNILVCGGDGTDGTVGWVLESMDKIAYGDGRPKIAYGDGRPPVAVLPLGTGNDLARCLKWGGGYENEPLQTILQSIERSTQVKRKGKRRKSQGKKAKAAKQRGDRRKHFQSKDKGN

SEQ ID NO: 130667 - protein, 200 aa, Heterodera glycines
  Coding regions on vcDNA: vcDNA=SeqID_57090; Strand=-; Position=1 -82,141-249,309-509,556-764
  Homolog annotation: Hit_ID=CAA65506.1; Match level="QueryCoverage =99%, HitCoverage=69%, E-value=2e-59, Identity=54%"; Hit description =cuticular collagen [Teladorsagia circumcincta]
MHAATRHRVARNADACCGCGESPRGPPGPPGPDGNPGGDGQPGGPGQPGAPAQAPPRPKPSGTGCQTCAPAENGHPGPQGPPGQPGAAGEPGAPGYPGKKGPRGPPGPAGPDGKPGDAGAPGQPGAPGELKPGPVKVGPPGPPGYPGKPGGPGQPGQPGEPGHPGGQGPPGDAGQPGEPGNPGGAGEPGQPGEKGEHGHC

SEQ ID NO: 130668 - protein, 44 aa, Heterodera glycines
  Coding regions on vcDNA: vcDNA=SeqID_57091; Strand=-; Position=1 -88,637-683
MPILLGRAIAPQWALRKASEKEKWPKQSKGCVMSLLCFCGCVLG

SEQ ID NO: 130669 - protein, 246 aa, Heterodera glycines
  misc_feature (12)..(12): Xaa can be any naturally occurring amino acid
  Coding regions on vcDNA: vcDNA=SeqID_57092; Strand=+; Position=1 -54,639-777,822-878,996-1172,1385-1588,1639-1674
  Homolog annotation: Hit_ID=CAE59919.1; Match level="QueryCoverage =95%, HitCoverage=33%, E-value=2e-68, Identity=56%"; Hit description =Hypothetical protein CBG03405 [Caenorhabditis briggsae]
EMRKLWGLKNPXSLMPVLLVRNLPEPLPLLTYDSVHKLRRGYRNPVLLLHPLGGWTKDDDVPLKVRIAQHEAVLKENVLDADVRIAQHEAVLKENVLDADWTVLAIFPSPMLYAGPTEVQWHARARLACGVNAYIVGRDPAGIQNPRTGDYLYEPSHGAKVLSMTTGLVGLEIIPFRVAAYDSFAGAMAFYDPNRHDNFMFISGTMMRKLAREGRQPPEGFMPPKAWEVLSNYYVLSNYYRTQNGN

SEQ ID NO: 130670 - protein, 23 aa, Heterodera glycines
  Coding regions on vcDNA: vcDNA=SeqID_57093; Strand=+; Position=1-73
MIDYCRKNGATVDMPSEAELFLH

SEQ ID NO: 130671 - protein, 708 aa, Heterodera glycines
  Coding regions on vcDNA: vcDNA=SeqID_57094; Strand=-; Position=1-2125
  Homolog annotation: Hit_ID=CAE56862.1; Match level="QueryCoverage =70%, HitCoverage=91%, E-value=3e-21, Identity=23%"; Hit description =Hypothetical protein CBG24692 [Caenorhabditis briggsae]
MESEINISPNNGSDFDPVHFTPEENEKWANLLGRMRAFELAVCRQFRTIENAFSQISSQIQIQDTADRVRELESSIKELENFTEMDTFETKEKFIEVEEEIGKVSNHMERYETFTKVRFGKIVEKMKDEVRKITENLDVLKGRVQLLEFEQDNPEGFGEWFDDGQSQEHNRLPDDKGATEGEDNIPIGDGSCEIMVADPFLGGITPLEGYDGNPSVSFSRWVARFEDMLTLYPQYSEVQKLSRLRILLSGQARAEFDSIEPSPVSLSDALNHLKRKFENENTRSIARQAMASCRQAPGERVYEFANRLNEAVRTALSGENEETIRRRLLEEFLEKLTPELQFEVKAGRPTSYSNAYEIAQHFELLLATKRTNQVSVADSVAELSHKVEALAIRQHSVPKRGIERRVCYYCRRPGHVVKDCRDKKRDEERRGHGGQRDRPFYGERKWNYERNEREHRHRHFSPHDRPNYGGNEGEHRQRHFSPHNRPSHGRNNHRSPISYEGREYENERTQSPGRRVRFGGQRIGAARIASPIFLALMVILSLFGANFATNSVESPMICHPDSPATLWSIPIDPICPSWTPTELPVAMKLNVYRVNTVKYKTKATACKCIKTKISRRIGFFGGKYEELSTENVEMPTAMCRKMKDFDESSAGKMVQINGTLRATQNSLEPGWRTWPIGLFWRTVEIVNCYLYETVVFARHGNSGPSTRG

SEQ ID NO: 130672 - protein, 123 aa, Heterodera glycines
  Coding regions on vcDNA: vcDNA=SeqID_57095; Strand=+; Position=1 -242,375-504
  Homolog annotation: Hit_ID=NP_501102.1; Match level="QueryCoverage =84%, HitCoverage=30%, E-value=2e-15, Identity=39%"; Hit description =putative nuclear protein of ancient origin (4H846) [Caenorhabditis elegans] gb|AAF60570.1| Hypothetical p
MKYSFNVREIQSLLNGFMCIFKPRDVSISAIEKLLMRRICEQANCLDPCRPLPTIEMPIVEAHPKSGALVVVGRKKQIDYSKHPLMVGQMFRPEDMRIEALNYLEPSCSGVCGKFNGYFLFLL

SEQ ID NO: 130673 - protein, 89 aa, Heterodera glycines
  Coding regions on vcDNA: vcDNA=SeqID_57096; Strand=+; Position=1 -156,204-317
MSPNECSDRPFQQPDNVQQPHRQPDEDAELRAQIEDAEEDLLLNWWREDPTIIRFLFGHGRAPAIEAALLQRAEREAEILREYAENQQQ

SEQ ID NO: 130674 - protein, 118 aa, Heterodera glycines
  Coding regions on vcDNA: vcDNA=SeqID_57097; Strand=+; Position=1 -133,182-405
  Homolog annotation: Hit_ID=NP_503721.1; Match level="QueryCoverage =80%, HitCoverage=18%, E-value=8e-13, Identity=38%"; Hit description =transposase family member (5D107) [Caenorhabditis elegans] ref|NP _503720.1| transposase family member (5D
MSNDAEKEFTPAGNPKAPALHMALDWIHRSWQEISKAVIIKSFEVCGLTTPLDGTGDEKIACFKPEGAIGPIGIKFLRDFRANETMKDGRNDHEEAGLSDDDDVELDAVGDVDEFFVC

SEQ ID NO: 130675 - protein, 207 aa, Heterodera glycines
  Coding regions on vcDNA: vcDNA=SeqID_57098; Strand=-; Position=1 -141,365-438,491-638,732-992
  Homolog annotation: Hit_ID=NP_741716.1; Match level="QueryCoverage =75%, HitCoverage=30%, E-value=2e-21, Identity=31%"; Hit description =putative protein, with at least 10 transmembrane domains, of ancient origin (68.2 kD) (XB658) [Caenorhabd
MKSYGQYAKSLLNSLNGHELTLVSVFLTATFINTITINCMETIYPKEIVKIGTKFTFYTALFLVSGSAICFGFLTFLHSNLTFFLCSLVIRFFQAVGRTFFVLSIFTLSAELFPEHVSLIGSILETFEGVGQISGPIFGASLYEIGGFMLPNFVMGTAMALMAFAFVALAPFPTALVYEDELHKKTMQNIEEGKMEEQQKRVKQTFN

SEQ ID NO: 130676 - protein, 85 aa, Heterodera glycines
  Coding regions on vcDNA: vcDNA=SeqID_57099; Strand=-; Position=1 -121,324-460
MDMVFEPFSVVLKKRDCQEIVDLIQMLPKSGAEIRGAMGRTDLSLLNHLVKIAGNYALDDMMLAYKKVHFHFMGSPTSSQETWLP

SEQ ID NO: 130677 - protein, 281 aa, Heterodera glycines
  Coding regions on vcDNA: vcDNA=SeqID_57100; Strand=-; Position=1-843
MTKAAAATTWDSSSITKPTGTTITSTTSAIVSMLLAPPKAQLVMNTSPSRTSTMAADKGHGMSTVNEQIDWKTGPKATLISVPLSVDQRCRRTDQMPSLAADAAAVQRESAYGVRESAIGGACDDHDQPPMLLRAEEAKRENVSTFEEEEEEEENGTTSDQKTDDNTDQQPPQLVLMIAAEKAAECEDDEWASDSCGMTSSLSSTAAPSKAASSKVAASALADQNNNHNDDDAVITGDERHEPRSPPPTKASKRRQSVYSDEPSSSKDGTHVTGGERHQPT

SEQ ID NO: 130678 - protein, 39 aa, Heterodera glycines
  Coding regions on vcDNA: vcDNA=SeqID_57101; Strand=-; Position=1 -117,337-339
MAPTAANKQRLPMPMPTDFSELMGPKKVPQQQQQQQKQL

SEQ ID NO: 130679 - protein, 109 aa, Heterodera glycines
  Coding regions on vcDNA: vcDNA=SeqID_57102; Strand=-; Position=1 -90,578-814
MVELYMKELLMQQKLQREYMLQQQQQQQQTQFHAPLLPLAPSPFPLFHALQHQPAVLPPASAATATTSSPFPTMAPLQFGTAPGTAGPFAAAPFCAAKPMASFSSVPDQ

SEQ ID NO: 130680 - protein, 90 aa, Heterodera glycines
  Coding regions on vcDNA: vcDNA=SeqID_57103; Strand=-; Position=1 -213,269-328
MEVEETKATKLEQMFANVWQNWSHFVLLMGLEGNAKCFDRANTFVRSRPLEAKAEFRPINSMDFHSDVGRMLYTIAILLMVRPSAVRSSD

SEQ ID NO: 130681 - protein, 89 aa, Heterodera glycines
  Coding regions on vcDNA: vcDNA=SeqID_57104; Strand=-; Position=1 -120,182-331
MFPHLQHQLGLTVQQQQQQQQQQRTVGGTKRRHCEEGGNSENIDIKSVSKRFHPMEAKENENNGKESSKEEEEEEDGAEESVAEEEEEE

SEQ ID NO: 130682 - protein, 42 aa, Heterodera glycines
  Coding regions on vcDNA: vcDNA=SeqID_57105; Strand=+; Position=1 -53,144-219
MENGKGKAQTNKKTELGIFAKKYVSSNRSALSRPLFDSMFEK

SEQ ID NO: 130683 - protein, 212 aa, Heterodera glycines
  Coding regions on vcDNA: vcDNA=SeqID_57106; Strand=+; Position=1 -93,162-707
  Homolog annotation: Hit_ID=CAE70735.1; Match level="QueryCoverage =89%, HitCoverage=66%, E-value=8e-16, Identity=27%"; Hit description =Hypothetical protein CBG17479 [Caenorhabditis briggsae]
MAKAIPDQKANTVSEIFVEIVVHQHSTPEIVHVTTTPYHQQSNGIAEGAMRIMANIISQIVNEKGNNWDEILPHAIFSYNVSIHAATKFSPFFIINLRQPKLPTDRLLKLPSPDELVSDISVYTRIQTEKAAKAWEIVRNEILKAQERNKEENDRIKKANEREFEIGDLVLFKKEVLGHKFDQRWLGPMRCCWGLKKKRKMLFYSQLMEALN

SEQ ID NO: 130684 - protein, 95 aa, Heterodera glycines
  Coding regions on vcDNA: vcDNA=SeqID_57107; Strand=+; Position=1-660
LFEYPKRTLEKIDFFVFGAVPPSRCAQIYGETESFRNSFPIACTLILRWIFAPHNCLSTPNGHLKKSIFLFSGQSPRTDAPRFMGRPNPSGIASL

SEQ ID NO: 130685 - protein, 69 aa, Heterodera glycines
  Coding regions on vcDNA: vcDNA=SeqID_57108; Strand=-; Position=1-270
LFEYPKRTLEKIDFFVFGAVPPNRCAQIYGETESFGNSFPIACTLILRWIFAPHNCLSTPNGHLKKSIF

SEQ ID NO: 130686 - protein, 34 aa, Heterodera glycines
  Coding regions on vcDNA: vcDNA=SeqID_57109; Strand=+; Position=1-104
MTNHSLAFISRRLGQWHKRNGVDFNAKCIRRMLL

SEQ ID NO: 130687 - protein, 122 aa, Heterodera glycines
  Coding regions on vcDNA: vcDNA=SeqID_57110; Strand=-; Position=1 -159,250-457
  Homolog annotation: Hit_ID=XP_326638.1; Match level="QueryCoverage =93%, HitCoverage=59%, E-value=1e-12, Identity=41%"; Hit description =predicted protein [Neurospora crassa] emb|CAD21384.1| related to high mobility group protein i/y (hmga) [
MDPSAPAKKRGRPPKAGGVAKTIAKKPPATTKAAPKSPSKSPAKSPPSSPPQPAKGSPAAKNAVKPAAATGRGRGRPKGTGTSAAAKKKAAAPAGGGTGKRGRPPKKTAQKAKESDTDEHDE

SEQ ID NO: 130688 - protein, 62 aa, Heterodera glycines
  Coding regions on vcDNA: vcDNA=SeqID_57111; Strand=+; Position=1 -38,158-243,321-385
MPEKSVKISKTLKVIRTTRLAEKFQNAISVLINIKTYLLIAAFAFQSGLAVIEFPITEIREP

SEQ ID NO: 130689 - protein, 198 aa, Heterodera glycines
  Coding regions on vcDNA: vcDNA=SeqID_57112; Strand=+; Position=1 -162,647-830,985-1140,1275-1368
  Homolog annotation: Hit_ID=NP_501223.1; Match level="QueryCoverage =98%, HitCoverage=66%, E-value=6e-74, Identity=69%"; Hit description =mitochondrial carrier protein family, embryonic tissue differentiation factor, DIFferentiation abnormal D
MSDTNVVTNFIAGGVGGSCAVITGHPFDTVKVRLQTMPKPAPGQPPLFTGALDCALYKGMAAPLVGVSPLFAVFFGGTALGKWLLQNEPGQQLDFKQNFTAGAIAGVFTTAVMVPGERIKCILQVQSMDGSAGTTPKYTGPVDVVRKLYREGGIRSIYRGTAATLLRDIPASGAYIAVYELLKDKFSGGERNELTPMA

SEQ ID NO: 130690 - protein, 52 aa, Heterodera glycines
  Coding regions on vcDNA: vcDNA=SeqID_57113; Strand=+; Position=1 -210,600-870
  Homolog annotation: Hit_ID=NP_501223.1; Match level="QueryCoverage =100%, HitCoverage=16%, E-value=1e-12, Identity=75%"; Hit description= mitochondrial carrier protein family, embryonic tissue differentiation factor, DIFferentiation abnormal
GIRDVFREMLREEGHRALFRGFVPVMLCAFHANAACFSGLELALWAFRQAGI

SEQ ID NO: 130691 - protein, 25 aa, Heterodera glycines
  Coding regions on vcDNA: vcDNA=SeqID_57114; Strand=+; Position=1 -52,150-175
MEKACKIWRDYIDFSALEKASESLD

SEQ ID NO: 130692 - protein, 17 aa, Heterodera glycines
  Coding regions on vcDNA: vcDNA=SeqID_57115; Strand=-; Position=1-65
TCYEMYKNNFIILNIIL

SEQ ID NO: 130693 - protein, 152 aa, Heterodera glycines
  Coding regions on vcDNA: vcDNA=SeqID_57116; Strand=-; Position=1 -31,1355-1782
MKLWVQKHSTNHFLYDQAKTNFKLEDEVTKLLNLLMIDASFDLEARKKCLETAFQVQFRNFAAIAISQEMDLKQIQKYVCAPLSEVMAFRQMDGIRDYSSGWCAGGIYMHRSLPSKAPIPSQACLKNIITFFSVGQIYKFGNIRKLYMFRSY

SEQ ID NO: 130694 - protein, 31 aa, Heterodera glycines
  Coding regions on vcDNA: vcDNA=SeqID_57117; Strand=+; Position=1 -53,137-179
MSPIWPNLSPKMAQALIKKYFFYFLLSTVRD

SEQ ID NO: 130695 - protein, 33 aa, Heterodera glycines
  Coding regions on vcDNA: vcDNA=SeqID_57118; Strand=-; Position=1-102
TKRFFLNTPEAQCVQLCSGGQPLQFRKMDAFLL

SEQ ID NO: 130696 - protein, 24 aa, Heterodera glycines
  Coding regions on vcDNA: vcDNA=SeqID_57119; Strand=-; Position=1-73
MPNRYNKHMETNLMGKVIMVMESE

SEQ ID NO: 130697 - protein, 132 aa, Heterodera glycines
  Coding regions on vcDNA: vcDNA=SeqID_57120; Strand=+; Position=1 -214,726-910
  Homolog annotation: Hit_ID=XP_522969.1; Match level="QueryCoverage =94%, HitCoverage=65%, E-value=3e-10, Identity=33%"; Hit description =PREDICTED: similar to putative protein family member (XC187) [Pan troglodytes]
MIRRGTTVIRRGTTVMRRVIRRGTTVIKRGTTVIRRGTTVISRGTKVIRRGTKVIRRGTKVIRRGTKVIRREVQSDQKRYNSDKRGTTAIRRVIRRSTTVIRRGTTVIRRGTKVIRRGTKVIRRGTSWFKIK

SEQ ID NO: 130698 - protein, 62 aa, Heterodera glycines
  Coding regions on vcDNA: vcDNA=SeqID_57121; Strand=+; Position=1 -24,191-267,316-403
MWVGVHLSSQTRPERKSRKIRVVAIIPKMWLEFIAKLAQKENPEKLGSSLLFRKCGWNSFEC

SEQ ID NO: 130699 - protein, 63 aa, Heterodera glycines
  Coding regions on vcDNA: vcDNA=SeqID_57122; Strand=+; Position=1 -96,744-836
IEKRREAVRKRICPCFLRLKSAIDDQYNEKKKKFLQELFNSNLTKCNDEYKSQSMNKYLVECE

SEQ ID NO: 130700 - protein, 199 aa, Heterodera glycines
  Coding regions on vcDNA: vcDNA=SeqID_57123; Strand=+; Position=1 -113,568-1054
  Homolog annotation: Hit_ID=BAB01023.1; Match level="QueryCoverage =80%, HitCoverage=10%, E-value=4e-35, Identity=46%"; Hit description =helicase-like protein [Arabidopsis thaliana]
MAFSGIAATLLKNGRTVHNCFKLPLDLNSNSLSSIELREINCYNEKVLSKFPGENYIFKSIDDAESKGAPILPEILNKLETSSLPNHELKLKINCVTKLIRNLNVSAGLCNGTRLQILDIGKNVLRVMILTGDRTGEIDFIPRISLIEDKKFPYVLKRHQFPLRLAFCMTINGAQGQTFEKIGIDLSREVFSHGQLYVA

SEQ ID NO: 130701 - protein, 500 aa, Heterodera glycines
  Coding regions on vcDNA: vcDNA=SeqID_57124; Strand=-; Position=1 -83,1802-1972,2321-2721,4964-5794,7538-7556
  Homolog annotation: Hit_ID=CAD22154.1; Match level="QueryCoverage =98%, HitCoverage=54%, E-value=2e-66, Identity=33%"; Hit description =pherophorin-dz1 protein [Volvox carteri f. nagariensis]
PAYSMYPTVTCPPTLALLPPPPRQPKGPPRRPPAPPPPPPPPGRRPPRGPPPPPTGRRPPSGPTTPRPSPPGSPPPRPERPQRPTPPRLPSPPRLKTKIEPRPPPPRPTAKREKQQVKLNWKKTQHPTPAPRAKREPELKLDPRPSTSRQAGYFPPPTTKIEPKHAPTKRPVPYRIPEREPKIREKPLQQQQPPHPTAVVEEIPYVPPPEGDQTPPPPPVTPKVPVPAPVTSPAKPTTVKTPATPSVTTPAPPTTAKPPVTVPSPTTKPITPTPPPTTTTPTPTTKSTTSPPPTTTVPPAITKPSTGPPPTTTVPPPITKPSTGPPSTEKPITTVPAPPKTTTTSTPAISAVPSPSVKPTIPVPPAQLKSSALSPKSKTPISTVKPPLPASVSAKVGTRPQTPPSPKAESPPHYDEEEDKDKLTVKTATPVKPSAKPIITAPPAQLKSPTASQLKPQQPSKPQAPPSGSPPRFEETEHQQPPPPPTSAAQIDPSQNVCEE

SEQ ID NO: 130702 - protein, 129 aa, Heterodera glycines
  Coding regions on vcDNA: vcDNA=SeqID_57125; Strand=-; Position=1-390
MERHKQQQQQQQVNIGELIKDNCDWLCALARTKSAKKCKKLIGKANSEQLLALVEICLNLVASRFRLSTRQKKRLMPHVDTVRRMSRARSERGARRVLVQKGAGFGGLFAAVLTPVLIELAKSVMTKNA

SEQ ID NO: 130703 - protein, 170 aa, Heterodera glycines
  Coding regions on vcDNA: vcDNA=SeqID_57126; Strand=+; Position=1 -61,107-142,190-246,313-372,425-469,614-867
  Homolog annotation: Hit_ID=AAP30775.1; Match level="QueryCoverage =100%, HitCoverage=100%, E-value=5e-82, Identity=84%"; Hit description=putative gland protein G32E03 [Heterodera glycines]
MRAILFLAMVCLVMAVILETANSKAVKKDNKKGAITTPAKGKAAPKGAAKGGIKKDAKSKGKGKKDAKGKKDKKAKPAKGKGAPKNAKPMAAVKAVPKAAENAQKGPSSAEVVAEENNLDTEAVDDLGAEESDFDQLAEDELLEDDAMDGEADEWEGMGEETEMDSQMAL

SEQ ID NO: 130704 - protein, 18 aa, Heterodera glycines
  Coding regions on vcDNA: vcDNA=SeqID_57127; Strand=+; Position=1-56
YREAIPEGFGLPINLGAS

SEQ ID NO: 130705 - protein, 154 aa, Heterodera glycines
  Coding regions on vcDNA: vcDNA=SeqID_57128; Strand=+; Position=1 -188,452-546,751-828,895-995
  Homolog annotation: Hit_ID=CAE74540.1; Match level="QueryCoverage =84%, HitCoverage=4%, E-value=2e-30, Identity=50%"; Hit description =Hypothetical protein CBG22297 [Caenorhabditis briggsae]
DDRSQSTPGPGTSKIAEGVKNRSSKRSRRRVGGGPHGGAGEDDEDYPYKPDELAFNKTSYFKVEKLLAQFGWGRWAVLKAFSDLEHELEHITRTLLLHCVREFRGDEKIREYVWALITPEEKKTAAATGDSNSRYHQGWAALPEYNVCRLMLIS

SEQ ID NO: 130706 - protein, 60 aa, Heterodera glycines
  Coding regions on vcDNA: vcDNA=SeqID_57129; Strand=+; Position=1 -139,300-343
MPKAAKSNAVLNRHWISKFPEGTYSTDGKINPGLYKLIDIAKILIGGFLAHKNPSPNYYI

SEQ ID NO: 130707 - protein, 116 aa, Heterodera glycines
  Coding regions on vcDNA: vcDNA=SeqID_57130; Strand=-; Position=1 -72,127-405
MKNTRKTVKSRRRRRVLSMRTTNLIVEQQLPEERQNLLPANSATVGIGSDSVRLAYELPEALPSQSAGESDGERTNGPPNCNTKTTEEQQQQTDAVLLNTNVTAELTELMAKLKAL

SEQ ID NO: 130708 - protein, 191 aa, Heterodera glycines
  Coding regions on vcDNA: vcDNA=SeqID_57131; Strand=+; Position=1 -96,155-298,343-528,576-630,1365-1459
  Homolog annotation: Hit_ID=CAC80545.1; Match level="QueryCoverage =69%, HitCoverage=12%, E-value=1e-57, Identity=80%"; Hit description =putative Na-K-Cl cotransporter [Meloidogyne incognita]
MASNYQGFGFTPLYEKEEPASFYVDKKKIEERAKLGVMLGVYLPTIQHILGVTMFIRLAWIVGVAGVSHTFLMLFICCLCTFLTCISVSAVATNGVVEGGGAYFMISRNLGPEFGSAVGILFYLANTVATSMYLVGGIEILLLYLCPGMTIGGKNAHTDTGNFNPNYPDFHEYAVGKKADVSKEVFQDVKT

SEQ ID NO: 130709 - protein, 92 aa, Heterodera glycines; identical to SEQ ID NO: 125147
  Coding regions on vcDNA: vcDNA=SeqID_57132; Strand=+; Position=1-304

SEQ ID NO: 130710 - protein, 35 aa, Heterodera glycines
  Coding regions on vcDNA: vcDNA=SeqID_57133; Strand=+; Position=1-105
KIPLKIKGLLRTALPIMLESICMCIKFIKKRDSIF

SEQ ID NO: 130711 - protein, 30 aa, Heterodera glycines
  Coding regions on vcDNA: vcDNA=SeqID_57134; Strand=+; Position=1 -66,649-675
MERACAQLESLGKVLDNATPSSILTFLVTL

SEQ ID NO: 130712 - protein, 40 aa, Heterodera glycines
  Coding regions on vcDNA: vcDNA=SeqID_57135; Strand=-; Position=1 -22,303-403
MGAQENTDIPPTDCQFHTTAKRIGSALIATNEICSNWEFS

SEQ ID NO: 130713 - protein, 138 aa, Heterodera glycines
  Coding regions on vcDNA: vcDNA=SeqID_57136; Strand=+; Position=1 -193,273-379,502-618
  Homolog annotation: Hit_ID=NP_498875.1; Match level="QueryCoverage =92%, HitCoverage=24%, E-value=9e-25, Identity=48%"; Hit description =dgre mouse dgcr14 protein like (58.3 kD) (3J578) [Caenorhabditis elegans] gb|AAA28021.1| Hypothetical pro
MAINREATRFGTEAMMAQRPQQQMMARVTLQNIAKNAGHIDITGKLIGIEAKTVGLVATPTPAPGIDDSPLMTWGEIEGTPFRLDAPDIQPSLEDAPAFRIPEVPIREKIAQGIAEQIASRYHNKRKRAMDQIQQMAP

SEQ ID NO: 130714 - protein, 100 aa, Heterodera glycines
  Coding regions on vcDNA: vcDNA=SeqID_57137; Strand=-; Position=1 -78,146-370
  Homolog annotation: Hit_ID=XP_425398.1; Match level="QueryCoverage =68%, HitCoverage=13%, E-value=5e-18, Identity=55%"; Hit description =PREDICTED: similar to Phosphatidylinositol transfer protein alpha isoform (PtdIns transfer protein alpha)
MCAYKVVTVKFDWWCFQTMVESYILKQYARLLCKFNREVFCWMDRWYGLTLAQIRLIEEETKKALDEVGFYSATVHPIPPLYVIVVHFAQMTGRPRGMSG

SEQ ID NO: 130715 - protein, 186 aa, Heterodera glycines
  Coding regions on vcDNA: vcDNA=SeqID_57138; Strand=-; Position=1 -66,567-827,894-1127
  Homolog annotation: Hit_ID=CAE65006.1; Match level="QueryCoverage =70%, HitCoverage=48%, E-value=4e-38, Identity=54%"; Hit description =Hypothetical protein CBG09844 [Caenorhabditis briggsae]
MPFAIEEYQIGQLFSVTEASRQALGLSKDELNERKVVRIDIANDNEFLKAADILDNTRPSTFRSVNTGRGPLEQQWQTNCEPVMCAYKVVTVNFKWFGFQTMVESSMQKSFPRLFCKFNREVFCWMDRWYGLTLAQIRLIEEETKKALDEVGFYSATVHPIPPLYVIVVHFAQMRATGNPKGMTDN

SEQ ID NO: 130716 - protein, 143 aa, Heterodera glycines
  Coding regions on vcDNA: vcDNA=SeqID_57139; Strand=+; Position=1 -157,214-408,472-552
KPKIDEEIDENNTFCDLLWADPTNNAQELRLCKDYEPDKGFLGEYGNYRFNTDRETSIQFNDRFAQEFFNRFPHIRGIFRAHENQPKGHSINEARTICTVFSSPRYTEDTDCGSVLRLSADLKHIHFVTLKPKATGEKLSREE

SEQ ID NO: 130717 - protein, 75 aa, Heterodera glycines
  Coding regions on vcDNA: vcDNA=SeqID_57140; Strand=-; Position=1 -98,440-570
DWQENFKGDEANSDGIRMLAFFCARFVSAFPAGIFVSRAKFGGHFSAKIIHWPSPEEYPDKFSTNSVHKSLKSPH

SEQ ID NO: 130718 - protein, 42 aa, Heterodera glycines
  Coding regions on vcDNA: vcDNA=SeqID_57141; Strand=+; Position=1-129
IGSWSYQSEYLRLVVDERDVFLGDFYDNQEWLLVKHFYPRKL

SEQ ID NO: 130719 - protein, 54 aa, Heterodera glycines
  Coding regions on vcDNA: vcDNA=SeqID_57142; Strand=+; Position=1-167
LVTYHHAFVVLNNFSSSTAAVSQSVSTDRSHRSSAICDSQKETAMEQNGTTIGG

SEQ ID NO: 130720 - protein, 132 aa, Heterodera glycines
  Coding regions on vcDNA: vcDNA=SeqID_57143; Strand=+; Position=1-399
IFGFFKLSTKVFTISSLPDRDSRELTPRLSTNKYSFLCIAQIEQGDLVEVWDAPYEENARLATVHRLRIVRCRFDQRKGYVIKTKCWPNYIMENWVSGDEAEEEGEEEAQQQQEEGREDEAEGTAEEKGGRK

SEQ ID NO: 130721 - protein, 36 aa, Heterodera glycines
  Coding regions on vcDNA: vcDNA=SeqID_57144; Strand=+; Position=1 -5,120-225
MRSILKGVFFVFIAFLLRNFAKKCRKSEKIVKKAKK

SEQ ID NO: 130722 - protein, 30 aa, Heterodera glycines
  Coding regions on vcDNA: vcDNA=SeqID_57145; Strand=-; Position=1 -37,984-1039
MSYGCSNFRFDSGRKSLASCYVYVYHIHLD

SEQ ID NO: 130723 - protein, 145 aa, Heterodera glycines
  Coding regions on vcDNA: vcDNA=SeqID_57146; Strand=+; Position=1 -198,427-666
MDSFCLYARRFACFCWQFPAQLFNSNANSHFTFGRSHSSELYLLVSNNLKKFSFFIFIYVLEKTHFPEKNYRFPHFKQIFWAFIAQIVHKATHRIYQKQLPEEAHNSQGYRFSAPKNDQTAMNFVKIDDQWTRVSVKLFNAFMFF

SEQ ID NO: 130724 - protein, 52 aa, Heterodera glycines
  Coding regions on vcDNA: vcDNA=SeqID_57147; Strand=+; Position=1-161
FLRSLPPLVINGLFPLLRYAEQLLTLKYPEVIEGITRPHHLVQEFRVRKCIL

SEQ ID NO: 130725 - protein, 75 aa, Heterodera glycines
  Coding regions on vcDNA: vcDNA=SeqID_57148; Strand=+; Position=1 -199,1053-1081
MRRGTKVIRRGTTVMRRGTTVNRRGTTVIRRGTTVIRRGTTVMRRGTTVNKRGTTVIRRGTKVIKREILEYLFSY

SEQ ID NO: 130726 - protein, 125 aa, Heterodera glycines
  Coding regions on vcDNA: vcDNA=SeqID_57149; Strand=-; Position=1 -122,259-514
MHFVGGAANAVMGMRSAQQMLTESEPTANKMVMLIHRHKIDVASRAEIEQIARVDNLALLELSYSRWPVLDNRQAYWSRQLCMLAALIERLENTVPADIDEIFFGTDREEEEGEEGTRRVRQVTW

SEQ ID NO: 130727 - protein, 380 aa, Heterodera glycines
  Coding regions on vcDNA: vcDNA=SeqID_57150; Strand=-; Position=1 -35,249-521,766-872,935-1028,1084-1152,1476-1886,2242-2305
  Homolog annotation: Hit_ID=AAQ11020.1; Match level="QueryCoverage =99%, HitCoverage=7%, E-value=2e-87, Identity=31%"; Hit description =mesocentin [Caenorhabditis briggsae]
NGPGLFSLPFTVRTWLAPRVPQVSMSPEQRLERRPSPDEMEVFCDADGVPRPRILWWWDGRPVADGQDEMRIIDSTALDEKVRTRQRLLFQSTTRSGTLKCQAINEKGTAEKELEVRILGPGSPPSQISSSPVQDGFSVNWLPPLVPNVNWLPPLVPNGDVINYVIYWNKDAEADLADWSQKTVGAELDNVLISDQQEQTWSQKTVGAELDNVLISDQQEQTPYVFRVQAIGSAGPGIISPSYEVVTGLRHIPLAVTIRVLSPPPSVAPEGTLVEPGGPIRFQCVAVGRPKPLVSFSWVPSASAEPGEGPVQLSTEPDSNGEAHRYVSAETETRTNTKRRLLCEARNDQGQVQAEQLFQVLKPGGAPRDVSAEVDGDNRV

SEQ ID NO: 130728 - protein, 295 aa, Heterodera glycines
  Coding regions on vcDNA: vcDNA=SeqID_57151; Strand=+; Position=1 -66,1893-2021,2315-2376,2432-2800,3516-3777
  Homolog annotation: Hit_ID=AAR11446.1; Match level="QueryCoverage =84%, HitCoverage=32%, E-value=3e-68, Identity=60%"; Hit description =matrix metalloproteinase [Heterodera glycines] gb|AAR11445.1| matrix metalloproteinase [Heterodera glycine
MDDPRGHQMESKSEIEWVIADGSENDVRTVQLKKEKQTDETEEEKDEESSAEQKLPSELDPEFVKTYLREFGHLKHNENGLSHGVKHFQRFLGYRQTGNVDLGTLQKMSWKRCANSDEGYTAQGGGGSMNYGICQDYFGVKKNAGNLALKIESQTNFLAKLPTENGTCITGLFRVEKNIGSGFGSGRPKNHRVGFRVEKKAGFRVSGFGELIAQAFRAWEIVIKIDFLETNNADNAQIIFTFESDGAKKEKSKNGEEEKEKEGKTGKSLSDLISTDRLVKKTEKEILIILAKNKI

SEQ ID NO: 130729 - protein, 157 aa, Heterodera glycines
  Coding regions on vcDNA: vcDNA=SeqID_57152; Strand=+; Position=1 -92,135-155,208-306,374-422,745-957
  Homolog annotation: Hit_ID=AAR11446.1; Match level="QueryCoverage =62%, HitCoverage=16%, E-value=9e-44, Identity=91%"; Hit description =matrix metalloproteinase [Heterodera glycines] gb|AAR11445.1| matrix metalloproteinase [Heterodera glycine
LAIAKASSPPVARIVLNADENWSTFQTQEEGKIDIFVVLLHEIGHALGLRHSGDEHSVMFPMFERSVGEHLPVISNDDVEHLRALYVLFGNKNDGPKLRVKRSSSVASSASAAGAIAGGANANSNANNAFASFYADDDNTVLCCVCPAPMTLGDLKK

SEQ ID NO: 130730 - protein, 53 aa, Heterodera glycines
  Coding regions on vcDNA: vcDNA=SeqID_57153; Strand=-; Position=1 -158,521-524
MALSEMPNQIDTIIRRIEKEITMNEQDKEQQLFAKIFAYARTQTNNAFNNFFQ

SEQ ID NO: 130731 - protein, 16 aa, Heterodera glycines
  Coding regions on vcDNA: vcDNA=SeqID_57154; Strand=-; Position=1-49
EAIPEGFGLPINLGAS

SEQ ID NO: 130732 - protein, 209 aa, Heterodera glycines
  Coding regions on vcDNA: vcDNA=SeqID_57155; Strand=-; Position=1-630
  Homolog annotation: Hit_ID=NP_504191.1; Match level="QueryCoverage =65%, HitCoverage=40%, E-value=7e-23, Identity=42%"; Hit description =predicted CDS, transposase (5E791) [Caenorhabditis elegans] gb|AAB63925.1| Hypothetical protein ZC132.1 [
MTQQHIGLMKSSDPLKKQIMQKMIFNSKQIEKGRQAIGMNQRTVGHLLAICICCIAITFAKSNDFQKMDKIRLRQLLLYEFRKNSTPTQALRNICESEGNDALSLSTVKRWFTKFREGNEQLEDEPRSGRPHALDSDDLEQHVQQHPCSSSRQPAAEFGVHQTTVLNYLHQLGFINKKGAEVPHALTQQQKHQRVVTCTELLARLSAGM

SEQ ID NO: 130733 - protein, 477 aa, Heterodera glycines
  Coding regions on vcDNA: vcDNA=SeqID_57156; Strand=-; Position=1-1432
DRDLVQNRVHFPKNFGRENSEDRHRIQKSVFNRSPISPSQTFSTEKSIEFFQNFPPNQIHFCEEEKQLVDLYRATTTQENAGKDVISSQLNPNSRPQFERVLNEEMVNQRRSPISTISNEINSDMKKRSPFVYEKFFNGLVQRIVEAKPIPKPSKCQTIEMKVQNWKAKSIIDPNSEINFINPEFLFKMSVSDKTDFLKWSFQPKCDLTGLPYEFATYKGQKIPVYGLVNVPIDIGDSELETWCMVTKIPLEYDFILSGNLLKLLENLKRDEDQANHGHANPQNLQTSPKFSAPPKPQLRQYKKVGQSSSKMWRQNRNSCPFPLNFQRMDKSKTEFTNQNHLKQFSHFPTKIFHSDPAQFSPKLQPIQPRTFLNSKFKKAKIEKKAFAQQLRPPSLLSIRTHIPQTLPVSNMSDNYNWTIPEFARHSHPVSQNFHFSNSLMSQQCRRCPTTTSARRPPWFVAEGGQTPKRFAGAQLV

SEQ ID NO: 130734 - protein, 99 aa, Heterodera glycines
  Coding regions on vcDNA: vcDNA=SeqID_57157; Strand=-; Position=1-300
MGMDHGQGPQHQPWELDPPLPEQHLEIGPQLPAEWAYQPPPQWAQVVHVEQQPQQQQHYHHHQQQQQQQQQQGAWDEGCETMMPHALDRIQDKEYGQYQ

SEQ ID NO: 130735 - protein, 52 aa, Heterodera glycines
  Coding regions on vcDNA: vcDNA=SeqID_57158; Strand=-; Position=1 -51,836-941
MSERQLAGLSMLGINKVPGYAFYRQRGQALVAEVESDPEKELDVLVTHTPPL

SEQ ID NO: 130736 - protein, 251 aa, Heterodera glycines
  Coding regions on vcDNA: vcDNA=SeqID_57159; Strand=-; Position=1 -156,324-922
  Homolog annotation: Hit_ID=NP_702063.1; Match level="QueryCoverage =69%, HitCoverage=4%, E-value=1e-11, Identity=18%"; Hit description =hypothetical protein PF14_0175 [Plasmodium falciparum 3D7] gb|AAN36787.1| hypothetical protein [Plasmodium
MARPLRGLGLNSSAFQSLGITQSTCIPITNNKSRRFFCIPIAGTQFYDLSITSLGPTHQHSSHWDSFSCISINGTQPSSISITGTQSSGIPNTGTQPSSISITGTHSPAFQSTGLNPPAFQSLGLNSPAFRSLGLNPPAFQSLGLNSHAFQSLGVNPPAFQSLGVKSTAFRTLGLNSPAFQSLGLNSPAFQSTGLNPPAFQSLGLNSPAFRSLGLNPPAFQSLGLNSHAFQSLGVNPHFNHWESNLRRSEH

SEQ ID NO: 130737 - protein, 251 aa, Heterodera glycines
  Coding regions on vcDNA: vcDNA=SeqID_57160; Strand=-; Position=1 -60,227-371,422-592,647-778,821-949,1064-1182
  Homolog annotation: Hit_ID=XP_414857.1; Match level="QueryCoverage =85%, HitCoverage=6%, E-value=1e-16, Identity=27%"; Hit description =PREDICTED: similar to CASK interacting protein 1 [Gallus gallus]
VARMAKEEFGFEQVSVWNDTFASFKVFDNIYFAGAFKGADGISQQFVHIERYMQNLRSYQKLYHQNEMYLKDRLTGLILTGWQRYSHTTPLCELLPAGIPSLARQAIFVSQWMNKREERTDQFMQEFLNCSVRHSTSATKFVRKGFTFPFVFEFKFCDCQFPGVELYSEIEELNLLRWKAAIERYISSNETEKETQNELEKMEEEFRKLRKTIASLLGHFFYEDTVDEWLAQHDHLNRFNDDDLGLPPPNR

SEQ ID NO: 130738 - protein, 67 aa, Heterodera glycines
  Coding regions on vcDNA: vcDNA=SeqID_57161; Strand=-; Position=1 -127,177-253
MASDGQALAKWLFTHRPDNVAKVEMFCSASTSVLAKNGIVQNSFCQCFISRQFHHCHQSTVTIRRAN

SEQ ID NO: 130739 - protein, 108 aa, Heterodera glycines
  Coding regions on vcDNA: vcDNA=SeqID_57162; Strand=-; Position=1 -171,368-523
MQTMELALLGEKPAEKGQINLMGTQWVTKDQLQQQMQEILSDDEVPHPILLTRSVFSVTINEDGRRECWRICKTRASAVKIVVRDGGTGLFTVNGQHYCTFRSLLARQ

SEQ ID NO: 130740 - protein, 55 aa, Heterodera glycines
  Coding regions on vcDNA: vcDNA=SeqID_57163; Strand=-; Position=1 -96,242-313
MLFLKMLNSFLTHGSSWEHSGHFPRVTLCDLKIRQPNERFHEFTVQCVLVANFVS

SEQ ID NO: 130741 - protein, 21 aa, Heterodera glycines
  Coding regions on vcDNA: vcDNA=SeqID_57164; Strand=+; Position=1-62
GTHAFRRSRFGAPVSAPARFS

SEQ ID NO: 130742 - protein, 220 aa, Heterodera glycines
  Coding regions on vcDNA: vcDNA=SeqID_57165; Strand=-; Position=1 -69,1048-1273,1346-1710
  Homolog annotation: Hit_ID=CAE67223.1; Match level="QueryCoverage =92%, HitCoverage=34%, E-value=3e-20, Identity=34%"; Hit description =Hypothetical protein CBG12661 [Caenorhabditis briggsae]
MSIVQDEEWKTHLGQCMFNVRARGDQTNAPTPPSSLAIFKLTKPEEAQKTEKASGATTEAKDAATLPLASSSPAAFIQVGPWAYPLEPGKTAILKNELGVYVMPNPSPDHPNMFVGIILPRGLAPGLESEFVYALKQFAVLNSSDIVDRMSEEQRERTRYLQSTPAKRRKIEKYRRKCLSERIAQFLIRTGQYIALNTQNAAQWTGEYVAKMGEQYRAGM

SEQ ID NO: 130743 - protein, 19 aa, Heterodera glycines
  Coding regions on vcDNA: vcDNA=SeqID_57166; Strand=-; Position=1-58
FQANILFLVNFGIYKMKHL

SEQ ID NO: 130744 - protein, 57 aa, Heterodera glycines
  Coding regions on vcDNA: vcDNA=SeqID_57167; Strand=-; Position=1 -10,52-180,1352-1386
MYTEEDAEEFEKLSIENLPQNKVSELNMQNVNAASTSAAAAGGSFNGYAKMQLFLSV

SEQ ID NO: 130745 - protein, 276 aa, Heterodera glycines
  Coding regions on vcDNA: vcDNA=SeqID_57168; Strand=+; Position=1 -140,184-210,259-391,441-528,907-961,1007-1166,1209-1337,1399-1496
  Homolog annotation: Hit_ID=NP_511075.3; Match level="QueryCoverage =82%, HitCoverage=20%, E-value=4e-50, Identity=39%"; Hit description =CG2212-PA, isoform A [Drosophila melanogaster] gb|AAF46305.3| CG2212- PA, isoform A [Drosophila melanogast
NNELHILHFYESNVYPFAVEIHGDFARLGRIISGNAVGLVLGGGGARGAAHVGVIKALRQNGIPIDMIGGTSIGSLVGGVLASDPYDQDGLEQKTHFWFTGMGSVWKVLMVRCSFLFVSIKPFVRTSLMGHYLLDGGYVNNLPADVMRSFGARTVIAVDVSSADEKDFHNYGDSISGFWAQLRALNPWSTKLRILTGQEIQDRLAYVSSVRQLEMVKKAPYCNYLRPPIASFLTMDFAKFESIRRSGYRYAAEIVPNLVMTNAHLKTLISHEKMHE

SEQ ID NO: 130746 - protein, 234 aa, Heterodera glycines
  Coding regions on vcDNA: vcDNA=SeqID_57169; Strand=-; Position=1 -279,322-747
MGKDETVTAQPTKKKQRKSSEMEGRPSSPSPVQQHRPSTTSSSTSNTTTTKWVKEGNTTAKSGANSTTAKKESALPNVISQITVPFPNLKNFKIPKVIENADPPPSTSSAPHFVPNKGGTTELQQQSSQSSLASSSNEKGSRSKFGPFKSSDHFEQRRPGGGAKQSKGAGHQHTHYQYNDKYAGGGGGSSSFQPHNAYSRQRAPKQSQAGGGGRHGGGNSEQPRKQHGAAPSTT

SEQ ID NO: 130747 - protein, 278 aa, Heterodera glycines
  Coding regions on vcDNA: vcDNA=SeqID_57170; Strand=-; Position=1 -367,721-882,929-1014,1059-1278
MGAGTDDAESQQCETVTRPSSKLTGRCSPNPGNSLSSLTQQNAFSTTSDQRVRPIEQKNVAGGNTDSSHLAQMSVEQQRQRFGMNVVYRQQQPKQPIAPMGGINPTTGRLIMASSHFVKCQRWNSGQRRPRKPRKPANVSFEQREGIPRSPFQHSESHPTIGKIPPLPTTPSNYISPQIEEDFRSKMMSVYEMGICESSTDDEEMDPPPPPKELMAHNQSESSTTDQKTPPEIDERAAGTVENSGNAAKKGGPPLAKCSVSSSQSSGGDQTAVADPPQ

SEQ ID NO: 130748 - protein, 276 aa, Heterodera glycines
  Coding regions on vcDNA: vcDNA=SeqID_57171; Strand=+; Position=1 -144,201-299,433-640,690-1067
KVVLKKVNVSEDYVHYFNKFGKLGQNYFIGINENDEATKSYLPYINCQKYNKNDCDKGRSDGCMKTVKCVVTDPIRGSQQLGDIIEPSLMDCWQHEERQLAECKQQDKCVADVRKTGQANQSSLFCCCRTHNCNRQMVYAEEKYIGPSTTTSSSIVDFPLSVGFNLLQLAIIFFTVLFIAIFVVFILSMPKLRKKICKRSGTAKFFLPFYRNTNDGKDQRKELLATEYDGQITLPDGEKVHKEKITLHEVLTVKRLIWSIFFSRECPLVALAKCTK

SEQ ID NO: 130749 - protein, 21 aa, Heterodera glycines
  Coding regions on vcDNA: vcDNA=SeqID_57172; Strand=+; Position=1 -54,575-586
MRTRPIWQVKQRLLTSQKKGF

SEQ ID NO: 130750 - protein, 86 aa, Heterodera glycines
  Coding regions on vcDNA: vcDNA=SeqID_57173; Strand=-; Position=1-678
KNRFIFVFGAVPPNRCAQIYGETESFGNSFPIACTLILRWIFAPHNCLSTPNGHLKKSIFLFSGQSPRTDAPRFMGRPNPSGIASL

SEQ ID NO: 130751 - protein, 210 aa, Heterodera glycines
  Coding regions on vcDNA: vcDNA=SeqID_57174; Strand=+; Position=1 -103,152-314,364-578,628-780
  Homolog annotation: Hit_ID=NP_507780.1; Match level="QueryCoverage =91%, HitCoverage=12%, E-value=3e-16, Identity=33%"; Hit description =predicted CDS, DNA polymerase type B, organellar and viral family member (5T899) [Caenorhabditis elegans]
YKLIPIKLANFVKTFGLEIEGVDNKKYFPHKFNKAENYGTVLDTLPPMEDYYPGGLFPAERAKFEQWYDENRETGFELNEVIADYCKTDVQILAHGLVKMRQLFLSETRHDITDSVTIPSGCMKYWVQLAHHDKERVAIIPHLGYEKRGKQSTIARKYLKWRAEEELRENGRVLRHVESPGGEFKFGNYSLDGMMERPDEEKNLAIEVNG

SEQ ID NO: 130752 - protein, 307 aa, Heterodera glycines
  Coding regions on vcDNA: vcDNA=SeqID_57175; Strand=+; Position=1 -88,130-238,291-580,625-786,835-1030,1078-1153
  Homolog annotation: Hit_ID=NP_001004509.1; Match level="QueryCoverage= 89%, HitCoverage=17%, E-value=5e-28, Identity=33%"; Hit description =si:busm1-180o5.3 [Danio rerio] emb|CAD60788.1| novel protein similar to DNA polymerases [Danio rerio]
MLEDNTAMKAYFDNCPDSGPIDFHDAFFGGRTGPEYLGASVINPETGDWKSRTIKVKDFNSLYPSRNMFTNYPVGHPTVVQFDKDVEWRRPEDVVGDDGIRLEGIIKCFVVPPRHCHYDIPVLPYRLNNRTLFPLCRTCSEMYPRGLIDPEYNCNHFEDSERGFSTTVTHIELQAALRSWYKVTHVYRAYIWPLACDWSNGLFHSYLLKFLKMKFEASGYPASCTEAGISEEESARRKQDHIDKAKQKAQVHLEADRIKHNPGLRYLSKLCLNSLWGRFALRNRLTKTEIVECHSELAKLLNDQKFE

SEQ ID NO: 130753 - protein, 218 aa, Heterodera glycines
  Coding regions on vcDNA: vcDNA=SeqID_57176; Strand=+; Position=1 -3,235-519,677-1045
MFFVTATYRGYCPAHDSFLYKSWLGMLNLTRAQLNDGVPDQEHPKREHQSPQKQYHLDVPLEELPQRLKMWIVPSGAGDVNADGYFQVKRIDARIWVSNEPESDSDSSSVNGDATSNGNNNKVPLSHSFAAWFHEMVTTFHHSNILSDERRTSIQQFVDELQQGFRTETGVDSLQIKLFGSVLSGFGSNDCDIDLCLINTGITKQEKVQQNGVISQEV

SEQ ID NO: 130754 - protein, 59 aa, Heterodera glycines
  Coding regions on vcDNA: vcDNA=SeqID_57177; Strand=+; Position=1-180
TKKTLNEFGNKVISAEWKKLGKMRKLYYGIGNFKTDQQRFYELLTECISLLTETDTSNV

SEQ ID NO: 130755 - protein, 95 aa, Heterodera glycines; identical to SEQ ID NO: 125597
  Coding regions on vcDNA: vcDNA=SeqID_57178; Strand=-; Position=1 -728,1221-1322

SEQ ID NO: 130756 - protein, 86 aa, Heterodera glycines
  Coding regions on vcDNA: vcDNA=SeqID_57179; Strand=-; Position=1 -68,1287-1404,3196-3268
MAIRERRRRRVISAFTERKDKKGKSGLCPPSDKNEGKVEQKAKRTDGPANANGQKESEGQLVLDESSNQEDEVFVEAHPMQPVTAD

SEQ ID NO: 130757 - protein, 41 aa, Heterodera glycines
  Coding regions on vcDNA: vcDNA=SeqID_57180; Strand=+; Position=1 -42,703-786
MHQCHCPSMFASDRKTLGKSVTDQLISGNPSLISGQSSLIN

SEQ ID NO: 130758 - protein, 278 aa, Heterodera glycines
  Coding regions on vcDNA: vcDNA=SeqID_57181; Strand=-; Position=1 -21,419-526,1105-1184,1263-1344,1856-1991,2217-2387,2746-2862,2978 -3099
  Homolog annotation: Hit_ID=CAA33463.1; Match level="QueryCoverage =39%, HitCoverage=1%, E-value=2e-27, Identity=58%"; Hit description =twitchin [Caenorhabditis elegans]
MDNKTLTSEDNTLVEWHNEIDAQRSRSLSARRDKRPEAPPKPLEWRCTKCSHEPFYTPRGLSTHMQRVHSGATHSPVRRPSIRTTIDFTAASPEPEEPKAAEPPTEVPQERWVDPLPEKLQFQQQENKFAELKCKYSRANAKVRWYKGRKELFSDGLKYKILIDKQSITLIINNPDPDDSGKYKCEANGVPTNSFFTVEDTPKGQRTRSGTAPGKSRRLAPVNNAASAGQSADKAHAQIEASFKFEKLIFVDGLSTDQLTSDGLSTDQLVMTDCPLIN

SEQ ID NO: 130759 - protein, 59 aa, Heterodera glycines
  Coding regions on vcDNA: vcDNA=SeqID_57182; Strand=+; Position=1 -72,201-308
MSQSLVDLMKHLLSTGEDADVYFLLLSAHKLILKHTSEVFAAMFRFDAKNEKAEFGKKY

SEQ ID NO: 130760 - protein, 61 aa, Heterodera glycines
  Coding regions on vcDNA: vcDNA=SeqID_57183; Strand=+; Position=1-538
NLSREFLRTLIYKQFVHFCEIYTQFKNVDGCFLAKNSFILSLFFCLCFLNNSMEKLKISMG

SEQ ID NO: 130761 - protein, 312 aa, Heterodera glycines
  Coding regions on vcDNA: vcDNA=SeqID_57184; Strand=+; Position=1 -315,564-1077,1314-1425
  Homolog annotation: Hit_ID=NP_502797.1; Match level="QueryCoverage =64%, HitCoverage=57%, E-value=9e-24, Identity=30%"; Hit description =HASI (4P602) [Caenorhabditis elegans] emb|CAB16520.1| Hypothetical protein Y57G11C.19 [Caenorhabditis ele
TLPRHQQPPPAAPQVPPVPPPRRGTKRRHPPENGDESGELRIRKRVRQARRVRVYYSPEPGPSTSAQSDEQQQQQRELFAIPSNQLTMAQRIELIYIKCNRYADPEKMEMINTTLDKLYNDPSSPAAFAGVSALWKEARKKLKQLRKKDVQHYLEGHRTYTLMRPRRVRFPRAKTVAAGFMTDVQVDLADFQALSRHNRGHRYLLVAVDVLSKCLFVVPFKNKKAEEMLEVFKELIEQMPMIPHRIFSDKGTEFKNKLLKEFFEEHEIKKHEPVHSIEKVYRKRRKPDGTTEMLVKFIGYPEREWIDESQIV

SEQ ID NO: 130762 - protein, 252 aa, Heterodera glycines
  Coding regions on vcDNA: vcDNA=SeqID_57185; Strand=+; Position=1 -102,160-249,308-388,444-524,584-673,732-812,869-1099
  Homolog annotation: Hit_ID=AAB68048.1; Match level="QueryCoverage =96%, HitCoverage=52%, E-value=1e-12, Identity=26%"; Hit description =proline-rich protein PRP2 precursor [Lupinus luteus]
MFPDDDGYESEDDEILLPPPPIPPQLGHPPPNVPAVRVQPMHVGQQRLPLRDLPQFEDHPQNVPAVRVQLMQQPLPLRDLPQIFHPPPNVPAIRVQPMQQPVPMRAVPQFLHPPPNAPEMGVGPIHDGQQPLPLRALPQFAQPPPNVPAVRVQPVQQPIPLRDVPLFVNPPPNVPVIRVQPMPQPLPLRDMPQIHHPPRNVTSIRIKLWLLFLSLWVFLQGIHVRQIQREYAVPQFAHPPPNLPYHPPENVP

SEQ ID NO: 130763 - protein, 267 aa, Heterodera glycines
  Coding regions on vcDNA: vcDNA=SeqID_57186; Strand=-; Position=1 -295,388-668,793-1017
MRKLRYPNNVGKRPEIAGETSKARKEVALDGGAFVGVEIDAEKMVGKLNFYAAGILYKEKDENVQPIEKVPDEKVPIGKWHKFEGQEIELMPREIDMTDENDNICIEFLALADADEMKDDAHFKMDDKERIQAKLGKYICKNMKENEKNKQKDPKKLNCKFDWTTVDDVQFYAEEAMGEMREKFGITYKKLAESFLSDDLADLGIKGKSSNKIYRTKDEKFLLKQIPQPYQMETMERTLKDYLKHMMQMGDKSFINKIFFVFRVEIE

SEQ ID NO: 130764 - protein, 56 aa, Heterodera glycines
  Coding regions on vcDNA: vcDNA=SeqID_57187; Strand=-; Position=1 -78,773-865
MGHCASKDQKDQKRHNRRIEEQLRKEDFAQRWLLKAGFAADKACGVEVRNGICSVL

SEQ ID NO: 130765 - protein, 83 aa, Heterodera glycines
  Coding regions on vcDNA: vcDNA=SeqID_57188; Strand=-; Position=1 -40,626-837
MGFGPFGAVVPKSGAMLFGAGKTVADDRSPPKRRRRDMAGQNVAETKRRRDRTPPRQNVAETKRRRDKTSPRQNVAEKKYSKN

SEQ ID NO: 130766 - protein, 32 aa, Heterodera glycines
  Coding regions on vcDNA: vcDNA=SeqID_57189; Strand=-; Position=1-96
HLELCSKRYQELKNIVIKAERRLLNVLGFVVH

SEQ ID NO: 130767 - protein, 33 aa, Heterodera glycines
  Coding regions on vcDNA: vcDNA=SeqID_57190; Strand=-; Position=1-101
RDVLNVYNRLKQIHHRRNAVASQQPEDLQKLSK

SEQ ID NO: 130768 - protein, 419 aa, Heterodera glycines
  Coding regions on vcDNA: vcDNA=SeqID_57191; Strand=-; Position=1-1259
  Homolog annotation: Hit_ID=XP_479365.1; Match level="QueryCoverage =34%, HitCoverage=10%, E-value=8e-11, Identity=30%"; Hit description =helicase-like protein [Oryza sativa (japonica cultivar-group)] dbj|BAD32013.1| helicase-like protein [Ory
MTFGYNPNVPAEVILLPVHFPGHWTLIVHDVQWGTHFADSLPTPYGRLDWQLTDKIGKIISDILPSAVLTGIFNAVNLTVQHDGNSCGYFVCLYAESWLMNNCTFVLPDLNINYEKKRILWHINELYGSDIVPFHPREGVSTSFAVVSHHNGDVAQTSSKVIMPMEVDDSAVLPSSEDTAVLAQAPVIGENQADTHGVVADTIVQQEPIAQADDVIFIRPKTPPRRSMRVQKRLSASVSRSPSPAPKRPPPANSLGVATPITRRCSAFHKGWQCAAAAAKHFPEYCDSGKLGDKKCADCGAHLFSHEDSSICCRKGRVVLPMLNPHPDELKELIVGNKQSREGKEFVRHMSRYNNLFQFASVSAGNKPSPAGGPMAVILNGEFHRRISSMQAGTTQIPGFGQLYILDPVEAMEQRRNNP

SEQ ID NO: 130769 - protein, 29 aa, Heterodera glycines
  Coding regions on vcDNA: vcDNA=SeqID_57192; Strand=+; Position=1-87
MGCTMSQEERAALERSKMIEKNLKEDFVH

SEQ ID NO: 130770 - protein, 55 aa, Heterodera glycines
  Coding regions on vcDNA: vcDNA=SeqID_57193; Strand=-; Position=1-297
FIFKCQCYSRAVPSFTFEFAHFSFGLAGCWEVIWHSFPIWSHFLLQIHFKILIYP

SEQ ID NO: 130771 - protein, 290 aa, Heterodera glycines
  Coding regions on vcDNA: vcDNA=SeqID_57194; Strand=+; Position=1 -172,220-272,416-649,699-872,922-1158
  Homolog annotation: Hit_ID=NP_510425.1; Match level="QueryCoverage =97%, HitCoverage=32%, E-value=1e-23, Identity=31%"; Hit description =insulin-like growth factor binding protein acid labile family member, SYnthetic lethal with Mec SYM-5 (sy
ANPSLVMLDLSRNELIDLSPGTFLSQLNLLLVDLSFNKIVRTPFGAFGRRIATVLLQENPLVCVEQIHMLQQGNGSLSADQIEDNASEETEAAEESAFVQQQSTTPPKGSTDQFAETIETTINGHKMGKMPNIRPIQIGHKQRQKAATTQVNAVPSADGFVAESSPSAELTEQNAKLMQQNQKNNGAELDQFSLEGNEIRHQQRKDSKVTKEINSGPIPLNEKIENGEGISKVRDRTAETESQTATDTVIGELTDAPSSTTVDPRNDPAVIYPHPVPFLATGPKLHTAHS

SEQ ID NO: 130772 - protein, 66 aa, Heterodera glycines
  Coding regions on vcDNA: vcDNA=SeqID_57195; Strand=-; Position=1 -13,1323-1510
MFIIKLCAASNSLKLHNFMLIILFVIYYFVEKQSKANFRPFRNLRLNKRADSGLKASLMFIRTERI

SEQ ID NO: 130773 - protein, 268 aa, Heterodera glycines
  Coding regions on vcDNA: vcDNA=SeqID_57196; Strand=-; Position=1 -351,657-884,1391-1512,1846-1952
NDDGIMVNNKVCGAHHYRRRAPSIPNITIDDYSTTNNNNNNNDAGVNEAVNGGKMGAAIPLPAPAIPLPAPEGMNEDNQIVDQQSSSVIENWAFRAQEYRKSAFDTSLEPTDPEKSPVEHQSQHQNNEALNQANKNVVVVVDNDRNSACERAELDEHVEEKQHNYGIKQTTADDIDLLQLLDETEHLTEQLRSERDGLMLNMQRILARCNTVNISIETPRDQHQFKALEQVNKMIQSVLDHTNGNIAESKQKIAAFLNACHPDEVGRY

SEQ ID NO: 130774 - protein, 39 aa, Heterodera glycines
  Coding regions on vcDNA: vcDNA=SeqID_57197; Strand=-; Position=1-118
MPIRKRKCQSENSEKRMKNDVTICFILEKTELDIRHLSD

SEQ ID NO: 130775 - protein, 36 aa, Heterodera glycines
  Coding regions on vcDNA: vcDNA=SeqID_57198; Strand=-; Position=1 -92,704-722
MQNSKVECRRSADGAKSRTQESQTRLEKSLGFKNQR

SEQ ID NO: 130776 - protein, 257 aa, Heterodera glycines
  Coding regions on vcDNA: vcDNA=SeqID_57199; Strand=-; Position=1 -302,349-490,540-702,746-912
MSSGKGMVVAVEPVAEHQQQQQTDDSIAEEVFSEDIVSTFKPSEKSLHSILSLRSNSMSTSARDSMGKLRRDSASEALLKLRTMNCVPELRSPRESKSPPKPLRSPRGIDRFMAKFPHNSSREASFSEELSVKGEMLEELPNASQIGMLFDVSGASVEGTLSKLDSTADSKRGQSDIFLGTDFVESNKMERGNSLGGFGVPEVCSAGVKARAEKTSHVQLDTNRILLAQFVYDHLNIWPTQEMLMETDLEVIKGLRI

SEQ ID NO: 130777 - protein, 226 aa, Heterodera glycines
  misc_feature (10)..(10): Xaa can be any naturally occurring amino acid
  Coding regions on vcDNA: vcDNA=SeqID_57200; Strand=-; Position=1-665
  Homolog annotation: Hit_ID=CAD22154.1; Match level="QueryCoverage =98%, HitCoverage=51%, E-value=1e-45, Identity=44%"; Hit description =pherophorin-dz1 protein [Volvox carteri f. nagariensis]
PQIPPSPFPXPVPPLPPSPFPSLPSFPLGSFTPVPPVPLPPLSPEVPPLRPSPSPEVPPLRPSPSPEVPPLRRSPSPKVPPLRRSPSPKVPPLPPSLFPSVPPVPPVPLPLLSPEVPPLRPSPSPEVPPLRRSPSPKVPPLPPSIFPSVPPVPPVPLPPLSPEVPPLRPSPSPEVPPLRPSPSPEVPPLRRSPSPKVPPLPPSLFPSVPPVPPVTMPPTFPHCSRV

SEQ ID NO: 130778 - protein, 60 aa, Heterodera glycines
  Coding regions on vcDNA: vcDNA=SeqID_57201; Strand=+; Position=1 -72,106-342
  Homolog annotation: Hit_ID=AAG45420.1; Match level="QueryCoverage =100%, HitCoverage=17%, E-value=1e-09, Identity=54%"; Hit description= vegetative cell wall protein gp1 [Chlamydomonas reinhardtii] sp|Q9FPQ6|GP1_CHLRE Vegetative cell wall pro
PVPPLPPSPFPSLPSFPLGSFTPVPPVPLPPLSPEVPPLRPSPSPEVPPLRRSPSPKVPP

SEQ ID NO: 130779 - protein, 220 aa, Heterodera glycines
  Coding regions on vcDNA: vcDNA=SeqID_57202; Strand=-; Position=1-660
  Homolog annotation: Hit_ID=YP_108245.1; Match level="QueryCoverage =99%, HitCoverage=45%, E-value=3e-14, Identity=19%"; Hit description =putative outer membrane protein [Burkholderia pseudomallei K96243] emb|CAH35630.1| putative outer membran
MTNSQTVGAEVRGTRSGEETSGAEVCGTRSGEETVGAAVRGTRSGEETSGAEVRGTRSGEETVGAAVRGTRSGEETAGAEVRGTRSGEETSGAEVRGTRSGEETVGAAVRGTRSGEETSGAEVCGTRSGEETAGAEVCGTRSGEETSGAEVCGTRSGEETIGAEVRGTRSGEETVGAEVRGTRSGEETVGAEVRGTRSGEETSGAEVRGTRSGEETIGAE

SEQ ID NO: 130780 - protein, 254 aa, Heterodera glycines
  Coding regions on vcDNA: vcDNA=SeqID_57203; Strand=-; Position=1 -606,657-815
  Homolog annotation: Hit_ID=NP_701342.1; Match level="QueryCoverage =81%, HitCoverage=18%, E-value=2e-16, Identity=33%"; Hit description =MAEBL, putative [Plasmodium falciparum 3D7] gb|AAL10509.1| erythrocyte binding protein 1 [Plasmodium falc
KKRLEQLCAEHVLEKKRLEQKCAEHVLEKKRLEQLCAEHVLEKKRLEQLCAEHVLEKKRLEQKCAEHVLEKKRLEQLCAEHVLEKKRLEQKCAEHVLEKKRLEQLCAEHVLEKKRLEQKCAEHVLEKKRLEQLCAEHVLEKKRLEQKCAEHVLEKKRLEQKCAEHVLEKKRFEQKCAEHVLEKKRLEQKCAELVLEKKRSQQVSLPQRFGNWLLSMLQGPAAHQLFFELMSSENFSVRAAPTDVPPMSALAPSL

SEQ ID NO: 130781 - protein, 417 aa, Heterodera glycines
  Coding regions on vcDNA: vcDNA=SeqID_57204; Strand=+; Position=1 -206,1055-1152,1342-1487,1551-1649,2313-2466,2604-3152
  Homolog annotation: Hit_ID=NP_963859.1; Match level="QueryCoverage =50%, HitCoverage=96%, E-value=3e-23, Identity=34%"; Hit description =hypothetical gene supported by BC039313 [Homo sapiens] dbj|BAC87637.1| unnamed protein product [Homo sapi
MTLSLMLGLKILVSFTHVVRVHDVVETHRLRQKKAAVMETGDAKQRIAEKKLAIWSGHFSKVLLLFCTHPFSSPAAAAAEKSQSKENPTDHFVGKELYLRNAKCRLSEHELSWNAFSYCKTELTNPDYRKDDFLIRIETMHLSDRGTTKNALGLSKGVLNERKVVCIDIANDKISECREKCPPVGIMDRTAVYDQWAAKEQMIKGTAPEHSSVAHQSERRERRNSRSSSVRRKVERVPHTSAPTVSSPERVPRTSARTVSSPERVPHTSAPDVSSPERVPHTSAPDVSSPERVPRTAAPTVSSPERVPHTSAPDVSSPERVPRTAAPTVSSPERVPRTSAPTVSSPERVPRTAAPTVSSPERVPHTSAPDVSSPERVPRTAAPTVSSPERVPRTAAPTVSSPERVPRTSAPTVSSPE

SEQ ID NO: 130782 - protein, 63 aa, Heterodera glycines
  Coding regions on vcDNA: vcDNA=SeqID_57205; Strand=+; Position=1 -43,205-353
MDWININLNKIKTKFFQRLTGDPPLGFKPSLSQKSRQCTSKRLKKANDKNEEIPYQNYYFLFT

SEQ ID NO: 130783 - protein, 101 aa, Heterodera glycines
  misc_feature (87)..(87): Xaa can be any naturally occurring amino acid
  Coding regions on vcDNA: vcDNA=SeqID_57206; Strand=+; Position=1-305
MIGRAVRNRPFIFEGIFKFILYPRKMAISFFEKFYTSQKRLRMRRRAVHNRHFISQRIFIFRGYPRKMAISFFDKFYTHTNALEHDXGGRCAIYLLFLREF

SEQ ID NO: 130784 - protein, 45 aa, Heterodera glycines
  Coding regions on vcDNA: vcDNA=SeqID_57207; Strand=-; Position=1-135
KIPSKIKGLLRTALPIMLESICMCIKFIKKRDSHFSGIEYKYKNP

SEQ ID NO: 130785 - protein, 38 aa, Heterodera glycines
  Coding regions on vcDNA: vcDNA=SeqID_57208; Strand=+; Position=1-119
AAANRKLRNDVATECANVAIHRQQQQQQKNGSAIIMQT

SEQ ID NO: 130786 - protein, 70 aa, Heterodera glycines
  Coding regions on vcDNA: vcDNA=SeqID_57209; Strand=-; Position=1-415
  Homolog annotation: Hit_ID=AAP30767.1; Match level="QueryCoverage =100%, HitCoverage=52%, E-value=6e-19, Identity=71%"; Hit description= putative gland protein G21E12 [Heterodera glycines]
KGDGAAAADKKEEKRKDKHKSKEGKSDDSNRRSKKDKHGKKDKKDKKKDAAEPAANAGEQSTAETTQADE

SEQ ID NO: 130787 - protein, 39 aa, Heterodera glycines
  Coding regions on vcDNA: vcDNA=SeqID_57210; Strand=+; Position=1-118
VRLGYSNNYGEQKSHAELSTGYREAIPEGFDLPINLGAS

SEQ ID NO: 130788 - protein, 53 aa, Heterodera glycines
  Coding regions on vcDNA: vcDNA=SeqID_57211; Strand=-; Position=1-168
IYQSAKNRMRSNPKKNGLSKNRNYAQKVSQTILALPIPSTIAFIHPFMSAKII

SEQ ID NO: 130789 - protein, 141 aa, Heterodera glycines
  Coding regions on vcDNA: vcDNA=SeqID_57212; Strand=-; Position=1-438
NRNYAQKASQTILALPIPSTIAFIHPIMSAKIIRVPKIACDLSLAKNGVSKNRNYAQKASQTILALPIPSTIAFIHPIMSAKIIRVPKIACDLSLAKNGVSKNRNYAQKAPQTILALPIPSTIAFIHPIMSAKIIRVPKIA

SEQ ID NO: 130790 - protein, 95 aa, Heterodera glycines
  Coding regions on vcDNA: vcDNA=SeqID_57213; Strand=-; Position=1-285
MVRIKQSFPSEDQCSSSSLHDNDSRPSNDQTGSKLPFKKADEPVQSSGEKKRLKTFENEHLNKKRKLQDTEQENVINLDLIDLEDINMDMIDLNE

SEQ ID NO: 130791 - protein, 37 aa, Heterodera glycines; identical to SEQ ID NO: 127515
  Coding regions on vcDNA: vcDNA=SeqID_57214; Strand=-; Position=1-117

SEQ ID NO: 130792 - protein, 102 aa, Heterodera glycines
  Coding regions on vcDNA: vcDNA=SeqID_57215; Strand=+; Position=1 -211,498-595
MTHLVPKLRSETAEDFEQILLFLCQVRLTITQFKDCDDKKGPSRAGLSISVLQKRCRRVGNLDFGKATYSGREIFKSSPAKNCFLGILSTCSFRPTAGQVRQ

SEQ ID NO: 130793 - protein, 136 aa, Heterodera glycines
  Coding regions on vcDNA: vcDNA=SeqID_57216; Strand=+; Position=1 -67,181-257,590-709,954-1100
MYRNSDFFHFYSTMVPPHPQKYNKVCTHSFNTLCRKSQRLLDEEIKKSSTKQFPISATHFIFWICEIIPHRKDSDSSRSWIPPIHCHQSSFVITRRKAWPLCSHLALSLALCWLFSPPIFSFGNPPPFAHSSKGSE

SEQ ID NO: 130794 - protein, 142 aa, Heterodera glycines
  Coding regions on vcDNA: vcDNA=SeqID_57217; Strand=+; Position=1 -212,346-562
MGSIDAPEHTSPWTVLLIFTTQCPTGEKLQDRCTGFIVSHDLILTASHCAFMSYNEIELRCRYEAETHKQCKKGEGYHCEEAQMKNENTNDRMGKMVVLNSLAVTEVESVNYLQENKQKHEYSVFNSIQLTFSVEKIYSETK

SEQ ID NO: 130795 - protein, 75 aa, Heterodera glycines
  Coding regions on vcDNA: vcDNA=SeqID_57218; Strand=-; Position=1 -69,984-1142
MKATNKYLNYRIVKFKGEAILQLCVFGPGWKRTCRVGYWIFKKLGPGTGLEKAGYPGLDPVWYLDPSDPSIYQKC

SEQ ID NO: 130796 - protein, 40 aa, Heterodera glycines
  Coding regions on vcDNA: vcDNA=SeqID_57219; Strand=-; Position=1 -83,380-419
MALFESRGIVLQQCVDFDRRRRRTYQRMHGCFQRWFVNGP

SEQ ID NO: 130797 - protein, 21 aa, Heterodera glycines
  Coding regions on vcDNA: vcDNA=SeqID_57220; Strand=+; Position=1-66
ICGQSVVQAASDVRGCERPHA

SEQ ID NO: 130798 - protein, 177 aa, Heterodera glycines
  Coding regions on vcDNA: vcDNA=SeqID_57221; Strand=-; Position=1-535
  Homolog annotation: Hit_ID=CAB40395.1; Match level="QueryCoverage =99%, HitCoverage=70%, E-value=2e-36, Identity=43%"; Hit description =TATA binding protein of transcription factor IID [Guillardia theta] gb|AAK39780.1| TATA binding protein of
PIIKNCVAVVDLKIPLDIEKIYLISPSTKYNPRKIHAVIMKVYNPNATAIIFSTGKFVCTGAANEKECRQAAEQVTERIRQCGYYEARIHEFAVKNLIVTADVGFHIRLGPLSDFLRAKYCSFTPELFPGLVYRNKSPKVSIIVFSSGKLNITGSKSKTEIDSVFNKFYSLLCNFKH

SEQ ID NO: 130799 - protein, 79 aa, Heterodera glycines
  Coding regions on vcDNA: vcDNA=SeqID_57222; Strand=+; Position=1 -148,502-593
MDRLDTIIASLLNCSARNLCDRLNHPDEIQKVEKYLKGKTLQTTYKNQLESISVFDLLPVIFNFPLEKTMMETLGLLFR

SEQ ID NO: 130800 - protein, 379 aa, Heterodera glycines
  Coding regions on vcDNA: vcDNA=SeqID_57223; Strand=+; Position=1 -64,288-357,416-468,528-569,1187-1211,1366-1395,1699-1725,2240 -2434,3054-3156,3308-3403,3724-3761,3808-3831,3901-3953,3998-4109
  Homolog annotation: Hit_ID=CAE64502.1; Match level="QueryCoverage =99%, HitCoverage=74%, E-value=1e-139, Identity=67%"; Hit description= Hypothetical protein CBG09229 [Caenorhabditis briggsae]
LRFRENVQADAIRYVLERGDSCFTEYIGRNGGFQDIIIGSECAEEYVVAHETGHALGYWHTHEYVVAHETGHALGYWHTHQQRPDREKYISINWRNVLEEATASFMPFRSMLQAFGIKQVGGFLIRYDYGSLMHYHAVAHARQVSDFTIVPKELKYVTTMGTERMAFLDAKVINGCLYKRMMCPGHTLRCQSGGYPDPNNCNVCRCPEGLGGTECERLQPSNCGAELQASDQWQTLRSPNGKDIQCYWRITVSEGSRVRFRLSDGEFPCSYGCQFPCSYGCQSYVEIKHKLDVRLTGFRSYVEIKHKLDVRLTGFRSCCYRPKEDTVSDGNQIFVIFRPNGSCCYRPKEDTVSDGNQIFVIFRPNGRTARFSLRFIRQA

SEQ ID NO: 130801 - protein, 40 aa, Heterodera glycines
  Coding regions on vcDNA: vcDNA=SeqID_57224; Strand=-; Position=1 -43,1162-1241
MLKLLISLLILNVQTNSTADNLPRGPDNPSANFNKLFFFI

SEQ ID NO: 130802 - protein, 333 aa, Heterodera glycines
  misc_feature (328)..(328): Xaa can be any naturally occurring amino acid
  Coding regions on vcDNA: vcDNA=SeqID_57225; Strand=-; Position=1-1012
  Homolog annotation: Hit_ID=AAV44035.1; Match level="QueryCoverage =90%, HitCoverage=19%, E-value=6e-40, Identity=36%"; Hit description =putative helicase [Oryza sativa (japonica cultivar-group)]
DSSGGKTVIFSGDFKQSLPVVPHEGLTAQVTACFQTSPLFGQFTTMKLTINQRLQGQQAYLQMCRQIGLGETGEHWIPPQFLVKSKEELIDYVYPNFQQLLGNDKELLNRLILAPHIDTCDEVNEIMMANVPGQVREYLSTDKPLDDRPLDIDEIESEVAALNRRTDSGMPPHSLRLKVGCVVVLLINKSDKEGLINGTRIVLEELGDDRLIGRVINSNAIGGQVRFFLKEHEMSMKTNRLAIKYERLQFPIKPAFAMTIQKGQGQTIRTVGIDLEKEVFSHGQLYTAFSRATDGNNVRVHAPNREIDALGRAKVLIIVATHMLKLQXMSNSP

SEQ ID NO: 130803 - protein, 49 aa, Heterodera glycines
  Coding regions on vcDNA: vcDNA=SeqID_57226; Strand=+; Position=1 -116,168-201
MSPSICPCSVPTTNFCFSPAFPPKCHRRRRAKMRKHFNTSTTAMCSFFS

SEQ ID NO: 130804 - protein, 392 aa, Heterodera glycines
  Coding regions on vcDNA: vcDNA=SeqID_57227; Strand=-; Position=1-1179
MVAKTPLQALLGIFLLRSGVASSLTAAQTLVEVIVKAQPKLELCMYFGKRGDQISSGKYPTEEDQRKALEKWAGSCYVARQALAATGFNPLEMEEPEGVNSLPESEKLKWKEVFGQSAWALECVRATVVHKAGRFLAHQRVLLGDSSAAALSQYIPNSFCIGQEGSMADIIRQFQPTILSSRVKAMLIITGRDSLVAGETAESIAEQFEMVVELCRRFSHVKIYWCPPPYVHNKSAEYDQLIDKMRALINNGPIISICITEKGRSVLEIFRFGDHFNKYLVTDDGKMRNPGCKILKAWIFSQSSFPGDIELSVRTLKSAVGVPSRDQADPRSDTTTAVPRDRVGPRRDQNPSFRILHGRRGSVRYQPYQGHLHGPARVRDSDRRNDGRPHRR

SEQ ID NO: 130805 - protein, 80 aa, Heterodera glycines
  Coding regions on vcDNA: vcDNA=SeqID_57228; Strand=+; Position=1-245
RKKITASNELVVEQDEGVAKAKPPNEHRYKRAAKDENENDAFGEDDGDENDYDGGEDEHGIWLNWRAKKRDNQSNKLGGG

SEQ ID NO: 130806 - protein, 524 aa, Heterodera glycines
  Coding regions on vcDNA: vcDNA=SeqID_57229; Strand=+; Position=1 -46,92-237,297-485,547-675,738-995,1060-1119,1282-1611,1684-2100
  Homolog annotation: Hit_ID=XP_395558.1; Match level="QueryCoverage =88%, HitCoverage=35%, E-value=5e-17, Identity=23%"; Hit description =similar to CG15792-PA [Apis mellifera]
MESLNMDAGLSLNSSGHSTFALAEKENQIEQMRRKLRVLESDNAELRTTLPRLKDAQGKDCTGEMIKMNKELLSAKEQCERWRTDYMELTKKYDMFEKSTITQLDQKDKQMTQLRHQAMEMEEENGKLREKLENEKSRVWHLQRGEFEDQLATPKAVQNEGADDQLSTPKAHNQMLANIMSKIPQNVDVVEDTYLCNVDDAEQLAAHLLMILETLDKNFHNANELQNDIFTFLASHSICSNNPEKFALLNSVYKKVTDNRLAQIRAGNEQFRSNMSTSTPEMDNDQNLTSGSFFAGNVTCRTSTLLEVCVRMFEKLRGTVEFFQNLLKILGVSAEELGEDIAKKLEAMKLDLDVSVGEAQSMLSEGGGLAAIEDSFAQCRVEREQQINDMKVEIETMRKSQQDVEQKQFKLEQSLAEERDRMLKVTAERDAFARELRDRETEVERLNSEMKELQKQTEELDRMKQMLQSEVEKMVGHCQNSSQKHIHNCTFFKDQLGTEGESAGAQSGGVGQNFRHDVSVLNAY

SEQ ID NO: 130807 - protein, 104 aa, Heterodera glycines
  Coding regions on vcDNA: vcDNA=SeqID_57230; Strand=-; Position=1 -131,249-429
MKLVHPEPLPVERKLLMKTLNCANLCVFPFVRVEPPTKSAEEIFLSSSSSRFHQQHQQQRYTFRAREICEALLQDDDDEEQFGGPSSVMERNSKFGQTQNGWPN

SEQ ID NO: 130808 - protein, 174 aa, Heterodera glycines
  Coding regions on vcDNA: vcDNA=SeqID_57231; Strand=-; Position=1 -30,60-554
  Homolog annotation: Hit_ID=CAA71047.1; Match level="QueryCoverage =37%, HitCoverage=17%, E-value=7e-21, Identity=69%"; Hit description =transcription factor AP-2 beta [Homo sapiens]
MERTTVIFLLSTTATTTTKLSSSSTWITTDVEETGTDDSSSSSNSSSSSSQSVVVVMPPASDQLQSSPVIVPFLPPIGALITIDQQQQQQQQQFHPINNYETYCSVPGRLTLLSNQKKYRVSVGEIQRRLAPPECMNASILGGILRKAKNKDGGRLLREQLHVRVLGNFGMCRI

SEQ ID NO: 130809 - protein, 203 aa, Heterodera glycines
  Coding regions on vcDNA: vcDNA=SeqID_57232; Strand=+; Position=1 -60,295-426,467-575,624-934
MSTDTLKVQLNGWEWVRTFRAQAKLHAFVSSCNKRLHSQRGQIDQFSEATLGRVQKMNNIMGDQKESTSSMRVHLNATLNDAQSMVDRFAHSDYKRVIATGVTPVRRRNSFSEELVELPPAQELIQSQQQLCTPRRTSFYRTRDSILDSSDFLTSLLSPNTLKENMNSTKMDEAGKLETIGESIERTASSTLSCSSRTEKRGK

SEQ ID NO: 130810 - protein, 85 aa, Heterodera glycines
  Coding regions on vcDNA: vcDNA=SeqID_57233; Strand=-; Position=1 -96,273-434
  Homolog annotation: Hit_ID=ZP_00149456.2; Match level="QueryCoverage =89%, HitCoverage=18%, E-value=1e-11, Identity=50%"; Hit description =COG4826: Serine protease inhibitor [Methanococcoides burtonii DSM 6242]
MATAFTDGANFGGISAEEPLLISEVVQKAFIEVNEEGTVAAAATAKNVRYCSSSPGKEYRFVADHPFCVFLTRDDTVLFSAIFRK

SEQ ID NO: 130811 - protein, 157 aa, Heterodera glycines
  Coding regions on vcDNA: vcDNA=SeqID_57234; Strand=+; Position=1-621
GQRVSGGRPLASGAAPSPDGHRVDGLLLSRSRTWEPPFFLYPNLLLGCVECFPNRQQRLAAGRTAEDLYERTVRRLWELEHQHGCELHTVWACEWKERLRRDPALRGRYEHVFVPRPLDPRSDALRGGRTEPFKLHHVCAEGEEILCIDVVSLYPYV

SEQ ID NO: 130812 - protein, 59 aa, Heterodera glycines
  Coding regions on vcDNA: vcDNA=SeqID_57235; Strand=+; Position=1 -83,502-597
MPIPGVLSQQIRGRGEHSKGCESVGERSVIARVGPLYGEGDRRSLVCDAILLTHRFGAV

SEQ ID NO: 130813 - protein, 20 aa, Heterodera glycines
  Coding regions on vcDNA: vcDNA=SeqID_57236; Strand=+; Position=1-60
MKDSKVIVAINKDKDAPIFQ

SEQ ID NO: 130814 - protein, 321 aa, Heterodera glycines
  Coding regions on vcDNA: vcDNA=SeqID_57237; Strand=-; Position=1-964
  Homolog annotation: Hit_ID=NP_608540.1; Match level="QueryCoverage =100%, HitCoverage=69%, E-value=1e-43, Identity=33%"; Hit description= CG2839-PA [Drosophila melanogaster] gb|AAF51469.2| CG2839-PA [Drosophila melanogaster]
ESGKERARGTDCGRESGRERGREQKVELKVEEEQKVELKVEEKVEEEQKVEEKEKVEEEQKVEEKVEEKEKVEKEKVEEKEEENRKWKRKRKRTESGRERECGKESKRNRKWKRNRKWKKNRKWKRKRKWKRKRKRNRKWNRKWKKKWKRKRKRTESGRESERGTESGRESGRESGRRTERGRESGRERERGTESRRESGSERGREQKVELKVEEKVEEEQKVEEKVEEKEKVEEEQKVEEKVEEEQKVEPKVEEKEQEEPKVEPKVEEKQKVEEEQKLEEKVEENRKSEKRKSGKERGREQKVGEKEKEEPKEEEKVEEK

SEQ ID NO: 130815 - protein, 112 aa, Heterodera glycines
  Coding regions on vcDNA: vcDNA=SeqID_57238; Strand=+; Position=1 -225,449-562
MSIYLQLCGLVALLLTVQCWPNPLFPFCLGRVVDFFQLFNAVCVHGFFLVGTFFLALAHLFSAPDAFYHYNFQLLFVTFAGFGLYAFDFWTRWKRDSQLRKEHQQNQSVYIT

SEQ ID NO: 130816 - protein, 151 aa, Heterodera glycines
  Coding regions on vcDNA: vcDNA=SeqID_57239; Strand=-; Position=1 -238,490-707
MMEIPDRLTNPKKTPKRTHHCRRPTYLTHQESTCTRLKCVPCKPNQKGRAMIRDRIASMPLFKNDKIYLAILDNAQFTYYFNCGMIHIGFLSNYKPKTPNDTICKIRMEMDGKASDDSGLAAVRRRGTPPPGKASEVKTTPLYVVKSYQIP

SEQ ID NO: 130817 - protein, 58 aa, Heterodera glycines
  Coding regions on vcDNA: vcDNA=SeqID_57240; Strand=+; Position=1-197
FGPRGRLGPNPKIEKCAFLKIKILKTKPEGSLVTCHKLGSINIRSCFTILLIPNPIIF

SEQ ID NO: 130818 - protein, 168 aa, Heterodera glycines
  Coding regions on vcDNA: vcDNA=SeqID_57241; Strand=+; Position=1 -65,109-550
MAVAALDTEFGNLAVFQPLIDWLLINYVGQPRPNGTWSQPTFRPEQWNVYTRTLNADARTNNHSEAEHHRLQGAFNCRHPSIFHFIDVLRREQKTTDVKYASFIAGEEPPPKKRKFLATDERILNLVRLYVPMNAGNINHDHNYHNRNQFHIILEFLRGISRNYRMNP

SEQ ID NO: 130819 - protein, 236 aa, Heterodera glycines
  misc_feature (28)..(28): Xaa can be any naturally occurring amino acid
  misc_feature (35)..(35): Xaa can be any naturally occurring amino acid
  misc_feature (122)..(122): Xaa can be any naturally occurring amino acid
  Coding regions on vcDNA: vcDNA=SeqID_57242; Strand=+; Position=1 -212,492-689,920-1024,1084-1288
  Homolog annotation: Hit_ID=CAA22457.1; Match level="QueryCoverage =85%, HitCoverage=38%, E-value=1e-66, Identity=63%"; Hit description =Hypothetical protein Y54G11A.5b [Caenorhabditis elegans] pir||T27177 catalase (EC 1.11.1.6) Y54G11A.5b - C
SPVDFASQQMNEYKSTKGAVSHFVFRSXAFPFLRXKMEVLTMSNGSPIPHNKNAVLSVGPHGPMLMQDVVYLDEIAHFDRERIPERVPERVVHAKGARAHGYFEVTRDMAEHCKAAMFSEIXKRTPLFIRFSRVGGESGSADTARDPRGFAIKFYTEEGNWDLVANNTPIFIFFIRDPFLFPNFIHSQKRNPATHLKDPEMVSWNNQWREKGIMGMGYMLWQEPPKEGLRRSGHEG

SEQ ID NO: 130820 - protein, 28 aa, Heterodera glycines
  Coding regions on vcDNA: vcDNA=SeqID_57243; Strand=-; Position=1-86
VKINRNSRVHSIVARNSPEKLQNNVKLI

SEQ ID NO: 130821 - protein, 17 aa, Heterodera glycines
  Coding regions on vcDNA: vcDNA=SeqID_57244; Strand=-; Position=1-50
CKAYNFFHCARLFEKMG

SEQ ID NO: 130822 - protein, 321 aa, Heterodera glycines
  misc_feature (16)..(16): Xaa can be any naturally occurring amino acid
  misc_feature (284)..(284): Xaa can be any naturally occurring amino acid
  misc_feature (312)..(312): Xaa can be any naturally occurring amino acid
  Coding regions on vcDNA: vcDNA=SeqID_57245; Strand=+; Position=1 -145,197-309,363-508,551-684,731-1046
  Homolog annotation: Hit_ID=P90682; Match level="QueryCoverage=89%, HitCoverage=45%, E-value=1e-63, Identity=48%"; Hit description =Catalase emb|CAA71618.1| catalase [Ascaris suum]
NDGMPSIRTILRLPIXLMTLEEASHFRWNPFDVTKVWPHRLFPLLPVGRIVLNRNPQNGRIVLNRNPQNYFAEVEQSAFAPSRIIDFSSDKMLLGRLFSYPDTQFHRLRLFSYPDTQFHRLGPNFMKLPINCPFRSRVSNTQIDGLACPDDNGGGTPVYHPNSYGRPPVYHPNSYGRPKELATANESAFSVSGDVARFNSGDEDNYSQPKMLWLKVLDEDHRKWLKVLDEDHRKRLVANISASLKSTSRPVQERASEFGKVSADFGSALQAELEKGCQSRQEQXESDEETNCELKIINWHMTSCNQTTRTNXIKLIAYANY

SEQ ID NO: 130823 - protein, 136 aa, Heterodera glycines
  Coding regions on vcDNA: vcDNA=SeqID_57246; Strand=-; Position=1 -71,523-606,930-1007,1441-1492,1629-1757
  Homolog annotation: Hit_ID=NP_501248.1; Match level="QueryCoverage =100%, HitCoverage=25%, E-value=6e-35, Identity=55%"; Hit description= inorganic phosphate family member (4I419) [Caenorhabditis elegans] gb|AAK29824.1| Hypothetical protein F
NKKASSINSLNTSFRPHHHQQAVLLPSMRLLLALCLCLVYITVSVSSSNIAVAVICMIKCERRHGYHGTLEWETDKEGLLLAAQNIGSLFMLATGFFADRINGKWMVAVGLALCGGNLTLPFVASQIVWYAFGARI

SEQ ID NO: 130824 - protein, 188 aa, Heterodera glycines
  misc_feature (178)..(178): Xaa can be any naturally occurring amino acid
  Coding regions on vcDNA: vcDNA=SeqID_57247; Strand=-; Position=1 -24,367-459,741-806,863-1005,1429-1589,1790-1839
  Homolog annotation: Hit_ID=CAE69480.1; Match level="QueryCoverage =96%, HitCoverage=48%, E-value=6e-51, Identity=55%"; Hit description =Hypothetical protein CBG15682 [Caenorhabditis briggsae]
FSAELATFFSSQRYLDHSMDNIRRCREYRKFQAMQYDQRFLPDRLIFLGADLAAAHFIVHRHGSVKFVGDDHGSVKFVGDDHWYKREGRAGTYYLPGTKTEGFYVEAIDASGTELMFEGFDNLYDLEFLRMLSLRDCRWIDDWVLSRIGGMFANTLEMLDLSNCHRISAKGQVLLRKXNLLHFLRKQN

SEQ ID NO: 130825 - protein, 20 aa, Heterodera glycines
  Coding regions on vcDNA: vcDNA=SeqID_57248; Strand=-; Position=1 -46,143-159
MGLNSEQGGKAKAKRGLLED

SEQ ID NO: 130826 - protein, 141 aa, Heterodera glycines
  Coding regions on vcDNA: vcDNA=SeqID_57249; Strand=-; Position=1-423
KNRITLKKLLKHFGASNSFYNRLYTSHYSAKIIRVPKIACDLSLEKNGLSKNRNYAQKASQTILALPIPSTIAFIHPIMSAKIIRVPKIACDLSLAKNGVSKNRNYAQKASQTILALPIPSTIAFIHPIMSAKIIRVPKIA

SEQ ID NO: 130827 - protein, 168 aa, Heterodera glycines
  Coding regions on vcDNA: vcDNA=SeqID_57250; Strand=-; Position=1 -256,311-561
MRLLDHYAQFFGLDSPPIDPSKTLQRLAADIFVWYNRMESKPRSIGGANGQQFADFLYFYCRIFNDSLSTEIAREASFMFSSFVDETFKFVEKMEKKKLDDPNFEIALAEMIHSVREKGKLGWIESGDKFNEPIEAIKAMHFAELNKFLTNKKKQKNLYGKFAAILAG

SEQ ID NO: 130828 - protein, 143 aa, Heterodera glycines
  Coding regions on vcDNA: vcDNA=SeqID_57251; Strand=-; Position=1 -336,496-588
MDNHNNNSNNGGGSNNGGRKPPPSRTGRKRLHENSSGGGGSNSANIFVGGDTSSTVRAVSSRSRQPQQHNNYNDLELLLIGGTEDGNSTAPQPQHAQTVQRPTGTENGRQMLAVNSASHGTPVDGALPNVDGGGSGGVLAQRN

SEQ ID NO: 130829 - protein, 397 aa, Heterodera glycines
  Coding regions on vcDNA: vcDNA=SeqID_57252; Strand=+; Position=1-1194
MVSAHYSTLTTAPPFESTSTLSTAVPSVTSSWYSTITRTETMTTTKTNPWTTTTWAPMTTTKQRWTPTMSNSASTWTTRRTRIQYVTKARSQQTDATTPPNTIKSAKSAKRDLGTNRDGADVFWCSDRGSTIWELKGPENSPFCRPPPSLTAEWHNLAIELYAKSIRPEQIDSAWHCSVKRTTENYYTNLLGDKFVTIVKEFPPVNKRICKQMALHQECPYAKSEMINHEGQLWSTNDELNVNFPGPISGLFKGEQTSTATNCFVQPATIFVKRQTLQMLSPVHQVQNCQYSAEFCQLPDNTTLIWKSTCSGDECKMCDYDRAEIISGKFTAAYGETVATWISDDHQKALTFAKKAPELIACDGVRIVLSEQNFGIAKDQYDDITSSVDLPRMATRQ

SEQ ID NO: 130830 - protein, 305 aa, Heterodera glycines
  Coding regions on vcDNA: vcDNA=SeqID_57253; Strand=+; Position=1-918
  Homolog annotation: Hit_ID=CAA82797.1; Match level="QueryCoverage =72%, HitCoverage=34%, E-value=2e-15, Identity=28%"; Hit description =gag protein [Ascaris lumbricoides]
MSGPIQKGIINALKTLDNAKSATSLLQHPDPDLSNWENAINLEAQFDRVVKEIRTTEMQMDSLRDLSNAWIELLARLTGDDKDNDEKEYIKFDKNEKIAERYDAASTKLRDLRDLEATLSAAAKLHRGRADREAKADQLANPQQQPPMPPAMAAPMTMPTFTAPLYQFQPIQLDKFFGQKRKWPEFYESFKSAIGSQSISKAQKLNLLRNLLGGEARELIAGFRLEDANYETVLQLLKDTYGAPEEHIRSLHFELANLKPCRSLRETKDFLLQLERLTRELNNAGEDIEGPQVFTSTAAAAAAQI

SEQ ID NO: 130831 - protein, 708 aa, Heterodera glycines
  Coding regions on vcDNA: vcDNA=SeqID_57254; Strand=-; Position=1 -392,549-641,813-914,982-1074,1222-1338,1428-1603,1657-1958,2070 -2267,2333-2508,2807-3286
VHFNPICSSTAKSASTNNMDNHNNNSNNGGGSNNGGRKPPPSRTGRKRLHENSSGGGGSNSANIFVGGDTSSTVRAVSSRSRQPQQHNNYNDLELLLIGGTEDGNSTAPQPQHAQTVQRPTGTENGRQMLAVNSASHGTPVDGALPNVDGGGSGGVLAQRNVRNLNNNGGSGGVADATGALHAVALPAQQPLALTVSNSLDNGGGIVQQPNGAVSGANVPMWSLNNSAATFAALMTAGGGDGSCAARPGGGMPSMVRGTVGGGLEALPPSVREAVALVHARQRQKMVNNNIQPEFASVVPAIGENGFSNLWWIYLEWQPDMVMNRVVGLVVLAGPFTTQTDISGYDVRIIFDHHDLEHEMAMHGWQECVPRMSNICAGQIVEFTRLKVRAQGHNAKGSFPFTLLYNAESRHRIVGQSSSAVATTVFNPPSTNTPIIVEANDSNSNAISIPSGVISGSISQQGGNGLFGGGGSNVMAAPHQTDQQSGMSANAGSEQHRLIMQSDDDYDGEEQQDEQIRGSGGSDGGPAANFALTSAGTVAPRTETGVSSTPWLSATRPPTPGPSSSSTNAHARHNMQQQPRSSPPPVRVCSITAQRSISAIVRQMNTNAAAVARDESRSRDRRRLRQLNAQPRQGRRLSTPRSSRGRNTLSPRPPHNVITIESDAEEEALGVAQQQPLADEDQHFYDDEMLLIEDQIAQGLVEGQPTKW

SEQ ID NO: 130832 - protein, 1632 aa, Heterodera glycines
  Coding regions on vcDNA: vcDNA=SeqID_57255; Strand=+; Position=1 -4574,4641-4965
  Homolog annotation: Hit_ID=NP_508324.1; Match level="QueryCoverage =80%, HitCoverage=49%, E-value=1e-126, Identity=27%"; Hit description= predicted CDS, peptidase family A16 and RNA-directed DNA polymerase and Integrase, catalytic domain and
MATIFNPSRPCHSMMATIFIDPGSHRSFISNTAAKQLELTVLRTEECFLTSFGEREPKRYVSDRVAIGFLCPNGDRLIFNLNALKFLLNNLPVLQLNTLDKQQLQQKKLFPPHESRQPDVMLGMDVWHDLHVQPIEQLPSGFTICQSKIGKIISGTGRIELSQPSNVTFVLTVTDENVFTAEEDLKANEELNKFYGLNIIGMDDSSTLIDRDEVMKNFKENLSFVNNKYQIALPWNDRVAQLPTNYHQAKARLISLIRKLRTINLVDEYQAILDEQQQNSIIELVNSDHSCGPVHYLPHRAVIRTDKSTTKIRIVMDASAKPKSTPSAPSLNECLHTGPLLLKDLTGILLRFRRMEKVILADIEKAFLQLGVREQDRDATRFLWLANPKEANLEQLKREDFRVFRFCRVSFGLTVSPFLLNATIREHLALHDTDVAQRISDNLYVDNIMVEIKPSENSNQLVTEAKIIFESAGMRIREFFGSHIDELKELDSSELAQDLENTKVLGIEWKPRHDQLIFKMPIFSSPTTKRKILSHIAKVYDPLGLISPALLPAKHFLQIVQNLNFKWDDPLPEKMALDWIKLMHAWDGFGFNFRVEFPRHIATSPNEEFHCFCDASKTGLGVALYQLADSSYGKKESNLIFGKSLVKPLKVADHDSTIPKLELQALTLGVKVTKFVQTQLNFDDQQVILWTDSQCSIERLKEERKYDRFVNNRLKKIREARFKVRHIRTDENPADIASRGTDPQSLQSSLLWRFGPVWLTKVSQWPESNVTYNPGEEIKEVTEPPIVEWSNAVQQREEFVPAIQFERFSNWNRLRATAAHVIRFTVAMLQKRQNSEPTSSPLLTHGHPLEKGPLTAKELEMADEWILIETQRQNWPSESVITNLKLFKTKPLETLKCQGRLGNANLPIHSKNPIFLPAEAWTTKLIIVHNDRIHNHCGPRILLSKIREKFWIPRGRQTVQNALYSSRIGCLECKREKLKPYAYPEAPNLPKERVNETRPFNNTGIDYFGPLKVKRGLETVKVYVALFTCLTIRAIHLEVAEDYSAEAFLRVFRRFAARRGVPRVILSDQGTNFIAGAKVIKENWTTDLLTLEVQEQLAHQGITWNFNTAHAPWKGGTWERLIGITKNALRRSIGRRLLTFDEFGTLVVEIEAIVNHRPLTFESDREPDPVLRPVNFLIPYGSTETNFPSMATDPEDPEYTPNPNKLKTMLQKADSRLNSFWEIWRSDYLLSLRERANQRLNNERQTPNEGDIVLVEEEANPRSVWSLARVLKVQIGRDNKSRSALISHKGKEKWRAVNQLYNLEIQPEFPEIHSTAFVMSNLDNDIDSVSLAGSEDEMPQPKNKFRIPKRKRAFLRPIPQQHSPLQGPRRKRRELQDSGLRKLFCAISEPEGGSKATTEAVNESRAMEKAPQPIQKEFNEKMAKKQREKARIKTSDRLKQKLADLSSVSAQTEAEKDEQQKEREIHDQQRAERRNEVKEAFEKPSRKEREEARSFWSAKKAESMKEKTKGRPIEDMPKNNEVLLTELHQLETQGWTLHDQKGKMVEPSEFLGGTRPSVNVRFKEGHYTNLTPEEMVFHGPPVSESEPEPEIVVTEEVSSSELQEENERRVRESGTHSPTEHRTFREPEELRD

SEQ ID NO: 130833 - protein, 108 aa, Heterodera glycines
  Coding regions on vcDNA: vcDNA=SeqID_57256; Strand=+; Position=1-327
MILAREEDEIMEVDPTPSTSAASSSGLMSRNTINTLMVISMFALMFLQPTAAAPLRIHRASLSQNAQRFLQMVSAHYSILTTAPPSELTITLSTALPPVTSCGTAQAQ

SEQ ID NO: 130834 - protein, 160 aa, Heterodera glycines
  Coding regions on vcDNA: vcDNA=SeqID_57257; Strand=-; Position=1 -95,377-467,550-710,871-1006
  Homolog annotation: Hit_ID=NP_508402.1; Match level="QueryCoverage =90%, HitCoverage=58%, E-value=2e-13, Identity=29%"; Hit description =predicted CDS, autosomal Highly Conserved Protein like (XC790) [Caenorhabditis elegans] gb|AAA81753.1| Hy
MATQQHNVQLYLNYSFNFFISSDRTVSTTTKRELDQFERILSSESDVQTLIDITQELFYIELAIFITFGLSGFPIGCTPGKYLLGLRVISCLDVQPIVGSSDRVMVTCMPSVGFRSSLTRAVIKNMLTTFLFPLSTAFYLFNHNRAIYDLAAKTMVISLV

SEQ ID NO: 130835 - protein, 57 aa, Heterodera glycines
  Coding regions on vcDNA: vcDNA=SeqID_57258; Strand=+; Position=1-271
SRDGPRFRFSHFAFAFFGVSLFAFRFLARNATFTPLRIGLNSHKIFQNFTYKLANFQ

SEQ ID NO: 130836 - protein, 40 aa, Heterodera glycines
  Coding regions on vcDNA: vcDNA=SeqID_57259; Strand=-; Position=1-121
MAKPNNKHKLISNDLIAFGNKKHLMGGFIRSNQRRDSSAG

SEQ ID NO: 130837 - protein, 119 aa, Heterodera glycines
  Coding regions on vcDNA: vcDNA=SeqID_57260; Strand=-; Position=1 -120,638-877
MHLFIHIFLSIHICLSTFSYAFESLNSLGTIGNLSHNQKTTIFGNKVLAKRSTSGISIVSGSGGKKPPHKGSLIKPSKASPKKKKAKSSMFSKIANAFKIVKDKKKDGGSSSKSTKSKK

SEQ ID NO: 130838 - protein, 132 aa, Heterodera glycines
  Coding regions on vcDNA: vcDNA=SeqID_57261; Strand=-; Position=1 -149,209-458
  Homolog annotation: Hit_ID=CAE75346.1; Match level="QueryCoverage =82%, HitCoverage=2%, E-value=3e-20, Identity=45%"; Hit description =Hypothetical protein CBG23326 [Caenorhabditis briggsae]
MRKLHAALDEARDLLELEQLADRLCTFVRAKEGMVGAEDLGKDLEHCQSLLDRLDESQGIDEGTLAEANRLGGRLIGRKSAESDYVRKRLAEVNEGWQRLAGRLSIYRTLLNAALAGQRSDRANGSDGRGTI

SEQ ID NO: 130839 - protein, 38 aa, Heterodera glycines
  Coding regions on vcDNA: vcDNA=SeqID_57262; Strand=-; Position=1 -94,234-256
MPFDNALHCHRQEIWAKNGQGIEITECGIIEVGISLLS

SEQ ID NO: 130840 - protein, 53 aa, Heterodera glycines
  Coding regions on vcDNA: vcDNA=SeqID_57263; Strand=+; Position=1-160
EERAHFRYPQTIDDAKRLGRVLIRYKDQHFYTVLSGVAAIYLMSVFINDNMVL

SEQ ID NO: 130841 - protein, 122 aa, Heterodera glycines
  Coding regions on vcDNA: vcDNA=SeqID_57264; Strand=+; Position=1 -279,1005-1092
MPLDGAIGQHLNSYGYRSDGSLGCNGISRPYKMGFGTMPMPFNAAIGQQRDRRYVGSANWSFPLEFVPVPMPSDGALAFQSPAFSTGDVVGCGDVSVPSTKKAQRCLTCQIGRDGVLSTWYG

SEQ ID NO: 130842 - protein, 338 aa, Heterodera glycines
  Coding regions on vcDNA: vcDNA=SeqID_57265; Strand=+; Position=1-1017
  Homolog annotation: Hit_ID=NP_917837.1; Match level="QueryCoverage =96%, HitCoverage=15%, E-value=1e-39, Identity=35%"; Hit description =B1158C05.18 [Oryza sativa (japonica cultivar-group)]
MAIRQHKDLLFGGKTVIFSGDFKQSLPVVPHEGLTAQVTACFQTSPLFGQFTTMKLTINQRLGQGQQAYLQMCRQIGLGETGEHFWIPPQFLVKSKEELIDYVYPNFQQLLGNDKELLNRLILAPHIDTCDEVNEIMMANVPGQVREYLSTDKPLDDRPLDIDEIESEVAALNRRTDSGMPPHSLRLKVGCVVVLLINKSDKEGLINGTRIVLEELGDDRLIGRVINSNAIGGQVRFFLERTRNVYEDKSPGGIKYERLQFPIKPAFAMTIQKGQGQTIRTVGIDLEREVFSHGQLYTAFSRATDGNNVRVHAPNREIDAQGRAKVLNIVATNMLKLQ

SEQ ID NO: 130843 - protein, 147 aa, Heterodera glycines
  Coding regions on vcDNA: vcDNA=SeqID_57266; Strand=-; Position=1 -345,760-858
  Homolog annotation: Hit_ID=XP_146481.3; Match level="QueryCoverage =97%, HitCoverage=9%, E-value=9e-09, Identity=26%"; Hit description =PREDICTED: similar to carboxylesterase 2; carboxylesterase ML3; acylcarnitine hydrolase M1 [Mus musculus]
MVENIEQWEGHLLKEKQSKNANGEKWQKRGEEKKADEEEEEEGRQKGGVRGIEEKGKGKEEEGEEEKGKEDEGKAKAEYSSEKADQTASSIKISDLQHDIKNIFNRFENEQQNYWHVECPEKTIEIDLLREEDRKILGGKKSNERDN

SEQ ID NO: 130844 - protein, 457 aa, Heterodera glycines
  Coding regions on vcDNA: vcDNA=SeqID_57267; Strand=-; Position=1 -622,666-1151,1758-2020
MNTTGLMRIKRLMAHRSGTERHKKELLRFMTVQMLMEMRMLPDNLQSQISERKGQAADEAGLSARLQSPRGFKLLIAKANTAAADALRNFGSPFQLCVLIKIANFAYAPKHNNSIDAITEKMVKKLRTDECENGIVQAQILKKEMAAELGAKITVIIAEIASADLTKFRRLFSFPGTKTRLLRLVGSRERIEELDNKIGLTQKFAENEPKNDELLWTHYLFVMLTNNKIELQSHKIGADLVVFMHFLGQTFNAGRHMRKLFRLISDYISDQIYDPIFDSDEDELNEIEKFLREKMFLETKKMVEKISKDDNVKASIQFKKWEVIVKKVAKKGTENGKEMKKIGEWIGQLHRAKFTQLIRRNNNWKTLKNILQSKGTANIRQKLLNLFDTNAVESVFEEFDFKNISEATGDIRNSFDIKWQLENSDEYGEFGMMKEEEERSTRTNRERDEERMRERCR

SEQ ID NO: 130845 - protein, 235 aa, Heterodera glycines
  Coding regions on vcDNA: vcDNA=SeqID_57268; Strand=-; Position=1 -43,89-483,678-945
MDENSPQNAMAENLDDKATELINFFKSYILQMVEAPLETHQKFQINSAKWNLARKIEGMLAFLTELGTKLNKNGLLDEIERLKSDWDEITELEEKGEEENNKMLCLIYQNGAQILKMMLTYIENDEGIREKWKEYLDKHRVLDIIEPIKIIDPVDCADTEINARISMCLLNEPLQWHIIGQNFYELLENSAELRHFMCMCNKIANYAEIKIVLGEMIGRKYLTLLDDEFPEIMRA

SEQ ID NO: 130846 - protein, 272 aa, Heterodera glycines
  Coding regions on vcDNA: vcDNA=SeqID_57269; Strand=-; Position=1 -72,105-851
  Homolog annotation: Hit_ID=CAE56511.1; Match level="QueryCoverage =80%, HitCoverage=21%, E-value=3e-12, Identity=31%"; Hit description =Hypothetical protein CBG24231 [Caenorhabditis briggsae]
MNVLLRKSLSETLGLKSPSSLSPLLVNIIFIDEAGQAPTNQIIHILSLAPNLEKILAAGDPKQLQVRSSELPEELLQYGFNSFLSHLIFIPNIPNTKLTISYRGHPILTQCLADSLYHGDIVAGVTAEQRSMITSSNFPLPNQTAPLLLVDLPNPDYRELTSFSRLNSAQNHIAHSILSLLSLILPPSASITCLCLYSAQAKAIRSLTPLNVTVLTVDSFQAQESDAIVLITTRSLPTTPDEMRQFSYSYFSGPHQLPFLSFYMMYVCIGFA

SEQ ID NO: 130847 - protein, 82 aa, Heterodera glycines
  Coding regions on vcDNA: vcDNA=SeqID_57270; Strand=-; Position=1 -87,913-1071
MGDQSTTINAPHLATSSSGYICETFSAEELIPIILRDPEKKPRDLSGSRVGREPDSGILLLVVFPKSCDSFYPSNCTVFTFH

SEQ ID NO: 130848 - protein, 56 aa, Heterodera glycines
  Coding regions on vcDNA: vcDNA=SeqID_57271; Strand=+; Position=1 -46,91-215
MLALSRHSPGCQSRASLHFGPQILLNSHAITLPHMGPKKNSSSCALGAARRWAHVK

SEQ ID NO: 130849 - protein, 40 aa, Heterodera glycines
  Coding regions on vcDNA: vcDNA=SeqID_57272; Strand=+; Position=1 -66,123-179
MAIYFFEKFSMQQTLSNMKRSAKNGSLFLRNFLCNKRSRT

SEQ ID NO: 130850 - protein, 29 aa, Heterodera glycines
  Coding regions on vcDNA: vcDNA=SeqID_57273; Strand=+; Position=1 -66,123-146
MAIYFFEKFSMQQTLSNMKRSAKNGYLFF

SEQ ID NO: 130851 - protein, 29 aa, Heterodera glycines
  Coding regions on vcDNA: vcDNA=SeqID_57274; Strand=+; Position=1 -66,123-146
MAISFFEKFSMQQTLSNMKRSAKNGYLFF

SEQ ID NO: 130852 - protein, 518 aa, Heterodera glycines
  Coding regions on vcDNA: vcDNA=SeqID_57275; Strand=-; Position=1-1554
  Homolog annotation: Hit_ID=NP_508324.1; Match level="QueryCoverage =88%, HitCoverage=17%, E-value=2e-65, Identity=36%"; Hit description =predicted CDS, peptidase family A16 and RNA-directed DNA polymerase and Integrase, catalytic domain and Z
MDMSVQVTFIGALISLFQCASSRRDADEEMEEQIKTFFGLNIIGLSDNPEEEDKEEVMRTFRKGLTFKEGRYECGLPWNERVKDLPTNFQQARARLCGTVKKLRELNLVDEYQKIFNEWERNGIIERVPDPTQTTGPVHYLPHRPVIKMDKATTKIRIVMDASAKPANHKGAPSLNECLHTGPLLLNELTGILLRWRRMKDLILADIEKAFLQLSVREEDRDATRFLWLEDPQKTEISSPTYVRTVVFRFCRVSFGLTTSPFLLNATIREHLSFYDTVLPQTIMENLYVDNILINVKKNEDMAQICHESIELFRQGGMKLQEFFCSKPIAIRSLPVELLAKNQKEIKVLGIPWTNEDDEICFRFKKFAGKHTKRNILSHIAKIYDPLGLVAPAVLPAKHFLQKRFEAKNGWDEGLEEELIHEWNQIMETWQTKEGTEVQIRFARRVDNEDEVDKEMHCFADASGKGLGVAIYIRESTEKMSANLVFAKSLVKPSNISDVAATIPKMETIHNAGSEVVK

SEQ ID NO: 130853 - protein, 356 aa, Heterodera glycines
  Coding regions on vcDNA: vcDNA=SeqID_57276; Strand=+; Position=1 -640,705-1096,1238-1274
  Homolog annotation: Hit_ID=NP_727620.1; Match level="QueryCoverage =54%, HitCoverage=70%, E-value=9e-19, Identity=35%"; Hit description =CG11138-PB, isoform B [Drosophila melanogaster] gb|AAF48174.1| CG11138-PB, isoform B [Drosophila melanoga
MGPLDLLNGTSSQLRSHLFSAQPAQQISVNGNGIGLANAAASAHHPATPSVPNNRFSPRSTAANGINCPPSSSAINGTTVNGSPLNLATQIGNQTVGLVESIHQQQQRAMAAALNSRGGTVNGSGNNALDELNQLNQLRAMLPFFNPHQLLPMGSLNGLAASLIGPQALINAVGANAGGNVAGMNGGGSGRKRELEGGGSGDTRESLNNKVQRGDAQTTSTSPTSTNSPDQSLQHNGFHHPSSHPPPHHSSDRRRSLFLSNANSVPTPSSTVASTTAFAMAAAAQHAAAVAAQQRENNGERTLKCTGCQERLEDTHFVQCPSVSGHKFCFPCSRKSILKQWKSHPTVDIHAAGDSD

SEQ ID NO: 130854 - protein, 67 aa, Heterodera glycines
  Coding regions on vcDNA: vcDNA=SeqID_57277; Strand=+; Position=1 -72,136-267
MNGRGRTPTNGETNGGAPIGSETAMCTLLNSTKCVKESLDHPNRSPGTVSGDSSGGENAVALNGQSP

SEQ ID NO: 130855 - protein, 65 aa, Heterodera glycines
  Coding regions on vcDNA: vcDNA=SeqID_57278; Strand=-; Position=1 -101,380-476
MNIFGVIVAGRMVKTDFTTHKEGEYTTELFDIANINHIVVFLTGLQPLPPDIGASSDLSENALSI

SEQ ID NO: 130856 - protein, 28 aa, Heterodera glycines
  Coding regions on vcDNA: vcDNA=SeqID_57279; Strand=+; Position=1 -49,233-270
MPKIKSKSELMRKWVNMHIKAYFWSFRE

SEQ ID NO: 130857 - protein, 98 aa, Heterodera glycines
  Coding regions on vcDNA: vcDNA=SeqID_57280; Strand=+; Position=1 -131,407-572
MPSLLSWPGVLLLGSQPNCCSIGRTFGFASTSKRIAQMCRWSVWCSALCWRVRSSSRFSSRIRCSKSSWPRNVPSCEQYAETRRIGNDADANKTQSMR

SEQ ID NO: 130858 - protein, 85 aa, Heterodera glycines
  Coding regions on vcDNA: vcDNA=SeqID_57281; Strand=+; Position=1 -248,291-300
MPSEPPSEPFELVNERTKEKLTLKQKSEELNELAVVYNWRLERRPIGETATAAVQWKDRYNSDVKANLNNIIFNLWSFNKSIGPL

SEQ ID NO: 130859 - protein, 48 aa, Heterodera glycines
  Coding regions on vcDNA: vcDNA=SeqID_57282; Strand=-; Position=1-144
MSGHFGTLTPRLVHPTSPVLLTKNGPLGAQTFNAWVQSQATLASYPFR

SEQ ID NO: 130860 - protein, 36 aa, Heterodera glycines
  Coding regions on vcDNA: vcDNA=SeqID_57283; Strand=-; Position=1-156
KPKLFGLFKKELKIFKIFIHLPFDRKSIREPYLTLN

SEQ ID NO: 130861 - protein, 45 aa, Heterodera glycines
  Coding regions on vcDNA: vcDNA=SeqID_57284; Strand=-; Position=1-436
LNLKKCQRLLFLKFFEILTFSLLIYYFAKLIHKYFLERALKRTKC

SEQ ID NO: 130862 - protein, 276 aa, Heterodera glycines
  Coding regions on vcDNA: vcDNA=SeqID_57285; Strand=-; Position=1-831
MACAVAAERATIHQELQRFTLITELIRVEELQETQVNITFRHQLNSVGEMMDMLQIWEEDTAISCRVDQNDETKPCALGFVRRIEKRALDNGFEVRVEVFLAFQDAKGQKVWEQFEFLREGALEAVELRPMVSTRALMERAELLTKNGCSIIAKDHASPANVIMAILLGRRVPRNVALQSVEEKVMKKGAVGLLKAGQCDSAERMLEGVPRVVFQQAGPGTGKTFTAAAIMAAILREDPARTRRHASWQWYRRTLPSVSWCWKWRKRCALRANPSQ

SEQ ID NO: 130863 - protein, 56 aa, Heterodera glycines
  Coding regions on vcDNA: vcDNA=SeqID_57286; Strand=-; Position=1 -44,133-259
MSEFTAQMFLETLKVHQKDSRHFFAARWIQSYDKANIENHLLQQCHIYYIPLLLTF

SEQ ID NO: 130864 - protein, 54 aa, Heterodera glycines
  Coding regions on vcDNA: vcDNA=SeqID_57287; Strand=+; Position=1-164
MAMKKSSKSCKVGVGNLTDENGNVVMKGRFKMCPKGFKKCAKNEAFGTTAFCVE

SEQ ID NO: 130865 - protein, 190 aa, Heterodera glycines
  Coding regions on vcDNA: vcDNA=SeqID_57288; Strand=-; Position=1 -148,744-859,1053-1361
MASRKQLPSLAGILLELETDTARQVTAMLKLQQLDKALHKAAQSQRPDLLQYADGSFDRPRIVYLGGGTGGNGTDGTVAKAAQTQRETSVIQLCVTYGNKNLAFRLMDRLNAYEEQVKAYLILGSVFEICPFYDTSPTQFREVKKAATLAVEREDLQMLQSIKCRLAPSSANWEEVKKITDTLLKKAAHA

SEQ ID NO: 130866 - protein, 174 aa, Heterodera glycines
  Coding regions on vcDNA: vcDNA=SeqID_57289; Strand=+; Position=1-525
MLGGSKQSVVSGEEKKQQQQQPPKTNVSVGRPLMSPPATESKDVLDIMLGGPKQSVVSGEEKQQQQSSKTNVSVDQPLLSSTQPKDVIDDLFGIVPKTGEKNRAQLFLNEMLGGSDEKEKGPPLELLMEFERFKIVFHDPAISGLSFSPQVGRVCCPNCHFVLLTVSLQIFVSH

SEQ ID NO: 130867 - protein, 139 aa, Heterodera glycines
  Coding regions on vcDNA: vcDNA=SeqID_57290; Strand=+; Position=1 -67,229-482,701-799
MGTVWAFCALLYNVHLLAAQNNAFNAEEICRPIDGTPFHAQCLLSSVVKQKGFIPKHLRPPWLNSPLFEDNKLSSEAKESENGCFSCYRGTKASNGKIQDEDYCACVYKDQAPNDGFSKIIGTFDGLNCLQDLYKMASW

SEQ ID NO: 130868 - protein, 65 aa, Heterodera glycines
  Coding regions on vcDNA: vcDNA=SeqID_57291; Strand=-; Position=1 -134,293-356
MPNGSSITVLVYEEKEMTNSNYTPICDDNKQRDNSRSSPNGTHKNNCFSGLSAHFLAGLHALERL

SEQ ID NO: 130869 - protein, 142 aa, Heterodera glycines
  Coding regions on vcDNA: vcDNA=SeqID_57292; Strand=+; Position=1 -114,265-579
MKGVQINEPIHSANDELDEPIKKWAKTKKLSKPKWKMPIETMANHDDEAYADLYVYNAGNYTNAGEECQNCLNFSKIDGLIGQLTESLNATETIINELVKKFKLVPIDLDSPMSSVTMLDQSTNSERIHLAGNVINSAIIGN

SEQ ID NO: 130870 - protein, 125 aa, Heterodera glycines
  Coding regions on vcDNA: vcDNA=SeqID_57293; Strand=+; Position=1-378
MKNLTDLPSSSKRGLTHQSSFVIMEISDNVKMDEQHSDDKNGQEKKEAKNLENAEKAMKEFNIRKKNVKCQKCNERAKILRMVQQIQKNNKEQIIKLVQNCKHSNEQEEFTEPNIIGTTIYGEQK

SEQ ID NO: 130871 - protein, 154 aa, Heterodera glycines
  Coding regions on vcDNA: vcDNA=SeqID_57294; Strand=+; Position=1 -231,778-1011
MQLAFTIISTRTEFNENSKLEVTLANADRIGKALLGISEPIEHKFLEYLKISKIFLLADSLGADETTLIEAECKNLEKFITNFGATRAPSAEETNKIGKNNLEFYIHLFKEMQQLLDSIKRTIKIEIREVWKDLIAFVEKFEEKLETFAKLTEN

SEQ ID NO: 130872 - protein, 36 aa, Heterodera glycines
  Coding regions on vcDNA: vcDNA=SeqID_57295; Strand=+; Position=1 -84,369-395
MTSKALTNAKNKHIVASKFAFGNIGIQNNLRIIEFL

SEQ ID NO: 130873 - protein, 40 aa, Heterodera glycines
  Coding regions on vcDNA: vcDNA=SeqID_57296; Strand=+; Position=1 -37,459-544
MSDNMLNTIFQNVTEKEFEKELIVIVHESVMFNGQCSFFD

SEQ ID NO: 130874 - protein, 78 aa, Heterodera glycines
  Coding regions on vcDNA: vcDNA=SeqID_57297; Strand=-; Position=1 -43,100-293
MTTTFKARNTAAFDEICLGNLEVQQKSKKKNKEDIVKFDVDRPGECPSVKIIIIFLFVTAPFVLFSVMVISYYFIQFQ

SEQ ID NO: 130875 - protein, 89 aa, Heterodera glycines
  Coding regions on vcDNA: vcDNA=SeqID_57298; Strand=+; Position=1-272
SYMGSNSRGKTGPEKGIGTRRRGEKIVIRIEFCLGRKPLLCPMSDSSIRRLSILSILPTDMSRSHHHKGAKMDGRIVVLVCPKAINKAD

SEQ ID NO: 130876 - protein, 170 aa, Heterodera glycines
  Coding regions on vcDNA: vcDNA=SeqID_57299; Strand=+; Position=1 -44,121-399,1042-1230
  Homolog annotation: Hit_ID=AAL78214.1; Match level="QueryCoverage =91%, HitCoverage=75%, E-value=8e-19, Identity=35%"; Hit description =putative esophageal gland cell protein Hgg-20 [Heterodera glycines]
MWKNPKKAKKEWKEISLCGDCWLSVFQFIGPYELGLKFALLSDRFDHLVDEHFKTKKWAMGFLEIRLSSRGKRAVIVNNFGDGQRSFYPIPQKPLPSNIVGFESIRISYVDQHVVQFLHRIRRLFDSVPTNLYIATAALAETVYRPKHFVRSCEAIRQHILPLLRANVRA

SEQ ID NO: 130877 - protein, 32 aa, Heterodera glycines
  Coding regions on vcDNA: vcDNA=SeqID_57300; Strand=+; Position=1 -52,365-411
MIIFSMFLKNKLCQILIDNTFLKSINFKFRNL

SEQ ID NO: 130878 - protein, 244 aa, Heterodera glycines
  Coding regions on vcDNA: vcDNA=SeqID_57301; Strand=-; Position=1 -312,458-880
MDKHLITDFEQSNRLLFNSFSSTPLPMIIQRNQRTQSTQSLTTANQKLPLVTVATAKIPQMFRFNTQFDQRRLNIGSVIHFECTVERCEERIGKTPSAITPCPRTNCDRKRIIAEKQQQPVITTQAEQHHNVDDAVDEDGAKVTGEDEELELVTQLLRAQQLEEEGEEEAQFGGVEGETDEDEAVTEAAQKKQQKQNGTEMADEKGKGKANGGKAKGEAGRNRTAQEEEEEAKAISGGANNRKA

SEQ ID NO: 130879 - protein, 63 aa, Heterodera glycines
  Coding regions on vcDNA: vcDNA=SeqID_57302; Strand=-; Position=1 -176,330-347
SARELTPFFSINHIFIIHFLSRSHELYYFLYLYRVNLIKDLNNINFLRFYTASETFKSILHSN

SEQ ID NO: 130880 - protein, 106 aa, Heterodera glycines
  Coding regions on vcDNA: vcDNA=SeqID_57303; Strand=-; Position=1 -111,162-287,603-684
VERIKLTCEQTLAQSVADAAEFDKHSYEISMLNEKLRQVCINYSHQIEALNEQQRHEYRQLVRTMYANEKSVYHGGTKAFASLAGSFSCADDTLYNCPSTANAFAP

SEQ ID NO: 130881 - protein, 55 aa, Heterodera glycines
  Coding regions on vcDNA: vcDNA=SeqID_57304; Strand=+; Position=1 -78,126-215
MAYNLFAKLLLCLNCLRLLLTKFVFMVLMGCQNEFRKKKSNLHCCFCMHHTTLAN

SEQ ID NO: 130882 - protein, 57 aa, Heterodera glycines
  Coding regions on vcDNA: vcDNA=SeqID_57305; Strand=+; Position=1-171
MRKAKCETPKNANNAKGEMRKAKPRPIPAPHPVKCCHHHYLIFSSIIYRSATFADNL

SEQ ID NO: 130883 - protein, 50 aa, Heterodera glycines
  Coding regions on vcDNA: vcDNA=SeqID_57306; Strand=+; Position=1 -144,1328-1336
MGTETDGRTILGGKWTKRDEQKVTHQQIKWTNCPPQISSHPSIHFIHFKK

SEQ ID NO: 130884 - protein, 265 aa, Heterodera glycines
  misc_feature (2)..(2): Xaa can be any naturally occurring amino acid
  misc_feature (33)..(34): Xaa can be any naturally occurring amino acid
  misc_feature (264)..(264): Xaa can be any naturally occurring amino acid
  Coding regions on vcDNA: vcDNA=SeqID_57307; Strand=-; Position=1 -33,1157-1850,2136-2205
  Homolog annotation: Hit_ID=NP_941288.1; Match level="QueryCoverage =91%, HitCoverage=60%, E-value=1e-120, Identity=86%"; Hit description= Tn10 transposase for IS10 right [Serratia marcescens] ref|NP _052934.1| transposase [Plasmid R100] gb|AAD
LXEKFLHFPIFSHSRHNVELINGWLGKRHLHQXXLAVYRWHASFICSVNTMPIVLVDWYDIREQKRLMELRASVSLHGRSDTLYEKAFPLYEQCSNKAHDQFLNDLERILPSNTTPLIVSDAGFKVPWYKSVEKLGWYWLSRVRGKVQYADLGGENWKPISNLHDMSSSHSKTLGYKRMTKSNPISCQILLYKSRSKGRKNQRSTRTHCHHPSPKIYSASAKEPWVLATNLPVEIRTPKQLVTIQKKRMDQTLVYGSWRMPVKXT

SEQ ID NO: 130885 - protein, 206 aa, Heterodera glycines
  Coding regions on vcDNA: vcDNA=SeqID_57308; Strand=-; Position=1 -282,590-928
MGFPHRPVQMTIPYSSTNPIPAVAPVQAMPMIGGIPYGMVSAGGQLAISPSFGAQLAPNHGVAGFGRGVPAGQQFIGQPLVLGYPQNAGFIQPTMVHPTGQMMAPIGLYPSVAGVVGPPQMKQPPISQTVMANMPPPQPLYEGEISFVTVSLKFLLDVEPLSAEEHNAILYNSSAEFHTALEASRWNAVSVLPDAKRKELYNMLHG

SEQ ID NO: 130886 - protein, 99 aa, Heterodera glycines
  Coding regions on vcDNA: vcDNA=SeqID_57309; Strand=-; Position=1 -174,564-689
MMTPHQDFHNSSVAMQQQQTLCPPESTLWMGDLKPEWDANFVREAFGENAGDVTNVKMLFGERYMSCRGAKVYRNEDGASKEQGLFGLLLKLTNKRLWY

SEQ ID NO: 130887 - protein, 85 aa, Heterodera glycines
  Coding regions on vcDNA: vcDNA=SeqID_57310; Strand=+; Position=1 -154,370-473
MIYDLLEKSVCRNHDFFWWGRHNKKSERVHVVYRKEARALRNSVPTTESAHDFMQFIAFIPSRDWTIRQWTIRQWTIRQKWTIRQ

SEQ ID NO: 130888 - protein, 42 aa, Heterodera glycines
  Coding regions on vcDNA: vcDNA=SeqID_57311; Strand=+; Position=1-127
TVFSLIKAPGGLFFNLFRKGDIIGDRAFNGDGGIIFQQIFND

SEQ ID NO: 130889 - protein, 104 aa, Heterodera glycines
  Coding regions on vcDNA: vcDNA=SeqID_57312; Strand=-; Position=1 -6,444-752
MYDWSCSSNLNMFLSNAKLIFLRFPVDKFPERLTFSALPHSLRILNICARRTENFYSNRKTSRIIEILQLAAIYCPALSVLMLPIEFQAGERILDEVGRFNRYF

SEQ ID NO: 130890 - protein, 100 aa, Heterodera glycines
  Coding regions on vcDNA: vcDNA=SeqID_57313; Strand=+; Position=1 -23,578-857
MNRRLWKIWICGDVWMDILPSFERAELGLKIALLSYRYDALMDKHFDGKKELTIWRTIKICDGIGPEPKLSVQIEDKRVEFPFPDCPLPNKIRFKHLWIT

SEQ ID NO: 130891 - protein, 259 aa, Heterodera glycines
  Coding regions on vcDNA: vcDNA=SeqID_57314; Strand=+; Position=1 -430,614-888,939-1014
YIDHSVIEFLRSNKHIWDRNGTNLLIQIESDTNVIKPIWDVFTSEIWPIFATNIRHLSFAGHYLDNLRRLVSPTILTDFDQLNSIDSGVLLPDGIADDGPDATAGQALFKWVHTPSKNGQPKQLVCADYDEEVNIDWVNSFKEAFLCATASVSYNIRLELYDSSTPIEPFELMNERTNEKLTLLLVGEDGYEFTEKLLKRCPISEKAATDQWENEKNWDDNLNNVQFSLLGGKSGPYGHQRMKKKKRVKASKYRRTARK

SEQ ID NO: 130892 - protein, 32 aa, Heterodera glycines
  Coding regions on vcDNA: vcDNA=SeqID_57315; Strand=+; Position=1 -40,97-155
MSNLICVVAKVRLGHWPPAEEEKADQSIENVV

SEQ ID NO: 130893 - protein, 39 aa, Heterodera glycines
  Coding regions on vcDNA: vcDNA=SeqID_57316; Strand=+; Position=1 -36,338-421
MKRKRVCREGKCHKYTSQITYKNGQFTQISCDRDYAFFT

SEQ ID NO: 130894 - protein, 214 aa, Heterodera glycines
  Coding regions on vcDNA: vcDNA=SeqID_57317; Strand=+; Position=1-645
MLIKAFTATSMAFFVLFLVAHSFELALAFAVVDKDEAQSTTTEAKNQATTFIPNSRQDDLEAADAAELLGVLLEDHDEPQQQHEWPYNSNNNNRRKVVSSSSSVFSSSSSSSSSSSYEDNDDHDHNADLKPASLPRMARRIIVQQQQHYGNRMPQQRHQRRFRIDPSHPIHILFPLPAREGRKTQNPFGITILKARPVVDEVGFIKKKYEPIDY

SEQ ID NO: 130895 - protein, 48 aa, Heterodera glycines
  Coding regions on vcDNA: vcDNA=SeqID_57318; Strand=+; Position=1-146
MGKGRAFGQRLVQKGPHNGKGKGGHSSRCGQGGHSHRQRAAKAGCSER

SEQ ID NO: 130896 - protein, 71 aa, Heterodera glycines
  Coding regions on vcDNA: vcDNA=SeqID_57319; Strand=+; Position=1-215
KFEVDTINILLLKLCPTWSICLDENRHDSSLSDRSRPPTFPRTATLRASPISSPSRPLHPAEFEANFLSPR

SEQ ID NO: 130897 - protein, 280 aa, Heterodera glycines
  Coding regions on vcDNA: vcDNA=SeqID_57320; Strand=-; Position=1 -433,483-624,669-771,817-979
  Homolog annotation: Hit_ID=NP_502882.1; Match level="QueryCoverage =52%, HitCoverage=28%, E-value=4e-18, Identity=34%"; Hit description =DNA polymerase like family member (4Q408) [Caenorhabditis elegans] emb|CAB60306.1| Hypothetical protein Y
VNFCYAHDTCPECIAKGIWDQPLDRSCGICGLTRTFAWAPFEFYNTEVETAYVVDDPLTAFTKWLLHFEADVLGLDPAEKRRKRKRANGDNNNKARNPAANAFIDMEAEDDDSDDNDAENNYMLGYDEEGEKPRSVTTYAYAHAGSRYDHVLIYGEMLRMGVRPELVRQGNHLLEMKARKRGAITTTIFRDSYKLIPIKLASFVKTFGLEIEGVDNKKYFPHKFNKAANYGVVLDTLPPLEDYYPGGHFPEERKKLEQWYEENRNTPFDLREVIADYCKA

SEQ ID NO: 130898 - protein, 254 aa, Heterodera glycines
  Coding regions on vcDNA: vcDNA=SeqID_57321; Strand=+; Position=1 -26,71-130,181-289,334-423,498-598,777-977
  Homolog annotation: Hit_ID=CAE63736.1; Match level="QueryCoverage =81%, HitCoverage=25%, E-value=2e-34, Identity=39%"; Hit description =Hypothetical protein CBG08265 [Caenorhabditis briggsae]
IKGRVDAFITLHTYAQLWIHPFSHEITLHTYAQLWIHPFSHEYQSFPNDVAKVKSLALSATARLRFPNDVAKVKSLALSATARLREVYGTNYKVGTGADLLSPASGGSDDPASGGSDDWAKQTLGVKFVYLVELRPQLRVSNGFILRQEELVPTSNGFILRQEELVPTAIETFEAIKVVIQGVLVENNHRRRRNSRGGRRKGRRRSTKNARKRKRRKSNGRKSKRRKRKGRKSNGRKRKRRKSNGRKSKRRKSN

SEQ ID NO: 130899 - protein, 425 aa, Heterodera glycines
  Coding regions on vcDNA: vcDNA=SeqID_57322; Strand=-; Position=1 -321,624-769,838-947,1279-1394,1453-1552,1717-1890,1953-2091,2172-2343
  Homolog annotation: Hit_ID=NP_493252.2; Match level="QueryCoverage =99%, HitCoverage=14%, E-value=6e-59, Identity=37%"; Hit description =PAtterning Defective PAD-1, dopey, N-terminal (266.8 kD) (pad-1) [Caenorhabditis elegans]
QKTLPSSDLSPVLEQRSGAGGSVLGGVSSVGGASTAATAQFFSSASALASEANSMRGSTISLTGAGLGGAGSGTAATSTHAPPSRLSAPLDTQSLTASSCGVGTASALPSTTSAGGGAASSSASVLRSSIKDSSGGAANKKDPSDSTQALFLLAENLAELIDSVCKSEDKEKLLPALQAVWNNTLPYLKAKSAKNVRFFLASSQFLASMSSYNYMRSVWKKNAMDLLWDNSFFKMDIHALRQWLIVIDNLMTNDKTSFKELLSRADHHLHVDHSVNTDHQQGAGVRDACPVPEAAGVRHSQLGAGPICGPIKRNPRHIKKKITADRKFTSLPSAGDPHAGVHVLPRAVGPHESQFICVHLAVDGHRIGVHVLAQIDHQLTSTTPTSSSGGASSSVDEQKSVRDEQCMQLFLAACKLLETLCALPS

SEQ ID NO: 130900 - protein, 80 aa, Heterodera glycines
  Coding regions on vcDNA: vcDNA=SeqID_57323; Strand=+; Position=1 -124,1095-1213
MQKPTKQFLERCFVVGHQIVDYDQPLAQRVDVHFEECCRKKDFSLLPSFVKTAIFGINFQYNNMKFQIGQFTGKIKMLKR

SEQ ID NO: 130901 - protein, 549 aa, Heterodera glycines
  Coding regions on vcDNA: vcDNA=SeqID_57324; Strand=-; Position=1 -796,1230-1411,1652-1790,1949-2181,2235-2535
  Homolog annotation: Hit_ID=CAE63510.1; Match level="QueryCoverage =76%, HitCoverage=17%, E-value=2e-45, Identity=32%"; Hit description =Hypothetical protein CBG07989 [Caenorhabditis briggsae]
SADKRKRVASSAARDSTYDQTSLVGSLLGPGDAAAAMPRITSYAGGDTIRRIRTGHRRQDSLQESIFSTGTQELRLFDPTELPNSTCPGDHKQPLLDETFSHMLFYAESPSIVDLGRAEKLFRTMGTLLRSGNGLGRHLVNSMLFTNMSELVNRTGTTSSGKTGGGNLSNIGTNSVNNSMATIGGASTAATQQLLDFMARHYQHIQGDGFWCTETAHDQQNFSVQKKEDGIAGGSGGTAAVTSTSSESKSGQQQRHSTLFEIFSTIAALDCFTELLHILDDTVREASSKELATFVQQIYRQTKTQKVILTLMLAAIPTPPNQKGWRMPLSMDIAEFNNGPPHSKHFRDLIFAYHRSLLSLASALVVLEYSLHTHLLALPINRNASPSSQITENQINYNSSQNRSTIREARYSVVELRLFLGVILNALKRCPARHELWLHFLVGILPYLDRALATFVVHTVEQICRNLYECVFINGSTASVAGLNSAALALVSNSQQPMGASVMEHPKNPIQFVDYRINRTNDVATTVGDDGTMPTVIYPANYILNVRVL

SEQ ID NO: 130902 - protein, 79 aa, Heterodera glycines
  Coding regions on vcDNA: vcDNA=SeqID_57325; Strand=+; Position=1-354
PCRTPFQRVQNYAEEQAELNDGVARLTNGGPILGGVVVDLVFSDLRRWRSVAIDRKGQQMGLKGQNILFFGRNFHIFIK

SEQ ID NO: 130903 - protein, 69 aa, Heterodera glycines
  Coding regions on vcDNA: vcDNA=SeqID_57326; Strand=+; Position=1 -133,473-549
MSLDNISEANQVILLRLLTDKMLNDQPPNNTIMLKILETINGKKDFEQLSAHFLITDESVEVYMKKYRE

SEQ ID NO: 130904 - protein, 57 aa, Heterodera glycines
  Coding regions on vcDNA: vcDNA=SeqID_57327; Strand=+; Position=1-173
FLMASKIVPIAVSPSFNFLRRPLPSLVSLRSLFKSPLDAPFCGIYRTNGGICRTDDI

SEQ ID NO: 130905 - protein, 69 aa, Heterodera glycines
  Coding regions on vcDNA: vcDNA=SeqID_57328; Strand=-; Position=1-207
CRLFSQPSLLLSVLRIPRAFRLSRDRVDCALASSVSVLYLFCGWNELISLLAESGFVGRAKANILKCHG

SEQ ID NO: 130906 - protein, 123 aa, Heterodera glycines
  Coding regions on vcDNA: vcDNA=SeqID_57329; Strand=+; Position=1 -110,290-549
  Homolog annotation: Hit_ID=XP_213396.2; Match level="QueryCoverage =93%, HitCoverage=18%, E-value=5e-34, Identity=58%"; Hit description =similar to Dph2l1 protein [Rattus norvegicus]
LAKDGFDIVIPQCSPLSPGELLGCTAPVLPKDVTALVYLGDGRFHLESAMIQNPSVPAYQYNPYSREFTRERYGTELMLANRDAAVAVTRDAQCFGLILGTLGRQGNAKIFNVSEQQRGRKRE

SEQ ID NO: 130907 - protein, 45 aa, Heterodera glycines
  Coding regions on vcDNA: vcDNA=SeqID_57330; Strand=+; Position=1-134
FSVLDSRVEKFLGFFGSRFSYRFPGSFLGLGFSVPGKNHFSHSPT

SEQ ID NO: 130908 - protein, 21 aa, Heterodera glycines
  Coding regions on vcDNA: vcDNA=SeqID_57331; Strand=+; Position=1-67
VRLGTQQLWGAKSNAELKYRL

SEQ ID NO: 130909 - protein, 138 aa, Heterodera glycines
  Coding regions on vcDNA: vcDNA=SeqID_57332; Strand=+; Position=1-417
MLQFVGLQVADQQIDEDHDGDNVDGHHHGHRRLGQHRVVDLARTWRLLFRELLSERAFQHLTHHNVVVVEELALEVLLDAEAPCSVHLQKNAEQFDEQKTDGVNGLSDGHVNGQCLGNAQNQSQRGTELRSAKNKEYM

SEQ ID NO: 130910 - protein, 117 aa, Heterodera glycines
  Coding regions on vcDNA: vcDNA=SeqID_57333; Strand=-; Position=1 -201,316-468
MVSATILICQIANTIIFASFAYNFGKLYIMLDDYMRKTDAMNITMPNSTVQFQYKGINVDRITKIDNYHDQLWNLFIAEVIELIFPVINLFMFAWIVKDKRRRFPSRVQIIYLVNFK

SEQ ID NO: 130911 - protein, 47 aa, Heterodera glycines
  Coding regions on vcDNA: vcDNA=SeqID_57334; Strand=+; Position=1 -51,200-292
MSSQYKFWKRLKLDINFLRHTFLTQLCRKCPMKGPSTSISLKKATIR

SEQ ID NO: 130912 - protein, 76 aa, Heterodera glycines
  Coding regions on vcDNA: vcDNA=SeqID_57335; Strand=-; Position=1-642
KYLLLIILKFYPKDSITPIVVKRCFSTAIFHLNYMRKSLHPNILKNLIFASEFEDFIMRKICLKIFVCFSFFSFGF

SEQ ID NO: 130913 - protein, 62 aa, Heterodera glycines
  Coding regions on vcDNA: vcDNA=SeqID_57336; Strand=+; Position=1 -84,567-671
MPINTATLADRIKLLLDNAANDGDVHFLLLSAHKMILKTVSDEFNSLFQSAEIENGEIDGAK

SEQ ID NO: 130914 - protein, 67 aa, Heterodera glycines
  Coding regions on vcDNA: vcDNA=SeqID_57337; Strand=+; Position=1 -73,131-261
MLKFIYTDKLDELSGDTVFKVLYTAKKYGITSLIKACAELPLSELDNVFEMLLKARSIEEHVNVSIK

SEQ ID NO: 130915 - protein, 69 aa, Heterodera glycines
  Coding regions on vcDNA: vcDNA=SeqID_57338; Strand=+; Position=1 -175,685-719
MDLILATDWINNAYPEMDLQDTNKENKEPTKKQEEEADDPSWISLIDEEMKREPLAPIDVFNFQLYCGF

SEQ ID NO: 130916 - protein, 533 aa, Heterodera glycines
  Coding regions on vcDNA: vcDNA=SeqID_57339; Strand=-; Position=1 -240,290-631,761-915,963-1246,1296-1578,1627-1924
  Homolog annotation: Hit_ID=NP_001004509.1; Match level="QueryCoverage= 93%, HitCoverage=34%, E-value=2e-49, Identity=28%"; Hit description =si:busm1-180o5.3 [Danio rerio] emb|CAD60788.1| novel protein similar to DNA polymerases [Danio rerio]
LTNLHGCELHVVWSCQWMERLRHDPELKRRYDAVFVPCPLDPRNDALRGGRTEPFKLHHVCSDDEEILCIDIVSLYPHVMKANRFPVGNPRVVTREVLLHPPTAPLPWTSPENNSFRGLLLVRVLAPRNIRVPLLGYRTKDGRFTFPLCGWCADRRQQRPCRHGDDRRSWVTAYTHVELNKALQLGYVVTDLFEATGWPEGCVTEEQRQAFVEDFERTEDIRLDSSKMEVNPGLRLIAKTLANSLWGKLAQRVGQTEIRYTRTPAEFHALLDDPTLDKLDFVHVSDHMDRCVVRKRPEFAKAPLTNCLPVAAFVTSYGRLQLYSYMEHVLAIDGAELLYCDTDSIYYVNKMGGPCVAEGEALGQMKREHSDRRIVEFIAGGPKNYGIRHTSRDGTDERANLKIRSFRLSYAAERVINFEAMKDLTLSTYNIDGPIDDVLDNDDPYVYGGGEHRAIRVNFPQIDRNVYADLFTREAHKDYRPYYAKGRVRHGMQTRPFGYVEDDGPPNDGQRTERRKRNFVDHDPAQPGHSGWF

SEQ ID NO: 130917 - protein, 35 aa, Heterodera glycines
  Coding regions on vcDNA: vcDNA=SeqID_57340; Strand=-; Position=1-106
KNFIFYIYSRITAMHIAYQYCIITCHRILINLLKK

SEQ ID NO: 130918 - protein, 77 aa, Heterodera glycines
  Coding regions on vcDNA: vcDNA=SeqID_57341; Strand=-; Position=1 -107,1037-1120,1551-1594
SAGASAGASAGASAGAAGASAAAGASAAAATIAPAGEAAERKCPKKGKLPNEATAEAAAIAPAGVHGNSPTHDSPTD

SEQ ID NO: 130919 - protein, 171 aa, Heterodera glycines
  Coding regions on vcDNA: vcDNA=SeqID_57342; Strand=+; Position=1-516
MTAAGAGVDGAVQILSTLFLFANYAIVLPMFLLCWMMVVHWLRRPGLMPSPHQTPSTSQHPHRHGGLHTIFENTVEQKAGQEKDVRQQQQQQPQQQRHTSAAAAAAATVITEAMVREAHRMTSQLAAAIPEPMRSAVTSSVAIPMLVSAQSGAGRKEATQQNSEEEEKERN

SEQ ID NO: 130920 - protein, 324 aa, Heterodera glycines
  Coding regions on vcDNA: vcDNA=SeqID_57343; Strand=+; Position=1-974
  Homolog annotation: Hit_ID=XP_487330.1; Match level="QueryCoverage =96%, HitCoverage=79%, E-value=4e-13, Identity=25%"; Hit description =similar to Hornerin [Mus musculus]
GVSAFGASFQSLGLNPPAFQSLGLNPPAFQSLGLNPPAFQSLGHNLKHSSHWDSIHQHSNHWDSIHQHSNHWDTIHQNSSHWDTIHQNSSHWDSIHQNSSHWDSIHQHSNRRDSKSIPVTGTQSTRIPVTGTQSPALQSLGLNPPAFQSLGHNPPEFQSLGHNPPEFQSLGLNPPEFQSLGLNPPAFQSPGLQKHSSHWDSIHQNSSHWDSISGITVTGTQSTRIPVTGTQSTRIPVTGTQSTRIPVTGTQSPALQSLGLNPPEFQSLGLNPPEFQSLGHNPPEFQSLGHNPPEFQSLGLNPPEFQSLGLNPPAFQSPGLQKHS

SEQ ID NO: 130921 - protein, 131 aa, Heterodera glycines
  Coding regions on vcDNA: vcDNA=SeqID_57344; Strand=-; Position=1-394
  Homolog annotation: Hit_ID=NP_033302.1; Match level="QueryCoverage =99%, HitCoverage=88%, E-value=2e-12, Identity=39%"; Hit description =simple repeat sequence-containing transcript [Mus musculus] sp|Q06666|T2_MOUSE Octapeptide-repeat protein
MEDKVEEEGKRKRTWKRNRKRKIKWKRNGKWKIKWKRNRKWKRKERGREREIGRERERGRKRRRGRKVEEEQKVKSGRGTESGRESGRGTESGRESGRGTESGRESGRETESERENGRGTESGRESGRGTE

SEQ ID NO: 130922 - protein, 53 aa, Heterodera glycines
  Coding regions on vcDNA: vcDNA=SeqID_57345; Strand=-; Position=1-162
  Homolog annotation: Hit_ID=XP_331497.1; Match level="QueryCoverage =100%, HitCoverage=24%, E-value=2e-09, Identity=62%"; Hit description= predicted protein [Neurospora crassa] gb|EAA29078.1| predicted protein [Neurospora crassa]
KEEQKVEEKVEEEQKVEEKVEEKQKEEDKVEEERKVEDKVEEERKVEDKVEEE

SEQ ID NO: 130923 - protein, 170 aa, Heterodera glycines
  Coding regions on vcDNA: vcDNA=SeqID_57346; Strand=+; Position=1 -56,387-843
MAEFRAADNFDGLRVGNGRFLDNYIGRMRFNVPMTAPLFHPHEWNVHQRTLDDADRTNKFAEAFHRKLQRQFICTHPTIWRFIDTIRCEQKAIDADISRCVMGESAPQKKKKYREADARILRLVHRYNDINNNHLPQNDHNYANVNVNPKTLTIFSLVFPETMKCDLSLF

SEQ ID NO: 130924 - protein, 34 aa, Heterodera glycines
  Coding regions on vcDNA: vcDNA=SeqID_57347; Strand=-; Position=1-104
RFRVLPCRVAIFAWPSRGRFRVVAYKREFITHIY

SEQ ID NO: 130925 - protein, 187 aa, Heterodera glycines
  Coding regions on vcDNA: vcDNA=SeqID_57348; Strand=-; Position=1 -30,778-1005,1054-1203,1256-1411
  Homolog annotation: Hit_ID=AAP30770.1; Match level="QueryCoverage =96%, HitCoverage=70%, E-value=1e-28, Identity=42%"; Hit description =putative gland protein G17G01 [Heterodera glycines]
MELSLFRNYKAFFNSAVSSSHCEQFTLIGMDSTTGEYGAMPDKQKWHMQLMASSGSGQPIDEQQQNHMDEFSSKLPTVGRHCIPIAFSLVKPWVRDNKSHLQKVADLFAIQLLCGLLSLFVIAMHVLDQPRSWGYESIDYERTTFCAVLWCCPALVSSVLLLHWTSYWHCTNFRADSTNVPLITLVD

SEQ ID NO: 130926 - protein, 37 aa, Heterodera glycines
  Coding regions on vcDNA: vcDNA=SeqID_57349; Strand=+; Position=1-112
QWPLLHLSLAAEELQQLIEPCQQINNKQIKMTDSNTL

SEQ ID NO: 130927 - protein, 126 aa, Heterodera glycines
  Coding regions on vcDNA: vcDNA=SeqID_57350; Strand=+; Position=1 -162,506-724
MPILFFHSPKWSLDSRMHQIWKAQAMPTKLTPTDFPFTILGQFYAISTPISIGDVALTDECSPRVGVLVAFCKCISAARTFEAVRVEHVEQSAAEDEFGRFDWNGTAGAVRLARRSAERSVGGGLW

SEQ ID NO: 130928 - protein, 65 aa, Heterodera glycines
  Coding regions on vcDNA: vcDNA=SeqID_57351; Strand=-; Position=1-196
SFGTSSCQPNCARCAIPIEPAELVFRSGLFNVFHTHCFKCSCCGNALAKGDQYTNTGGALICQRD

SEQ ID NO: 130929 - protein, 29 aa, Heterodera glycines
  Coding regions on vcDNA: vcDNA=SeqID_57352; Strand=+; Position=1 -13,434-510
MMAFVKSSVPFFCETIRKVAEHLQLQSPS

SEQ ID NO: 130930 - protein, 964 aa, Heterodera glycines
  Coding regions on vcDNA: vcDNA=SeqID_57353; Strand=+; Position=1 -334,395-1345,1406-2768,2799-2990
  Homolog annotation: Hit_ID=XP_318550.1; Match level="QueryCoverage =99%, HitCoverage=99%, E-value=0.0, Identity=43%"; Hit description =ENSANGP00000020240 [Anopheles gambiae]
LKTAVLFNKKPVEFHLDTGSDIVVIDQLTHEYVGRPPIEKCNEIGKAFDGTKISFIGKGFGTFKFGKIEVEQTFFVAKAGSLNLLSCKMMDLFGLLDELKLKISNPAVNACPGGTEIQALEKEFHEIFSEELGHCLKEKAHLALKDDARPVYRKARPVPYNSLEVVESELSRLEKMNVINKVEHLEWAAPILIVKKADGSARLCIDYSTGLNDALLDCQYPLPIPEDIFATLNGGKIFSQIDLRDAYFQVELDENSKNLCGLATHKGNYRMERLPFGVKSAPAIFQSIMDKMLAGLEFATAYLDDIIIVSKSIPEHTNHLKEVFGRIQAYGFRVKLAKCKFFRDQIKYLGQIIDKNGRRPDPAKIYAISQMPAPNDIPSLRSFLGMVNHYQQYVKNMRFIRKPLDDLLKKEIDWSWSEGCENAFRKIKETDASEDASELGIGAVIYHKFQDGNIKAIAHASKSLAPAEKNYSQIEKEGLALIFAVQKFHKMIYGRHFTLQTDHKPLVSIFGSKKGIRQCSANRLLRWSLILLAYDFTIEYINTKDFGQADALSRLIAKGNETEDEKIIAMINAETDFETNFGQTISKLPLKFSDLVAASERDENIIQVNFVKNGWPNEKAMDKENQIVRDFCRRKEELSIEKGCLMFGERVVIPKVFHSKILKLLHKGHPGMKRMKQLARQYVFWPKIDQDIEDFVRECVPCQAAAKAPIKTNLQSWPKTSGPWQRVHLDFAGPFFGKHFLIVVDSFSKYPEVFEMSTISTAMTIEKLRYLASRHGIPETLVSDNGTQFKSTEFAKFTAANGINHLFSAPYNPMSNGQAERFVDTFKRAFRKLKEGMSSVKEIIETFLVTYRTTPTDSKSPAEMLLGRKPRTTLDLLKPPPIKKFNRRFGTRPQIFASKDAKKFNRRFGTRPQIFASKDAVWARHRLSQNWKAGTICGCSGVIYNVRFEDGSGRYHANQLRFRK

SEQ ID NO: 130931 - protein, 32 aa, Heterodera glycines
  Coding regions on vcDNA: vcDNA=SeqID_57354; Strand=-; Position=1 -68,254-284
MGFFCRSNVLLHLDLTIPLRCVGVSVLSHTPW

SEQ ID NO: 130932 - protein, 27 aa, Heterodera glycines
  Coding regions on vcDNA: vcDNA=SeqID_57355; Strand=-; Position=1-83
MHSSHQIHGIIMGIRENDMSGDEKSDR

SEQ ID NO: 130933 - protein, 199 aa, Heterodera glycines
  Coding regions on vcDNA: vcDNA=SeqID_57356; Strand=-; Position=1-597
  Homolog annotation: Hit_ID=NP_702063.1; Match level="QueryCoverage =88%, HitCoverage=4%, E-value=2e-11, Identity=20%"; Hit description =hypothetical protein PF14_0175 [Plasmodium falciparum 3D7] gb|AAN36787.1| hypothetical protein [Plasmodium
MALNPPTFQSLALNPPTFQSLGLNPPTFQSLGTQPKSISITGLNPPTFQSLGLNPRTFQSLDSTHQHFNHWDSTHQHFNHWDSTHQHSNHWTQPTNISITGTQPTNISITGTQPTNISITGTQPTNISITGLNPPTFQSLALNPPTFQSLDSTQEHFNHWDSTHQHFNHWHSTHQHFNHWTQPTNISITGTQPTNIQSL

SEQ ID NO: 130934 - protein, 154 aa, Heterodera glycines
  Coding regions on vcDNA: vcDNA=SeqID_57357; Strand=+; Position=1 -98,296-531,1148-1275
VLMHRGIVPKVVSLNLLGWSYAILLSLGNNQQMRSVALPPAHFQRGARRPRLQPCQVHTHGHAVRPTVGPRTDPLAHPPGTKRRNSELHAVRLARDNFSALHADQSGARRSAVRLYPMRGQSVASVPPGAAELHRPWQLESDGIAPGQPGEGLP

SEQ ID NO: 130935 - protein, 102 aa, Heterodera glycines
  Coding regions on vcDNA: vcDNA=SeqID_57358; Strand=-; Position=1 -104,349-506,550-594
  Homolog annotation: Hit_ID=NP_872170.1; Match level="QueryCoverage =99%, HitCoverage=9%, E-value=1e-26, Identity=51%"; Hit description =ankyrin and patatin family member (5V188) [Caenorhabditis elegans] emb|CAD54162.1| Hypothetical protein W0
MVFDNRRPHNTQVLEKFIRQEMGAETMFSDLKWPRLMFTTTRAEFFPVQLELMRNYKLPTNDEENEELGYRTPDDLLLWKVLRRSSAAPTYFASVDNKYIDG

SEQ ID NO: 130936 - protein, 71 aa, Heterodera glycines
  Coding regions on vcDNA: vcDNA=SeqID_57359; Strand=+; Position=1 -52,509-672
MISTNDDTDSSWIAIDNEVIPLNPCDTNLFDLVKRRNSPPKIDRLPNPWLPFFPFLNGLDDELLEWVLFEL

SEQ ID NO: 130937 - protein, 129 aa, Heterodera glycines
  Coding regions on vcDNA: vcDNA=SeqID_57360; Strand=+; Position=1-633
GSPGGAFARLCHSRAISNFGDFLGIFEQMGLMVGGCAECVGFVPSLYSLPPQTVASYVQCHGATAAARKFNIPPAVAAYYYRKEFKKQGGVSARRASISVHQQQQGMAGGDGTKVGTKEGKKGGKFQMR

SEQ ID NO: 130938 - protein, 243 aa, Heterodera glycines
  Coding regions on vcDNA: vcDNA=SeqID_57361; Strand=+; Position=1 -117,188-391,434-687,741-894
  Homolog annotation: Hit_ID=CAE64662.1; Match level="QueryCoverage =100%, HitCoverage=24%, E-value=1e-105, Identity=75%"; Hit description=Hypothetical protein CBG09434 [Caenorhabditis briggsae]
MPKQKPKNDINELKQEVSMDEHKIPLEELFRRFGSSKDKGLTKAKAKEVYDRDGPNALSPPRTTPEWIKFCKNLFGGFALLLWIGAILCYIAYSVDCFTMERPSKDNLYLGIVLMSVVIITGCFQYFQERKSSKIMESFKNLVPTYALVIRDGEKTQIPSSMLVAGDVVEVKGGDRVPADIRIVSGHGFKVDNSSLTGESEPQSRSAECTNENPLETKNIAFFSTNAVEGTATGVVIYTGDRT

SEQ ID NO: 130939 - protein, 82 aa, Heterodera glycines
  Coding regions on vcDNA: vcDNA=SeqID_57362; Strand=-; Position=1 -82,277-443
MSVPRSMQRMVTVREGSGMPNRTYIRKAKLSSRRIISAACFDTSDPAIPTNLFHYVLRLFAHPLPLRCQPFSVPANRSLRRR

SEQ ID NO: 130940 - protein, 405 aa, Heterodera glycines
  Coding regions on vcDNA: vcDNA=SeqID_57363; Strand=+; Position=1 -237,500-607,654-776,823-1094,1135-1179,1227-1411,1453-1517,1573 -1662,1703-1792
  Homolog annotation: Hit_ID=CAE64662.1; Match level="QueryCoverage =100%, HitCoverage=42%, E-value=1e-162, Identity=70%"; Hit description=Hypothetical protein CBG09434 [Caenorhabditis briggsae]
MTVAHTWFDQQIETCDTTENFTGDRHKARETETALLRVASLCNRAEFKPGQVGIGVKRRPWNCLFRIRFRFSKGNAPAMLSIHETDDGHPGYLVVMKGAPERILQRCSHMLLKGQDVEMTHQMREDFERAYLELGGMGERVLGFCDFRLDHDKFPKGFEFDVEGPNFPIEGFRFVGLISMIDPPRAAVPDAVAKCRSAGIKVVMVTGDHPTTAKAIAKSVGIISEGMETVEDIAVRKEISVDQVDPREAKAIVIHGSDLREMNEDQLAEVINNHDEIVFARTSPQQKLMIVEGFQRQGQIVAVTGDGVNDSPALKKADIGVAMGIAGSDVSKQAADMILLDDNFASIVTGVEEGRLIFDNLKKSIAYTISSNIPEILPFLMYVLFGIPLPSRTVTILCIDLGTDM

SEQ ID NO: 130941 - protein, 52 aa, Heterodera glycines
  Coding regions on vcDNA: vcDNA=SeqID_57364; Strand=+; Position=1 -102,709-765
  Homolog annotation: Hit_ID=AAB02615.1; Match level="QueryCoverage =100%, HitCoverage=5%, E-value=9e-12, Identity=57%"; Hit description =Na,K-ATPase alpha subunit
MADNGFFPKDLYQLRAQWDSRGINNLVDSYGQEWIKCNWYVCMLLYNLAVIL

SEQ ID NO: 130942 - protein, 281 aa, Heterodera glycines
  Coding regions on vcDNA: vcDNA=SeqID_57365; Strand=-; Position=1 -73,189-525,1107-1408,1462-1595
KAIGCFPNALANYAKSVESHREQTVKGKGHRTWPRRRVEQTATIASVRFDWHEQSRIHCVAADEKHKLGKDGPAFHFRTEAAKPRQFGQIKENLKIGPIHWLFIIIVIDRPHSWASPTTKGTAFTCAIRWSNAALSSFGMALYHILFRLAPFDRTTLSPKEIIEEVKRRSLKPILENTSPEEKPAIGEKNGKRRNDCFLTVSGRDGTVLAEEPRTEAQTPSFGPSVFQRVPGKKMRGGIAGQFNRSNATDERKARAEFGKFGGATKRGTRGGTRRDGTAAA

SEQ ID NO: 130943 - protein, 100 aa, Heterodera glycines
  Coding regions on vcDNA: vcDNA=SeqID_57366; Strand=-; Position=1 -164,695-833
MPFSVVLLQLLLLLPYVLSLLKVGLVESDPLLVALCLQALTDARAQGKCTTEEIQPYLFNRILPLRLFWSVRSIRTLKSRLCGRVCHKYLRNALTESSKD

SEQ ID NO: 130944 - protein, 105 aa, Heterodera glycines
  Coding regions on vcDNA: vcDNA=SeqID_57367; Strand=+; Position=1 -228,945-1034
MPLSPVLILFRFLPLFLLLLLPPAVVPLQCFQTQHSLSASLQGNALSCPSSSLSCTKSTDFNMQIIARTCQSTNCTKNNSSERNEEKQCLSFCRQQNQQKNAASL

SEQ ID NO: 130945 - protein, 26 aa, Heterodera glycines
  Coding regions on vcDNA: vcDNA=SeqID_57368; Strand=+; Position=1 -34,112-158
MAVKDDPPEIRGVIWCAEHEFDLLLT

SEQ ID NO: 130946 - protein, 62 aa, Heterodera glycines
  Coding regions on vcDNA: vcDNA=SeqID_57369; Strand=-; Position=1 -43,91-188,1145-1189
MAELDKLISETKVKFDNDLKELELAKRHFSLDFVQRMETEFAKIFPETGGYAAPGTEAQAQE

SEQ ID NO: 130947 - protein, 112 aa, Heterodera glycines
  Coding regions on vcDNA: vcDNA=SeqID_57370; Strand=+; Position=1 -200,326-464
MIETESIDELEEAAFGEHSERAEGQRPGGRSDDANFYGPSARRSPSSMTSGGRGTTTVHTRNLLAFWLLGLCNNFGYVVMLSAAQGHFGTVGNAAKRHGSMHYKTNQTFEFL

SEQ ID NO: 130948 - protein, 39 aa, Heterodera glycines
  Coding regions on vcDNA: vcDNA=SeqID_57371; Strand=-; Position=1 -24,101-196
MKMGRKRQFFCYFEPSNPTEKEVENATIMKLVTCRRMKY

SEQ ID NO: 130949 - protein, 185 aa, Heterodera glycines
  misc_feature (171)..(171): Xaa can be any naturally occurring amino acid
  Coding regions on vcDNA: vcDNA=SeqID_57372; Strand=+; Position=1 -78,382-540,600-668,715-862
  Homolog annotation: Hit_ID=NP_505798.1; Match level="QueryCoverage =97%, HitCoverage=33%, E-value=1e-28, Identity=44%"; Hit description =vacuolar protein sorting 36 (5L440) [Caenorhabditis elegans] emb|CAA96630.1| Hypothetical protein F17C11.
LPLLSSFPLLFPISVGRMLHFIQFSRISLPSKLNQKKSEKVVVSSVRMDRLSWYQTGESMEEILCQAGSVGIYDGDLKQSSFEQGTASLTYQRIIWSSFEQGTASLTYQRIIWADSTDPDCRLVLHHSMVHKIEKQHDCRLVLHHSMVHKIEKQHKTMFGRGGKIVTVNPXRLATRKGPSRERHK

SEQ ID NO: 130950 - protein, 255 aa, Heterodera glycines
  Coding regions on vcDNA: vcDNA=SeqID_57373; Strand=+; Position=1 -248,298-379,439-609,658-708,1073-1213,1264-1338
  Homolog annotation: Hit_ID=NP_524724.2; Match level="QueryCoverage =77%, HitCoverage=17%, E-value=1e-19, Identity=28%"; Hit description =CG5206-PA [Drosophila melanogaster] gb|AAF55786.2| CG5206-PA [Drosophila melanogaster]
MDEEQSTSKILVCHITTMNATKSPSKDSDEKVHGDDWWDDYCYVCSQGCDETTGSLGCCDTCPKVFHAKCHVPMIKKTMEELPNGWQCTLCLPCDPLSQISQSFGEREKLLCSKVYLACFVDFSNVEHFLNAVSTAESDYYSVIKEPIWFNKIATKISSDEYKMISEFVEDMNLLFRNCSTFNLPTNPLSNSGKKVYTLYMKAMREFLPAYEKQIWIYVSLYNGRVSVASSNDEESVRRRGGKRGGQKAKSQTPC

SEQ ID NO: 130951 - protein, 291 aa, Heterodera glycines
  Coding regions on vcDNA: vcDNA=SeqID_57374; Strand=+; Position=1 -103,158-268,381-515,568-680,753-923,976-1066
  Homolog annotation: Hit_ID=CAE75135.1; Match level="QueryCoverage =99%, HitCoverage=56%, E-value=4e-53, Identity=43%"; Hit description =Hypothetical protein CBG23064 [Caenorhabditis briggsae]
AEQHQRTHEHISVAGMDQGDKGELTKSFENIYLAFEDMSKLMEAFEDMSKLMEQAREMVVLSKNITERLRQKKGEITEDETVQLKSYLLSLGVNDPVTKSSFGWSSVFFDKLAAELTSVLLEPIKESGGTMTLPEAFCESGGTMTLPEAFCRMNRARGMEMISPEDLLNACQRLDNPLSLFNFDNGVPLSLFNFDNGVSVLQLRSLNALQISDEILQMVESAGAMDASQLSKASGVPLVLAAERLRYAEEQGKLCRDDTIELRYAEEQGKLCRDDTIEGLFFYPNKFLDID

SEQ ID NO: 130952 - protein, 436 aa, Heterodera glycines
  Coding regions on vcDNA: vcDNA=SeqID_57375; Strand=+; Position=1 -33,80-340,382-502,554-694,1390-1527,1581-1840,1934-2204,2255-2337
MHSSYHKRNYICEYHPDRYADLLKVQEKSAKNKQSLLEQEAIVDTLLEAKGLLSPDVYVLNGRSQEWAFQKLGLSSEPRKDPFIAEEVTDNHKIALCYVCGETFISFSKEEEFRDAWFSHLSTSIHQRCKAMQILVHEDNLVECEGVPAECELRTNSEFRRIDDSSDDEANYGPTVGLDYLIIYNVSDPHPPFSQECKEYVNTVGDENAWSIHIFDDAHFERAARRALYHYERSVVTRSCDVLDNFAHSYPPIWDEQFSVSLGVLSIQSRCEFGLEFIIRDTLSSKLYCTCCFVQCDDNDTQMFSKHARSLEHITRAMHSMNKRNMITLSWRFPNANDRKPLVMDYLVNCRKKLRQEKHGISVYNPALVYKMNCSSALPKRLFKLAKIAPNDRITFIAEHKKKRQPRIVPLNNALNEFCRIEVKLEKKEVIVCHCE

SEQ ID NO: 130953 - protein, 95 aa, Heterodera glycines
  Coding regions on vcDNA: vcDNA=SeqID_57376; Strand=+; Position=1 -352,687-1145
LFEYPKRTLEKIDFFVFGAVPPNRCAQIYGETESFGNSFPIACTLILRWIFAPHNCLSTPNGHLKKSIFFFSGQSPRTDAPRFMGRPNPSGIASL

SEQ ID NO: 130954 - protein, 135 aa, Heterodera glycines
  Coding regions on vcDNA: vcDNA=SeqID_57377; Strand=+; Position=1 -124,497-574,1148-1353
  Homolog annotation: Hit_ID=NP_651999.1; Match level="QueryCoverage =68%, HitCoverage=41%, E-value=2e-14, Identity=50%"; Hit description =CG5812-PA [Drosophila melanogaster] gb|AAF56656.1| CG5812-PA [Drosophila melanogaster] gb|AAO42640.1| LP0
MPMGSGMGGDNGGMGGGGMSGGMPGGMNGGMGGMGGGGDMGGYGSNQGGGGFSNGGPSGFGSAGGASGMMESARYVQSAQGLPPIQIPPYSAEEDGPGSAGHKNAMPPIQIPPYSAEESDDKNVKSIIKPLLPGN

SEQ ID NO: 130955 - protein, 78 aa, Heterodera glycines
  Coding regions on vcDNA: vcDNA=SeqID_57378; Strand=+; Position=1 -19,530-747
MKKDEKRLITFSKMELIIEHTLDVAEDGKRNDKNKLKTIIEWFKNGAWTLEKEGDYDYGLAYSQDKQKALKRVRVVVC

SEQ ID NO: 130956 - protein, 31 aa, Heterodera glycines
  Coding regions on vcDNA: vcDNA=SeqID_57379; Strand=+; Position=1 -51,102-146
MDCIVTLSNSTYVMAETANREKIGYRMIPRM

SEQ ID NO: 130957 - protein, 142 aa, Heterodera glycines
  Coding regions on vcDNA: vcDNA=SeqID_57380; Strand=+; Position=1 -161,739-1006
  Homolog annotation: Hit_ID=CAC21848.1; Match level="QueryCoverage =74%, HitCoverage=49%, E-value=6e-10, Identity=39%"; Hit description =hypothetical protein [Globodera rostochiensis]
MVDFTKRPSTISYHRICTKIYNILGFVSVCAKKPIPKSGIFYFEVNDLNGFASFAAVGLAPKELPLGERAVYFDGTNTDQQNNSYEYSLHSVGFASSFFPIFKNLPSLEPGDVIGCGVNLNTREIIYTKNGKRISGKMKQNK

SEQ ID NO: 130958 - protein, 48 aa, Heterodera glycines
  Coding regions on vcDNA: vcDNA=SeqID_57381; Strand=+; Position=1 -37,747-856
MFIYYCCRTTEKLIPMTDKNRNLPPVHFSVNSGADFTWFNASNTDDCR

SEQ ID NO: 130959 - protein, 181 aa, Heterodera glycines
  Coding regions on vcDNA: vcDNA=SeqID_57382; Strand=+; Position=1 -49,305-484,759-861,1016-1226
  Homolog annotation: Hit_ID=XP_311596.1; Match level="QueryCoverage =40%, HitCoverage=16%, E-value=4e-19, Identity=59%"; Hit description =ENSANGP00000016120 [Anopheles gambiae]
MYIATSKSCNGISGEPSSSSPPVNWRSGALRGGRKVTKEPAYAFILPNLEQYPADFRHFLERDIIEISTLRRLENSGHLNWWCQHDSNQRLWPLVTTGDGNCLLHAASLGWHLGCPRPAAELAQHAARCAEIREPKTCHLPALALARVQEQFGVGFGAVGGGMAPGMERRVGVGIADTAPK

SEQ ID NO: 130960 - protein, 33 aa, Heterodera glycines
  Coding regions on vcDNA: vcDNA=SeqID_57383; Strand=-; Position=1 -62,224-263
MTITIGQRNKRSMGRRMGEVRFFFCNLANQTVT

SEQ ID NO: 130961 - protein, 102 aa, Heterodera glycines
  Coding regions on vcDNA: vcDNA=SeqID_57384; Strand=+; Position=1 -305,645-649
  Homolog annotation: Hit_ID=XP_522969.1; Match level="QueryCoverage =99%, HitCoverage=64%, E-value=2e-09, Identity=37%"; Hit description =PREDICTED: similar to putative protein family member (XC187) [Pan troglodytes]
TTVIRRGTTVIRRGTTVIRRGTTVIRRGTTVIRRGTTVIRRGTTVIRRGTTVIRRGTTVIRRGTTAIRRVIRSGTTVIRRGTTVIKRGTKVIKRGTTVIRRD

SEQ ID NO: 130962 - protein, 87 aa, Heterodera glycines
  Coding regions on vcDNA: vcDNA=SeqID_57385; Strand=+; Position=1-319
TIFETQTKKILDQKIAISFFSFFYRKLGNNRCLLLSGPIKQSYDIETQTKKILDQKIAISFFSFFYRKLGTNSCLLLSGPIKQSYDI

SEQ ID NO: 130963 - protein, 39 aa, Heterodera glycines
  Coding regions on vcDNA: vcDNA=SeqID_57386; Strand=+; Position=1 -98,207-228
MYSKFYLSPMGDKWRLGDYFLNSSERGDNWRLRCFFIIY

SEQ ID NO: 130964 - protein, 37 aa, Heterodera glycines
  Coding regions on vcDNA: vcDNA=SeqID_57387; Strand=-; Position=1-129
LRPPGGLFFNLFRNVDIIGDRAFNGDGGIIFQQIFND

SEQ ID NO: 130965 - protein, 82 aa, Heterodera glycines
  Coding regions on vcDNA: vcDNA=SeqID_57388; Strand=-; Position=1-529
SVHLNNFYPKNFFWVFGAVPPNRCAQIYGETESFGNSFPIACTLILRWIFAPHNCLSTPNGHLKKSIFLFSGQSPRTDAPRF

SEQ ID NO: 130966 - protein, 95 aa, Heterodera glycines
  Coding regions on vcDNA: vcDNA=SeqID_57389; Strand=-; Position=1 -184,412-512
MSPADFYQQQKSIHTKQMLQQSPIAQQFHPSSTSNSVFPQLSDFVEDGLVDDLVVPSISNEDDFDLDLIEPMRCGDHQQQGYHQQNQHQQQNIIE

SEQ ID NO: 130967 - protein, 305 aa, Heterodera glycines
  Coding regions on vcDNA: vcDNA=SeqID_57390; Strand=+; Position=1 -127,174-440,488-583,633-800,845-1104
MAGHHSDADVEELMAKHKAVLEREQRALAEQQYWRDFAFQPSGESIAEQALHPTGLEMEIQRYNFEHQQQERRLQQERIWKEQREAEMLEKKMRRIQLEQQKSQQHQAKDSTRKRTQQQAQISTPTKAETKNCGKNGTLSSPGNARKQPQHAVSRLYFSEANAEPEHAAPASAVLTTEQPIAIIQPDPEAIRAREIIDQRLNIQEADFVEDVHCGSDDKAPGPHPNFNAVHMEIVSSKKEGSWRDNNETCGVCTEPLLRGDLVTQLPCDANVKHIFHTICLRRSLTINRTCPKCRRPVNIPDDIW

SEQ ID NO: 130968 - protein, 89 aa, Heterodera glycines
  Coding regions on vcDNA: vcDNA=SeqID_57391; Strand=-; Position=1 -141,948-1073
MAPKCLGGKHNECHVVPSLALSPSFSAGCTVPPIRNGRLDQFEQGEARGDWSPGLKPECVPQVHPAVEGQILWSRPGRRRRRRRHLLSG

SEQ ID NO: 130969 - protein, 66 aa, Heterodera glycines
  Coding regions on vcDNA: vcDNA=SeqID_57392; Strand=+; Position=1 -61,1230-1369
MLVVIIHPEQWNGGSDRCTIAELKRRGLRPRIQMAGSVMPHIPESRIYYQERQSHCKQLELDDLER

SEQ ID NO: 130970 - protein, 33 aa, Heterodera glycines
  Coding regions on vcDNA: vcDNA=SeqID_57393; Strand=-; Position=1-6,99- 194
MGGPKTYEVTEESLKQLVNFQMNICGSVHSYKL

SEQ ID NO: 130971 - protein, 136 aa, Heterodera glycines
  Coding regions on vcDNA: vcDNA=SeqID_57394; Strand=+; Position=1 -239,542-710
  Homolog annotation: Hit_ID=CAE63510.1; Match level="QueryCoverage =91%, HitCoverage=5%, E-value=4e-28, Identity=53%"; Hit description =Hypothetical protein CBG07989 [Caenorhabditis briggsae]
MDIAADTLLHPIALLLLRLHSRRVSETSSEVEDIVVAELTSSNKVLSGSAVRKFHDLWVFCRSAVIEEVYAGILLKPMNRVVMVLLSFIADDKLSAEQVELKALAYAWFLDCAHHNELHKIVQMLTLMLLNPVTAR

SEQ ID NO: 130972 - protein, 77 aa, Heterodera glycines
  Coding regions on vcDNA: vcDNA=SeqID_57395; Strand=+; Position=1-236
  Homolog annotation: Hit_ID=NP_495862.2; Match level="QueryCoverage =97%, HitCoverage=17%, E-value=2e-14, Identity=47%"; Hit description =FUcosyl Transferase (50.0 kD) (fut-1) [Caenorhabditis elegans] emb|CAG32977.1| core alpha1,3-fucosyltrans
SHFFYFAFENAVCPNYVTEKFWKALRNLVVPIVLSRKVMEEVGIPNGTFIAVDDFNSVKALAEYLKELQRDKDKYMR

SEQ ID NO: 130973 - protein, 36 aa, Heterodera glycines
  Coding regions on vcDNA: vcDNA=SeqID_57396; Strand=-; Position=1 -3,216-323
MKSAQFSSLLQNQSILINKNKWKPWFKGQLLTKSDY

SEQ ID NO: 130974 - protein, 92 aa, Heterodera glycines; identical to SEQ ID NO: 125147
  Coding regions on vcDNA: vcDNA=SeqID_57397; Strand=+; Position=1-304

SEQ ID NO: 130975 - protein, 46 aa, Heterodera glycines
  Coding regions on vcDNA: vcDNA=SeqID_57398; Strand=+; Position=1-141
LFTEDFILEVSQKNGYLFFDNFIHIQMLSSMIGRAVRNRPFIFEGI

SEQ ID NO: 130976 - protein, 53 aa, Heterodera glycines
  Coding regions on vcDNA: vcDNA=SeqID_57399; Strand=+; Position=1 -100,302-363
MTMKRSQPSGQKPVASSSDDVLQQQNGGIAKRKVLKMAQILFYHILALMICLL

SEQ ID NO: 130977 - protein, 39 aa, Heterodera glycines
  Coding regions on vcDNA: vcDNA=SeqID_57400; Strand=-; Position=1 -94,741-766
MTLTRIFRTILTFTRIYITILTLTRIFQNDSDEYPCLMA

SEQ ID NO: 130978 - protein, 71 aa, Heterodera glycines
  Coding regions on vcDNA: vcDNA=SeqID_57401; Strand=-; Position=1 -33,142-324
MSWVFRFDLNWILKGGNLAKIFNPSPFQDKFLETLRTFKLPFSNSGQMYFHPEFRKNLKIQGFVLYCISEM

SEQ ID NO: 130979 - protein, 76 aa, Heterodera glycines
  Coding regions on vcDNA: vcDNA=SeqID_57402; Strand=-; Position=1 -157,230-303
MAMKCFTYIFLGAKTKARQTKCFYLFIHSLGFFPFIIYFSSTSLLHYHNPFIVIVVSLSVPYSLSLHLFRDDDEDQ

SEQ ID NO: 130980 - protein, 100 aa, Heterodera glycines
  Coding regions on vcDNA: vcDNA=SeqID_57403; Strand=-; Position=1 -78,639-863
MMILANGADPNATDSAAMSPLAHVLEKKKTGTKSEESTVKKPECVDVEEAIWKEWQQMALKTRRNEQRKTPRRKGTGVLEPSKHKPRPSRKLRPKPKLKA

SEQ ID NO: 130981 - protein, 364 aa, Heterodera glycines
  Coding regions on vcDNA: vcDNA=SeqID_57404; Strand=-; Position=1 -78,644-850,1308-1421,1629-1819,2004-2018,2127-2302,2775-2851,2906 -3040,3211-3312
  Homolog annotation: Hit_ID=XP_394049.1; Match level="QueryCoverage =80%, HitCoverage=37%, E-value=3e-36, Identity=36%"; Hit description =similar to CG6718-PB [Apis mellifera]
MMILANGAGPNATDSAAMSPLAHVLEKKKTGTKSEESTVKKPECVDVEEAIWKEWQQMALKTRRNKQRKTPRRKGTGVRALSLDGGGIRGIVLVQMLIEMESLMYGEGLQAGGHEKNFVQKNFNWIIGTSTGAIVALALVSGISLIDALRLYLRLKDSVFGARAQLIGYNAQNLETFLQAQFGENKKMAELSRGNIKGLKIGLFTTATYVGQKPPRLVKFRNFISALNEYDPYKTNIWLAARYSTAAPTYFESRDKFMDGGLLANNPSLELLDEISKENALAKQHNEPQYELECFVSLGTGKAPTEPVGTTSLEIGIIGAIKNLAGILMDQASHSPGKNMDFHIIGIPNYDPSKMVELWAPWCR

SEQ ID NO: 130982 - protein, 49 aa, Heterodera glycines
  Coding regions on vcDNA: vcDNA=SeqID_57405; Strand=-; Position=1 -78,959-1030
MMILANGADPNGTDSAAMSPLAHVLEPQQQPAPMSIYERFNKEVCEKNP

SEQ ID NO: 130983 - protein, 97 aa, Heterodera glycines
  Coding regions on vcDNA: vcDNA=SeqID_57406; Strand=-; Position=1 -174,305-424
MTNLVSFQIQHRLAKHMDREHFEKVLALIFWEKADPEKAMLPKRPLDLGPGKRGQVLTALNLFVFCKAYRASEELSNVTNNVGFGTKFVVFVDYQKV

SEQ ID NO: 130984 - protein, 167 aa, Heterodera glycines
  Coding regions on vcDNA: vcDNA=SeqID_57407; Strand=+; Position=1 -147,196-469,656-738
MHPFVLRNFLSENDWPPLRLWTDDYLTEKLGKGQCLNVRIGEKRHFRGKVLHEHQCDRHTFENSASMLKWMKSANFGPVNGNEETSSAYPNPNTHWAYLDYRDVLELLEQDEAQYVDWSLLGMKNATGEGENWRNSTVWIGLFGVAGRESDIHFYQVRTPDPNSNRN

SEQ ID NO: 130985 - protein, 75 aa, Heterodera glycines
  Coding regions on vcDNA: vcDNA=SeqID_57408; Strand=-; Position=1 -75,153-287,339-356
MEGNHWRREQLFHFAEIVRLDLMKTTVIATQCANISSAGKAEKIQKEMHAIGIMLQEISSHVATWIEKKLENIKK

SEQ ID NO: 130986 - protein, 107 aa, Heterodera glycines
  Coding regions on vcDNA: vcDNA=SeqID_57409; Strand=+; Position=1 -198,443-568
MIETPQKFTDKVTEEEGNISAAEMKKMRRKANKVKAVEEKAKQNGQIQGKQVKQLGNHKGWKQLELLLVMLQCLNKIVTLDPSNENTKKLFGKYMEKCLFFVDDSVF

SEQ ID NO: 130987 - protein, 202 aa, Heterodera glycines
  misc_feature (18)..(18): Xaa can be any naturally occurring amino acid
  Coding regions on vcDNA: vcDNA=SeqID_57410; Strand=+; Position=1 -105,179-229,287-422,474-609,654-697
  Homolog annotation: Hit_ID=NP_497181.2; Match level="QueryCoverage =77%, HitCoverage=27%, E-value=2e-37, Identity=53%"; Hit description =protein kinase (3A877) [Caenorhabditis elegans] gb|AAF59648.4| Hypothetical protein Y50D7A.3a [Caenorhabd
IRGDLSNGDHSKNNVLFXGAGQQPSGFYRMYEPKEVIGRGLASVVRRCVEKGSRKESRKEYAVKIVDLSTERQSEREAKRLSEETFSEVRLLKLLSGHPSIICLHEFFITTTFVFAIFELARIICLHEFFITTTFVFAIFELARCELFEALNKSVTFSEKRTRLVMRQLFDGVHYLHSVSYLQVMRQLFDGVHYLHSVSYLQ

SEQ ID NO: 130988 - protein, 24 aa, Heterodera glycines
  Coding regions on vcDNA: vcDNA=SeqID_57411; Strand=+; Position=1-80
RTLSTAVRQRSSKIYSMPQILWAG

SEQ ID NO: 130989 - protein, 218 aa, Heterodera glycines
  Coding regions on vcDNA: vcDNA=SeqID_57412; Strand=+; Position=1 -361,413-578,622-643,697-804
  Homolog annotation: Hit_ID=CAE60646.1; Match level="QueryCoverage =97%, HitCoverage=22%, E-value=8e-41, Identity=43%"; Hit description =Hypothetical protein CBG04292 [Caenorhabditis briggsae]
MDKAGGFIGYMFVPVLGEKGIIHKNLSELLVEAGLASVHFTADRSSYYNHLLAAEKSAKGAKLGIWKHFDETTGGNTTTNHEEERRKQDNDASERKLQFKKVLATEIYPGFRFAAQYFDDGPTIEKLMQALQIEMKGVPTGQFVPKRQQICAAKYTDGDLWHRAKVEAQKGDKIDVYYIDFGNREALSLERIAPLPPQFHSQPPLVKEFQLALIAGVN

SEQ ID NO: 130990 - protein, 276 aa, Heterodera glycines
  Coding regions on vcDNA: vcDNA=SeqID_57413; Strand=-; Position=1 -273,324-522,585-943
MSANNYSAVRNNGPAQANRGRKRAQPADLELERLREEKRRRRQRRKEEEVQRQRALIRLRTDYRNARNAVMAGQYRMSVTATTTFLAIPQITQVRGQPSVPFTSVINYEPNVPIVVPPPLLGQQTIVPHLPAPVPLLPRSDDAVSNVTAALNSNTQFGPILHRTLATSPTNPQPVPLFHRIVTRPTDPRLGFQAAHQPSAVPPMALLSQIPPPPLPPFLQKPSTSARPCAATSAKSRKKAYSSDDSTWSGGSEACTLPKRRLVICSEDDGEEKKKE

SEQ ID NO: 130991 - protein, 141 aa, Heterodera glycines
  Coding regions on vcDNA: vcDNA=SeqID_57414; Strand=+; Position=1 -249,297-473
MYCESCAHHVKKASISLYMKLELRDCEDPEISQIATVFSVVAEHYMNLKVEQFANMVDEHPEQLEALLKSKIEQTVIVKLNIKFKAKGELETLDWIISSIQQENGEEGMPQEGKKSTDANTEDGEIIEIDGPLKKRVAKKN

SEQ ID NO: 130992 - protein, 307 aa, Heterodera glycines
  Coding regions on vcDNA: vcDNA=SeqID_57415; Strand=+; Position=1 -316,381-988
MAHFEAPKADEKQPQQRTPLFEQKQHYVHRVERFALQRHVTEFVLNGQYDEPEEALLRAFEHIIARAVRNAEDSQQQTDGAGISAGDGARRQQRVTRLGILLNGRGLTDPIVLPIRPPEQNTAEVLMAELDKLGQSDGDEEVHGGGISKRSLLLSEPIEVVITCIAPPVGAAPRFYQYQHWGYDDRQMIRVTNLDDNFCLFHALIATRAYTDQEFLKTTSQRQSATDADHGHQSNAVPAEIARRVMTRTDFCAGYEALNRLVSNRERMNAAVTELMRAADIPADQEAYGLEHLDQIQQLWVSCWCWK

SEQ ID NO: 130993 - protein, 371 aa, Heterodera glycines
  Coding regions on vcDNA: vcDNA=SeqID_57416; Strand=+; Position=1 -269,317-729,973-1406
MCHLQLDFWLRRMLQNWYCLVDDMKSNHNLKVIKRARHEVNAPPAVPQSVDQLIVPPAYQTYESTDGEVEQFLLADSGVYYEAGNENPQRILLFGRESFGRWADRMKDCFGDGTFSLAPPMFYQIYTILAKCCFNLISRENCFKAWVVGYRRVPLLADVQVASVLREDVWTSPSSVADILACLVQHGLRDSCAQRRCCHVSCMRNQILLLPFRAEFAKKNQGTKSLAGCSTITLDNRGQMELGLNHSSHQNNGTSRTLNGEARTNNYAEAEHHRLQGAFNCRHPSIWHFIDVLRREQKGTDGKYASFIAGLEPPKKAKKYQAADERIFNLVQNYNPVNPNYDNDHNYHINQNHHIILEFLRGISRNYHMNP

SEQ ID NO: 130994 - protein, 95 aa, Heterodera glycines; identical to SEQ ID NO: 125597
  Coding regions on vcDNA: vcDNA=SeqID_57417; Strand=-; Position=1-828

SEQ ID NO: 130995 - protein, 64 aa, Heterodera glycines
  Coding regions on vcDNA: vcDNA=SeqID_57418; Strand=+; Position=1 -85,188-297
MLDLVYKEKSYSQKHAGAETGAPKRSGPVTKGSVTKSSALLVNSTFLNFIKNKRGTLSFCKIFL

SEQ ID NO: 130996 - protein, 46 aa, Heterodera glycines
  Coding regions on vcDNA: vcDNA=SeqID_57419; Strand=-; Position=1-140
MERFVQWLNEQLQKHDIGSGQKRDWMELAAHAHYAIVRQMTNLYGM

SEQ ID NO: 130997 - protein, 26 aa, Heterodera glycines
  Coding regions on vcDNA: vcDNA=SeqID_57420; Strand=-; Position=1 -55,111-136
MMYRIRGPVYYEEFIFLNTHTMLDFL

SEQ ID NO: 130998 - protein, 81 aa, Heterodera glycines
  Coding regions on vcDNA: vcDNA=SeqID_57421; Strand=-; Position=1 -145,372-472
MTVISCEMKHIMTVISCEMKHIMTVISCEMKHIMTVISCILFFSLHLKRNPELDLLFLDKNPGKSRPMTNPVCRKIAWTWN

SEQ ID NO: 130999 - protein, 273 aa, Heterodera glycines
  misc_feature (270)..(271): Xaa can be any naturally occurring amino acid
  Coding regions on vcDNA: vcDNA=SeqID_57422; Strand=-; Position=1 -107,152-293,360-516,572-693,750-925
  Homolog annotation: Hit_ID=CAE68352.1; Match level="QueryCoverage =94%, HitCoverage=64%, E-value=8e-56, Identity=46%"; Hit description =Hypothetical protein CBG14085 [Caenorhabditis briggsae]
ALSAECFPANVLITGGCGFIGSNFVNFAFDRWPQAKFVNLDKMAPGASEFVNLDKMAPGASEERIEKKCRNSDRYLFVKGNLTEATLVRNILTRNRIDTIIDTIVHFAALTHVDESYANPTEYMQENTVAMTVLLEAAKDHGQLAKLVHISTDEVYGDCLNAEEEVYGDCLNAEEPKREQSPMEPTNPYAVSKAACELLLRSYWHSYKVPYVMVRHSYKVPYVMVRMNNVYGPRQFRNKLVPKFVRLAMEKRPFTLAGGGTPKRWNLENXXFE

SEQ ID NO: 131000 - protein, 249 aa, Heterodera glycines
  misc_feature (6)..(6): Xaa can be any naturally occurring amino acid
  misc_feature (19)..(19): Xaa can be any naturally occurring amino acid
  misc_feature (24)..(24): Xaa can be any naturally occurring amino acid
  Coding regions on vcDNA: vcDNA=SeqID_57423; Strand=-; Position=1 -245,397-534,577-677,781-856,907-1005
  Homolog annotation: Hit_ID=CAE70434.1; Match level="QueryCoverage =94%, HitCoverage=44%, E-value=1e-35, Identity=37%"; Hit description =Hypothetical protein CBG17010 [Caenorhabditis briggsae]
NLIKLXKCEVHAMKMQFDXWEMPXETSSTIIAWGMAHLLNNPQSLTRVYDELDKVMGDERRLINAGDKARLPYTNATINEFLRISNMIVQNAYRRVFVDVTIGNFQIPKGTCILPQISVVLADDEVFDNPKMFRPVFDNPKMFRPERFLDENGNFVTCEKLIPFSVGRRKCKCFAESMAKMEIFLFTANILNQYRVLSVGKVLPSIKREMGITIHCLSVGKVLPSIKREMGITIHCPKFECRVEKRIGH

SEQ ID NO: 131001 - protein, 19 aa, Heterodera glycines
  Coding regions on vcDNA: vcDNA=SeqID_57424; Strand=-; Position=1-58
GLLGSWVRVPPGELPFMFY

SEQ ID NO: 131002 - protein, 275 aa, Heterodera glycines
  Coding regions on vcDNA: vcDNA=SeqID_57425; Strand=-; Position=1 -25,658-849,922-1068,1294-1757
  Homolog annotation: Hit_ID=EAA20445.1; Match level="QueryCoverage =95%, HitCoverage=68%, E-value=1e-17, Identity=25%"; Hit description =hypothetical protein [Plasmodium yoelii yoelii]
MAYKKSIYETKHNKRYNDEERVQIIENYAQTSKIINTKFANYSKEQRAEMISKIIGVNIGTITKWKRRFSLQRKRLNDVQREEIMAEYYKLKNGEEKLSDVAIAKQLDISINNLKLLKKTCGHIQNGTNNKKEEATKKEKLPNGKKKKEIIKKKKQINDRQNGEELSKSSNASTEEEIPKKKKTQKEVKKGQKESKSGEKIIKTEQKENKSGQKVIKEEQKESQSGEKIIKEKQKESQRGQKIIKEKQKESQNDEKIFKEELKEIKTEPIEIKQE

SEQ ID NO: 131003 - protein, 169 aa, Heterodera glycines
  Coding regions on vcDNA: vcDNA=SeqID_57426; Strand=-; Position=1 -42,113-209,556-647,705-813,1024-1193
MEMELKMAKLELENKEQKLKQQQELIGEQNALKEKLAKIEQEKKNIATSDQFSEMQNDRKILLKKISQLKKEPKQRKALLNFKQNYWVANDCDEKLEIIGDKKLIVHYKGDYKVISSALDSPLYSRQMNRINQCDMKRTLMHMKVMAVFGLTEKERDQLPNIPTVLAIP

SEQ ID NO: 131004 - protein, 81 aa, Heterodera glycines
  Coding regions on vcDNA: vcDNA=SeqID_57427; Strand=+; Position=1 -165,729-809
MIETQFNAFLNKEQQRAFEFKIKLSGRTCTLSINGVKLSNNQFRQLPAWATNYIRLKGGWKRHEKKAKIDPNAVKIIYKAM

SEQ ID NO: 131005 - protein, 128 aa, Heterodera glycines
  Coding regions on vcDNA: vcDNA=SeqID_57428; Strand=-; Position=1 -29,73-205,441-599,671-733
MRKHEIQLFKNDFIINYCQNHINKMVNERRILYQKANYFYKIDKYDEAARTINLSIVQSGTKNEEINKMEADLFANANKKDVKQRLEFIKRLEVLRSLERLDEEKETALNECLWNLQDDLLKTCRDVW

SEQ ID NO: 131006 - protein, 53 aa, Heterodera glycines
  Coding regions on vcDNA: vcDNA=SeqID_57429; Strand=-; Position=1 -21,232-372
MEIDHLLFLFYWPRLIFTFVLPVTIILIANLAIAFKVRSLNIIQGQCEQIETL

SEQ ID NO: 131007 - protein, 137 aa, Heterodera glycines
  Coding regions on vcDNA: vcDNA=SeqID_57430; Strand=-; Position=1 -63,357-568,714-849
MTNSGGNYTPPAQTQPNYSCQHQSPYLAHSQRLSAHPSPAPSVRPLSQTPSSVHSMNNATIQQQQQQQTQFNQTATHSYEQHQRFLADQRQRMLDFQQQQQFVASHQSVSVSTFQQRKPREMHSITFHKGSHGLGIR

SEQ ID NO: 131008 - protein, 44 aa, Heterodera glycines
  Coding regions on vcDNA: vcDNA=SeqID_57431; Strand=+; Position=1 -17,125-242
MTYVFCFYIILAINLYIFRLVNRDQIAKLWSYSQTKIENFNQTI

SEQ ID NO: 131009 - protein, 36 aa, Heterodera glycines
  Coding regions on vcDNA: vcDNA=SeqID_57432; Strand=-; Position=1-131
LYVYFILQIVIYIMLLVTRNQTEKFWNYSQDIRLFD

SEQ ID NO: 131010 - protein, 36 aa, Heterodera glycines
  Coding regions on vcDNA: vcDNA=SeqID_57433; Strand=-; Position=1-131
LYVYFILQIVIYIMLLVTRNQTEKFWNYSQNIRLFD

SEQ ID NO: 131011 - protein, 108 aa, Heterodera glycines
  Coding regions on vcDNA: vcDNA=SeqID_57434; Strand=+; Position=1 -25,79-153,660-886
MLMNGFETGLLSINGAVFCTYPDLIYTSGSVGLCNRTWLLCIVPTVYAIILSLYTTPILFSGLYMSWFFNPYVGYVDDFGKIVKIFNIFSIYHTVSLSQLQYHSPMHT

SEQ ID NO: 131012 - protein, 81 aa, Heterodera glycines
  Coding regions on vcDNA: vcDNA=SeqID_57435; Strand=+; Position=1 -81,314-478
MFVIFGLSAIYITFSVLLIIQTQSYNNTFLQVVLISFFNGMAAGIYIYMQSVRISDALIIAGTYAWLLAHGTQMAAFHFLN

SEQ ID NO: 131013 - protein, 102 aa, Heterodera glycines
  Coding regions on vcDNA: vcDNA=SeqID_57436; Strand=+; Position=1 -135,427-600
MAFVRSFRRYNDYYRIGMDQLIGWVLVSEDSFVRRVVLQENLAAQLELLPRFMDDNASMHYNSREKQFATRYQLQNPLPSIFVAEYGDCPTMKKVAKLGNVH

SEQ ID NO: 131014 - protein, 86 aa, Heterodera glycines
  Coding regions on vcDNA: vcDNA=SeqID_57437; Strand=+; Position=1-261
MRRRLQKRFKYYEKKQKLEETAARKKATAAEKRARETEEEKPDETKKVGKERGKGECGREKEEMGGKKEEGKEKKKSKWEKGRKNG

SEQ ID NO: 131015 - protein, 86 aa, Heterodera glycines
  Coding regions on vcDNA: vcDNA=SeqID_57438; Strand=-; Position=1-290
AEILKNSSNCQKRRNSPPNPLRVDVIEGQLPKLFSAAQHAHLQVLLHKARISDGFALALNKRKCANGLARKRSECCLMRLLISFNF

SEQ ID NO: 131016 - protein, 376 aa, Heterodera glycines
  Coding regions on vcDNA: vcDNA=SeqID_57439; Strand=+; Position=1 -50,102-377,429-797,1619-1894,1950-2109
  Homolog annotation: Hit_ID=AAL78214.1; Match level="QueryCoverage =37%, HitCoverage=74%, E-value=7e-11, Identity=29%"; Hit description =putative esophageal gland cell protein Hgg-20 [Heterodera glycines]
MSSDNQNEAEAKMANAIFISADCWLCVFDLLAPSQLGLGIALISHRFDFYVDEHFKTRKWTLAFIRIWHKIGENGTKKMEIVNFKWKALPIPQIQMSRKVIGFKRIYIQYIDQNVIAFLHRFRQLFAACQINLNIQTDNDRISEFILRNIWPMLGKNIHGIETSASFFHLLRQMAPSILSDCPSLRFVIFYAGDLFAEFPPDDSAAASDGQSVAKWLFTPRPDDVPKVFKCCFISADCWLSVFDLLSPRKLGLGIAMISHRFDFYVDEHFKTRKWALKFIEIRSKIGKNGTKEMEIVNYDKETLPIPQIQMPRKVIGFKWINIYYIDRNVIAFLHRFRQLFAACPINLDIDMRSDRISEFILHNIWPLLGKNILVL

SEQ ID NO: 131017 - protein, 126 aa, Heterodera glycines
  Coding regions on vcDNA: vcDNA=SeqID_57440; Strand=+; Position=1 -66,138-406,461-506
MFNCWLTLDDGNLASRIEHFKAAFANASSPANFIAIISFPLPFADSVVPFALTNELTREQLALKVIDNSHRFLFVRCPIARDESKWTKWEEEAIYWRICDQWNQTEIRICDGFLDEIPGPIDQQQK

SEQ ID NO: 131018 - protein, 401 aa, Heterodera glycines
  Coding regions on vcDNA: vcDNA=SeqID_57441; Strand=+; Position=1 -67,116-189,251-503,570-664,716-850,920-1144,1260-1365,1458-1549
  Homolog annotation: Hit_ID=NP_508783.1; Match level="QueryCoverage =89%, HitCoverage=56%, E-value=6e-98, Identity=53%"; Hit description =AMmonium Transporter homolog (61.1 kD) (amt-4) [Caenorhabditis elegans] gb|AAA96190.2| Ammonium transport
FRSPIRDNQNAFFLTFMALLIFLMQCGFAFLEAGAVRMQCGFAFLEAGAVRAKNVTNILTKNVLDSLITIVNVLDSLITIVSYWSLGWALAYGANPVTILSPFFGASQFFGQQISDFGRFFFQYVFAARASTIISGAVAERAEFTTFFVYSLLVPGFAFFAFPVLAHWGWSSVGWLHKGITVGEHNSFHTDLAGAGVVHLCGGTIDLAGAGVVHLCGGTISLIAAWMMGPRIGRFSSEGQPCKMEGHSVPLASLGLASLGGFILMLGFLAFNGGSVADISLPGNGLLVAKAMINTLLCGAFAAICTLIIHKIRNGKWTVLLTMNACLAGMIAACAGCNQMDAWGTIVTGVGAGLIYMALSGLMLRLPFSHYPFSHYLSFFSCFSLSHFYTLSLFSFIVRSD

SEQ ID NO: 131019 - protein, 37 aa, Heterodera glycines
  Coding regions on vcDNA: vcDNA=SeqID_57442; Strand=-; Position=1 -60,1504-1557
MHQQKQRQKKEKKKKQQQQNTMTSIVTAMKTLKYSNE

SEQ ID NO: 131020 - protein, 67 aa, Heterodera glycines
  Coding regions on vcDNA: vcDNA=SeqID_57443; Strand=+; Position=1-368
RSRTKRRRTNFSTITFFFLNQIKHSWYYSKAFEKCYYPANFQKFLFMHKKIRAKKVRITGFLSSFWP

SEQ ID NO: 131021 - protein, 102 aa, Heterodera glycines
  Coding regions on vcDNA: vcDNA=SeqID_57444; Strand=-; Position=1 -149,205-364
MTIGMVGSVAMSPRAAEVHRQMLQKLGMDASNVPPNRAVNTMARGLFNGWLRFGDADALVVFIVSPEDKFRFDERAIENELQQISDGQIEVERMTSEEAFCQ

SEQ ID NO: 131022 - protein, 44 aa, Heterodera glycines; identical to SEQ ID NO: 131008
  Coding regions on vcDNA: vcDNA=SeqID_57445; Strand=-; Position=1 -17,125-242

SEQ ID NO: 131023 - protein, 36 aa, Heterodera glycines; identical to SEQ ID NO: 131009
  Coding regions on vcDNA: vcDNA=SeqID_57446; Strand=+; Position=1-131

SEQ ID NO: 131024 - protein, 30 aa, Heterodera glycines
  Coding regions on vcDNA: vcDNA=SeqID_57447; Strand=+; Position=1 -21,507-578
MEHSVKNNNSIIWLSDHDSLDEKCINLLQG

SEQ ID NO: 131025 - protein, 205 aa, Heterodera glycines
  Coding regions on vcDNA: vcDNA=SeqID_57448; Strand=-; Position=1 -59,859-1084,1271-1387,1445-1490,1557-1648
  Homolog annotation: Hit_ID=CAF96189.1; Match level="QueryCoverage =99%, HitCoverage=60%, E-value=4e-34, Identity=41%"; Hit description =unnamed protein product [Tetraodon nigroviridis]
LRIQVNPENKVEFPNISPEKTLGLSKTLAHSLPQIKGYQKLCVKVEERRLESYCANCSEHEWELLRLWKLLKPEEALEGRITDQWQQIGFQGDDPKTDFRGMGMLGLDQLVFFAQFDLDNCQRVLSLSNHPIIGFPFAICGITITFPFAICGITITALCKELLFDDLLKNHFYNELLFDDLLKNHFYNALDQPSLSEDHFHQVYC

SEQ ID NO: 131026 - protein, 199 aa, Heterodera glycines
  Coding regions on vcDNA: vcDNA=SeqID_57449; Strand=+; Position=1 -155,198-363,838-1116
MNALSAVFPATNILCCMFHYGQNLYRKMKGLKLVQMYGEQSVRGEAVRHSFRNVLSLPLLPPTYVRRAFSVIAGTAPMEMAQFLLYFARNYIGMTQRQLLDGANAFGKGLCHHPALSDFISEVSGSIDRQVDAARSARNFIHKRYVLQDAVIMRILADATYNDDAEIHDVMTALGLQVEGYAGKLKDYENTEDSIMNFA

SEQ ID NO: 131027 - protein, 395 aa, Heterodera glycines
  Coding regions on vcDNA: vcDNA=SeqID_57450; Strand=+; Position=1 -103,157-267,473-583,654-886,934-1129,1281-1429,1539-1823
  Homolog annotation: Hit_ID=EAL29215.1; Match level="QueryCoverage =99%, HitCoverage=64%, E-value=1e-56, Identity=37%"; Hit description =GA17577-PA [Drosophila pseudoobscura]
MGFGGQFGVQSDRQDKSAAGWDEREKAAKHESQTDYKKGFGGQFGVQSDRKDKSALGWNEVEKVKPHESQTDYKKGFGGQFGIQSDRKDKTAHGWEEHEKVEKHESQTDYKKGFGGQFGVQSDRQDKAAHGWNEKAREEGDGAAKTAAETQKNGAQRQQKSDGPTHGAAKSLRRKFEQMASQGEQQNLDRVREERERRKREDEQLRERRGEEERQRQQRLEEQWAKQSEEGEKGEEQQQKVQQQPKQRPTIGVRLPYAAAPVPEQQQQRNSRLVEENSAEIASEHSVAETEVEEPQPPPVKVLPSVADIAQHKMFMGAVSHDELKKHANLDTKGEEEKLRDSGEWADEPKNSMPKETDEEQKERAQQQQVGREKQRENSKNKEPKIKPKLYLNGR

SEQ ID NO: 131028 - protein, 183 aa, Heterodera glycines
  Coding regions on vcDNA: vcDNA=SeqID_57451; Strand=+; Position=1 -168,586-882,999-1085
  Homolog annotation: Hit_ID=NP_005222.2; Match level="QueryCoverage =96%, HitCoverage=38%, E-value=2e-20, Identity=33%"; Hit description =cortactin isoform a [Homo sapiens]
MFMGAVSHDELKKHANLDTKGEEEKLRDSGEWADEPKNSMPKETDEEQKERAQQQQHHQYELPPIVYDELPDVVTSSAITPADAALSNHSENDQNVPPPADPTPAVKEEPSAGESTAAPLDTSAGATAIALFEYERQDDDEIGFEVNDIITDIEQIDVGWWRGVCKGRYGLFPANYVQLTERK

SEQ ID NO: 131029 - protein, 104 aa, Heterodera glycines
  Coding regions on vcDNA: vcDNA=SeqID_57452; Strand=+; Position=1 -17,68-365
MIRQGCAPIETIHLLREFGLRSTDEIQRERLIEAGKGLKMLEIEAREIAREDESVEREEEGKDAREEERVAEKERDIGRKEGKREESAAKEEKDAGRKQQQKAN

SEQ ID NO: 131030 - protein, 112 aa, Heterodera glycines
  Coding regions on vcDNA: vcDNA=SeqID_57453; Strand=+; Position=1 -238,512-613
  Homolog annotation: Hit_ID=CAE73351.1; Match level="QueryCoverage =93%, HitCoverage=47%, E-value=4e-18, Identity=47%"; Hit description =Hypothetical protein CBG20783 [Caenorhabditis briggsae]
YCDQTVPDEFLHLIYPGPVTLLFNRTDAVPSDFNPGCSTVGVRVPQAKFVRDLCRRMPFRLLAQTSANVSGGPNPLCIRDFEEIWDDIDLIVDAGEIIENNGADEGSTGGRT

SEQ ID NO: 131031 - protein, 42 aa, Heterodera glycines
  Coding regions on vcDNA: vcDNA=SeqID_57454; Strand=-; Position=1-128
MNQFPWGLRMTKYEEQLGADLIEHGLAGHNIAKYSIEKKLNV

SEQ ID NO: 131032 - protein, 17 aa, Heterodera glycines
  Coding regions on vcDNA: vcDNA=SeqID_57455; Strand=+; Position=1-66
HKHLFDLFYHIHNLIKI

SEQ ID NO: 131033 - protein, 53 aa, Heterodera glycines
  Coding regions on vcDNA: vcDNA=SeqID_57456; Strand=-; Position=1-162
ISLEYLLLPPRSALVEAPAGPTPKAFNATTTTLLHVMGRLRDKHVYKPMDVEY

SEQ ID NO: 131034 - protein, 95 aa, Heterodera glycines; identical to SEQ ID NO: 124528
  Coding regions on vcDNA: vcDNA=SeqID_57457; Strand=+; Position=1-828

SEQ ID NO: 131035 - protein, 95 aa, Heterodera glycines; identical to SEQ ID NO: 130684
  Coding regions on vcDNA: vcDNA=SeqID_57458; Strand=-; Position=1-703

SEQ ID NO: 131036 - protein, 326 aa, Heterodera glycines
  Coding regions on vcDNA: vcDNA=SeqID_57459; Strand=+; Position=1 -618,742-938,993-1158
MHLYRGHEQKIVKKFLANANRPMFDYMTERLYISDKYERQISEIELSYLERLWTNKNPTNFTLLKLNFVCMLPQDKTDFIIIDNKVYLIRSDRRIYKYGINDGQINPKFVSNISDTKFNFLLFKEYRDDVINILQASSPTPQIKLLLWSAYTFDVLLVVICAYVIRQIRRTSRSSKTSSEDVGMFDQMELEMFSDNPKDLVYRPTTLYALLKSEIDSEPSNYYPNPLQSVPCVHLVNEEYENQPVVVEGTLDLIGDLFFSTCYPKKRQGIDWSEPLYAELKDLMVCPGDLRKCLSHFGHRKDQRNLVVDELDWHDDDDDDITEGAW

SEQ ID NO: 131037 - protein, 87 aa, Heterodera glycines
  Coding regions on vcDNA: vcDNA=SeqID_57460; Strand=+; Position=1 -94,185-241,593-705
MHAFCARAIYHRACQSKAKQQRCCFERIKGIESVNRLLEKYICNLSTILRKSVNRLLEKYICNLSTILRSELEMINFTIQTSFRCSN

SEQ ID NO: 131038 - protein, 19 aa, Heterodera glycines
  Coding regions on vcDNA: vcDNA=SeqID_57461; Strand=-; Position=1-58
GPGSRSRILKSSGPGPGRA

SEQ ID NO: 131039 - protein, 571 aa, Heterodera glycines
  Coding regions on vcDNA: vcDNA=SeqID_57462; Strand=-; Position=1-1718
  Homolog annotation: Hit_ID=CAE56861.1; Match level="QueryCoverage =35%, HitCoverage=13%, E-value=2e-19, Identity=29%"; Hit description =Hypothetical protein CBG24691 [Caenorhabditis briggsae]
SSIVTPLSETHDCPYSKGYCILSDKSVLIWQIDFERKCNFIPIGNKNGKMMDKIWLSDDGELGLSFGNQTNLIDCGQNITVSDQGIGSIILEDKTRRRKRSKKETKNRVVDGIVTSSQLASQLTYLDAELTQTMSFAFSQSLRTFCEFIEENRRWVEASFFSNPTDLARFTFSNPFIYAKRAAQTLLKIWPCVPLDQKDYEFRPTKLQNQCFEFIPINLKTQGREHFAFIDPKSMIISPSSRKGSCEEFRKIIIQIEGQILEIDQIEGKITSVSPNKLIHHEIKFGLNNLLPQIEAHAFHKLVLLNLTDIKDHAFVSNMVKLSQMTYQIHEKDTKITATISQEWEEVESQMIKAVIGDYRKMWLIIMSLIITILSIDLAIRLTIGLSEIYAGNGRLGNLLFGTTIQKAGSRVRKLRETKIQQGEIYEEPINQINWPPRIRRAGNSFKKSFTRPFKRNRHGPNPTQMSTHFELNSLMGQLGSLNNNTMTGTTFVSLNNFQMKCLVETGSSTSVAPKALADYLGIKTFKSEAHLMSASGHPVHVKEAARVTLKIGNEYVDIIVVFSMMNFHGQ

SEQ ID NO: 131040 - protein, 30 aa, Heterodera glycines
  Coding regions on vcDNA: vcDNA=SeqID_57463; Strand=+; Position=1-91
KERTPSDIPIFPFHNWPKATVLIDTSLSNK

SEQ ID NO: 131041 - protein, 129 aa, Heterodera glycines
  Coding regions on vcDNA: vcDNA=SeqID_57464; Strand=-; Position=1 -107,252-343,867-1054
  Homolog annotation: Hit_ID=CAE63211.1; Match level="QueryCoverage =83%, HitCoverage=8%, E-value=1e-14, Identity=35%"; Hit description =Hypothetical protein CBG07568 [Caenorhabditis briggsae]
MNLFVNGKKTTEHVYGRQEWENGTVYTYASLAFRPGKIHHKKVISCEAQHPETNTNLRDSITLDVFYSSDRPKIDLISASAAGTALKAGQNVTLLCTAEGGNPPPQLTWSNQNGRIHEEDDYSYDTGTQ

SEQ ID NO: 131042 - protein, 54 aa, Heterodera glycines
  Coding regions on vcDNA: vcDNA=SeqID_57465; Strand=+; Position=1 -75,561-650
MLDLVQNDASVCPPLHMERLTCAMVQQRHLSKTMTREGKAAKKSEGKSHQFLAA

SEQ ID NO: 131043 - protein, 72 aa, Heterodera glycines
  Coding regions on vcDNA: vcDNA=SeqID_57466; Strand=+; Position=1-218
MRSSITPSTFLQSVFRLNKWKSHNYRDKELWVINRDERNPKLNKMLTNWLWNDHLPNENAFFIRANLKYGAS

SEQ ID NO: 131044 - protein, 35 aa, Heterodera glycines
  Coding regions on vcDNA: vcDNA=SeqID_57467; Strand=-; Position=1 -65,459-501
MLNFSPDDDECEEGFVIKKSFGERILCAKNSAIYN

SEQ ID NO: 131045 - protein, 73 aa, Heterodera glycines
  Coding regions on vcDNA: vcDNA=SeqID_57468; Strand=+; Position=1-221
  Homolog annotation: Hit_ID=CAA70694.1; Match level="QueryCoverage =100%, HitCoverage=20%, E-value=3e-32, Identity=100%"; Hit description=cathepsin S-like cysteine proteinase [Heterodera glycines]
MAFLSRLSILPNSPISLLAVSLAVLAFVALASANPPTARETAPNAQQNNANSVATGEIAKNIAEKMERMNEFI

SEQ ID NO: 131046 - protein, 34 aa, Heterodera glycines
  Coding regions on vcDNA: vcDNA=SeqID_57469; Strand=-; Position=1-104
FFNFPIFQDFSESGQMLRKDADLLLDHFKSRASE

SEQ ID NO: 131047 - protein, 130 aa, Heterodera glycines
  Coding regions on vcDNA: vcDNA=SeqID_57470; Strand=+; Position=1 -62,377-707
MAPTALMEDGGTSTVTSASSRSTRSSTGSSSGSCCSSCGGEHCSQCCDETSSFISSTGVTFMSYYFFQYFKSIKHMPLDLRQAVHDGEDPRMVVVFSARGMPNMCSNEKCQSWGQILVGFSMNKLFWQLL

SEQ ID NO: 131048 - protein, 38 aa, Heterodera glycines
  Coding regions on vcDNA: vcDNA=SeqID_57471; Strand=+; Position=1 -3,457-570
MAMPVIRAQPGHIPLSDSEEDEQLMRRSTGMIKNETPQ

SEQ ID NO: 131049 - protein, 84 aa, Heterodera glycines
  Coding regions on vcDNA: vcDNA=SeqID_57472; Strand=+; Position=1 -59,481-676
MAEFNTVIHGSSAFVGWQCCSRIGRAIGIERDPFLYELQCQIVAEFGDCLSPRVMFAMLALHQKVVRPIGLGPIGLSLYPNSAI

SEQ ID NO: 131050 - protein, 234 aa, Heterodera glycines
  Coding regions on vcDNA: vcDNA=SeqID_57473; Strand=-; Position=1 -13,825-1516
MASKNNASKKSTSDYPYTALSDQLAAISQQMDNNSVDPITKQLLKICVELLQHVQQQQAVISEQDLQLQHFKQQKMMEEAIQDHERRRSVVVMGLPESQKQKPSERVAEDRTAISGVLNELGIESPITVYRMGSPDQAKAGQNRPRLMKVIFGCSKHQKQTLAQWNKGRAQINQKLGMSNIRIRPLLSQEELKARRVLQEECSRKRKEDGGEWVVYADKVMLRSDIAAFKNNTN

SEQ ID NO: 131051 - protein, 46 aa, Heterodera glycines
  Coding regions on vcDNA: vcDNA=SeqID_57474; Strand=+; Position=1-138
ACNQSSKAKPSADGQRWAVTNSSEGEWQQQSVRTQIGTQMLPTGNL

SEQ ID NO: 131052 - protein, 57 aa, Heterodera glycines
  Coding regions on vcDNA: vcDNA=SeqID_57475; Strand=-; Position=1-503
KPSIACRFSAQQSTNRVFDSLQKIIPYTSFLQPNIANLISCRLKAIHCLPVLGTAKH

SEQ ID NO: 131053 - protein, 179 aa, Heterodera glycines
  Coding regions on vcDNA: vcDNA=SeqID_57476; Strand=+; Position=1 -200,331-360,570-879
MASSSASAVGDNNGWSPEAKKRRTIIGTLLRRGDILETNDGDDKTVERNDQTAADDDETDQTHSNRHHFFLKFMMNYNGFSVETQQSVDLSCMTFANAGLEMDEAEQTMMNNEDEQNCSDQPIVQRTTQDEYVVSEDWPNANNVGTKKARKSETTTTTRRTSVKLTAGQKALEVVARVN

SEQ ID NO: 131054 - protein, 16 aa, Heterodera glycines
  Coding regions on vcDNA: vcDNA=SeqID_57477; Strand=-; Position=1-49
EATPEGFGLPINLGAS

SEQ ID NO: 131055 - protein, 39 aa, Heterodera glycines
  Coding regions on vcDNA: vcDNA=SeqID_57478; Strand=+; Position=1 -31,337-425
MGANVSLSTTVAMASAIAVLYLSTDSRLCKGPIKVRSSN

SEQ ID NO: 131056 - protein, 103 aa, Heterodera glycines
  Coding regions on vcDNA: vcDNA=SeqID_57479; Strand=-; Position=1 -64,119-189,386-472,964-1052
  Homolog annotation: Hit_ID=CAE64383.1; Match level="QueryCoverage =99%, HitCoverage=32%, E-value=2e-24, Identity=40%"; Hit description =Hypothetical protein CBG09070 [Caenorhabditis briggsae]
MDDADLSLVVPAVTFSSVGTAGQRCTSTRRLIIHEKVYDVVLERVLDERTLIGPLHSRESVLKYKTAIAEAIATEAVAVNNEASQGLSSSLFTQNVSLLSEWI

SEQ ID NO: 131057 - protein, 143 aa, Heterodera glycines
  Coding regions on vcDNA: vcDNA=SeqID_57480; Strand=-; Position=1 -151,212-278,494-608,654-752
  Homolog annotation: Hit_ID=CAE73050.1; Match level="QueryCoverage =94%, HitCoverage=33%, E-value=2e-35, Identity=48%"; Hit description =Hypothetical protein CBG20420 [Caenorhabditis briggsae]
MMLSLTIVVSFHGTFVTRSDRAYRCMCFFRNIKTLTNAIDVNLAATTELLDTAKTPSCLYSIHAQSPEGPPVQLGKVGDKIFHVWQCDDPAYEFLVHSCAVDDGRGSKFDLLDIDGCAIDPVIQPDVAYIREKKLVSLVFKKW

SEQ ID NO: 131058 - protein, 239 aa, Heterodera glycines
  Coding regions on vcDNA: vcDNA=SeqID_57481; Strand=+; Position=1 -135,177-761
  Homolog annotation: Hit_ID=NP_507780.1; Match level="QueryCoverage =61%, HitCoverage=11%, E-value=1e-13, Identity=28%"; Hit description =predicted CDS, DNA polymerase type B, organellar and viral family member (5T899) [Caenorhabditis elegans]
MTFKLMEKAGINGEEKTFGLQHLEMIQIFWDKEFPDMFRIVAFDMRTGIKPIFKGEGIRKNEVCVIKEGDHWDGIKSVTQFLCVRNYCASCEVTCERPERHRLECKERCKKCCRMGFGFPCADVCAGIYCAECNRNFYNTECFESHKKTACREYKKCEKCGETHNTRNKHTCGEKFCRICKIYHPKRGCFIQKLKIRSTRKYRIVAYDLETTLYNGVHAPNLVCAALTCSRVRGREKEM

SEQ ID NO: 131059 - protein, 104 aa, Heterodera glycines
  Coding regions on vcDNA: vcDNA=SeqID_57482; Strand=-; Position=1-438
NGLSKNRNYAQKASQSILALPIPSTIAFIHPIMSAKIIRVPKIACDLSLAKNGVSKNRNYAQKASQTNLALPIPSTIAFIHPIMSAKIIRVPKIAFDLSLEKMV

SEQ ID NO: 131060 - protein, 198 aa, Heterodera glycines
  Coding regions on vcDNA: vcDNA=SeqID_57483; Strand=-; Position=1 -24,600-971,1066-1266
MGMGRPNKQRLAIGQFTFAQKSVGGNARKIGIIATKTGGITSGKESISDRVQAEGRGIPSEMCGERDETADDGRRAEGTGGRIRPDESGVGETEARKRSGGRTKRKVPTEGGGGRPTDSADTADKSDDEQSDAYQQYLLRRRPHPAPFCRPAATAAAKLFRSRVFLPFADAPIGGETRDQSDGIATSFGGEDGDKTGG

SEQ ID NO: 131061 - protein, 493 aa, Heterodera glycines
  Coding regions on vcDNA: vcDNA=SeqID_57484; Strand=-; Position=1-1482
SKVNQQQQQQRHERKTKSNCKRRNSSVSTLSAPCAHSIPTSSNVLLNLVDRFVTKRQYSDSNLLKHNMNKSTFGENFCRRSFKWNLFWGRKDENSDKCTEKNDLVDELQSSRRKSEEDKDEAMRDYRKKSVQQRKSLRLGTLMEEMGEDRDKKKRQFGNGAQPKAVLSVHEEETHSNTQTVRIRNNNSLGSGQEAERSYPIKSPTVPKIVATQRFSLIGACDLTKLEEAAEGEMATSGGVRRTTSLKEKYRVREEDSLKLDMFLKEKRMSRTVEQQEDGEQSDDVQLHLGNNLDALHFVSITSGEGPQNQQQNLHNLSQNSKKVISSQLNIIKTTSTTLTMPRKKNHCNIPRKSSISFQTNGTLKRKKGIGKAQLARRRSSYVTKAQILMAKSKMQQDGEQKNGNTKDEAKEKGVTKKNGNGKRQSDIAKTETVTLREGAKLLAKQRGASVSSSSLRQLLVGSERKASRGSKVAPKTNDNTDNGPKDANAEKE

SEQ ID NO: 131062 - protein, 298 aa, Heterodera glycines
  Coding regions on vcDNA: vcDNA=SeqID_57485; Strand=-; Position=1 -142,376-582,645-822,870-951,999-1136,1190-1337
FLQENRRVSRSSLDHFTEYEQQTLFDLKGRAYTVSGLEEGKESEEREGGEDKMIISTSDAAECQPTKEPTPSDNTSGNSTPRQRRKRRSAAERRESHRRRSSAVVKDAVHLAKVLNGLPQQKQKHENDKSLDPCLVHCQPFSPIPDYSETENDEANLHEPPEPSVHAPGDEDEVDEEFDFISRLNGETAEKFYGRRTEANLDKNALLQNSLEHRRSISADHLLHGIGLRREMLLLDTDQAEFADAIQIKMRSPSPHAVPVDDNTIGQQRHIEVEKVAGEEEWGKKGGRDLPDASHLAK

SEQ ID NO: 131063 - protein, 58 aa, Heterodera glycines
  Coding regions on vcDNA: vcDNA=SeqID_57486; Strand=-; Position=1 -53,112-235
MDSDDESEVMAETENGSMINIYDPCVKSAIGDRDTVTDRFSTDSNSRVVKTVLRVANR

SEQ ID NO: 131064 - protein, 70 aa, Heterodera glycines
  Coding regions on vcDNA: vcDNA=SeqID_57487; Strand=-; Position=1 -106,328-432
IRLILHYKGIPFEDVTFSSTLADESSREKWLKQKQNYLYGQLPNLEWDEGTEHKVLAQSQTICRYLGNKY

SEQ ID NO: 131065 - protein, 48 aa, Heterodera glycines
  Coding regions on vcDNA: vcDNA=SeqID_57488; Strand=+; Position=1 -59,554-641
MEMCSNLLLRVPQFLSTKNKMKSAENGVPNSAGTQVTVLYKALKRHYK

SEQ ID NO: 131066 - protein, 59 aa, Heterodera glycines
  Coding regions on vcDNA: vcDNA=SeqID_57489; Strand=-; Position=1-193
VNIDHRPQTQKCLKTVRIDVKRFEMGWKNRIRGALALFQDEKCRKWSAKLSWDSSDRAI

SEQ ID NO: 131067 - protein, 64 aa, Heterodera glycines
  Coding regions on vcDNA: vcDNA=SeqID_57490; Strand=+; Position=1-193
ATSTSPSALETRQKAEVEVNEYLRDPKIKSRADPSLYWEVNSQKWPMIGDVVRKFLSPPATSSE

SEQ ID NO: 131068 - protein, 24 aa, Heterodera glycines
  Coding regions on vcDNA: vcDNA=SeqID_57491; Strand=-; Position=1-71
ELMCSFQRLSHACVSLTCQTGILR

SEQ ID NO: 131069 - protein, 140 aa, Heterodera glycines
  Coding regions on vcDNA: vcDNA=SeqID_57492; Strand=+; Position=1-423
  Homolog annotation: Hit_ID=YP_145681.1; Match level="QueryCoverage =65%, HitCoverage=37%, E-value=2e-10, Identity=39%"; Hit description =CopB protein [Ralstonia metallidurans CH34] emb|CAI11330.1| CopB protein [Ralstonia metallidurans CH34]
MAYQLTPIIMLRWLFVGLVLSSHQQMAQMGRMEGDQMRGMEMGQMRGMEMGQMRGMEMGQMSGMEMGQMRGMERGQKPGMVMTQKSEMDMAQMRGMDGDDGQMRASWAASQKLLRAEEKEKGPKSQKNETEKVKKTCEMR

SEQ ID NO: 131070 - protein, 94 aa, Heterodera glycines
  Coding regions on vcDNA: vcDNA=SeqID_57493; Strand=+; Position=1-362
LYKINNYLLIVDYFQLFSSVFFNFLSFSVCCWPLLIAFFPTYYSKSFRWSSNRQMSQIEAAHRTDWPKTWRREEKRRERQKRRERVALEWRRAL

SEQ ID NO: 131071 - protein, 40 aa, Heterodera glycines
  Coding regions on vcDNA: vcDNA=SeqID_57494; Strand=+; Position=1-122
MLRTLGVWRKEQMRTGDAGQEEEGGHVRLRRVRGIPTVIA

SEQ ID NO: 131072 - protein, 28 aa, Heterodera glycines
  Coding regions on vcDNA: vcDNA=SeqID_57495; Strand=+; Position=1-87
MANPIATKKQKVKLNSNALYESNQLTIH

SEQ ID NO: 131073 - protein, 106 aa, Heterodera glycines
  Coding regions on vcDNA: vcDNA=SeqID_57496; Strand=+; Position=1 -102,160-378
NCSQINDENVGEAGAYKEKHNESSDIFSKVYGIADQKFKDLFKDNAFPTLEKLFGDAKALFVNTTPLLDYDIGSLPKRVKFIGGIDLMQPDHKDVIPFSSKTVYTD

SEQ ID NO: 131074 - protein, 113 aa, Heterodera glycines
  Coding regions on vcDNA: vcDNA=SeqID_57497; Strand=+; Position=1 -81,258-518
MPLDKFETVIQGLGMCKEKEVKKCHGMYGWPLSTVSYCKSVPPFSGNEKTELVISECDIRIVMDALSSGKALLCLPNSFMCRKSCDAWALRLCLIRAVTVSPRRGFSKVSAKH

SEQ ID NO: 131075 - protein, 87 aa, Heterodera glycines
  Coding regions on vcDNA: vcDNA=SeqID_57498; Strand=-; Position=1 -147,572-688
EPEQNLNCADLMAKFNTQNQKVEPMDVEGAPSQDEVEEILGAARMNSEIFYLVKLKGDSLAQFFSSRIASEKFPKLVIDFYEQRADM

SEQ ID NO: 131076 - protein, 86 aa, Heterodera glycines
  Coding regions on vcDNA: vcDNA=SeqID_57499; Strand=+; Position=1 -52,142-348
MFCSHPTLIYLLGILGVAFWFAESSANMVKIVLISKLFFVESQLLAINRCFETISPNICKMIQFWLFLVCLYSIYWVFFQKPCLFN

SEQ ID NO: 131077 - protein, 70 aa, Heterodera glycines
  Coding regions on vcDNA: vcDNA=SeqID_57500; Strand=+; Position=1 -98,307-421
MAIASFALSIACPGPALTAQQRIVRTHFVHVFRLGNATLCADGLANEAIRALQNYCPFSLFIYNWQTIFS

SEQ ID NO: 131078 - protein, 109 aa, Heterodera glycines
  Coding regions on vcDNA: vcDNA=SeqID_57501; Strand=+; Position=1 -294,362-399
  Homolog annotation: Hit_ID=CAE73294.1; Match level="QueryCoverage =97%, HitCoverage=60%, E-value=5e-36, Identity=49%"; Hit description =Hypothetical protein CBG20714 [Caenorhabditis briggsae]
ISQGPAGSDGQPGNPGENGQPGSPGQLSQGPPVVGPPGPSGPPGQPGQPGENGQPGQPGNPGPQGQPGDNGGPGQPGSPGGNGEPGQPGGQGAGGQCDHCPPPRTAPGY

SEQ ID NO: 131079 - protein, 33 aa, Heterodera glycines
  Coding regions on vcDNA: vcDNA=SeqID_57502; Strand=+; Position=1-98
FRVPKKNRGPGPGFSGPGKSRSRFCPKFPVPAS

SEQ ID NO: 131080 - protein, 280 aa, Heterodera glycines
  misc_feature (15)..(15): Xaa can be any naturally occurring amino acid
  misc_feature (57)..(57): Xaa can be any naturally occurring amino acid
  misc_feature (191)..(191): Xaa can be any naturally occurring amino acid
  misc_feature (238)..(238): Xaa can be any naturally occurring amino acid
  Coding regions on vcDNA: vcDNA=SeqID_57503; Strand=-; Position=1 -261,297-379,408-650,682-724
  Homolog annotation: Hit_ID=EAA17111.1; Match level="QueryCoverage =84%, HitCoverage=46%, E-value=6e-40, Identity=46%"; Hit description =hypothetical protein [Plasmodium yoelii yoelii]
FVQHFCFRSRAQNKXNGSHGSFLCGNDPSAGSPTETLLRLHLPLNGEVKKSSHEFKXSKRVHSPNFSPSHSIGRCDGRCVQRAGTNSSFKIENCNNLPSTMRIQRCVQRAGTNSSFKIENCNNLPSTMRIQKITQTYRSVARVQPRTSKGITDLLLPQLKITQTYRSVARVQPRTSKGITDLLLPQLPLVXLPKSPSKKSQNLQKIVSETIYAEVSFVNGINQTNHHQLRTAMHHHPXNQERALNLFPVLSQIKPQAPLLLFPVLSQIKPQAPLLNPRSP

SEQ ID NO: 131081 - protein, 135 aa, Heterodera glycines
  Coding regions on vcDNA: vcDNA=SeqID_57504; Strand=-; Position=1 -222,435-527,654-743
MPFKTVAEREANTTYNFTNVTLRPFLPRNRTHHDLGALFASFIFGGFSPNLFFGTDVDDGRICVVSLRVDDQMQRLSVRQFFAVNSVKFNQKYLCEIQLLPINALEWDVVKIKIFANSMNKWRGMMSRIERILLR

SEQ ID NO: 131082 - protein, 124 aa, Heterodera glycines
  Coding regions on vcDNA: vcDNA=SeqID_57505; Strand=+; Position=1 -180,660-740,1133-1243
MFEEGRTKIKQVNDESATVCYAFKHFLELPRVDDATARRQRIDRLVKFFIDEALEKKRMEQGKQQQVSVSNNWSTNGQPQNKKSPIKRKLPANSRKALRKLPTMGLNFDDVIEEDQQRLRDMHP

SEQ ID NO: 131083 - protein, 210 aa, Heterodera glycines
  Coding regions on vcDNA: vcDNA=SeqID_57506; Strand=+; Position=1-633
MHSKFGVCFILLFVIAWAIAAPKKGSQVENTWRRGVTAKKTSAKSASEMSDRRRAANAPAETSRRPTENDDTASKQRLAGKSASQRAAANSFMSLSEERDEAEQSGHQSQTPSKRQRLVKAVNKQQKQPKKPETPRRKLILYSSDEEDEQMPQRTLSATGSTPNNLSSAANASVPLSSRRMDNSSSAQKEDQQQMGDDHIRLLNMFCGSD

SEQ ID NO: 131084 - protein, 89 aa, Heterodera glycines
  Coding regions on vcDNA: vcDNA=SeqID_57507; Strand=+; Position=1 -195,238-312
  Homolog annotation: Hit_ID=XP_396834.1; Match level="QueryCoverage =100%, HitCoverage=9%, E-value=5e-16, Identity=47%"; Hit description =similar to MKK7a [Apis mellifera]
MHRDVKPSNILLDWLGNVKLCDFGISGKLIESKGREHFCSSFPAITFLQILSLASTKTGCTGYLAPERVNIYSDSSGQYDVRADVWSVG

SEQ ID NO: 131085 - protein, 18 aa, Heterodera glycines
  Coding regions on vcDNA: vcDNA=SeqID_57508; Strand=-; Position=1-53
QLTNVVTFAIGALTPTPG

SEQ ID NO: 131086 - protein, 113 aa, Heterodera glycines
  Coding regions on vcDNA: vcDNA=SeqID_57509; Strand=+; Position=1 -162,772-951
MDTFIGLIDAVASVKRHIENETKQQQQQQQHKQKQSVVTKSNSNASKESSSLSVSSDTSKRDRTQSANSENGWTKKLRFESHNNNENNNKEQKQQQRQSSASSSCSSTEGWEK

SEQ ID NO: 131087 - protein, 102 aa, Heterodera glycines
  Coding regions on vcDNA: vcDNA=SeqID_57510; Strand=-; Position=1 -78,642-872
  Homolog annotation: Hit_ID=CAE71853.1; Match level="QueryCoverage =87%, HitCoverage=5%, E-value=1e-23, Identity=57%"; Hit description =Hypothetical protein CBG18897 [Caenorhabditis briggsae]
AALDGRDLKWIKVAETRGCHLLCWGGHGAQLGQHYFACAILKSVMVFQINRKERRHKPLREMAMPGQPQCLKIAGGRLFVGYPSSFRVWDKRDNSQICTLLL

SEQ ID NO: 131088 - protein, 36 aa, Heterodera glycines
  Coding regions on vcDNA: vcDNA=SeqID_57511; Strand=+; Position=1-149
FAFRFLARNATFTPLRIGLNSHKIFQNLTYKLTNFQ

SEQ ID NO: 131089 - protein, 328 aa, Heterodera glycines
  Coding regions on vcDNA: vcDNA=SeqID_57512; Strand=+; Position=1 -127,1210-1433,3154-3516,3995-4204,4454-4516
MLRNQIFWIALLLSLLRVAQLAPSHGGAAYNGYNESETEGDEVFHNDDDDEELKQLKDRTRAEYDQQQIAKAMEKSMEEIGNDPYRQEMEAIKQLSLKEQKKREKELIKLAIQQSIEQKPRQQAIEEKSEHEKLFHDLNAVESEALQLYMLGLVGQAKALLSESAQSRRAKVKERYKLWEMQNAGGGNGGSVGTGNTGAVIGSAGYGGAETDRPYLNSRPESSKAAAQRGKAVDQPNEASAGDEGLNEAEKTVFKNGLNMGTNERELSLFQLSDNESKDKVFNAWLKQDIKEQKYRKLLDKDNDTRRETRRGGPGGAVHAVFAQWDVD

SEQ ID NO: 131090 - protein, 122 aa, Heterodera glycines
  Coding regions on vcDNA: vcDNA=SeqID_57513; Strand=+; Position=1 -69,178-474
MKENKKEIENNSCFAGFHLKILVEEDDDDTVSHIGHNTDEEEDDATVLHTRRNRDREEDVATVLHTGRNRDREEGVATVLNTRHNTDHNAYSDIVSHSEQSDSNSDQYEVQYHDKIDLGNVE

SEQ ID NO: 131091 - protein, 104 aa, Heterodera glycines
  misc_feature (98)..(98): Xaa can be any naturally occurring amino acid
  Coding regions on vcDNA: vcDNA=SeqID_57514; Strand=-; Position=1 -67,112-180,226-294,340-408,457-641
LRQREARSTAFGGDGRCLRDSASAAGIAGRRTTCGGASRFLRDSASAAGSAGRRTTLSGAGGFLRDSASAAGSAGRRTTLSGAGRCLRDSASAAGSAXRRTTLS

SEQ ID NO: 131092 - protein, 153 aa, Heterodera glycines
  Coding regions on vcDNA: vcDNA=SeqID_57515; Strand=-; Position=1 -298,415-576
ANCFCGPFLIADKVRALPAFYASSPLPHAISTLVKDLLACAAGLGTRGVRELINLLVGADRNSKVPLQMLLKFKYTNRRVRFSVEACERAAQFPGWLRTLLIRLDACPNLLSLEKRDKCPLDCSASLASSLYLCHGGHVNTASAQSSQQQTNK

SEQ ID NO: 131093 - protein, 172 aa, Heterodera glycines
  Coding regions on vcDNA: vcDNA=SeqID_57516; Strand=+; Position=1 -51,93-308,462-612,692-789
MLMNPVAATSSENSKTAALSKGCKTTKFNADENKCNDKDGEQNNDYGSEAEKGGDTVEENQIETEQQIENDDDKQQQMEAVNGEHIATQSPPPPPPPGVDENTPEPPQIDPSDCAKNYDGISLSEQFGEQNGGQMEKENVQSTSSPTTSSHPQRTNEVDSLTIIDDGQFIAL

SEQ ID NO: 131094 - protein, 72 aa, Heterodera glycines
  Coding regions on vcDNA: vcDNA=SeqID_57517; Strand=-; Position=1 -73,114-259
MTTNLWLCNRDEYTLGPTNNELHIVWPNLTAADLEQCVCIFDNVFRFMVNEHHFKVASDLSPIIRHQRKKVA

SEQ ID NO: 131095 - protein, 310 aa, Heterodera glycines
  Coding regions on vcDNA: vcDNA=SeqID_57518; Strand=+; Position=1 -99,155-226,273-655,709-997,1080-1168
MADDWAEIGCDFKVVFIHHKPEDIVEDAHTLLQDALTDMQFIVGGAQSVLVSVAQPKSFNSMDNGTDVEELEPRIEFYIGLIEKFKSVGCIFVLDHLMQCLRHYQMQNRRLLYLRYRVEFRPPIGIDLPPFKRHLSAADSAQLGRILLGNVIWHNQLYVRRVVKPNRKKMEEILGKDIRHVQIPNVPLNQQRKGSINSGGRGIDGQVLSGETPLEKSDRIVNSAKSSIESDKFSMENGQSPNDRKRNHEDRKKSLATDRTTTPEENGLTEKAPPQMGQHQGRGLNRNGDSGVELVNGNARDFDEIDGIVP

SEQ ID NO: 131096 - protein, 221 aa, Heterodera glycines
  Coding regions on vcDNA: vcDNA=SeqID_57519; Strand=+; Position=1 -495,747-917
MVEHEFVEPDSAVDNRRKRALDAARKIVCVEKGGVAWKMVDEGKEESEEKEEEKQQQEKDENGWPTENRTWEQQHAVLGKVSIWRDYFRNGTNSTSAFVYGAGQQINQQDGSLRSRMAKFLMRDNQSWGSDGAFDREGRDAHGRRRTHLRRKNVVSTLERRFDKGSWSSNMEKGRRLETLWTSSSNCFAEFLAKSYEEDPVLLQRVLEENEEDEEEAIEGI

SEQ ID NO: 131097 - protein, 33 aa, Heterodera glycines
  Coding regions on vcDNA: vcDNA=SeqID_57520; Strand=+; Position=1-104
ESRDDEDELLVDNEETEDEPEKCFCCDLSNNLP

SEQ ID NO: 131098 - protein, 47 aa, Heterodera glycines
  Coding regions on vcDNA: vcDNA=SeqID_57521; Strand=-; Position=1 -67,116-192
MNLATGRCAIGVIVPGWTCTFGEKFVKIVHVGLMNMTYFYQMSKTMA

SEQ ID NO: 131099 - protein, 45 aa, Heterodera glycines
  Coding regions on vcDNA: vcDNA=SeqID_57522; Strand=+; Position=1 -8,1066-1195
MNRLACSSLVGTIMAKFRKVMNKAVKSEISSNEEKICEQKRGTTV

SEQ ID NO: 131100 - protein, 75 aa, Heterodera glycines
  Coding regions on vcDNA: vcDNA=SeqID_57523; Strand=-; Position=1-229
IQSLGLNSSAFQSLGLNSPAFQSLGLNPQAFQSTGLNPPAFNHWDSILLHFNYWDSILRHFNHRNSTSATEYRTI

SEQ ID NO: 131101 - protein, 220 aa, Heterodera glycines
  Coding regions on vcDNA: vcDNA=SeqID_57524; Strand=+; Position=1-663
  Homolog annotation: Hit_ID=XP_227715.2; Match level="QueryCoverage =95%, HitCoverage=11%, E-value=1e-21, Identity=49%"; Hit description =similar to lymphocyte alpha-kinase [Rattus norvegicus]
KEHAAVPAESVQLLDGNVVVVLLLVLVSVVSVVLSVVGVVDVLVELVVVDGVVDVLVELVVVVGVVEVVVEVVLVDELLELVVGVVEVLVELVVVGVVVLELVVGVVLVELVMVGVVVLELVVGAVAVLVELVVELDVVGVKVVLVDVLLELDVVGVVDVLLELDVVGVVDVLVEVVVELVLVDVEVVPVGVLVELVVVEVVDVLDDDVDEVLVVSSSDE

SEQ ID NO: 131102 - protein, 94 aa, Heterodera glycines
  Coding regions on vcDNA: vcDNA=SeqID_57525; Strand=+; Position=1 -66,258-476
MDSHHKYSTIFFTMLCDDEMRLTSVTLFRDKVHNVVLCCPIGDWGGVRWDWSFPETIKEQIKLFIHRTIGQITDGEMQLENGNGNANLGSFGAI

SEQ ID NO: 131103 - protein, 70 aa, Heterodera glycines
  Coding regions on vcDNA: vcDNA=SeqID_57526; Strand=+; Position=1 -132,395-473
  Homolog annotation: Hit_ID=CAG11459.1; Match level="QueryCoverage =100%, HitCoverage=19%, E-value=2e-10, Identity=47%"; Hit description= unnamed protein product [Tetraodon nigroviridis]
MAKLRSELDIVQVNLTVLRELVAQMKPTNDGGVTEAPEDFHFVRELHSTCKEMQKRILELIPSVSNEEVT

SEQ ID NO: 131104 - protein, 64 aa, Heterodera glycines
  Coding regions on vcDNA: vcDNA=SeqID_57527; Strand=-; Position=1 -152,745-787
MLCALVPNLVAICRHCRTMPTINPLNLWHSVARTTSSLSWCCSRPSLRQPNFANFSSLEYLFCV

SEQ ID NO: 131105 - protein, 28 aa, Heterodera glycines
  Coding regions on vcDNA: vcDNA=SeqID_57528; Strand=+; Position=1 -39,352-399
MPLGVNFNFNVSQFYQQTENREKTFCNF

SEQ ID NO: 131106 - protein, 110 aa, Heterodera glycines
  Coding regions on vcDNA: vcDNA=SeqID_57529; Strand=-; Position=1 -139,322-515
MYATAHLAPQLLIRHLSFCLCATVASAFVYGSRGGGAYGDGLRGYGGPYRPPVYRRPMYKPVPGPLYGYNKRPPVYGGGSGNNYYYPAPAPKPPTPCPPAEKVRDRKMRQ

SEQ ID NO: 131107 - protein, 217 aa, Heterodera glycines
  Coding regions on vcDNA: vcDNA=SeqID_57530; Strand=-; Position=1 -418,463-697
YIDQIVIGFFHNIRHLLQKVEITVLFCNNRRSYDVLQQIAKHFWPFLSEGIVAIVHLNGNELSQLMKLTSPSVFRECAKLRCIYCSQVFPESPSYDGTGASVGQALSKWLHTPRADGRPKVLKCVGLSHIEKHLEDLKMAFISAESPVSYVICLNFGIGFKYGGQPFEWDNARTRERMTFRYIKYICFGGVWLLRRGPIGWDESEWSESEKRAQRGG

SEQ ID NO: 131108 - protein, 78 aa, Heterodera glycines
  Coding regions on vcDNA: vcDNA=SeqID_57531; Strand=+; Position=1-237
MRRCRRRRDSREKLGNNKCIGVWHTPEKRMGMSASSVDSIHFHSDGQLQQFLPKGMAKNALRFVVKHRKTDDCCKKAQ

SEQ ID NO: 131109 - protein, 128 aa, Heterodera glycines
  Coding regions on vcDNA: vcDNA=SeqID_57532; Strand=-; Position=1-387
PIKYFFKNLLYFFFEKFRLPTFLGSEFRLPKIFGASEFRLPKIFGASEFRLPKIFGASEFRLPKIFGASEFRLPKIFGASEFRLPKIFGASEFRLPKIFGASEFRLPKIFGASEFRLPKIFSASELHP

SEQ ID NO: 131110 - protein, 121 aa, Heterodera glycines
  Coding regions on vcDNA: vcDNA=SeqID_57533; Strand=-; Position=1 -5,684-939,1599-1703
MSHLCDDVWHNVFDCFVRPELGHKIAIVCARFDALVERHLRTKKWTLRALGFYQKKEEKSTEMRGVWQRKRQKWIEKLMLTDKNGQMGWHGIPSSDFRHFWGRNSDFRKFLGPRNSDFRNF

SEQ ID NO: 131111 - protein, 95 aa, Heterodera glycines
  Coding regions on vcDNA: vcDNA=SeqID_57534; Strand=-; Position=1 -17,196-466
MFYEINDKDSSVYNFSSHLMETPMKLSNILIELSLLPKNNESVSQYKISTSLLFKAYIILSYNIVRPYLVIIDANEILIVVPSFNILISLSILQK

SEQ ID NO: 131112 - protein, 276 aa, Heterodera glycines
  Coding regions on vcDNA: vcDNA=SeqID_57535; Strand=+; Position=1 -123,183-243,468-1114
MGPKQFLVLSIFIIMATFSTILANKNTNRRQKRMDNSQENNSTVVRKRKTTVTTNSGGENAEFFEPAKAFGKSAATALSAKTVPKRKTQPQQMGTSLNSKRNVEEAGQNQQQSPKYAVTLDGIKEMLMSINWAATSRPLTDDHDQLGAQHMGEQQMDNNVQQNLNDADDQFGLSNIGMQPIDVIGMLMEDEPDKENVEIFVKLLNQCHLILAIATEHIQHKSTNVPNLPMVLWDENWEAMSNFIQQNGGHVVGCALLNNANDLTREVADVIENGKT

SEQ ID NO: 131113 - protein, 87 aa, Heterodera glycines
  Coding regions on vcDNA: vcDNA=SeqID_57536; Strand=+; Position=1 -144,259-378
MRALIASLSTDKLVNLLNIEYAPEGTEKQLTPLMLATVLGDAQMAHIFLEKGADPHRMCLRKINTDDNLISELREEKPKMKKVTFEK

SEQ ID NO: 131114 - protein, 86 aa, Heterodera glycines
  Coding regions on vcDNA: vcDNA=SeqID_57537; Strand=-; Position=1 -81,312-488
  Homolog annotation: Hit_ID=NP_492146.1; Match level="QueryCoverage =69%, HitCoverage=18%, E-value=1e-10, Identity=58%"; Hit description =electron transfer flavoprotein (34.5 kD) (1I279) [Caenorhabditis elegans] emb|CAB61027.1| Hypothetical pr
MLAAFCSTGSAAGNRILINAPIFRRLNAHCLASTLVLAEHNEQKLSQITLNAVTAAKKLGHQISLLVAGKNAEAVANGAAKIPDVE

SEQ ID NO: 131115 - protein, 75 aa, Heterodera glycines
  Coding regions on vcDNA: vcDNA=SeqID_57538; Strand=-; Position=1 -181,262-308
MNCALASSFSPVGKHFAAVVADKKGMRPDLYVNGEELVERLGSCVKNTQIELQNFFVKVEAPLRDFIRQNWCWAR

SEQ ID NO: 131116 - protein, 105 aa, Heterodera glycines
  Coding regions on vcDNA: vcDNA=SeqID_57539; Strand=-; Position=1 -230,414-498
  Homolog annotation: Hit_ID=XP_316724.1; Match level="QueryCoverage =97%, HitCoverage=42%, E-value=1e-25, Identity=49%"; Hit description =ENSANGP00000002653 [Anopheles gambiae] gb|EAA11800.1| ENSANGP00000002653 [Anopheles gambiae str. PEST]
YPLLPKMDKLGTETNRLCQLYPEKSEDIAAKVDEARGRWEALKLSVEQRKRGLDRSYNRHRFMADYRELVEWTNGQKALIQSSELAKDVAGAEALLEQHQEHKGG

SEQ ID NO: 131117 - protein, 420 aa, Heterodera glycines
  Coding regions on vcDNA: vcDNA=SeqID_57540; Strand=+; Position=1 -87,123-1145,1192-1344
  Homolog annotation: Hit_ID=NP_507780.1; Match level="QueryCoverage =89%, HitCoverage=26%, E-value=1e-34, Identity=28%"; Hit description =predicted CDS, DNA polymerase type B, organellar and viral family member (5T899) [Caenorhabditis elegans]
MPGFRQLNRNTMQKYTSIKCKGYGTSNIPIRPITKSDVTDYQFPILLYHNNNHFDGIKTISKFFNKNYYCLSCETFFSNKPQHSMNCSSLCHGCREVGVDYPCEPQQGYFKKCLHCNNYFYNNDCYERHLHKDLCTKFQRCEDCGVIYNVKYHGNVGHQCGERFCRLCKQFHLKEEDGENPCKSCFIQPLKPHKLKPYRIIAYDFEATQDKKVGNKFEHEVNFAAATIICTDCINGNWKDSLKGSSCKICGPHRTITFAPFDFSNTIVDQKVTTQQPLREFVQWLLFDHNKKFPTVAFAHFGGRYDMTMIIKEVLAQGIHNPDIIKQGNRHYELKIKDNEHCPLTILHDSYNLMPIKLSGLIKSFGLKIQDKQHFPHMFKKSSNYDNILSHLPPREEYCPDQMKIPDQQKFDNWYNNNYN

SEQ ID NO: 131118 - protein, 80 aa, Heterodera glycines
  Coding regions on vcDNA: vcDNA=SeqID_57541; Strand=+; Position=1 -98,456-512,568-620,812-847
EAIRDHINILVKLNFLENDKGFKKDAKNMENLNALENQLIANKACLIKEDEIVQTYHNERAELERKMKRNEGNETLDEYD

SEQ ID NO: 131119 - protein, 491 aa, Heterodera glycines
  Coding regions on vcDNA: vcDNA=SeqID_57542; Strand=+; Position=1-1473
  Homolog annotation: Hit_ID=NP_001004509.1; Match level="QueryCoverage= 99%, HitCoverage=33%, E-value=9e-57, Identity=30%"; Hit description =si:busm1-180o5.3 [Danio rerio] emb|CAD60788.1| novel protein similar to DNA polymerases [Danio rerio]
MTIASACVKNFALNHLKPNSLAIVPEKGYTPQQNQSALAIKYLNWYSHINNVNIQTAHSRYGEYVFKREGQVYQVDGYIKGTNGKRDKIIEVNGCLWHGCGECFVDLDDETKMPNGKTLGQLREREVRKHEILRRYVDLEVIWEHEINEQLKKDKQMREFFDNWKDHSPIKIRDAFHGGRTGPMKLLHTAKPGQKISYKDFTSLYPWTNFSTSYPLGHPKIISFRLNEQTVNWRAPSDNPYKGLLKVLLLPPNRNINVTVMPIKFDERLLFPLCEKCAKHITNEHPNGLKDDNYSCPHFTPDDRAFVSTCTHLELNAALEVGYTVRKLFHVLQYDQWSDNIFKSYVSEMMALKIHATGFPSWCSNEEEKKEYIEENRQRFGILLDNEKMKAEPGKRYIAKLCLNSLWGRFSMRNLLSKAIINNDESLIRQYTDDKKIELVDLEMIDDDNDVFMLTYKPKEEFVDENKYSNVVISLFTTSAARLYLYDALKK

SEQ ID NO: 131120 - protein, 147 aa, Heterodera glycines
  Coding regions on vcDNA: vcDNA=SeqID_57543; Strand=+; Position=1 -159,234-373,494-629
  Homolog annotation: Hit_ID=NP_495449.1; Match level="QueryCoverage =100%, HitCoverage=36%, E-value=3e-51, Identity=63%"; Hit description= cystathionine gamma-lyase (43.1 kD) (2H346) [Caenorhabditis elegans] gb|AAB93432.1| Hypothetical protein
FMTPYFQRPLELGADVVMHSLTKYINGHTDVLMGAMVTNNDQLDQHLKSQQITAGAAGAVPSPFDVYLVIRGIKTLHLRMRQHMENALAVARWLEKDPRVEKVLYPELESHPQHKIHKKQSSGMSGMVSFYMRADADGARKFLANLK

SEQ ID NO: 131121 - protein, 217 aa, Heterodera glycines
  Coding regions on vcDNA: vcDNA=SeqID_57544; Strand=-; Position=1 -201,523-710,781-1045
MTITVFIAFSTSPQSSRPLTNVITIVIQLVVGIVEFAMFYQLCQYNSKIYQKIMQKQGYHSLSLRYQLSENIRIGKQLVPPLLLHLLTIVTSTVIISWSYFQWPHYYQMYNLLSTLNAVTGFLIELFIITRDMCQIWNNFGKMFLLCPNNRRIADQTATAVANFDNRIVAASNKNTAAVGIAQRDLISGKALIIDQPKSDEHFAMLLQAWESHIKLR

SEQ ID NO: 131122 - protein, 30 aa, Heterodera glycines
  Coding regions on vcDNA: vcDNA=SeqID_57545; Strand=+; Position=1 -30,220-282
MSFLAGLPPMEQIWSFVFCCAISLKEVPKV

SEQ ID NO: 131123 - protein, 171 aa, Heterodera glycines
  Coding regions on vcDNA: vcDNA=SeqID_57546; Strand=+; Position=1 -130,280-378,602-681,939-1021,1317-1437
MADDQVLAGFSAGIGLRIMFTQLGNIIHFRSNRICAVDLPIKARCFFFRFTIHACQFWLIPLCHLGLLSTIEWASKEKIKLIKCLPSFWECFDAINLNTLAISILLAGFLSRWLNAERLWQLETIKFGNGSFLSQTLLLDAFALALLVHTLHIRAASALARTHKYRFYEKQ

SEQ ID NO: 131124 - protein, 31 aa, Heterodera glycines
  Coding regions on vcDNA: vcDNA=SeqID_57547; Strand=-; Position=1-95
DDLASQWRNLKDIFYKRLKEMNRRIQMGEVN

SEQ ID NO: 131125 - protein, 195 aa, Heterodera glycines
  Coding regions on vcDNA: vcDNA=SeqID_57548; Strand=-; Position=1-589
  Homolog annotation: Hit_ID=CAA36712.1; Match level="QueryCoverage =72%, HitCoverage=88%, E-value=2e-14, Identity=36%"; Hit description =proline-rich protein [Triticum aestivum] pir||S14959 proline-rich protein - wheat
VYYPPSPPRLPLPPRAKAKIEPPPRPTAKREPQKPTKLELKPSKFEPDSRPKVALPRSKKEPEFPLDPRPSTSRQAGYLPPPKIIPKPEPTKRPVPYRIPKREPKIVEQQPQPLQQPLPASAVEEEMPTIPPPRRGTKRHYPVNGENGENSGGGARARRQTSGISAAASEPRGRTLGMRYPSDAGAEQRNAQVVC

SEQ ID NO: 131126 - protein, 113 aa, Heterodera glycines
  Coding regions on vcDNA: vcDNA=SeqID_57549; Strand=-; Position=1 -56,370-653
MPNSTRRCSSAMWSLTFLRGKLAQRVGRTEIRYTRTPAEFHELLEDPSLDKLDFVHVSEHMDRCVVRKRAEFAKAPLTNCLPVASFVTSYARLHLYDYIEQVLAIDGAELLYC

SEQ ID NO: 131127 - protein, 127 aa, Heterodera glycines
  Coding regions on vcDNA: vcDNA=SeqID_57550; Strand=-; Position=1 -61,115-374,575-634
MTGLIRDRSRYFSSLPPRVESPFSGVEPLSSVTRHHHGSQIHYHRKLIRQTLERHVAGTRPCDQLSCSESTLDARRALGFVANKCAPLWGDWSFGACISSRITTVIQQKQLRSAQACAWAAKETEQV

SEQ ID NO: 131128 - protein, 92 aa, Heterodera glycines
  misc_feature (45)..(45): Xaa can be any naturally occurring amino acid
  Coding regions on vcDNA: vcDNA=SeqID_57551; Strand=+; Position=1-1633
  Homolog annotation: Hit_ID=XP_523367.1; Match level="QueryCoverage =91%, HitCoverage=58%, E-value=2e-21, Identity=66%"; Hit description =PREDICTED: similar to rRNA intron-encoded homing endonuclease [Pan troglodytes]
NSWTVARRTTAKAFGKNVFINQERKSEVRRRSDTALVLTVNDANXAIRRRIYSPWWGASRKRKSSGSGGSMVAKLKLKGIDGRAPPGVEPAA

SEQ ID NO: 131129 - protein, 172 aa, Heterodera glycines
  Coding regions on vcDNA: vcDNA=SeqID_57552; Strand=-; Position=1 -512,597-605
  Homolog annotation: Hit_ID=NP_506146.1; Match level="QueryCoverage =92%, HitCoverage=46%, E-value=1e-35, Identity=54%"; Hit description =putative protein, with 2 coiled coil-4 domains (5N52) [Caenorhabditis elegans] emb|CAB02877.1| Hypothetic
GCGGGCGAPPPSGGGAIKLTLGCEGPPPQAPAPCGCGGGCGGGCGGGYGGGCGAPPPSGGGAIKLTLGCEGPPPQAPAPCGCGSGCGGGCGGGCGCGGGCGAPPPSGGGAIKLTLGCEGPPPQAPAPSGCGGGCGGGCGGGCGGGCGGGCGGRRKRMALIRRCRALQGSVDN

SEQ ID NO: 131130 - protein, 323 aa, Heterodera glycines
  Coding regions on vcDNA: vcDNA=SeqID_57553; Strand=-; Position=1 -53,470-820,1225-1564,1794-1847,2357-2527
  Homolog annotation: Hit_ID=AAO50913.1; Match level="QueryCoverage =69%, HitCoverage=19%, E-value=6e-11, Identity=29%"; Hit description =similar to putative protein; protein id: At3g44340.1, supported by cDNA: gi_11229585 [Arabidopsis thaliana
MANNAPAAAGGGGGTEMTYRAGAGSQSQLYFVDGNAPSMDLSSPQAAAGTIQQHHHHHHRTAKSCDFDMLGGGGGGTDATATTTATMLGNSHIMIDGENSAHPQQQQMGTQFFGNYPTITGYFPATQHQQQQYIDPAKQLNSSSSVAYWAGARGKSQSLDPIRFAEQTAQLSPLSSSAQQFTTPHLSSPHVASGASPCDATKYQQQQHQQHVQPQQQQQSQQMPFQQQQQAHQQQNPAKQQQQQQSNIELVDPGDGLGPLPKGWNIQGPYGALPNNETPDNNGSTAVNSSPSSTTIGGMDRRVQQLKHEQQCMQEKREQMVRQ

SEQ ID NO: 131131 - protein, 58 aa, Heterodera glycines
  Coding regions on vcDNA: vcDNA=SeqID_57554; Strand=+; Position=1-3,87- 260
MHHLHHQKKWWGMNVSMAMIKKVVMKKMANNKYGPGVRPRDNDEYEQHNGLDADKGPK

SEQ ID NO: 131132 - protein, 214 aa, Heterodera glycines
  Coding regions on vcDNA: vcDNA=SeqID_57555; Strand=-; Position=1 -56,694-799,847-927,982-1034,1086-1253,1302-1376
  Homolog annotation: Hit_ID=NP_495846.1; Match level="QueryCoverage =96%, HitCoverage=28%, E-value=2e-57, Identity=55%"; Hit description =choline dehydrogenase (67.3 kD) (2I988) [Caenorhabditis elegans] emb|CAA91263.1| Hypothetical protein C34
TLSIGTFRNVFRAQKRWDFWREGFFKYGKFVRHLPEGVKPTHIVVGAGSAGCVLANRLTENPANRLTENPDNRVLLVEAGPQDNWWNWKIHMIHMPAALMYNLCNDKYNWMYFTMPQEMYFTMPQENMNGRVLYWPRGRVWGGSSSLNAMVYIRGHPKDYDRWEREGAKGWAHKNCLPYFKKAQAHEFAINCLPYFKKAQAHEFAIGPDDPYRG

SEQ ID NO: 131133 - protein, 222 aa, Heterodera glycines
  Coding regions on vcDNA: vcDNA=SeqID_57556; Strand=-; Position=1 -149,219-504,563-797
VGNAFLDEVIRNYMPKPHAPIQCIAMEDAHFALNTTPISSNSPSKSPVRTGNDRLLEESIALMMPHPNRKREGKAFARPKDQQKFGQKMDDLLTADEEEEEAVLEQQQKVTAELPADVNAEFAAHWMVVECGTTKSPKTDDEERSRFSLKKTPSQSSIPRPSVAPSDRSPKTATTTADLTDTAATSLLKRPAARSSTLSRTQQKAPPLAPKPNIAKLGKVLA

SEQ ID NO: 131134 - protein, 49 aa, Heterodera glycines
  Coding regions on vcDNA: vcDNA=SeqID_57557; Strand=+; Position=1-216
KRARSARYEAAKRPNVLKKRARSARHEAAKRPNVPKKIKKRARSARPEA

SEQ ID NO: 131135 - protein, 93 aa, Heterodera glycines
  Coding regions on vcDNA: vcDNA=SeqID_57558; Strand=-; Position=1 -94,196-244,292-403
  Homolog annotation: Hit_ID=CAE67518.1; Match level="QueryCoverage =98%, HitCoverage=38%, E-value=3e-27, Identity=61%"; Hit description =Hypothetical protein CBG13037 [Caenorhabditis briggsae]
RFHVLAQLEHLQSKYTGTGHADSSRWDWITNQHRDTFASIIGHPDHLSMMAICENEMMAICENETRARTKYNMLCRMVQPCGPPPEKSALDDL

SEQ ID NO: 131136 - protein, 414 aa, Heterodera glycines
  Coding regions on vcDNA: vcDNA=SeqID_57559; Strand=+; Position=1 -82,1137-1930,1986-2354
MDKDKDNKDKIEPKGRSDHPNRPCHSAEEDGLNEGQTERDKRLWLIHQKRQLRNMDLDALRRRIVTLEQEMREIGGTRSGLPMPTTFDGTTDLQDYLKSFNLIATAHNWTPARCVQVLPLFLRGSARAIYESIEPDIKDNWRSLIDAMADKLKQMSPSLTARQKLAQRKQQTGESLEEFAQAIRNLVLRAYPDNSLEMDFGNLVLGALENDVKQANEVRLRQFRSEIARDFFRANMAPRLKERVMYMEEPQTLEEAVAQARRVEQVQGNLADDMWKNTQDAKAEVALAEVNADEINENGKIKAILGEETTPKDKINLIFGGAIPNFGQFAEGISRQGDSQDIPGDSTHTEEDLIRAALTQTSHRLATTSKEQTTMEISNRTSTKTKIGQEDVDQQVPTEDAEEVMPIEDGLAGA

SEQ ID NO: 131137 - protein, 103 aa, Heterodera glycines
  Coding regions on vcDNA: vcDNA=SeqID_57560; Strand=-; Position=1-350
IESLELWRVSCAGRNCSRRCFGFEEWENPVFCADSIPFCTSGVAWPIWMIASSFGLNFVLIVLVLVHLAVVRVRRDLPFASIGVCDQCQRRVSVLSSRIVSSM

SEQ ID NO: 131138 - protein, 1213 aa, Heterodera glycines
  Coding regions on vcDNA: vcDNA=SeqID_57561; Strand=+; Position=1-3640
  Homolog annotation: Hit_ID=DAA04499.1; Match level="QueryCoverage =69%, HitCoverage=62%, E-value=1e-122, Identity=32%"; Hit description= TPA: pol polyprotein [Schistosoma mansoni]
MNGVKTKALFDTGADITYIGHSTAQRCFMMVRKGDYPQARAANSTPIRFIGSALANIKLGDFEGKFPILVSEDDSCPCTAIIGTDLMDFISEQGEEEIGLNFKRGLVRVGNMHLPMIAAVNIEKQPIEAQLIETQTLPPLSDSLVWGKINRSLGPDEVFITAERDHEYFPLRVGKCLISPGSTRIVPLRLLNFGNSVIKVHEGSRLAWLEPIADGTEINAQKEDEKENPEMIMTDEVWMKFKLESDKISPEADWTDQTLEFQKKEEAVAPILERIRLNDTILSRDGIEKLKNIIRQNENAFVKPGEVGLFKGQTIHRIDLIDGARPVQQRPYRYPVALQPEIERQVKELLRQNVIRPSTSAWASPIVLVRKPDASYRFCVEYRKLNQLTKRSTYYLPRIQSILDEVSRKKYFSVADCSSGFFHIKLAKGHEERSAFICHMGLFEWLRCPFGLAGAPTTFQRAMEEVRQMCSATFLVYLDDCIIGSMTEEEHLRDINTFLRTMTEVGFRLKPEKCRFALGEIRYLGHLISANGVRIDPKDLEPIHKLRKPKNITELRSLIGMLSYFRKFVYGFAEILQPIYELTKNESTTEWGPPHEKALEELKTKLMTAPVLAPPKFGQPFVVETDASIKAIAGCLLQENREGEVHPICYFSRVLTKHEKRYSVVELEALAICASLKNFRPYLEGAGKSTVITDNSALTSLFRRKDLEGRLSRYQLAIMAFDVEIIHRPGKRNQFCDHLSRYLDDNDTQINWLKIEPKISQSEMREAQKQETDTQKRRETLKKDQNSEEPNEFTGKWRITEDLLCAMDRGEWKIYVPSSLRQRVMKEYHSDPFQGGHLGEKRTKDKIRRNLYWEGMEKDIQKFVRTCDACQKRKIIGNQMSSEPICPIVPASQPCERLHLDLMGPLKTAKGGFQYILMIIDSFSKYMTALPLREQSATTVTTAFVDKFLCQFGIPKIVVTDCGTQFLSSTFESLAKTWGFKHQTTVPYHQSANGQVERFNRTLADMLVTTTGGKDWAAALPMLCFAYNTSINSQINHSPFFVLHRFDPRLPSKMLLEKDGEEYNDMAIYVQELTKRMEEAKSRIRESLKKCANRMTQQQKGTKEVRWTEGMLVLRRRNDKKNKLEPNYEGPFRVIKIEKPNLQIRELDPDGQPFTVHMDQCKPYFTDEEARQDTETSENEKSKHKNGNKKMGDSKLEESDEEMHDGETIVACI

SEQ ID NO: 131139 - protein, 55 aa, Heterodera glycines
  Coding regions on vcDNA: vcDNA=SeqID_57562; Strand=+; Position=1-166
MPKKDKTKAKVINEAIKANDIYSVSSLYGLNKQMYKCVQPNHSEKAKQMPSFCSS

SEQ ID NO: 131140 - protein, 83 aa, Heterodera glycines
  Coding regions on vcDNA: vcDNA=SeqID_57563; Strand=-; Position=1-251
  Homolog annotation: Hit_ID=NP_740900.1; Match level="QueryCoverage =100%, HitCoverage=2%, E-value=5e-31, Identity=73%"; Hit description =chorein A (359.3 kD) (1J482) [Caenorhabditis elegans] emb|CAB02304.1| Hypothetical protein T08G11.1a [Cae
MVFESVVADLLNRFLGTYVDNLNASQLNIGIWGGDVKLNHLEIKDTALDELDLPVKLSFGYVQSLVLKIPWKNLYVEPTIVEI

SEQ ID NO: 131141 - protein, 24 aa, Heterodera glycines
  Coding regions on vcDNA: vcDNA=SeqID_57564; Strand=-; Position=1-72
MPCQPGKGEKGPGVPIWVPTSQQM

SEQ ID NO: 131142 - protein, 94 aa, Heterodera glycines
  Coding regions on vcDNA: vcDNA=SeqID_57565; Strand=-; Position=1-284
FRTLNYTDAFIYKIWDADQLKSVEKFAFEQPISSFHWFVPCDCNSSLISIATSSSNVVLLDPRYPSFRSIHIPLILPKDWVTLHNKFAVCSNAF

SEQ ID NO: 131143 - protein, 24 aa, Heterodera glycines
  Coding regions on vcDNA: vcDNA=SeqID_57566; Strand=+; Position=1-76
ITGVSIIAVLFLVFLMPSQNLVRF

SEQ ID NO: 131144 - protein, 151 aa, Heterodera glycines
  Coding regions on vcDNA: vcDNA=SeqID_57567; Strand=-; Position=1-456
MNSEKSEKANSILLEAAKKETERAWRDVAALTDEVSDFAKSSRETLNRAIKSREKAPYANGIRELYLKMSDSIWEIFTILDKINLESEKAESTWRDFERCKTFDQATKLEEQSQNSLMEARRLHFESRRVQSQMLNYENRLQTIVWEHMGI

SEQ ID NO: 131145 - protein, 49 aa, Heterodera glycines
  Coding regions on vcDNA: vcDNA=SeqID_57568; Strand=-; Position=1-4,99- 244
MVREKKCASPAYITNMLIVNVKKRTAHAGLLNNVKIKENVESMLWLCAS

SEQ ID NO: 131146 - protein, 193 aa, Heterodera glycines
  Coding regions on vcDNA: vcDNA=SeqID_57569; Strand=+; Position=1 -90,139-259,310-680
  Homolog annotation: Hit_ID=NP_507780.1; Match level="QueryCoverage =76%, HitCoverage=10%, E-value=6e-09, Identity=33%"; Hit description =predicted CDS, DNA polymerase type B, organellar and viral family member (5T899) [Caenorhabditis elegans]
MDYGSGQSALQLVYRQQDLVQRYDTRILYMDTDSIFYDFKTALGDPLKGGNQLGELADEYPNHTIVEFICAGPKAYALWLRNNATGEDEYKLKLRGITLDSNACTRINFEKMKEMVLEKWGTPGNHVRFDYPTKNFRITKQGDILTVPITKQFNPTVNKGVLRDRGLKVVPFGYSSWEYCKAHNPNECRCKKE

SEQ ID NO: 131147 - protein, 228 aa, Heterodera glycines
  Coding regions on vcDNA: vcDNA=SeqID_57570; Strand=-; Position=1 -409,458-735
  Homolog annotation: Hit_ID=CAE56395.1; Match level="QueryCoverage =96%, HitCoverage=28%, E-value=5e-35, Identity=38%"; Hit description =Hypothetical protein CBG24082 [Caenorhabditis briggsae]
MPKLPETLYTDRGLEFVAKPMQEFFAENGIKKYETSSKKKAAVAERAIRTLKTRLYKYFSAKNTSAWVDVLPKFLSAINNSVCRATGLRPNEISDVNAREVWKRVYGEGLVPAEKRPKIKAGETVRIPEPKHIFEKGYIPNYSDHVYTVDEARSTNPQHYLLKDYYGTKLKRKFYLPELTKVQIDENTMYRIEKKYKERMRDGKKEILVKFIGFPEKKYWVTDEDFEK

SEQ ID NO: 131148 - protein, 601 aa, Heterodera glycines
  Coding regions on vcDNA: vcDNA=SeqID_57571; Strand=+; Position=1-1806
  Homolog annotation: Hit_ID=CAA82797.1; Match level="QueryCoverage =77%, HitCoverage=70%, E-value=4e-32, Identity=27%"; Hit description =gag protein [Ascaris lumbricoides]
MSSPILDIIQGLVNRLEVELTKEIPINPGQNATPNTIQRHLYRAKNACDELSEILEEIQRKRVEMAESLQKIAVAARENKERVYVDFCTHLDIEAKINRAVIKKNEWQNKKEQLEDIFDINPQNSLNSTILTPRNQPIKRVKIPQIQLKKFDGSVEKWIPFWETFRVHVHEDDSVTKIEKHNLLESNLEGEAKELIEGIPISEDGYQIAIDLLLEKYGKSTKLIRALNQEINLFPPSTSHKEVNHNKYESEATMNFAVKFREEWKKVQNEQKHKNFGSKNDQRRRFSSSPEYSVDHKNSQNSNNQRFSRPQNRWERGKKKGSPYPNKFRSSSNSSNYSNGSNYSNKSPPKFPRHFCEQIHSPVFCKTYQTAEKRKEQAIKKKLCLRCLRRGHFAKECFSKKRNCLFCKSANHHSALCRWSKMNDSSPKRKDFVNASTKEVNDEVLASKIIESINAASCLITQPNKISVLKCRYVTIYNPLNKKLRKRVLAFFDDGSQKTYIEEELARSLKLTVIGRQKLELSGLGGANLGKFESPVVEFGLKARDFNMLMIGRAIKKVLKEIPVLDYQEINNDELKKNNISVPYLLDEPKITIGKRFLQLF

SEQ ID NO: 131149 - protein, 761 aa, Heterodera glycines
  Coding regions on vcDNA: vcDNA=SeqID_57572; Strand=+; Position=1-2286
  Homolog annotation: Hit_ID=NP_508324.1; Match level="QueryCoverage =96%, HitCoverage=26%, E-value=2e-92, Identity=34%"; Hit description =predicted CDS, peptidase family A16 and RNA-directed DNA polymerase and Integrase, catalytic domain and Z
MIKNISFNGKRYQSKLLWIEEEAEKLPTNFAMAYSQLKSNLKRLRTNPKLLQLYHNTILEQINDQGSVEITNPLVDPNQKGQKIHYLPHHGVVKETSEHTKLRIVYNASAKSGKNPALNECIEKGTNEYNDLTGIQLRTRLKNILIGSDIAKAFHQIELAPEDRNCVRFLWVEDPFDPNSPLIHYRFKRVTFGVICSPAQLALTIKLHLEKYNHPIIKQLAQNIYVDNLLVGINHKKDFQMVYELIKKVFAKAGMNVREFVSNELSELQKLPKEDRIEKETVKLLGIWWNVKNDEYFIKMPKFEPNNAVTRRKVLSQIAKTFDPCGMTSPIILAAKLFRQEIENGKNLKWDSKLSDSEEQKWKELMLTWENKEIKYPRKLFQNNLSEHTKFQLHAFTDACSKAFGAAIYLRIENDQQIYCNLVFAKSLVVPANMPKGKRTIPNLELHATMLCGKYLNFVKIEFEKEIKIQNCTIWSDSTDVLDFVRSERKFDKFIRNRVQNIKKWHLKHINGKNNPADLASRGTSVEELQKSEIWWKGPNFLSESENSWPKTIREYDPINPPEIKEKQNVIFEINSAIKEKDFCEFEKYFERFSKWDRLKNSIAYALRAFKKEDQKKVSQNMEKISDIKNKKNGNDITKEIIKLIRPLEAKEILKAEKLIFKLIQTNSSPTKSIIRNLDLFKDDDDLWRTKGRILKSGLNYDTINPIFIPNNSYIATLLIRDAHLKTMHGGRELVNSKLRENFWIPKSRRKIYEILKRKNK

SEQ ID NO: 131150 - protein, 237 aa, Heterodera glycines
  Coding regions on vcDNA: vcDNA=SeqID_57573; Strand=+; Position=1 -31,90-772
  Homolog annotation: Hit_ID=NP_496808.1; Match level="QueryCoverage =96%, HitCoverage=9%, E-value=4e-21, Identity=33%"; Hit description =integrase, catalytic domain containing protein family member (2N547) [Caenorhabditis elegans] emb|CAB02490
MLGSNIYMFNSFRRFIKRRRVPKLIISDNGTNFVLASKALKQIALEENKQNRIWSEIYRDPMIQNFSSNLGIDWQFNSPYASWRGGAYERMIGLVKTHLIRSLGKRLLSFEELMTYLIEVERIVNERPLSYITQDEVIEPLRPIDILNPTDGEPFSLKLDPTFDREDINEYFEKKTKREELFEIYKKAIFKSEIFWKEWSEKYLLSLREKHINKNKDGNKYPKIGQVVIVRDQDNYP

SEQ ID NO: 131151 - protein, 1512 aa, Heterodera glycines
  Coding regions on vcDNA: vcDNA=SeqID_57574; Strand=+; Position=1 -2249,2572-4861
  Homolog annotation: Hit_ID=CAE61412.1; Match level="QueryCoverage =14%, HitCoverage=25%, E-value=1e-15, Identity=26%"; Hit description =Hypothetical protein CBG05276 [Caenorhabditis briggsae]
MSDSQSSDDELMYSADENFEMKVSVQSSKNNDKISEAKKHSNCQKDPLEDPPNFENLLDNSPNCQKDPLEDQQNFGKDSLEDQQNLLKNPLEDEQNFGKNPLEEKSKKFKIPEDLLVDSQKPKIRNYVPENIPKVVARSILVFIVDNQVEIELRQIMRKKEMKAMVFRPRKWDKNTIGTEIEIGTITQCIVIWRETMDAELLAVLTKVEEICYELLCIWIVPKGVPIHVMKKRFPAIVRVPEEENINNLLTKLEQIGMPIEKRGEQKWHETVATNAQKVNWNQLGNGRREKAAGSHSHNSFVPPHFSSYLPTTTKMFFPTPEMPKKGENFGKIQSENFDPFVVLGVKRKSQSPESNYEYEDIFEGPLCTKRTKFWVNSKCETTKTEPLEVKTFFKNENKEIYQPHWKPIVLSSPSGKKGAFFFGKNFVFSNFHPSSFMMDGFKWDNVEQKYCFEKASYFGYFNLAKKIKFKDGITEPSEFKKITDKEMDQYKSFEENPKFFDQYEWNRVRENVIRPILWAKFTQNEKFGQMLLETGNLPLYEASVNFSWGIGIDIRERQLIFSNMDQGFKGKNMCGRLLEDIREKLNPMNTGNQKGQTNPKNEKDLDQILKKIENDRKICVFKTESILRQCTRIKEVVKENWDMNVFIQGSIYNGLGRKESDLDLVMINSKGIPNDWTKDDSCQFFDKLRKKLRDSGMALTRTLIIPSRNVSILEITINSDDQEINAQISCNNLIGLINSKWWHVVYSWIREPVEYERRKNDFWEKSTQEMKMHLFILEPFGAFNVARSVTQNGFIKIKNAFHVTWEKLKFGIHNPKKLLEAIKGKENDEIIEEKLNLNRILISDQELVQGQEANTPMDSASKSRKWVLNSQKYFFNALMIINIINFCVATQPMICHNRAQTKLVQFKRDTSSCGKISRFLEQPTRALMLDLFRPNPDNFQFEAWRCIKTRQTQKYRTDLFGYKIEEIPDQILLPTTFEDCHQMAIYKKCEFGVLSGEIGQKHTNKKLIIEQSWWKIGFQKTESENCFLSKITLFGTPGSDIIHSPADDTKNCKYSDGQCQLENGVYLLWEIKKNIKNLFDEKTCVYKREEKINGTYVPGIWMSNDNNRALVFDQNSKKVESCGERLRVSAQGFAIIEEQFKELMKNEKNSFDQNIRNKRKRFKRWNTPFSSEIENTPLDGEVRASQLAMQLQAGAFYQNKEIKSSFHKLIEMVCKTLDDNIFNGYSHLNPSLFIRQKTGQTFLEGHWISDEILEFWGCSAINFSFVPSLDGKCYEFIPLNFSLDHTEKLLIGFLDPITMIVKENSKIQTCTEGQFKTILLNNKLIKINQLTGKYTFIGEPTIYNINQKIWGEENLPIFPVQIFKQLILTNLTNKQIDMLEMLHAFRTSRIIDNRPNEDRKIWNSNQFRAFTFQNLITEIDWWKYVIRSVILVVIINWVYKIYKWKQKMLIRKEINKRNSQNFQQQTGAIQIPLAALKQRFVGGVSAPTTDEAEMPENAERIKCQKRKRRRK

SEQ ID NO: 131152 - protein, 140 aa, Heterodera glycines
  Coding regions on vcDNA: vcDNA=SeqID_57575; Strand=+; Position=1-423
MSSPILDIIQGLVNRLEVELTKEIPINPGQNATPNTIQRHLYRAKNACDELSEILEEIQRKRVEMAESLQKIAVAARENKERVYVDFCTHLDIEAKINRAVINKNEWQNKKEQLEDIFDINPQNSLNSTILTPRISPSKE

SEQ ID NO: 131153 - protein, 95 aa, Heterodera glycines
  Coding regions on vcDNA: vcDNA=SeqID_57576; Strand=+; Position=1 -141,259-405
MLEMLHAFRTSRIIDNRPNEDRKIWNSNQFRAFTFQNLITEIDWWKYQQTGAIQIPLAALKQRFVGGVSAPTTDEAEMPENAERIKCQKRKRRRK

SEQ ID NO: 131154 - protein, 243 aa, Heterodera glycines
  Coding regions on vcDNA: vcDNA=SeqID_57577; Strand=+; Position=1 -330,366-767
  Homolog annotation: Hit_ID=CAA82797.1; Match level="QueryCoverage =65%, HitCoverage=26%, E-value=3e-11, Identity=30%"; Hit description =gag protein [Ascaris lumbricoides]
MAESLQKIAVAARENKERVYVDFCTHLDIEAKINRAVIKKNEWQNKKEQLEDIFDINPQNSLNSTILTPRNQPIKRVKIPQIQLKKFDGSVEKWIPFWETFRVHVHEDDSSNLEGEAKELIEGIPISEDGYQIAIDLLLEKYGKSTKLIRALNQEINLFPQSDTVEEDEKLYIKFEKICRQLSSLNQDMDLSPHYLSLEGKLSTLVLDKYFVIKDAEDNQNWNTTKFRNALSRAIEQIKKGKK

SEQ ID NO: 131155 - protein, 58 aa, Heterodera glycines
  Coding regions on vcDNA: vcDNA=SeqID_57578; Strand=-; Position=1 -58,198-269,606-650
MGREHRSDRKRDYEKVCFARAQSVGGRIVEWQQKEDKKGEEPKFRHHAEKFRQSAALE

SEQ ID NO: 131156 - protein, 340 aa, Heterodera glycines
  Coding regions on vcDNA: vcDNA=SeqID_57579; Strand=+; Position=1 -47,101-376,424-841,885-1166
  Homolog annotation: Hit_ID=AAL78214.1; Match level="QueryCoverage =42%, HitCoverage=76%, E-value=2e-12, Identity=30%"; Hit description =putative esophageal gland cell protein Hgg-20 [Heterodera glycines]
MSHNPKEAKKEMEKAIFIAADCWLKVFDLLPRSQLGLGISMISRRFDYFVDEHFKIRKWTFDKLEIRSKIGENGAKEMEIVNSDGKELPIPQNSLPNKFIGFGCILINYIDQNVLIFLRRFHRFFATFETKIHIGTVNVRISKFAMLTIWPMFKDTIRVMYFNSITLRQMRQFAPSMLNDSPSLRVVAFDDGISPEFPPDDSANATDGQAVAKWLFSPRHDNLTKALSLENLAVEQQWLATMEQIKAAFSAASSPVNFVISVGFSSSSPIDSVVPFELTNEFTQEKLTLSPELVNVYRLTRRSIAADDEGKWMKEMNELMRGQKNNKIGIFIGDDGIDNE

SEQ ID NO: 131157 - protein, 286 aa, Heterodera glycines
  Coding regions on vcDNA: vcDNA=SeqID_57580; Strand=+; Position=1 -143,202-622,667-963
MGRLEIRGKIGENGAIEMEIVNSDGKELPIPQNPLPKKVIGFGSIEIDFIDQHVLTFLGHFHRFFSVCSTKLYISTGTVRIAEFVVLTILPMFKDTIRLLYLDITDLRHMRQLAPSILFNCPSLQVVTTFFDFLPEFPPDDSANASDGQALTKWLFTPHPDNLPKLFFVHIWEDTGKQWSTIVGQIKAAFSAAASPVSFNITVAFMPFYTLPDVVPFEMTNELTGENLKMTKSIGTEDDEDIFEIIRCSVEEGSEQKLEKALNELVYGRKNNKIDFSIKYRGVDER

SEQ ID NO: 131158 - protein, 248 aa, Heterodera glycines
  Coding regions on vcDNA: vcDNA=SeqID_57581; Strand=+; Position=1 -47,99-380,431-845
  Homolog annotation: Hit_ID=AAL78214.1; Match level="QueryCoverage =68%, HitCoverage=90%, E-value=3e-12, Identity=28%"; Hit description =putative esophageal gland cell protein Hgg-20 [Heterodera glycines]
MSDNPKEAEKEMEKAIFISADCWLEVFDLLPPFQLGLGIALISRRFDYYVDEHFKTRKWTLDKMEIQINGEIGQNGAMEMKIVNANLDSLPIPQHPLPKKVIGFRSITIHFFDQNVITFLGHFHRFFAKCATNLSIETENVRISKFIMLNIWPKFNNTIRLIYFHSIAFGQMRQLAPSMLNDCPSLGIVSFRDGIFPEFPPDDSANASDGQMVAKWLFSPRPDNLPKSLRIMNSLVDQWLAIVEQIRS

SEQ ID NO: 131159 - protein, 211 aa, Heterodera glycines
  Coding regions on vcDNA: vcDNA=SeqID_57582; Strand=-; Position=1-636
  Homolog annotation: Hit_ID=P23241; Match level="QueryCoverage=49%, HitCoverage=20%, E-value=5e-10, Identity=44%"; Hit description=Elav protein (Embryonic lethal abnormal visual protein) gb|AAA28505.1| ELAV
LAAAAATLLLNQQNNGASTTIAGGQHHLYHHHDSGTSSNSSSSLVAAAHHQHQQQQLLFAALAAGVGGGDQKPSATVLHQLLAASGVTGGDFQQQLATLAALGNGGADAANSLAAVAALQQQQQQQLVQQLLQQQHALLGAAGAHNGGGGGAANAAAQHQQQQQQQLLSALAVAQQQQQHQQQQLSNGYGGGGHGGHSTYGFEYIYRCNQN

SEQ ID NO: 131160 - protein, 63 aa, Heterodera glycines
  Coding regions on vcDNA: vcDNA=SeqID_57583; Strand=+; Position=1 -67,352-476
MGRRSQCEVAAMAFLALPMGVEGLLYFFATSIFLLIVPLVIIGIFIDIVRSSFSMFHFIKEAC

SEQ ID NO: 131161 - protein, 302 aa, Heterodera glycines
  Coding regions on vcDNA: vcDNA=SeqID_57584; Strand=-; Position=1 -93,187-329,389-535,1026-1217,1278-1350,1540-1797
  Homolog annotation: Hit_ID=CAE68977.1; Match level="QueryCoverage =99%, HitCoverage=32%, E-value=2e-24, Identity=37%"; Hit description =Hypothetical protein CBG14959 [Caenorhabditis briggsae]
MALVSTMLSAVSKEALLPKRQFLSAETTLTTLCDDNYFGAHLDDWPETVRQMLASPDVAIPAPSECHRLCLSSLGAVLWYLKHCLVDVDTVTMRRFSAYIPPYIESKEIVKGAKNGMEDEAFWEGKHIIHTIGLKYRMDSSNGHPDSRANLFEADKYNKRKIKDLLIVLDGLEDTRKLMLLFEEINSQGESNAPPLLNECLSANYKEMVEDLGFFKGAFDRENALERGVILPRRGVDSEYDGTCREIEHCKEQLEAYLGWASKKLKCTPKFVGTGRNSHQLEIPESACHNLTDDFQFTSQRK

SEQ ID NO: 131162 - protein, 133 aa, Heterodera glycines
  Coding regions on vcDNA: vcDNA=SeqID_57585; Strand=-; Position=1 -93,145-453
MDICELIASIAFDTHVQGHSLAACHLYALAKCHEKAIKLANCQLSMCVSNPMAKETCEMVECAKWLAQQFGQPNMNEENASFSTLILLLKLHNFFRLAVEERHGEAIELMKSEKMYGTGRCATQCQPIPRSAN

SEQ ID NO: 131163 - protein, 219 aa, Heterodera glycines
  Coding regions on vcDNA: vcDNA=SeqID_57586; Strand=-; Position=1 -78,684-1046,1094-1312
MEISSRHIPTIWFTSPNIAEAHGGASSQLSSTRLPISKIAEKPPSADASDRYEDINTDVLNERFTDAETNKFVQRTIERAQIEAERTFLNQQILERRFAPGESLFGPVNKRAMGSAQPDRTASGGIKRFINLPNAPLSHEQSVFAQKVNETLTSNASALILLAVKESLSNLKSKEADYIWSKAWAMFPSSIGENWHEKRSSHNWMGHIIDNSTKFLQNE

SEQ ID NO: 131164 - protein, 70 aa, Heterodera glycines
  Coding regions on vcDNA: vcDNA=SeqID_57587; Strand=-; Position=1 -103,176-285
MKEKIEEFADPDLYANVVILHTWMFFKKATVITYGYTWTYVRAVQTQQGMNSLVNPPVTDAEAFHTHLFL

SEQ ID NO: 131165 - protein, 24 aa, Heterodera glycines
  Coding regions on vcDNA: vcDNA=SeqID_57588; Strand=-; Position=1-72
YNSLFLIVSLCTQFLGMTSDECSS

SEQ ID NO: 131166 - protein, 21 aa, Heterodera glycines
  Coding regions on vcDNA: vcDNA=SeqID_57589; Strand=+; Position=1 -35,180-210
MGGSLYVYAVLRGVMAIRTKA

SEQ ID NO: 131167 - protein, 165 aa, Heterodera glycines
  Coding regions on vcDNA: vcDNA=SeqID_57590; Strand=-; Position=1 -63,110-332,425-636
MIQSAPGDIFDEIWDKFQPNKGLSNENHSKEQKPSNLLQIKEEKTELNPNEMIWNKGIEIKTEPKKEDEEIGVKIEPKIEKEKENEEMGPKMRKKKNKAHTTEEKLQILRKFMTRKIECAEIPSENSVYEMEEKIAKELGVCRASINKWKKELGLSAGINDKNIL

SEQ ID NO: 131168 - protein, 116 aa, Heterodera glycines
  Coding regions on vcDNA: vcDNA=SeqID_57591; Strand=+; Position=1 -270,459-539
MNPITFLSAVCCFLFLANHFQSVAAASTNVFVQGKKSYTINLILDDREGGYIQQITTKKVNGKQCLTLNQNLWKTYQDDDVIAFRHGSTDALIGSITVKLLRADTSIDISADNTHL

SEQ ID NO: 131169 - protein, 204 aa, Heterodera glycines
  Coding regions on vcDNA: vcDNA=SeqID_57592; Strand=-; Position=1 -63,294-428,518-649,852-1136
  Homolog annotation: Hit_ID=NP_499065.1; Match level="QueryCoverage =81%, HitCoverage=36%, E-value=1e-36, Identity=43%"; Hit description =solute carrier family 17 member (52.7 kD) (3K478) [Caenorhabditis elegans] emb|CAA79549.1| Hypothetical p
MGFASAIPYVVYFAVINLGGHLSDSLLQRQLLSTLNCRRLAMALALGGQAFFLLLISFCPCGYDKLYSGFVINYLDIAPELAGLLLGLGNTLSCLAGFLGPILMGWLTPTGSKTEWLTVFGITELILVLGALAFAVLASADVQPWAKREQTDDEEEEVISGGTKTDQHMTDQDQMMINNSRKLPEQLLLLEDGTDQQQNAKDKI

SEQ ID NO: 131170 - protein, 119 aa, Heterodera glycines
  Coding regions on vcDNA: vcDNA=SeqID_57593; Strand=-; Position=1 -254,585-689
LLLSKRFSLALICFAGCALCYALRSNLSFAIVCMVKEGSPTVDDNGTTKKGCGAAHATTEQQRQLPINESDMAISRFRRQTNRSALIGHHDADVEQYLPVPLGPGEFDWSKQSRGQVLG

SEQ ID NO: 131171 - protein, 21 aa, Heterodera glycines
  Coding regions on vcDNA: vcDNA=SeqID_57594; Strand=+; Position=1-64
MLNISKLVRRKKGICLKSRSL

SEQ ID NO: 131172 - protein, 175 aa, Heterodera glycines
  Coding regions on vcDNA: vcDNA=SeqID_57595; Strand=-; Position=1 -96,165-344,482-543,588-657,825-843
  Homolog annotation: Hit_ID=CAE61661.1; Match level="QueryCoverage =96%, HitCoverage=44%, E-value=1e-45, Identity=51%"; Hit description =Hypothetical protein CBG05597 [Caenorhabditis briggsae]
DQMPVVNVYSTSVTSDNISRNDLLSWVNDCLQSSLTKIEEMATGAAYCQSSLTKIEEMATGAAYCQLTDFLFPTQVPLKKVKWNSRSDVDWVHNWRVLQQSWKTIGIDKPVPVQSLIRAKFQDNFEFLQWFKKFFDANYDGHKYDSFKKFFDANYDGHKYDSLAARNFEGVPRRF

SEQ ID NO: 131173 - protein, 124 aa, Heterodera glycines
  Coding regions on vcDNA: vcDNA=SeqID_57596; Strand=-; Position=1 -287,663-752
KNAEKLSIYISQLSAKHGQNANANQQSSAGLSSETSSEEEHDVVSADLVLLLNLMRLPVECVHPGEKNWWKNYWAVIADILSIWTEMPEIVFLSVNMLNIDAEKRMTAQGAVDYLEGKCKQRGI

SEQ ID NO: 131174 - protein, 95 aa, Heterodera glycines; identical to SEQ ID NO: 130684
  Coding regions on vcDNA: vcDNA=SeqID_57597; Strand=+; Position=1-811

SEQ ID NO: 131175 - protein, 360 aa, Heterodera glycines
  Coding regions on vcDNA: vcDNA=SeqID_57598; Strand=+; Position=1 -391,454-580,637-965,1058-1293
MDEIRAEIGKGGNSVKKTYKMWHKLANLFNKIPISKSQQKIGIIYDKFGQTKTEFLWKAKDQMMEEHAKNVAKLAGDGQNELSRTLANSIGQMRGAKHRLKSFFTSKFKGTEILEKLMGEDANFAAVFRSDLTSNEIKELQIKFYLKFLDSESETDDYLRAKLIVDNLAFYQWFKNRRQKLPKNGQSLLEQHLLQIELRLDSIAEIETSEGTELAHEAKMMALKMSKDKLFPEENPTEVKTFGKSMKNEANNVKKTLLMMEMHCKIIEEFAENEQKFMDGVKMIDLEIVLDSQRLHKMIPRLSKTCQLLKENAKGETNGRKKSNGKNETEKRAEAEKGEANGQRGGECVASDGKGKLMGN

SEQ ID NO: 131176 - protein, 88 aa, Heterodera glycines; identical to SEQ ID NO: 124691
  Coding regions on vcDNA: vcDNA=SeqID_57599; Strand=-; Position=1 -96,135-305

SEQ ID NO: 131177 - protein, 21 aa, Heterodera glycines
  Coding regions on vcDNA: vcDNA=SeqID_57600; Strand=+; Position=1-65
ITGVSIIAVLFLVFLMPSQNL

SEQ ID NO: 131178 - protein, 45 aa, Heterodera glycines; identical to SEQ ID NO: 124814
  Coding regions on vcDNA: vcDNA=SeqID_57601; Strand=+; Position=1-436

SEQ ID NO: 131179 - protein, 59 aa, Heterodera glycines
  Coding regions on vcDNA: vcDNA=SeqID_57602; Strand=-; Position=1 -155,221-245
MKWMASQWNTLIAGGHWLWLDEVKMEEDEEIEDVSVVVPWAEEAEEEEQFPMAYRIPNL

SEQ ID NO: 131180 - protein, 62 aa, Heterodera glycines
  Coding regions on vcDNA: vcDNA=SeqID_57603; Strand=+; Position=1 -66,123-245
MFTLYISIINISTVICKEIAIKLRSTFKLRISASLSENWPSPELPLSRTNKLAKFLNMTSGN

SEQ ID NO: 131181 - protein, 117 aa, Heterodera glycines
  Coding regions on vcDNA: vcDNA=SeqID_57604; Strand=-; Position=1 -162,227-270,788-838,888-981
WLNNAVNKNCGLPSKKENKIYERAQQLMEEVESKRSTNNGEDFTMSREYKKCKPNIYSVLGYYFCSIHNDIEQVKKREKRSESEYECFLKKISFRYERRREPLLDHANIIISDVARI

SEQ ID NO: 131182 - protein, 249 aa, Heterodera glycines
  Coding regions on vcDNA: vcDNA=SeqID_57605; Strand=+; Position=1 -57,101-790
MLLCFVFLLTTLSTQKAFGSVKNALSLITAALSRNQQRRYFRSVATASFGHRGGPQYIVKSRSAAEPRLFNRLVHQTSRGIRVSAFEGGGSHQYGAAHQHVPGGGGFRDFNSRRGVGPGGSADPRRYDAGNAEREEMLRLMEQREEEHRKKEEELRLEREREKLKYEREKLERERLEVEHMKLTAQIQASGWLQAAALPAAGGFVAASPAGFGVPAAPQQSSARDSRQQQNYSRHHSEAAVALARNSAK

SEQ ID NO: 131183 - protein, 19 aa, Heterodera glycines
  Coding regions on vcDNA: vcDNA=SeqID_57606; Strand=-; Position=1-59
TFAFSSLALPNTHTIFEML

SEQ ID NO: 131184 - protein, 19 aa, Heterodera glycines
  Coding regions on vcDNA: vcDNA=SeqID_57607; Strand=-; Position=1-59
TFSFSSLALPNTHTIFEML

SEQ ID NO: 131185 - protein, 19 aa, Heterodera glycines
  Coding regions on vcDNA: vcDNA=SeqID_57608; Strand=-; Position=1-59
TFAFSSLALPNTHTIFEML

SEQ ID NO: 131186 - protein, 19 aa, Heterodera glycines
  Coding regions on vcDNA: vcDNA=SeqID_57609; Strand=-; Position=1-59
TFSFSSLALPNTHTIFEML

SEQ ID NO: 131187 - protein, 19 aa, Heterodera glycines
  Coding regions on vcDNA: vcDNA=SeqID_57610; Strand=-; Position=1-59
TFAFSSLALPNTHTIFEML

SEQ ID NO: 131188 - protein, 29 aa, Heterodera glycines
  Coding regions on vcDNA: vcDNA=SeqID_57611; Strand=+; Position=1-89
AEPVDFIKHNLTIQSYYLAGDAPKALTPL

SEQ ID NO: 131189 - protein, 331 aa, Heterodera glycines
  Coding regions on vcDNA: vcDNA=SeqID_57612; Strand=+; Position=1 -129,176-283,335-500,559-764,1110-1240,1293-1468,1529-1606
MESAGSSSQPILNRDLQILVGEQIFTGICGPGQYISNGFFNLFEAGPTVKSSVVSVLSKMTVFTMNECRAQISSPTDKRKFLCIDFRKSSGYLFLNKLVQIMNESKGKFFEVLHLICLKGVYIERLFDIFLMLNDLTIINLPYEFDSFSRNGETKILDKLIGKNAATLHSIHHLVYPFQLFPNIRNRIVAINSATLRTGTMERECDFFAFYMDPSDCPKELLPPKFGGISMSISINRCKEVFRSIKRALQRDKLRSEITKLRLLSTFDFDEKSAQILLTQIERIRSTLPKVRSLNIELRAVEFNATEPGPLFERRLRRLQSDPILRFRLFT

SEQ ID NO: 131190 - protein, 167 aa, Heterodera glycines
  Coding regions on vcDNA: vcDNA=SeqID_57613; Strand=-; Position=1 -109,166-293,342-608
  Homolog annotation: Hit_ID=NP_510308.1; Match level="QueryCoverage =74%, HitCoverage=19%, E-value=4e-27, Identity=49%"; Hit description =putative protein family member, with at least 11 transmembrane domains, of ancient origin (63.9 kD) (XO47
MHSSPFGGSLIAAIGFLISALLPALPVLYLCFGVIGGLGFGLIFLPAIVIVGQYFSERRALATGIAVCGSGIGTAIFGKLNPFLLDLFSDMAGEEESWRLFLLFLSGTSLFCAFFGYFFKPLKPSKSQLEQVNCFKHFQKIIPYFVLDEVIGFSKGCSDHSRTDGNG

SEQ ID NO: 131191 - protein, 100 aa, Heterodera glycines
  Coding regions on vcDNA: vcDNA=SeqID_57614; Strand=-; Position=1 -191,609-722
LSKIGGDELADSVQMRLLRDENARLLSALGSVKADKAVLKKRLDQLQQNDALAEHQQTNVLKQSKLSPTRTEKSQQRHVFTLHDNNNGFTGCTSARQPTT

SEQ ID NO: 131192 - protein, 75 aa, Heterodera glycines
  Coding regions on vcDNA: vcDNA=SeqID_57615; Strand=+; Position=1-230
LPPLCLFSTKCLRQFNPPFFCAMPCNCQPIPPPPPFDVPPPPDPSFVFHLLSDDPPEAFEKVKGNLKNGPMVTEK

SEQ ID NO: 131193 - protein, 299 aa, Heterodera glycines
  Coding regions on vcDNA: vcDNA=SeqID_57616; Strand=+; Position=1-898
  Homolog annotation: Hit_ID=AAH44265.1; Match level="QueryCoverage =99%, HitCoverage=71%, E-value=2e-34, Identity=27%"; Hit description =B52-prov protein [Xenopus laevis]
MKSDRTKPNNGMKSDRAKSNNGMKSDRAKPNNGIKSDRTKPNNGMKSDRTKPNNGMKSDRAKSNNGMKSDRAKSNYGVKSDRAKSNNGTKSDRTKPNNGMKSDRAKSNNVTKSDRTKPNNGMKSDRAKSNNGMKSDRAKSNYGTKSDRTKPNNGMKSDRAKSNNGMKSDRAKSNYGVKSDRTKPNNGMKSDRTKPNNGMKSDRAKSNNGMKSDRAKSNNGIKSDRTKSNYGMKSDRAKSNNGMKSDRAKSNNGMKSDRTKPNNGMKSDRAKSNNGMKSDRAKSNYGVKSDRAKSNNGTK

SEQ ID NO: 131194 - protein, 260 aa, Heterodera glycines
  Coding regions on vcDNA: vcDNA=SeqID_57617; Strand=-; Position=1-783
MANKLILLPYEHYKGLVAARETKNDDDDDIAERTNLGFVKRQVTAAVQKRKGNVSERNAMYNQHLRRYLKMRKEHKERPVRVQLSNGAQLLNKTVETGVQVRPGPDEPKDKSVMVTDEDEEEEIEVPKFLTPTSQTQGSSRSPRTNKKAAKQQKLIEKKDHLLAIIMSDPQRFGATDRGKIINPKTGREFIDSDLAWSIERLVDPRPENAPSPRGTKELKRKLAQNPLASSLLNRLFVGSGFVGQVKQTRGFVPSKWTRK

SEQ ID NO: 131195 - protein, 199 aa, Heterodera glycines
  misc_feature (146)..(146): Xaa can be any naturally occurring amino acid
  Coding regions on vcDNA: vcDNA=SeqID_57618; Strand=-; Position=1 -60,165-250,689-857,1656-1779,2576-2739
  Homolog annotation: Hit_ID=CAE60473.1; Match level="QueryCoverage =93%, HitCoverage=16%, E-value=9e-48, Identity=53%"; Hit description =Hypothetical protein CBG04085 [Caenorhabditis briggsae]
VRNSCYFPSNVRQVLSDFSVMIAIVCMNLLDVFLGTNTTKVNVQRNFRPSWPGRGWLVHPFIGNSLWIPPLTLILAVLACVLLIFMGQQIHAVIVNRREDQLKRDCGYHLDLLIYWVSSPKVANLGSIAISSVILSFSYWNWLPIXSENPAPSHSCSNVYRKRYITGIVTVTLIGLSVTMTKLLSRCMHSFTNGIATSK

SEQ ID NO: 131196 - protein, 29 aa, Heterodera glycines
  Coding regions on vcDNA: vcDNA=SeqID_57619; Strand=-; Position=1 -40,413-462
MPASANCRAAKRNSSPFAVHNYTYFSDDF

SEQ ID NO: 131197 - protein, 111 aa, Heterodera glycines
  Coding regions on vcDNA: vcDNA=SeqID_57620; Strand=-; Position=1 -57,316-468,605-730
  Homolog annotation: Hit_ID=NP_999938.1; Match level="QueryCoverage =61%, HitCoverage=19%, E-value=3e-10, Identity=50%"; Hit description =zgc:63825 [Danio rerio] gb|AAH55256.1| Zgc:63825 [Danio rerio]
MRENKIGIYNNHLNAYVTTDFTKVFASKKSKKELYKIASGEMAPHFLLNVGDNFYDEGVTKEDVAERFEQNFTKVYNYDSLNVPWYTIAGNDDWKSKDGIKPQIDYPTGKW

SEQ ID NO: 131198 - protein, 16 aa, Heterodera glycines
  Coding regions on vcDNA: vcDNA=SeqID_57621; Strand=-; Position=1-49
EAIPEGFGLPINLGAS

SEQ ID NO: 131199 - protein, 165 aa, Heterodera glycines
  Coding regions on vcDNA: vcDNA=SeqID_57622; Strand=-; Position=1 -459,650-688
MVRTKQLFPSELQCSSSSLQNNSSEISENQTGSKLPSKKAVKPVQSSGKKRSRTMFDSFERMHMNEKKNIGNEMNLENVINLDMIDFEEVKESDEIERKRKKIGKDMNLESVINLDMIDLDGVNETTQTQKSQPNTKRIPTGFLFKSAAELNNKKMKLRKILRII

SEQ ID NO: 131200 - protein, 64 aa, Heterodera glycines
  Coding regions on vcDNA: vcDNA=SeqID_57623; Strand=-; Position=1 -144,196-243
MRKKVELPRFTRILYRFPNGTYRMMVGTGLEGSKWVKGSKKNADWQFKPNEPFIGNYWDGSKHE

SEQ ID NO: 131201 - protein, 244 aa, Heterodera glycines
  misc_feature (7)..(7): Xaa can be any naturally occurring amino acid
  Coding regions on vcDNA: vcDNA=SeqID_57624; Strand=+; Position=1 -133,200-374,684-802,848-1009,1169-1236
  Homolog annotation: Hit_ID=NP_509897.1; Match level="QueryCoverage =93%, HitCoverage=17%, E-value=6e-57, Identity=47%"; Hit description =guanylyl cyclase (gcy-9) [Caenorhabditis elegans] emb|CAA91488.1| Hypothetical protein ZK455.2 [Caenorhab
VAMLYAXLGKHFLSFDTLGSVALTSATEMARATMTFLQLYGWKQVVGLVKASVNFDRLSLHSLKGYLKDAQIEVNVEIELDPFMTPDEIIATGKLKQLRNRARIIIVEMGLDLHTSRSFMVAIYRSQMKNPAEYVYIIPWLAHMHDHYPWEASNIDKLETRVAFDDTIMHDHYPWEASNIDKLETRVAFDDTIVITAHGYDKKFIEEFELGFSKVTGVISSHFVALWDIGFRSHLFLYNMLDTV

SEQ ID NO: 131202 - protein, 1424 aa, Heterodera glycines
  Coding regions on vcDNA: vcDNA=SeqID_57625; Strand=-; Position=1-4275
  Homolog annotation: Hit_ID=XP_318550.1; Match level="QueryCoverage =70%, HitCoverage=99%, E-value=0.0, Identity=42%"; Hit description =ENSANGP00000020240 [Anopheles gambiae]
IFKNFSLRVRLKSAVCSSLHLAMDAQQLQQLLNALQQMVTNAAPQNAAPANLSNANLASSIDARISSFHYNPEVGTTFECWFKRYGKLIEEDGSTLPEASKVRLLLGKLGEEEYSKYRDTISPTQPDQVNWNETISHLKSLFAETRSLFVRRYECFKIRQQQGQDVSSLIAQINASCENADLSLTKEQLKCIILIIALNDEHHDLRQKALKMLEDAQKNGTNISLKKIEEELRAIQLVKESALSLVNPPIATNAIRTRPRQWADPAQRQSGGSNQRQTPNANSSGKPTRGQPTHPCGSCGKSDHWRSDCTFKDAICLKCNKKGHISTICRQKKAKAAPNNHRAFHTVKVDANCLHVGTTQGRWWKLCILINGRQTSMNGDTGAQATIISLQTWRELGEPNLTPSDIDAKNCNDQPFALLGKFICTVQFSDKPPQTLIAYVSGEVGHNLLGLPWIEALEIIPRQILFPSSKSADQATMIENFSAVKPPNKSINDVSTLKAALQKDFPEVFEEGLGHCSKAKAHLILRSDAKPVFCRARPIPHGAMEAVNAELDRLLQIGAIKPIDFSHWAAPILAVKKKNGKTRVCIDFSTGLNNALELNRHPLPRPDDIYASLNGAKFFSNLDLRDAYLQMEMDEESKQLCAINTHRGLFQCQRLPFGVKSAPAIFQHLMDQICAGIPGVFAYLDDGLIATKTLDQHITALYTLFGRIKEYGLRIQLDKCKFLQPELLFLGHIVSANGIRPDPSRSDAIRKMPAPIDKSTLRSFLGALNYYGRFVKCMRELRAPLDRLLQKDVAWNWTSEQQNAFEKAKEMITSDLLLTHYDPARPIVVSADASKDGIGATLSHTFPDKKEKVVEHAACTLTAAQQNYSQIEKEALAIVFAVQKFHRMVYGRKFILQTDHKPLLAIFGSKKGIPIYAASRLQRWSMILANYDFEIRYVNTTSFGQADVLSRLIANYPRPEEDILIANICADTDCFINSVFENRIDQIPVTTTEISSAMANDQPLQMVLQFLRNGWPTKVTESEISPYFPKRDKIFEVDNCLLYEDRVIVPTSLRSRILKALHIAHPGIVRMKALARRHVYWPGMDSAIEKVVSTCEECQLGQKNPTKAPLSPWPTTDKVFQRVHIDFAGPCSDGHQYLILIDSFSKWPEVYRMNTISAYATVFVLRSIIYRLGIPEEIVSDNGTQFRSAEFATFCKEFGIKHIFTPPFHPQSNGQVERFVDTFKRSMKKMSKGGKDWIEKMLFSYRTTPHVALNGFSPDQLFFGRKLRTKLSLVHPNGEKAENFDQNSFKKGQSKYTDKMAQNFDRKHGSKLINFFPNDHVLLINYRNNKTEWLQGKVVERLHKSPTYRVYVPVLRRLVHRHANQLRRRHLLEEEAEKEAPQIEEPPPVVEPPHPPQQNQPANSPLVIRRSTRVKKPRQFYSPG

SEQ ID NO: 131203 - protein, 74 aa, Heterodera glycines
  Coding regions on vcDNA: vcDNA=SeqID_57626; Strand=-; Position=1 -82,185-327
MDVYMALDSGAIIDCFHDQKNGLASLNEMADFFTTQAVTDVVQPKGCYLVEFLPFVLKIAFTLLPVAMRALLGF

SEQ ID NO: 131204 - protein, 39 aa, Heterodera glycines
  Coding regions on vcDNA: vcDNA=SeqID_57627; Strand=-; Position=1-119
MAVVSRMWYIGKETCKFFHGAVKVFFDPNWQIPKTKLDP

SEQ ID NO: 131205 - protein, 118 aa, Heterodera glycines
  Coding regions on vcDNA: vcDNA=SeqID_57628; Strand=-; Position=1-612
GSYSGRIRSPHKSGRIGSGGLPRKQKNRFFQVYVWGTQTIMGSKNPTQNYSTGYREAIPEGFGLPINLGASVRGYCPENKKIDFFKCPFGVLKQLWGAKIQRRIKVQTIGKLFPKDSV

SEQ ID NO: 131206 - protein, 60 aa, Heterodera glycines
  Coding regions on vcDNA: vcDNA=SeqID_57629; Strand=-; Position=1-531
LEKMPTLVVFKIFRNSDFFINYLFFAKLILKYFLERALKRTKFYLHVSLGTLMLFLSKGR

SEQ ID NO: 131207 - protein, 138 aa, Heterodera glycines
  Coding regions on vcDNA: vcDNA=SeqID_57630; Strand=-; Position=1 -49,481-848
MIKPQMRPVFGVWGSAARQFPAHLDLPETQEHRASPAAPDSPETPEDKDRPVLPEALANPETPGPQEPPGSPAKLDSPATTVPTVLAPLAQAFLLAALASLLKHLKWTRGEEKEQKRETIRNLCWPMHSLIWHRMEKE

SEQ ID NO: 131208 - protein, 58 aa, Heterodera glycines
  Coding regions on vcDNA: vcDNA=SeqID_57631; Strand=-; Position=1-177
NLKTEHNSLLLLLNPPQQKSNFRKENARSENYSRNCFPLFAGRDLGTLVVIPQLYTQI

SEQ ID NO: 131209 - protein, 387 aa, Heterodera glycines
  Coding regions on vcDNA: vcDNA=SeqID_57632; Strand=-; Position=1 -167,223-345,390-497,549-587,633-695,739-858,907-1020,1077-1182,1245 -1335
  Homolog annotation: Hit_ID=CAE69538.1; Match level="QueryCoverage =98%, HitCoverage=99%, E-value=1e-67, Identity=39%"; Hit description =Hypothetical protein CBG15747 [Caenorhabditis briggsae]
PLFSIVFHLFAIISGHIRLPLFNSSADGQGVIILVARGDDPNSSQDKVVIPQEDGLQPPDGLQPPLPCLITGVGIFEHGQTFTKGNFHYECKNGTAEVIACIAEDMSVIQICIAEDMSVIQIGRTFLRNGTRHKCLVSGNTALYEQRSTCFENSIYYDVGSTCFENSIYYDVGDTFKNGSFKVDTFKNGSFKVTCKDTGVAVVGCFLLNSTDDAILLGCFLLNSTDDAILLGESRLIGTKRHSCEVSESGKVRYVIRMLGCQGQNGTEGEFKPGQTLGCQGQNGTEGEFKPGQTWADKHIRYHCTEEGQKKVLGCVCVDDGGLFIELGHDVMMGGTVHRCFKSQNVTYYHRFRCDRQFRCDRQRSLAECISATKVPKLKRKKRVAMR

SEQ ID NO: 131210 - protein, 152 aa, Heterodera glycines
  Coding regions on vcDNA: vcDNA=SeqID_57633; Strand=+; Position=1 -306,633-785
MHFLGNNYLEYPNGRTLAIIGDTEEKVESARDHVDREFILKRWEASDRRTDRPPNILGNFKAWNTGQHDNVEEEATTYEEIYQLSPKFALREDLELVMKQIKFVESISKLKISKTSEEAANNGEAKRKEAQKGAKGTKSGGKTAPGGGKGGK

SEQ ID NO: 131211 - protein, 50 aa, Heterodera glycines
  Coding regions on vcDNA: vcDNA=SeqID_57634; Strand=-; Position=1 -81,208-279
MNILNYKFLAGAQIGPNGDDEPSTSVSKFKRDWEFATSSDVNEQVNNLQR

SEQ ID NO: 131212 - protein, 32 aa, Heterodera glycines
  Coding regions on vcDNA: vcDNA=SeqID_57635; Strand=+; Position=1-154
KPKLFGLFKKQLKFLKILFISLLIEKASESLI

SEQ ID NO: 131213 - protein, 58 aa, Heterodera glycines
  Coding regions on vcDNA: vcDNA=SeqID_57636; Strand=+; Position=1 -158,686-704
MNTTIWKIGLLKSQRMAKWRNAEDVKKMKGPSMNLPSLTLPVGQPGTGKNKHWKNWDF

SEQ ID NO: 131214 - protein, 94 aa, Heterodera glycines
  Coding regions on vcDNA: vcDNA=SeqID_57637; Strand=-; Position=1-631
DQVPSSDQFESQINIHFSFCLFRVFSLSVLPSLSFCVRLFTLQLSLPFLCYLIPISSDHSLPIHSFFCIFLCCLFVVFFTTIAPTHHHQFNSIE

SEQ ID NO: 131215 - protein, 115 aa, Heterodera glycines
  Coding regions on vcDNA: vcDNA=SeqID_57638; Strand=-; Position=1 -78,350-518,554-654
MASSIIFAPLALKIPLKFAKMDNFGKQKICPILLMDDHEFMEGMEQEDEDEFIEEPMSADFDLGNINDPIGVDEPINHGYSLEVQPKPPTVNSAGIDLDSLSNDYTDYALMNRFL

SEQ ID NO: 131216 - protein, 297 aa, Heterodera glycines
  Coding regions on vcDNA: vcDNA=SeqID_57639; Strand=-; Position=1 -40,253-352,427-468,1001-1031,1088-1229,1684-2008,2406-2511,2568-2632
  Homolog annotation: Hit_ID=AAG40111.1; Match level="QueryCoverage =98%, HitCoverage=14%, E-value=4e-76, Identity=52%"; Hit description =chitin synthase [Meloidogyne artiellia]
LKIIIHILFYFFATAVAVGTSLQIQKDGILSPHSIFLFTVLGSWSISALLHPLEFGCVIPCALYFLAIPSMYMLLPIYSLCNLNTVSWYMLLPIYSLCNLNTVSWGTRENISSTNSGEHHHHNGTHHNVLLAKTAPEDGEVSLGCGNLCRVVCCVRHAFGPAAPTSSHATTAVRRLDEGLQQIERKLASLERRRDGGDCGASELGAEQQRADQSVPEPTAAVGVGLVDQRAPQAQQQERMDSPNWMEEEPFKQFDTVYLDPDEASFWREMINKYLRYLRPINLDSQEVERMQIGLDE

SEQ ID NO: 131217 - protein, 32 aa, Heterodera glycines
  Coding regions on vcDNA: vcDNA=SeqID_57640; Strand=+; Position=1-98
MHTVYALIIAQSLLIPQSPIIPQSTRCFEKES

SEQ ID NO: 131218 - protein, 136 aa, Heterodera glycines
  misc_feature (118)..(118): Xaa can be any naturally occurring amino acid
  misc_feature (122)..(122): Xaa can be any naturally occurring amino acid
  Coding regions on vcDNA: vcDNA=SeqID_57641; Strand=-; Position=1 -95,655-721,1078-1254,1762-1831
  Homolog annotation: Hit_ID=AAG40111.1; Match level="QueryCoverage =100%, HitCoverage=7%, E-value=3e-53, Identity=74%"; Hit description =chitin synthase [Meloidogyne artiellia]
RRRWIPSTMANIIPLLRDYRNVVKVNESVTIWYIAYQLVMLFSSVLGPGTIFLMVVGAISISFNIDTRLALLVVTTPVLCFCICCLTCSTDKQLLMAQIIGALFAMLMVPKIIKLNLXFFNXGRFNKHNRILFKII

SEQ ID NO: 131219 - protein, 209 aa, Heterodera glycines
  Coding regions on vcDNA: vcDNA=SeqID_57642; Strand=+; Position=1 -279,332-682
  Homolog annotation: Hit_ID=AAL78214.1; Match level="QueryCoverage =71%, HitCoverage=75%, E-value=3e-11, Identity=30%"; Hit description =putative esophageal gland cell protein Hgg-20 [Heterodera glycines]
WICNDVWMDIFPSFDRPQLGLKLALLSPRFNALVDKHFNGKSELTIWRSIEIRRKDKGPEPKLSVWLDDKFVPFPLPDRPLPSKIRFKNLQIEYIDHSVIAFLRSNHQIFDKRGTNLHLWIPSSHSTNGQPILDIFCREIWPIFSTNIRCLGFTNGVDLDNLRRLISPTILTDLNQLNSINSGDLSPAAFGGDFDGPNATISAGQALSK

SEQ ID NO: 131220 - protein, 18 aa, Heterodera glycines
  Coding regions on vcDNA: vcDNA=SeqID_57643; Strand=+; Position=1-56
YREATPEGFGLPINLGAS

SEQ ID NO: 131221 - protein, 70 aa, Heterodera glycines
  Coding regions on vcDNA: vcDNA=SeqID_57644; Strand=-; Position=1-213
NENANDLNYALNLFDYRIKRDYLRYNYAKVSADGSAEKPYKAMEAEEIEGKMEQLKVGLKSIVTNREGLT

SEQ ID NO: 131222 - protein, 17 aa, Heterodera glycines
  Coding regions on vcDNA: vcDNA=SeqID_57645; Strand=+; Position=1-51
MDVPNVGDEHEDFEDDA

SEQ ID NO: 131223 - protein, 91 aa, Heterodera glycines
  Coding regions on vcDNA: vcDNA=SeqID_57646; Strand=+; Position=1 -180,274-369
MSDFEFAAINAAGNVFPNSVKSGCLFHFGQALFRRIQRLPNLYTIYLQDRNFQLSIRSLEALAFVPDHYVYNYFCALMSKSFGKSAPKKSD

SEQ ID NO: 131224 - protein, 25 aa, Heterodera glycines
  Coding regions on vcDNA: vcDNA=SeqID_57647; Strand=-; Position=1-131
FSSNFWILLNKKSKFNFVLFSIEIN

SEQ ID NO: 131225 - protein, 64 aa, Heterodera glycines
  Coding regions on vcDNA: vcDNA=SeqID_57648; Strand=-; Position=1 -48,92-238
  Homolog annotation: Hit_ID=AAB96704.1; Match level="QueryCoverage =93%, HitCoverage=15%, E-value=2e-26, Identity=91%"; Hit description =Hypothetical protein F33D11.10 [Caenorhabditis elegans] ref|NP _491703.1| initiation factor (45.5 kD) (1G44
ALILGPTRELAVQIQKVILALGDYMNVQCHACIGGTNVGEDIRKLDYGQHIVAGTPGRVFGDRQ

SEQ ID NO: 131226 - protein, 75 aa, Heterodera glycines
  Coding regions on vcDNA: vcDNA=SeqID_57649; Strand=+; Position=1 -64,408-571
MKLISDQRKITEQKSDQPARKCGQMGWKCPNFGTKWPQWAGHCKSTNSTWTSGVIGAEKSGHENGIEGWMNGTME

SEQ ID NO: 131227 - protein, 67 aa, Heterodera glycines
  Coding regions on vcDNA: vcDNA=SeqID_57650; Strand=-; Position=1 -24,606-785
MPLLPGRVAFFRATTSASHILLFRLPPSGQIVPFELVNEQTREKLTLEEGRDYPNWLLKRCPIGQIN

SEQ ID NO: 131228 - protein, 280 aa, Heterodera glycines
  Coding regions on vcDNA: vcDNA=SeqID_57651; Strand=-; Position=1 -134,192-618,672-953
MRICHRIGENGTKQMRIVNSEGNSLPIPQIPLPNNVVGFRRIQINYIDHNVIEFLRRFHRFFSACTTELEIFTANVRISEFVLLNIFPMLRDSIRVMNLNDIAFPRLLQLEPSLLTDCPSLRYFEMENKVPIIFLPDDDSANASDGQAVTEWLLTPRPDGVPKMLKCTMRALGGDKRWSAMEEQLRAAFSNASSPMTFRLYVNFTITRKKRIVHIEPFEWTNEVTGEQLTLEQHERNYFAISRCPIGWEEQNWANVLNELMDDRQNPIDIVIKDGEFDER

SEQ ID NO: 131229 - protein, 16 aa, Heterodera glycines
  Coding regions on vcDNA: vcDNA=SeqID_57652; Strand=-; Position=1-49
EAIPEGFGLPINLGAS

SEQ ID NO: 131230 - protein, 240 aa, Heterodera glycines
  Coding regions on vcDNA: vcDNA=SeqID_57653; Strand=+; Position=1-721
  Homolog annotation: Hit_ID=ZP_00225060.1; Match level="QueryCoverage =63%, HitCoverage=92%, E-value=2e-16, Identity=40%"; Hit description =COG3236: Uncharacterized protein conserved in bacteria [Burkholderia cepacia R1808]
MENHIIPGIPFLLDGQIAIKFFTLRYFTSNHHPAPFEMDFDDWGVRHMHSSEQGYFALRAVEFGDRQQFEYVLNLASARDVKNRGKRVRGYNYGHWQTVKREHMLRVVLEKFRQNEPLCEALLRTGFVRLVEASTDRYWAAGLLITDEAIRSSNNWMGRNELGWVLMHVRDQLRPLPQQVHLIHKHYIVCQAAAPDYVVALAAEPHVQPYAVRINNETVNAARQLQIGDTLVIESVEWRE

SEQ ID NO: 131231 - protein, 118 aa, Heterodera glycines
  Coding regions on vcDNA: vcDNA=SeqID_57654; Strand=-; Position=1 -116,217-355,414-515
MEIFDEFIVVDEKAINGFSGQNYSRYNWSFRDVTQFAALDFMTSCYPILKIKDIGNASSSKPNSVPLAQIIRWDWDKNGAQRVISTNTLNKGSELSFHICANDYASFVIRILKKQEKK

SEQ ID NO: 131232 - protein, 58 aa, Heterodera glycines
  Coding regions on vcDNA: vcDNA=SeqID_57655; Strand=+; Position=1-321
FGPRGRLGPNPKIEKCAFLKIKILKTKPEGSLATWHKLGLINIRSFFTILLIPTPIIF

SEQ ID NO: 131233 - protein, 63 aa, Heterodera glycines
  Coding regions on vcDNA: vcDNA=SeqID_57656; Strand=-; Position=1 -176,331-348
PALELTPFFSINHIFIIHFLSRSHELYYFLYLYRVNLIKDLNNINFLRFYTASETFKSILHAN

SEQ ID NO: 131234 - protein, 87 aa, Heterodera glycines
  Coding regions on vcDNA: vcDNA=SeqID_57657; Strand=+; Position=1 -59,148-352
MFLAGEVFACSAFGGSTVVHTYMDYHLANLGQLSPAVTSAAGNNIAAGGVDFFQPQLAQFNSSAAIGLMAQQHPPKDIKREQQPSNT
